United States Patent 7,468,248 (METHODS AND SYSTEMS FOR INFERRING BOVINE TRAITS) - sequence listing, part 18

SEQ ID NO: 54556 - DNA, 1907 bp, Bovine  19866882064660
ctgtttcttgtctcctttgagtttcctcctcccgagcatgtgcctggggaggtagcagctacaccagcggacaaacatttctttgcagagggctctcataattgaggacttcttctcagacctctcctcttcaaggtagaaaggatctttctcttttctcctcaccttcccccttgagcagctctgcgaataattaatgattgcattggtaaatttcagatagacccataccaagcaaataaaaaggatttgggttctcgcaggcagttggcctgttcaagtgagagtcttccagagcacattccagaccagcttgaggccactgtggctcttctaaacgaccttgggaccatgatgctgagagctgaggtccatcaactgccgcttgtttgagaaccagctcgctgagcaggcagctttcccaggatgcccctactctatgattggctggagcaaagcaggagacaaaagcaccgcttaaagcacatgttagtgtaacccgtgaaccgctgcccctgtaaggacagcccgccttgggatggctttcctcactttgagaaggaccagtaaagcccctggcaggatggtctagttggacctgcagccctggggccccggtggtacctgagagctttgccccacagcccttagagcaacctcatctggcctctcagtgcttccggagggcaaggtccctccatctagagggagatgagggtacagatgacacatgagcatgtgatgaccagctcccacagtagatagcaccatgtattaccagccagtccaagcaggtggttctcctgcaggaggcgggcaaggcaggccccagtgcaatggccgttgtttcctgtggctgcttccttcctgtcttctctcatcccttggccatggggctgtgcttttataaacaaggaaactaaagctgagaatcccccggcagtccagtggttaggacttggtgctttcactgctgcgggcccaggttcgattcctagttagggaactaagatccctcaagttgtgtagctccccaccccccagaaaaaagttattaaaaaagaaaagaaactaaagcccatagagtttaagtgacttacacaagtcacctggcaaataaaccaggattagaaccagcatcctgactcctggttcagggctctttccaccatcccggtggtgtgcaacccaggctgcaagtcagcatcacctggggaacttttagaaataacagtgtctggaatgttctccaagatattctattttggtggttctgggcaatgggagctcaaacatggttaaaagctcccagggtgatttcagctaccactgccatctgcccttctttgtctcaatcacctacattgtctgcttgtggctgaaggtcacagacagcacgagggtgctgtccccacacccacatgctgtgtccccatactgaacctttctctgccccagctccttgcagagggggggaatagatgaattcactaagcaaacattatttttaagtacttgctaaagtatttgactcgcatagatctgaccaggattgctatgagattaataatttgatgttaagaaggttctttgagtttcctgggtaaaaggtgcaatgtgagtttaagtagtattattacattatacatttttgattaaaaaattcaacttgacttatgagctaaagctggcagtaaagatgacagataactcctttattcagtgaaactgtagggtgcaggcatttttcaaaagcaagatagtcatacttcttttttacagttactcctatattaaggtaagttgtctcccagctccagaagcttcccccaaacagatggatgctttcaaaatgttttatttaggatccttttcttctcacgtacattttctatcatccaaaattt

SEQ ID NO: 54557 - DNA, 1484 bp, Bovine  19866880462655
atcatggcatccagtcccatcacttcatgggaatagatggagaaacagtggaaccagtgtcagactttattttggggggctccaaaatcactgcagatggtgactgcagccatgaaattaaaagacgcttactccttggaaggaaagttatgaccaaccctagatagcatattcaaaaacagagacattactttgccaacaaagtccatctagtcaaggctatggtttttcctgtggtcatgtatggatgtgagagttggattgtgaagaaggctgagtgtcaaagaaacgatgcttttgaactgtggtgttggagaagactcttgagagtcccttggactgcaaggagatccaaccagtccattttgaagaagatcagccctgggatttcttcggagggaatgatgctgaagctgaaactccagtactttggccacctcatgcgaaaagttgactcattggaaaagactctgatgctgggagggattgtgggcaggtggagaaggggacgacagaggatgagatggctgagtggcatcactgacttgatggacgtgagtctgagtgaactccgggagttggtgatggacagaggcctggcttgctgcgattcatagggtcgcaaagagtcggatacgactgagtgactgaactgaactgaactgagataagcattcagaagtcaatgacattgttattattggtatttattggttatttattggttttttataattatttgagtgcatcaatcattcactcaagaccataatgaaaaagagattgtattacagttaccaaaaaactgaatagtttataaatttttttcattaattaaaacaatgtcttcttcataccagaaactttcccataagtgtaataggaaaaaaaaaaaaggcaacattattattgaagaatgtgatacaatcaaatacatttatataataataactgacactacccactgcaaaaacattatcaaaataaacaataacttatcctttagtgagaggacctgagggcatcagttgtcacctagattctatcttaacttaacctaaaattgggtgcatatctgtgttagctaattggatttactcagagaaaaagctaaccttctcatgtcagtgtaataggaggtagttttaccaattgaggcaaggaacccacccttagttggaatccttcactcccacaggacccaggagatgaggtgcagtctcccttgatgtttacatttcaaagagatggctcccaggttcttgataaagatagtcccagtttaaaaaggttgacaaagtgcctatctagtcttcaaaaggatgtatatgcatttcaaagaaagggaaaaagtacttataatcacaacctttgctaagataagtgctctgagaaaaaaaagagagggagaaatcccttcctttattttaataagggaggactaagcctcttccttaattttaatttggatttgtccttacatt

SEQ ID NO: 54558 - DNA, 947 bp, Bovine  19866880827636
attttcccatccttgctttcatgagattttataagataacttgaggtactgtgggatacagttataattcccatgcactggtgaaaaatcaaacaaataaacaaaaaaagagtctctaaattcagcatagacaagaaagaagtgtttaaaccatccccaccaggtgagaaaaaggcatgttttggctagtcagagagaaatagttacagcattaccattctaagtgacctagaacaatgggcatttgggcattaaaatgagttatacatgtcttcttctttaagttacatgttaggttttctttatgttatcatttttcaacaacactttgataattattatagttaatactctcctcactgaaatggccactgcccgtgctgcacttccaagtgggagagccctgcactggcagatcatttcactcacagcaaacagcatggggacacctctccaccactgcactggagtccaaggccccatttaaatgcttttctttttttttttaaagaggctttattctccctgttgtaaataagagtcttctcattcttctcttttattagaatatttactttagaaaacttgaagttctttcactttctctttaaaaagtaaaactaaataagcctcttgccagctttataacttagggatgcttttcttaagggtctgggagatatctctttgaaaagtaaacatcaattgaaatagtactcctattttgcagtttttgtggaacagtaagagcctaacttcagtgggtacctggctctaagttgaaaaaatacctcttgtccaaaagatatgagaaatttgcttttcctttgtataaaccaattaaataacatgggatggtcactccaattaccaggtaaatatacgctaagcatgtgtgtaataaaatggtgttattgtgttctcttatttgaggactgctgctgcta

SEQ ID NO: 54559 - DNA, 1534 bp, Bovine  19866881037610
tccatgtggtcagggccacagttaaggtgatatagcctggaaagagtatccagcaatgggcagcagtgattaagactagagtggcagatgatcatttggttcatgttgctgatctgacttccttttcttaagaatcacagccagtgaaccttaaaactgcaaaataattgtagaattatttatgtgtcgattgtgttggaatctcatgctctctttgctcctactgcttttacttaggaatttacttgtctttccaagatattctttttttttttcctcttctttaaagtcctggtgtcactaatatatattttctttcataaattaagcaaaaccaaattaaatatttctggaaaaaatctaaagtgctttatgtagatagaacctcagatgaaacagttgtgaacctaaagcacataaattcttctatttgcccaattgaaaacaatggattccagaacatgtgatagaatggaatgatagataatgcagctgggagtaaggtcggctaatgtagccttacactaaccagctctctgaccttgaacaaatcactaaaattaataaaaatatagtacagcacattgtgcatgataggctctcatgaatatttaatattcagtggtgagaacttaacttctctgatcccagatgcccttctaaattaggcagcttatagtacatggatagaaaagtgtgataactgcatttgacctacttgccttggaaaatatgcctgcttgctctcagtggtgttaactaatgttctggatgaacaactacctggcttaattcaatattatttaatgttttaaagttttgaaaatatttttatctctctcatagctaggtattccttgcagtgagaatccttatttgcttgaagaagaagcacaagggcagagattattggattctccaaagtgacagtcaatcctcacaccatgagggctagtatttagagatttcatgtctggaactgcattctgtcttgcaccattactaacacaatttgtgcctgcttccttgcacaacttagagggtgatattatttgatgaaaaataaagacaaaaaatgttgccaagcaggattagcctataggtctggaggccatggacacctggaagttgaaattcaggtttgccacagtgcccctcacctcactgttgcttggctgcacttcttgtcacttaccataatgcttactgacccactgagcagtgaatgggttggggatagaaagaaattggcttgatccccagaagtatcatacatggtgtggtatgacccaattatatcacaagtagtaagtctcacagatggaaataacctggagcctggccaggataggggaggaaccacatggttggtaaatactgggatgttctcactgcagcaagaaatagcctcctagctgtgtaccatcttgggagctggcattattgccaaagctaagaataggcctgcttgcatacataaggaggtgactctctaaggtctattttaaaatttcccactaaatatatggcatcc

SEQ ID NO: 54560 - DNA, 1845 bp, Bovine  19866881078740
tttccttgtttatttgaggtttttcttgtttcctgaagtcagctataatcttccctcttagaactaactgcctttactgtgtcccatcaatttgggattgttgtgtttgcattttcatttgtctcaaagtagtttttaatttcctcttggatttcttcattgactcaaaggttgttttgtaacatgttgtttagactccatgtgtttgtattttttccagtttttttcttgaagttgatttctagtttcataccactgtggtcagaaaagatgtttcacatgatttcagtcttcttaaatttgctgagacttgttttgtggcctaacatgtgattccaaaagatatatgcaccctatgttcattgaagcattatttataatagctaaagtatggaagcaaactagaggtctactgacaggtgaatgaataaagaagaatgaagaaagaagatgtgatatatatatatatatatataatggaatgttactcagccataaaaagaatgaaatcttaccacttgtgacaacatggatggacctagagagttgcaatagtcgaaataagtcagagagagaaagacaagtgccatataatctcacttatatgtgaagttaaagaaaacaaaacaaacaatacagaaacagatgtagataaagaaataccaaggtctaccttgaattaagttttgtgcatgatatatggtaagagaaaagattcatttattcacatgtgtgtatctaattgattcagcaccacttattggaaaggtcatgctttatccacatttccttctccaatgcatgaaagtgaaaagtgaaagtgaagtcgctcagtcgtgtctgactcttcgtgaccccatggtactgcagcccaccaggctagaggcaaatcctctaggggtatatcaggaagctctttttagcagcagttgagaaccaagttcttgaggctggtgggtgggacaactaactgcctggagcagcaaaggtgacaaggaacagggctagcggtgtggcagggaggtgagagagggacctggaaagaaaacctgtaggacttgaaggataaaattcatctcttaaaaatatttttaaagagctggtttgtaagatgctacattgcctaacaagttcttgggaaatctatatattagtgtattgaatcttgtcagctcctctgaagcatgattggcccattaagcctcacaagatcaccccagtggaagtccatcacgatgtttgggcacttagagagtacaacggcccagcttgccttaactgtgatttctattcatactgggccttaaaggattatttggaggtgttggtataacttacatttttatagaaatatgagcaaacagaatttaagaaactccacatgtaccttacaccttgttgcgaatccccagaacttcataaaactcctcactaactaaacattagattttttatgttatcaagagagaggaataagttgctatgaataggttaatcgtggtggaattttgtagtgctctacatttgccacaaggtctgactttgtattctagttttgtcagttgcagtccttaaatattttatttagtaagaactaaataagacaaggtctgcctcagctttcaccctcgattgtggtggtggtggtggtgggtggtttaggtgctaagtcgtgtctgactcttgtgaccccatggactgtagcctgccagggtcctctgttcatgggattcttccggaaagaatactggagtaggttgccatttccttctccacaccctccatgttggggctacttaatgcccacagatttcaggcttgaccttcctctattgtctgaaaaaa

SEQ ID NO: 54561 - DNA, 1413 bp, Bovine  19866881570606
aaaagaccctgatgcttggagggattggggacagggggagaaggggatgacggaggatgagatggctggatggcatcaccaactcgatggacatgagtttgagtgaactctgggagttggtgatggacagggaggcctggcatgctgtgattcatggggttgcaaagatttgggcacgactgaatgactgatctgaactggagacctctctgaaatatttcctaaggttgctggtccacagtagttcctcttcccccactgtttctcaaccacctatttcacacaggttatatattcctttgtagctttctattatttattttattaaaatttttttcctcaactaagctcacaccttttcattcaatgaaaactcctttcttatacctcttcatatccttagcacctaatgtacacatgataagagcttaagagctatctgtcttttgagttgaagttatgatgatgatgataatgatgaaaaaggtactgtcaaatgtgtttctaattaatttagtctttgcactctgctctctctgattattagccttgatcagatatcttaaaggacttttaaattctgtcaataatatctgtgtcccctcatagaaaattacattcagatctagagcttctcagatatagaatgatgttaacaaattgctgcaaattcaggggatagttgctggattgaattagggaatgcaggacttgatttatgaggaaacttttaaagaactaaatatgcatagctggtttccaaagagatttagaaccgggctgggggatctgacaactatatatcagtagctcgtggctgaaaataacattgcaagaagagcagcttaaattagggaaaacagcctttggagacagtcaccagggatgttaattactagtgaattaaacataccaatacatgaatccattgctttctcagtgctttgtatgcacagaaatcacctaggaaaagtgttacaatgcagattctgatacactgggtctgaagcaagccaggattctacatttctagcaagtttccaagtggtccagagactaaacatacttagccaacccccttctctttatgaattgtgcaattctgcttaattacaaagagtaataagcttcaaatatgggatatttaaatgaaataaagtatcctggagcctacagtgaggaaataggaaaaagctaatcaagcagggcatgaagatgagttctttcctccaaatgttcatctgccttttttggcatccatatagggcctgcacactgtgattagccacactgtgattagcctcattggttctctcatcttcttattcatcttttcactttgtaccagatgacattacaggaagaaagcagagatacctacaaatgatgatgggaggctgttgtgaagctcct

SEQ ID NO: 54562 - DNA, 968 bp, Bovine  19866880422159
ctttctggtgacaggaaatcttgggatggaatctgtgtgtattagtccgggaggccagttcggcagtgggtatgttatcccaatggctaccaggcacatggtccaaagctcactgtcagtgcgagatggagtttccttctttgtcaagatggagtcagctcggcctgttcctttcctccctcactagctttgaaggcacatgatgctgccatgtgttctcttaattttctaagaaactacaaggaaatttagaatacacagctcggaatctcaccggccaccccccctcccacccccccaccccgtccattacttctaatcaggctcctgcctattactccctctttgtccatttgcaaagaatgtttttcaattaagcggctttactctgtgaatgaaaagagaagcccttagtttggctgcaattgcgttacttcccagcttttctatttctctgaaaaacgatgggtccaatttctgattggttgtttgttgtccaattttcctttgagagcaacagcgagtcgaggctgtgtttaaacacaatgaagaaagtggaagattgacacagttttcccaatcgtttgagttaaaaggaaagcagtaattgagtggagagtaagcagtgtttcagcagacgtgacacaaatgggttagccttcttggtcaagctcatcctcctgatgattgtttttggtttttttgtttgtttgtttgtttgttttatggattctctctagtgggtttcgtagtcagagattttattgtgcatgacacgtgagtcagcttgatacccattcgctcatgcatagattctggtgaaatctctgccatgttttctctggagtaaaagagaatgtgtcttcatctggacagatccagctctaattccagctccactctttatgaaggatggcacaagggcaggtgtctgtccctcctcttcctgctccgtccaagagagagac

SEQ ID NO: 54563 - DNA, 1874 bp, Bovine  19866880748508
ctagaagtaggttatgctgagacagcacttccttttaacactccaaggtcattcccatatgccactttaatattcactaaaggtatctttctaccctgacagtctctgaggacagagaccgctggtgctggtcagccatgccctgctctactgcccgtggaaggtgaacactcccagcctgtgtcacaagtgtctgagccgagccatctagacaagcccacgcgtcaccaagcacttcccttggatgtggcgtgtcgtgcacatgactgccagcgtgctaagcattcaatcctttaaaacaggagggactgcattgttatccaggaaagaatgatggatgagtgaatgaatgaaaggatgaatacgtgaatgaaacaagagtctggattcacatcctcatcctgctagcttcgtgactgtcacttgactcctgtgaacattggtctgttctctgtatgcgtgcttgttgtagaaatctaaggaaatctttaaaaacaatgcttggcacaggtcctgggatgtgagaaagactccacataaggtagttactatggtgttaaaaggagcctaaccccacagggatatagtgtgactcaaatgagataatatgaagaatatctattattcagtgacaaatgctagtattagaattctagctctgagtagtgatgagcgtatggcaggaagaagatttattttcttggttaaggaggtacaatcttcaatgagtcagcctaagaacatcaagcaagaggatcgtgcagaaaacattcactgcacacatcacaagaagaaaccttgtaggggttttaatgggcttattatttgttccattccaaaaaaaatagataactcatttaaaaggatttggaaattgtatcaactcaggaagaagaaaataaaattactcacctaccagccagagacacactgttagcattgtaatatatttccttttatacttctattttcctctttacagatgttaacaacaaacttctgagaatttattttttaacccagcggtgaagatggaggatacaagatttagcattttatattttgttcacttttcttttttccatctttgcttaggtttgtgaatacaattgtgatggctggcaaaatatctcaaaagtatatgcctacttttctttttttagtcaattaatttattttaattagaggataattataatattgtgatggttttgctgtccatcagtgtgaatcggccataggtatacacgtgtcccctccatcctgaacccccttccctatgcccacttttcttaatccccactgttagatggtttccactttttattgcctcagtaaagattgaaggcaggaggggaaggggacaacagaggatgagatggttggaaggcatcaccgaagcgatggacctgagtctgagcacgctccgggagttggtaatggacagggaggcctggtgtgctgcagtccaaggggtcgcaaagagtcggacacaactgagcgactgaactgaactgaatgatgggtgaacagcttcacacataaaattttctttttaaactttagaaaaggctttgcgtctgatcagcattttacggtttgtgcaggtggctcgttttaccgcatcctctgggaaatagtttgtgagcatccgccacgcgccaggagctgttctcaggaccagggcattccacagacaacaagacggaggcagatcctcgggagactgcagacagcagcccaccgggcagcgcatgaacccatgtcgcaggcactcactgcaggtaccattttagctcggagattcagctggcgcaacctgcctgcggcagaatgatactaaaatggatcgttccggatgcaggtccagcgtg

SEQ ID NO: 54564 - DNA, 1232 bp, Bovine  19866880758674
cctggccttcctggctccccgacggggcctgcccgacctggaagcccatcttttccaggaggccctgggggtccgggtctgccttgagagggcttcgtgtgtgcagagggcatctgggccaggaggtaggcgagtttggctgtggagtaagaaaaacagagagatgtttcatgaaggagggataaaggactgaagatgggccagcagcgcactgcaaagctcgaggcagtaagagctggggaatagcagcgagagagacacaccaagagcgcgctgcagggcgcgtgtccgtgtggacgctgctccggagccaggcagctgggctgtggtcccagtgccaccactgctggtggcatggccctgggcaagccacctgacctctcttagcctttgctgccttttctgcaaaacgggggcaatgaaataagtccaaccccactgggctggtggaagatggaaccaatgagacgaggcatcatgacagcccccggcacgagatccaagtggtgcgtggatgtcgctgttcccctcgaggcggcaatgacagcagcagcagaaactgttgcaactctcaggctggggaaactgaggccagtgggggagggtgagacttcagtggcttacacagagcaacttagggacttctcctaagtgtggaattcctcatctataaatgaagggctggacgcgatgtcattaatgattcttaggtgtgtgaaatgttaaagatcacaggctgattccaaacccagaggtccagccgctggcctccatgccttcctactgcacggggcatacacagcccaccccagggccaccaggggctcttcctgtgttttccagacgatcaggccatgcccttcacctggcaatggggagtgaccagcccagagaggcagtcctgatgccctcctgggtctcagtggtaaaaccaaagcagaatcaggtctctgacagcctggcgggggagcttccgagtagccccttccccaccctcccacatgaggaagcgggaggggcgtgcgccggagaccggggcacacagctgttcggctcacagccaggacactctcatcttgaacgtggagcagatgcttctgatgcttcctcctcccaagattgtttaaaagaaaggattcagctcagcagatgctccatctgaactcattcaaaacaggactcgtctctgcccaagggctggaaactcctcgtgtgcccgataaatctaacat

SEQ ID NO: 54565 - DNA, 1368 bp, Bovine  19866880762225
tttttgtgcaaggtgtaagataagggtttggttttattcatttgcatgtgagtatccagttttcccaacaccatttatcaaagaggttatcctttcctcattgtgtattcacgacacccttgtcaaagattagtcgactgtatctgtgtgggtttatttttgccctttctatgtgtctgttttttaccatgaccatgctgttttaatgactatggctttgtgatgtaatttgaaaccagcaaatgtgatgcttccagcttcattcagcagtgagaggattttacaatgggaaatgacagacacagatgtgtattttggattctggctgcagtagagagagtgcatgtgaggggagcaagtcaggacgtgtagagatgtgattggaggtcatcgcaggaggtagtgatggtcctgaccatggttaaggtcacagagataaagaaaggagaataaacttcagaaatattaaggcagttgaacactgggaagtatggatgactcaatatacagtatctgaaagtgcagaattatcaaggatgactcctaattttctaatggattggccttgatgttgttcactggcctggggacacaggggaaggaagagattttcagggggaaatgatgacttctattttggataagtagatttttagatctctgtggaaacccatgtatgttttatgcaatttgagttatcagtcaagctcggaaaggagttcttgacttgaatctgagcttagaagatcatcagcacatagatgttaattgagagcatggggggagcagtgatcaccccagggagtatatagaatgaggaaataaaagtgttcttttagactcacaaggtcgataacaccgcctattcaacccattcaaaaaaagaagaaaaaatacaaaacacacattctagaatttcctcttcccttaagggctttttactctgtctccatactgccggctaggaagtcagccttgatgtttccagggctctttcccctcatccagtcttttctttatagaggtctccctgcaccaccctagtcaaatagcccctcagagcttgcttcatttttctccacatcactcatcactgtataactgttttaatattattacatatgtatttgcttgtttaattgattatctccattgaagatggtaagctccgtggtgcagggagtttgtcatgtttatagctgcaccaagttcctagaagagatttcctggcactcagtgagcatagagcccatattcattaaagtgcatgtagaggaattaataccaggaatctccagtaatagaataacactcttccaattaacacaaatacccacagtcctatttaagtgccgttccgagctcctg

SEQ ID NO: 54566 - DNA, 1207 bp, Bovine  19866880952068
atgtggcagaaaccccatggagtcagggaaagtggggaagccaggaaattgtctctgtaacaggctagactggataaacctggactcaatcagaaggaagcagccaccacaagtctaatagtggtcccaggcttccaacattctggaggaagcctgccatcttccctctgcaccgtgggctctctggcactccttgtccactgcgatgtgcagaagtgtgcagagcagcacgccagtctccagtccttacctaagaatccctcgtcccttcagcatctgcctttgcatttccattttccttcccagcttcctgtcccttgcaccctggggtgaacccagcctccactccacttgggctctgggcctgccatggtcataacacgccacttcccaactcactgtgggtttgagtgtgaactcagggacctgcagactccttcacaccttcagaggctttgtaattactcctgatttctgaactcccctcctgaagttagagacttccaactcataaagacgaatgaggcttaaaatgctagttcacctgggggagctgaaggaattgctttaggttcatactagatgtgaatgacagcggcagctattacccacctggagtaaaggacaacccgcccccttcgtcttccacagtacccataggacctgctggtggtgatggaagggggaggaggggccagcaggagagagagagggccaggaaggcggggaccagaaagtctgatgttagttaggacagctcagaagagtctgcctgtggttcccaagcgtggggcgtagaccaggctctttgtgtcctgtgtagacatgtcacctgttacagtcacattttgaaggctgctcgctgcagaagcatggaatatgcagtgtgcacttgtgtgtatgtatttatttatttttactttgacagggcccctcttcagtactgtctccaggggacgtaaatctcttggtgaaggtaaaaacaaaaatgtgcatgccttttgagagttgtgacggggaggctggcgatgtcaatgatatggtcttttttttttggtctgagcagagtataaacaactataacaacatttgttgagaacatgccgtgccagcagtgcgctaaaatccactgtccagcacagaagccactggccacatgtgtgaatttaaacttgtttaacttaataaaaaaaaaaaagattccggt

SEQ ID NO: 54567 - DNA, 1219 bp, Bovine  19866880996870
ctttcatagggtggctatgagaactgaagaaggatctccgaagcagtcggaacaagcttgggctcctactgactgtgtgtgagtgtgggtacaacgtgtgcttgggggcagggctcagcttcaacctcgggaagggaactcaccaccacggagcaagtcccctctcagcgagccgcccatgagtggctgctgtgctcctgtggcttgagcatgcttttgttttgtttcaaccccaaatgaaaatacatgtgtctcccggatgaagatgagtcatgtctcgatacagctcatacgtcgtcaagaggggacaagggtgaaggacagacacagttggtccatgggctctgagaacaaggggtttggtagctgcacctcagatgaacacatcatgctgctttgatggtcaaatcagagagaggcaggccctcactcggctgcctgctctgctgcactgtcccagcttcacagggatgagaaccacaatgcacctgatgtgggcaaagacaggctgcagcgctccattcaaggtcaaaccaaggacgaccataaaaactctattatacatcaggcagcatcttagatgctttacagacatcactctgtacgatgcctccaccaaccattgacaggaggtgctctgtgtcccgactaagaacatcaggactcggaaagccaatgtggccctgagcccacaccaagaaaggaccagacacaaggtctgagcccagtcgtgccaactctgagccggtttcctccactgcatcacaaacacgctgctaacacaatacgtgcattaggacagcagtgctggccgccacctccccggctgggctgagggtccctgaggcagcagctaggcctccagcccaccagggtgctgggggcttggccattagtgagaagtgaggctgcagtccccccgggggcctcccggtcccccaggggtctcccagtccctgcaggtgccctgggcctggatacactggactctccattttcagagcccaagacaggacccatggagaaaacacagcaggtgctgccctgcccatgaggaggagacagaagcccacactgggacatggcgtgcagctcgcacctgcgggatgccgtactggtcgatgacctgccagatataccagtcttctctccgggatggtttcctgagccggaaggtggtacaaaggcgtactcatcgggcaaaccttcgggaacacgt

SEQ ID NO: 54568 - DNA, 1255 bp, Bovine  19866881185309
aatgagctatatcggttatggtgcaaagtatagcacctcaggcgttcatgcagtgcagcaaagttatcaaagcaagccaaccccccccgaaagaaacgcttccccgccctcctccttcacctccttccacaggaaaacgcaagctgcaacgttcggtctagagagcactgctgttgaaaactactgagagtaatgcaaacacggtttgtttttcaggacagacatttttgccgagtacgtcatccagaccttgagtgcagcgctcatctcctcgcccctcgggtctctgccccccgagcctcacctgtcgctgagggtctgtgggtcagggatttgcccaccgctcaacctgaacctcagagcctggggtggggcctggcgtggagcgggtttaccgtgaagagatggatggaagacttagaaggaaaggcaggggcacgtggagagaggacaggagaaggaaaggggggaaggggtggcggaagcaaagcacaagcagaggagtcggtttaaacgcagaaaggctgctgtagctctggctgggcggtgataggggacagtgttcagacccgcaggaagagcaccacatcgtcacagggaccatttttacaaggcgtttggagaagtgatccagcagggatggataggctctcacaggggagagtcatatggcagaagcagagggcgggcaggaggaaagaacacagcattgtgcattggcagagaatgactaccatttcagtgagcgagaagcactaaaggtaagtgagcacaaaattttaaaatatatattaaagaaaaaaaaaaggaaaaaggtaggctcctcagatgattgggaaaggggagtgtgacaatgaaccaaggtggaaactatgaaatcctgattaaaaaaaaaaaaaaatcccaccgaagacaatgaagagacaagaaaagatttccaaaatggtggagtgaaaattacttaggaaaacatagtgctgcttcttcagggtgagcagtttattataaactgaattcttacctggtcacctttctgtccaacctcaccgtctgcaccatgttctcctttatttcccttaggagaaaaaaaaaagaaaattacagaaaatcttgccagagctcctttgcaaaagaaaactttcgtgttgcattcattcactcattcttcatcagtttcttatcaggtttgtgctgggggcccaagtagctacatgaccttgagcaggtcatttaaagcccaagttgtggggcattt

SEQ ID NO: 54569 - DNA, 1273 bp, Bovine  19866881259238
cacgaattaggagtttacccttgactgttctttctttttctctgtgcacaagagcccttttgtttggagagcttctgccaattctccctaacacacacacacacacacacacacacacgcgccagggacacacacatagtaagcactcaataactgtttataagcctcttgactggcctgtgaacaatataaatatctgtgaaagacagagctcatccaggaaaaccaagcctagcttcccagagctctactttctgtgaagatccacctaagccaggcggtgctcaaaagtgaggaggtgagttcactttcccctaaaatgtgtcacccagaggtgacacttcttgtccatcagccacattcatcacccagctcctgagaaaggaaatgcaattggtcatgacttctgaagggaaaaacactgcgttcactagaaagactggcctccttagactttccaggtcccagcgctgtgtcagctgggttaaaaggccatttttctttctttttgctgaaggctgggaaaatagatgtgaagatgtctctgggaccaacatttggctcagagcctgggctggtaaacagatgggtcccttgcaagtgtgtggctatcactcagggaagaagggtggtgtgagtaccatagggctcccgtgtgctcgctcctgattttatagttatttctcttctgtctggagctggaggtgggaattcagaggaagcagccaaggctctgaaagtgtccgtgatgtgctcgggttgcagagctggtaaatgagaatttccttatctttaatgggaattcgatcatattatttaatagcttttctcaagaagtggactgtagtctattagtccaggtgataacctacaaaataggattatcacaatcaaggaaggtagagagataccctgtgctagatttgcttggattgtcacagaggaaattgtcttattaaaggctctgagatcagtcctgggtgttctttggaaggaatgatgctaaagctgaaactccagtactttggccacctcatgcgaagagttgacttattggaaaagaccctgatgctgggagtgtttaggggcaggaggagaaggggacgacagaggatgagatggttggatggcatcactgacttgatggacatgagtctgaatgaactccgggagatggtgatgaacagggaggcctggcgtgttgcgattcatggggttgcaaagagttgggtacgactgagcgactgaactaactagaagtcctgcagtctga

SEQ ID NO: 54570 - DNA, 901 bp, Bovine  19866881310644
cagccagagtttaagccattgcattggcccaagtttctcctcaaaggtcaattctcctggccgagaaatggggctgagctagagggaaagtggattactggaacacagccatgtttcactgtcccaatttttccctcatccatcaaatggaaaataactgccttccacgcctcccttgtatgatggtttttgagggatttattgtgttagttcccttggcaggaatgacaaaatggtggtcagattctagtgtcttcccctagaagggaccaggaagtttatctacctgaaccacctcattaaacagaggaagaaactgaagtcaaacatattataaaattgtctcaatattatcaagcaaatagggcagaaccagggcaagtgctaaggtctgactctgcacgctttcttcctctgtcactcaacatgtacaaacaaaaaggaaatgatccttttgttcagaattaagttctgaaattaagttcactggagaaggctcactgggatgctgttgtaagagcatcactgaacctggaattagcaagggtgagaacaactcattgctgtggacctaatgtgtgcccagtgctctactacaggtcctatacagagcctgtattccccacaagactgtagtctctacaaatacaagaccttcatccaccctttctgacctttgtattattagccgtcacccagaaagcttggcatgaagtagacattcaatgaacatgttgagtcaatgaatgatctcacttaaatctaagaagccagggacttccctggtggtccagtggctaatacttcaccttccagttcaggggatatggattctatctctggtatgggagctaagatgctacatgcctcacagtcaaaagataaaacataaacagaagcg

SEQ ID NO: 54571 - DNA, 1534 bp, Bovine  19866881627968
tttatttctctgcctttagttcctttgtaaaatggagaaaaagagaaagatagcactcatttaatttgagtaaggtataaatacaaagagttaacctgctccaggtacatattaagagactcctagagggctttccgttatcgcaggtctgatgacaacagtcttcttctgtgcctgtctggtggccaacccaagccaggagcactgcagggagtgactaaacacgggatacaagcaagcaagctcacaggactttatttatgcctttcagccgtctttattcagtcgtttcatacatttattgggtgcctacattggcccaggtgcgggcaaagtttcaggaatacagaagcggccacatcatgattcattcatgaaccgggagctttttatggcagcagttgcctctccaatgtcccttctcccttcaggccaacgccttttcccatgatctatactattgctatcttgatcagtttttctttttgctgatcgtcggatgtcaccaaatccagtaacacaggcacacacagtgtaaagaaatttcctacatgaaattatacattttgaaacaaccagattttcatgaaactaaatgatagcaacccaatcaattccctacaaggttgttcacaaatgtggccacccgcagtgcacaccaatggcaaggccagaagaggaaggcattccaaataattacttactggtggtccagggtcccctggggggcccatgaaaccgggaactccgggatgaccctaggaaaacacaagacaattattttaaatgattccccaaaggctttttactttgtgcaactatagatttcagataactagccagaagccatctcctaactcaggtaacaattctggatatacatgtgtgtttgtgtgtgtatacataaatctacatatttatatttatatcaaaaggtggccgagggagtgtctagcaatctaccctggaactggatttgcttcaaaataatatgaggaagaagtatacagatgaaaacaagagtggctatagagctggaagatgctgtgaccaggtgagaagtccaaggggtgctttttattatactctcttattttcttaatgaggtttccccaatggctcagtgagaaaagaatccacctgaaaaagaatctgcctgcaatacaggagacacaggagatgcgggtttaatccctgggccagggaagatcccctggaggaagcaatggcaatccactccaaaattctcacctgaaaaaatcccaaggacagaggaacctggcaggctacttgtagtctacagggtcacaaaaagtcagagatgactgagagactaagcacgtttttaaaaaatatgtatttatttccatggctgctctgtgtctcagttatggcacgtgggaccctcagctgcggtgtgtggggtccagctccccaaccagggatggaacccaggtccccacatcgggagcgcagagtcccagccagttggccaccggggaagtctctacactcttattttgatgtgtttgaa

SEQ ID NO: 54572 - DNA, 3334 bp, Bovine  19866880392182
agctatgaagaaggacaggctgatgatcaatgaatgaaatgtcgaagtcaccctcggaggatgaaaaagatcatttagaccctgaaagggaaagtgaaacctctttgtggaaggcaccagatgctgatgacaatgtgaaagatgagggtgatggatgctcggagagtgaattggaagatgataaacaaggcaagttgtttagcttatcatgcggcataggctgtttagcaagtgtcgctactttcccttatatttaatgagataagcctcctttaagactgtttagaacgtggtacccttaccagaaggtgctggtcaccccatcttccatagatacccattatggaatcctttctctttaatttgctgggattttccagcaaggcgtcaggtaaaacttgtagtgacacatctcctgtttacttagaaagttacctcattaaaaaattttttttcagtgttctcttatgtgcacacacatatagaccatctcttttggctttggaaaatgaaaagtggttcctattcaattaaaggaaagttgaaaatttctcccttatttatgctcatttttttttaatttactttgaacacaagatgctggtatatcagtttatggaaagattgataaaatttcccctgtacaatattcaagcctaaaatgattctgaatttcatagggaaaatacataatatttcaggtagataaaaaaaccctcattatatgtggcatatcttgaatttttaagatttttaaaaacatgtcaagttactaagataatatccaaagaaggaatccatttctggctttgtcccttgaaaatgtttggccaaggctatgtaggtcttagtaaataaatgatatatcttccctggtacattctgggcattttatcagtgataataatagcctcttatatttaagtgtgtgtatgtctatgcagtttgctttaaactagagaaatgaggtcacattatgatgagtttttgaattgctgtccattttctccatttttcacttctcaaattttttcctgtataaaaatatcaaaagtttgaattcaagggatatatttgaattatacaaaataagagtaaattaagtaatgaagtaatcacaagaacaaatagtttgtcactttgtcctcttcaagaaagaatttaagaaaacctatcctaaaatttcatgcagacatacacagggcaataaaataaagaacagaaattatttagagtaagagagaagataatttttgctaggagctgcataggggatcatgactacccttgagttaaaataatcctgaacttcctgatagtcaaagcaaagagtgaagcgatgtgaaaagcacaatgtgacaacacattgtaaaaaacacaatgtgaaaaactagaatgactttaactttcaatacatttgaaaagatttgctgccatttcaattacagttgaaagagctactgtatattaatagtcaggcactgaaaatttttagtaaagtcttaaattaagccttttaaatttctcagtacttaacattttatatttctaggcatgcctaatatatgtttcttttctcatcttgaatgtaaatgttgaatttaattcatattcctatatgatatagaaaaagttaaaagaattgtatggaaaagtgatgtcacctgaatcctattttaaagaaactatacttgaaccgggaaaacagtttgaaaatgtgtttgtgtataaatataatctagtcaaaacaaagaggaactcaattttttatctcttcaatgatggtagggaattgtcatctattgattttgtcaagagtcagtacattatttcaatatatggtcatctgaggattatttttgtgctgtgttatcaacttccttcctgggatcaaatgaatttcttccaagatcgaataattttttaatgttcaagcagacaaagatatatgcagtacttgaattttacttggagggaaagctttaatcatttagacctgtgattattgaatagctgacaatgatggtaagctttaacactgaatactgcttgcagttaaataactggaatcccatgtttaggaaagaatcctataggtattgtttataagactcgattttgtgccgagctcatattaactatttcacatgaattatctgatttacctcaaacaacttttaaaaaagcaggtactttttgcctccattttacaagtaaagaaacttggaaataatgagattaagtaactcacacagctggaaagtggtggagccaagacgcaaaattcagagcctggattttggagaaaaacaatgtaacgtttctccaaatcagtcaacatctacttgtctaaaattaatgcaaatgcctctaataaaaggattttgtttccttaagaacgtatattttaaagaggcatttatcttgagctcttcatcttattctattttttaacttctgttttgtgattttgttttgcttttaaacagaagaaaataaaatggaaaaattttaattttacctaaatttacctttctcttccattgatccactccctggcctgttgctcatttccagttcattgccctcctcttccatgagactctcctacttccacagccttcactgagctcttgattttatgaaactttatcatgccataattcattttccacttacagttccatgtgtgttaaattttgcctttaaaattaatcacccaaattaataacacacagatttattatactacaaaagctaagacagtgttgtttttgttatttctcacagagggcaatttcctaaaggatattttgtgaatattaagaattacttgattaacaccaagagtcccaaaatacttttggcagtgccatgctatctagttaccatttacactatgtgattattattagaattttattcaaaacattgtgtagagttagctgcataaggtaggtatagaatacataatattttaaatagttatgtaacgaaaactatcagaacatgtagaatctagtccacaatgttgggacatttaaaagccccaagttaaactggttaactatttttctttcagtaatgacattttttaacaatcctttttaagagctcctttgcattcctgagatttacatttaatctttgccattattctgaagtaaaaatctcattgcttattaccatttctttcttccacctacaggctcttttattttccatcccattattttgataacctgacccctgtgtttattcaaaaatattctttttagcatgcagagtatcagaattagagatttcatccagcaaacaagaaatgtgtattaaa

SEQ ID NO: 54573 - DNA, 2203 bp, Bovine  19866880458269
gtgagggctcctcttggcaccttgtcgatttcctaagcagctaacctttcataatattaatgccgccttgtggttatctatttctcagttcatcattttcaacctttgtttgctgggattcatttatgaggttgtgttcttaagatcctggagtttaatagagaccaacctgattcagggcccacaaccagaatttctagctaacaaatgaggaacaaaataggtggatatttatttttctattgattgaatttccaatagctctaccttgaatttgatctagaaaaaagagatgcagaaaatcataaatgttcttgccttgtttaatattttctatctcaaaatcctccttgtcagccttgtgagaaagtaacttttccagtaatattagtcttcttttgagcttgcagcatggacagttctggcaatctgtattgctgtgagttaccaccctattagaaggctataggatggagtaattgagatttcaggccacaaaaccatcctgtgcaggttcaagtaccaactttgttacatcttacccgtgtccttctgcaatttgtttaaataacagttttccagtttgcaggatggcaataataatacctatcttactggttttaatgagaaaacacattagatattattgtcattatttttcttatttattttttctgaaggaatattttcactacttaatattcttgaatgcccaaatttctttacttaattaaatgtttctaaagaccaggctcccttttttattatagtgccacaaattttgttaatgatatctcagatgccttttttcttcttgtcataaagatgtaagagctaactggattgtttgactgtagatctctttatgtatggagaagaaaatggcaacccaatccagtattcttgcctgggaaatccatggacagaggagcttagcaggctacagtacatggagtcacaaaggagttggacatgacttagctactaaataacaactatttatatatataaagacggggccagggaagtctcatcccatattacttccttcattgagacctctctatcccttcatggttcaaacttgcagcagggattcagtctgtcacatgggttgatgcagatgtagaacagaatttggataaaaacatagctaagggttgacagggttatttgattatccgacacccttctcagtgatttttcttcctagggctcattcacacaacttaaacatatgaaaaatgtgtatatcattatcataatttatattgtaactgactgttgtaaactatattttctaaaaaaatgggcagttaggataactgaatatgtgacctttagtctgtggaacatgttattgggaatgggtaattttcacttttcaagaagaacatttgctattttaattaaacataataaaataaaatgatattaaataatgttaaaaaaaaaaaacatacagtttaaacacctgccattcagtcattcaacaatcactgcttgggagcacaatgtcagagacggggaaggcacatcccagagttcatgcaggtaaaaaggtcaagtaggaaaaaccctgattttgcagaggatgtatggggtggggcgtctaggtaggtaggcatcttcccttccttgcacccagtgagctcacccagccacccagctaagacactgtccttctcactctaaggagaaggggagaatgttttcaaagttaacattgagaaggttgcctctgctcttccttcagtagtaaaagaaaaggaaaaaattcatcctatcacaccctcttgattcccagaagaccatcatttttctcctttctatttctgttctcatcgtgtcacccttgttatgtcatttgacttccttctgcctcaggttcctcatttgcaaatgaagataatgatgtctgtgtcgacctgttcacagagatatctttgcagttaataggggtgtcaggacaaaggtacatggagcacttcagagaaatactgtacaagaaaaatcagtataacatttttattaatcatatggtactgggttgccagaacgtctcaaaggaagactcattttgcatccaactgctggatctctactatttgtagagtagtctgaattatcttcctcccaccgaaggtgaaagctgctgtggttaataaatggtatgggagacaacatactccttttctgaaag

SEQ ID NO: 54574 - DNA, 2711 bp, Bovine  19866880543164
agagaagagaaacaaatgttatttcagaaccaagaaaattcagaacaaaatacaatcctatctgctatatggaattgaacatgaaacttgatgttaacaaattaaaaatcagttaaaagaggctgtgcctttagagttccatttctggtgatagcacctcaaacttcattctgataggatctatgctgtttagtgtctccgttttggccaactctttgcaaccctatggactatagccagccagactcagactcctctgtccataggatgtcccaggcaagattatttggatggattgccatttccttctccagggaatcttcctgacccagaggttgaatcagtgtctactgcttggcaggcagattctttaccactgagccaccagggaagcctgagaggagtgctacaaagcatttaaaaaaatctatttgaagacataaaatggttaaaaatcagtgtagaattaaggggataagataaggaggagaaggaaacacagagttgtgacactagaattgaagggtcaatttcctgctttgagaatttccctgttgtattcccaaataaatactcaacagaagtacatgcatatgaccatcaaaagccatgtaaagaatgttcagcacagcatattcttatgctatggaaatagcccagatacccatcaacacaaaaatggaaaaataagtatatttgtagaatagaatactaatgttttaaatggatgaattcataaaaagactggaacaaaggaagccagatattttcagagtgtctataatctaatatcccatgctaagaaccaggcaagattaatttatggtgttacatatcgggagcagggaaggagtgacacttagccattcaagcttggatctgatactccattgtttaagacttcagagtatatcttagaatgggggaaatgagttttccatatggttcacagcagaaacaagtttttcagtaggtttttggagccaaattctgagctaacaattccttactattccttcctttgtcacaattctctgtactaaaacttcctcagggacttctaaaggaagagcagtataatcaccattaaggcaggctgtaggcttactggattgcccactgaaatttcatcttaatactgctccattcctttacttccaagagtcacacaaattactgtcaagagttgatataaaaagtctggtcacttgatccagtgctattttgatttatatacatttggataactatgatggaataaaagttagttattaaaatacaaagaaataaactaaaaatgtgaaggatgcagctactcagattattccattgtgagtttatcatccagggttcaatatataccaatataaattttgtatcatctttatgaatatcatttaggatggcaataatagggatagatccaaaattgcattctttcctcttaaataatgagctcccctcaaaatgcaaatagtaatggatgatccaaagtccaaatgtactagaaaaccattgcttgaagagtttaatattgaaaaataaaataagcaaagttttaaaataattacacagccatcttattgtttgaatttatatggcaaagacagatctgattatatttgacatcttatttcttttgttatctccttctgtgtttagctgttattatctctcttaactccctattgggagaattatatttgagcaattgcctctccagcaacatttatgaaaatgagtgtagtactctgaaaatacctccctccatagctcattaaatgctcttttctaacttgttcacatggagtgtggattatttagctttcccataactgagcagtagaatttaccaaacaatatcaagctatttatatatttttcctttttgttacaaaatgcacacaggtacatacattttcattgatagtgttattaaagattcaatacaacttgtgaattacaaagggctggattatatagttaagtattaaaactgataaaaaagtttttagaaaatctttttcctactgtgaatgcattaaaaaaatctttagctcatcacaaaaaaaatgtacaaagtaccagaattgctatgacctgaaaaaaatcaacaaatatgggcatttagtgtatcctatatatgtgtgcaatggatttgaatatgttatagaaggaaacatatgtttgtctctcacatagctatatctgcatggaagtaaaaaaaccctttgctggttcagaacagctacttaaaaacttacttttagtacaaggctcataatcaaccttgaaaagaaagtgaatcttgaatttaagactttaaaacttttcaatattcccgacatcctatctctaagtgctactgaggtcagctctatcttagattgtaaaaatcacacaaaacttttctgatattttcttatttcctcataagatgagaattgaaatggttcagtactctgctcccaaagacattgctgcaataatcggaatttcttcctattcctctatttctcaccaagaggcgctggtaaactctttttatttctccctttttaaattgacttctctattgcttaacggggcttccctcgtggctcaggggtaaaagaatctgcctgcaatgcaggagacatagttagagccatgggttcaattcctgggttgggaagatccccggaggaggaaatggcaatccactccagtgt

SEQ ID NO: 54575 - DNA, 1329 bp, Bovine  19866880592843
tctgctttcccttatacaattatttaataaacattttatttagcacagactgtgagctatgtaccgggggaggcagacaagtttacaaagcaatgataaaaatgtgataaagtatgtgacaaagagggcagctaaccaagtgttggcgagggaagcccaggcttgaaagctgtgttgcattatccaatggaagaggagaaggcaagaatgctagagactgaagtggtcatgagaatgaagatggtatgtatcagggattcttctacctcctttcacatatagcaccatataatccacacaatgaccctatgactatgatagttactatatcattatgctccattgcacagaagaaaagtgagacataggaagatgaagctacttgctgaaggacgagagctaggaagaggaggcactgggactggaaacctgactctgactcagacctgaggctgctgaccactcagcccacctgcacagatcactgggactgagagatggagccgcaggagttcagttctaccaaattcactttttaaatacatgttgagagcatactctgtgccaggtcccaaatgccaggacttcagagataaataacaaagcatggctcctgtactgaaggggtgtgcagtctgctgtgtcacacatcaaggcttaataaataacaatataaaaatggccatgcagatctggctgtgcagatggccaccgagcctttcttacagaatccatagttgcgtttctgccaacacagaaggcaggagcagtggttggcccagcaggaaatgtcaaaccccgggcggccctaggattcaaagaagcatcacagcacatcacaccagagtaggggaagagcccccacattactggcaagagaagagcttttcaatgagaacaaggcaccctagcagcctaacactattttgttattcagggtctgacagcacaggatacacagaggaggaaaggaaagctttggtgttgtgtgatgaggcaaaaggtcccagaggtttggtgtacattcacttaaaacaaaacaaaacagaaaaaaaaattgcttgtaattttgtaacctccttagggtatttcaaatggtttgtgaagatcaatgttgtgcatgttcaaagagtttagggagttttaaaatctttccattcagactggcctgtcataaagaacaaagggacatggaatttcttgcagggattctgagttcgtaggatgaagcctagagatgtaaaatcaacaaagctggcctttgaactttcctcagtccagaaggggaaaagaatatgtactgctctgtaggcgcttgtgtagttgctc

SEQ ID NO: 54576 - DNA, 1119 bp, Bovine  19866880703822
ttactcagcttcagacaactcaaaatgaagttcggagatttctacgaaatctttaaattttcatttaactttaaattcctactgcacagatgcaataggaaatgttcagaaactggagccactctccctaaattcacattctaggaatgtttcttattatctgtgtgatccttgacatcttacttaacctctccaaaccacaattttgtcatctgttaaaaaaagagacaatgacaagagaacctaactcgtggggatttggagcattgtgaggattaggcaagtttctctgtctaagtacttagcactattacatagaaatcatctatcagtgttagctatatatacaggtgactgcatatttagaaaagaacaaatagcattgctaatattaaataacctctaagaagccacgcatacccttgccttcagacatgtattttatttgatttttgagatagaactgccataggaaggaattacagaaaatagaagacaagttatataagaattatcaagtaattttttaaatgcagtagaaggaaaacagcaagctgaaaatacatgtatggttatgtgacatagagagaaataggaaaaaattgaatccttccggcattatcacaacagtatttcccaagctttggcagaatgcagtgatcaagatcaggttccatgcacagggacaatggcaggtcaactcaaaggccgtacttaccacctttatccaccctacggggacctgcctttttgtccttcaccttagcagtgctttcttcccaaagcttactcttcctcttttccttttcttccttggaaacatgttccctggacttctcaaataagctctctgcaatcattccagttcctttctctgcttcttgttcaagaacattctccaaattttcctctatcagcagaggcttggtctccacatctgtttttattatttcttgttcttcaatttctggagaatcctcagttggaaggtgggtttttcctggcttatcattttcactcaactcttgagaagatggacttctgacactttcatctggactgttttcagcgttggtctcctggtcccccactgcagattcatcttcactagaactagaa

SEQ ID NO: 54577 - DNA, 1878 bp, Bovine  19866880748532
ctttgatttatttgatatctggtgaattaatggcccctaattatgatttgactccctattttgatttacaatagtgataaaaatgggcttgtcatgtcttagtttagttagcttgagactatatctcaggacctgacgattcctggacactagcttgaaatgggaaatctctggacatttaaagtggagatcagatcctagaaagtgtcaaccgaattggcttatgacccaataacttctgcccagctctaagtagtattccctagacaaaatgccaccactttttaatttatccttctttccaagaatgtactattaaattaactaaagtaaggtttgtgaaaagtgcttcaccagctaaaaaacatattagttggattaaaatattatttatcatttgggggttatatttatacttttaatgtgaaagataatttatttcagttaatttcttagtgacaaggtcatctgtcagctttaagtaaaaacatcttaatttcatatgtcttatgtttcctaataataaatggaactaaattcacccatttgagcataattacaattgtactcataacacaggttctttcttaagctggcaaatgtttcttcttggtcttagaaatacaaacaataccttttctaattactaaatgtcccaattgtccttccctgttagagtaacctcatgttttatgacttccctgcatccttcctgtgctctgtttaaaataagtgaaaattacctgagacataaccttgaaaaagaagcatagtcaagcttccgagtgtgattaattcggacttttttaagacagacattcttttccttctatatccaaccttctccagagtcaaacttgaagcaatttcatacactgatggtaaagtaagtcagcatgcaaatgccaacctattcttggaaattttcattttctaggtttcatgcattttaaaatttggaagcagtcaacactgtgtctattctgttagaagtcatatctagccataaaaagatcctctttgtttttatactacctttcaagtttgtgagagatcatcttatattattacaagtctattccttactctttttcccaataacacagaaattataggtcttccaattaaagtaaaatataattaaacagaagtacagagcaagtgtttaataagtacacaatataaatttcattgatcagattaattgaatctagcatcttaaaaactgagaagaaaaagcatttaccccaatgggaaatgaagtttcagtttccagcaatgaggtttttgatctggatcccaaagttatctttggaacagttcgtactgcagaattactgggaagaggttgtaatcgaaatggaggctgcatatttccaggagcagtgtatggtcgaggggctgtctagacaattaggggaaaaaattccatttaaattagtatcttgacatgtttccagaaccaattaataactcaacaaattgcctagagtaattaatggtgcctttttactgaacagattaaactttaattatgtccttccattatacatacccttatgacccaatgtatttgttaaaacatatggtgtggaagtcttctacatacctaaatgccacaattgtagagtattttagataaagatgttctctgttaggttcctgtattttattcatactgtaaactcactgacaatgcctagttgatgctgtacatagaatgaaagttttagtcgctcagtcatgtccaaccctttatgaccccatggactgtagcccaccaggctcctctgccaatggaattctccaggcaagaatactggagtgtgttgccatgcccttctccagggatcttcccaacgcagggatcaaacccag

SEQ ID NO: 54578 - DNA, 999 bp, Bovine  19866880758242
tgtaaaaagaacaagaaaagactttaaaaaataaatatagtcatatagttttcacaaataccatttggggaagaaatgatttggaaaaaatttcataccaatctacttaaaaaattgagaatttttatcaatgtaaaatggtactaagactgataaaatatctgatatgaccttaagcttgactttaatgatgaaaaatggttttaacttagggccaagcatttgattgccaagagagactctcagtatttttctttttgtcttctacaatgataggtcatgttccaacagtggttggagcattaacttctcaagagtaaggacaatatgcacatatagtattgggactgttactgcatcatagtctgtcctgactgatactacaagaatgtggcagaggccagagttgcagtgaagatgaagagttttgttttgaataagccaagttttatatttacatataaaggactggtaaaatcacaattctttaatagaagtggcaccaattgtaaatgtaatgggattcatccctttttttcaagttttagagacatagactaaaccagggttaccagaaaggatcagatctgaagtccatgtaaatataaggggggaagactctgagaaaccgtttgatattgataatgactatctcaggtttacatttcagctgcatgtctcaattgtataatttcactatgcccatgaattcaatcacttgtgtacagacacactacctgctcagaaaatttccaaggaatccttcagtgccttcaggcaataggcttttggaaattgttttcaagttccattctttaatattctcttcacaagtaattttttggttgatccttatctgttttgttggatgacagagcatgaaggaaccttttattgagctcaatggcagtttgatcaaagtaatatctaatttggatgcattggctctgaacattttctaggaagggagaggtgccagacatccctagggctgctcag

SEQ ID NO: 54579 - DNA, 1115 bp, Bovine  19866880761508
acctgtatctcataaaaatatcctaccctcagtgtgtatgacagtcaacatctccagttgttttaatttgcttccatatatgttacaactatatgtttcatgtacatgcacttatgtatttacatgaaagtaagaaaaaccctgactgtgtactagagtgaacttcagatattaacatgcaattttttccaaaagtaaagctctaactaaagttacataaacaggtaatgagagacctaggctcataagcacgggttcctgtttaccaatccagtgttatctctacaaaccactctgaaattagactctacttctctataagcattgcctaccctggatggaaataaagattattttcattgccatgttgcctgagggatttcaagaggaagtcagagtcccttgcatcttccaatttattgtactcaagcttggtaacaattggaaattatgctctggcgcaatgccatttcctgagcagggggatgctgagtcccactctggtgcagtttgcattttagtgtattttgtaaataaattcttaacagatggacagagcagcaggaagccaacaccagggagtcagcaggtggacaggaaagccagaaatggactggcactgatcagattaacaaaactaaaatatcttgggattcacacatgcttcccacagaataagctggcactgaccagataggcaaactcaaatcaaccctgagcatggaaaatttccattactctgttcctatggggtaccaaggtccctcccagatggggatgccaaagctataaatccttcagagtggcagtctgtcttcttttcttcccttggaattgtcatacagcaagaaggtgagatacaaattgcaattattaggaggattaaactgctcttaattgcactagccacaaaactaagcagggaagaagaaagatacaatcattggtaccctataaatcattggtatagtctcccaaaagacttagaagatttcattgctactgtaagaacatccccttctactctctaacccatggcattgttccccataatgtataagtctaatagcttcattttaaggtctgctgccctgctcaaagatgttactcttgca

SEQ ID NO: 54580 - DNA, 2723 bp, Bovine  19866880825118
cagtcctgtggccacagtaccagtaatcttccagcttgtgattcatccagccctgcattttgcatgaggtactctgcatataagttaaataagcagaaagcagagcccaagcctaaacctcaggtagtactgtttctttaggaaatgcaattccatggaagcaagagtgaggaagggaagctgggaggaagagccaattctacagtgcagttgagctgacactgtctgcaatcaagggcacctgatggttagtctcattgaattgtcctctgagacgctaagactggcggtgcctcaggacgtttgtgatgtggtggagaaaggagaacttattccttggcactgatccctattaatcagaagtttactccatacgtccccaagtgttgactgccaaggtgacctgcaaagacttcaagaacttggaccatctctcctttggataacaggagtgtgccatggcagtgatctgaggggtacaaggcaaggtgtggtcaagttgtgcccacagaaagttggccatggtgatggatgacacagtagccaatggcataggtgggaccaaaatttgaggtaacacaaaagaggagcctaatacatgttccttggagacattagtaattaattgtttacatttaacttaactgcactttataattttattcatgttgtgctttttatattattttcatattcattttgttatatagccttgattataggatgctaatttaggatttacttctctcacagacacttaaattctctcaaaccataatcctttaattagcatccaggaagtaaatgattcccccttggtgcttggttgatttctctctcagtcatgttataataagcatggtcagttgctatggaacacttattatgtgcctggcactgtgatgtgtgactttcctgcattattttacttaatcctctctttgaggtaataatcatcgtctccacgttatagatggggaatctgaagatcaaagggacagagtaacctgcctatggaaggtcacacacacagtgagggactgaactagactttcacctatgcttgactcaaaagctcataccctttaccacaatgccaatgcttctcaaagcatcatcctggcaccagcagcatcaagtttccagggaacttcttagaaatgcatgtttcggggtcccactccaagacttctgattctaaagctctgggttggggcccaggaatctgcatttgaatgaactctccaccgattctgacaaacaccacagtttgagaatgctctgtgctattcaggttcctgtaatttcatacctggtacagggtaaacatacatcatccagtgtcccatttatgtttattctgctcatctcaaattatcctcagttctgacactgattcttttccctttgactaatttgagtttaaggaaggcaaaaaaaaaaaaaaaaatttcctctgaaagaagaacctgacactctgcttcactgtggattaatttctgaagtgttgttaagcagaccatggattattatgagtaaaaactgaagggcaaaccaaaattcaaattatttttattgcatttcgtggtcttgctggaatcaccctttcctgattagttgagataaaagaagagatggaagtttgtgaaattagtgagcttcaaaaccttctttaaagatggcgaagataccttttcctgcatatgagtccattgcttaaaagatagatatttgagatggtattctttttatctcactaattaaacataaagttagactgagtgtgctttggagacctgtcctcgtcagcggggcctggcacccgtggcagcgttttaattcaagaggcctaatttaattagcaccctgccactgggtcggctgcttgctgccttggatctcgggcctgaggagaaatgtaaaacccctgctttttttatatctagttagccttctaaaaggtaggatgtccaaggagggagaggaactttgcttctccatcatgttttgcatatggtgctaattgagctgacagtcttggaccactgtcggttacagcagcagctgagccttcaactgatcccctgtgaagggattgcaaatgtcaaatggctcatctttgcccttgtggctcttgaaatatggaagggaattgatcagggggagcttttcagtctgcatgcttgagtaactacaagcaacacaaaactaggaaggaataaagtattcaaatcttactggtaatggccataccatctcgcctcactttccctatccagtgtgctaatgaggagaggaaaatgtgaaactccttggtttccctaattgctgtgctttgccctcataacttttttgttcctgcttatcgtggtgagagtcttgcttctgtcaatcatttctggttctttctgcctagaaaataacaatgtatgttttttgaaccttgagattattccagccctcttttttccataattaaaacagagaaaacgatgataatttttttttctttttttggcttgactttgcaatcataagctatagtaatcaagaaaggtttgcttttttatttttctgggtccatgcaacttctcctgggtaattcccaaattttcctcaggcctgcagaactgcagatttgtttgtttttaccacaattttggattgggaatgttggtatttttattcctttttctccatcacagtggaggcagtactatgta

SEQ ID NO: 54581 - DNA, 551 bp, Bovine  19866880864902
ccaataaacgcagaggactgcagaaccttgacttttcttaaaacaagctccagtctgtcagtagaagtatatttgaaggcttacttctaaagctactggatttgtcccattgccagtgggattgaagaggtggattataagatttgtattgtagttaaacccatttattgagggtaatgtgaaaaaaaactccatacttttcactcactgtttgctcagcaccatgaaaaacaagtggagcagtgagaatgactgaataaatctaaccacacggacacacacacacacacacacacacacacacacacacacacacacacacagacccacacacacactcacacatacatacacacacactattgatgtgacgtttctgcaagctagtgccctagaataacaatgaagtatgatttacatttctatgtatggctaaccatactgcttatcagcttcttaacagggcataatcttatgaggaatctgaagtatgcaaacggaaaatggaacctttttaaatgagaaaggacaatcaatatcacaggcatcaa

SEQ ID NO: 54582 - DNA, 1069 bp, Bovine  19866880886468
tgtttaaagttgcatgtgagaaagctaggaaaaaattttcagacataaaggcagcatatgcaaaagcactaaattaatagagtgcatttcatgctcctaggaaagtgaacagtccttgtaatatgagtttagctctcacaaaggttttcagtcaggaaataataagagataaagttgaattagtacttgtaatactaggagaaattcagtacctcctgaagagaagtaattttgcatgaatcaaattcaggatccttatcttgattcaaagctcatctttaatttccactcaggtttgaatcctttggcatatctaattttaataattaaaggactctttggaccacatagcatctagtgttcttttataattcatgaacttggaaaagttttaatattgtatggatatgaatgagattactaaaataggctaacaagccatctgcttcatgacacacacttccgtaaatgtcatgaaactttatgttaccataaaattggcaacaaggaagcacctttctgtggaagagaagttctctaacagtcagttgcaagatactctggtctttgcttcatctggcacattacagctataacaataaatgcccctaatagaaacagaagaaaaattggctgtaaactttcaaaggagaaggcctaatgctttgaccatggtttctacattcccgttccaacaaaaaaaaaaggctattaccatcaaagtacctacgatatttagaagatcccacaggtcttaaatcttcttgtttagaagactcagataccaagccagagaatatactattttcttggtaatgtatagacagtggatgtttttactgctccctgttcaggacaaaagaaacttgctaatatctttccaaaaaccctactgctatacttaaactgcctcctaaaggagttagtccaggttccaaggaagaagtattttatctcttcctcatagtaaagagtatgcaaaagaactctttgtataaaatatctatatattcatcatgaagtgaggctagagtctgctttggttcttggtatcagccacatcttcaaa

SEQ ID NO: 54583 - DNA, 1883 bp, Bovine  19866880905618
aatctggggcaaaagcatatggcagcagaaatgagaagctatcacaaggaaaccaggcaggaacacacacatggtctgttggggatacagaaagaaagccacttttgttagcacacaatgagcaaaaggagggtggtgcacaatgtgtcagagaagtaaggcaggagtcagattaaatgggacaatacaggtcatagaataactggatggaatacttggatattattctgagattcagagccatttaagtaggtgagtgatatgatgtgtgattttaccatgaagaaaatggatctgaatgtggaccacgagaaggtaaaggaaggaaacttgtttacaaggctcctgtaaaggcccaaataagatttgatggcaagtagtgctagagtgaaagcaatgaagttgcacagaagaggaaagatttaggatatgttttaaaagcaaggccaatacggcttgacaataaatcagatcatagaggagagggggaaaagtaattaaggataaatgctagcatttgggcttaggggccagatagacagtgatgccatgtattgagaggaaatacaggaggaaaatcagatttggtgaactagattaaatatgcttatacatattattctttctaaagttcacagctttcatactcaaacacaagctaacacttcctgaataaggtcacatttaacttctttaatttaaaacatcatttttgctatacaatgtcatttaagattttattctaaaaataagaaaaaaaaatttgaactcacattatttgtttctatttacatgattactaataatactcagataaaaattgaggaaaattacacctttttatactttttatttaataatactagggaattttgaggtacagctataatgtccagaaactgaattattcaaaaaagggtgatacaatttctttagctatagtttatcatatgaataataactatttgctaaaaggaaattatccttatatttgtactttatatgaatttttctattaaagaacaaaacaactagaccacattataactcatttattttcaattgtctccatagatagttttactgtcacatgaacctttcataggaacatagaagccagtaccatttgcagtcaacagagcttatctggtccttctaaatggattatagatttatgagctatctgtgaagaaacacatggtctaagactatttaaaatcagtgtagctatgatctgaatggtcaaaaatgggtctgaagcagctgctcttttcaacaaaagtgtctgatgtctcagcacaagtggatggctttcatggtaaacaagctttgaggcagctttgagttcaggtgaagcaaagaataggagggagagggaaacagaaagtaaatgtaaaggaaaaagcagtgacattgacttctgtcatgcactgagtttttcctgatttgttaggcatataaatgtcactgaaattacagtggccatcagttttcttggtaagaatacaaaagtgtctgagggcatcccctaccctatcctattacacattcacacatagacagcctatgtatgattcacgatcgccataataatgaatgttaccaaaaatcgtacatctcaaatgaaacagaggtatactgaaaactgattacaataagatagagaaattatttctccacttaataccatgactatatttctgaaaattaaacattctatgtggaaatgctatccaagaacctgtatctgtatattctacatggaagaaattgtaatgcattacgagttaaatacaaaaccttataatcccctccaaatcctttaaacatgatagcagcaaaaaaaacatatttacaagcaccttacatactaataagtaaaa

SEQ ID NO: 54584 - DNA, 1313 bp, Bovine  19866881166619
tgcttagctttaactttcatcatgataatagaggtatccaaatcaataatcatacattttgatccaccaatgcaggcatttcattcaggaatagctagaaacaaatccttataatattgaggggatgtgggaaagctttttagggaatacttcagcatatctgtcaaaaagagttgggagtctcatcctattcttatatttcacagatgtagataaatatgggttggaaaaagtcatcttggctaaatctgttagagctgtattttaagtaatgtgtaaaaatcagattttagcttagttgattagaattaatatagatcaagcactgctgatagctcaaaatgtcaattagaacaatttgaatatgtagcctggctgggggccacacaaactagaattttactcactcttcaccttgtacttcaagagttataaagaaaatgttaaaaggctacatggaggcaatccagtaggtcatcataaattacattctgtccccaactcctgagaataggagggtgaatcttagggacaagcatataaaaacactacatctatacattttcctttcagtctctttttctgtttcatcatttatggagagaatagatgggtaaacaagttgaagtttcctcatttttattcctccttttcgaaaggtatgatatactaacgtataccactagtttgagtggtagcctttaactctggcagctcaattttcacctgggtaaagacaaagcaagcctttgaaggctgctctctgtaatccatttgtaggcatacaggctcactcagtcacgtccaactctgtgacccatggactgcagcacttcaagcttctctgtccatgggattttccaggcaagaatactagatgggttgccatgtcctcctccagggatcttcctggtctgggaatcaaacccacatctcctgcatccataggcagattctttaccagggagccacctaggaagctcttgttggcaggaaatcaggaagcttatggtatctagaggcttatgatatcctgtacctgccattccccttcttgatcttcgtatcttaaacctagtatataatgcagccttcctttcatatcctcactgtgaacaccagtcagttggacttagttttctgagtatgttctccacctggaaaagctatctgttttttattcagttgatctgattatagtagatattttatccatctcttcaccaccccattggcgaagggtaattctcatcctgaggctatggagatgaccaaatgcacaatatctaatcctaaaaggaaacttcaacaga

SEQ ID NO: 54585 - DNA, 2342 bp, Bovine  19866881310653
taccaaaaggtaaagcagtgaaaattttcccccaaagcactcgcacttggaaggcgttgactgtagccacctatatagaattaaacaaaatcactgttttaaaatgtttataagattgtaagtaagatttaaaattgtaggagcatcagttacaactcaaaatatctctaaagatatttaaaatatatgcattactataccccaggaaagaagaataaatttcaaattcaaagagcaattctcctgtaaagatttgatataatgcaattctagactaggaaagaattctaaatatgctttacaggctatgacacatttttgaatcaactgtagaacaagtgaaaaggaaaatgagcaaaaatatgatcttgtgtctacattttaaacagtaaatttcaaccatgtgtaaactaccatattaaaaatccacttcatgggggaaaaatgtaaccaaaaaaccagtatacataattatctattaaagactaatttccagttgcaacatttttcatcaaattattacctacatttaaaagcagtaaaggtgcatttatataaaagcattttacaatatatacttgtttttaatttaaaaaggcttctccctcagtgatgagccatatgacttaattccttgagaaatgtgttctcttaaatacattaaatacactataaattgttacatcattttatgtaactatgtaactaatagtgagagacatagtagaaagagtcacataaaaatgggtttaaattctggtataccattttttaactgtttatctttggatttactctaagacagcagatgtggaataatactttatcataattattattatataattattattttaagattaataatagatgtaaaatactcacctcagagtacattgttcaaccaacaagagttaatactttctttttcattttccaaatactaaccaacagtaaaatttcacgttacaagaattacctatttttaattatacttgaccctggaagagtaagggtttgaattataccaatccctttatatgaggatttttttcaataaatactgtaagactgtatgaccccaggttggctgaatccgtgatgagaaactgtggatatacagagtggaactacctctatacaggttcaactacgaagttacatgcaggtttcagactgtgtaagggttagcacccctaaaccctgtgttattcaaggatcaactgtatacattttctggtgtccaacttaatttttactaaattggtaataataacaatgttctggaatacaactctaagccttttttttttaaccttttaaattaaacttaaattagaacttggacgctttacttggtatcatctttaaaaagaattgttctgtgtgtgaatcataagaaatgaaaagtcccttggtaaccatgtggacaaatggttctaaaatatctgtaactgaacagtgcaggtccatgacaaagtttcaccagccctcagttcacagagggaaagtaacaggtttctatcatacaaccaaaattttaatacaaccaaacttgtccaatttgaaaactatcctttattctgagattatttctttcttatatttctaccgccttatttgtatgggaattcccctcttttatactttgtcaactctatgttctgtcattaccttttctttggtttttaaactctttaaggattatagactttggtcaccagtaattagataaaaatgtgtaacagaaggttttgcctaaagtctggtaatcatagtactaatgcagcctctcccctaaagcaagaatcctttctaaaacattatcaagaaatgctcatgttttgatgagttctatcttaggaaaatggaacaatatccatgaaaagttgataatgtacatgatccatgattttaaagttaaattttgtgaaagatattatgttactaacaacctaacaatatcaagaaatacatgaaatatttgcttccaaagcagaattaacttcaaaacaaaagaacaaaatgaaagaaagaagtattagtaagggagaaaaatgtccctgagatatcaagggtaaaatactaaaagaaaatgtaaattagtaaagtataacattaccagagtgaattaataggatggtaaaagaattccatttatctccataaagcttttccaaacatcgaagggcacaaagggttgatcctccatttccttaaagttaaaaagcagggtttattttattacagtaaatttaggtgttataactttgaggataagatcctttggctaaaattaggcagagagcaaaggtacaggcaaaagaatcaaattaaataca

SEQ ID NO: 54586 - DNA, 1143 bp, Bovine  19866881380776
ccagcatatatggatgatttattatggtctggaaaaggtcacattgggaataaattactatttttttttttttttaatttctgagcatgcaccatttaagcagtttcaactattgttcagataaccatttgagaatctaattttggaaaccttttaaagagaacttatttagaagagaaaatgctttcatttctgtttatttgcatacaaacttgaaatttaaaacttctgattttgtttctgtttttaattccattttctttcaattcaccaatactttttttttttaaactggacttgaactttttacagcaagttccatgcttctgctagctactctgattttattttacatccaccctcccattttgttctgccagacacttccaaaaccagggatggtcattcatagaatttctctgacagagaaattctctgaattctctgatagactggttcccattttccttcaagaggagatactattttgaataaatccttttgtttattgctgtccccatttgagagactattactaatatgaataacttgcagagatgtaacagttccctctcaattcccagttactatttccgtagctgatacagttgtacttcctccttcaagttgacttgaactattccctttattaactagtttttaccttccttttgcaatgctgtaatagccataacacaaattaaatttatcctgagactccttcttttaaatatcattttgattaaacatgcatcattataaattacacaaggcacaagcacagaactcttaataattttaagggaaaacgtgtagtcaatagtaagttaatactctctttgcctttgttttatctaaaaatctatgtgtatactcaaatgtcagaattttatgatcttgaaatagcatttttgaagttgactttacttttatggggttaaagaattacacattctagatgttaaaagtacttttgagccctgtacattaggtagttgttcaaatgatttgtcttactcctcagatttagacttcagaaccagggatagtagaggtcatctctcacttgtattagactcatccaactgttactgttttgatttttgatcacaaatcatcattcttggcagtgtctatttggtg

SEQ ID NO: 54587 - DNA, 1413 bp, Bovine  19866881396822
tgatttgcagaggtagtttaatggattgctgtcaccagattaatggcctctctttgaaactatgtcaatctcttgactggacatgcttttgataggtgtcctagcatatagttataagaaacaacctattagcttctaacaaagttgtagttttctgaagcattcaaaatgtgtactttgtttgcagtaatacaccaaattatcatatgtgtgcttctttattttacaaaaaaaaattatgcaagctttttctttgttttcagtcttggaaggtgaatgtacttcgtgcaaagtactacacagagctatgcatgattccagttttgcaaggtggaggataaaatcctttaaagtatagtatttttctctccctgtaaaaaaaaaagtttacatttttctttctgagtggcacatatttatgtctgtgtgaattaaacttgatttgcaaaacaaaagagctctattttatgaacaaaagctttacttctctagtctttttttcaatatctccaaatacctattttctttaaaaatctcttgcatgttaagctcttctgtattttgaagcaaagcactggaggatttcttgtgctggaacggcttaccctgtaggagagacatgttttagccatgcatcttggcatgcaaactgttcaagtctggccaccttaaaacaaagtggtttgcggaacataaaattctttggggaaatgaagtccttttcatcataggggactggaatgcaaaaataggaagtcaagagatacctggagtaacaggcaaatctggccttggagtacaaaatgaagcagggcaaagactaacagagttttgccaagagcaatcagtggtcctagcaaacaccctcttccaacaacacaagagaagactctacacatggacatcacacagacggtctataccaaaaccagattgattatatcccttgtagccaaagatggagaagctctatacagtcagcaaaaacaggactgggagctgactgtggctcagatcatgaactccttattgccaaactcagacttaaattgaagaaagtagggaaaaccactagaccattcaggtatgacctaaatcagattgcttatgataacacagtggaagtgacaaacagattcaagagattagatctgatagacagagtgctagaaaactatggacagagattcatgacattgtacagaaggcagtgttcaagaccacccccaaaaaaaagaaatgcaaaaggcaaaatagttgtctgaggaagccttataaatatatatgaaaagaagagatgtgaaagacaaaggagaaaaggaaagatacacccatttgaatgtagaattccaaagaatagcaaagagagataagaaacccttcctcagtgatcagtgcaaagaaatagaggaa

SEQ ID NO: 54588 - DNA, 1751 bp, Bovine  19866880404706
aaactcctttcctgggattcgctcgcatctctgtgtcggccgccatagctttgaactgtctgtgggcatctgtgctttatctctatttatttttgtatgctgttaacaagatgtgccctagggtaattgcttttttactttactctatttctgctaaccaaagttttcacagaaacattctacttttaaacagtgaaagaaaatagcaatagaagttggaatagaaaattatttcaagtgtgctcattcattaacatcacactgcaagcaaaaagattacatcataaatgatactgtagaaaacttttataattgatcccttaaaactgatgattaatattaccttcctcctggtcaacttttcccaaagtatattcattcgaataaaaatcttgacaagaaatcaacaaaatacatatactggggtgaaggaactgtttatactccttcaatccatatttccttttgagaaattcagcagacacattagaatagaagtcctgagccatggggtcgcaaagagtcagacacgactgagcgactgaactgaacctgagccgtctcaaacaagcagataaacaaaaatgtttatctgtgtttaatcagttatttctacaatatatttgaccataataatgtttttctttggaagagtggttgggaaacagttctagatggtttacttttccaggattctttctttacatcctgctgcttctccatttaggaaagtaaacacagccccacagtaacagataagttaaattccatttgctatttcacagcacttcctgcaagaaaactgtctgtaaaccacagcttgagattctcagagggaaagaagaatgatcagtgagctcagtttagacactgtgcatttaattttgtcttctgggctctgtctcttgtagcaaagctcagctttaaattagaagtaccattatcatattatgggctttagaaagatacttgacattcaccctggacttaaacgtccttggagagagatttcaagaagagaattttagtgattgatttgagacctctccttgtctataaaccttacagtttacataggcaataaatgttttttgaaatcagtacaaatggaagcaagagactaacaagtgagaaaagtacaatacaaaacaagtagttagtacatggaaatggctcctttttagtatagcataatttttctgctgttcttttaaatgttttgtctaccaagagtacagaaatcttctgactagaagatgccatctggtgactttatacaatatcagtactaaaaaaaactctattttccccaattgtaataggtctaaaaactcattcttttgagatttcagtgatagggtccagaaaaacacatttttctttaattcttttttagcattaaacaaaataagctaaaagtttattttcattatttaaaatacctatatgattcataatataaagtaaggaatggaaataaaaactcatcagatcaagaaacataaattcataaaactgctgggaatccaaaataacttgagaagtataacaaaagttatattaatacattccctctggaaatcatagctatcaaaaagctatataaaaggccatgttacaaatgtgtggatttttaatccatagaacagatggcaggttttcattttattcaattgctttaccaatggatgaatcaaacatccagtagaatttttatttttatttcatttgaacttataactataattata

SEQ ID NO: 54589 - DNA, 1376 bp, Bovine  19866880407844
ggacattagggaggtaagtgattcataacactttcagtctctgcttcctaaatgctgcctctgagatatttttccataatttccactgatggcatgtgctcatatattttcccaaaagatcataaattggaatacattactgttagttatgaaacttattcactaaggcaaaaatagtttatttcatcacttctctaaatatgtacagaaagaaaatgttggtagcaagtctcagaattaatgaaaactatagtttttttaatgaatttttaaaagtttaagctgttaattttaaataaccctagatttgggtatgaataatgaattgctgtactcttagcagatgggaatacccacagacattactttaaaaatgtctctcttattttggttttgtatctatgaatgtgaatgtacatgtgtgacagtgggaacctttctttttctatatattcagttcttcctacatgtaacatcacttcatctatttgaaaaagagtactttatgacaaaagttacgaggagatgtcttatttgtgacattgcgggatcgtcttaccaactaaagtgcaaagtttagaatcgtcattttatcacttcatttaattaaaaagaaaaattatctacattcatgaactttttatgattttcacattttccattttacatgttcttttaaatcacatttttaatttttttatcttttgtgtttcattaattagctattattggagttgactctgtgtatccaattcttttcttcccattctcctttgagccccttttatctctcatacttttgcttccacagtcccgtcaaaacagttcttatttagtttaacttccatgttgctaaatccaggagccacttctcagtcctttgaagcacttgatctgattcctgatatactttttcatcctgctactagcacactacactcttcctgattttcctgcatttttgcttgctacccctgtctcaggctgctttacgttctctgcttctcatccctaactgtggaaagccttccctcttcaatcagccttaacgcccctggtaaatccatgctgtttcatagctccaaaaactacccatggccttatgattcccaatttatatctgcagcttatctgtctctcctgatttccagatgcctgaatctagatctctaatgggggtctcaaaattaacatcctcaagactggtttattgctattccccctaagaagtcagatttctttgcagccttacttatcgcagctgatggcaatactacttattggtgttcagaccaaaaaccttggaactgtccttggtacctctctttcactcacactgtatttgatacatccacaaagcgtattacttccaactt

SEQ ID NO: 54590 - DNA, 1897 bp, Bovine  19866880464904
ttgcacactggagcttaaaatgagaatcccagcccagagcaagaaatcaatcagacggtggtggtctgaggcagcggtagtagacgacgagaccaacttggagtgacactcagcattaaaaggccttgctgatggtctggatacagagacaggaaaagagggagaaatttaggacaagctccagggttttggtttacagatgaaagacaacatagaaagaagagcagatgtgagtgagggctaagaggaagaacgttatgcaggtttagatctataaataagagctcctgctatatctggaagttgccactgtgctcccactgaggctctagaaacacacattaaaacaatatggattttagaagttggtggcccatgcagagagttaaagtcctggaaataaatcaattcagtggcccagggcccttgagtcatattaatcacagcatcatgatgggcacagaagcaatctgtaaagaaaccattctctacacctctaaatctatactgtgagctataaataacttgaatggtggtagcagaaagaaagcagaaacagtgagatgtacttgcagtgaaagaaaatcaatttaatcttttgtgttcatgagataggacgatcatagtttaaaatacttaattcaaagcagtctaacttttggtactgggagtagatcattaattcaagctgtgagacactggtcttatcctactctcttaccagcaagctgcctctcaccttagagactttcataaataacctgcagctgaattagataagaaatgctgaattaatgaaggcataagataaaacatacaaagaaagggctctaatcaacacagaacaatgaggctctggtcctaatcttaactagttgactctaagaaattaaattctctatgattaatattttcttttatgaattaagctcttatgttctaagttttcttgggtctgaactacctacagaccagaatactaaaagatggcctttatattcatgaaaggttattattcatagaaatgaaaggaaaagaaaaacattcattgagtgttagtaaaagccagaacttgctgcattgttcatacatatttcacttcatttcaagatttctacaaacctttgagcaaacagacgtgccctagagattaaggacttgccagtggctacacaataagtggctaaaccaggatttaaagtcttactgggattcagtgtcactttttactacccgtgttgcttgttaaagagaatagccactttttgtttcctaattagaactgacaacaaaagaggaatcgggaactactacttcatggggccaatgggcccacagtgcagagaattacatgcaggaggggaaaatcaaatttccagacaataaggtttatcaagggagggtttcagaactcttttccttataaagatctacaaaatcattacatattttcacccttctagaatggattaaatgtgattcttgccaagggtaggacaattaaaatagatgatatttctaagaccaaatcaattttacattcttaatttctcagtgtttagtcactaagggacttccctggcagtctagtggctaagactttgaataaggggattatgggtttgattccctgtagggagttaatatcccacatgcttcatggccaaaattaaaaaacaaacaaacaaacaaaaaaacacagaagcaatagtgtaacaaattcaccaaagactttaaaaatgatgcaaaaagattatcactgatataataatgggcataaatagagattctaaaaagcaagtatacatatctgaacagcttcatgtatagtaatcatacctgaaaaaataacacatgggagttcttcccacattataatgctatcgagatgaaaatg

SEQ ID NO: 54591 - DNA, 1944 bp, Bovine  19866880490053
atagtataaaagacaaggagtagtacaagatggcataatatttgtgtcaaagtttgccttaatatctctgagcatttcaatacagaaaatcagccagctgaaaatgcaggaataatcatgcttttaaatgttgactgggactaggagattgccacaaagattaagaacagtctctgattctttcagaatcattgacttgcagaatgctaagattttaaagaactttgacataatctaataccattatccacacgtcacataaaattctctttttcatattcctctcttgatgttgaaagactttaagtgaaggagagccttctatttcagaagctgcctattctaccaatgaacagttaaattttctctgatttcgcccaaaagataggtctctggaattccacattactacattactatgtggccactctttaaatgtcaaaaggttcttaacaaatatgcacactaaatatattactattatcagactaaaccattcacaattccttcattgctttcttgtatgacattttcactctatttcctttcatccaaatgctttctaataagttaatgatttttttcttctcctcattaaactgaacataagtttccaaatgtaagaagggaaaataagatactattgcatatggtgactattttttaaagtcatcctatcaaccactgatgtttgaactacagacaattataatcacagggatttaaccacataaattgtaaccaactcaaatttccctgactttatttttgcaattatattttaatataattataaaaggatttccatattctcccatcttgtgtgttttatcccaaaagtccaagattattttgtgtactgatttagcaaactaccattttactgttcctctcaacttccgatatcctacaaatctgatggacatgtgttttaagtatttatacaaggcacttactaaaattaaatagaataggcataagagcagaattttctagtatacacacaaaaatattattcctggttaacattaatccatgcaactgaatcttaaagctacgaagattcaatctgatcagtctagaagcatatatacctccaacaattatacatacatacaacatcatcagaaattatacatacatcatctattatacatacagaaattatgtatacatcatctattatacatacaacaatcatcagaaactaccaaaaatatctgctaaaatcaagaaaccatacagttgaaatccattaattctctaaaaacacaaaaaggtgaatctctgttttgtgatgactgttttctaaggttctaaatcaggatcagtccaatgatattttctagaaagggacagacataaagttttttagtgtatatttttcagaatacggcttttgttgttttatggctttgttcaacacaatttaaatagtgtatttttttctgtgtatttctctgtcttatgaaatcatatttttaaactggaagaagacataaaaatgttccctgtccccattcaatttttttttgttcctacttagactacttctcagaaacttttcagtgaaattaacactatgtatatgtggtatgaattttattacctcatataaaactgtagtatttccatgtagaagaggtccgtaacagatataggaatgtccgacaacccagcctaagtcagaagctgcccaccacacctaaacaataagaagaaaataaaacgcatatatcttaatcagataaatgtcatataatatgaacttaaaaccatgattacctctccaggtttaagtccatatatggaagacatcgaccagttaagcattacagcgtatcctccagtgggcctcaccacaccctaaaggaaagaagagatgaagttaaaatcaatagacaatgtgttaaaagatcctctttcttcatactatccacttaa

SEQ ID NO: 54592 - DNA, 719 bp, Bovine  19866880551346
aaatccaaagcaaaggagacagataaattattcaggagacagaaaaatcaatcccagaaggtgcatccattcctgaattttgatttctggttacaatatgcttcctctagggaagggttatattgtgccaaatatatgcatatatagcactttccagttttcagtatcattcaatactcgcggaactgaggcccagtgcccgcggcatagtgagccccagcttctaagtggtggaatcagaaagagggccagttctgacagatttcaaaacattcctctttccactattttaagctgccttttaaaagcaaaaaaagaaaaaagtaaaaagtaaatcatgtatccttttattatatttttaaaggtcagacgtttgaatataattcacatattaacatctgtaatatgtacaaaaataactctagataacactccctacaattagaattctgaataaatgaaagttacacatcaaattaaaaacatgtatagaatatatcaaaagttgaataagttaataaaggcaaaattagattcttcctctagaaaatcattcttttgcatttctattaacagccttttattgcaggttttattccatctcaatcagaatacatttttcccatcttcatctattaaaataaaactcttctcaagctatttagttgaaaatcatgacatcaaaatcattcctggtttcaaatattaactattttcaa

SEQ ID NO: 54593 - DNA, 1673 bp, Bovine  19866880576213
ataatgaagatttatcttatggagtaagcgacttaactcaaaaatgtaactagtttctacattgtctgaccattgagtccaaggacattgttttcagcctattcattttaaaaaatgaaatcatattgagcgtagcctataattatcactgcttggggtagaagaagaagatattacgtttccatctggtttttcaggcactgactctagtggccaaaaccagagatgactgtcatcccaaaggcaatttatagttggaaagagtcttccagagctctgggaaagaaaggaaagggaagggaaaaggaaagggtataacaaaataaaacaatttcaataggaggaaaaattatctgctacagctgtgcttcacttccttcataagaaatggtcttagccttgacatagccttatgctttccatgataacaaatgttcatcaagcagctaatgtaaggttatatgcttcacacgcatgggatcagttaatcgaattgtccccaaaattccataaggcaaccattgttatcttaagagaaatcgaaacctagtattacctaggcacacagaaacagaaattaacttagctaggacttgaagggacttcttcggaacttaggggccttgcacttcatccttctcttatacctccccaaccaccatacctatgtgcactgaaccacaggcaagctgcaggtaaacacactcttccttggtttgcgtcttcgctgctacctttctcagctgaatcctaagaaacaacttatctggcatcaaagggtgccaagaaagagaataaaaagccgtgagcacacagtgtagaataggagccttaacagaggaaccttagagtgccacactgaatcctggaatatcaaatagctatgagtcttatttccactaaaactattattcaagagacattattacattcattgcatccccatcctcagtcccacccctcaccttataggtactactggtccaccatggaggggtatggaattcggatcttacgttgccaccctccagaaaaagatagccaaggaaggaatctgagcaccctctagccaccccttccagctcccaaactgtcatacaaccttagtaaaagagaggaaagagatttacctgctgctatggaggctgaagcctgaaagtcatgtataaccttggaaggactgtaatggttttatcacaggaatagcatctttttgagaggcaggagagagaaaagacctgaaccactctgcaaatattaaacaagctattttggagcaatggctattgcctttgaaatctttcatcatgggtctatacttagaattcagatgagcctgggggaggggaacagtgcagtgttaatccccagttgttttgaacttgtcctgtaagcaggttagcctctaaagtgtcccaaattgaagtgttcgatgctttgtttaaatttaggagtccatatattttgttttaacctgtcctgcatataggttgtcacatcattctaaaggtgacacttctcagttttctttcaaactagatgttctagagagcactgggtgtaatcacattgagagactgatgctccatgacagctaaaagttggattgagtttcaggagctactatatataaagctggggcgacttatgtcaccgcactaattaaatgccat

SEQ ID NO: 54594 - DNA, 1915 bp, Bovine  19866880595175
ttgacaatagaagatggagagcagctgtgtaatggcgcaccctttgaaggggcactgcagagccatggtgcccactcaggatgtgtgccctggcagagagaacattccatgcattcgctgcaggggcagtagggcctgcaaagatgaatgtggtagaggtacccgagtcctttcagcaccctgcatgctgacttctagtgttgccttatgggagcaggccaaaaatgccagcagggaaagagtatcatagtaactttttttcttccattgcttcatgcattatgcttttctttcccaaggggaaacatgcatttctaaatctctataactgcatgccctgagggtgcaataagaggggcataaaaattcatcatctccatgtaatcatgaggaaatatcagataaacccaagtcgaaggtcattctacaatatatgtggccagtccttttcataaatgtcaagatcatggaagacacagaaagactgagaaattgtcacagattagaggaggctaagaagacccgatgactaaatacagcatggtgtctcaggattggatctggaatagactaacattattagtggagaaacgtgggaaacctgaagagtttagttgacaattttgtaccagcgttaatttcttagctttggtaaatattccatgcttatataagatgttaacagtaggtgagcttgggtacaggatatatgggaattctctgtgccatatttgtaactcttctataaatttagaattagttcacactccatttgtggtgttggagaagactcttgagagtcccttggactgcaaggagatccaatcagtccattctaaaggagatcagtcctgggtgttcattggaaggaatgatgatgaggctgaaacaccaatactttggccacctcatgcgaagagttgactcattggaaaagactgtgctgggagggtttgggggcaggaggagaaggggacgacagaggagatggctggatggcatcactgactcgatggatataagtctgagcgaactctgggagttggtgatagacagggagacctggtgtgctgcaattcatggggtaacaaagagttggaccccactgagcgactaaactgaactgaacatttgaaggaaaaaaaaagtcctctatggcgtataccacagtatgccctcaccagccaagccaactttatgtaaatttgtgagagaaacatctattagggttttctgtttataagtatttgtaatactgtgtccccttcctccaaatcagttttattgaagagcctgggaaaagcaaaattatggaaaaaagaaattgagcatgacccatgaaatgtgaaagaaacgctttaaatctagaacttaagcttgtgcttaagaggatcaaaaaggacactaactgtgagttgtggggccttattgagacacaagatcatcatgactgctatgagggcagagaggaggccttttataattcattcctattacgttttcttacgtaacccatatgccagaaacacatagggaaacctgtgttctagtaaaaagattgatttacaaataatctcagtaagaaaagatctcaagtcaccagtctcatcttaggaattcaaagacatctcatttttttaatccttaattttcaatattgttgaaccaaatataatcatgaaatgacctgaaaatgtggcctcagcacaatagtttctgttttcattgctattaatcacaaagaacaatctgtaagaggattatttctgtagtcacaactgtcattggtgaataaagcatttgggttgtctctagggaagtggggctgctgccaaacagctcatatgcatgagaaactaagcatgggttagaatgtatattttgacctttatgatttttggagtattcattatga

SEQ ID NO: 54595 - DNA, 1168 bp, Bovine  19866880660080
gggtgccttgccttctctgttttttttggttctagaacttattaattcttaatctgtttgttccttcttttattcttcctttctttctattgttcactcattaatgtttactgaatggtcatctaggccaggcactattccaggtgctgaataagagtccaagtagagtataacgttgaggagtgatttcatacatcaaagggaaaaagtgtttttgcttgtaataagatagctttcattttcctatttaataaaaggagagtaatcatgagtgatatggactatcgagttattttctgaaaatacgggtaataaaatttgctttattttgcaatcaagtctactctgaattacctttgaccattgaggtgtgagtaactagaatatacaggctcacatcatggtgatccgtggccattttctaactaagaaatcctttgatacataaaataatcaaccaattttaattttatccctttgtgtagcttcttattttctgccagaagtgctaacacccaggaaagtgaggaaaagacaagtaacacaaaaagaataaagagaaataatgggcttggttagcatcagctagataatgaactcttggataattgagcaggctgcactgcattcaagtttcaaattaacgaaatgtgaatggaaaatgtttaatctatgatattatatgtagacagtgaggaaatgggcaaggatagagcaaagacagtttgtgaccttgttagattattttgaggttaaaactaggggaaaagacaataacaattttgtctacttttcttaatgttttaatttatactcaatggtatctggttggttaagttggctttagtttccggctgtgtgttaaggttgttttggcaagagtgaaggtgggaaattggaagagatttagtggggtttaattaaaagagcagagattttatcatccaaaagccttggtttgagacatagattttgaataacttttcattgacatttcttattcaaaagtaattctgactgaaatttaggtttatgcttttttttccccagaaagatgcagtgttactttaaattttaattgtgtaaactcaggaaagccagaatagatggaatatcaattatagttcaatatctagtctcatatatatcttggtatagttggtatatt

SEQ ID NO: 54596 - DNA, 3817 bp, Bovine  19866880786079
tacttcagttgtagcccttaccaaggcctgctacgggtgagcaattagcatactggtgcacctgtgcactcaactagctcctagaaaatatgacttgctttcttcatacagaagtctataatgtctggaaatatgtgaatcagaccatgctgttctcttactctcatctctttagtacgtttctatcacacttcagaggaaatccaaagtcctttccaagcctacaaagccatcaatatttgatcctggccctgcctgtccactgcactccaccatgcccttgcacactatccagaggccacacagtctccttctctgccccagaatataatatcaatgatacagtggagatctactgatcagaagctatgagtcagatgccattctaggcatctggggaacattggtgaatacaataaacaaatacccatctttgtagagctttcactccagtgggaagaagcgtggagatcagcaatataagtaaattatattgtctttcaaaagggataagtacaatagaaagaggcggagcagggtagaggaaagggagaagagccagggaagaagggattagctgtgatttcaaatccatgctaagcatgttctcccctagcactggcaactgctaatccttttgcctggctctccccttgccagcccacccaatattcacatagttccttatatcaattatttaagtgtctccctaaatgtcaacatttctgaaaatcattatctgaagagggtaaaatgtatgctcccgctcccacactgcagctctctactcccctaattagctttattttcttcactacattatatatttattcattttacaatgaatatatatatatatataaactattttatttctagtgcttaggacagtatttgccatagttataatagatatctattaaataaataaatgcaggtaataattagcttcagctcatggttattaaatgtaaaaggtaaagccaagaaaactgaaatttattcaataatatattattccttaataattggggaaataatttctattttaaaattctgccttttttatgcccatggtactttttatagaaaacaaggacctgccaaacttctttaaatgagatccctcttcattaattcaatagttgttgagtgctcataacattctaaactttgtactaagcacagaatatacacacattcagaagatggatataattatttttaaaatggcatctttaattattaacagccttttatacatatatatatataattatttatatatataattataaaaatcaaaacacaaagattgtgaacatcatcacactacttctttggagttaagtccccattcaaaaatgatgggttgagaagaaaagcatggagggaggtagtcagagtggaacaaggaaaacaggctagaaggctgttcaggtgaacactgatggtggctcagaccaaggtggtagagggaagctggtgagacttacctacgctctaaaatattctgaaggtaggtttggatatgaggaaaacaggagtacaaaaaaaaaaaaaaaaaaaactgaagaattttacctacataaaagggtagaataaccataaacggagatgggaagactatggttggatcaggtttggaaggatgatccagagtgcagctttcaacaagctgtgttttagataactatgagacattcacggcgagatgtcaagtaggcagttagatgtatgaacttggatttcagtagagagtactggcaagaactatacatttggaaggcttcagtgtataggagtaaatttaaggagagaagaggagagttcaacaacagaatcttccaccccgacatcacagaatccagtgaaatgaggaagggctgaaaaagtagctaaaggggcctaaaagggggtgtcagcaatcacagtgctgggactggggttccatgggcagagcagtcttctcctgaagaaagagcctcctgtgtagagcagacagcctttttgtccaagctgagaatttggacagatagctaggtggactgaaaaaggaggttgcctctttccagccaaccaggtctgccaaatccatagtagtgaccaatgaagtcacaaattatcacgtgattattatcctattctgactttaatggcaggcaggatggaaatacatcagtaaacaacatgtgcttgcaatctgatatacagagtgtgagtgctaagtagcttcagtcgtgttcaactccttgcgaccctatgaaccgtagcccagcaggttccgtctgtccaagggattccccaggcaagaatacttggaggtgggttgccatgtccccttcccaggggatcttcccaccccagggatcaaaccctgcatctcttatatctcctgcatcaggagacaggttctttccaacttgcacctcctgggaagcccacagaactaaataccaacatcaaaataatcttggagggcccagatggtcagtgctattggggtacattatagattctttgatgaaaatgttgatatagttccagtaactagtaatttagactctttcctaaacagaaaaatggtatgttaaataaaattaaacgtggaaacccatgatatagacatattaaaagtgaaatatctttgtttgaagcagaggtagcagaatcagagacatgcttgttcagagctcctactggactgttcttgggcatcttgacatagtcttagagccctggtaaacatggcttaggaacactggcagagacttaaacataaagcaggttagacatgaaaaaaattggcatttgaagctctcaggaaaggtctgggaaaacaggacccagatagacagattgagcccaggttgtcaatgttttggattttcctgcctccagaattgtgatatctcagttgtaaaacttccaaactaaagaaaacatcttggagatgaccagaatcatctagcaatagtgttaaattaactataattttaaggaagagataaaatgtatagtccagaataaaactaaacttgatgtgagtaagaatatacatattcagtgagtttcatccatttcatgaatacattgattctaaggtaaaggggttaaaaaaaagcatttaaaagtttttaaaagagaaaggaaaacaagacagtgaaaatgctcttccacaaccaccttgggaaagacagaagttgtgacggagcacactcgataatgaacctacaattgcatccaatattaatctattttaatcaaatggggaattagccttcctgccagcactaagtggaagtgtgaataagaatgcaatcttgcagagtccctcaagaggaatattccaacttatttagagatgtgagactgttaggaagtattcaaaatagggaaaatagagacaatcagaaaggcatggactattttaaaagagcagataagatagaataagagtcatgagaaatacaaactagtatttgtaaatgctcacttaagtgatgaggaactttggcaactttaatagcctaaatgatacattaacttcgtgcgtctactccatcgaattgggacattatttcttctaaggctgaaagatgtaccactagtttacaaaggtgagcagtgaaatgacctgccaaagatgtcatagactttagcccaccaggctcctctgtccatggcattctctgggcaagaatactggagtggggagtcattcccttctctaggggatcttcccgacccagggcttgaaactggccttgcagacagattctttaccatccgagtcaccagggaagccctaaagatg

SEQ ID NO: 54597 - DNA, 894 bp, Bovine  19866880792830
gtctatacaagatagtatttgcacatgtgaatagaagtgtaaatgtatgtgactaattaaaatgcaatgaaaaatataggcttgtaattagaatatccttcagcttcttatttgtcatctttttacctttaaacagttcaggtcaactatgttctaaatcttacttttaaaatttgatattatacaatttcagcaaaaatgacaggatagtttaaacatctgatgagaagatggaactgaaactcaatattattcatgctaagctatcttaaatgtttttgcatatgttaactcttgtgctagaattaatttaagaaggtaagcattaaaatctcagttccttgatgcagaatcatttcagaaatgcatttatgccattccataatgagaaccactttcaaaaatctaactaatcatttccacaagatatacttctgacaaatggtctgttattttacagcatctcatttctcatgacagtaccacaatcaaaactacatcaccttaaaataggctaatgtatatataaataagaaagataatcctgcataattcagtcccttgaagacaaaagcaaagagttaacttttataagccagttttcatgctttaaaaaccatccttctcttccaccaaaagcaaaaacaaacaatagcaacaaaaaggtaaacacacaacgcctgtcaccacaaatgtcaggatcaaatacctttctgtgattttaaaaatgtagcaaaatagatctcatatttgtcaacatttctattttatctgaaatcttactgctttttacatgaattgttataacatcagcaaaaaaaaaaaaaaaaaagagtggttaaaaatcattccagtgtgttttcaaagaaaatcacctgtcaggaaatgtgtcag

SEQ ID NO: 54598 - DNA, 1928 bp, Bovine  19866880798189
aaaaatgagtaaactttttgagtcactgcattatctattttctactgttttatttttcaatttaggaaattaacaaaaatacttaaaatcagattgacctaagggttaataattttttttttttttttggaaaataaaataggatagtccatcagaacagtttttcaggtttggataagacattgttccaaaaatattaaggaagaatcttttaataagcacattcaattctgaaatctgcttagagataaaacactttgaaaattttaattggaaaatatcatcagactagttttcaataaacatgaaaataaagtacattgtaattgaagtgcactaaaggtttctccaagtatattactttatatatggactttatataaaattaagtttgcagctatagtaatgatgataataacaaatgcaacatgctgtcatataaatgatccatcatcaataggaaatactcttaaagctgttttctcttgaacctggggcttctgttgatctactctgctcttactctcagttctctttgcagacaaaaacaaacatctccaaatacttggcaagactataaaaggttaggtgagttctgggtttttgaagaagtagaagacactgacttaattgatggcaggttcttgtttagcccaattggatgttaaaacagacgaactaaggaatcatcctccaaatagatgacagctattgtttttatagcagcaaacttgaggcttaatcaggcaaaatggctttattgtgaattagttatatattacaaactagccaatcaggccatagccattaaatggcacaactgtcagtctttatttatagcagaggatataaatttcatcaagacaaagatcagattttagtcaccactgtgtgttcaaggagatattcctagaatataataagaacttgataaatatctggtaagacaagaaatgaatgcaattgattatattaatattatagtccagactgtccaggtcagcatattccctgtttaaggacctttattagtctgtggctgcttagggtaatgtctctttgggcactagagtttctaaaattataactcatcatgctaggagtattgttttcatgttgttttatctctcaattccaggtcatcaataaaaacactaaacaaacacagatctggtcccattgatgccctcctcaaaactcttcattgttcttacaaagccctctacctgggcttctacttcccagtttcatttccatttactctcaaagtcaaactttcttttgcttcaagcctttgaacatgctattctttctgtctcttcacacatttatatgattactatttcttgtttctatttaagctgaggcttaaaagtctcaacgtcatatactactctagctcctggtgaatgtattcacattccctgtatgaatgtgaattccctgtgtgaatgtgaatgtgttagtcgctcagttgtgtccaactcacagagagtccatggactgtagcctgccaggttcctctgttcatgacattttccaggtaagaatactggagtgggtagccattcccttctccaagggatcttcctgaccaggtctcctgcattgcaggcagactctttattgtctgagccaacagggaagccctggcttcctgaggattacaggaagccctgtaatcctcaaattcgtatttgtgcattttccatctggaacatgtattcttcactaccatcacctatctccaatgttacaacatctcacaagtagaaagcacttaagttatcttgaaagaacaaaagacctgaagcaacactaattgtaggaaagcattgctattattttattggaagcagttactcctcacctctctccttttattcaactcgatctgtcagaggcagtatttccctatatttcaattt

SEQ ID NO: 54599 - DNA, 2114 bp, Bovine  19866880855038
cagtatctttaattcacaatcaattcctccacctgggtacctgagtcaaattctcaggtttatcataactccttttacttcccctacaccccacctggtgattggtgtgtctaatctcacctgggacagcagctactcagttccagccaagcgttgccatgtgaaaatgctgaccaagcgctgacagttaatctgctttttttcaaaagaagaccccccagcctgaatcattaaaggaaatttaaattttagatgaaatcctccaatgtttaaatactgacaactacttcaaaaacacacaaacaaaaaacccagcacctaggtcacacaaaacctatctgcagacttacagacaggttgtgacgtacagccttaaaagcgaatgcaaatgtcttagcttgctattccaagccttccaaaaccatcctgaaaccaccttatggagtaactgtaactccacaataaccactacaagccaactgatatcctatccattctgacctacaagcatatttggttctttctctcctctatgcctacgtcatgtttggtttggacacaaaagtttttcttttgcacacaaaaagtggttttcttcctctaaatcctactttaagattgagtccatatgctaccatttctctgaaaactttctggtccacactagcttctgggaatctcgcttccaaatttcaaaaacatcagtaacgaggtctgtgtgccaggtacagtcctaggcactttatgctcccacccacctctataatcctaagaaattgatcctatcgttactcttattttaccagtacggatattgaggcctatccaaaggaagcggcagagccggggttgaacccaaacatttcttgttccagtgcagaaagaagagtaggaagttcaagttttggtcatccactatgggacctgtttgtgctaggaaaaaaaattttaatccttaatatgactcaccagatcattcacaatatggctttctccttctgtttcttaattattacctgccaagtcagccttctttcagttcctagaacttattgagctacttcatacctcacgaccttttcatctgctgttctctttgtctggaatgttccctcctccatctgagtctaatccctacacattgtgatctcagtttaaccatcatttcttcaagactcctaccacaatccttccagaaaagattatggcaaatccccttattatttcatagcatttactacaactctaaagaaatagttttgtaataatttactgtatgtctcccatctctttcatcattttctttatactatacacacaatgagtgaataattgatatctttaacacttataagcccttttaagacttggagacttaaacaacctttatctcatagtcagtgagaaactgagatcctgcatgttaaaaaaaagtacctacacgatttccattgtagatatgttaaccaagcagaaatcattttctaatcatctgcatttagacttttctttgttagcttatggtcactgttaatacatttaaattaaataatcaaaaaaaaaataaatcaaacagtatgtgagagtctgattattgaatgttgtttaaatataaacaaactaaaataggactgcaatgtttccagacaaagggataattaatgacccagaccgcaaaaattaaccacaatgcataatgcaaaagtgaattgcctaattcctctgagaggggtagctggatttcactttcaggaaaggcagtaggatgtctaattcatcaggagaaaacaaccaaaacatcctttctgtggtcccaggactacagaaattactaggggttctaattgcttcaccatatagtcagttctccactgaagtctaatagagactctattctccccaaagctaggtgtcaacaatgtgaatgaaccaacaaactatgaggaaaggtaattcttcacatgttcctaaagcacctacatggaatttgtttttcaaagatctcagagattacagagaatacagaaatctattctacagggctattcactacaatggaagggccctaaagtatcaccctcaaagacttcgattccatgctcatactactgcat

SEQ ID NO: 54600 - DNA, 1525 bp, Bovine  19866880927882
ctaaacacccccaactagattcttaacttaattacatcttttgccaactaagataatattaataggttccaaggattaggacaaatgtatccttttagggttcattaagtatcccactcagggcttccccaggggctcagcagtaaagaatctgcctgccaatgcaggagacgtggcaggagcctcgggttcaatccctgggtcccctggagaaggaaatggctacccactccaatattcttgcctagagaatcccatggacagaggagcctggtgggctgcagtcattggggtctcaaagtgtcagacacgactgaagtgacttaggacacatgcaagtattccactacaatgttcctctttatctctattgaactaagcgtgaattcatactaatgtctctaaccctaattcagtttcatattgatcattctggtcttcttcccttgcttctctataacctatcaatccaagagagaaacctagctgcccccattggccaaacattacttaattgttcaattccattatgtgtctacagtggtttcaaaactgttaagtttagagcctggacaggtcaattccggagcaagtcaactcaagaaaaagtgcttttttgtcagaagcctgatcatagttatcctaaatattcaagaaaataccatcctttcgtttactgatcactttaaagacataatcaatctgattaatattttaaaaaaaggagctattttgttgagcaataacatttttttcataagtctgtttcatttcccacaaaataaagccttttttcaaattgtcattgatactgtaaacatcatgtggagaaccaccaaaacaaattcactgtgttgtatattccttcttgaagattatggttttcctttggcccttgatttcccaccacagaagacaacttttttcatggaaacttcttacagaaacattaatttatacataaaattatcttacattcgtatggacagctgttgaggtggggcttatggtcaggattgtcagatttgactgtgccatggaaagtttcctacagctgagtccatttgaattgcactcattaaaaagagaaaacacttgccaatgagctgtttgcaattcgagaagaaaaaacagtaagaaatgacctgatttctttatgaaagaataaactgttttgttcttgtagtagaagactgtttcgcaatgaaaataaatggatgacagctacatgtatccatagtgataaatttcaaaaatgtaatgttaagtaaaaaaactaagttatttatgcaaattttggacacaatacttatatatacatgtataattgtataatatgcaagaatcattgtgggaataatatgctccatcttcaggatagtggatatccctggaaaaagagataaaggcggttgagctgagggggtacaggctttaattgtatgtctgacatgtaatctttttcctaaggagagatctatagttaatatggaaatatgaagcatttctaaagtcttgatatgta

SEQ ID NO: 54601 - DNA, 1853 bp, Bovine  19866880984081
gaaataatcgtgatgaaattatgttttgttactagatatatctttaaatggtgtaggaaacacgcttcaggttagtcaggagaggtcctcagaattacaccgtgcatgtttccctgaattgaaactgtatgttattggttaaccaggatatttagcataatcactctgctagactgtggtggagggaggtgattatcactgagaacagatgggcaggtccacagcactgccagattctgcacaagctccatttactgttggttcttgcttttttccttcggtgttttaatttttttttctttttaaacactgtatgttctaaagaactagctgcacaaaaggtcagtagctgatgacctttcagcttagatttcaaacgtagaagaaagattcaaaatgctatcactgtgtatctaagaaggatggagcaggtttcattttacactctagcctccctcaatgcatgcacagatttatctgtgtgctaagctctctgctctgcatctgtagctccttgtggattatattgtctctctgatcagaaatgatcttctcggatatgaacaccgtttctggctcccctaaagtgcatcctcctaatgggacccggttttatacttttcaagtaagtgtgctttaaatggcttcactacctagggagttaatccatagtccaacttttaataaagagaaaaataagggaaggaaaactgcaaaatggaaagtattaaagaggatgtaagatgtagaaaatgtgcatgtccttttaatccaggttttttgatatggaaattagatagcattatgattctctgtgaattcaagccaaataatagtgaactaattttcacaaggatttttaaatctgctgtattatcatatttacaaggtttatgagatagtctcctgaaattgttctttatggatataatatggtgaaaattattaagttccttccctgatatattacagagaagataaaattaaaagacattttatggaactttgcaaactatgttctgtaggcttagaaaaattttgtatttcttatacatagcttaacatgactcttgttatttacttttatgagtgcaatataaaattaaccaataatacagtagcttaagtgtcatgtttagtatgctctttctatttgaggtaaagtagaaactcattaagatggaagatttcctgtgttatcaaaaagtcaaaatgatttacaatataaatgtaaatgtgtgttacaaagctgttactgactttcagttgcctttgaataaatcagtcatcagtctagaaaatggttaccgtctaaagtaaatcatattctacctcatttttatcctcaaattgcatttttcagtgctaaggtttacatttgtagttcaatcatatcatcattagattaaaagggggaatgaaactcttctctgtatattttacactctgggactatgaacagcctagcatttaattattttagctataaagttataatgtactaaaaaataagtgcaaaaacctagagaattaatgtagtagaggtaatatttcttgtaaaaagaagctctgaataaatgcacatatgatttattaaaatctcctgcctttgcacactctagcagtagatataattactctctctctctcctccttcttatacttctatttttaatcctgttgcctctcctgctttacactgatgtctactgatagtgcaagtctgtgctgttacagaatatttttgcttcccagtggcgatcagcttattggtggaagtgattcaaaatgcaactgccctggggctcttgtacagaattattacttttttcttctccgtacactgagatata

SEQ ID NO: 54602 - DNA, 1188 bp, Bovine  19866881008048
atcaccaaatatatcactccaaatgaaagtgaaccagcattttaatcctcttttctggttttaacatacaaagtgaaatcgagtattattgtcagctttcatcctataaaatacaatagattctgattacttggctttcaaaagtgagctataaaggtcatgctccaagtcaaagcctggagacattaattatcttttcattagctgtgtcatcttatgaacatttcttagccttttatttcctaaggggcaaagcctatccctgcctatcttacttttcaaggacaactgtaaaagtataaaattttgaagaaagttgttatggaaagctaaagtactttccagataccctgagaaagtttctgatgggaaacagaaaactcttgtatgggcttcttgaagggacagtgggatggggcttatggtcctcggaatcttttgggtccccagacgtttggcaaactttacctacactatttctaagcatattctattggatatgatacatttaactcctagtgaaaagtcaaataatttataaaaactcttcccacagggttttattttacattttaatcaataattccctaaccttgagtaaatcccacaaattcaacaagcattttgtgtatttagaacctattctgccgtgctgtgctcagtcatgagcacagctgcttagttgctcagtcgtgtctgactctgtgcaaccccatggactgtagcccaccaggctcctctgtccatgggattctccaggccagaatattgggagtgggttgccatgccctcctccaggggatcttcccaacccagggattgaacccaagtctcccgcattgcaggcagagtcatcaggaaagcccagaatctattctaacatactgaaaatcgacaaatacagattaattcaataaaagcattggaagtgtagtgagttggttcaaaaagattcattcattaattcattcagctaatattcacttatgggctattctactcagtatgttaggcatatgggccaaaatatgaaaaaaaaaaatactggctgcttctaaaactttgagctaatattagtgtttaccaaagaggggctactttaaaatattttaagtgaaaagtttaaattttactttttctttatatttaaaagcagatagtctactttttcggagagaaaaaatgtct

SEQ ID NO: 54603 - DNA, 1734 bp, Bovine  19866881047486
ccccttggagtttgctgtgaggaactcacacttgctctagcagttaactagagtttaccatctcatggttccttcttcacagctgataggagaaatgaaatccctaatgccatggaaatcataaaaggctctctgcacatatttatgtaagcttgtttttctaaaataccacacaaatatgctgctcaaggaatccaaaaccatagttagatgccactgaggtaggtactaatttactcataactgacacatagctcttactaagttctgtgctcaggacactcatagactctatcactgaatcccttcaacaactctctttagtaggttccattttatcgacaagaaaactgaagcacaggtttgtgacctgtccaaggtcacacagcagatggaactgggatttgaacccacacagtgtaacacgagagctcatatgtcttcgcattttctgtggcttgggggataccattacattaaaataaatgtgtcactgtatataaaaagtactttgaaattgtagtatacaaagagattagtgaagtgtgatcagcaaaccacagcagtggcagaaacagagtgggaactcaatcttatgttgcagcttactctcatgaagaatatatcaagccagggaaatggataaacatacagattcagacagtttctgacatgcgataaatattgcaatgacttttcagaattatttgttgttagccactgtgtctatttggtgctacaaaaaaacctgaaagaaacaaaatcccttgctataagggcttatcataattacacagtgtggagatgagtcaaggatgtttcagatttatggggaaagattgggcgatagtaatactattttctcaccattgcatgtgattgtgtctttctaattgttttcattatttttctgaaagagctgcaaaattgtgcagtggttcaacctgaccaaagtggtattatgctgctgggaagtaaaagtactagataccagattggaagtactgtcttcattatcaaatttaaattcctttaaagcatgaatatagagggatttttaaatgctccagacccctgattatttggatgttaagtttttcatgtttctcctttacagaccacactgtgagatcatgctactgaggggttaggttctaaaaccaatgtgaaaggcagaaattgagattgggctaacattattaccacaatcaagtagatcagtgtccatacttctagaggtgagcaagaactgatgcctttgggaagagtaaattcacagctcccatctcagtcatcaaacaagaggaatcatattcattatttaaatttgttctctctctggcccctcacagttaaatgagcatgtaatgcaacttaaatgctggttcctatttgtggaagcaaggagtcttcttatgaagattttttattatctcctcattctttcttattaccaactaattactcctttaaatgattaaaattttggaaagtttaacttcacatgtaatacagcactaaggaaactcataagtcttttgtctaaagccatactttatttctacttctctcgacacctttatttttactggagatactcctattctctgtacagatttactgatcttccttatttgtcattcatggtcggttcttagattctttagatttttgctttggggaaagtctccaactgtcttctcttacacattttttaatattcctacctatgaa

SEQ ID NO: 54604 - DNA, 1353 bp, Bovine  19866881060649
ttgtagattctttttaagtgctaataccagataggaattcttttttgttatccctcttcattattcgttttaaacttttcctaaggtttctggaccagtgaaattactctgccaggtgaaatttagaagtcctgttctaaatgttagtgttatctttaaggtcttcattatctctcctcctcccatcctgaacctccattccatccatcctgtatctactgcagctaacctgttcgtggttcaactacaaatgcactaaatgataacattgagggcatgaatctgccataccttctttaaattcccagttgttagaggttgtactataatactcattttgcatttcgctccagagaaaagaacatggaagctctccccttatgagatatcattgtcgtttcagagtgtggaaggagaacaccatgaaaaagccgtagaactgcttaaggctgccaaggacagtgtcaagctggtggtgcgatacaccccgaaagtcctagaagaaatggaggctcgctttgaaaagctacggacagcccggcgtcggcaacagcaacagttgctaattcagcagcagcaacagcagcagcagcaacaaacacagcaaaaccacatgtcataggtaagaggtgccctctacacaaggaagccccatatgcacagaatttggtttttttaaaagtatagtttcttagacagctggaatgtaatcattagatttaataatccaaaaaaattaatcaaacaaaaaacagtgacctcagaaaatgttaatgagacagttgcttatattatgtttcatttagccatattccctggaaatgtacgctattttgaaaaaaatatatacttgaggagggccaggtacagacgatatgatgcctttgtgcagattacagaactgcggcatctgtgcagacgcacatcctctggcacacggcttcatgacaagagtgtgggccacattccagccccgcttgcctccctggctagttgcctttgcacagtgtacaaactaatcaaccatatagtgctagccctggggagatcccctttaccatactgaaaccgtttactagaagactgctccagtgaagaggacgaagtagaaacctgccagtgtttaattacgctctgagattttggaattctctttgggtcttcattaaaatgtgtctcaggtatacctgtctttctaaattccactttgtgacaagggtaagtcaggttttgcttcatgtttttagaaaaattcaaaaaaaaaagagagaaaattcaggaaaaattgttaaagagtcatcatctctgaagtgcctgctgtgtgctagacccttctcatgtgttatccctaat

SEQ ID NO: 54605 - DNA, 996 bp, Bovine  19866881105411
ataataagtgcttctgggagctgggaatactctgttttctgatctggtgacatgagtgtgttctgtttgtgaaaaatctaacaagtttatacttatgacctgtacactattctaaatgtatatcacatttcaatagaagtttaaaaagctgcatgctagaaaaatacatgaactgctttaaattcaatctcataatagcctcgttcacaatttaccaaccatggaaaacataagctgtcttacagagatataatttttagtggtgcagactgtaacacaactgaagtatttattgtttatttaggaagtttaagaaaagaaaactaagtatacccactgctatatatcttctcctcaataaggcaacctctggcagggctggacttctgcgtgttccggttttggtgatttaggggtttgcttctggaaatactgatgatgtggcaagcaaagaaatatgagatgatcttaccctgacatgtttctgagaagacaaaattcacattttgaagagagcttcctaaagggggcagaggttggaaggaggccttctcatgggatatagcccttgatttcagagtaattttctcctctaaattattcagcctttataactacagctcctgccgtaattatatttcaaaagctacctttagtaaagataatagacactttcagtttgaattaaatcaggaaaatgtagtacacactgggcttcattttccctgcatacatatatttatgaaaatttctcaaatgccctttagggggtcatatttttgtttagtgaatacacacataaaaatttacaactgtatgaataccaaaaaaacacaaacttaacacatgtagaagtaaatttaaaatgtaattagatgcagagaagataaactcatagtaggaatttctaaaaagaataactacatataatatacacatacacatgcaacataaactcacacacacttttatttcaatgagctttgctataactag

SEQ ID NO: 54606 - DNA, 1346 bp, Bovine  19866881123488
acttattcatattttggaatttctaaaatgcttatttgaattttacaggttattgcctggtatgatagtggttcaactcacataaatcatttctttttgcacttctcaggacactggcttgagtagcttttaacaactgttcaattgtgtatgtatatataatttttttttctgtagaatatatttttaaaggaaatctatggttcatgataaaaatagctgtactgatttcatatctaatttagtttaaaatgttcctggattgtgacagtctgatgttaagtacatcgtctaatcttatatataagaagaatataatgcctttaaatacacaatgattttcaggtaaacaatatgtttttctcagccactgctttcagacttttatggcatttgaactggcattctgttattgaaatgtcagataaaaatagtaacgctacctctatccaagcttaataaaccaacacaatttcctccttttgcttcatttatatgcagtaataagtgttgacattgagatgcgtgtaggagaaaaggattcctaagagagacatgtttatctttttcctttcccattaaagatatccttgataaatgtcccgaaagtaagtttgtttaaagcattataagaatgtgatgatgttcttgcacctgagttaaggtattcagtgtatatataattaaagataaaataaaactactcaggaaattatggcaggtgtggcttgtgttaatgacacttgaaaaataatgcctttaaaattaaactttttaatgtaagagtagcttgttttgcattaaaacatgtgaattcatactcagatttaagtattgggatattatcttattcaaaagataaaacaaagctaagcttatttaattttctctgaaatagaacaaaacccggctatttcctataaattcaagaccttgttgagcaagtcatttcaagtttattgcatttgcctgtttgttttgaggtcaattagatcctaatgactcatgaactagaaaaggtacaggtataattttaagggcatctaatggtctaatggtctatggagaaggaaatggcaccccactccagtgttcttgcctggagaatcccagggacggggcagcctggtgggctgtcgtctatggggtcgcacagagttggacatgactgaagtgacttagcaatggtctgtgggattaattttttttcatctgacaagaaagtattgttattttagtctaatatgaagttgcagcatctgtttttatccaattaaatgttttatttgtgaattttttaactcctcatgcttagagtctgcatcccaacctctaaattccatctc

SEQ ID NO: 54607 - DNA, 822 bp, Bovine  19866881160667
aatatgatcttaatgtttcctccaaaccctcatttctacagagagaatggctacgcaatctgctccttaacattaaaaaaaagagaagtactattatgtattttttaggaatataattcatgattgagaaccatttaaagagttttgttgacaccaaagacatgggggagaacatttcagaaccaagcactaaacggccttgataatttaccttatatggcttgccattgacaagggcagacagcgttgagcggggaattttgccagatctggttttgggtaactgtttgacaaacaccgctttccgaaaagcagccacagggccaatggtctgtctaacgtgtttcacaatttcttctaaaacgtgttcctctgttgtatttatatctagggagaaagttcagatggtaagctctgcattaaccttaatcattcagggcccaaacagggaagacaaagacagcttaccttttttcaacacgcagagggctaatgggatatgacctttcaaagaatcttccttcccaacaacagcacagtcagccacaatgccaagggaaaggatagactgtaatttaaaaaagcgttcatttagatgtttatacacgtatatatgcagtatatataatttcaactcggaaaaacagtacgtgacagagaacttaaaaacccagagctgcctctgtgaaaatgactatcaattcactattcatatctttatgactgaggtgaatgggttaagatcccaaagtcactaaagactggcagtaattaagacaaattgcttagcttaccggaaagtaagggaagacttcttcatct

SEQ ID NO: 54608 - DNA, 1279 bp, Bovine  19866881182219
tcttatcctctgacaccctcttttccttctgccctcaatctttcccagcatcagggacttttccaatgagttggctgtacgcatcaagtgaccaaaatactggagcttcagcttcagcatcagtccttacaatgaatattcagggttgatctcccttaagattgactggtcttatcttcttgatgtccatccaaggagtggaataggcaaatcaaagcatttttccagttcctcttctgtctctgacctgcatatcttgggtcataatttagctttctctggtagttcagacagtaaagaacctgcctgcaatgcaggagacctagtttcgatctctgggtcaggaagatcccttggagaagggaatagcaacccacttcagtattcttgcctagagaatcccacggacagaggagcctgttgggctacagtccacagggtcacaaagagtcggcacactgagtgacgaacacttttgcttttgctttagcataaagtcctctgtgagttttctcaggatacagtcatgtgtctgttgtcactgccatagcattcaaaaaactaagatcatggcatccgatcccatcccatcatggcaaatagatggggaaacaatgagaacagtgacagactttattttcttcggctctaaaaatcactgcagatggtgacttcagccatgaaattaaaagactcttgctcctaggaagaaaatctatgacaaacttagacagcatatttaaaagcagagacatcactttgctgacaaatgtccatatagtccaagctatgaatttgagcaagctccaggagttggtgatggccagggaagcctggcatgtggcagtccatggggtagcagatcggacacaactgagtgactgaactgaacccgatttattctgcacacttaaacattatatcctgttgggtacagttttccttcctgattcacgttattggcctcttatcacagcagataccattttcacattgaccctggggctatctgaaacttaatgcttttacttgaagcttctggaccattccacctatcagtctcttttcttagcagcccaggaagatccatttctcctttcttcaaggtaattaataaagtataatggggagtataacccttcaggaaactacactaccacacacacagaggtacatgcacacgtatttaacaaaatttcaatttcctgtgattttatagataaattccatataatttaagtggcttaaaaggcactaatattaggttgctgcaaaagta

SEQ ID NO: 54609 - DNA, 1123 bp, Bovine  19866881207837
tctttactattcgttcgattagctgaaatgactcatatgacaatgacagtatatacctaattgatccaaaaatgtacagttcattttcctgataaatgcataatttaaaaagtagaagttgattttacaaatctggcagacttgtaagtaccctggtaaatttcaagtctacttagccaatatcctagaattttgggatcctttatgagatttcacattgtcttaattcaatcagaaaaaaagattttaagcccgaaactttatttgaattttacccaaaataagcacatagagattatccagtgcctttgaatggtgctatactaatcggaaatgacatcttcccaaaattttgttcaggcgtttcctgtcacaggggactctggttgtgtaacaaggacaggatgggaacagctgccttaagggatttcttttttagacaacagtaaggaaggatatttctccctggtggcttggccacctgtcatgtggaccctgtggaaattctccattgtgatttcattttttccttaaagttactaaataatttgtacaaaatatttattttgttcaaccttatgaaagttctgtgtgttaagaaaccactaggaaatataaaccaattataaaaataaatagaaacgttaatagttaacggcatagtttttaaaattataatcatctttcacttttatagtttcacaactaatgcttctgctttttataacagaataattataattagttttgaaactataaaactgaacaaaatattgtctgttccttttggaaaatttaagtatattcagaatcattttaattcacttacaacaaatgatgtaactaacatggtaattttaaaaatgatggagattctgaagactgtgatatgtaacttaaaccaatagttctatgcctccctactgagttcctccagaattaaaacaagaaaaaaaaatacaatatgccatcccattaccatcagggatcagaaggcatttaatcctctgtaggaaagtgatccagcattaccctccttgagggtcctcgcatccttgccacatcatttgggaagtagagtgctagagaactttcttaatgtgtacttctcattagaatagcc

SEQ ID NO: 54610 - DNA, 1012 bp, Bovine  19866881259787
tcatatgcacatagattctatacgtaactaaacacaccttaaacattcattaggtctggatgtgcctgaacatttacatattaaaatatgtgctatatattactgcatttattttcttttacatttctggagaaagaaatggcaactcactccagtattcttgcctggaaaatccaatggacagaggaacctggtgggctacagtccaagggatcgcaagagttggacatgacttagcaaataaaccaccacaacatttcttttatacttcagttagagtgttacattgactttttaaaaatttagatgaattatattttgtaagagtttcacttaaggagataaaaaagagcatcacaatggaaagcactggatttattataagtcaggattggttcacgactggttcaggagcttctggtcttcttttttcctgcagtatagagacagcaggctgtgactcctcagtgtctcatcatgccctaagcctggcagtgataagtgtggcagatgctgggggtgggtgttctggaagggaaaagaaaataatattttccagtatctagattttggtgttggcagtaaaattatttgtccatgacaatctgcatttatcttctgtggaaactgtgttcaatttatggaactatgctcactttaactacaaacctaagttatattgtataagtttcactggcatttcattttattaccaaaaaatgtattgatcaataatatattttgaatgatttaaaatccaggtatcaagagtctacttctgagtctcagtctaaaacaaagttacacactcttcactttatggtaactgttaactggctgactaagaaatggatgtaatgtatttaatgaaagagacaacaaaattatagaaagaatgaagagaatagcaaatttgagctatatttcaccataatttgttctggaacaaatttaaaattctttgacaaatgatgtaaattccatgtgactaatattttaataggaaaacagg

SEQ ID NO: 54611 - DNA, 1025 bp, Bovine  19866881310718
cagcaaagcttcctgtgacatttgccaagagaccaggtgtgctgctggtagatagaaagtattccacagcttgatacctatgttttattagtggtacctgaggaaagtagcaattttagtaacaaacaggaagtcagcttctttttcattctcctgatgcatgcatgtgtgttatagttacagagctgtgccaaaatagttcaaccagtagcacgaacattaattacagccatgtgtggcctttcaggtaaaataattattttcttcactgagtgattatagttgctctactaagagatgtttgaaaatacttgtgagtgaactataacatatttcttagcaagcattcactttctcgttctgaatattcacatcattaagtcattgtgagccaataatgactaatgtttataatgaagcaataaatgaaattagttattaaatttgctgtcagttcttgtctgtgatgactcttgcacttagttttcaaatattaatcttgtattaacattgaatacattcactctcaagaatatctgctcacaaactgattcatgaacgctatggtgctatgctgtaaccatcaaatctgtcagccttagatctaactcatcagaagtgagatctaaagaactgctcggctctactactgtgatagcatggtccttcaggttagcattttaataagactctagttagaatatgactgtttcctctaggcatcctattattatttaatactattaaggaataaatatccttatggtggtctgtgtcgtaggcacacagctatctttgatctttctgtggacttaattttgaaggttttcatttttgttctggaaatatgtgttaaaatgcagtgttgataattgatgttacccctggaaatttttctttttattgcatgtgattctgtgaaatcatattttctttagaaagtccagaatggtctgtgagaatgaattctacaaatggactggtatgaacaaattattctgtgtttgttattggaggtgtcaaag

SEQ ID NO: 54612 - DNA, 1059 bp, Bovine  19866881321014
ctttattcatagagacttacttcttttaacatcaggggtaaattagtgtcacagactccaataattatcttaaaagatgcctggccttccctgctctatggaaagtggtccagtaatctcacagctctagcctggaatgtatattttcaatgttttatttaggaatggagcaaaatgttttctttttatttgacaaaagattcttggctttccagaagataagtgttaatatgcttggttgcacttgggtcagaaatttcaatgtttatttttctaagtaaaggattgctatatcttagcaaagtgtgacagaagacgctcattcatggctggattttcttgtagcaatattagggcataagaaggaggctgtggtccctagattccaggtttgctgatcttattgtggttactgttggaaacagctgccattttggcgggagagatttagagctgaaaattcgtgatgtttccagtgctaaaagggtgtctgtgaggggaagggagttgaaaaggagaaagccttgtcagtgtatccacagggaagacctgcaacaactggaaagcctgcaaaactcttttaaaggttacttctacttagatttaaatgaaaaaaggattcaaatgtcattctttgcggacagaagcctccttgctgatgccagcctttccaaaactaacatcacttgacctgaggataaaggctttgctagaacctgattcaacctgaagtgtcttagagaaagctcaggtgtcagaagtcctactctgccctgatgaagagtttaacccactgctgttgaaactgatctgaactgaagctttgagcacttgctgctatgagaacagacactaatggattggaaattaaaaatgacctaaatatttgtaaaagatgagtccaaattttccctttttctaaacaaataaagcagtcttcttattgaagcatactttaagtagacacaaagttttcctattttatatgaattgtttaatttggaattattatattttccaggaaagattaattaaaaaaaaaaaagtcatagtatcgtt

SEQ ID NO: 54613 - DNA, 2703 bp, Bovine  19866881353746
ctggattaggggtacctggccttgggacaggactaacctgaaagggaaagcttatgttgatgaaactgttggtcaaaacctcattgtaatactttgcctacctgcttacttctaaactcatccaagaacaagatcaggaggtttgggagggcagcaggaacctgtttctccctccatccgactcctccacccctcaagttagtagctttctgccctcccacccccatcttagagggtatccggcttctttactttatgctggttatttaactactccacctgccatgtatgacttaccaaatgcagatttgaaaaatttgaaccagcttttacctgttgaaagtgtttaattcagggcactcttggtgggtggctttctccagggcttatacatttcctcttgctgcaaatccctttcctcttttgcgctcctctcttcctggattatttagttgtctcttcatttgtcttttcccactcccctttccatcccttatcttccaatttattttacatccggagcgaactgtgatgctacctcaattgttaaaacgatcagtcaaataaagtgctctgtgcagcaaaaatggaaaacaaaggaagaagaaatgaatacgtaaaagaggaccctgaatttaagatcagatcccagactctgccagcaatttgactgcaaccttgtgagcccttgccctgggtagagcacccatataaatcatgcctagactttgtactatggaacatgagataattagtgggtgtcattttaattccccaaatttttggtaatttgttatgcagtaatagaaacccaaactaaaatttctaaatcacacccaaattaatctatacatttaacaaaattccaataataatcctagcagctttttaaaaaattaaaattaacaagctaattctaaaactttattaagaaaatgcaaaaaaatgagtcaagtaaatcttgaaaaagaataaagctggattacttatattcttagacatcaatacataaatctacagaaatattggtgcaaggatagacatgcaaattaaaaacacacaacagagagttctcagattcacatgtgtgtgctcattgaaatcccaggtggctcagcggtaaaggacacacctaccaatgcaggagactcaagagacatgggttccatccctaggtcaggaagatcctctggagaagaaaatggcaacccagtccagtatctttgcctggaaaataccatggagagaggagcctggtgggttgcaatgcatggggtcacaaagagttgcacgactcaatgttcatgtttggtgataagaacgtcactgaagtttgttgtacaaaaatagtcttttcaataaatggtgctgggtcaactgaatattcgcaaataacatggataaacctttacccataaaaatttaatttgagatggatcatagatataattataaaatgatcataataaacctttcaagacaaaatataggcagtcttcaagtgcttgaggtactcaaagatccctgaaacagttcacaaaaaccaaatgatgaaagaaaaaaaaaatgataagttggttttgatgaaattaagaatacctgttacacaaaggacatcgttttgagggtggagagctaacccactggtggaacaagataactgcctcacatacatccatcagaaaacttgtcttcagaatatgtatacctcttattcagtagaaatcaatcaataagattaagaaaatcaatcaataagaaaaccacagatcacgattttataaatggggaaaaggtaaaggcttacaaagagaggagatccaagtgaccaaaaacatgaaatatgttcattatcattagtcatcagcaaaatgcaaattaaaaatatagtgaggtatcactgcacagaaattggaattgttaaaattagaagattaataatatcaaatgttgccttctttaaaaaaacttggatatgagatgaacttcagattcttgatttgagattcagtttaaattgctaattcaggctcttttagggtcttattaaaatttatttatttttaattggaggataactgctttataatattatgttggtttctgccgtacatcaacatcaatcagccatagatatatgtatgtcctctctctcttgaaacttcctcccacctgccacctagggttgtcacagagcaccaggtttgagctccctgcatcatacagtaaatttccactgggtatctaattttatacatgttagagtgtatatttcaatgctactttctcaatttgtccccccctctgcttccccagctgtgttcgtaagtctgtgttctatgtctaatgcagggttttattctttcttttactgcacacgttaatattcccagggaacattacagttactaactagtacgctttttggaagaaagtctgtggttcttcatgttaacaaagaaaactatggtattcttcagtacagtggggagaaagcacaaacaagacaagaagagaggggttcatagaaagttgcgaacagaactcagttatagcatatattactctctatgaaatgatgtgaagaagcttctagagacatcatgtccagggaactgattattgcacttctgtgttttgtttgcctttatagtctttcctcaattcttttcttgtagaaataactaaaaaataataagtata

SEQ ID NO: 54614 - DNA, 1085 bp, Bovine  19866881360285
tgtatcctttgtaatttaatttttatctgaatcattatttttgcaatatcttcctacttagaaagtacgtcccatttcattccagcaatgagcataatgacagtttacatagcaggtttgtattaatatttgttgagtgaatcagtaaatagaaagtacttgtcattgtgttttagtggaacagaaaacagctttcttttcctcctctttttgcatttattcttttcttcccttttaaaaaataactttatttatttacttatttttgtctgctaggtctgcattgctgctcaggcttttccccagttgtggcaagtgagggctgttctctggtttcagggtgggcttctcactgccgtggcttctcactgcagtggcttctcgtgtggagtatgggccgtagggcacatgggctttggtagttacaccctggggctctagagcacacgctcaatatttgtggcaaatggcatacgggatcttctcagatcagggatcaaacccatgtctcatcaccacagtaagcctaacatccatccgcatacatggttgcaatcattttttcctagtgatgagaacttttaagatctattctcttggcacggcattcttaaagtgcttattttttccacttaaaaaaaatccaagttggaagcagcatgttatattaagagattctgcatgtaatatgggcatcttaaatttaccatgaaactgaattttttgccttagagatgcagaagctagaataatggatattataattcatgctcagtgatgcttcagacaacaaatgtgacctgttgtttgtctgagtatctaaaatctatacattactttttggaaaagcacagcttactaagaaataaatgtgagtggaatttgactcatccatagttcttataataagttttgggatttttatagaacataaccacaatgcctgtgggtatgagtcatgaaatgcctgaattgaatatgctcacattcaatcaaagaattttgacaactctgttgacacttcaatgcttccactcgatgtttttagattataatatgtattcgggtgactagcatccacattc

SEQ ID NO: 54615 - DNA, 4013 bp, Bovine  19866881411330
tggtaaagacgtggtttcagttcctgggttgggaagctcccctgcaggaggaaatagcaactcactgggctattcttgcctggagaatcccatgggcagaggaacctggcagccacagtccatagcatcacaaagagtcagacacacacacaaaaaccgacttaacaggcatgagataagtcaattttaatgtatcataccttctgaacataaagacacatagagttacatcaaatgtcgcctttattgtgttttatgtataggatccacagtagagagtcaatgcatatttcttggatgaagttaaatgtatacctaggagaatacatgtccattttggagggaggtgtaggcagtggaatcaaaggaaaaatataacctgcaatagattattttgagtcagtgaaatagctagctttaaatatcttgaataatggatgcttgcagcccagttcacattgcttatatattcaagtctacagatttaatattttccaaaagtcatgatggatcaaatatctgaaagaagctatatttttggtgttttccttaatgcatgacaattattcgcttagagaaatgtattctctgattatgtttggttggaatgagaaccactgaaaaaatcaattcttgctgttttctttacatattgataacaacctatagtgtaaattttatgttacaaagtcaagcagtcctggatataatttatcttcttcagaagataaaaaattgataaatatataaaatgtgaagttttaacaacatctattaacattaaaatttttttcatttggatgtctcatcactacttaaaatacttcagttaataaaatagccatattgagtgcttactgatacatatattgctcttgcagaagcttgcaatatattgcttctgttccaagaattcatgattagtaaagattaaaataaacctccattcactcaattagatgattaatatctcaaattaccactcaccagagttactgcattaagcagtatttaataaggactgttatctagggtgtgcagaagtctcaaaactcactttgatcttttgttaatgatcattaagccacattttccttcatgtgactccttaaatttgtaagggtcaacaatacattgttttccattaactaatcatttagttatactctagcaatccatctatgaatatttagcaccatccttatttaaaaaatatatatactatagattttggatttatgtcattctctaacattaaacacaaagtagggcattatataataaaaagaagttttctgctattatcttttatatgatgcttaggtaatttgacactaacccatctgggctccctcctgaaaggcactgtgagccctgctcggtcgccttagtcctgcctgactctctgtggccccatgaatggtagcctgccaggtttttctgttcatgggattttccaggcaagaatcctggagtgggttgccatgtcctcctccaagggatcttcctgacccagggattgaactcgcagctcctgcatctgtctcctacactgcaggggattcttttaccactcagccactgctacagggggaagacccaaaagcactataccggcttctcattgtgcacacaacagaatgcagattcccgctctgggccaccagacactgcatggtgtgaatgctgaccacctactatccccgtcctttcatacactcactgtcatcccttctgtcccaaaacactaactcttagaatatgctttgcttttcccaccaaagaaataggaaagcatgctgaccccctttcttacagctattctcttaattgactgcttcttatctttcagatctcagacacttttttctgtcttgctatgtgttatcctgccaaacttgtcaaagtacctggcacgtagcaggtaaccaaaaaatattcgtggaaggaaggaaagaaagaaatcagaaaggaaaaggggaagaaagcagcagttgccttttgtactgtgagaggttacaaaatacacaaaatcagataattccattctttaaataacccatcataaatgttattatgataatctctaaatagcattttgttgtgatatgcttctacagctaaagactgtgtagcttttaggaacatgttaattacaaaaagacttgaaacatttttttttttaatagactacctcatgcaatttgacatactatagatctctggaaggttcactagagtaatgaaagcaacatcactgtcagcaatcaaagttaggtgcatgtaagtgtacaaatataggctctccttttgcatccttatgtaatatgagcctctataattaggtaatcagtttaagtagtttcctctaatttaattttcttcttcatttcctattaacagattgtcatggttgacttacctgatgtaattaatagcttgggaactacattatgactgctgaaaggcatcattaaaatgaatctttaaatattttcaagctatttaatttcctttcttaaagacaaattgaagagagtagaatcaatttgaaaagaataagagtttcagtacaacattaatatatctatagttattttaattgaccaatctgagaattcattcatttagttatctcacatatttttaatctttagacattatattgttactttgtgtgcttagtcactcagttgtgcccaactctttgtgaccccatggactgtagcccaccaggcttctcagtccatagggattctccaggcaagaatgctgaagtgggttgctatgccttcctccaggggatcttcccaatccagggattgaatccaggtctcctgcattgcaggcagattctttaccatctgagccaccagggaagcccatgaatactggaatgggtagcctatcccttttccagtggatcttcccaacccaggaatcaaaccagggtcttctgtattacaggtgtattctttaccagctgagctacgaggcaagcccattgttactttatttgaagtaattatcatcaaaaaggtggcaaattttataagggaaaataaaagaggaaaatttttaaattttatattttgaaaattttaattttatatgaaattttaaatttcataaaatataaataaaacatcaagataactttgtatttcttaagtattattgactttacaaaatggccttttccacttacctttaatggatataccaaatacaattgtaagggcttacttcatcttagaattgcggttctttatgacttatttattcaaaaaagtatttgagcacctaccatctgacagccactgttctagttaaattaaagaatcattataagataactatgtcatttatttactcagaaaatattatttgagttcttattacatcccagacattactgtacaatctggagcagcagcagtgaataaaacagtctttggcctcatggcaattgcagtcaagtgaaaaaagaaaaaaaagatagatggctacacaggtgttagggaaaattatacatcaggaaaagtggtttagaaagtgcttgagaagacaaggagatgcttggaaaggtgtagatgtctgcacaattttaattatgaattacagtatctaagatggatgttacggatgtaaggacttgagatagaatgaagagatgatatgtagtagattcaggcccttctcactttggagaattactgattcttgggtatttaagggaatagttagaaatctagaggatggtatatagaaatgaggtatttataatttagattatgatattagggtatagctattgatgttagcagtgggcttccctgatagctcagttgttaaagaatatgcctgcaatgtgggagacctagtttcaatctctgggtgggaagatcccctggagaagggaaaggctacccactccagtattctggcttggagaattctaaggacagtccatgggggtcacaaagagtcggacatgccctgagtgactttca

SEQ ID NO: 54616 - DNA, 1231 bp, Bovine  19866881621083
ctatggaatagcaattcattatagtccttaaatgtattaaattatttttaaaatgtacggctgttaaagaagttttagttgaccctaagatcctagaatggtcaatatttctttctaacttaaaatactctaatatcttaactgaaagaaaaaccaaatccaatctgtatactgttctaggctggaagcattctcagcaggaattgtacctctgactttcaccctatcattagagctttacttaatttgcctgatctgtgatcatgattttggcttgcaattagacagatggcattcaattgcacatttaatgttacatcttctaatactgcaatacaaaaatagttatcatgggctgcatatccattttctgtagacacccaggaaaaataactttcacatttcctcttttatcatctacttctgtgcagccagaaggttgcatgtcacgccttaccatctgttgatgtattgcttattaatatatttttgttttaaatcagggaattaatggaaaattctagataataagattctatttaatagcaatttattatcttttttaagaaattaaaatatatctaagactaaaacttcacgaagtattattgacttttttttggtgtttcagaaggatcatcagtattttaagattacttgtattaaaaaaatcttagataaatcccactaagtagaaaatggtaagaattagaggaggatgattcttatttttatgccactgtgttcagcttcccagacataaatgtttacatccttctattgaatgcaatgataataatttgcaattatcaacttaccaattacctttttagtaatatgagccttagaatagccttcaactttccagttcccatgaacaaaatacagattcatttctacctgtgtagttaccatgacacctccatagatgttgttgttcttgtgggaaaaaacctctattcccctgagaaggcttacattcatgtccagttacagaaacaaagtcctaatttaatttattcttttgtgcttcacactgctcttacatttgcaaagcttaaattgctttggtaaggctttgtgttcctgaggttagatgacaggatacccagtttcttttgatattttctcctgttttcatggaactgtatcaaaactaatttgaatgctaaacaaactaaaaccaaactgtgggggtcttgggttctgaaaactgacagaattctcttga

SEQ ID NO: 54617 - DNA, 898 bp, Bovine  19866881787779
tatttgtggtcccatagactgtaaccttccggctcgtctgtccatggaattttccaggcaaggatactggagcaggctgtcatttccccctcctccaggggaattttagtgacccagggatcaagtccacatctcctctgtctcctgcattggcaggagtgttccttatcactagcgccacccaagaagcccccataaaaccttatggatggaaaaacctgaatgaactttttggccaatccaatgttaatatttttcttgtgttgggatagtaattgtgatcttttccttattatgactggaaagaatctgtgatgacccagattctttatgttactgattatcactgtttttgtcactattaaacaacggtatcttttgaagagcacatagaagttagaatacagatctattccatggaaaaagtcagctcagtgtattaatgagcaagccatacatttttcaaaaaggactgctgacattttctctgaatacctttgtttgtattatggccatactttccatgaagttgagcaaatcttatttttgaagcttgcctgcacaaaattagagaggagcaaatattaattacatacagctattagttggccccaagataatcccctactcattatctcttaggacaaaagtgggcaagatgcatggaactgcaccaaaaatagcagagggagagtttccagtctggggtctttccgtaaactaacgctgtccattacacattttagatgtcgtcttttcagtctactctacctaaagtgcactaccatccaagaagacaagcagtgaaaacctttgtgaagactggattccaaggaaataaccacaagtaatgcttcactaactgaaaatgtgattctggggggagtcagatattaag

SEQ ID NO: 54618 - DNA, 1536 bp, Bovine  19866881034566
taaagcaaataatctcctgctcacatatgcctcaagtccaaaacacacttaggtttccattttaaaccagctcacatgaatttgccccatgttccataccaaggggaactttacttagtggctgtttgacaaatgaatgagtgagtgaatgaatggttgaacaatgccaggtataaggaagagatagatggctttcttatggctccagcttcatgtgatgttcttaaattcctccgtacaattagtttcgtgaaccatcaggcagcataaatcttgattggtactaagagaatctgaattactgaaaaatcatctcttcctacaaagttttattagaagtgtgacacttctaataaaggtgtttctgttaattgagcactgagtgagggaaatgcacacagatgcagagaactcaccaggcgagcaggcaagacctggcttctgcacccagtctcatcgctgtcctgggtctctgtccccacccagcgccctgagctctgccggctgtaaggaagaccctgccagcttctcctgtgatcaggctgctgtctcttttctccacccacggtaagccccacccttcaatgtctgggctgcagtctcttctcaccccattcaaaaactgcacagtagcatcgttaagtaagtagtgctgcatgaagacagacacatgtcagtgtcctcagatgtcacgcgctggggcaccacatggttcattccatgtgatctatttctctgacataagcccatctttactatattgacagtatataacttcagtttgctaattgattaagctgtactttctatatgaaaatgtataaaggggggaatatggtggtgtgaatgagctctcttggacacctgaagatgtagcttccaaatttgaactgattaaatggcatctgtatacaaaaaaaaacaaaaacaaaaacaaaaaaccacacacacagtagatggtcctgcttactctgccagcaataaaggaagccacagccgtctgatttcctgggtgcctggcattgtgcttgtcttcccttatgactctctttctggtcaccctttacattccacaaaaacatcccctcctgctgagtcccctgctcagtccgacaccttgtgtatgacacccctgtgttacaggatgctgttctcaactgcattttctggcccttccctaacactgttcaaaaaagtaatgggttggagatttgtgtccagtcctcaaagaacttcccttaaaaagctgcagtaggagaaagcctcattcagtggtgaaaatgatgactagcttggatgatgaccaattcagataattggccatagacctctaatcttgctggcatccctctgtcactcagcagggaaccggccgatcattccatcaatacatttattttgtcagctgtctctgtgtggcgcccacacgtctcagctgggtaacttaggctgagaagtggaaacctgccaatatcagcatcatttcatccctatcacgtgcctttcttgtcatatggatttttcaatgcatttctg

SEQ ID NO: 54619 - DNA, 1306 bp, Bovine  19866881578369
caaatggttcctgcacacaggacgtataattatgtcaggaataagcttcactgcccagcccacgggcctactctctcttctcctgcgcctgccccagcacagcgtttctggctttacgattgccctccagagtctgacaactgttgcagcattgtcaactatggatgacccccagcatctcttgactctgaaaatgtgtattagctattgtttacagcccctggacttctttcctttgtattgtcctgttcctctttgtctattatttatcttttttaattcacttccatgactctgatatttggctgatctttatgaaactgacttttatatctgcaacagtttatttctatgatcattatggtataatgatcattaccatataccataatgatcatacattaccttctactacagttcttgctatcctcagagtcgttgtgcttcttcaaaatcctgcgggatttagctctgtataccctacaggtttgttgcatggaattatattttgttgttgctaattttttatgtctagagctttaaagatgttaggaagatagcactgtataagttaagaacaaaagttcaaataagccaagcagcatattttaatttaatgctgggttactcaagatgccaagatattatctctagctaagatgtctgtctcaaagctcctgattcacatagacaactacctactatacacccctaattaaatgtctaagaattatctgaaaattaatatgcccataaactaaagaaacccctgatttctctcttcatctgtttctcttttaaacaccatttattcaaaatagaagtcatcttgatttttctcctctcatctcctccccatacccaattcatgaaggtctatttaattccaatataagttttcaaattaatccacttaactctaactccatttcccctataatgtgctacatgtagtccagagaatccccttaaatgctctccttagattaactcttgcttctcaacaacctgcaactccccaccctcatagtctcattttatctaaatggggctgtccctgccacactactttgtttctgagaatcctgcttgtttttagtacttatcaagaaaatgacttgaagtaacacagcattaatatcataactgatagaacctcataaattgttacaaaaattgttagcttgacttaaaaaaaatctgccacactgcttgcttttaagtccactgaaggcaggagccatttgtatccttggatcacctttttactccagctttactgggatataattgacagataacattg

SEQ ID NO: 54620 - DNA, 788 bp, Bovine  19866880388738
accctccaaagagaccttctagaagtagccttcaaggtgttcaataatagagaggaggaggctgagagagaaaaagaacgtgacagaaaagctaaatatgcctttttggcagcagcaattaaaggaagagatcagcctggcccaagtcatcccagaacagggcttaagacctgccctccctacccgggccctgcttcctatgcaaccagtcaggacactgggcaaaggcatgcccaaacccacagccccccacaaaaccatgcccaacctgtggccagtggggacactggaagatggactgtccccacctcccagacctggagagtggaatgtccacagggacaccctggtgcctctggggaaattcccacttctccacagaaccccagcccaaccctacaagagttgttccaatgatggggcccgggttccagccccctggccctgtcccaaacacgagctcagaacttagggtagatggggtagtggccagaaaaaagacctcttttatagtagacactggagccactttctcttaatttcctactctggcccaactcaagactcagaactcacaatcaagggggtctctggagttcccgtaaggccaaaaatcagccctccattattctgtcaatttggaaaatcgacccttatacacttattcctcataatgcctcagtgcccgatggcactcctagggagacatttgttatccaaattgggggtctttattaccataccccctgccctcgatacagtctctatattctgcattcagatgacac

SEQ ID NO: 54621 - DNA, 807 bp, Bovine  19866880460865
tggttctggtgggtgcctgggtacctagtgggcgctaactggatagtggctattttctccctcctgccggctgtgttcctctctaccaagggacagcagtactgccagactggccaggatgtgccccgggcatcaccgatgcagagacaggggtgattggcaggtggatgctttaccactgagccaccctccctcaaaagatgagggctggaacgagagaccaggatcaagataaggaaagagagtggcctataggaaaagtgtgagaaaaatacaggagagatgatctcctgtgtgctggggggggaacagacagcccttggctctgggtcagtgaactcagaggaaaagccctcactgctacccctttaaatacgctaaccccataaactgtgtttactatcagaaccccgtgtgctttcttatagtttagagcctgtgttcaattctttggcctttagatggaagggaccctccgctttcgattgttttttgcttcttggccttgaactgaagaaccagtaataagatgcagtcatatttttctagcccctttactgtcaggcagccaagctctggtgtcgggcctctggttaacgtcccggagatgacggcccacttcacccaggccatatcccgcaccatttatctttgggtttatctgacctctcagaagctactaagctacctgcctatttttaacctgtgcctggagccagctccagaatgaagtggccacatgagccacgatgaggtggtgaccacacagccttccaaatcttcactccactttctcgggcttttctt

SEQ ID NO: 54622 - DNA, 974 bp, Bovine  19866880491909
ctgagagttttctcttcccttgttggccatgctacacagcttgagggatcttagttccctgactaggacttgaaccacagcccccagcagtagaagaccggagtcctaaccacggaccaccacgggatttcctctgagagtgttttaaaatcacacactgacacaatgacgcttaacccacggcaattattattatttaaaaatgtctcccccaaattaatctatttttgcagatctgcagataatttaaaccaccataactttgtctctaccatacagcactctgtatagacctgcttggttcattattgcagcttaaaacaaaaaaacctaaatgaataaaaaaaaattagtgcccaagactccaccttttcacgttgtcagtttcttctttttgctagaggagcccaatgattaaacgtgtacctcactgaattcgcttgctgtttcacaaataaaaggcatggtcttaacagaagccaaaaaactgtttgctatcatgtcacatgagaaaggattaaaacttccaacttcctcgtcatgaggctgttaaaggcaaccgcgggtttaactgagatgaaagttgtgctctaggtcagggggagctggcagggggtaggttgagtttacctgtcagatttttgcctccagactttgagggttgatgtatgggtcaggttttctggtgtctggaagcttgaggccccttcacagagtttctggaccactggtacccttcactctcctggaaaggccctagaaagacagcttgcccacaaggcccccttgtctgtggtgaccctcgcatatccgaggtgcccctttcttcggaggacagagcatctctccttggttggcatgccctccagcctggtgttcggggccatggactggaccagggcccctgggacagagtctctctccctaacacactctgctgggcgtgtgtcccaaggcgggctcggccagcatcg

SEQ ID NO: 54623 - DNA, 1877 bp, Bovine  19866880550519
ctggaataaattgagacaaataaataaactcaaaggcaccacatgcgtttggaatgctctttgccacggtttcctaacatgcttgcagacagctaactctcaaggcaaacagaaagtggcagtgtttacccagcttctatttggagcgtgctaggagcccctgacgcgtagatcgctagctgatggcggaatttgcacacaaattcggaattaatcatcacagtccaccttcccttcccttctctgtattcctcgtttttagtcatccaagctgaacgcagacttgtttggggtacgttggtcctagcttccacctgtctccagaatgcagtacagaggtcatggtgtcctgagagtagggagatgggaagtgagagtgagcccaggttcagggtgcacgcgtgctcagtggtgtcatgaccccatggactgtaggcctccaggtgaccccatggactgtaagccgccaggctcctctgtccatgggattctccaggcaagaatgctggagcgggttgccgtttactactccagtgagcccagcccctttgatgaaaagagcagaccagcaccagccgggcagtctcagtttgctcagctccaggggtgagctgtctggggacactttcttctcctgtgctctagtgaaagaggcagatgtccccgggcccttgtaaggctctaaaatgaatctcttatcttttgaaactttcctctgtagaacttgctcccatgggcagccacatggctctggattcaccagcacctggagccctcccctctcctccaagggaacatcttgtcctcttctacctttgggagaatccacgtgggctctgctcctgcctggtcaggcacagctgtgacagcctcaagaccaccgctcccagcgtgaatatgacgcttcagtggtgctgagatgaaagcccctgacaagaaggggcctcatagctaaagattgaatcttatccatgtctgaagattgacagaaagactcctaattttaaatatatacatttagagggactctcctggtggttcagtggttaagaatccaccttgcaatgcaggggacacaggtttgatcgctggtgggggaattaatatcccacatgcctgggggcaactaagccagcgtgctgcaactattgaaccaactcaaatagagtccgcgcaccgcaacaaagatcccacgtgccacagctaagacccaatgcagccaaataaataaataatttctaaatatatatgcggatgtatatctacagatttatagtatgtatttaaaaaaaccagccaggaaatcaagtcaatcctaaaggaaatcaactctgaatattcattggaaggactgatgctgaagttgaagctctaatactttggctacctgatgagaagaggcgactcattggaaaagaccctgatgctgggaaagattgagggtgggagaagagagcaacagaggatgagatggttggatgcaatcattggctcagtggacatgagtttgagcgcactccaaagtgtgctgagcacactctccctgcctgtaacagctccctagttccccaggagatggtgaaggacagagaaacctggcatgctgcagtccatggcatcttaaacagctggacacaacttaccagctgaacaacaacaaatacacatttataaatatttataaatagcacctcatactttctgtgattccaatagcttcatacaataaactgcaagctggctgcacccccaacagggctcccacatctaatactccacgggcatctgtctgtgtcttcgctctctttagaccttccttgtcggccgagcacactctcccggcctctacagcaccctagtttcccagtgaggaatca

SEQ ID NO: 54624 - DNA, 1333 bp, Bovine  19866880574563
cttgcatgctaacccaaagtagaagattagcctgcttgcatgcagccggatactgccctacgagacaagcatgtgtgggaggttgacgcggctcagccctcccttggctgaattcctcccatcctgtctgtggcctcattcactgtggtacgtgcgtaataccatcgtcagtttcactaaccccagtgctcattctgcggtttagccatctgctgaaagacgcattcaccgagtcacctaaacctgttgtctttctgatttctttagatattaggttgaaaaagcttgttgatgaacgggaatgcttattggaacaggtaacaatcttttttattacttttcaagttctggaatgggaaacctgaaactgggaccctccccactccagcttcttgcttcatcaggaaacccctaatgcatcatgcctgaagatatcatcaagccaaccagtgttcttaatgtttttatccaagtgagacatcagaagtcatactggacttaggatgtcccagagattcaaggccatgttctgaatttggcacactctacatgaattgctgcttaaataaaagatttgggtaaaagaccttgaataaacattgagaggcaagggtgttcctgagacattccaacacccttcctcatctgcctgcccataaaggtcagttttggggcttccctggtggtccagtcgttaagaatccaccttccaatgcaaggggtgcactatgaatcccgggtcggggaattaaggtcccacatgcaaaaaaaaaaaatttttttttaagtcggttttgtaatctctcagtgatcagcacccctgtccggcagatatttcttgcttatagctgatccaagttattttcagtgctgtttacctaccttgatctcttctgcctcaggaaatccgacacagttgtacgctttggtctttttcatagtgggatagtgaaagctgctcagtcgtgtccaactctttgtggccccatggactatacagtccatgggattctccaggccagaatactagagtgggtagccttcctttctccaggggatcttcccaaccctggggaagacctgggtcaagcccaggtctcccacattccagacagattctttgtcaactgagctaccagggaaaccctttttcatatgcaaggtagtattattaagaaattattccacaatcactttcttaggaaactcgattctcctcattttccctcgtaagcctaatcaaaggtatctgcctcacttttttcaagttttgaagatttctctcaaaattgggtaaaccactaaatgtggtgagaggattctcttgaagtgt

SEQ ID NO: 54625 - DNA, 2234 bp, Bovine  19866880580794
atttttaaactgctgaagtcttgcctattccaaagatgctaacacctctctggctcaccagcccagactttggagagatacctggcaccttgcacaattaagtggctgcacaacttccttctgagaaattagactcttttcctttctaactaaagaccaaaccacagagcccacttgaagcacaactgcactgaaatgtcagattacaaaagccacccatcaccacaatggcccccatacagcatggaccccctcctgctgtgggctgctcacaacacagtgctccagccgctcccacactgcccacccctgggacctgcacagtgtccatggtgggggctgtgcattccgatccagccctgggaccccagcccctgggtctgagctcggcacacacagagtgcttgggagacgcttgacaagcaagcacacttccagcagagcggcagtggttgcagtgtggacaccctgagacatgagaagcctggctcttcacacagctggtgaccaagcagttccaaaggtgtagtggactgaactgagtcccctgcccacgttcatacggtgaagccttaaactcacgtgatggtattagggttaaatgaggtcatgtggggtggggccctcatgataagattagtgcccttatgggaaaagacccaggtgcttacaagccaggaagccctccctaggaactgaatctgccactgccttggccttggccttccccgtgtccaggcccccagccccggctgtggtgttctatcatggcagcctgagctgactaagaccaagcccaatcacagatgcaatggttctgggcagaagccagttccgagccctgtcaggaaacccaggcaggacagctgtgccctctgacccaggcagagctggcagctgctgcccagaagacttgattacctcttcttacctcaatcacccctacttcttaggtttctcaatctaggactttatctcttagcttcctgtctgtctttacgccttgagtgcctcttctgcattgccagcatccacgaacagtgcccttatgggcagacacctgccccaagggcatcatcccacccccagagatggcactgctacagctgaggccaagcgcccaccgagccactcccactcagtctaagggccctccagcagcacagtgcagaaagcaggcccacaggagaggagtcaggctgcgccacactctggggcagcaatgatgaaaccccgaaaaccagcacggagtctgcagcagagactgctctggatgggggtggagccccacaccgtgcgaccacccactctcaacatgagcagacaaagctgactggaaccttcattcctcttgcacagatcctccccacccccactggccccgcctcccccagatctggggctatatggggctatttggcaagcctgagggggctgccacattcccaggcggtttcactggtgtttaaaaccctgtaagaaagtgttaaaggggagccgtgggccaccacctcactccgccttagtagggctcctcctctctgggccactgccctagttttttttttttaacacattttgtaacacacagcccacaacttcacacgctgctaaatgctctggacactctgccagcatggccagccaaccccgagaccacctccagagtcctgggcagggctggcaaggacaagaaagctctggagaacaacaaatgcttctctctcgcccattcttccagggagcgccctggaccagagccctccctacaccaccacagcactggactactcgggtgggcacagacgtgctcaaccagggaggctacacgtggcccctgtggggacgcctgcaccttgggtgtgggaagcccacgcaggtgggcagccaggccccttggttcagcagaccaggccaggagcacagagagccgccacagccacggcaacaacaacaccacggccacgtggggcacagggctgaggggacaaaggctgcagaatcagtccctgtagttcctgactccagacctggccctgaactcagccaactcaactccaaatctccacagttagcaaatgcttccgaccagcctgcctggagcccctagaggtattcagggggtcactaacaagaggctgggacacaccgggcactaagataaatctttgtcaagtgaataagtcagaggacagggagacataccgacatgttcccatcatgtgaaaagtaag

SEQ ID NO: 54626 - DNA, 2212 bp, Bovine  19866880599773
gcagtgccgaagaatgctcagactaccgcacagttgcactcatttcgtatactagcaaggtaatgttcaaaataccgcaagcgaggcttcagaagtatgtgaactgatgacttatagatgttcaagctggatttagaaaaggcagagaaaccagagatcaaattgccagcatctctggaacatctgctttactgactacactaacacctttgactatgtggatcacaacaaactgtagaaaattcttcaagagaagggaattccagccaccttacccgcctcagagaaacgtgtatgcaggtcaagaagtgaccgaaccagacgtggaacaatggacgggctccgaatcgggaaaggagtccgtcaaggctggatattgtcaccctgcttatttaacttctatgcagagtacatcttgtgaaatgccagacgggatgaagcacaagctggaattaagattgctggagaaatagcaatcacctcagatatgcagatgacaccacccttatggcagaaagtgaagaggaactaaagagcctcttgatgaaggtgaaagaggagagtgaaaagcctggcttaaaactcaacattcagaaaactaagatcatgcatctggtcccatcctttcatggcaaatagatggggaaacaatggaaacagtgacagacttattttcctgagctccagtatcacttcagatggtgacagcagccatgaaatcaaaagacacttgctccttggaataaaagctgtgacacacctagacagtgtaataaaaagcagagtcatcgcttcgccaacaaaggtccatatagtcaaagctacggttttccagtaatcatgcacagatgtgagagttggaccataaagaaagctgagcaccaaagaattgatgtttttgtaatgctgtagaagactcttgagagtcccttggactgcatggagatcaaaccagtcaatcctaaaggaaatcagtcctgaatattctttggaaggactgatgctgaagctccaatactttggccacctgaggtgaagaactgactcattggaaaagaccctgatgctgggaaggattgaaggtgggaggagaaggggactacagaggatgagatgtttggatggcatcactgactcaatggatgtgagtttgagcaagctttgggagatggtgatggacagggaagcctggtgtgctgcagttcatggggttgcaactggacttagcacctcaagaacagcagtcccccaaaaaatgcttgggttgagatacttgggtgtttatttgtaaacacactgcccacgagcgggtacacctcccaaagctagatctgtcattagctggtctgcttgtggccgtgctcgtagcatggcatggttccgtgagtgcttgcccgtgaactggacctcacctcagtcaggactgctcggtggcaggtaaacctgctttgcaccctgactttcagttctcctgctccagcctcatccgtgggaaataaaagcacgttccggggtcagccacgtgatgggtggagtaacgggactttctctttcagactcttttactcaagaatgcatggaggagaagtctttcttctgccgagtcaggtgagcccagctcctgaaggtggggaaggtgcgggagtgccctcgccctgccgcctgcccaggccccattctctggggtggaggctcagcaggggcacctctgccgcatggcacgcatgtcctgaaaagtccgcgtgaagacacgtttccataggccaagccgttctgttttgtttcatttttggtcgtgctgctcagcttgcgcgacctcagttccccgcccagggatcgagcctgggctcgggcagtgcgagcactaagtcctaatcactggcctgccagggaagtcccgagccacattttaaatgtgcctggggagttaggagagatgggtcaacagtggggtgactgacctgctcctcgtgaagaacgtcagcctgggcagcccagacttacagtccgtcacctgggaaattggccagctcccccgcttcggaaagacatgaaccccaggttctgtgaggactccagaagcttgcgtagcctttggtctgagtgtgttttctcagggagagcccatagctttccccacaggtctgtgaggaccccagaagctcatgtagcctttggtctgagtgtgttttctcagggagagcccacaggt

SEQ ID NO: 54627 - DNA, 1597 bp, Bovine  19866880661345
ctatgattccttggcattagaaaaaagagctaatgataaagaaatcagcaatattgccaaaatagatttattggagccgtcttttaccatgagtccagatactaaccatagagagtgctcactctccagtcaagtgaatttgaagataatatcgactctgctttcctgaatgaaacctaccactatacattattcagagtcaaaactaaagagtgaaagtcttattcatttaaattcagagttagattctgaaatgcagaaaagagaagaggtgttttttgatattttggaacatcaaggtgataagactactgacttggaaagaatctacaagatttcatatgatgattataaaaaaactgctgaagatgtgcaaaagcctgatatagatgaagactcacagcaggaatatcacagtgcagaagaacaagagtgtataaataaccatttatcatttgaccaggcaaaaacattagacatacctaatctggaagttttgggattaagaaattcaggctgtgaagttaaatgtgttagcaatctagaagacagtcatgttaaattggaaagtaattccagcatctctttagattcagttgatgtttatggacaagaagattcacctagtgtctccaaacttcagaattctgttacgttaagagcatttcatgaacctaaatatgaaaagtgtaaggaacaagggactagtttaatgcttcacactgtattggatgaaattatactcaggagagtcatcttgaacacaaggaatctgaatctaagggtttcctaaaccctcaaaaagcattaaaaactaaaatttatactcacaaagtgaaccctcaattaactgaaagtaaagattctattggaaatgtaattgttgaggacaaaatgttacagcaccttgataatccaggcacattgcctcaggacaaacatttagagacattactccagccttgtaaagattgtcagacttcctctgtttttgatgattcagtaatttctgcctctgggtattcacattatgaaagcctacaaagcacccctaacccagccttagatgtttctattactctaccaaggtctgcaatcagaggtaatcaggcagtagaagaaagtggctccctaaaagtcgctaatggcaataccatcagtaaagcacactttcacaatatggaaggaccgtgtcccaaatcagagacagatgcagcaggttgtacagtcacagttgatcagacggtggatgttagcactgacttcagggcttgtttcacagcaagcagggcaacaagtgcaagatcgtctgtagtatccacatcaagcaacacagagataacaatgatgaataaaaaacggcctagtgaatggcaaagtgagaaacaaagaagtgtggcttgtaacacagattggtcatacattcaagatactgaagacccacagatggctatgacaaaagggcccacagggaaatctctctctgttgacaatttaaaacctaatggaaatgtcctaaataaggtaaaaccaatatgattaataataaaaaatgtatatatagacttcataaagctactgtatgctaatgtaaaca

SEQ ID NO: 54628 - DNA, 852 bp, Bovine  19866880682668
gagcgcctctgcctccgtggtctcagtgccccaagccggtcagcagctgtgatcagagcccctcggacagcgcccggtgggccgatcctgccctcagcccccgaccagcccctcgacggcctgagccggccctctcctcaccttggagctggggtccccggatggagaagttacaggtgttggggagccgctcggcgcctggaaactggctgttcagatggattctctcaccaaattcagcctgaaaaacgcacaaaatgtgtcatgtcttcgaagcccccctcctcacaactgtttgaacttcagactttctggaaaacaaagcctcgccctcaacacacagagtgattgttctttcttgttgtttagtagctcagtcctctccgactctgtgggaccccatggactgtagcccgccaggctcctctctccctgggattctccaggcaaggatactggaatgggttgccatttccttctccagggggtcctcccgacccggggatggaaccccatcccctgtactggcaggcgggttcttttaccatggagccccagggaagccccacagaattattattttatctgtaagcatctccttataatactcagggagactgagtgtgaaaggcaaggtaaattggaagagaaagattctgagcacacttgggtcttccagaagcatcaggtgtcttgtccctggtgtttcggtcccgcgtccaccccccgggctccgggcacttaccgccagcctctcctccaggtagtcgcgcacgccccgcatgtgggcctcgtaggcctcgccgttctccgccaccagctcggccgcctgcggacacaggagggtgtggg

SEQ ID NO: 54629 - DNA, 992 bp, Bovine  19866880695966
gccctcccggttccccctaggttcctcagcgtcagccttcctcccggggcttcatggatgtctccagctcttgctgtgtccagggccctcccgttccccctaggcttcctcagcatcagccttcctcctgggggcttcatggatgtctccagctcttgctgtgtccagggccctcccggagaaggcgctggaggggaaacagaggcattggttgtgcctcccgaccccagcccccactttgtttgcaggcagagcacgaagggttaatgcacccctgacttgggccgcaggagacaggacaggcgatgctgatgacaggccagggtcacgggcagctccccgccccccatcttgtgtacagcacagggcgccaagaatggacgccctacggggacccagcgcctcagatgacaggtcagtttgggaaactcgaaaccaggggctcaacagatcctcatcgtcggattgctccccagtggggcagtttttaaaaatacactgcctgtttctttttaggatggtaaaaataacatatgttcatggtgggagatttggaaaacacagaaagacacgaagcagaaaactggcaacagacaatccccacgagcacacgggtgtcaggaccgtggcgaggcctgtgttctgtttcatcacagtactctgtggcaagcatttctgatgtgatgaggcatttctgatgtgatgagtctttggacctgtgatttttaattccaccataatggggacacatcatgctttaagaaggtggaagtgacacccgatcacttctagtaatggacgtgcaggttgggagccatgcggactgtggtgacacaggcgtcacctctgtgccttgccccggaacagatggggagtgtgagatgaccgcggtaaagcacacaatcatctttacagcctgatgcgtggacagagggtcgtccagctcgggtgaccgaggcacttacctgcaggaggtaagactgccccctacg

SEQ ID NO: 54630 - DNA, 1373 bp, Bovine  19866880708188
atctgcagaaagtctgtaaccccaaattaataaccgtttcctcagtgtactattaccccagaagaagctatagagaccatttagggaagagtatttttagtagcatatttggggttcttccagaagacccagcctccccttcatttaaggagttgtaggtctctactctgacacaagtctgggaattgattgagaagtcatgactatctgtatgattcaggtaagagttttgttcacttgacctagaacttttctgcttttggtagcctaatacattttccaaatgttccttggaaatcctaaaagaatatgtcttatctgtttaaataatgggcttgcaagttggcttcgtggtagagaatccacctgccaatgcaggaggtgcaggagacatgcatttgatccctgggtcgggaagatctcctaggggaggaaatggcaacccactccagtattcttgcttgggaaatccaatggacagaggagcctggcgggctacagtccatgggggtcacagagttagaaacgactgagtgactgatcatgcatgcacgcgtgatatttaaatgatataatcttttattgtagttctctgttcatatctttaaaaaaattattcaaatgtcttactgttttattagcccctgatgttagaatctttgactatgattactactctgtcaaattcttgtttttctaatagtttttaaaatatgtgctgagtatcatagttcaatatttatacctcttctaggatatacatccttgagtgatgcaagccactgcagtggttgagacagcttctaataaaggctacaacaataatggaagaaacattcagaaaggtaagaggcgttacctttggttggctttattaatagttccctcctcagtgttgctatatgttaagccttcctacaagtaagatgagattcagcatgtttttaacttgacggatcactcaggtgatttctggcaaatgtgagcaacctaaacaggatctctcaggtagatggaaaatttaagaaatagaagtgagctagaagagaggatttatgtccagccaggctttcaggaactactgacaggtacagttaccttcagggtaataagtggaaagtggacccaaggaaagattttttctttatatcgatctaaaatttctttttctgtcgtaaaggtagaagagaaaataacaagggcatataaagcaagttgattaagctttaagtgtttatgaatacatgtagttttaactgttaagaggacttatgataaaaattctttttcaagtcagaagggaaagagtggatttttcagcaaatagtaacccttagtcattctacttagtcagcctgagttcttatagcaca

SEQ ID NO: 54631 - DNA, 1198 bp, Bovine  19866880815237
ccctagcgccatccccggagccccacctgtcccggggaccccctttccctcagtggcttccatgtcccccacccgaggacagagggcttgcacagggtacaaggcagcttggggcccaggctctcagagcccgaggtgggttccaggtgggtgcccacccacgctggtgtgcgtcaccatcacacccaggcggtccagggctgggacactgcgtgcgtgctaagtcgctcggtcgtgtccgactctgcgaccccaaggactgcagcccgccaggttcctctgttcatggaactctccaagcaagaatgctggagtgggttgccatgccctcctccaggggatcttcccagcccagggatggagcccccgtctctctgcattggcaggcgggttcttttccactagcgccatatgggaggggcggggtgaggggctgcctagaagtccccccgagaatgactttctccatcccaggaagggcctccgccgtgtgaagggcctggagatggcagcctcccgggacccccacaggcacctctccagtcaccctgggctctgaagggctcagagcagctgggcctcaccgggaggccccatcacccactccgaagtcaggcatccctggtccaggagcccactcccatgccacttcttggcgagtggccttggacagacactctcccttctctgagctctgctgccctctctgtaaaatggggcacatccctgcctctcaggcttcccaggtggctcggtgggcagagcatctgcctgcaaggcaggagatgctggtttgaaccctgggtcagaaacatcccctggaggagggcatgacaactcgcttgagtattcttgcctggaaaaccgcataaacagggaagcctggtgtgctgcagtctgtggggtctcaaagagtcgggcacaactgaagccacggaccacacacgcatgcccgcatgtacctgcctctccgagctgtgcccacctccccctgcccttgtccccctgggcgcccagggcagcccctgcagcctctgcagagcctcagaccctgtgttttcaggaaccttccttcgtcctaggcccctgcagccctaacgctacccttggccccgcaggcaccactctggatgtggtggaggtggagagctttgaccccttcacggacacctggacgcccatccgcccagccctcaag

SEQ ID NO: 54632 - DNA, 2118 bp, Bovine  19866880821582
gacaggacccagaggcagggcctgaggatgagatcacagcaagggagcacacagcacgctggagacatgccccacatggagcagccgggctccccgggtcacacggccaccagggttgggcgaggacgccagcaccagagccctgcaagctgacctcactgccctgccagagaatgtgcgggacacaagacaagacacagcccacaggctaaactgatttgaaaaccacctcccacccccaccctacacaacctctctggttctctacattagtgaccagcaagctctagaagcaggaaatggctggttcccagccatctgcccctggaagggcagggccccgggcaccacggataaaaggctccaggcacgcgctcctgcgcacatcgttttggtaaagaggatgctgagggaactgcctggcagtccagtggttaggactccacactttcactgccagggcctgggactgatcctggccagggaactaagatcccataagccacgtgcatgcagccaaaaacagtagaaaagaaaaaccacaagaaaggacacttaaatgtaagtgggcggtcttctgaagcctgccatccgcattatcctcccactgtgaattccattaatcatagtttccccttttatctaaaatcagccacgtggcaggagtgtgcctcattaaaataagaggggatggggtaaaggtccttagaggggccgtcctaggtggattgcagaggccaggctgggatgggggagccgagagaccgctccaaggcctcccaactccaggcccagcctcagagtgtcctctcaggggaagtaacgggtgggaagcccagcctcagagtgtcctctcgggggaggtgacccctgggaagcccagcttcaggcagcactcagagcacaggagatggaagcggacagaactcacctgagacatatctcaccagtctcggtgatgttggggtgccagatcctggtcaagcatttcactttgggaggctgcaacacagaaggaagagatcacaggcgctccagaccttctgtgtcccccatccagcgccgttttaccgcgcactcccggatcatcaggcagcggccccagaccctatagcagtgtctgcacactgcatgcagtgctggtctcgctgggggcggctgctgtccctgcacaggacccctccgcaccctggggctgacagcagatggtgctggccgccaggctcctgccccctgcccctccctaggctccggctgtcagggagcagccgcagaggcctggggaaggagctctgtacccccagaccctgctgtgaaccaggagcccctagactccttcgcacttcgtggctgagcggctgaagctctgctccccacagcagcgctggcaccctctgtggggtgtttctgaagacactactgtcattttccatgtctagatgcaagtccttgtccactaatacttagggagagagaacgaaaaggatcacgtgggaataagacacatcaacatcacttagcatggagcgtgtttgggtaacgttcttttaatcttactctattttaaaaccgatcacactcatctaaaaaaaatagcaaaaacaaaaaggaaagatactaatatgtgtgtagacagagatatagcactctacctggaataatttctattaatatctgatgcgtattctggagcctctttttgaggccatgcacacaggtgtgtgtggtgcacagtcgtttttctttctagaagtagggagacgtgctgtacattttccacatttattcttgtctccgatgcctttgggcgtccatgcattccatggcacaaacactagcatttagcaagcccagaagcttaggttcttcccacttctactacaaaaccgctaaatcaatgctatcttcactcacaccggaatgaaatacttcactgggataagaccaggaactgggcagggggttctggccagagcgctgctgcggagccagtgccaagcgccctcgcctccagggaggtcgcacgcccacccctgactccagtgggtagccccttccccaggcccagtccactgcaaggtcacccttggtttgaggagcatgacagttgtctctcag

SEQ ID NO: 54633 - DNA, 2837 bp, Bovine  19866880897927
ctgctgcggctgtggagaaggacagctttggggccagcctgcccgaggccacccctcccgaggagctggcctgcagggacccgccgggccggctcctaccagcagatcagctgcctggacagcgtgcatcaggtgcggcccttctggcctccctccccgccagcggcacccacagtcgggctctcggttacatgaagccctttccgacctgcccgcaggtacctggagagctgcagcgaggcagccaccctgaagaggaagtgtgagttccctgcgagcctccccacgccccaggccagcgacaaacgccaggccctcgcgggccctgggccacacgccacaggtactgcgtctgcttgagctgtgaccgcctggccgcttacccctctctcaggaccaggccttacctgggagcccggggcctcttctccctcccactgtggttctgagcgggatcagggacacgtgtagggggtcagctgttgattaaataaccaaagtggctcagaaccttctcaccagcgggaggtagaggtgattctggacttagaggacaggatgccccggggctgccggaagccagggtgttatcgggcgggcccgtttccgagacgtctcagaggaggactggcctctgggtgtcagcggcccaggagtcagaggagattggatgtgcagttatctccagtggccctcaccaggaccacaggcagggtctccaccgctgatggaagcccgggcgacgggtggagcttaccctagcccacggggggagcccagctgctcgcctgccctcagcagaggggccctggccgcagggggcagctccccacaggccccgccagaggccccgaagcccaggcgcctggctcctcccagaggacgcggggtaccagggtgccatggtccccattcagagtctcatcttttctgccgtcccctgaggacacggcatcccctggcagggcgagtgtggacttgagcccccgggtcctggagtgcccctcagccggcctccgtgcttcttctcccagcagctcagctttatcgcggttttgtgtctgcttccttttttctcctgtaaagaggcagcatcgccctcgccagtgaagagccgcacggacgcgagcgcacgcctgctgtcgcccccgctgcccggcagggcgcagagcgtggcgtccctcggcagccagtgcagctacagcagcaccatcgtccacgtgggcgacaagaagctgccgccggagctcggtacgcgcgccgcgtccggggcctcggcgggagcggtctgactctgacagtagagactcggagtgttgccgcctgtccccggatgctctctaagtgtatctgagtgcagaacacccacgtagcccagtaaggggctgtccaggaagtccaggcacgtgccgtgtagggtggaggtggtgacacttgcccccgcccccgccacactccggctccccctgggacaggcgtccactcaggtgtcaacacggaggggcttcctgggaccgagcagggatgccaggactcccccttgcctggtgccgagagaaccccagggacgaggccccccggcctctcgacgcccatgggtggggtggcgagcctggccctcccctgttggaggacaggagccaaaacaggacagccaagggcgacacgctgagctgtccttcaggcccctagaggagaaccagcctgaacttgttctttgcttggaagaagggcgtgatgagggggagagtccacgtcagagggtcagtggccggcccctctcaggatggcccgcagacccacagccccgtcccgcctgtccccgcggttctgctgaccacactgttgggcccatggtcctaggccaggacagggccgggcacgtcctgtgctctgaaagcccaagacatcctggaggggcttcagcgtcagaggctgaaaccccaggtgcccccaggttggaggacggatcagttagagggcgggttccggagcccccacgtgacgcggctgcgtgtccccgcctgttgcctttcttggtagccttctcagaaagctgagcagacgcgtctcgaacgtcagcccctgctgtgggcgtcgtgcgggagtcttctgtgggagactctgtcctttgtgggagcggtgcgcgttttttcagctgtcctcgggcagcagggcccctgtggatgagagctccgcgtctgctgttccagagccgctgggagatgctgctgcaagcaggcccgagtctctggagtgcccggcgggccccgcgctgccctgcggcctcagccagggaccaggaggccttccggaagctgggcctcaccaaggaggtgctggccgcccacacccagaaggaggaacagagcttcctgctgcggttccgggaaatcaggaaactccacgttttccagtctcgctgccatcattatctgcaagaaaggtccaaggggcacttgagcaacagaagtaagtggtgacgtctgaacgaaaagtgggttttgtcgttgttgtttttaacttagttcttaacgctgctgcatcccatgctgctttcagatggggagcacccctggtcaggacacatgcgtttgtaagatgctgttggagcttgagcagtgacactctcggggatgtcacctgcgttcccaagggaaccgtgctataaacagtggtgacaggcccagttcacccctgtggagcacagggccaggtgactgccctcctgccttgccaggcgttctctgcctgggtgaccccagcccccttccctccctcagagaaccaggtgggcgaattcaccacccagggaaggagcatctgacgtcaggctc

SEQ ID NO: 54634 - DNA, 1537 bp, Bovine  19866880922537
tgaagtagtttgaagaaagatacctcttgtccacctgtttctgagctacttgagaataaggccctgtgcctggtgggagaaggacggggcccatggggtccaggggcatgcgtcgagggtgtgggcactgaggtggcagcgagggcccaggaggccagtgctgctgggggcgcctttccacaccctccgtgcctgcctcagagcacgtttccacccgctcctccagctccccagctgacgcctcaggagagtcttgttgccacatgagagcaggccccgtgttgtccctgctgtgcagcagagcagagcccccctccggggtctttcacctccgcggaaggggctggcgggccctcacaggccccaggcacaaaccacgtacctgcaaatgctcgctgagtgagtgcccagtcagaggaggaaaaccaggatgcgggtgttaaaacggggaaagagacgagcaggagaactggaactgtcccaccctctccatccctgtcagagagactccccttgggaagtctggggggactttgaaagggatggaggcctcttctccagcagtgaaagtgggtggctgtcctcccttcacgtaggcagtgagcacttgacgttcctgaagtccaagcatccgtccagtttggggaacggattgaggcctgcggtgcctgacacttaccgtgtatttatcgtaccacctgatagatctcctcggtgatcttcctggagtttgtctgagaagctgggattgggttcatccgtagcttaggtgaacagtgcagtctcagctctgatgtgtaccgtctcactcaagatatttttaagtagctttaaccttgatcttgtagacgttaaattggttttaaaatgtttaggttttgactacgttggctaaatatattttacctccattgccaggctattttgtaaagtttgctgctaaaacccatttatgtttttctccatgttgtaggtttattttgctggcctgtgatggcctcttcaaggtctttaccccagaagaagccgtgaacttcatcttgtcctgcctggaggtgagcactctcagaaggagtgggtgcctgttgttccggctgcccttgggcttcagagaagtcctgggcccccttcccgccttgtccctgtgcagccccggggcccccttccccccgtgtccccgtgcagccccgggccccttccccaccgtgtccccgtgcagccccgggccccttcgccccgtgtccccgtgcagccccgggccccttccccccgtgtccccgtgcagttccaggccccctacctcccatgtccccagaggggagtgggacctccatccagggcactcaccgctcagtttctcccatgcccccgccacggggactgggagcagtcgtccctcgtgggggggcatctcaggagtggtggggcgcggggtccctgttcaccagcacccctttcccaccctgtaggacgagaagatccaaaggcgggaagggaagcccactgtggatgcccgctacgaagccgcctgcaacag

SEQ ID NO: 54635 - DNA, 1235 bp, Bovine  19866880948445
gtgatgcaaccccttccctgtccttagggcttgagtcacatgccccgagctgggacagtgacaggcccagaaacgccccccgcccccagcaggctgcgtgctgaccagtcctgacgtggtggagctccaggaggcaacttccagggagaggcctccggccctgtgggcggcaggccccggacagtctgggctccgggcaaggctgccagctgggaaggaaactggctcaagagggcttggatgaggtcatgggcactgactcgggcagctgatggaaggaccctgggatcttggagccggccaggctcacgggtctcgcggccactctgcagggacccagggccttctttcaggagccggtgtggtgtgatggggatggggcttctgtgacggagggacgtgggtcggagggagaggcctcagagtgcccagggcatccccacacctccctgggtgctggaccctgcaaggcctcccccagtggttcctctccacgagtactggtgaccccagttcaccgtcccacgcagccttcgtgggaacacccggcaggaggactctgtccagggtggactgtgtgctgggccagccctcccactggcccaggagtctgtggagggactcagaccccagtttggcttgaaacagaaacaggtggaaccacattgatctgggggcctgggagatgggctgcggcagtgtgggtgggcgtcgggccactgccctggctgatggaggtctccagcctccagcagctctcaaaaagagccctgcctccaaggccagaacccatccctggaagcgcctgaagcccctctgtttcctgaccatcacagcccagcctctggaaaccctgccccctggcgtccccccggaggctgaggtaataggctttgccttcagcccacgggaaatggcagggggcaacgggaacaagggctctggggaggcccctcctggggagtgatcggggctggctgccactgtgacttgtcttcagtgggggcatccccaagcggggcgtcgtggttcccaaagtgatgctgagagcagaggtgcaggcctgagcctccaggcaccgcccacaggcatcttcagagaaaagaaactccaagcaccctccccagagccctcccctccctgcctggaggccccacccacactgagggcagctctgaaggccccaaccccctggtaacccccaactggaccacccgcttctgcagccagaaagg

SEQ ID NO: 54636 - DNA, 1026 bp, Bovine  19866880952197
gtgttgagggggatggagcagggcctgggtgcgggcactcactccaccctaaaaactgtcaggtccaagaatggacaacgttccaaacagaggttaaaggtgaatcctccaatctaaaaaagtggtacaaacgaccttatgtacaaagcagaagcagactcacagatgtggaatacaagcctttggttactggcggggaaagctgggcagagggataaactgcgagtttgggcctggcatatacacaccactacccatgacacagataactgacaaggacctcctgtggagcacagggactccactcgacaccgcgtaatgaccttatgggaagaatctaacaaagagcagatacatgtatacgcgtaactggttcactttgctgtgcagcagaaacggacaccacatcgtaaaccaactgtactctaataaaagttaaaaaaaaagttaactgggacaaataaaaaaaaataaaagagtgaatccttcccatttttaaatcgtaaaaaacaacacatccatgcacccggctgcctttcttccccaccacacaaagctccccttcccgggaaggcctgtcagtggcttccgagacggtccttcagaagcctgagcagggcaattccgatctcactgagccgtccttttctaaatttggaagcgtcttccccaatcctatgttttaaactgagacctggactaagtcatggaatgccttctggcttgctcctgggttcaggcatctggaggctggggtgggggggtcttcttgggggtcagaagatcagggtctgagggcaggaggcagggaaggaagggaggggacaggggccagagagagagagacccactcaccactgggctggcccgcgcagagctggctctggaggaggcgcgggagctggacttgaagtggccgctgagctccgaagcctgcccacccagctggccgcgggacacagagacagaaacagaggaacaggtcagtgaggaggaggggggccacatgacagacgccccggttag

SEQ ID NO: 54637 - DNA, 2133 bp, Bovine  19866880962716
cgcggagggacagatggagcccagcagtgctggaggctttcagtggaagcatggagtagctttgaatgagcagtagttgttcctgagagtcatcttttccctaaattgtaaaccttaaagtaagtgtagcaaggatgcagtagttgagattcttcgctgagacattaaacttagatggtacgtgtcaatctttggcattgataaatgagttagtgaacgtttttgtgccagaaacttctgtctttcgggccatctctgtgggacaggttcccagctgtgattcctggcacgagggctggtatggacgtcctgaggtttcagctgctgtgggcactgtcccagtcttctcccttatactttcttccgggatttgttttgagcctttgctgattttcatagacagaaagcactcagagtctgagtgctcttaattcgcgtgaactcctttaacattagggacatctgccagtttttttggcttccctggtagctcagttggtaaagaatctgcctgcaatgttggagagcccagttcaattcctgtgtcgggaagatcccctggagaagggataagctacccactccagtattatggcctggagaattccatgaactgtatagttgccagtttttaaataagtatctgtttcttgtatcttttcaggtttttaattctgattatgtttggtttctgacttgcctaggtgttaaatttttatgcactgggatttttatgccgtaccagtctgtttgtgtggtctgcccagagttttgagatatgaagatctttgtccccatggtcgctctccgggtgccccagggtcgcccctgactggcggtgccttcttgcctgctctgtactctccccgcaggccttttggggtctggagtctgctgtttctgtttccgttttactcttctgtttcactgtcagtgccctgtcatttttcttttcaaaaaaaaatacaaagccattttatttgcttattattgcagagacattttccagtcatttgagttccatgagtcagagattcccacctcccatgaagcagacttgtcaggaggtgcctgcacttgggtgaagcctaggctttgttcctgggacgcctggatcctgctgctttcaagtcagacggggggtttcctctccagagacctgtgtgcggtgcttgggtgtgtccaccagtcagggatcgctcagttgttttgttttcagatttctggaaatggtatcttcttcacctcattaattttttggtgatcattgttggaatacatagaagctttactgatttatgtggctgtgtcttcaatctagcctgtatcaaatcttaatagagagttgttgcattggttcttttcattttctaagctgacggtcatgtcatctgcttttctcgtctaataactcagggtgtttgcatctgggttgactggtgagcttgtaccataaatttccttttatgtggtctttaagagatttggttatcagagatttgctggctttacaacattaagctctactgagctactgacaaataggtgaactttttttcttccctgcccactcaccaagcgcagacctaataaccccaggtcctcaaccggcacagctggcactgccccctcttgtaacgggtagcgtttgggcaagtgtctggcgcccaggaagtgtgcgagacacaggtgctctgtgttcctgctgagaagagaagccttgagtttactagaagggtgggggtggggggagtgtcacgtttgttgaacatactcagaatctgaaagccattccagaatctctagaggatcgaaaaagcattctgcctaagaatatgagttttttttttttttttttttttttgcttattcttaactagtgaattgtagcaaagtgaagcactttcagctagggaatgcattttaatttcatttgttcaataatatgcagcattaccaattaatacatattttcattgtgcaatttcatgtcaggaagaagggactctagaaccagtgaaaatagtctctcccctgaaaaagaatgtaactcttcctacagtaaagctaagaaggagcatgccgtgaaacagttcggtaagagtgagccccaggggaggctgagagtgctca

SEQ ID NO: 54638 - DNA, 1122 bp, Bovine  19866880988000
cgaaagggaacatcagcggtactgggacctatgaaaccacgcacagcttgatcagatgcaccgagaacagagcctggcttctgagcgagtccgccctgccctggagctaacactggaaggcagcactgcgcacggccccccaccgccctcccagcccccagacgcctcaaggacgctgtcggcagagtctgtctcatacgagggcaagagggatgacgatggggtccaccgttcaggggtccagggtggagagaagagcagcgttgtcagggcttggtaaacacgcaggccaacactcacagctggcaatcctgtctcatcacccgtctcttccccagaacagacaccgtggtgtctcagcagcacggagctgaggaagacaatggtggcacgcagacccaggggctcaaaggacaccccgcttcccctctgacgccatggagcaccatcagccactacagatgcacatgtcacctgttctacaaactgtcctaggaacaaccttctgacacacaaaccaaaccaggcagaaactgctatttcatttcatacaaccaattaagagactcagatttcaagcactgaaatctgtttcctccttattcttaggaagatgttttccagaatgtttgtcattttgggcaacacgacaatctggtattagctgagctgtgggaaagacagccttcatccgctcataaaaacgtactggctgggagccagttaattttaatcctgagtattttccaaaattcccgtactgcttttaatatcgctggccaggaaccatggaacaactgcataaatcaacataacttttgcacacacagaaataccactccttacctttataaaacaaaacaccaagggcaatgaaaagtaacaaaacggaggctacttgcagagggacatcagaccataatagtgacagagagtgccctgcccgtgagggacagggacacagggaaggcaggagttgagtttggactacatgtaggttgtgttatttgttcagtaacttaactccattcttcagaagtcaattatcgggtcgtttagaacataggaaactttacaatagtatatgctcttgggacctcaccgcacaagtgacatcctgcg

SEQ ID NO: 54639 - DNA, 1050 bp, Bovine  19866881088520
tggagaattccgtggactgtatagtccatggggttgcaaggagttggacacaactgagtggctttcactttctttcactttcaagccaccagggttacaaacagctgggatagagggatattttgcatttcactctaattagatttggaaaatacctgaaagtgactatcctctgattcagaagcaagtgttctttaccttgggtatgaacatgctttaatgacttaaatacaaacaggagaactctggacagaattacacctttgctcattctgcttccaggagagggaaaggtgactgcagggcctaggacagctggtcctgtcagcagggagagcagccccatgcctgccgctcccaaggacaatcctggtggccgcttgctctgccactcgggcagctacaacgccctaacacccaggctctcaggagtgagaccagaggagacgacacacttgacaaggggcgccagagagctcagccaactgcagagctgtgcgcagaggtgccgcatcaccacgggctcccaacggggacgcgccctggaagctgagccaccggcgcaggggccggaaccacccacctgggccggggccgctctcagagtcaggatcccgcctggctcccggcccttcgctggccctcagggtcaccctcctggtggtcacagacaaatcaccagcagctaagacttgtgctggtatctgtgagcagctgagcaatcttctcaggtacgaacagcagaacaaaaggcaagagggagcaaagggcgccagcgctgagctgagggtgaagaagtgcatgggggaccctcagccctcagcgtgccagaggcggcagctcggagcccgcggtccagagtgcgtctttgggaccaagggccagggtacccacgcggcctcctcccgtcacagacccagctatgtttcaacaagactgtgcgcagaggcggggcccgaagacccaggtaccaccaggacaacagagtccactcacgcttcggaagccaacccagcgggctgctgctctgcctgcactcagcacaacagg

SEQ ID NO: 54640 - DNA, 1018 bp, Bovine  19866881145564
agccacatcttttgtccccagagttggctcctaacaggttcttctgagcaaagccctgagccagctgcctgggagcagacagacttcagctccttgcctcagtcacaccctggcctgtcaattaagaacttgccctctcaccaggcccaccgccagcccagataggaaattgcatcccataaacgcttgagcagcttccgaaggtcaggtggtggccggctgccacgcctgtccgtgctcctcgcctctgtacaagctgtgcgctcttcctggcttacttaaccctgccgggctcctatctttcctctaaagcccagctcagatgctgcctcctccaggcagctttccctgactgcctgcctgtgaggacacccaaagtccagcatggcctttctcatgtgccttgggtgtgtttccagggggttttcccgccaagctgtgggctagggatgaccacttctgggtcccctgtcctcgcgggcaggaagtggcacacacaggggcgcagtctgtacttgggaagtgaaccgaccccagggaggcggggttgcacactccatcccgtctgtccccgtgcgggtggggtttcggggctcctctccctgctccccacctgtcactcaccccctcgtggccctgggccaaggcctcccgacaggcctccgactcccggatcagcggctccgaggccagcagctgctgcacgtggggcctgggcacggcgtccaggtgcaccaggccgagcagctcgggcaggtgggcggcccggatctgggggtcgtggcgtacccagcgcagcagcgcctccagccggctctgctccggctgcacctgcagcaggtcgctggccagataggtggccagccgctcctgggacagctgcaggaactcgtcctcccgggccacggccctcgaagttctcccgcaggaaggcccaggccttggcggccacgcccagcagcccctgctgttccccaaactcgcagatgcccagacagttggaggcgtcgagctgctg

SEQ ID NO: 54641 - DNA, 1925 bp, Bovine  19866881190250
atctttactttcttccataatacaaggacgacctctacttaaatactgtatcatctgatttttagctttatcctgttgtttttttgctcacaaattgtttttaaaggtttttaatttttaaaattttatagatttccttttttgaatttgttttttattttatactagggttgatttacagtgttgtgtagtttcaggtgtacagcaaagggactcagttatgtatataaatgcgtccattctttttcagattcttttcctatataggttattgtagaatattggctagagttccctgtgcgatacagtaagtcattgtcgactatctactttatacagggtattgtgcatatgttggagaaggcaatggcactccactccagtactcttgcctggagaatcccatggccggaggagcctggtgcgctgtggtccatggggtcgctgggagtcggacatgactgagcaactttactttcacttttcactttcatgcattggagaaggaaatggcaagccactccagtgttcttgcctggagaatcccagggacgggggcgcctggtgggctgccgtctacggggtcgcacagagtcggacacgactgaagcgacttagcagcagcagcagtatggctgagtaacattccattgtataggtgcatcacatcttctttgtccattattctgttgatggacagttaggttaactacctgtcctgaccactgtaaacagtgctgcggtgaacatcagggtgcgtgcatccttcctgaccgtgttttcctctggatatacgcccaggagtgagattgcagggtcatgtggtagctctatttttagtttcttaaggaacctcccacactgttttccatcctggctgcaccagtttacctccctaccaatagagtaagagggctcccttctctccacactctctccagcatttatttatagacttttgatgatggctgttctgaccagggtgaggtggcacctcgttgtagttttacacattaaggattttgttgttgtttaggcagccaaggtttgtcaacattcgttcacaaatttatcaatatctgctcatcatttcttctggcatcttagaccttccatctggaaccacctccttctttctgtaagtgtcctttttcaaaactggtccttcaaaatttcctttaaggaacccgtgatgcagcaggcagaactgggtagaaagagccctgccatctcactaaagcttggcgagtcagtgggaagcacgctgccctccgtcactttgcctgccttccgtgggggctggaccgctcggccagcgtacccggcatccccgcccatgacatcgccacctctagggctgctggccaccttctcaggacccctgtctttgcaaaaagttgtgctcaaagtgggacttaaactaaacagacttcctctaggaaacacacacaatcacactgctgcgaacgttgcttttatggacatttccccgagaaatatttctctctggaaaaataaattcacaggatgtaattaaaaccattatatgtgtatgttggcctgggcacgtcttaagtgcttcaccaaatgggccaccaaataaagaaatgaaggccggctttgttcacgtctaggaacaatgacctttattaactgtaacccagggcgttcttctgttcctttgcggattcagaagcagcctttcaccgggaccgtgttcaaggcactcgcctttggtcctgaccgcagtgtgaccgacccctgctgggaacagcagagcagcctgcgcggtgtcacttggacgaaggtgaccgtttcagggcccatggacggtcgaatggcctgtgttttctgacttgccacctttgaaaaaataaaatacattccccttatcttccaaacatcttaaattctaaaggagaaag

SEQ ID NO: 54642 - DNA, 1125 bp, Bovine  19866881296038
cccctgacggtgccgcaggcctgcagcccctccggctctgacttggcaggccttgtctgcatctcagacacgtacctggaatgttcctgacctgtttatttaggtgtttgtgacaaacacgtccttaattccatattgacagatgctttcccatcaccactggggcaaaattcagacctcagtctcgggcctgggggcgctatgccatcacccctgaggccccatcctatcactctctggatcctctgtctaaacagcctgtctccctctgccagtgcccacgtccctgtatccttggatttgaagatcctccatatacacttggtctcctcacctctcctgtctgctcattgctcacatctttgtccaggacgccaccatgctgtcccctggggtctccatcactcactccttctctgtctgagaccggaaggaagacagagctcagcagtggggcgggttggtcaggtggtgggtagggccttgctggtagagaagagccagcaggaaggacgctctccagcattgacctggttagagaactgcttctcccggcacggttcctcttcctacgagggacgcaaggcacgtctgcaggcagctttggtttcatagctggcgggggcacccctgcatcctgcgtgcccaccaagaacacgtagactgcagcgtcctcgcaccccagtgggggaagtagggccagaggcacagtgaaggcggcacctagggtgatcacgtccttcttcaactccacagcagcgagcagtccaccaaagccgatgcccacaaagagctcatcaaaacgctgaaggagctgaaggtccacctccccgcggacaggaaggccaaggggaaggccagcaccttggcgaccctcaagtacgccctgaggagcgtgaagcaggtgaaaggtaggtgtttgttccaacctgtagcagtaagtctcagatctccccagatcagagcttagactgggttgactttctgaaactcagtcctgaaatagcagaaggaaatcatagaagtctgatgaaattgcagctggttgaaaacctgagttcatcttaagttttctattgtatgtacttttagaggaaaggaaaaaaaagcaggtagaaaaccagc

SEQ ID NO: 54643 - DNA, 1623 bp, Bovine  19866881312362
gttgaaactgattaccttgtaggttaagtgcattttcttctccagtaagcttcattgctttcgctaattgtaaaccccaggattgttgtcgttgttttgtgttttttgatagatgagggttactaccagggtagaaaatttgtttgaaattgaagttcctgatgtgtataacatggtgcctcccacagtgagatgcttcatcaggttacagcaagttatagcaccccaacatcacagagacaggtaaaatatgtctaggtttattgagagagtgtttgattgacagcactggctgggctctcaggaggacattgaggaatgttgtttggagattcaactcattgttaactgatcttttgcattttgattatccaccaaatattgaagctgcagaacctcatttgcaggacaaggatggcttccagaataaagttgaagacagcatgaagttttgtgccagaggatatgagaagactacagcattctgtactgtgtgttataagtttgtctccacctgaaacaaaaaggaagcctcttccccagtcctcaggctcccctcagtcccactgggtcctccagagtcctgtgagtatgttgttttgaggaagaacctcttcacacagcctgtggtagatagagagttccacataaatacagcaagataatgtgtttggggttatcaagagttatccacttaccttaacatgtttaccttttttgaagctgtgctgtataggttgctgatgagattcttgagaagtcgtcatgaactcagaattgaggctaaagcatgctgctttctcttttcccagagtcagtcccaaagtcagtctcatgcacaggtgatgctactagatgtgctcaatgtagcttgcagatgggtgattagaaactcattacaaactgtgaatggatgcaaaaatcttagctcctttctggaatgcctagatgttatgaaactgcccagtcaccataaatctctttctgaagtgcatattttctttaatataagtatattttggaatagatttggaatttatattatttaataatttaacaatttttttctattcttatttaatttgtattttcattgtgtagagcagacagaaagatgctgagtcaaacaactattgaagagaaatacaaagaaaatatcgaggaaaaaatgactggcaaaagcactgctgataatttctataccttcacatttccaaaggcaagatcaagcaaatgggctgtgagaaatggtaagaatgaaaggataagatgagaagttgatgctgttttggttgtcagcatgagaattgctaagacttagatgccaatgtctgagggaagaaaaatacagaaatatgctgagtatccaaggcaaatgatgtgcattcaggtccaggtaccttcttggactttcctgatggaaagcatgcatatttggaaaatatcagcagaggaaagagtgtttacctggagcagagtgaacaaggaaaagtgcaaaatgatataagccataaagtggaattggggaccaaatcatttaggtttttataggcaattataaagacactggattttactttgatataagaggatttttaagggttttaagtaatgaaaaatatt

SEQ ID NO: 54644 - DNA, 1269 bp, Bovine  19866881332593
tgaactggatattatactacctcgtgagataaaggcatagcatgttagttttcactataatggattaacatgatggggaccataaactatgatctgccagagacagtcaagttttatatcaattgtcatggtgaattattaaatcactacctttcatcctcaaagtctcctgatttgatgacaaattgtgtggtcatcttactcaacatatgctactgacatccatttggtcaggacactatgttccttctaatcagtcacagtcctcaaatggcagtatgattctttactatctgagccaccagtgaagccccaaagccagctgagtgaaaagaaggatgggagagctcctaaaaatgagtttactttgtgcaagccataaaattaaagacttatacttgacgaactacttaaaaaaaatctcacttgagagagtgtcttctttaggctagaagaaccaacatcacgtgtactttgattatctagttcagaatctgctcctgaaaagctaaacagattaatatttcattaaagcatttatcaatattctgaatacagaataaaacagaaaacagagttaactgaattaaccaatgtttaaaatttaataaatttcaaactagatgaatacataacttacatatgtgactcttctttcatcagctgcaaagagagagaagggaagaaaaagcttttaaagtgtttcctgtccaaacgaagtaaaaattttatttgtaaaacataaatacataccctggaagcaaaagtagagaaggcagataataatcttgattctattgacaagggaggcagttcttccagtggtatacccttgtttatcttctctttcaaattcatgtatctaactttcaagtctcctaaaaccgacagcagtgctgatcctaattccttcctagtagaattacttgataaattcctgttcaaaagttaagttcacaaaactatttaggcccaagccactcatttaaaactaatatcaaattacacatctatatacatttacttctaactctaatagatctctaaaaatttttttaaaatgtttaataacagaaaatgaatcacagaagatatgtttttctgggggcagtaaaagcaaacctcagtatacaaataaccccagaaagaatgggggtagaatgtcataaaaaacactccaactgacttcatccatatttggactttataaacactggaatctgtctttttactgggattcattatcccaacatggcactggttgcctgt

SEQ ID NO: 54645 - DNA, 739 bp, Bovine  19866880467461
atatcaaaccacgccgagcagcttggaggcaaacatcgggcgtgtgtgatctcgctggaagagagacaaatggggctgcgggcagctccatccaggggccgctgacaggggaacggcatccgccaaccggcacatctgtcaggacgcggggtattggcacctgtcacgcaatttcagccatgacttttaataaagccgccttcccttaggtaaaattggaacttgactgtaatattagctgcaagcccatcttgttttccccttcagagcgcttttgtacgtgaggcgcttcaaatggatctcaaagctgaagtatggtgtttaccagcacctcccctgcgccccagaactcagggtttgaaaacgatgttgcatcgagttttttccttcctttctttcttttgcaaaatgtctgctttggccaagggatgctggtttccctatttattttcatatcactctccctcctcccgcctccatctccttcgccaaccctctctgggctgttgtttgagtgaatttagcccggggacgtatgtatatcataaaaaccgggttgggatttgttggctgtcagtcaataaatcagtcagagtttaattaccaagcaagtgatgggctgcggtgacaggcaccagcactggtggagagcctttctttgggagcaatcgctatgaaaaaccctaaaaatgaggttactctgtgagtgtgtgtgtgtgtatgtggagagagacagaca

SEQ ID NO: 54646 - DNA, 1033 bp, Bovine  19866880473370
tgcatcctcccatgcagactccttgtgaaatttattagtgtaatcctgtccacaaagcaaggctttccatttggaatcagggaagccccgttccaccatctgcaccttcctcatcacccccaactcttctttcttctgctttcttccacaccccggggtctccctgaagtgtatcccacccacagggcccccctctgatgctggctccttctccaccaggctccgctctgcctgactccccactgggcaggggccccacagggtctaaagcagaggctggacccaaggtaaagccccaggaggggagcccccagaagagaagggtcaggtgtcacggacattgtgagggtcagatcttgagggagagggtggggcaggacatcagagtaaaggaggaaggcatagctcaggagcaggatgaggggtgctcggagggtcccagaaaggcagtccagtgccctgagccagcctggagaagggcacagctgggcctagggctgagggggcaggcagatgctggctgcttgggaaaaatgggagtccgtggatttttttttaacccatctgaaaagctaattagaaagtcaatagttatcaatcagggtgtgtagattgcaaaacagcctttgcgctctgcttcctgagtgctgcataactgacttctgctccaacttgacattccttcccttccttttaaaatgtagcatatatctatttaaaacaatattagtcttggcattgtttagctcttgtgtacactcctgtcaaatctgtgagagtgcgagagagtctttggctccggctgcagctgatttatgtgacaaaaatctgtatctgccaatgtttgccaaaggagcgctacaagctggaatcatttcatgcgatttataaacacatttaaatgaaaagaaaatgttttacttgtattcggcatcgtgaatgtattttgtgtctgaatttagaagacaggaagtaacccactcttgggaatagcactcagaaagcacgcatgaaactcttctttccagggtta

SEQ ID NO: 54647 - DNA, 1881 bp, Bovine  19866880527858
aagagaggcttatgatacagaactgtccctaaaagccaaaagcatgtaaccatgagacctgactgcttcacccagagttgtttgtttccgtctgggctcatgaaaatagtgaaatccacttatttgctctcaaccagcatttttttaatgggatgggatgcaaataggatagggtagaatagattaggatagactgttgggatatggatagaatagaatagaataggatggactacatcctataccttatatatttcctcatgaactcaggtacatggtgggcagtattgcacagcatctttctaactataagctgaaggaaagtatttgcctattgcaccactggtctctgactctccacatatttcaagtcatcatgaaaccctttgtatctttttaagattcaaatctatttcatgcaatcagcaataagagaagaaaaaagtgtggtcactttctatgagatgctataaaaaagcacaaatgaacttcttggccagcccaatacttaattatatgtatatactatatcattataaaaagattcaatatggctgtttagagataacgtaactagattgaaaacatatgaaactaagtgtagtataaggtggtatgagaccaaattttggtcagacatttggtcagatacattatttgtatttctacctctttattcatactttgggtggtcaaatagtttgatggatttgctctattttatttgcatgaatcatatttgccacacccatataactcaaaatataagctccaggatccagaacttatatttaggagaaataaaatattttcatctagggttatctaaccattcccttccagtacctgtgagttgatgattagttttctgcaagtcacaaaggaaagaccttcctctttcttttgttccatgtgtgtgtacacacccgtgtgtgtgtggccacacgtggcagtgagagatttttaaagagagaaaaagaatgacagtcatggcaagagaagggtctcaaccactgtggataaatcaatccatcaaaaaaaaaaagaaaacaattctgccatgaaacttaatcactaaaggtcatgtcggagagtaaggaacagattaaattagcatagtattagatatggaaaatgatttctgtcaaaatcatctttaccacaattataatatgttaattacatatttcattaaggaagttgattatggttcacggatgaaatcacgcctgcaagacacctggaaggggcggcggagcctgactcgtcctcccgttcctcctgggcttcccctccgtcctccccactcccctcctccctctcactccagccccccagccctccttttccccttttcccatcctcctccttatcaccccacccctgtctgatgccatcagcagtggccagatgtttccctctttaagctgatctcacgtcgggactcaaggctacagtgtggaagtgagcaaatagtggccgcttaaaggccattgtggggatcttcatttttctcctttttggttttgccttttttaatttaaatgttattgcatattaaagtatagttgattttcattgtgatgttcatttcagttgtacagaccgtggttcagttatacatatacacatatccatcccttttcagactcttttcccatataggttatgacaaaatattgagttgagttccctgtgctatatagcaatggtccccaacctttctgacaccagggaccagtacctgtgtctttgttgatgacctatttatatatagtagtgtgtatgtgttaattccaaactacttatttatccctcctcccaccttttagtagccatcagttgttttcaagggctcccaggtagcactagggtaaagaa

SEQ ID NO: 54648 - DNA, 2292 bp, Bovine  19866880714539
tgggaaaggctggatataatgcttatctatgtctaaactgacctgccctggtggctcagtgataaagaatttgcctgccattgcaggagacccaggtttgatccttgggttaggaaatcccctggagaaagaaatgataacccactccagtattcttgcctggaaaattccatggacaaaggagcctggcaggctacaatccttgaggtcacaaaagagttggacacaacaacaaatgtctaaaatatcactataaggctaggggaattttcttttcctgccactgctgttagaggaggaaaaatggatatcaattattttgctaagtcatggaaaactaatgggtctctctcctcatgacttggggtagaaagcttgcatcttagtatatgaattcttctggatgctacaaaatctttataaataaatgagtacagtatatataatacagtatatagaaatatatatacacatacatatacaatatatatataagtataatatagtgtatatatattatatacatacacacacaatctttataaatagatgggtatagatgaatatagtacatattgatgcttttgaattgtgatgctgggagaagactcttgagagtcctttggaccgtaaggagataaaccagccaatcctaaaggaaattaaccctgaatattcattggaaggactgatgctgaagctgaagctccaatactttggccaccctattctaagagctgactcattggaaatgaccctgattctgggaaagactgaggtccagaataggggtggcagaggatgagatagttaggtaacatcattgactcaatggaatgaatctgagcaaactccaggagacaatgaaagacaggggagcctggagggctgcagttcatggggtcgcaaaaagtattgaacatagcaagtgaacagcaaatgactgcttatttaatctacatttggaagcaccctgaaggcagagagagttggggcagaggtaaggagagggaagatgtctattttggacatctaatttgtctaatctggtatgtccaaggacattaagagacgggaccaaggggacacacaaaacttgtttcctgaacatgagaaacatttttttcctacacagattaggttcaaaggatgagatcagctcaccacaccgtggatgagtgtgaatacacaattattgtgttcattatggtttaaagcaatacccagaaaaggcaatgtgttttctggccagggcaggaatgtgtcagaagcatatagctcgtgatgtcaggaaaatataaactgacaatatttggaagccatcagggcagtgatcacagtattaggcaagttaaatcttaaggggtgttaatttttttcctattggcaaagggctcaaaatcttcagaacctaattcccagtaggaaatatagattcagcaagaatttgcatgtgtttccccagaccaatttctaacatagcaaggcttccaaaaacacccactctgctttataaacacatgcctcctggctgaaagcttcactagctttgaaggttttaaaggcatacaaattcagggaaacaaattatgaccaataaaagttgaacaggatctgtaagatggcctcacaatgctggctgactctcctgctggaggatggttttagggcaatgtctgatcagggttcttaaagtgaaggaagctgagtcattggatcaaaacatcagtggctcagtttggggcagcacaggtatttgcaagctcagatcaaatctttattatcatgataaagtagattaagcaaaggatcacacagctggttaccgatttgatcagtttcatagcttttagaaaaagtaatcatcaaagaatttaggaagtaacaaacacagaggcatatggtgggaagacttaaaagagtaagcttaatatttaatgacaaacctagacagtgtgttgaaagcaaagacgttactctgccgacaaaggtccgtatcgtcatcccatggtcttcccactggtcacatacagttgtgagagctggaccgtaaagaaggcagaacactaaagaattgatgactttgaactgtggtgattgagaagactcctgaaagtcccttggacagcaaggagatcaaaccagtcaattttaaggaagatcaaccctgcatattcactggaaggactgatgctgaagctgaagctccaggattttggtcatctgattaaaacagacaactcatggaaaagtccctgatgcgggaaagagtgagggcagaaggagaagagg

SEQ ID NO: 54649 - DNA, 1620 bp, Bovine  19866880742253
gatgtctctaagttgatccccatttcttcctggaaaatctggcatatttgttgtaaagatcagggcttcccaggtgatgctagtggtaaagaatctctctttccaggagacaaaagagaagcagattagatccttgggtcaggaagattccctggaggaggaagtggtaccctactgcagtattcttgcctggaaaattccaccggcagaggagccctggtgagctactgtccacagggctgcaaagactcagacacgactgagcgactgagcacacagcgcggttgtaaagatcagtctcatcacttaaggtcacgtattttataaccttattcattcaaaacaaaacaaaacaatacacattgttctagtggtgtgcctggtatccagtagagctagatttatgcatccatcttctctgaagtttatagactgcttgattttcatcaacaatcagcaaattagtggattccatgttgacttacatttgaacctaaaggtttatttatttaccatccacattaaggaaacattatagagagcttttaaaagaaaaacaaacggctttggggtcaaaggagtagaaagaatcccaatttatcattaggccaggttcagcaaacgttgcattatgaaccaagagcccctaaggaggacagttccaatactctaaacaaatacaccattacacttaattgacttagatagaaatctaatttcttgattgtttatggccttgagcccactggtggatgacaaagttgtgtatatgtgtgtttgtgacaagcatgaagggatatctcaggtatcagtgaagaaacgaatacattttcccgtgtgcacccacacagactgatgatcgctgggtgttgctttgcactcattctcattcagaccagaattatatactcttaatataattaagaattatacttttgcatatatgcagcctgtatgaatttaggggtttttataaatgttgaatacccccaagaatacaacaatgtgaataaaaacttcttagctatagccaagagggaaacagaagtgagggaacagaagagtaaccacaggatttactgagctagacacttccaaacaaaccgaaggtaaagctgtcatgctgctgctgctgctaagtcacttcagtcgtgtccgactctgtgcgaccccatagacggcagcccaccaggctcccccatccctgggattctccaggcaagaacactggagtgggttgccatttcctccctcccaatgcatgaaagtgaaaagtgaaagtgaagtcgctcagtcatgtccgactcttagcaacgccatggactgcagcctaccaggctcctccgtccatgggactttcccaaggcaagagtactggagtgggatgccataagctgtcatagtggtgatgaaaatcaaaatcaagcacctgatacacgacttaggaacaacatcttcatgatcttctgcactagtgaccacttgagtgcaaatgactttgaaagatgagaaggcacattttgaaatcccagcaaaccaataaccttatttggcattctgaataaatgccttctctttggttggcatgagttacgacaccagagaccagtgataataaaa

SEQ ID NO: 54650 - DNA, 923 bp, Bovine  19866880855974
aactgacaaattgctggaggctcaatatggactactttgaaagttaaaaactgcaggagagttcagtcttaagtgagcccccacacttttcatgattctttgaacatcataaaaaattagttcctttgtgcctccggctgagagagggaaatacagcctttttaagatatgccctggatgtacagttcttgttaataatgctcaccctcaatagaaacttaggtcacagaaacctaatagaaacctaacctacttgagttttaccagggccttaacaatggtggggaggaaaatacccaactccagaaccttctagtcttcctgtcacttctcagggggcaaaggcaaacaaaagtgagatgcacttgtgaaagtcacaggccagggacaaagattcattaaaagactgagacctaatcattggactatagaatacttcacctcctccacacttcaccagcacaccagtagagatcctatataataacagaggaatacaactgaaaaaaacctgtgcatctcggacaatattagaaatctctagagaaacccccaggtaacaaggggagacaaaaacaaaagacaccagtggaaattttagactctaatacctgttgaaatccttggtgtttatacaaagatcctgaagagatatctgtacaactatgttgatgttcactgaaagataactagataaacagaaagtgatatatacatatgacacactattattcacccttaaaactaaaaattctgacacgttttatattatggacaaatctttaaggacattatgctaagtgaactaagccaaccacaaaaagacaaatactatatgattccacttatatgaattacctagagtagtcaaattcatagaaatagaaagtataaaggtgtgccagggttggaggcaggggaat

SEQ ID NO: 54651 - DNA, 1362 bp, Bovine  19866880866691
ataaagggcagggagaaaagaagaaggaaggagggaagggaagaaaggaaaataaaaacagggttaagtggtgatgagtcatttaaacactatatgatctggcgacttcaaatagtaagagagaagccataactcttgcttctctggtccaaagcatgctctcttctctacctggtgaacaggcttctctagatccaatttacttcaggcttgtcgctttctatcctggagaataactaagtttataaagatcctcttgcctcctgggcgtcttaatcatgataactggtgccttcacctctccccactcctccccacctccaccaaagtccatttctttcgtgccccccaggatagaataacttttacaaggcaatctgttgtcatcccgtcaattttcctttgtgaatggaggccagagtagtgcatcttcaagggtcactctgaacgatttattcctgcagagcaaggctttcatgcgctcctgtaatgcagactgcaaaccagagggctgatactgtgtacagcccagttcagaaggcatcaccaataacacgcacaggacacaaacagcccctcaggtgccttcattcctttctctgaattctttcttgactcgttttgcgtttgaaaaactgatcagagtaacagccgaaataccagaagttttagctaactgctgcatcctccttgtttgaggcttactgacagtgagaagacccagagttctcagtctgcttcaaagggtgctcagatccttctaaatctaaaaaaaaaaaaaaaaaagattctggttttccattctttaccacaatgtgaacacgtgcaacgttactgtttatcatgtatttcagcattctgaagagtttaaggcagagagcagcagatttctcccagtcctgtaaaacacctgcttctgagtccaacctactcatgagcagtccgttttgtggaaacgggaccttcgattctcagaactgggagtatcttaaaactctgctcattcctgtcatccgtgtctgtctctacatctctggcatcagagagcccattccttccttcccatccctgccttctttcctttattagaaaacatctcctcatgctggactcatatccaccccccagtagtctccacattctgtgtctggaatccgacagtctctgtaatttggtcccagtattcctcagtgcttgtctgaactcactttttcttcccacccattagctccaggtgaactgcttccaacctggagtccacgatagcgctcctggcctgcaatccccaagctttactccatcgtatttgctgtctgtggctggctggtcccctgcaaacaccactgcatcttcatccttgaa

SEQ ID NO: 54652 - DNA, 968 bp, Bovine  19866881037745
ctgagatgacgaggttgacatccgtctgttagtgtgcgtccccatcgacatatgaatcttacagagtcgtctgctaacattccagcaaaatcattacagttctttctaggttgtctttttcctcttatatttcaagatggaagttttccatactaatgctgcaaagtgggtattatgttgagtcatgctaatcggttgcatggatgctgtcacatcacatcgttcagcaatgacactggagacacagtctcgggtcttctgctgtctttcaaacggcccggtgctgccagcgcctcacatccggggaccctcctctgccgcgggatgacgtctgtctggagaggttcgctaggaatcgtgggaagggaggcggagagagctatgtctgtgttgctgcgtgtcctcttaaagaggaaactgtataaaagggctgaggcattttgcgcacgagcgtatgtgaatttatagcggcttcatcgccaagtattattttcatggcagcacttcggtaaatggtgtgtcaggccctccttgaggagcttctggttttaggattttaccactagctcataaaccaggaaacactcctgttaaagcgaaggcttccagaagcagttttcaaagataagtttatttgaaaagggagacttgagtttggcggttttcaatgctgcttttgcaaaagggctgcgctcccaccattcccacccctgccctgaacaactgtagccactttatagggagctaggcaattgttgggcagaagtggtcttcccagtagtaaagacactgatgacggctggtgtgcaggaagggggtgagcagcgaggcgggtcgttacagccctcctgacggtgagcaaactggcttcacggtcagcatctccatgaaacgcacagtgtcccagcgtccctgggtcccctttgcactttgccatcccaccaactcggcagggcattctgccccta

SEQ ID NO: 54653 - DNA, 1785 bp, Bovine  19866881099668
gaaaccctgatgtgcctagtccgtgggatcgcagagtcgcacatgacttatcgactgaacaacaaatgctttcaaagttcatgctgctgtagcatctgtcaatacaccattccatctaatcaccaaataacattccattgtgtggaaataccatattttattcacccagtcatcagctgatggacgtctgactaatgagaaaatgatccatggatgaaacatttggcagtgttttactccttctggattcttgtgttgagcaatctcctctggttctcaaactggccaggtctgcagggaacgtccattatgaagacgcaaggctcttggctgcaagcaaggtccttggtccctctgcgagtgacaagaacagatgagttgagttgacagatgctcttatcagcatctatggaagttgatggcacctgaagcaaacctccaccttttgaaatttcagagccccagtttagcaattctggaacattaatgatctgttgtgagggccatgcagccactgcctgtttctgaaacactgactcctcttagcttggtagcaacccaaacaaaaacagactgctaaccaggcagtcctaaatattttatttcatttatcaattcttacattttttttcccaagcactcctttcatgcctgcagtcattgagttgtacaggagaagaatactgcacaccaaatcctgttgacataactgaattttccatgtcttattcacacctctgctaggctgggtctattgttaacgtgatgcctggttttgttgttgttgttgttctgggatgcaggttacaatctatcaagagaaaacaatcataatgagatttctctcagttttaaacctaagtttcctaaaagaatctgggaattttaactatttgtcaatacacgcttcacttccctctttgctttgtcttttcgttttggggtcccctctcaagcctgtgggattcgcctgcctctggggccaggatctgccattcctctggaacagatcatcatctgggtatggcatgtaccttttatggcactttatacagaccagcctgagtgaaataaatacacaggatgcaaagctcaaagtgacacatcccagatctctgacattcttaccatggctttgagcttcaggcactgacaaatctcccacgcgtaccagctctcccagaggacgggctgtaatgatgtttatgttatacaatatgtaaaatatttatacccgggcttcagcacaaactgactatcacttaaatcaggagctagtatttacattcggggcaaggggggctctctgtgtcactctttgcaggcagaaagggagcccgatagaataaatgatcagtttatgtacagaatcagattccagcagtgtctctgctttaaaaataacagttatgggaaaggtttttaatgtgcatgcttcttttagaattgttaaattaccaagaagggcaaaatttatgcctttctgactattgcccttatctttagaatggaaaaagtcttttcttttgacaaaccgttctttcatgaataacctcttcaagagcatttagttatcattattaataaattgttaccgtaataaattatattttaaacattttattaaatgcagttctcatgtacttaaaataaattgcaaagccggcttttttcaaggtatttaatatatatggtgtgacacaatgtgcttttaatatatttaatgttatatactttaaaatgtaagtgtgttgtacttttatggaacttactttatattccttt

SEQ ID NO: 54654 - DNA, 1499 bp, Bovine  19866881152045
tcattgggatgcatgggtttagttgctcctcagcatgtgggatcttcctggaccagggattgaactagtgtctcctgaattgcaaggtagagttttcaccactggatcaccagggaagcctgaggtggaatctttgccttcctctctgagtcccggacctttcttgctgtggactgcatctctcagaatcacgaattgtttgcatccctgccataggtgactcagtggtaaagaacccacctgccagtgctagaggcataagagacgtaggtttgattcctgggtcaggaagatctcttggatgaggtcaggcacccgttccagtatttttgcctggaaaatccccatggacagaggagcctggtgggttatggtccatagggttgcaaaaagtcagacacgacagaagcgacttagcatgcacgcatgcatcttctccttgtctcctccatcctcttgtctaggtacttggctgtgtccaaatttcctcctctcacaaagacccgagtcctatagcattggggctgacacgaatggccccctttttacttaattatctctttagagatctatctccaaatgcagtccctttctgagatcccagggttagggttccgacctatggattgttagtgggggacacaatacaacctattacattgataatgcaatttctttcgtcattgaaatcccacagttctaacatttttgttcgcttgcttgcttgcttttaactctgcagactcatatcttggtctgactcttggagatatttaattacgtaccttttcatgactcttgtcattgccctggatggagccacagcctggacctaataagtattcttcctttcaaattgttcgcttctccttcctatttcaaaattggatctgaagttcccccacatggcacgagagctgtttgtgcgttgcgagctccaggtccttaaatttatgaattattgtctccttgaaagcgaggctaaccagacctgatttccaggcatccccaatgcacatgaagccagacctgcaataaaaaatgtccggtgagttcagacccttctatgggagagttctgaaaggcaatcgcttagatttgctttttaaattttttttccccctcatactgagaaggatcgtgcagaatcaacccactaaaaaagaattgtcataaaatctcacaccattgacttgtaaatggaattgaatctgtagcgtctacataatgatactatcaaaaaggaaaaaactatcacatccatataacagatgagatatgaaatgactaccatggcagatgaacaccccagaggtattttgctttattctgctcactgcgtttataaccccagtttctctaattttagttatttttttcctcaggtctcaagacaagagcagaaagactcttcccccaccccctcaacaaatcacctcatacagaagtcaataatataaatacttacgtttctggggtcagggctggggctttattaa

SEQ ID NO: 54655 - DNA, 971 bp, Bovine  19866881240499
cagacaagaatactggagtgggttgccatgcccttctctaggggatcttcctgacctagggattgaacccacatctcttatatctcctgcactggcaagcaggttccttaccaccagcaccatcaaggaagcctaaaggtctttcatagcaagacatattcacaaatgacctaaagcactgacccagtggtaggatcatggggtacagaggagccagaataagcagggaggaagagctgcctttggacaaaggtgtctcgtggtgtatgagacaaggaaacactgttaaaatgcactgtggttttttagaagctatttaaggctagaaatcaaaggccttgcagacccatgtggtcattttagccacaagcatagagatactacacactggcacacgtgtgtgcagacacacacacacacacacacacacggaacactgagagtcaggagatacggattccaatgccagctccttccttctctcaccacataattttgaactgcattaacatctttgtgcttatatgtctcgtcctaaaaacaggcactgctgaatcagacattttccaagaatccttaaaattcaggtaagcctttggagatggcttcattgaagtcgattgttttcattcctaaaatagatagttgagaagaacagggaatatttcacttgataacaaatacaaatagcatggtcatgtctccaaacagccctttaacagacagagagatgatatctaatgacaggtttctaacttaatgccattttatacagaaaaataaagtgtttttgcctttataaaaccaagttaaaaaaataatgcatatgattctcattaataagtccaaacacatcttcttgtgtgaactcatcttacggtgctatctcattgaaagaataggaaaatgttgccaatttactgcaataaggtaattactgtaataagataaatgttaactttttaataaaa

SEQ ID NO: 54656 - DNA, 1467 bp, Bovine  19866881273558
ccatatagctgactcactggaaaagaccctgatgctggaaaagattgaaagcaaaaggagaagagggtagcagaggatgatatggttggatagcatcaccaattcaatgaacacgaacttgggcaaactctgggagatatagagggacagggagccctggtgtgctttgtccatggggtcacagaatcagacatgatttagcaactgaacaacaaatatataaatacatttaaaaggaatacattctttttaataaaaaagaataaaaatttgatatatattaaataaagaatagatattaaatgtatttaagaagaatcaggtcttttatcccaatttctggagaaaaaaagaaagacaaagagaaagagagcaaggattaaaaggtgcttccaggaaggatgaagagtttcagagctcatcatgaacgttcatgaagtacgtcaagaggaaaagtctcagtgtcagaattactgatctgctgaccctctggtggtacagtgacccctgaaataacaccttctggcgattcttctgggactgatgactactggttccaaatcaagatgcttctcacccagatgcttctcccccacagtcaacagttcaattgttcttatgttaattagaactggaactcattagagagatgcaaagacctctctgaatgggaggcatttaaggcagtagtttaaaaaatggaataagacttaaaatcccaaatggcaagacccacacccagatatccatgacagacagaaatagattgtacaaacacaacccagatttcaagcgatgattgcaaatcaatggtgtggtagctccagaatataaccataactcaaccattagtaaagtatattagaattgctaccaaaatagcaaaatttatcaaaatgaggatgcagcagcattaagaaaagtaaaccagttaaaatgtgttttataatttagttttctggacgataagatacttgaaatataaaataaaataatggccaaagtttagacattgggggtattattgaccgtagcatttcagcagaaaccagataatgagtccaaaagagaatcaaatacaagcggctattggcggaagcaatactctgatgatgacttggcctttcctgggcgtaaaagggcaggacagaacagaccatatggtgtcctcctgacctttcatgtttctgtgtaactctgtattaacaaggcaacagccagtctgaggagagaatgccatctggtgctatagagatatggagcaggataatctattagatggataataaaggcaaggctgttggaatgatacccacctgcccaggaactataaaaagccaggtgcaggaccttgggttgatgttggcccagttgtgagcagggaaagcacatcgatccaatttgctaggactctgtttctataaaagcaaaacgatcaatgttttccattggatcattttcataacg

SEQ ID NO: 54657 - DNA, 2571 bp, Bovine  19866881312724
ggggttatgcagcggagagacaggaggaagagtaagggaagagtgtatggtgatgcgcatggacctttcctcacctgggagtatcgctcactgagctaattgagtacagtctctgccttttaggagtttgcaactaaacataattatatcaacataattataacaaaaagctcatacatattcattacttaattcaactaatcttagaaaccacttgctatactcatgctctactgggtgtctgagatgtgaggaaaggtatgctccaatatttgcccccaaggaagttaaagtcatggtggagagaccaacacgccacaaatcatgagaattcatttcagtatgtagtggtaacgtgggcagcatgaggaatttcagtaatacaggtgtggagtttagagcatccaagcaggtgatggtgtgagaaacactcaccaaatgaattagtcaagcaaaaacagtgtgtgtgtctgtgtgtatggcagtttgtgaatagccaaactgtaaggggtcataaatgtgcagacacaaagttgtagcactttttggagtctctttaaggagatttatgcttttatttgagtatcaaatatcagacagtgatagaaaaggtcagccacatggaacaaatatgacttcttttgtaccacattaaagcacttatatttgattttatgctacagaggataaaggaaagcaagaatgaaaaagtgtgtgagcaagaaagtgactataaatctgattagaaggtttaggagacactatatggaaaaaataacatatgagaaatgggttagggcattcctggtggaaaaactgagcaagggtggagacagcaaagcatggagcatcgtataggaagatggagaatcttgctggcctggggcacagagaagagaaagctcctggtccgcaggtgatcatccagtgcccagacatgcaagctggacagcgaagcagaagtcatcaaagcaggaagatcttcattaatgagtcggtcacttataaattagtcgccattgtttaatgcaatggtttgttcatttccattgagtcaatgatgactcattaatagattcagataatacaatacaaagaaaacacaactgaattgtaaagaaaaattgcaaaaatcgaaaaatatgtgcaactactagaaatcaataaatgtgatattggagaattacttaaatcttacacaaagacatttataaagagaatttagcagttgacaatttattgttaatttcaaaattatgtaacaattaacttccaattaatgtagcaattaattgttggcctcaccatagaaaaactccacaaggatgataacatggtaggctcattgaaagaaaatcctgcagagatcacataattacctgagagagatccttgggggaaatgatgaagactgaaagtacttgcttgcagacgtgatgattgttaagattatgcagcaaaaacaaccatgaagagaaggacgcagatgacgaaactgaggcccagagattcagataactcatgcaaagtctagtgtaggatgcagctaagatgagttgaaggcattatcctcctcgttccataacctataacaggatttgcctagagcctccaaaggttttatcatctgcaaaatggggataataacagtccagtccttccaaggaggctgtgagttttaaccgagataatgtgtgtccacgctcagcacaaggtcaagcccaggagagacagatgagtgctgtgactcttactatttacagcatcacgatttgacatgaagaggctgcataaatgattcaggcttaccaaacataaatacatacttggtgcttcctttgattattttcatgtgagaaggaagtgagcctttctttgccaaataaataatttataatgaggcttagagaaagtgtgtgcagcgcagaatgaaaaccaaacccgcagtgagcagatctgggtgaagtccccaagaatggtcatttctagtctcctaatgagtgtccacgaggaggggcggctgagtccagcatctccccatcccacccatttcagagcagagcagcctccagctgcttctctcaagaggaagatggtgaggcgatgagggactctccgtaagttactttcctataacagagacatcattctgcatgccagcacttggaaaatttctagcattttccctcaaccatcacacacttcctttctgctgaaagaaagactggggaaccaactatagccttcttttaagactccagctcctcatggacgtccgctcctcaacaatgtaatgcctcgctcctgcaggaccctggagggtctcatgtggttttcgctgcttgcttttgcagtgctagctgtttcctttttcatgtccacctcttcttataatggtgttttcaggttcccttctcaccaatggctgcacactagtcaatgaaaatacaccctcctcccttccaacttgttgtttttcagatactggggatgagaaaaccaaattccatcttattagaactgtgtgttctaaaacaagagtaaatcggccccaaaagagcaaggaagggt

SEQ ID NO: 54658 - DNA, 891 bp, Bovine  19866881412059
taaattccttgaacaagttgcaaagtggaagcacacaaaaagaaaagtaaagtgagctgaattcccctgcaaactttaatatatgcacacagaagcaatttctaggtctaactgaaaagctttctttgtttttaaccatctcagatgcccaaaataaagaccctagccagacaacgccacccaccatgcagggaagatacagaagataactgctcacgtgaaggcagaacaaaagaaaaacaccagcccctggatcccaggtgtctcaggaaacagggatgcggtatcattggctgcctggactggatttagaatgtgggtacatacaccccatgggctcagatcagggctgaaaaacagcagagagaacactgctcctgagtcttctaaataaaccagtctaaaatggatgtatcccctaagagctcacaggcctaattaagattttttgaacctgatcaaaacgttaattactctgcgcaaactgagcaaacatatagatgtcacatcctatgaatgtttctttcaattgctgtcctgggaagacagatagaaatgaaaatagcacctcgttaagtagaccacacgactccccggccctggctctcctgggtgctccatctttgctgaccgtcgtgtttccctttacagtcaaccaggtaggatattataattccagggactaaaatttattgaacacttactcttgtcaggccctttgcctttggtcctctgttggatctgtcaataaaattacaagacggatttcagcatttgcattttatgggcacttgtacccagagaggccgagcctgtgtcctgagtgacacagctcatcagtggaggggctccaacaaaactcaagtctgtctgaccgtaaaggtcacatgg

SEQ ID NO: 54659 - DNA, 580 bp, Bovine  19866881751362
tatgatcatcttagcactcattttcataagaaattgaaatagctcttttaacttgattaaaaacggtcaagtttacttttttaaaacatctaatttataactttctgtgatattcattaaccttgaaaaaggctttcagattgaattatatttgtggaaggtcctcaaacgtatgttcccgggagaataagggctttcagcatctctcttccatttgaacgatggcctcgaactctgtctttgtgtcttgaatggtgtttagagcaggaacagccttttgtctacaccgcctccaatgtcctcctcacctcagggaaatttctcattttctgttgctgttaagcaaacataagaaacaaatgaaaaaaggaaaaatccactcgtatgccaaaaataaagtcatattaacgaggtggcttgaacctctaaatcccagggcattcattgactgaaaactgagacttcatcctttacccgccaggacgaacctggacatttcccaggatggagctctctcctctgagggtgattcgccttcagtaggaaaccagatagggctggtgcgcctgagcggggtgct

SEQ ID NO: 54660 - DNA, 1664 bp, Bovine  19866880572797
ttggtgtggtagccattaaaaaaactgcactgtttaaaaacctttgtcattcagtacttgagtgagacttagaggacagctggatgaggttgacaacctgaggatgagaggttagttgagtagagtaccgaaacaagctgataggatattgtgggggaaagataaagttaaaagtagcacattaaactcttttccccaacatcatctcttgtaatcacattgaaggaggtcccttagaagatcagatttaaaccccatttccaaaatcctcatagcatacccagaaacgatagtttgtccttcacattgatcttgtcaactagccccacagttcagacacaatttccctgttttccctgagacacagatggctaatgttaattttgtttaacctttaggtggaacccttgcctttttgacaatgataaagaaaccaatgtgattttaagatacccttgtatatggacacttgtttttttctttttttccaaaacctttacaaaagttcccctcactcctcaaccattcattttactttttataactaatgggtatactaaaatattataaataattgaatactttaaattctttgaattttgttagagatatatctgtgtaaattgtggatgaaataaagttgtagaatgagaaaaagatatatatcccttatatatttgacttctacagatattattgaatcacttttttttttttttttttgactagttaaccaggggtaatattaaacaattgaattccaggtcagcaaatacatacaaatctcaatgttgcttttatctacagcttttcatgttgaaaatcactttttagtctgccctatgggatagctatgtgttctagtggatttgctattatataatcatatttctggtaatttaaaagcaagagggtcattgaggaatgcttaatttggcctacagtggtcagccatcatcacagttactttgttgttaccaaatttagaaatgagttttaaaatgtgtttttcaagttcatctatacagaaggaattaatttaaaatatattttatttatgtgacttatatccttcatgattcatatttgggcttgtcttcaggcaaaagcaatgttagctttcttgggggaaactcctttaatttgatagtggtaatgttttgacagctggtaatttgcttatttgcatcttactgattattaatagatcttctagtgcagcagttagttatataaactagcaacctgcagttaaagaatccttatttcctattaattaccccactaagagaaaacagattagttttttcttgagtattatcattaacatcatgagatatttctcatctcaatgtaatagtgattattatttcatgcgtaggataatagatatctaccttgaacattgcaagattcttttccagttcaccagctattactatagatttgcactttataaacaatttcagtagagatggtgctttagctactgttgttttgttgggatgagataacctagaaaagtttaagtaacttgtttagcttctccacattatgcaaaagatctttccttgttttcagtgaatagggcattttgagggaagaagttcctttaaatatgttcatagggatatattatattcaaatggtgagatgtatataaa

SEQ ID NO: 54661 - DNA, 2256 bp, Bovine  19866880604263
gatgtataatgttatttagtcctgcactgatttactcattaataaaacagtgcagtgatccacagtgtagtaatccaggtcacatgactgaggtcctgccaccacttgtgttactcagagacctttgctgctgtatacacacgccagttgtggaagatggcaccaaaatgacctcttaaagaaggaatttgtatttgtgaggtagcatggtatagtcactagtctaacgtatactccgatcaaattccagcttttgccaccagttgtgtgacttcaaaacttattgtttaaattccctggtcttttgctttcttaattataaaacaactagtatactcttctcataggacaactgtgaattaaatgcagaccggtacataaaacattaatgtaatccctggccccaaagcaaacacttaatggctggcagcttttattatttcaaaatgcagaatagtacgaagacaatgtatttcattgatgaaagtcataggactctttactggtatgaaatcttaaaagatctttaagctgtagtatctttcataccattttgttgactgtcaacaaagcatgtccattttccaggtcatgagtttgcctgtacacttggagctttgcataatttgaataactgcttaactattcagaccttgagaagtcaaaatttcctatgatttggtaattatttatagcaaatacttttaagactgtaatgcttaccagtgtgccttaccaataaatattaaatgatggattaatgtatatttcaatgagggcaataaagtacctcaatcaaagtcaagtttatgagctattaccataaagttagtaaaataataaaatacacatttgttgtgtgcaaaacacatgaattatctcatttgatcctcaacaacatatgagatagaccatactattattcctattgaacaaatgcatagcttagaatgagagaaaataaattattttgctaatatcatgtactgctgttattgttggttagttgctaagtcatttctgactctcatattatcccatggtctgcagcctaccagactcctctgccataggatttaccaggtaagaatacctggagtgagttgccatttccatctccaggggatcttactgatccagagagcaaacctgcatcttctgcattgcaggcagattctttaccactgagccaccaagtcgttactaatataggaaaattagaatgtaaatgcaagtgaccagtctctggaattaaagattttaaccattgtagtttatttctgattttatagaagagtcagatactcataaactgtacttttaaattaatttttattagagtatagttgattacaattttatgtttcaggtgcacagcaaagtgaattggggatagatattggggatagatatataatattatatatatatatataagaatgaatatatatatccattcttttttagattcttttcaaattaggtcattatggagtattgagtatagccccctgtgctatacagtagcacagtatacaccctattatttatctattttatgtttagtagtgtatatatatcaaaccccaacctcccaatttatccttttcatgccccctgataactgtaagtttgttttctacatctctgactctatttttgttttttaaataagttcatttgtatcattgttttagatccacataataagcaataacatgacatttgatagactgcattttaatacaaagaggatccttgtttcagtgaattctgggatttaaagatgttttaaatttctttagggtcaaaacagtgtctgtcacatatagtgagaataatgaaaaaagtcaaataagaaactatagtttgaattttgtactttcataccatgtgtagcttttacaagaagatagctaatgcatgaagtgaagccaacatgtaacttaatgttggtcttttaggaattttccttgtatgcttttcactgacactataatcattggcttgaatttcttgaatttcttactcatattgtttactaacaggtattgaagttaggcagtgtctcttcaatttcttgattaaaagtaaagtctgtttaggtaatttagatggaaccaaagtctcatatagaatattgcttttgaacaaaatataactgctccgtctaattataaaatgggtagttgattagaaataggagccttctcaatgcctgcccatttaatatgatggaaggtaacataagagtag

SEQ ID NO: 54662 - DNA, 1395 bp, Bovine  19866880687264
tgaatcagatcattgcctgcttgctacttgctcacctgcacagcctgcttcccttatcaccagcatgactttcaatcttgttgcagatctagctgattaaaaacgctggtcttgagaaaattctctttcttgaaagtcagtgctgcaggagattaggactattcatattgtaaggcactcccttcaaagcctctggtggctttactctcttgactgatgcaacccttaactaattctctttatccagataatccacttgcttccagtattcatcaaacagcaaaatgaaaagcttttaagaaagagaataaatgtgcaggcttaaaatcacatagcgttttagtcttaataaaactgtgaaaaaaaattattaggaaatcagatgtctgaatcttaggtccagtgaaataacttaaaagcagagaaaattcaagagaccataccaaatgtgttttgtactttttgaattgctttagcaggtgtgtggatcacaaactttcgatgagggaaaagaactgtgttttttctctcagataaattgaacataaggcaacccgcccaccctccacgtgagcccagcttcttctctttatttgtgtataattctcaattgcacgtgatatttgatgtttaaattgaattgattaggtatttaatgcacagtgatcatgcacaaggtactaacaaatatacgtatctaccatgaatgggaagaaccttgtcctgagggagctctggtattacagtaaggaccgacagagctgttctgagttagggccagaaaatcaaaacattcaaagtcaggttttcccttgattcaatcactcctatggcactgggaaaaagaaatgtgatgaggaaagggatgttttcaaagcagtgacgtccagaattccagttccaaatgtatagaattgacaactgaacagatttccataactacctataagatatgtgattcggaagtggtgtaactcaagcttcttcatgcgacactttgttttagggctggcatgtggactgaccctgcaagattcttactgtcgcttccaggataccacccaggaataccaagtatctgccaaatagatttagaaactacttggagtggttcagtggtaaagaattcgcctgccgatgcaggagacgcaggagatgtgggtccgacccctgggccaggaagatcccatggaggagaaaatggccactcactccagtattcttgcctgggaaattccatgttcagaggagcctggtaggctacagtctatggggttacaaagaatcagatacaactgagcgcacacatatgcacgcacagcaattctttcatactttgaaaaatcctgtccaagagacaacaaagcttcagtgttctttctaaatgacagtgtg

SEQ ID NO: 54663 - DNA, 1058 bp, Bovine  19866880738016
atttctggaattttccacataagatttttggattgtggttgacctcagggaactgaaacccatggaaagcaaaatctcagataagggagaactgttgggtgcccactgataattcccttttgttagctaccacttatccagtgtttactatatattaggcactgagataaatgccttttgtgtgttattttaactctttttttttaaatttaattttatttttaaatggcggattcatttcgatatttggcatcaaatgccatttaatccatctatttatttgtgatttgtatttccttattatattttaaatctctttcatcctacagctttgcacaatcttacctctcttactggttatcccacaatgtagctaacattcaaagtagcacaagtactcaacatgaaagtaaaatgtaatccccactctgtggaaacaggtacttagtttcccattaacacagttggaaattaacatgtaactccacattcattcgaatgagggtatatatgcaccgtgccagtaatccactcttaaatcagataccatgatttttgagcctttagaattgactgctttttagattatatcttttgactagaaagaaactactgctgtgaaatatatcagtttattatgtttatatttgtggtgattacattataaaacattttgagcctttagaattgactgctttttagattatatcttttgactagaaagaaactactgctgtgaaatatatcagtttattatgtttatatttgtggtgattgcattataaaacataaattttacctgaaaaggatataaccaaacatttatttccttccttttatgatacaggtaattgtgtgaatttaaataatttgcaagttggttgttcttatagtcataacaaatacatacagggactcatctataataaatgatcacaattagtggtttttttttttttattactggtggtcttatctattgcttaatccctgagttgctcaggtatttctagaattgaaatttataaccccctcctccttagctaattttttatgag

SEQ ID NO: 54664 - DNA, 4011 bp, Bovine  19866880869273
cagaaagaacattgtgcttcactgtaaggcactgaaaatataagtgtttttattacattaattaaatatattccagattcaattaagtggaaaaatcagctttgatcattctttctattattagactatatttttggctctgtgacgtatatttattttgaaatatctattctaattcaatcaaatagtggttcccaaaagttgttgttgggcaaattttcctagtcctatcccaagagtccttccctgggaaaatgggccccagaatgttaggctttaatagcaaggcaataattcagatttgaaggaaaaataaaaagtttcacaggcaaacaaaggttaagagttcaaaaccatgaaatcagctttacaacaattgttaaagggaattctcaaagtagaagaggttacaactagaaatatgaaaaatatgaaaggaaaagtctcattgttaaaggaaaatataaagtaaaagtagtaaaaaaaaaaaaaaggctaatttgaaaagacttgttcattgcagtgttatttacagtagccaagttatagaagcaactaataataaattaatggataaagaaggtatagtatatatatacaatggaatattaaccattcataaaaggaaacgctgctgttagcatgcagcatggatggatagagagggtattatgctaagtaaaatgagacaggaaaggatggattttaagaattatttcacttatatgtggaatatgaaaaaaaggaatgaacacaacaaaacagaaactgagttattaatagagagagtatatccttggtttccatagagggacagggtaaaagaagaagagtaacaggtgagggagattaagaggtcaaaattccagttgcaaaacaaatgtcatgggttttaaatatacagtatagtgaatataatcaataagtatataacattttgtatggtgacagatggtatctagacttattgtgatcattttgaaatatatagaaacatcaaattactgtattatataacagtagagtattgtaggtcagttttacttaacttcatagaaattagatttgtgattaactggtgggctgtgggagaaggaggaaatctatgaatgtagtcagaaggtgcaaaccctcggttataaagtactagggatgtagtgcacaacatgataaatacaatcaacactactttatgttacatgtgaaagttgttaagagtagatcttaaaagttctcatcacaacaaagtttattgctttatatctatatgagataatggatgttcactaaactttgatcatttcatgacatatgtaagtcaaatcatttttgctgtacaccttgaactaacacagtgctgtatgtcaattttataccaataaaactggagaaaaaagaactacctcttcatatcacttatacaaatacatgctaaatgtaatcattattattgaatttactgctttgggaactaaatataaaattatttctcactgaggttcacctgattggaataaaacaatttgtgttgtaattttttttaattgaagaatgactgatttacattgtttagtttcaggtgtacagcaaagtgattcaattacatattatttaaaaataacatatacatatatttgttttaagtactagcaattctagcagtttctgaaaaccggaactgtataatcttggaattaatgtatgaatgatacagaaatgagctcttatattcatattcgaatttccaaagcactatatttaaatgtgaattagatactttgcagtctcagctttgaaacatcccaatctttcaaataagaaaatttatttatcctttcatagattacagaagataaaggctttttatcattttaagtggaaaaatagttgagatgaaaaattaccttgacaggattgattgaaataaaatatctttgtaagattgagaagctattatgagacatataactgtcaaatgcatgcaagtcttagcagtattcgttgtttccctgataccatatttatcttgaaaaatttgaaagggaagtattattttaaaaatattgttgtcaacaggaataaataggttattttttattcaaaagcaagagatgtatttagatgttcttgtgacagattttgcatatctttaatcaatttttctacttgagtaaactcacttttgcttctgtgtgctgttatttattctgaaagttattgacagactctctggatttctagaaagatcagcagaaataagtgtttttcacatattcattttgtttttaatcaaaatgtctttaagtttgtactgaaattcaattgaattggcagatcaagtcctcacaattatgatacttcctttcctcacttcttttgcctgtattctgttcattataagaatggagattccagaacattcatctagtttgcactggcctacattgagtgtctactacataaaagtttcagatttaaaatttgctgatgtcatactgtgatgttgtcaattcattcctctgaaaattattacttaaatatagaggactgatggatataattattatttttcagtaagattagttcttaactggtatatacttccatcagattgcacatggtctctatttttatgccttttacagtttgtttcttatttgggtagtgtgtgtgtgtgtgtgtgtgtattcagaagtttatatatatatatccacacacacagactctttgtcttttatagtattaatgtatctgcacattacaagattcctaaatcaagtgtccccctttgtgtatagcaaaatgtttgtgcttataaatgtgtgtgtagtggcagagtaaagaggatagagggaaaggagggatgagagagaaagagacaatgaggaatgcttgcattttgatttttgttttaattcattttttcattaaggaatcagttttcccctttgtttatttctccttttcaccactgaattaatacatctcttccttttgcctgtatgtctcagtgtaagcattgaagtttctctactaatattatgtattctttaatttgcttgctggaaattccctggtggtccagtggttagggcttgtgctttcactgcaggggtctgggcactccttggaagaaaagctatgacaaacctagacagcatattaaaaagcagagacattaatttgctgacaaaggtatgtatagtcaaagctatggtttttccagtagttatctttggatgtgagaattgcaccataaagaaggctgagcacacaagaattgatgctttcaaactgtggcattggataagactcttgagagtcccctggactgcaagatcaaatcagtcaatcctacaagaaatcaatactgaatattcattggaaggactgatgctgaagctgaagatccaatactttggccacctgatctgaagacaacccattggaaaagaccctgatgctgggaaagactgaaggcaggaggacaaggagacaacagagaataagataattggatatcatcaccgattcaatggacatgagtttgaacaagttcctggagatgatgaaggactgggaagcctggagtgctgcaattcatggggttgcaaagagtcagacatgtctgagcaaatgaataacaattttgtttgctagtatcagtactcctctatcaggaactctgtgtgtgtgtgtgtgtgtgtgtgtgtgtgtggtattttcacatagggtaacattctgtttctgtctagaaatgttttttctttatatatatatatatatatatatatatatatttgttttaaaattggagactgtattgttatgctgagagcacttatgttgtgggagtttggggggttattttcctacttattgttgtgtaatttttttagaagacatatggagtgatgtgaacctgaataaccaccatggttggcaaatcatgcctctagcagtttcccattaactatgatatttgccgtatttttattagatatcttatct

SEQ ID NO: 54665 - DNA, 721 bp, Bovine  19866880874249
ataaattttctgttcaataacctctgtgatgtcacatagcacatttgtttttcaactcaaatttgggtgtaatcttagctttgttcttttttactttgtgaccttggtcaaagtatttaatatctttaagcttttatttctttacatctcaagtaggggagagaggaaaaatatccacctttaagactgttatgaggattaaattagagaacatttgtaaagtagttaagcacatcgtgtggcacatgatggaccttaacaaatgatagattttcttattatattttagttgcaagtttgccttttacaagtagttatataatcactaataccaatgtgattttggaccccaggagactaacatacatctataaaactgaaagacacagttttaggagaaataatagaattttcccttaaaacaattttctgcacctgttttagaaatggatgtcgtataactctattgagaattcacctcctattatttaaaacaatgtttgattggattcaaaccaccttccaacattttctcaaaggacaatccaaactcttcaattacctttttcacatacatctcagaaagtattttgactgcctgaaaggccataattctttattcctaaagttttgaattccatctgatgaagatatcacactttgtgaagtagcaccatgtcacagaaacaatagtttaaattaacctcttactgccttcagt

SEQ ID NO: 54666 - DNA, 1078 bp, Bovine  19866880889163
tgtgctgcagtccatgggttcgcaaagtgtcagacatgactgagtgactgaactgaactgaatcatataattatgcaagtgtatgcatgcaatgatgttcagtgtaaggatatttatattactggaaattggaaacaaccaaatatctatcaatgggaggttgaccaaatgaagtatacacctctgcatgcattatgatgacatgcgacataaccactaagattataatgcagctcactatttatgacatgaaaaaatacttatgacatattaatgaaaaaattataccatattgcattgattttatctatgtatttgtacatcaaaatacccttccaaatatgcacatagctttgtgacacatgtaactaatatttggcagtgatttttttctcagtgattttattgttttgctatttcttcactgttttatgcctttctaagactgacatttgataatacaaatgaccgtccatgtttgaaaaaggaataacttcctcaccttattgtcatatatcagaaaactgccatatttagtgaacaattgtctatttataaatattgcctaaggttgtcccatgcataatctccaaagccatacacaatggcccagcatttacatactacctttaaaaagtacttttatttaataataacactttcattcttaaaaaaattccttaagtggtagataattatattttccttgtcaatgtgtttatatcagttttatagaggttacaaaaagataataaaatgggaataatgttatagcaaccataaaaatgcaataatttcctctacccttcttttaggaatcaggagaatgagtctaagactgggtaagccataaaatatttctgaacatgagtagctaaaccttgaattgcttgaaatgtcattgtgtgcatcacctgtagtactaccaatttcaaatgccacaaaaatgttttcatattctttgttctggacaaaagataatctgagctcaggaatacaacccatgtctctagtttaacaatataccacttgggatttaatgtcctttttaatacagattttgtcacatcattttata

SEQ ID NO: 54667 - DNA, 855 bp, Bovine  19866880896710
tgtcttgctccagggcatgttttatagcattagcctgggtaaatatgcttcagtttcaattaataaaattgtaaatttaggatctgtgttttagcaaagttacagtttgggtttatgcaatgttaaactaaagcaaaataaagccataaattaccataccctctgaaatactttaatatggttggttcaaaattgaatttttatcccattactctagggagatagttgctataaaaaggcattttcactcattttcatcattgtcatgatctaagtttttttcttctaatactgaaatagtttttaatgtagcttttgaaaattgtattgatgtttgttctttggcttttctctttcttgagataattcttaatttgctaatatattgctagcgctacagctttgcatattttttgcttgtttaatctgtttgttctaaaaaaaaatctagcaaatttccatctaattttgctattcttttcaaaatgcattcaaaaatgcattcttaggttaactttggtttgaaatacaaagtgctaatgtaaaatttacctttgcattttatttagaggagtggaatatattgagaagattgaataactaaagcaggatttcaaggagaatgttcacacacttaagaagatttttaaaacatattattctctgaaaattgccactgcaaagaaaggaccaatcatttttcacacgatttccttgatttggggttgggacagcagaaaccagacattttattgtctctaactctgaagtagatgtcttagaacatcaggcttaaataaacactgagctttggtaccattcaagaaataaataaactgaatgaacagtaggaag

SEQ ID NO: 54668 - DNA, 1002 bp, Bovine  19866880898655
caaacactgaagaatctttggctctgcagatattgcttctgaaaattgcaatgtaaaatgcctgggttaactcataagatcagactaaaaatagaagactcttacaaggggtgtaacttctcagaggcccttttaaagactttttttccccacttccactgctctcaatttggatcccagctcatctgacttgttcacaagtccttccatatgagaaaaaacctcaatgctgattgtgaatcacgtgggctgctgctatccttgtgtgatttttgttttctgccacttctcgctgggggctgctctagcaggatgtagcttcatcacgtggagctgcctctttgaaaaagtgtgatgtacatcacctacaggcaggtacctcagttggttcagtgaaaaggcgagccatttcatttcccagcctgaggtctcagctgcacagacagcccaacaagttcccctttaaaatgctccaagataacttcccaaggaccagatggttctggtaagtctgggatgattagcaggcttcctgttccagagcagctacctggcaaggggatttggcattgcctggagaatgctcatgataacagaaagcagggaatagtggctatgacacagtatctggctactatgtgttaggaagcctcttatctgtctttgttttaatggttactggaaaataaccaaatacttctggagataatcctatttcattacctagatcaactgtgggacttgttctattttcctataaaatggcagggatttgggaggaggtcaaaggggatactgggaaagaagtgggttaactgtccaaattcaagtcagagaatgggggtattattttcaagagttaatgtaagcaaaactgggcaaatctttcataatcagtcatttgaagcattctcagaaaaatatagcatcaattatataaaattccctgaagcatcaaaatattttgcatgcttgaaatcctgcagatggtactcacaagta

SEQ ID NO: 54669 - DNA, 967 bp, Bovine  19866881153222
atttaggctctattcctgagctttcctcatttatgtcagtcatcatttagtatctgtctgtatttatgcttgagaccacagacagagagatgccaagagaagatgccaaaacctgacaatccacagtgtataaacctagtagacagaggttaggaatccttcaagaggttttataatacaggttatttcaatataataatagccacaatgcaaatgagaataattacccacttagcacttgaacaactatgacattatgcagccattaaacatgatgttttgaaaaaatgtcatatgcaaatataaaaatgatttggttaaacgacaaaattacagatagatcacacagttgcaggtaaatgagtactgagttatattacagagatcattgaaactagatgtgcactatcaaggcaccactctcatcagtgaatggataatcacttagaattgtcctgctaaattgggccagggaaaccaattctatgaccaaaccttatatctacatattaatttcaactaattatattttcttttttttaattttattttatttaactttacaatattgtattggttttgccatatatcaaaatgaatctgccacaggtatacatgtgttgagatttttaaggaataaattagtgagctactatgctcctttgaatagagagaagtaaaaaaaaatattgtgtaagtattagctgaagtttaaggtctggagggactaaagatcatgcttatctttgagattaatgagtctagcactagttggagaaggcaatggcaacctactccagtactcttgcctagaaaatcccagggacagaggagcctggtaggctgcagtccatggggtcactacacaactgagcggcttcactttcacttttcactttcatacatggagaagtaaatggcaacccactccagtgttctgccggagaatcccagggatggggaagcc

SEQ ID NO: 54670 - DNA, 1167 bp, Bovine  19866881217702
ttttctgtaagagtttttgcctagctggtttcagtgcaacccctgattatgcagggggcatttaattcccatatcttttcataacagactcttctccatttgggtctcaactaatatgttactgtaagcactctggctcaagtaaactcatcctctctcctccctattattttatcacatcaccctattttcttttattcagagtatttacttaaaattatcttgcatattaatttgttttgcattatttctcctcactcttgaacctaacctccatgaaagtaattgtcttccttgattcgatattatttgaatctagaacatcacttgtcacaagaaagcactcagtaaatatttgctgagtgactgaatgacttactcttatggcatctgtgatgccagtctggttacaatgtttctaaagacgaaaaaaaccctcaagattatgcatttccatatatattcaattgcagttgattttttaaaacaaaatcttttaaaatctttctttagagcatttgtttgggaaatgaaaatgattctgtaactactcatcgatacacatgaatcaatatcaatttagaagtgcatcaatatttttattcctgtctgcctgcattaattcatacatcactatgcattccacttcttggcatctgctgattccagattttctagtttgcagcatagcatcattgagtttcatgccatatggctgccctttggtccaagctttgatcaatcaagtgatagcagactgactcgtgccattttagagaagatagagatttgatgtggagccaattcactagaacatttttttttttttgcagaaaaatgttctaagcatcaataggagagcataaactatactaaataaatatatatacaaaaatacactttgtacctaatggttgtctcagagacaaattgccagaaacttgttttatccctaaaggagaatgttccttccaaaattctaactggtgctgtacccatgtgtgtgaccaaaattattctttatcagcagcagtaaggggttttacactctgaagtagggtagtctattctttcactgatagcagtctgaaaacccagtgttgtgatttagtgatttgaaacgcaacaaacaaatgtgaagaaatgctctgaaggatgctctggtta

SEQ ID NO: 54671 - DNA, 1538 bp, Bovine  19866881230879
gaacccttcccaaactccgtgatgccatctgcagagcactctctgattcgtaccctggctgaccaaagcctgtcatgttagcagcaacagactccagtatctgtcttctcaacttggtggcattgctgtgttctggggctctacatctctccaccactgccaggaaaacattccctggaagaaatttgaggacatgtaaaatacctattttgttcttcctcaaaaatcatgatcctgaactgtgtattatccagtgcctgaaatatttccttcatatgagttgagcacttttattgttgtttatagcagcagggcaagtccagtatcactttctctattatggctggaagaggaggttacactttaattttagatggttgtatttaatcttttatttcttttcataaaatagctccttttagtagctgtttgaaaaatatcggtaataggaaacaattgaaaaaaggagaaaaactgagtttttgacagatttgttaaggccaactcaaagagtaattttgtgaactttttttttaaaaaaaagctgcacacagaagaattaatattcaagtgacaggacaagaattgttattaatatacagttctttcctaaatgtttattgctacagtatcacttctgtttgatatggatcacatttcattgcagtttattagcaatcagcagttattatttggctctagtgtttgcaaactataattcattaccctcttattttttatttatgacatagtgtcaaatgaaggaagtaaattgtgtattttttttgttgttggagagttctgtacactagagtatattaacagtgttagtgttattgtttttgtttaaatgtattttttcaggactttagaaagaagaaggtcctatattctgaaaaacgcaatgctatttttctgagtgcctgctatatgcattgtttctccacattccagtctgatttattgatacttaaagcaatatttaagagtagcatttaaaacaagccaatgtcactccaaaaatcatgtcttaattttagatgtttgacaatgaatggctttttaaatatataccaatacaactcaaaactgtgtaatattgttatgtcaagatttgagtaacaacaatagatttccattaaatgaaatatgatttaactgatgcattttaaagtttttgtctaatagcagaaaatatagtgtgatgtaataaaaagtatataaaaccagaagtcagaattcatgctctcccattgctgcttacaaggtacacaaattttgagcagattcttcaattcttagaagtgtttcttcatccactaagaagggaatactatcatatgtcttgattacatcacagtggttttgtcagcatgatgagaactatgtgaagtactgtaatagctgaatgccatggttatcatagaatagaaacaataagatttttcttctagtgtgtacctattattgatttgctaagttgccttgagaaagaatttagctctgtcttctcaacatcttaaataataactgaaata

SEQ ID NO: 54672 - DNA, 780 bp, Bovine  19866881313953
agaaatcctgtttaatatattagggtgttagttatcttccatttatagcaagatggattcagtttttattgactagtatgacagaactccttgaagaatatgggaatggatcctggttccactcctgacagaggggaatgctactatacttgcattttgggccaagaaaaaaattaaaaaaaacatgtttttccacacacactttcgctttttgccttcttatttagaagttatttcaaaatttaaagaagacttcagttcacagggagaagccttgagtggtgatcataatgagttcactcaattttccacattgttagtctctaaatgacaggagtgggctgttgatccaactactcttaggcattagagaaaatttagagctggtaaaaagtaccaaatttatagtcctgtagacagaagctctctatggagcttctaaacaacaagaacaaaatagcttgaaagcagtgaggcaaaactctctatattattatggatttgccagacaatcaagattctagtaaggccctaagtgaggggtgatgtgatacatcacaggctgggaaaactgatgaccataataataaagttctagataagcaggaagcctattttccaactaatttattctgaagcccattagggcacaagcctgttcaaaatccaaaattattcacaaactcatattaagaggttgctctatattacagatgggtcattgttaatagcaggtgtcttctgccatttgaatctttcagatgcaggtcttttccacat

SEQ ID NO: 54673 - DNA, 1303 bp, Bovine  19866881401350
actttaatttttagaaagctgtatataccatatttgggcttcccaggggacactagtgctaaaagaacctgtctgtcaacgcaggagacatagaagagtgggctcgattcctgtgttgggaagatcctctggaggagggcatggcaactcaccccagtattctaacctggagaactccatgcacagaggagcctggcaggccacagtccatagggccacaaagagctggacatgaccacagtgactttgcatacacgcatatattatattcaggatgttatatctcatgatctgaaactgacaaaatcgtcaaagtaaaaggaaaaattgtacagtttttaagatgcaatcatatttgctgaattcttacaatgtacatatttctgaaccataattgaatacatttgagcataaaatacaatatcaggagtgttattctatctacacatagataaatttacagttagtttgcaacttcagattttagagtttcattgttacctttaaatattgtgaactgtaattagaatgaagaatagcattaaataatactaagaattaggttttggaaataaaaaaaattgtgttgattcagactcatcagaaatatgacatttcttatttttacatgtggttgtatatatggttatacaaaaggatctcatgaatgaatattaaacaacagtgttactttatttattgtacacagctatctgcaactgtccccaaataaaactatacctataataaaccatgaaaaatgatgggtggtaatgaaagtttcccatctggaaaagaccctggtccagatggatttgctaattaattttataagatgtttaaccaacctttgaagaatatctcagacatgtttgattactttaaattaccaacatttttggaactactgctgtgggttctcaaactaatctttataaactgccaagaaacgctaaaatccagaatgcatttcttaagaacatacttctttcacaaaaatgctgaaaaaaaaaaaaattcagcccagtgatacaatgttttctctttgaaaggatacttttttaggtcaaaagataggcagaatatcttagtatgggttaaataatttattcacagaacatgatatcttatttgaaattaaccaatacactatttttataaaggcttcccaggtggcctggtggtaaagactccacctgccattgcaggagacatgggtttgtaccctgggtcggaagattccctagaaaaggaaacaggaacccactctagtattcttgcctgggaactcccatggacggga

SEQ ID NO: 54674 - DNA, 2176 bp, Bovine  19866881404549
tattgaagtatagccgattaacaaacaatgctgtgatggtttcaggtaaacagcaaaggtacccagacatacatatacatgtatccattctcccctagacaccccttcccattcaggctgccacataacattgaacttccttccccccaggaaccataatctatgtgtgtgtttttagacgagtggcgtttgaatgggtagattcagtaaagcagattgccctcactaatgagggtgagccccatccagtcagttgaaggcttgaatagaataagaagactgaccctttcatgagtgagaaggaacgtcctcctacctgactgcagtgggctgcagtcaggtagaaatcaattttctccttgcctttggttccaccccagtttcaagcctatcagactttggactggaacactactggctcttctgggtctccagcttgctgactatagatcttggaagttattatgctctataattgtgtgagccaatctgttatccttagaataaatatttctctctcttttaccttttctcacataccccgacttatacattaaatgaatcacaaattctgtgactcttcctacaaatgcctcttgtcatgagccaccttgtttcaagtcattttgtcaccaatgtaatcctgtcttctacttacactagtgttgtggcatctttgaccttcattaacactgatttccatccaatctgttctctgtagctagaatgaattcttcaaaatacatatctgttatgatatcccctcaccacccacactattctccccaccaaaaataaaattttcaaaggctttcagttgtttactaggataaagatcaaaaatcctgtatatgacttatgaggctatacatcatctcatatacatatttctttacaagctgctttcatattactctctcctccgtttttcatattactgctctcattgaatgttttgcacttacttgaaaatgtgttctcagacaagaccctggcacatgcttttcagttcagttccttttgttatttatatgctctcattgtatctatggtgtaccaaggacaggatggtagtcttccagggtgcaagcaataaaggggtgtattgtctgcagagaatttaataacagtaataaaacacattaaatgtaagtctgctttttcttagaaacttgtgccagcaaatctaaacaatgtctttcctaaataaagcttttgttgatctaagttctcaacaattgatgtgactactactgagttctaatatttatgtacacttcaaattagtatttgaaaattatctttcaataaggattatgttctgcatggaatttaatttggaaaactccaagttccatgtaagtcctcaacatggactcagctacgcatgtgtgttgaaagaataagtttacaatggttcacaatcattttatctcacttcaggtttaactcctatcatacctattttttagtttaaagagtaaattctaacaaacaatgatagtccagtaattataaatacaataaacaatttgagttacttctgttttacaatcctgtgtgaccacttggagttttgttttgtttctgtttcaaaacaatgacaaggacatccttgatggtcctgtgattaagactctatgctttcatagcagaggcagcacattcaattcctagtggggaaactagggtctctcatgaggcacgtcacagccaaagaataaaaactgtggcaaaactaagaacaaatgacatagtataatgtttttgtctagaaagaacagattttagtccacacatgaaatagtgtgctgaatttgagtaatatctgaaaaattggaatatattcttctttcttgcttattttaaaattaaagaatgactaaaacataaatcctttataattactagtatccatacttacttgaaaaagtttcctcactatgagagaggtgttaaaaaatgatctactccagatgtgaaatctctaggaatgccactacgtgaatcatgttcctttccttcagagcgcttactgttagttatagtccacattcattcacagtctgattgtattattaacattttaatccctggttaaaccaactgctacctggagagtaacattacatttctttttacttacagcactgatgggaacctagcacaatgctga

SEQ ID NO: 54675 - DNA, 810 bp, Bovine  19866881611613
aacttgtcgcccctttctcttgtcttagcttctcatcacctcagctccctagacagatgggtccagagggctctccatcattagataattcaccaactccccacttgtaattgcaggactgatcttgtctggagaaggggattttaatgattccttgtactattctaccttaccaccctcattgtcctccatttctggtcatccagcagggcttggcatgaatcagccacccacatgtgatgagatataggatggaacatatatttcttataacttttctcagcttaaaaaaaaatgagggtacttagcattcatgtaatttcaaaatgctgaataacctaaattggcctaagaagccatcctttgtgatatgttacagttgccatttgcttatactgttgatggcaatgaacatgaacaccataactggtcaggatgcatgaataacgttccctaagtactttaagaagtcctgggggttcaggtaacaaagctaaaacaactattctttctcagtcgtctatgagtattcatattctcccaggtttctgcgcttgtctaactcttttgtagacaatctttcctctgggtaatttcatttccctggctctgattactccctacgcagtaacatagtccaagtctttacctccagtgtggagttttgtccttgagactcaaacagatacatacaactacttgatggtactcgctctacttaaaagggtgctcttatcagtaggatggggtagacgtgaaggaggagattgggggaaggtacattttgctctctaaaatttcttacgttaa

SEQ ID NO: 54676 - DNA, 1096 bp, Bovine  19866881657311
atcttaattattttattattaaaataagagtactcccaaataaataatactattttcactgataggagggaacattttccatatgtcaactcaacagacaaatgatagaagacatcttcaaagaaaggtagaagtattatctaatttattaacatgtaatcaccattttatgcttcattaccctgatcctaaaacatgtgcatgcacacacacatactctaatttactcatactgcaatgatcattatgtggaataatggaagcttaaggggtctgattgcttgagtttcatatccttttcattatggcacagaatttgtctgggatccagttttattatctgccaaatggatataacaatctctccttgttttagtgtgtttaaaaaaagacaaagtatgaacaacttagcataggacagagcacacagccagctcccaataaatgttgcttttatattgtggtagcaataaacttcattcaaagagtggcagcatgatggagcagaacaattaaacaggcaccaccttggctctgtcagatattaaccttgtctctcattcagcacctccacatatctgggtctcagttttctcatgtaaaaactgagcaggttaatttagatgatttcacaagtcttttcagtaccattttggatttctacagaataaagaacatctcctattaacctgagataatagtttgctttgcacattggaagatatccatgtttttactggagtccatgaaaaagccaagaaaaagttaaattactaattagtcttctagctccttccttaaagcagtggttatctttgttcagtttttgcagtggtacagttctaggatatcaaattaaaaataaaagtaggttattgcggtagtgttccacaggaagagaagtaattttattgcttaagagtcctcctatattatgcaatcttgtaagtcaagtatgaattttgacagaaatgatgtattacacaaatacaaatttcacggatagagatgtgacttccaaagatccagaaagataaaaagtaaatccgtgctgtaatttaaatccaggttataaacttggactccacctgggatt

SEQ ID NO: 54677 - DNA, 679 bp, Bovine  19866881860514
tgctaatttaagtgctatttccttatttaactataaacattatatagttagacatgcttatttcttttgaaatttaacttgttattctgtaattaagatttaagagttttaactgactgactcactaataaagattatccccattctgccatacaaagaaaatcccagttcactaatcataaattctcattggcctctggctagagttgccctcattatttgcaagttttctagaaattaaaaaatgcttggcagttagtatggggattcccagagcttttctaaattgtgggggatatcaggaatgctctgctaggtacagtaagacttgagactgcttacacaaagcaattaagcaagtgaagacactgaggtgaaaggaaaatgtatagtttttaaaacaaagtgagtcttttttttttttagccaagagggaaacaaggtgagccaggactactaaacgtaaaatggagtcttgcttggaatcctggatgagaaaaaggccattatataaaaaactaaggaagtctgaataaagtatgcacttttacggatgcattattactaatgcatcagtattagtccattaattgtagtgtaattaaatgtgccattctagcgttagatggtaataataagagagacagtgtgaggtacaaggaacaccttgtcagggagg

SEQ ID NO: 54678 - DNA, 1754 bp, Bovine  19866881897108
ttattgatatttctcccagcatgagaaaccatattaagggcaattcttttcaaaaatggctttatcattcaaatttcctgtcactgtctgtatttcatagaaaatttactccattctttccttcattcagtatgtaatcaatatttactgagcttgtgtaatatatctagtactctgcaaataaatagggcataaactttgttctcagtttgtacagtctgataagaaaacagaaatggtatgttatgataatagctattttagagttatgttctgtataaagtagcttgtagaaagactctctgagtctgtttgagagagttgggggagacttctcagaagttagaaaatgtgagctagattttaaaggaatgctaagaattcacaaggatttgaggtaaggacaagaacattgaaaggggaggatagaggaaaaccctaagcataatgtagtcctatcccgtccaatatatcaacagtgatatctggatttaaaatttagaggcctaataagtgtactctgtggaggacattttcaccacattggaatcctcagatttggagccttggcattcttcatggagagctggatcatacccagaaatgagacctttagtgatctcatcccattaaaaccctcgtaaaaaaatcactattctggcatcttttttgattagaaaatcaaacctcttctcattataagatgtatgcaagcaagcacaaaagagagctggtgtttttaaaaaatcatactaaacaaaaggagcactcacttgctaggctggccttgtatgctttagcctgaagggcatttttccagccaagcaagaagcccacaaaacataatggaaacactgacagatacttaactatatcagctctggtgggtacaaaccataattcacttcataatacaaattgatatgttgtcttgaggggtccctgccttggtgttattgagtgtcttttgaaaagctctggttctgggctatgaagctacaaaataaaactggatgtttctctctggaatagattctgaactgggcccctcaattacagtaccggtatccttagggcaggcaaaatggaaatgtcctctaaagatggacaaatataataatacaaagtgaaaacagcaaacaatgaaacaaagtttattattaaaggtctgatatttcttcagacaaggtctacttaaaagctgagtacaccagaggtgaatgagggcagctacttgcatttaagtggggttaattgttaagcaggttataaggacactctgtattttcaaaatcatgtggtggggcaaagttcaaccaccccagtgatcttgatgaccaagcatcctgtgtgttttctaatgaaatgcaaatgacttcaatcataggtagccacatttccaaataccatttagagctttaatgacttgtcctagaaaggtcctgtcaagccatatttaatgggtattccaaacaatgtaaaacagatttctgtaaatgtgttctacagtttgtaattttattgtaaaaatcattgtcctctatccctactactttgcacttcaccagatgcaatttttgaggcttctttactgaacatgttacagtgtcactttcttctctctgaatctgaatcttcccaattgtgattttaagttcccacgtgcagagcctggagttctgacaattagaaaagctccataaaatgtggaaaagaattctgaaaggcacaattttcaatagaaaattaggaaa

SEQ ID NO: 54679 - DNA, 1229 bp, Bovine  19866880825521
tgagacaaggggatggtttgtttattgagtggaattgtgaggaggagaaggaaaagagatgttgagggcaggaaatgatgcagacttagatttctgtcacagttattccccaatagatttctaccccaaattcccacagattaaacccttactgtatatagatttctatggaaccagtgaagaggctgagctcggcctgcagggtgaatgggacaaagagggctggtttcctgggcccagtgcggcatggagacaggggaaaggtgaagacgtaagaagcatgaagagacccaggagaaggatacatgatatcgaagaccttgcaattggggttgtggctacatttaacaatagcattaaaaaaatcatctgaaatttgaagtacaatggttatcaacaaaactttgccatttggaggactgagagaaaatgatatgaaatctatctgtgcagatgcttttttttctacatgcaaagttctttaaccatccaccttgatatggtgtgacccaggctgctctctgtctctaattagtgctacacccatgggggctaaggtgtgaggaaagaccacagctggagagccgggtgtcactccgggctactgaccagtatgtcatattcagagtgaggtagcgtggaacacgaagcatcactgctgcaattcttactgagacttctgaatcaaacactacttttttttttttttttttaatatcctaaaaagaacatctgctaggatcaaaatcctaagcttacaacctttccaagtttcatgaaaaagtaaatttcattaatgctacatttttctttctggaaaaggaaatacatttatgggatatatttgccctagtaggagcaggccttttctccaaagagattatagacattataggaatcaaaactaagtaggagattagacctacttgctagaaaaaccctttaaaccctgtttctgacatttgagatgtttgattaagcggctttcagtggagacttagagaaagagttctgaatagggcaaaagcagaagctatgtccctaaggtagagacagattttgggtagcattacttaactccagcagcaagagaaatatactgtgtttaaagcttgatccaagggtatcgggtccagaaagatcaaagttcagtccctaagaaaaacatttgaaaaagtacctaaagactttttcagatgctgtcatcatataaaacaatcagcaattag

SEQ ID NO: 54680 - DNA, 1918 bp, Bovine  19866880398873
gattaaaataagtgcgtatttagtatttcaatcagacataaagaaagaaaatgatgttgaaataaagtttgatttttttcccttctttctttatatttggtgactgtatgcaagtaattcaatctccacttagataataaatacctaaggtaactatgtggatcagccactatcaacgatgcttatagaaaataaactaaagaggcaaagcagttgttcttaactgtaaagttttgttgtttttgtttagtggctaggtcatgtccgactcttttgtgaccccatggactgtagcctgccgagatcctctatccatgggattttccaggaaagaattctggagtaggttgccattttcttctccaggggatcgaagtaaaacttatcaacatgctaacggaaccttgttttctgaagacagggggctttgtaaccatttccctctcttcaaatggcagtctacttctctcctgaggtggtccctgtggccctgcctcttctgtttatcccagtccttattgctttctccacatccatcattctctcaacaaagaaaataagactcactgcctattctgaaattattgtaactccttatcagtcaaaaggaaaaggacactttcctttccctgggagtttgctgtagtgactgtttttataggtcagtccaagagggaaacattttcttttagattgaatccttcattgttcagaggagagctcaaaacacagataaagttatcattctgagaaagagcacccaagacatacgtctcccctccctttctctcttctccaaagaaaataatttgcatacatgtatccttctgagctttgtccaagtctgctcttgacagatgctatctgaaaaaagtgactatcgagggaagacaggtacactaatcaggcatttccagtattggttggggcaaagcagaactcttcactgccagtgggaagatgaccctggggagatggccgcccctttctatcttcagagaacttctctggatgtctttagaaagcaactgctgctgctgctgctaagtcacttaagtcgtgtctgaccctgtacgaccccatagatggcagcccaaaaggctcccccatccctgggattctacagccaagaacactggagtaggttgccatttacttctccaatgcatgaaattgaaaagtgaaagtgaagttgctcagtcatgtccgactcttcacaaccccttggactgcagcctaccaggctcctcttcccatgggattttccaggcaaaagtactggagtgggttgccattgccttctctgttagaaagcaatgtgctctgtaaactctggtaaactctgtatgttttctatagtagcacttgcttatccaaaattgacttaattataaaaattctacatattgcagggcttttctgaggcaaacacaataatacatgtggaattattttgagatatcattgtgaatccatgaatataagggattgctgtctttaggaaatcaaccaaacttctccccaaagtaactaacctaagcttctgatttgatttttaacttcaaaatatgcatatattttcatattgcatatgtatgtatatagtatttatttaaataatctttcaattcacatttgattaacctggactgtgtaataacataaaggtagatgttctgcaattttttatttaaattatacagagaaattccagtactttggccacctcatgcgaagagttgactcattggaaatgactctgatgctgggagggactggaggcaggaggagaaggggacgacagaggatgggatggctggatggcatcaccgactcgatggccatgaatctgagtgaactgtgggaattggtgatggacagggaggcctggtgtgctgtgattcatggggtcgcaaag

SEQ ID NO: 54681 - DNA, 1798 bp, Bovine  19866880408060
attgagcagagttgcactcattatctacccaaagaaaagaactttggaagaaaaaaaaattcacaaatggcaagactttgaagaatctacttgttatcttttccactccgggtgattttagacttccgcaccaaattgaaacaccattttctgacacaataatgtaatacatttttgacatcacaaaagaatgcttttaaggcataaaaatgcatttcccttatgtaatcaaaaacaaaaaccctataaattacaatgcaatgaacagtccaattcctctattgaatgtatttaaaagatatatgctgattaagctcttactcatttgtgataactgtctagtgaaagctttacgaatctggctttacccatattaaatgccctagtggtggccctcaaataaaaagagaaggggaaaattaatcttagcctttgttcctttatatattttaataaatgttgctgcacatttttaatgcatttatgtcccacacagaatgccaaatggtttgatgttttcaatggaaaagccaagaacaaatttacacattaaaatgtaaagcagttcaacagtacaagctttgttttccagaatataatgtgctttctctgtttcttaataactttttatagtcatttcagctgtatatggaagtaggttttgctaaaattttgcagagtatctcttttgttcctttgttcccttctgccttgttgagaatatctttggactgtcttgcacatcatatagtaataaattctacttttttactagggcttccctggtggctcagatggtaaagaacctgccctgcaactggggagacccaggtttgatctctgaatcgggaagatcccctggagaaggacatggtagcccactccagtattcttgcctggagaatctcactgacagaatagtcttgagggttacagttcatagggtcacaaagagtcggacatgactgacgtgagttagcaggcacttctttaatataatgatttatttataagctgatagggatatttgctagattttgtcatgaaacctctttacagagagaaaaatcctgaaacaaaactcaattaaattaaaacaatagccgcacaatattatttgcagtgatgcacttaagtaaaaataacagaggacattgcagtggacaatgaggagcccatttctgggatatctttaaattgagaaaaggtaaagggggtagcactcttgcctggaaaatacatggacagaggagcctggcaggctgcagtccatggggtcgcacagagtcggacacgactgagtgacttcactttcacttttcactttcatgctttggagaaggaaatggcaacccactccagtgctcttgcctggagaatcccagggttgggggagtctggtgggctgccatctatggggtcacacagagtcagacatgactgatgcaacttagcagcagcaaagggggtagacaataaaaaattaataaataaaataaagaaagctgcctgtcaatgatacagcctctggttttctaggtgacagcattctggtttaagaaaaggaaacaggcacaacgacaatgcagattcacatctccgacacagattgcaattggctttgggaaacagatatgctgttagcccagttgattatggtttaagttttctgacagaaaattaagcaagaggcactcttcaatggtagatgtctgctacctagtaaagtggtaaaagtgaaaatgagacatacaataaacgtaaatatgtaggaggaaaaacaagtggggaccacgtt

SEQ ID NO: 54682 - DNA, 3647 bp, Bovine  19866880518985
tgattagacttctgattattaggtctagcccttattgtctttgttttatagaagggtagctaattcagattcagtgacttttcccaatctccctcagtaggtgaagggcagaaccataatctctaagacatagagtctgctttgttctgcaagaacagccctgggttccgagtacgcttggatccaggcttcagattttatccttccttggttgatgaagtggctgagcagtatatttttcctcctactgctgacttccgtcagaatgtcccccatcggacatcagcacagttagttaccctgacactggtcagtatgtttctgtcagtcagaaattggctgatcccaaacagaattaaagacaaatcatacaagacaaaaatgcaaaggggtcccaaagaagaatgtgaaggaagatgagctggggtgattttaatacactatgggcctatgatcgtgggagttgcacagatgaacatgttgatggagcagtgagcagtgagtagtactcaccccaaaacagtgttgctccttaggtaagagtggtgatacaggggtggcaaacatttggatcagcagttaaaagcttttattgattgactcaaaatatatttcataagcacccatggtacatgtcattcttggctactaattcattaaatacatatatttcttgctcttgaggagcttaaaactcataaggggaaatataatgcagcaaacaaggagaaaaaagtgaaatttacttctgatattgactgctgtgctaaaagtcagctaacacttggacaaactttaggtcatgaaattcctgagaggttgctttaaattttccaactgtgtattttcatcagcagaatgaaaacaataatattagctatgtgaactctattatggtcctgataaggtaggtgtgaaagcatatttaaagaaagtaataattttattaatgaaagtgataattattagtggtattattttccagataagcaaagataaatatgcctgagcatttcaaattgttacttgaaagccatgtagtgatagcattttctttttttttttaatatagggaataaactaattactattaacaatatagtatcactatggaatcattacaagatcatcatatgaataaagaaaccattgttgagcaaactatatatatttagcaaatattaaaaaaattaaatgctttcatcatgatcctttaggaatttttgtaattattgttcttatttcttttgctttaaaatttggccatttgagaagtaaaattaaattgttctatgaagagaaaatcagagaagggctagaggataagggtagaatttagactaattgccagttaatgtgtccatgtagttcagaaagaattgaaaacagttttaagaaacccttattcatgtcagctcgctctaattggtagtaaaacaatccacatatggaaatgaaattagaaacccaggggaaaaaagtcaaagctaaaatgaaagcaaattgcatagcaaacattacttacattatgatatcaaataagggaaacagtacaataaatgaaataacatgagcaaaaaaagaaatttgacttctatttgcatgcccaaacttcttttcagttcagttcagttcagtccctcagtcatgtctgactctttgccaccccatgaatcgcagcacgccaggcctccctgtccctcaccaactcccggagttcactcagactcatgtccatggagtcagtgatgccatccagccatctcatcctctgtcatccccttctcctcctgcctccaatccttcccagcatcagagtcttttccaatgagccaactcttcgcatgaggtggccaaactggagtttcagctttagcatcattccctccaaagaaatcccagggctgaccctccttcagaatggactggttggatctccttgcagtcaaagggactcttacttagatttaaatctgaaggtctaacttttgacccttctgaattgttcatttccctttcccattagtttaattgactatatcttaaaagcaaatatcatttttttaaatagtttgatgaaaataattgtctccttatagtcttctaataatatcttaatagcatcctcagatgaaagacagaatattataatgagaccgtaggacagaaaaaaagatgtcatgtttgctctcttaacaaatatttaggataaatatttgggcaaattttaagccataaaattctagaatttaaagaaactattaaattgttccctcaaaggagactattttttttttttttttgcttcacatgatataacaagccttatctgataacaaggcaggggatggacacttctgttctcttagctcctgaggataaggacatatgcttaaaattatcattgtataaataataatttattatatgataataagatctcaaatctacatattattttatatattaacaacacacagtactttatcagggccttcccttgtgactcagtggtaaagaatgtgcctgccaatgcaggagatatggattcagtccctgatctgggaagatctgatatgtcatgaagcaactaagcctgtgcaccacaattaagcaactaagcctgtgcacctgtaatctagagaccaagagctgcaacttctgaagcccccaagccctagaaccagtaagggaagccactgcaatgagaagttcattcacctcaactagagaaaaaagcccatgcaactatgaagacccagcatggctaaatgtaaataaataaataaaagagaaggcaatggcaccccactccagtactcttgcctggaaaatcccatggatggaagagcctggttggctgcagtccatggggtcgctaagagtcggacacaactgagcgacttcactttcacttttcactttcatgcattggagaaggaaatggcaacccactgcagtgttcttacctggagaatcccagggacagaagagcctggtgggctgccctctctggggttgcacagtcagacacgactgtagtgacttagcagcagcagcaacaatattatatattattattttgttactgatagttactgctaagtaaaaagtcataagggggaaggagtgtcttaagttagttagggtagtgagccaagacttcttcaaggaaggtcatttaaattgagactgaatgaatgaaaaagatcaaacaagagaattctagactaaaggaaatactaagcaaagcttttagagtttgggatgtttatttctctatctcgctctccaggaattgttcgaggctccctgaatgcctctactgaagttctcaggtccctttcttactctctcctgcacccctccaccttggtaatgccttcccatgctgacactaggtttggtcatgtgactcgctttggtcattgggacattaacaaatatagagcaagtggaggctggaaaaggatttgtacatttccactttcactctgggtcctctgcattcactgacaacatacccatgcccgtatgctagaggatgagagatacagggagcagagttgggttgtatataaccgaggtgataaccaagtataacatgtgacaaggtccaaccaagatcatcagaaacatccagagta

SEQ ID NO: 54683 - DNA, 2606 bp, Bovine  19866880641798
cttgcgaaatgcaaaagtatctgagattgggccagctttgtgtttaccccagaacattattttctttttaacatttctatatttcttttctttagtttcttgtttcttgacattttgtggataaacaacaccaagcagaaaatggcagtcatttcagaaatctgattacagtggttgcatttttgctaatcgggtggttgtgtgtgtattcataaacctttcatctattgtctgctctcttacatagctctattctactttattagtccagtgtcagccactaaagtgtatgttcttcaaggaatgatgaactagtatagaatttagtgtaatattcatgctaaatggacctggacaacactacagattagtaataaattcttatgaatgaatatatgagattatagagaaatgtattatgtaagcctcagttcttgcatattttaactctaggaattataataaaaataatagaataagtttttataatatggaattttggggaagaaaaagtatgtatataaactagaaaaaagctaaataatgcctagaaaatacctgatgtgtacagtggaatatataccctgagtagttattgctatatttaaaatatagaaatggccaatatgagtgttaaatgatcttgaaaatttaaatataagtaggttccttcttacttctttctcattatttcatctctcacaatatactacatttattcatactgatcagttcaatatcttcacaggtattgtattgctactatatgtagatatgtattttctaaaaaggttgtaaattatattcattcctttaatactaacctagaagcaaaaagggcctctattattgcaagttattattccggccccagagatgacaagagaggcagaaactatttggagctctgtctgaattgcagttttaagcacatctgatgtagtacatgtctagaggtggcatttctaacctttttatcaactgggttccatggatcagaataaatgataacaatagctcaccgccttctgctggacagattttgctacttgaaaaatgatcgaggccctattaagagaagccacaccaacctaatggggagcagatcacaggccaggtctctctggggctgtatctctctgtatgaggggacgtgaccttgcctgtctttttccctgggatcagttgaatgatagacttcttttctttccctgaattgttacagcaagaggagaggaaagattgcagctttttttttttttttttttctccttttctttcagaaaagagacatggcccattttaacatccccattatctatgtgtctgtccacaaaagctctatttgaaaaggccctatggtttcacaatgaggacaaggcctttcaaatgccactccactggccacagtgtacctggggctccattttcatacttggaatggcaatgcatttactaagtgcccccagaccttctttacactgacccacccctcagattttgctctgctctttcctttcatgaatcagatcctgtccctccttttatgtacacatattgcagttctccttcaagacataattcaaattctgcattccttctaaagtaatccttacccattcagactcacaatactacctgcttcttttgaattcctgtatattcttctaaggactcagtatagatactgaaacattatgctgcagtcattcatttatgatacaagaatgaaagaactcatcttgttctattttatttttcttcccttcatcctctatcccttccttcattttccccattactaccctctttttatgtcttttatccataagcataaaaatgtatgtatccactaaatttttagtgttaatttgtggatatatatatatatatattgtactatgcactatttctcattatctttcttacatattactctacattaaaacagtagaaattagatatctagatgatagttatatagatacatgaatgaatagatagggagagcaagagagagagagagcacacaagttagaaaaagagagaaatagatatatgaatgggtaggtagtagataacaaacaagcagtagataaatagatggaggaaaacttcacactcgtttcaaagtgcctggggaactaatgtgggagtagaaaacaaagccaaactgtcttattcctcactagtcctcattttaaattttaggcccacaaaaatggtggacaatccttggccagggaaggtccagtgtttctaggaatgttacatgacccaaggaaaaataaatgagttttgcttttaggaccatgtttacttagagataagaaccattggaccatcacagatagaactcctcttaccaacatttttagaaagcttagtgtgtgtttcatccagatgtgaatgtggaatgtccacctctgactcttcctccatcctatgatgaaataaatgcacacatttctgagttcagaactgagatagcttcaaatacgtagataactttatatagagtgaagacagttgcattatgacttttgtgtgccctaatcacttttgtctttgttcgcctcttgttttataaaagacaaccaaccaga

SEQ ID NO: 54684 - DNA, 1136 bp, Bovine  19866880779460
aaaaaaaaaaaaaaaaacagactaataagaagtaagaaaaattcaatgggccatatttcatataggaaaatgataccactgattgtcaataagacatactctttgaacttctatgggaaagaaagttttcactaaattacccacagttactcatttggtttctgtttttgaataaagacactcttgatctggcaacaatgttttctctatgaaaactaattcatttagcttcactgactctactctctaatccattgattttccaagattcattaaatgtcccaccttctccatgttacctttcatgtatagaaaacccactaaaacctcacagttacattattatctcttatgactcttacaatatactgcttgctgttaagcatcttgtgttaagctctcttaaaaatatgtggaaaagatctcaatttattgaattttccatgaatgctcagaggcaccaaagggactcaagataaacagagcccaaatacttgaaggaaagcagcatggtttgtttctacctggttgtcccaaaccattgaaaaatcccttagcaagtcaatttgcagtgaaagcaggtgtgagctgggaaggctttgtcccccgcacccccctcccttaggagtagtggcctggaacccagtaggctgaatgattatgttctcctgagccccactgtgagtcccttggcctaattattcaaagtaactattcatatactagttactcaaagtggatggagtcagactctgttgctacactgtcttcaaggaagtgggaaactttgcaagaaaaaccttccttatagaaatgtatgatccctctcctttcttcttcctttcttgtatcatcataaaatcggagcatattacctacagatgttcccaaaagatattccatcttttcctgtagcctatttactttatctcaaagcattcatcaaaacctaaaatacatttctgctttactcttctgttgactaggatccttaagagtagggactgctgctgctgctgctaagtcgcttcagtcgtgtccgactctgtgcgaccccatagacggcagcccatcaggctcccccgtccctgggactctccaggcaagaacactggagtgggttgccatttccttct

SEQ ID NO: 54685 - DNA, 1453 bp, Bovine  19866880865705
tgagttattgaccaacataaaagctataaaaaattctgagaaggcaaaaacaattttataaatagggaaatcagggaaagcttcaaaagaaggtaggatgaagatgaccctggtcgtaaggtagggtttggtgatatagaggaaaagaaagagcttatctaaggaatgacaaagccacggtgttaagaaaatgccatattagtccaagtaccacaataaaacttcagaaatggatgagaactttctcaaggaaagagaagcaacatttccacatacaatgagataataataaataatgcaggaacagaaaatcagtttagtgaaagacaatccttctttcattttatccccaagatgactgaaaatggtagagatagacattcttttgccctgaaatgactccatggggatcaacagaaaccttttaatttggagcagcagccccagctcattgtgaagaatagtttccattttctaactaagtttaataatgcacttgaaagtctgggacaaatagccagaaaataaatgttttctgtaactgactgtcaaggaattgaatctgcttcacgctgccaggaaaattgtattagtatctgaagcaactattatcagtaggtaaaggagataagtaacgaggcagaaaaagaacaagaagaagactggatgtacaaagcaatccatggcgaagcaagatattgattggaaattacagctgattacactggtaacgggcaaagaaggtagtgttttctcaaatgtgaacaagtgacatttcaaagcactttctatgtgtttgaactcagacctctcattgggctttgtgttggcacagagaggagagagagataattgcaggaggtcagttctctttgtttagaaaaatgcattttctggttagaatttctacttaaggcttgataacgacagatgaaaatatattatcataacaccataacactttcctttgactttgactgcaaattttcctataactttggttgcttatttttacattgcatttaccaattagaaattatgtcctcagtatatacttgtaaaaacaaagcaccagatcaggcagattactaaggccacctctagagaagcaagcacagaatacagtattataagtcaaaacaaatggtacagcaacaagtactatggaccttaaacagtcactgtggacagatgggatcaaagaaaggtgttatgaaccaggtcgaccttgatgaatcttgaaaggttagaacattctatcaggcaggggcagggatgtgagcaaagaaagatgaggaagataacaaagagggcttttgaggaccacagttctttcagagaaatcctggttggaagagcagaatgaagttccatggaatgagcactgactctcaggttacaaagagagtatggctttatcatatgtaagtatacgtggccccagtgagtattt

SEQ ID NO: 54686 - DNA, 1276 bp, Bovine  19866880971266
atcagtaagatcctctaaagagtaattcctgaactgttcctcaatgtttacagctatctgcaaatctcctgcctgcagagaaatcaataaaaagaaatacttttctaagacagttccagtagaattccatcaccaatataaccttccaaagagcatctttttcaaaaggaaatggatattttctgataggacatccatggtggtgactaaagcatgtgaatagaagccatatgagctcacgatcatttaatactattacaagatgaaggcaaatagcatatttgacaatttctccatgatttgcttaaaaattgaacgaaataacatgttctgtggagtggaagatatcatctgacaaaagccctgcctacattgccttgctctgcttcaagccacagagcagtttgataattttcaagctccatattttccccaagattgttccaattttgcatagctccttttcttgtcagtaagattaacaatacaaaataatgcccaataaagtttcctttgtttggcttagggtaaattcaagtttgtgtaaataaagattttaaaatcatgtttgatccctcaccccatgtacacacaatcacactcatactcagttcagtgcatggtgaaaatggacagaagcacatttgctagctacaggtacccccatgttatggatattatgacacaagaagcaatgttgatctaggatcccatgtgaagcaatgatgaaaacattatatcaactagatgatttatgaatatcagcaggcacaccttttctgacattttataactttagttgggctatatgtaaactgaggttcacatctaaaatcatattgtttcccccttctcagtaactcttcctgccattgtgctttggtggtgatgaccagcatacttaacattctagcctttgaatattagaaactatacattaataacacaacttaaacataatttgcttgagttatttttcctatttcagttttctaaaaaggtgtacaagaaaaatttggttcgcgtgtgtgtgtgtgggtatgtgtttgttagatttttatttcattttcttcatcatctaagtatattaatgtccctgatccttggttccttgccttggaaacagagtccttgattgtatagcatgatactgctcagacttattgctatgaagaacacaaatgacaaaatgttctcttctttttttctcctaatctttctgtattatatacatgtgtttatatattaatatatgtatgtatgcatacatgctctg

SEQ ID NO: 54687 - DNA, 1021 bp, Bovine  19866881053055
cccttcctacatagcagcagagacctgatcctggagatgcaaatttaaattctgaatgcattaccccataggaatattgctatgctttgtatttagtttccatactgttattaggacattactgtagttcagctacattatgacttaaataggcttttgtgagtagcttaggaagtaaaacaccatatctaaaacacatttctctgggaaaaatgcctcccaacttcaaaaatggacttgtaaatcaaacttcttttcaatatgtggaaaggaaactattggtagtgtgtgtttcatttttatttgaatgagtcttatattacaaactcaacctaaaatactaaaaggcagatttcactagagattccttataacagtgtacctacacatatcatccaaaatttatacacatgttcagcatagtatttcttacatagatattcaattaatactagttaaaactgacttcttaggccctccagagctggcttttctgagcaaatactccgagtcatcaaagcaaatttgttgttgttggccagttgctaagttgtgtctgactcttttgcgaccccgtggactatatcctgcaagctcctctgtccgtgacactttcccaggcagatatacttgttgccatttcctcctccaggggatcttcctgacctagggatgaacccgcatctcctgcattggcaggtggattctttaccgctgagccaccagcaaagcccaaagtatcagttcagttcagttcagttcagtcactcagtcatttccgactctttgcgaccccatgaatcgcagcacgccaggcctccctgtccatcaccaactcccagagttcacccatactcacgtccattgagtcagtgatgccatccagccatctcatcctctgtcgtccccttctcctcctgcccccaatccctcccagcatcagagtcttttccaatgagtcaaagtataactgttaactaatatgttttgactgaagtttgtttttcccaaaagttatgct

SEQ ID NO: 54688 - DNA, 1033 bp, Bovine  19866881251410
aattttgtagtatagcaaagaattgagttgttagttgatcaaacggaaagtatcacatgataaacgttacatatcacttccctacttgtcaacagaaaccagaaatgagtctctgtgtctcagtaagagatgtgcatttggagtgaattgtgggcagaagtagtagagggaagtaggaacctaaaaaaatacaccatatgggattgtcttggaaagtacagattaaatgttttaactgaaaatgtctcttttacaaaaaaagacaaatagaacacaattagtgaaataaattatttttgcaggtaaaaatgttaaaatcattatatttgaataagaattgcatctctctgtaaattgatcttttcccatcataaagacctgatgcatattgttgcaggattgtgaatcaagcgtgaggacagtattgatgctactaaaaaaaggggggcttaatagggcaacacattggatattaaagacctaaaagcaagagatgctgaatcaaatttccaataaccagtcccctgagacatccaattctgccactgagccagtttaaaacaaaaaagtgaaggatgtcaacagcagtaatattgaaatgcattaactgtaaaattgtgctagtgcatataatgacagtcataggactaataacactttgcaattaaatagcacttaacttcctaggagttcaaagtgcttcccaatacaatattgaacaaccttatgatacaaagaggaaaaaagcttccacagatcccatcgactaaagacaatgttttaaacgtacaccactaggatacagcttcttataaaatatgacaagaaatgccaaaataccttgggttcactgcccagtcagaaaagaatttgactctcagagacagttggagacacaatgaaaggaactgtgattgtcccttcttattcatcttcaaagctccagtcttttcctggttctgcactaactgcctgagtggccaagttcacttttctaactgcctttgtctcctcccctttaaattgaagatgg

SEQ ID NO: 54689 - DNA, 2604 bp, Bovine  19866881251557
atgagtttggggattgaggaaagagatttaatagactgaataagctggtcaccaccaaaagaagtgaaaacctgagcgagagtcatcagtaagaacacagcattagtgctggggacgtggacttaaaaagcaaataaaattaagtagtttattattcctctggctctcccactattaataacgtgttttccctcaagaactgagtatttgaaaatccatattaatcatcaagaccagtgttcgctgttattggtgggcggcctatcgtgccgctgctgctccttggcacaggaaggctggccaggaccaccgcccgccgccgccgacctcggacgggggacggtccacaggagcaagctctctccagtttgctgcccaggcggctggcctcttctaccctggctcttcactgtagggccaatatttcaactgcaggagaagagggacataattactgggacagacaatgttctattctacatggtctatggcccctatactaaccttaccttttcatccttacaccccattgcttcctgtccactagctgttcagactgggcagatggagaaggcaagaacctgtgtccatggtgtggtcccactgcccccaaggccatatctcagggattcagtcaagattatggactcctgaggcttctctgtcattaatgcctggatccagttctataggagaattatcttgtcccattctgtgaaatggagtaactattagtaaagactgagagaaattagtcccaactaacagtttacttttggacccttgtacttttgttcatctcttcctaactctggagctctgggataagcccccacttcagatccatcttctacttattgctaagggactccccagaatgctgtatctgagaggagacaagctggtgctagccttcctatgaatatttgaatattgcaggagatttagcccaattgtagctgtcatttattgtcaggctaacataacacaatgttcactgtctacctggactccagggcctgaaagctggagtttgaatatgtatcctccacgttttagttataagatttcagtgaagtcattgaaccttccagacccttagttcccttgtctgtcaaatgggttgttgcagggaattaagaaatgttcattgcttagatcattcagtgttaaaagccagaatattaagtctcacaacatgggtataacattttactgttattttcatcaacatttttttattatcattatgtgatttttactgtaaagctaccatgcaatttttatatatgttgcttattttagctgaaaaatatcatgtgttatgtaattcacttatcatccagtttacacattaatatctgagacagagccaatacttgaatttggggctgttttcaaatcctgtactttcctaactatgcaagtattttacttataaagaagtaaagttacaatattaaaatttctattatgacaagagatcacagagaatatcttatctagtaaaattttagataactgataatgctttactttttatttaagtatatactctagtgctaagcagtgcataaaatcattaatattttattttatcataacaagaaccctacaagacatcttcaattattactcccatttgacagataaagtggctaaagcttagtgagtttttttaaacctacatacagtgacagagctaaggaagttaaaagttcaaatttacagtaccatttagaacccagattcttaccaaaatgcctcctgtagaaaatggcaacctctgtatgttcaaaagataataattgaagaggatgaaatgctgaatggtagctgagattattgatgacttaagaagccaagaagttttggggcaatgacattcaataagacaatttgatgataatttgatgttgcctaaaaatgttttcattagaggttcagacccatgcttttttcctaattttctgaagcaccattatcataattacagtcattgttttcttaataataacttagcattatttttatatattttcaaatagcctcgtgtcaaatatttaatttctctttcactgatacctttgagagagtcttatttacattcgagataccaggaaactgagacagggctaagagtataggacattttgtcaaagctaatattgtccaaatctcttgatgactcactctattctcttaacatttactcctgtccacttgtgagaaatataccaaaaaaacaaaagaaagaaaggaaggaaggaaggatgaccatttctctcccctcctcctccaaccagtaactccaattactggctgagatttacagtgtgtgtatatgggtatgtaaagcaaatcatgtggcagaataataaaatgttaaaaatctctattaattcttctcatcttttatcttgatgccttcattagcaaacatactttgagtactaattctgtactagccatagtttagttgtagaagcaaatacatgcaatggttgtggcctctaatctcaaatatttgaaagtccatgaataaaacagatacaggtacaaatcacaatattttaatagacctagtgttttaatagaggtgtc

SEQ ID NO: 54690 - DNA, 1032 bp, Bovine  19866881315028
tgcagtgtattcagaaacctttagacacatttgctgtctatgaaatgaggatacaaacatttgtacctctcctctttgagacatgaggatggatggcaaaaatcacttgtacaatactttaagtgtcttggaaaaagaacctatcgaaatggaaattattatcatcagaagagtcataacagtcttccaactgtcattgttatagtggaaaatggtgattcattctactccccatctcctttgtcccggtggatagaaatcagcttattagtttcttagtgtaactgacagtgtctcctttataaaacccattcccaattcacatttccactgaaattttaatccaatgaattatattttgtcctctgtattgccaattcaaaatcgttctttggtaactgtactctctgccttctagttctccttcaggaagtagaattactttgagaaaagatagagcagagcctgctgtggatatttcagttttgtgcccttagcagtgaaaaaggaaggattctgacctatttacaacacttatgctcccaaagaacagtcatgcatatgagggttaggtaaagaggaggtgggggtggtctttctattcaagttatgttcatgaactcttgaaggccactctatctagcattgtgcagaaattaacagcctcactaacagtcttcacccaatgactctttgtagttggtttatgaataacctagttccctcgccttttggatggagtaatttgaagcatgtttccctaattttgtgtcccctccaagctgctgtttgcctcctaggttctagttgcctcctaggcttaccagtttgtgttcccagcatcactttccactctggcacctcccatgtaaactctgtgtatttgaatccttgcctcagagtttagttctgggagaatacaacctaaaacagataacagcttcctatatctgatcacccaagactgacatagcaattagagttaaaatcaaactttttttttcttcatgtctttctacctcatctaaatca

SEQ ID NO: 54691 - DNA, 1317 bp, Bovine  19866881569530
atgaaagggttaagattgtaagtcctggagtccaatgtcccaagaactgggaagctctgatgtcttagagcacaaaagggaatgatacccccacctaaagaagagaaaggtcttctaccattctgttctacttggccctcaacagattggataattccaatcctattgatgagggcagatctttaactcagtctgctgattcaaaatactcatctcttccaagaacaccctctcagatggatctagaaataatattttgccagctatctggtcatcccttagccctggaaagttgacacaaagttaactatcatattttctgcactattacatcccagcttctttctactgctttgtctcatctcctctgtgcaatttgccttttctcatcctcctttggcctgctttctggctcccttctttgtcttaacccctgaggtatgataacactgagatcctagttcattcagcttatctttttcccaaatcttcctccttttgtaaaacacagcaaagaatgactggaagcaaaagtacctccagaacctgagtcttcctcttcccagtcatttgcacattcagttgctggcttctttgcctgcataatttcctcttagaaataaaaacagttataaacttctcagggttgagtttctcttttcttcattcattggagacagtcttcctatcctgaacagtcttcttccatggctctgtaaaatgaattatttgatctgagaatccataatgaatttttttggtcttaattagaccattaaaccagaggttgagatcataacatgtcatcctaatgatagccatttaatcaaaatgcccatttgttttcattacatcaagtttagaaagcaacgccaaagtgctctccagagtgttaattggtcttttaggtttctttcttcttctttttttattttattaatgtggaggtgaagaatgtgctgcagtggacaaaaaaagaatgatttcactaggtcactcactggttctcctctgtctgtcattatcctctgttcttcaaagttcatcctaaatgccaatgtttccaaaaaatctagacaagatttgcctgtgatctttcatcatgctggctaatccctggatcttcatttatctacccacatgcaaaggaaatagtaaggaaaacacttcctaaagaacaaaataaaaacaaatgaaaacaaacaaacaaacaacaaaaaaaaaaccttagtgtattttgtttagaaatggcaacagatgacagcaggtatcactagctttcccagagagaaaaagaaagtctgacagagtgtttga

SEQ ID NO: 54692 - DNA, 929 bp, Bovine  19866881653995
acggggtaataggcagggcagtatatcacagaattgcagtataaagatgggaggaaggaggaaatattttgcaaacagattaaaagattttgtttttgtctaggggtttgggactagaacaaattggacataaaacttaccaaggaaagcctgatctattttcatgttttgagattttaagttgccactttttacaagatagacaatttcatttaaatctttgtaaattcaaatctatttaattcaaatgaatattttttatttggatgcctactgtgtgtctgttattttcttgctgctataggagctacacagaaaggaaaaggcaaactcctgtcttgttaattattaaaaaaaaaaaaaaaaaccagttttggaggcaaggttagcatatatgaagcaattacaaatcattactagaaagaacataaatctgccaaaatgcacagaatagtctgtgaattttgagtgctacggcatctcatgggaaaagatcaatgggaactagaattatcatgggatccaccataaagtaggaaatatgaagtgtttcttataaaatggatggccattggaatgtgaaaacacaaggaaagaccattccagaggagaaaatagctcagggaaattccttacagtgaaatatactgtatagtggatagaatatatttttagatttggaaagatatagctttgagttactattttattatattatttgtttaagggagagggaatagctggacagaaatgtagtgtttgtgacttgaagcatgcatgttttaaatactttaagaatggcttatatgtttgaaagaagaattaacatatccattgagggatattttaaatataaactgcttatataaatttgagtaatagattactatacaaagtgtgtttttaatggcataacagttcttctttaa

SEQ ID NO: 54693 - DNA, 1349 bp, Bovine  19866881752978
taggcaacataattttatgagaactaacatcttagttcttaaaggaccaatgctacttatttaccccattgcaggatcagtgttagatccagagttgtttttgttttatgagcggtcatctcatcttgtcacgttacagacaaattaattcccccttttgacataaagcacaggctttctcttccctcgtacatgcttgatcggacatgtaaatacatatatttgttgaatatatgaagacaaacataaagagcactccttatgagcttacccttttagtcatgacaactaccaccctaccaccctccaaaaatggaaataaaaattctaactttccttgaaagtgaaagtcactcaatcctgtctgactttttgtgaccgaatggactatacagtacatggaattctccaggccagaatactggagtcagtcctctccaggggatcttcccaacccagggatcaaacccaggtctcctgcattgcaggcagattccttaggagaatttatttttgaaaaattgaatgcacctcaaagcttcgaatagttatggtttaggtgtttggggaaaaagccttttttttaaaaaaaaaaatctgatttctataagtactgttcctaaatgaaataaaagtagcacaggtttgaatattcttagaagtgtgtataaaagtgaagctcttcctgctgttggaaagtagttctcttgtttttgtggagggaactacaaacagcagaatctcaggcctctgtaatgcacaacaccactcatctgtcaagctctatcatttgaaaataaagagcagccaagaatttgaaaaactaaatctattaagaatatttatgcaggaaaactatcactaaacacctccattcactcatgtaatgagattggcatcacgataaaattcttgtcttgtaagataatgatcttatggctttttctggctcttaaaccaaagataattgggttaatctctgcgggaagtccatctgtttccagtaaaccattttaattgtggatgactttatttcagaaaagttgaaaaggtcttgtcacttgcttcctgatcttggggaataaaagaatggatgtcaaaattcaaaatgtagatgtgtggaaaataggactgccacagaggatgtacctgtctctacacagtgtacatagagtgttatgggcaatattatactatatttactgagggctttttgctaaggatttaaacattaagttttggtcattaatacttgtgcgtcattcctgagacatggacagaaagatgtgttgatgttgcatggtaacatgagattatgcacaggcaaatttataaaactaaaaacatat

SEQ ID NO: 54694 - DNA, 1293 bp, Bovine  19866880386336
tctttgtattaattgctggcaaacagactgggcgaacagttcccactggtgactccgataactaatctcactgtacctgaggcaagagacagccaaaagtgagccatcacagacgtctgacaagattatccatttcatctgtgctgtgtgattctgacattccatctctgggagatgggacaaaagggagtttccctggtcagtcaagctctaagcctcgcctgattcctgattcctgagtggatcaacactaccatctagcggactgcccgacagcatcacatctttccaaaaggaagaccaaaaacaagtttttacattaaaaaacgtaaaacataaggatatgtcattcttttggcagttatgtcattcaattaaaaaaactgggctcaaaaataaggaaaattataatcctccaaaatattttgacaatcctttgtgatttatttcttttattggtcttatcaaatagtaattctgctgattgttcagatttaatctaaaaagatctagttccatgtagaatgtattgaaatcttttcttatttagagcctactgaaatgctgacttgctattaataatcttctacatgaaaacgcattttttgtctaaatgtctgtattaaatcaccttgaaatcttgccatcattttaatccaacccttgaagatataagatcccattacccacttgtttaaattgatgctggttttatttcccatccaaacctcaatacaacctccttaatttgtactgcatttaggaataaaattcagctaatattatattataggaagtatctataatattgagtaatttgagaagaataaaattctttagaacataaatcttgcatagtaaattttctgcttctcctgtgtcttctatggtatcccaaactaaaagataacatgagaagagtcaaaaagtactattttcataggtttatattacttgaaactgttaaaatttagaggaaagaaatgggatgtaaacagaaaaacatgaaatagtctaagtacataagaaacagctttttgctttacttttatgttttactttaacacaccctccatcaaacttaaaaaaatgtgcaacatgtaaaatgtggttcatggttttgtaagatgcggttttgtcatgacacaaacagtactttgccattgtactaatcaattcaaatcaaaatgttgacacaccaaaatgtgttcagttttcccccatcaattaatatctgagatgcacagaatgggaaaatattaactatcactgtttaagaccagagaatcctat

SEQ ID NO: 54695 - DNA, 2112 bp, Bovine  19866880452150
taacaaaccttggaacaaagaaaatggacttttaacacttgctaatgaattgaacagaaactgattaaatatttgtctttctgcttttctaaaatgagagttctaattttctttctatgcacctctctattctggctagttgaacataaggcagtggttcctgacagtggctaactttgctctccctttccctaccccgggatttttggcaatgtctggtctggagacattttttgctacaaactgaagcagaggtagggagtgctactggcatctagtgggtagaggccagggatgctgcttaacatccttcaaagcccaggacagcccctgagaataaaaaaatattcaactgagaatgtcaatagtaccaagattaagaaactctagtctaagataccaagtttacatatattcacttctttaaacaaactaagcaatttgattcatttattaggtgttcttaattttttaaccataaattgtggaatggtttgattaaacaatgaaacttctttgctcttatatcaaagcactgatcaggctactgttgatcaaacataagaaaatgacaccttagatgcttcaaaagtaacataaatgcctgacaaaactggcctaagtaataagaagatgtatttttccctactttaagcagcccaaagggtaaaatggctccaatattggacaatttgttagtagcataacattgaaatcaaaggcttagagttttcctcattttgttctattaatatattcctttgtcatcaaatggctttcctcttgactgaaagatatctgctaggattccaagcatcccacatagatacaagaaactgttcactgaaggaagtgggactgttttctcctgtgcacatctatgtaagagcaaaaaaaaaaaaaaaaaaagttttcaaaaaatctgctctcttgtcccattgtgaagaaatgagtcccatactcatctttgactaaccttaggcacagagaatgaaaaacctgattggctcagactaattagaatttattcataagtcatatgggagatgggtagacatttgaataaagttgcgattctggcagcaaagaaggggaagcaaggctactgacaaggtgattacaaatgggcacccatttcaactctgagatatacagttagggacttgacaattcattgccgttgcaagtcctattgtacttctcagaagaacaaagatactaaccttggaggtttggctccatactacactggataattgccttctgtttctaaagtttaaagtagagaaatgacttcttttttcttctcaaaatatgtgggaacatatttctactttagaagtgctatcagaactgggacaagggttaaggtgaatggaccacccagggtgcaaaacttaaggaggtcctcactgaatttgtaggggggcccctttacatgtgtgtcccagatgcctcacttgccttgtcctagtccggccttgtgactgtcttacaatgtgagcttcacacacaacagacagagcttctgactatttcagagaagactcaagacaattgtcattctgcctgctggaccacaggtttgtttttttttttctttaagacttcttgaaaataattcactgcttatggaaagaccatcctccccattgggtatataccaaaatatggcaacagttttttgagccagtgaaacttggttataaaatgattttaaaaatacttttcccttgaagtcttgacatgatcagcactgggcgtgacccaacgatggaatgaacaacatgaacggatgactgtttccttagcaacaagaaccatgtttcctttgaaacgagaaaccaaaagaaactgtgcccctataattttctttcctccagtttagtgatttcaaaagtagtggcataaaattttaatatctattcaaccaataaataatgtaacacaattaatctattaatacctcagctctggctgcacataagaattatctaaacagcttttagtaaacaaagatgttggggctccgatagcacacaattcaagttgtgttcatctagcaccagcattttttaagagtgtcccccaggtgattcaaacgtgcagcca

SEQ ID NO: 54696 - DNA, 1758 bp, Bovine  19866880504797
atatatatatacactatatataatatatatatataggtatctatatatacaatacttttaccatatagaatttgtcagctacatgttttataatcttgaaaacgcatatctattaccaagatacacactcagaggcatttggggaacttttccataatttttaatataatcattttgatccttccaggaaaatgtcttttttcaatttaaggaagactctgctaaaagttgaccaatgtataaaagcccatttcaaacaaataaaaaatatattcaagccaccaatgaatcccagctaacatcatcctactaataattaactatacttatacacttatcatgttgaattattatctttttcatatggctcagaggttaaagagtttgcctccaatgcgggagacccggattcaatccctcggtagggaagatcccctggagaaggaaatggtaacccactccagtattcttgcctggagaatcccatggacggagaagcctggtaggctacagtccatggggtcacaaagcgtcagacacgactcagcaacttcacttgcactttcatagttcttattaaactatgaagtatttaaagactgaacccatatttcattcagagcctaattcatgtagcaaatttacagtcagtatttgtggaagaagagaatggaaagaacgaaagaaaaggagaaaaggaaaaatggacaggcttgaacaaaaaagctaaataagacaacccccaaagaaaaggaatgtatacaatatgtaacgatattaagtttagcagcctttgctatcagacaaggaaaagcattaatctctaagtcatacagatgtaaatatggttgctggacttattatttatctatgcttgagaacttcaacatgtttttctattatgtaagctcaccttacttcattaccattctccaaggacacattttgtgaagatgagtttatgttttgttttgttttttcaaataaagagaacacattccatccacccactgctgtctagtttctgaaccacattatcaaaactaagtttccttctgtgaaagccatacaagaacacccaaaggtgttcttatgaaccaccaataaacagtccccttaggaacctccagacaacagcagcagccatacctgcgttcagagccctgctacctaggaagactccaccggcaagtcttagactaatctccagttggaggggaagttgcaaacacggtcagtttctggaacagaggctacagtgctcatcccgcgaacaatcttcaaggaaagaattgctcttggttgcttcagtaaatgcagtctttcttgtgcattcatttttgacctacaaagaatgtcaggatctccctaaagtactattgaaatttttaaagtcttaaatttcattgtcagaaactgaaagtctatgtactgctcttttctggtaataagcagtgcatttccttctcacaaataatatggatttcaattctaccaaccataagacaaggttatattatagtctaaagcaatcatctttcgtctggtatagggtctgaatacatccctaaaattgcatgatgtatctgtcctgagttttaaaagctaatagaaatgaattccagtgtcctactaattagtcaatcactattatagtaaaaaagggatgatgctataaaaataaaaatatgttgaagtttggaaaacaattttggaataatcttactaacccaaggaatgggggaaaaagatacataa

SEQ ID NO: 54697 - DNA, 1926 bp, Bovine  19866880598755
cattttgaccctgacactccctttgggtatatctgactatcctggtacaatgcaccattccccattattgaatctacaacaaactgctgtaggttattcattgattgagtgtttaagtatattctttaggagcaaatagagaactaatccgtaagcaatcacataaaataaaattcagcagaattcctgctttaaagatgctttgagcttaggcacttaattatgtggattctttgattatattgtgttacattcaataaagatatataggaactctgtttctttgtatctctgtagattcttctcagcgcttcattgtaccatgcatagaaattaagaaagcaccttccaaagcagtcataccaagttgaagcgtatctgctccctttttataccagtattttttcccctgggtcaatcacattattcaccagaatgtttatttaaccaacaaagatgctagcagtgattctatagttttctaatatgcatcacctatatatcaggtagactgttttcagactccagatatacatttgtctaggcataggcacctacattcatcttgctgctactgctaagactgtattttaacaacaggcttgaggactccttgctcagtgttcttaaacaattcagaagctgagagcgtgtgcggtggcatgtgtgagagagcagacagctctgtgtccattctcacggcccctctgtcagtgcgtatttaggacagctttctaacatgaaatcagctcagctgcagagtcgacttcaggggcttctgagagagcgagaaagaaagaaaatacttcaactccttaaaatgtagttgctgtttctgttctctgaaaccctgaatgtgttttctcatttctcaaggaaacgacttttggaggatatatctaatcatatccaacttatatttctttttgttcaaatcagcttggtagctgttaataatttgacaaacatttagaaatgtttaaaaatagagtaagatattcaaagatatatattttcagaaaaaaactttatagaaatgtgtacactttttaaaaaagtggatttttaaaaaggtggtgagaaaatgaagtggaaataatttttacagccatatagatgctgtcttattttattcttttgtaaaatatacttctggtttgttaggttctatgtgttctgttctgtcctatagccagcaaagctttcatggcagccactatctgcataacagagggaagacatgtaccaagtattgatatcagtaaataaaaataatcacaatttcatctaaattccttttctaaaatgcaacagcagcactgctttgatgctgatgcttttatttactgaactatatttacttaaactcagcagagaaggcctgtagaagaaattatcactttgctgcctacctaatataagaattcagtataatctcgagtttattccagctaatgctgaatgtgaaacagtttattttaataaaacattttagtaacatttctttcaagtgggaaatgactagagactgtaaaacaattttaaaatacaagcaagcaaacaacaaaaaaagaaaatgtcagtctctgtggccaatgtcacattaccagtcacttctctgttcaagtttatagagttcttcaagtgtaacaattactgatccaggtcagttaatcaacgtgattatgctgtggggacctgtatgtgtgagaagaatgtggcccgttcgcaaaggactttgcaccgtgagacaagggtatagaaatggaactcagttgcttataaaatagagacaaaatgctgacaatatgagagattttaaaagagatttctcttctccagatgtatttcccctaaattatgaccgatttcaaaaagctttttctttagatggggaggaaatgcagagcaaatattttttaccat

SEQ ID NO: 54698 - DNA, 4469 bp, Bovine  19866880633618
cctatcaatgtgagaatgaataagtaaattgtgtaaaggacacagtggaatatacactacacaacacacaattgcatggatgaattccacaaacataatagtaatgaaagaagtcagacacaaagaataacattctatttttataagttcaaaacaaatacaacagatctacggtgtcagaaatcaagataacgggtacagtgggtgagtgtgcaggggtgtgagggaaccaccgggtaaaggagatattctgtttcttaatctggatgttagatactcaggtacatataatacaacatctgagaatccatcaagttgtctacatttgttctcttagggtaaggtatgtcacacttcaataaaagggtaaagaaaagtgactatgaaattattaatgcaaaacggagaagagtcagataagaaatacagaaatcctctgctttttttaggtgcttcatgaacctttttggaaagaatctgtctcagaaattcaacactcagtaataatttatgacctacaacacccaaacccttgaaagtaatgtcatacttaaacagaagcttatgcatctgaaaggaagttcttgtaagagctctcagtgaatgtggatgagttggaactaagtgtgtatcagtactctggattctgttcctaactccgatcgttctttttctgtctcattgactagctctggtagctcctgctctcctaagatgcagtccttggcttgactcttttctttcccttctctcaactaattcactctccctcctcttcagctcttaaggctgtctgtcaagttccttgaattgaaatctccagctgcagttgctttcactggcacttcaatcctaactgctagactttccaccactgcaaacatagtctgtctaaaaccaaagttccgaagggtggttcctcaaaatattacacaatcccagcaattccacttctgagtacataaccaaaagaagtgaaaacaaggactgaaactggtacttgtacatcagtgttcattgtaacatcattcacagtagccaggaagtaaaaacatcctcacgcccatcaacaaacgaaggggataaacaaagcgtagtaaagacatacagtggaatatttagccataaaaagaatgaaatccttacacatggtacaacatggatgaaccttaaagacattatcctatataaaataaaacagacacaaaagaatagataccatatgattccatttacatgcagtacctagaaccgacaaatttagagagacagaaagtagaatggtggttgccaaggaccagggtgggggaggaatgaggagaatgaggagttattgtttaatgggttcagggtttcattatgggaagacaaaaatgttctagagatggacagggatgatggctgcacaacaatataaatgtatataattccagtgaacagtaaaatggataaaatgataaattttatgttacacacgttttctcaaaagttgctgaaaaaattaaaaactaaaagtatctccctttttctctctcaaagtgcttttttttaaaattctgctacgtctcttacaactccatgtcctctccaatgccctccactgttgttaccccagacattagactcttcctccgagtttctcacacaaccaacaactcctcacccccattattaccattccaatttagacctttgccttttcctaactaatctccaaaccactgttttctcattcttccaatacaacctggacctttatatcataggaaacctcataatacatttgcatcaacgtgaccactgctcaaaaactcatctacttcctacttgttatgagataaatccatgtagtctggcagttttcgcttgttcattcatctatccattcaacaaatatttattgaaggcctaccaatgtgtcagacattcatcttggagcttgaaattttgtagtcaacaagacagtaagtaagaaatcattgccttgtggggctcctattctaatgtgaagacatgaaaaaaaaatctaatgtaaatcttaaatggtggcaataaacactatagagaaaaacggattgcagaagagggagagaggagggaacaggggaaagaaattcattttctaaagcttgtcaagggacttccctggtggtacagtggttaagaatccacctgccaatgcagtgcacatgggtttgattcctgatccagcaagattctacatgccactgagcagctaagccagtgcacctcaactaccgagcctatgcgcctagagcccgggcttctcaacaataaaagccactgcaatgagaagcctgtgcactgcaactagggagtagcctccactcgctgcaattagagaaagtccacgcagcaacaaagacccagcacagccaaaaataaataactaaaaaaaattttttaataataaagattaccaaggaaggccttgttgagaaggtaatgcttaaacaaaaatccaaaggaaaagaaggcatgagccaagcagctattgaaagtaagaactagaagagactccctgaagcaaacaaaggctggcatgtttgaagcagggcaaggaggctaaggtagctaaagctgagtgagcagaaggggagggaagtaccaggacgagaggtcagggaagtaaaggtgatgagctggggcaaatggataaagccatgcaggtcagaataaagatctggcttttcctctgagttagatgagaagtcattttgaacaggactactacaagctgacccctgttttcactggatgaccctagatgctgagtggagaactgatttcacaaggcttaagggtagaaacaggaagcccacctagtagaatactgcaattaacaaggggaaagatgacatggcttggatgagagtggcagcagaaagacatataagaagcaagcaggatctggatgtgttctgaaggcaaagccaataggatctgctgacaaattggatgtggagtgaaagagaggggttagttaaggaagacacgaagattcttcacttaagcatttggaaggactgcctccattaaagagctgctgctgctgctgctaagtcacttcagtcgtgtccgactctgtgcgaccccatagacggcagcccaccaggctcccccgtccctgggattctccaggcaagagtactggaagtggggtgccattgccttctctgattaaagagctaggaagactgtaagagaagcagtttgagggcagatccagtagtcactcagatatcaagtgagaagttgcacctctaataatctttattagccttacgtgtgtctacttctcacacaaccccagctgatattttcaatcttatgaagcacaggttcacattattaaacatactatgtgttaagcgctgtatctgtattcactgcaactacagtgggagaaaattgcaaggtattaagcaagaggtctgcctatttattaacctgagtttaattgtactcatcacctatccctgctgctgctactgccgctaagtcgcttcagtcgtgtccgactgtgtgtgaccccatagagggcagcccaccaggctcccccgtccttgggattctccaggcaagaatcctaccattaagaaaacagcacatgatctgccctgaagataaactatgcagagaggaaaaatgacaaagatgcactttctttactttttgccttcaaattagactttatcaatctttgacaaatatgatcacttagggagaataatgggcttccttgatagctcagttgattaagaatttgcctgcaatgtcggagaccccagtttgactcctgggtcgggaagatcccctggagaaggaataggctacccactccagtattctgaggctttccttagagttcagctggtaaagaatctgcccacaatgtgggagacctgggttcgatccctgggttgggaagatctcctgaagaagggaaaggctacccacttcagtattctggcctggagaattccatggactgtataattcatggagtcacaaagagttggacctgactgagtgacttttatttccactttcagggagaataatggccagccgatcctccactgccccatgcagggatgcaccctctgtcatctgggaagttatcttggattaacgggttagtggaggaaagggtagagtggagactgagagggagatggagagtaagcggatggcttaggtcccagcgaccccatactctgcccttcctagaactaggaccctttcagggtgaggagtggacggtgataaaaccccatataagtttactggtggtgtgtggttcaaaccagagagagcctcgggagacttagagcctcaagtagaagtcctgcatctaacatggcagaaaagcaattagctaagtgcaaccttgaggaagatgagtccataacattcaagaatagaaaagaacactcagaatcaag

SEQ ID NO: 54699 - DNA, 1794 bp, Bovine  19866880712174
gacatttgcctttgttagtattacacccagctccaggaacaggaatatttttgtattcttgatacttcaaacttgctgggaccaaacaccaccttgctcaatgtactcattagttttaagaacattttttggacagttttttcttggactctctatagaggcttctagattgtgtgattaatgaaactggtagatatggagtaaaggaaaaatgttttgcttttaaatcaaaggaataaaaatttataggcttatagggtatgaggtgccctttgggacattcatgtaggctagaattcattaaagacatatgatttagagataacaatttgaagatttttcagcagatagttgctaactaaaatcatgggagtgaatgagctcaatccagagtgtaaaaagataaaaaaacagaaagaaagatttctgaggatagtagcaataatctgctctcatttcatccttttacaacatctataagcagttatttacataactaaagtttgaagaccgtcagtgggacagaattagtttctatcatcttttagtatctggccctggtaattagaaggtgtgcagaaagagcatagcaggcctgggattgctatccttagaaaggtctgcttccaagattatcccagctggtctctgggaacttggatttgggagagtttctatcatttcctgataaaaatggctcactgtacctaaactgcacaaaaaatgtaggttctgctgctgaatacctgctttccttctgggaatctggaattttggtagatgttaagtaaaggatgcctacctgaccaaaactcaacaaaggccctggccactgattctctaaaaagtgtccttggcagatgatatttcatggatgttgtcacaacttatgctaaagagaaattaggtgtgttctgtgtgattccagtgggacaggactcttagaggcctgctcttggtttcctctgactttgcttcaagagcctttctcattgctcacttggttttcatcttttaatgtaataaatcacagctatgggtatgaacataactatgtattaatagtaagtcctatgagtatttccagtgaatcatgaacctgggagaaggtaagaggcttggggactcctgataaagagtttatcatttaattaccatcactttttacatgctgtatatatttttccttcagtggcttttagaattttctttttagatttgagttctgcagttttgttataatgtgtctgcctatgattttcttcttattttatgttaccacttgatgtatcttttcatttagagtgctcatggctcttcatggcttattatttctctgccaatatttatttaaatgttgactctctaccatgccattgcatggagtctgaaacttctgtgccatttccatgtgtcttgtttctgtctcatattttgatatctctttatctgtgtgagctgtattctgaaacatttcctcaattctttctccgaatttgctaattcttcattcagttgtgtcttatctaccaattgcccataaccatcaattttttttatgtgaatagccatgactttactaaaactcttattattttttcctatatccatgctttttttttttttttttttgcataacttcctattcctggtacatgtgtgctattccttattttatctatttggagactactatacttactttaaagctcaggtgcatctatgaagtcatctcttcaggtataaattctcatttttggaattgatattccccatatgttctgtaattgtttt

SEQ ID NO: 54700 - DNA, 1269 bp, Bovine  19866880767244
aacaaacaaaacccctgccgtctgcagaggtggaacacagccggctcgatcaactttatcacacagctgtcagcaggtgtaaatccaccctctctgtaggccgtgggattccagagagaaaagcgaagggacagagtgtggcaggcaagtccacttcatacttgcaaaccaaataagttgttcctcttttctggggagagagagcataaggcctggtgagtgagacgctgggcagcgtttctcatcctcggcactgttgatattttggactggataattctccattataggggactgtcctatgcattgtaggattgacacattatataccaggagcacaagcattagatgtgacagtccaaatttacccaaatattatctgagatggggataggagtgtgaaactactcctattaagaaccatagtttagagacttcttttacttggaaatgggaaggaaaaacagattaaatgttccttattactgaaaactagcaattcagtgcatttcaccattagattttaaactccctgactacttctttgaaaataaagcctagaaaagtgtctttcaagtaggcgataatagtgcaaaacattctaactaatgataattcagacatgaccagaagaaaaaatgttacttgctaataagaggaaagttatctttctactgattataaaataaaaaaaaattcatatatgtggtattaatgaaaattagcagatgaagataaagaggcaataaagtggaaatgaggaatatgaccaaattaatccacccagtatttatatgttccctctcttgtacacagcattcatctcagtgtttaggggattataaactgtacccgtactcaatcatctaaactctggtcttccccgttgtgaaaaatatgggcattctgacacaaacctataaaaagttcaatatcaatatcaggtagggtgtgaatcagtgcagttcattgttctccttttgccttttagaatctatcttttggttccctaaagtgaagaaagtcttggctgcttttgttttcagtctgtaagcttgatatcccctccctcagagatttttcatctggattagatacttttcatatattcaagtaaatccattttccatgtagctacagacactgtgaagtaagctatcaaaaaagaaaaaaatttggctagctaaggttgtggaataagataagaaaccacgaataagcgaatcaagtgagaataatgattagagtgtgggctaggcatggacatgt

SEQ ID NO: 54701 - DNA, 925 bp, Bovine  19866880815613
tctttatatattgtccttgttcctttagctttgtgccctaaatgtccttcccaaaggtccaaagtggactcaccctgcaaagcttacatcatatactcttcctccatgaagtcttctctgattccctcagcctatccctcagaacttcctagaattttagttttacctaaatgccatatatcacttttcccttgtatttgtttataacatgagtatttttttctacgcctccaaaaagcaaggttgacattctatccatctttgttaccctcaaatcaccgtgtactgccttgacaaaagcaaacaatcaacaaatatttgaatggataaatgtgatggcatacagactaagaaactgctctcgatcccagcctccctctctgtattcttattgttattataaggagtagttaggctgttcacagagcttttaaataaatataaagttttaattctcttaattatcactgctattatattttgctttttcccatgcattttgtattcctataaaatttttatactctgtaaaacagaatattttaagttttttgaatacataatagcagtaaaaacaacacaaagtttacttggtttgttaaacttttagaagaaaattaccttttcaaagtttattaattttattagaccctattcttttaagtttctagatttttccttctgcctcttcattcataaattgtgtctagagagctaagtttttgaacttacataagtataaatttatttcaatttcaattgtacaagtataaagaaaggtactaggcaactttaggccatggacaggggagcctggtaggctgcagtcatgctgtgtcggacacgactgagcgacttcactttcacttttcactttcatgcactgggaaaggaaatggcaacccactggcagtgttcttgcctg

SEQ ID NO: 54702 - DNA, 1582 bp, Bovine  19866880849985
ttcccttctccattggatcttcctgacccagggatcaaacctgggtctcctgcattgcaggcagatttttttttttaccatctgagccaccagagaagtcccaagaattcttattcacatctttgaatataatatattatgaggttaggcgaagttgtatacgggttgtgactactaagtagaaaagcagatattacattgtctagttcctatgatttttagaagatatttagttgttgattatggtgtattttccatggattctaacctatgcctacctacctttttttccatggacagaggagctctccaaagagtatatgaaaatgcctactttacaattttaacaacactggagtcagactgctgaggttcaaatcctgcccctcagttgaactacttcattgacaagactcaaaatttttcctatccttaagtattactatcttgcagacaagtagagtgcctgtttgtgggctgttatgaggaagggtgaaagagggcctgagaagctgagtgttgggtatgtgggggccccatgacaatgacaaagcattctttatctgaatattaaaatgttagctcaacacttgtacagctcattaggagcaattttattgtcaataacctatgacaaaactgttccaacccctctctgtaagtatccacataccatttgtcctttggatgttggccattattgtgatgtttttgtcatatagatgcatccatgcatgctaagttgcttcagtcatgtccaactcattgcaaccctatggactgaagcccaccaggctcatctatccttggaattctccaggcaagaatactggagtgtgttgccatgccctcctccaggggatcttccagacccagggatggaaccctgatagaaggcacctaaaaatgaagacttttgataaaaagtttgataacttaatgcaaagaaggtaaatgactgttttctctgcattattcatggtgatcttcatataaggtatcaaatcttattttcatgcttttgattttaaagtcaggaaaatcatttttacaaagaaaatataatagtatgaagtccagaatattacagaggaaaacacattactcactgctggtgaaattctggagggaagtgtgtgtgcatttaaaattcacccaagatgagagaaacacccaggggaaaacatgcacatcacaggcaaggtattcttaaagggtgtctgttctagagtttgaccaagtggaagagcaaattattgactgggaattatatttgccccttgcccagagacctcacaaggtaacaacgtgtctccatgaaaacagcatctccactgtgtctctgcttaccctgcctttgcgtttccgcttagcccagcagagacactggcagcaccacccagggcaaacagtgtttggtttctaaataaggcacaaagctgaaaatacataaaaatggagtggatactaaatcaataagagtcctgcatcttctgtccatgctttgtggtgatgatgtctctgtctttgtagagctcataacccaaaatcttgagagccaaggaaaataatgtttaactct

SEQ ID NO: 54703 - DNA, 1174 bp, Bovine  19866880888617
ggcaggcagagttctttatttattgctcccagcaggtgtcagatgccatagtttctttgcaaccatccaacaccctggggctttttagttccatatccaagacaaggaagacagaggatggccactaacccccaagagattagatgcctgaatcctatcccaactactaggagactccagctgtgctgaaatgttttgttgttgttgttgttgtttttgaagaatttctgatgctcagtggttgctgattacttccagattttagttctaccccagtggagctttgctacagagagtttatctgttgttaaaattgcaattgctacaggaaatgtctcctcttaagccagttctcaggatgtgaactgttacaaaggttaaacaaacaaacaaataaacaaagcctatttactattaaaaatgcattcatggcactgatggagagttagtaagagtgtgtgttaagactagcggcattggttgatgagtctcatcgaatactcttaggatatgattgctgaagttactgcatcgatgcctgtaaagggctccagtatgtgttctttagtcaatatatctaaactgacaaagaaaactaatttttgaaatcagaatagtggtccatctattaaagggaaaaaccatttgcaaccccgccggagtttagtatttttccctcaatagtaaagaacactcactagattgcaatatttcactgacaactgaattgtttaagaaccacagctattgtctaaaattgtgagtgtgtatacctgtatgtttgtgtataccttgttgtatgtgtgtgtgtcatgtgctcagtcatgtctgactctttgtgaccccatggactatagcttgccaggcttctctgtccatgggatttcccaagcaagaatactggagcagtttgccatttcctccttcaggggaccttccggacccagggttgaacccacaagccaaaatctcctgcattgaaggtggattcttaatctgctgacctatcaaggaaccctacacacacacgcacacacacacacattagtattagagtgtgtgtgtgtgtgtgtacacatcttaggtatcgaattgacatttttagatggatatgagattttaggacactcaattgcactaaatacatgcttccaggctcagaatgttctaagta

SEQ ID NO: 54704 - DNA, 1081 bp, Bovine  19866880922165
tcctattgtcagcaattactttccttagaaatcctcactgaaaattctaatttgaagtgaggtttgcattttattgctgtccatccaaattagtttaaaattgacagctacattttcatttaaaattttaaagatattaaatatgcttgagaaaactgaagcacactcagctccgcataagcctctctgtgtgtgtgcatgcatatgcggacacacacacttagaagaaaagacagccaacacccaagaaggcgctttttatttttccgaaagggagttgttgtgcaaacatcacaccatggttgcttctgtgaaatttcaggtttctgattgttacatttacacacagacccctgcagtgatgctctcacctgcacacagatggacaaggaaacaacacactattagactgctttctagggttccgagctccctctgggatatggctgttggatggtttttcatttgttctttcttcatgctccactagccaatcaactatttcccttccctacgttctgagcattgtataaagctaaaagggaatatagcctcaaaaataatactgaggagttgactcataattagcatgggtccattgatgtattttaactaagggcaactgatgagtcaggctcatcctcaaactttgtaaaagtttaagcaccacatatttcccaactgatggttttcctcttttaaaacttaagactggtttccttgaaatacagctggatatctttaacaattagaccaggcttccaattgttaactttaaagatatggatgcaaaggtcacatatttttctctctaccccatgattaaaattctgaaactgtaaaacaaatctttaaaagacttgagttaatatacctgtgcacagagaccctgtgtcttagatgaagctaacagaacttgctctgggaaaagcatatccacatagttatatcatgataaagagggtaatgtccataaagaacatttgatttattaacctagagatagaattacattaaagggaaaatgacaatgaaattccataattacatgtctaataattcagtaactaataagggtggt

SEQ ID NO: 54705 - DNA, 1003 bp, Bovine  19866881153920
tctaaactgaaacatgtaatgcagaaataagctcttacataaaaaagcaaaggaagtacagactggtaggcaaatagacccatatttatttactaatgttgttacagtattccaatttatggatctgctcttatatataatgcttcttatagattactgtctcttatgtctctgggcactaggaatgatgaaagtgttggtggcactatataaagattagtgtaggccactggcagatcagggttcaaatttcaagtctgctgcctgtcctctgggtgactgagcaagctgctgaacctgatccttactacccctacctgtaagaggaactaataatacctatttcacactggtcttggatgataaaatgggaaaatgctggtaaaagcacacaggacctaacaggcagtagagtaagtgttagttgacactaaccatgaatctgatgtgccacacactgcctttcttgcctcttctccattcgttaagagttctgggagagaagcgatggagtgtggggcacacctgactcctctgagtgtcaccaggctctgtttctgctttcatttggcctgtcttctgttgctgatccccatgcaaattcatcaggggatttcccttagagacactaggggtaacagcaaggagaccttacgatgccaagctcaaggcaaggctggatgttaacttgattttaataaaatctgtgtatgtgatgtttgctctaagaacaagtagatggaattcagattctaaaacactatattcatttttagaaggcagtaatagaactgctttgtgcaaaagataaaaagactgattcaaagatagacttcttttttggttcacaggagtgagcaataagaggaactattattcattatgaaacagaaatgctaatatatacagaatctgaaatatatttaaatatgcaaagtcttatattatcagagaaatatgctcttactacataaaacagatagaagtacccactccagtgtta

SEQ ID NO: 54706 - DNA, 2053 bp, Bovine  19866881205230
tgactagatggacctttgtaggcaaagtaatgcctgctttttaatgtgctatctaggttggttagatatcctaggtaagggttaaataaggaaagagaaagattcaatttttctaggaacaatactgtgaaggctgagaaaccaagcaatgttatacaatcaagtaacagaaaaaaagacaaacatgttcagatttgaagaatgtggaagagaggcaataaatgaaataagagagagaattttgagttaatattccagggttttataaatctttaggaatgggacttttttcagagtaatatacaaagaacaaattagaaatagactgaccatattatccagcacccctacacctgtgtatttacccaaaagaattaaaatcagggtctcagagagataccagaacttccatgttcattgcggcactatccagaatagccaagatgtagaaaaaactaatagcttctctggtggctcagaaggtaaagaatcagcctgcaaatgcaggagatccaggtttgatccctagattgggaagatccactgaagaacgaaatggcaacccactccagtattcttgcctggagaattccatggacagaggagcctggtacagtccatggggtcacaaagagttgaacatgactgagcaactaacacttccatggccttttcggggttctctggtggctcagttcgtaaagaatccacctgcaatgcaagagacctgggttcaatccctgggttgggaagaccccttggaggagggcatggcaatccactccagtattcttgcctggagaatccccatggacagaggagactggcagggtgcagtccatggggttgcaaagagttagacacaactgaaagactaacgacagaaataactaaagggtttcccaggtggcactagtggtaaagaaccctcctgccaatgcaggagttttaagagacatcggtttgatccccaggtctgaagaccccctgggaggagtgcacagcaacccactccagtattcttgcttggagaatcccatggacaggggagactgatgggctgtggcccacagggtcgaaagaagttggatacaacagaagtgacttaacacatgagcataaacaactaaaacacatgtcaacagatgaacagataaagaaaatctcgtatacatacaatgggatattattggttttaaattataaaattctgcaatatgcaacgacatggatgaacactgaggacataattagtgaaataagtaagtcacagacaaacgctgcataattctactaacatgaggcatctaaaatggtcaaattcatagaatcaaagattgggatggtgttcaccagagattcagggaaagaagaaatgaggagtcgataatcaatgggtatagtttcaattaagcaagacaaataagcttgagaggtctgctgcacaacattgtacctatagaaaatattgtatttaaaattttgttaacaaggtagatctcttgttaattgtttatcaaaatagttttttttttaaaggaatggacacagtttaacattaaattatattttctataaaactttttcaaaagcatatttcacagatctagaaattctaatatagagcccaagatttggaatctcccatggaaagaatgataacacactggccaccagaacgtgacacttctaagcttttcagctctgcataataaaatgtttaccttgagaaaaaaaaaatttaataccaaggtaagccatttacttttctcatgggttaatggtaacttttgtctactcagatggaatgtatcagaaataagatgttttcttttgtgagttaggctatcaactgaacagggttagaactgttcaattggaagccactcaaatggtgataccaaacttggacacaaatgctgacctctgtcttgctcctaaaacgtgacttcttttctccacagccaataaggccatgtttttatttccttcaataacacatgatagatttcagtgagaaaaagtaattctgcagcaaattctgcaggcaagg

SEQ ID NO: 54707 - DNA, 1171 bp, Bovine  19866881245841
cacacacatttactttaggggcaacatatatgtatatattaaaaaatacttaaatgtttatatacattataaacacacataaatgtttaaatgaaataaatatgatatattgaaagacgatggtggtcaaaagcaacagtgatttacataaatcagaatgtagaatgaaaaataaaacatattcagatttattaaaatacatcttttgagcccactatgaaaatattattatcaacttttgtcacaaatttaaaaggatgggaaaagcagaggacagaagaatgtagggagagagagctgtagagtcagaaacataaacaccgctgacccaacctgacaatactttattgagctttaggaagctttcagtgatagtattcaaaaaaggcttccatgtagcagcagtatagacatcgtcaacagccacttcagacagttcagatagagcttccctccgaggatggaaagaagtgataagtggaatgctgctgtaagcatctggacttagaaggatttctcaactttatatattgatggccaagttgaaagaatgtgcagcaaggtgagaatcttgcttgtgaaacaaaaaaccaaggaaaggtggtcaataaaaaggtgagaaggagtgcagttggatgattagaaaccttaaagttaaatggcattttgcaattcattgtgaaagaaagaacaaaaaccactgagactgaacgagaagaatctcaaaagaattctccatttacaaatgtgcctacagaaaaatggaacatatgaaaaggaagaggcttcaggtctgattatacttcatcacagctttcagatgaagagtgaaacgttgtttaatcctctatagatattttcaggcatgtgtgtaaataacgaagttgaaaacaggttactgattcttaaaatctagcatctattgaatagtatggagtcagatttttctttaagtcaaataacagtatgtgatatgagtaaagctcttccagaattattatctctacagataacttttctaaactagcgacagatgaagaaattgaggtgaatttcatgttctgaaatttctgattttttttattctacatgatagtcataaagtgtggcttctttatttacgtatttatttatttatggagatgtctgtatgtatgtaagtacttgttta

SEQ ID NO: 54708 - DNA, 808 bp, Bovine  19866881265647
tgatacatgtataggtggcaattattcctaaaagttgggaaataattacataagtcacaatagggttacttccagaggggaagaaaaagggttgttagaggtttattggagcaagactggaacacaatttaagagggaaccaaaaaaattagtaatcagaataaatatatcttaatgcaatatttttaaatataaaaattaatgcaaaaatccatgataaagtcaaaattttaaataaagacaggatcaggagggagctggaggtattctttctcttgacctgggtggtgggctacctctatgtctgttttcattgcgctgttcaatgcacgtctctgtacatgtattatatttcaaaaaattgcagaaggtggtagaaacagacacaaggctctaatttcttacgcttttttcctttcttacgctaatttctctcttgtgcttaagtcccatatttctgtgctgttctgaacatgtctcttggtttgttttaaattctaacgtttcttttatagaacaacagttataatgccaaacaaagtctccagtgattttgacagtgggtttagactgttcatcagaaagttggctctgtgtctgcctgtattgtggcacccaaatgttcactttaactccaggtaccaacctgccttatggctcttgttcatacttgagcaattaaccttcattatatacttggttcacattagaacaattatctagttgatagctctagtgtaaaggtagtcatgaattttcatgtttctgaaggctttttcctgtaccttacccccatctcaacctgcat

SEQ ID NO: 54709 - DNA, 1569 bp, Bovine  19866881270467
tagggaataattttctttacagactatcaatccttacactttagaatatagctatttcttcttaagaatattatattaatagtcactgtttcaccaagctttcatgagcattctcagaaataattcacctacaatctattcagatgcaggacagaatctgaccttcccagtgtcacgaatatgatttgggggaattgctctgacacaagggacgtttagctcttttcgtcacgctagcttaggcagcaccttcagcttgttgtgacttctgtttgctctggacagtgatgtcccacaattttaggggtacaaggtaaagagggtccacagagttgctaccaggaaaaccagttctcaaggtttcagagtttcagtgagctgagagggtatattctgtaaccacagagagggggagatgcgggcttctctactgcactgggacaggacatctgtactcctagtcaaatggctacccaggcacctcagtgctactttatgtaatttccattatgcctttagactgtcatctttcagcatattttcatttattgtttttagctacgattagggcagtaataggagagcaattctagggagtgagaacacagataaaatatgtagacccggcaccagtggggtctacttagccacacctcatatttcagttcacagaaatgtgcgcggggactgacataagtactccctgttgtgttattgcttctggctcagtagccctttgagaagaacgcagaataaaggactgcagagaacgggtgccatcaaaatggcagtgctagagacggtacctacaagcacccgatagagttttatgttttttaacaaatgttttcttgatgttacctttaaatcccacctgcaattccttctcttgccatcgacatcagtcgcctctctgcttttcaggcttctttttgaggcatcaatgaacctaaaggaaaccagcatgatgggaatttcatgacaacttgcagcacatagcgctttcttggcgagcgatgttattgaatagcattcagactctcacggcagggccatggctgatcaataatttccaggagacccttttgattgtgtcagaagcaaaacccaaggaatgtgactagaccagttagaaatagcaccctgacaggaaaatttcagggcagtcaaaggataaattgtaacatttggttatattactatgtgctaaggctctttcttgacaggagacatttggttcctattttcaggctatagaagactttaactaagcataaagatatgagtgtcacaaaggagtgtttcaaacagctacattaagaaattgaggttgtcaaatctccccttgtgattaaagatgagaaatgatcatctaggtatgcactaaaaagttccattagaaaactctcttaaatgctgttttcctggtaaagcctccgcacatgaaatggaaatgatgttatgattcctaaactatttttttctcatttttctagcaggaaagtttttcaacttgcaatatagtatagttacatttctttagcttattattttcttggtagtagtagt

SEQ ID NO: 54710 - DNA, 1341 bp, Bovine  19866881277657
tatatgaagtaatgtctaggttgatctttttaatgctttatttttcaaaaaaagaagcttttagatcaaatgtgttcatgcttatgtatgtgtgtgtaatttgccaactagagtggttttacataggagcacaggtaaggacctttaatagacatttaaaaatgtgacctgtgtttcttattgagaatgtttcccctacatgcctttgttttaataacattttttttaatgccagcattttcccttctatattgatataaaagatttgggttatgaatattgatatttgcatttaaaaaaatagatcaggtattggttttatttgtatgtctttcatttactctataaatgagagtctcttcactcagtaagatgtctgtgaatgaggttctgtgtgggtaagacttctttagtaattagccattaaatagaacagtatgtattgatggaaatcatcatttttctttctgataccttttcctttattttagtccagtgggtctcaaactgtaatgtgctggaccactagtggatgggattaggaccccatattcagattctattttaaaaagtataatgtgggcccactcaagcagatctgtattaaaagcaagttccatagataactctaatgttcattgaattttgagaatcgctaccttagatataattttattgtaaatgaaattgtgtatagttttatttttaaatagtttgatttggaggaaattgcaaaaataatgctgaggtttccctttgccttcccccaagcttcccctgatgataatatcttacataaccacagtatgttatcaaaatcagggaagtgactttggtacaatactcacatagagaccttatttagatttgtatcacctcttacatgcattctttactttaaaaaatttgtcttgatttataattctatgaaactttcatacatgtgtaaatgtgtgtggcattccacagcagaatacagaactgttgcatcaccacaaaggcactcccttatattactcttaatggttacaccctgcctccaaccctggcagccagtgatctgtcttctatgaccataagtttgttactatgagactcatataaatagaacatatagtacttaaccttttgagactggtttccaccccctcagcataatgcccttgagatcatccaagatgatgtatatcaaggcttgctttttattgctaaggaagagaaggcaatggcaccccactccagtactcttgcctggaaaatttcatggacggaggagcctggtaggctgcagtccatgaggtcgctaagagtggacagactagcgacttcactttcactttt

SEQ ID NO: 54711 - DNA, 1655 bp, Bovine  19866881289814
ttaatgaggaaaacttttaatagttccagcatagatattactttgaatatattgatatttgaatatattggtaaatacactgaggatcacagatttcttttctgtgggctttttatttttaataggttgtatttcattttttgcttcaaaatattttggacatatgattggtgtcaagatttctccaaaagctagtgggttttcacagacaccccatggaattagggtgaattgcagcggaggtagtgccccaggacccccactctcatgcctcttttaatactttgcatttggattatgagagagtggtgggttggagttcttctgcctcctttcccaaattctcctataatttagttatactgctttaatgttagattaaaaaacaagaaaaatcagaactttggaatcagatagtcctgtatgtgcccctgacctcttctctccactgaggcaatatttccactttttaaaacgttcctcctttttctagtgtgacctctgtgactccctttttaaaatttaattggtttggtttaataacttggaaagcactcaaactaaaaaacctacttccctgttttgcatgtcaattaattaatatctgtggctcattaaattaaaacttttttttaatttacttaaaaaacattatctactctcggtatttccctgaatagccttttaaaaatatgtcacgttgttttagataatgctttcttttagttttagtttttctattttgcattagtttattcatagaggtttctattttcttcttttaatgagacactaatgcatttccactgtcttaactaaggatgctgagcacagctactcagagctagtccttttcattctccatttcctgactgacacatgccctctgtctcagctacttttcactgggtagtaaactaggccaaactgtaatggcttaagtatccactcacgttttatcaaaagttttgtaggtcaggatttggaaagggcttagctggatggttttctgaggcagattgactcccaaaggggttatggatccacttctaaagtggcttttcactgtatgtgcctggtattgcttggcacctctcccctctctctttctcacctctccccagccctacatgatgtctcatcctctagagcttttccagttgcgttgtgcttctcactatacagccatctcagggtagtccagtttcttacatgacagctagcgtccaagagttaatgagtgaaagccatcaggctagttaagggacagagagaatcagcagtgtgcctctcccaccacatccttttgatcagagcagccacaagcgttgcccagattcaagggggtggagaaacttcatttcttggttcagtagcagggtaacacttgcagaagagctactgttgcagttctctttggaaaacacaacctgccatacccacccacaactgagaaccatagaggacgaagaagagattatttgctttaccttcattgaggagatgaatttggctcaatttctttattcactgaataatggaagtctggatcgtggtcttacttagactgtaatgaagttgaagttgataggtcaatctataatctcgagggaaatcaccgaaagggataaaagatactcggtttctctccagat

SEQ ID NO: 54712 - DNA, 956 bp, Bovine  19866881377528
ttacatgcaaaagaacagggaaagaagtcctggaaaaaagatttatttccttttaagaagatccggtttatatttttctactaaagggacatcaaaaggtaaattgtaatgatatattatgatatatgatcaatgatatattatgaattatatggaagttgtaagttaaaatggactttactttgttttatttattattttattacatggtattgatatttggtttttttttttaagattccaaacatttgccataacctgtttaaaaactaattattcagctttattttccactagtttcaatatacatcctttgatggaatttggatgctcttgtttcagtatcacattccttgctcatttttcccccactctgaatccgccctcgtttttcttatcaaggctggggttttgaagcccatcagagttcacatcttttctttttacccaggttcatattactgacctgttgatgttgagcagttaataacacttagctgagtctgtaactgcttattaattgctttgtgtgtgtcagttttgcctcctcacctagactgtaaattcctagaggaagttgtgttatgatcaggtggatgtatgtgtttgtgtgtttgtgtatgcatacctatctatgtatacagttacacagacatggctgtgctgatgttcctacacacacacagaatcacatatgcgtataattgccttagtgctagcactaggtagactgtttctatggagcctagtagttgccgactacaccatatgcctgcattctgtgtcttgatattttatgcaatgcatagattccttttaagtaaaactacttttgagagttttcatgagagtttaattctatgttcatgcctctgttttgtcactgacaacattgttgctttttgatgggtaatctgtcatttttctcggctcgttttcaaatttattatcatctt

SEQ ID NO: 54713 - DNA, 1825 bp, Bovine  19866881497007
actgggtggctgttgttcttatgtctgtgtcttcatgccttcgacaaatctcagcatcacacaattgatgaggtgctaagagatgccgtccactatgctgctgtggccaagcagtggtgggagcatttgccaaaagcaacatgaagatgaccaatcctgagaggacaagaagatctgacttggcgctgctccttcatgtgaaacaatgataaggcgccatttcagtaccctcagaggccactgcccactccatgccagggaacgagggattgggaatgagctggtggccattggacaggttccctggacttcctgactacccccctgctttcttacagtaaactcccatcacgtaggataacaaagcatgcctcttatttttcatgctctgttgtttatatcagaggaactacgaaatgaaaatctggagatattctgaagtctaagccaaatttaagaagagaacaagaacagagcaagaggtaaatgttggggaaaatgaaaacaacatctaaccaaccaggaaatgccattaatctcttcagttgacgttgctacaaatttttaaaaaaaaataaagttgccaagaattgagacacataaatttagaaggacaaggccaatttaaatttctggaataagtgcatgtactcattttttaagtaaataacacttgttagaagaaaaactcaatatttttgcttgaacttcatttcaaatccttcttttaaaaaaatagttccatttaatgctgacatttgtccaaaatacacatttatctatgaaggataaaattacatttttggttgatattccacagtccctgtcatctctcagatctattcagtatgtatgaaaaactccttacactaccaatggagaggctttgttaaaatgtctcatttttgtttctacttatttctccttgaaatatatgaaaaggggaaagataatctaacccttaactctttagtaggttgaatatgccccttgtcaatattattattacactaaactttcctatttaagaaaaatatcaagtcataagtgaaactacatgactactacagatttaaactaaggtacaaacttttgtgatcatacaaaaaccaaatagcagagttgctcttaagaatcattagagctaaacagtggtatcctatttcctccacatactgaaagataaaaacagagagatatggagatcatataatcatgctatttaataaagggatattgtacatttctaattgagtgagtgagtgaaagtcactcagtcgtgtcggactctttgcgaccccgtagactatacagtccatggaattctccaggccagaatactggagtgggtagcctttcccttctccaggggatcttcccaacccagggatcgaacccaggtctcccgcattgcaagcagattctttaccagctgagctatcagggaagtccttgtagtggcccaaatcctcaactttctatataaagtaaaaaaaaataggataaaaagaagtcatatcaattgatccatgagatcatttgcaattgtatattagcaagaagaaatcctcctggaaccctaaagaagaacaggaactgtctttgtctcatcaatgagcaaacgcttgattagcaagaagacaagcattgataagatctgtctataacatcctgccaggatgaacagagagagctccggaggacagccaacaatgtacacacaggctgtgttgaggaagccctcaagtatcactataatcctgacagagcagccttggcctttaaagtggtttacagtttaaactgctctgggagcatgtggcat

SEQ ID NO: 54714 - DNA, 2136 bp, Bovine  19866880361748
gaggcccttagatagtcataaaagttgagcatctcctctgggccgggcaggaagaagactgaagacacagcaggtgtggccttcacttcatggagcttataggctagtttgggagactgataaaaaaactgccacctaggaaatcaggccaactacagttgtaaaggaagacaacaaggaatgtaatgaagagggaagactatttcatattaggtggcagagaaggtctcagggggcactcaaggagggctctggaggatacgagaaatcaccctcgagtccagggcaagtacaaataagagctaaatgaatccttgagcaaagaaaaaactgcacgtcatctggaaacagagaggacttcaaagatctgagttcaaaccatgagcctgctacctaccaactctgcctacactgctcaggcctagaattgaggttgtaagatatggtggttacacctgttgccttcatcttgatggccactaagatgaggatttaccagcctcacagttcactggccttctactgtgggtacttcaccactacactctatggctacattttccatttctaaggaatataaagttgtcttttacactcacttcttggttctaatattttaatattgtcacccctgtggtttcctttcaaaatcctgacaagtattccaatcatatagcagatctttagttcactgttccattatttggttggactgaaaaccatactgattcacctgcactcggattttaatatcactttggctctatattttcatttctgctgccactaacaaatgccagcctctgtgaatttcttaaactgccactttagattaaaaaacaaggataccatctggtgaatcctgaaaaagtttaaataaatatttcttttactgttgtatcatttctttgtgagtccaattagcatggctcctacacacccccattcagtatgggtttatttatactttgagtggatatataacacacagtcaaaaaaagtgtgatatattttctcgaattgatgctctttgtgtgctcaattctcacacaaagaacatcagattaagaaatggaagattataaactcctcaggaattcttccatgacttttttaaaaagcaagttctttttattttatttatttggctgtgccagatctttaattgcagcccacgggatctagttcctgtcctgtgcttagttgctcagtcacgtccgactctttgtaactcatggaccgtagcccgccaggcttctctgtccatggggattctccaggcaacagtgctgggagagggttgccatgcccttctccaggggatttccccccccctcccccagggcagattctttaccgactgaaccaccagggaagcccaagaatactggagtgggtagcctagcccttctccagggggatcttcccaacccaggaatcaaaccggggtctcctgcatgcattgcaggtggattctttaccagctgagctctggttcccttcccaggggtcaaacccagttcccctgcattgtgagagcggagtcttaaccactggatcaccaggaaagtcccccttccacgactcttcagtcactaactcctccagtgtggtcactaccacagcttctatgagcccagacaagctgtgtctcctttggagttttcatagatgagaacatccactgtatagtcttatgcctgcgtgcttcactccatattgtcatactgatccaggtttcatcgcctggatggctttacatcatttgttctgagtactgcataggattccatggtgggaacagactgcaatgtacttatcctttctacaattatctttgcaaatctttgagcagttaataagaatgcacatccctcaaacccctttccaccaacaactcattctccttctaggaaacacacagttactgatttttttgtgagatcacttttttttttttttggaactgccatgttgtatcagtgttacaattacagcttcataaccacattctaattgatgaactgctgtcctaacagttatatatataatcaattatatatgtccattacagtttacacaatatatttttaaaacctactgtctcacttatttaatgtctccaaagcttacaaa

SEQ ID NO: 54715 - DNA, 1991 bp, Bovine  19866880440283
accgtatgctgcaggttgtttgccgagatggaaaaaccatcagtctttgtgcagaaagcacagatgattgttcggcctggaagtttacactccaggattccaggacaaacacagcttatgttggctcagaagtcatgtatgatgagacagctgtggcttcctcccccacctcctgacacagcgtatgctgcaccgacccctgaggcatatggctatggtccatacagtggtgcatacccaccaggaactcaagttgtctatgctgcaaatggacaggcttatgctgtaccctatcagtacccgtatgcagggctttatggacagcagcctgccaaccaagtcatcattcgtgagcggcaccgagacaacgacagcgacctggcgctgggcatgctggccggagcagccacaggcatggccctggcgtctctgttctgggtcttctagagtccgtggaacctcggcgtgcatagcttctgataccccgtgtgcaataatatgatttgcagggcatttctgtttgttataaatgtttttagtaataggtttaatagttcttttgaaagtagtgacaaaatgcttataagtacatagaagtactgcagagaaagcttcggactgctgtttagctaaaatgtggactctgtggcggcactggctcattcgaggggtttccttataaaactctcgcaatactttatttaaacacacctgttttgaaaggccattttgtttttagagttaggccttacttcttaagggataattttagtgttttgctggtaacatggtgatatatgagtgagtgaatggccgtggcaagaaaaactgcagtttttttggtttaatgtcggactttgaaacctcagaccagaactggctgcatgttacttcaggagttataggctggaaccttccttaggcagcggtgtgatatcccacagcctctggggctccagcaaagctgactgctcaggacgatggatgggatgacagtttccccccttgaaaatgatgctttttcattttattcttatttgtttgtttttggtagtgatacttggaaagcagcccaaattaggagtagacttgagtgtcaacattttagggctttatcatttaaaacttgaagaaggcacaacaactacaaaaaggtgtgtggaggtagatttatctttttcagaggcatcatggttttagtgtttgctttgggcattttttattgccacttcagcctacttatagcttatttttctacttgttgagaaagtattattaagagaatggtgaggaaagtgaaatgagagccatagttgcagtgttcctgttccaggggattgggctgcacggaggatgtgtttcatgtccttctgaaggctgttgatgagcccatctcctgtcttttgtaggactgggcactgttgctgcccctgagctctgtgctgcatggtgggggaaactcaggttatagatgggaatttcggcccagagacatgaataacctgctcaagatacctttccacctgaccaggacactggccttgcttttatttctgactttagtgtcacagagaagcttgaaccatttaattttgagccccagtttatatgtgaagctctgaaaaaccaagggtcctgcatttctgtaattttcttatttctttagctgtgtaaattttaaaacttcagttgttccagttttctgtcccgcatgttttaaaaaaaatgtacatttacaaaggcacattgaaggtctctgcacctatactccatgtggccatgtttccataaaatacactcctggtagcacaaattctgtttttattttatgtggccagttacagacacagtcttttgtttcacttatcagtccactccacctccaaggcagacttaaatagatctatctccgtatgaaaaccagacgccaaatgaacgtttgtgggtgaccacaggtctgtttccctcgccaattctactgtacttggtga

SEQ ID NO: 54716 - DNA, 2087 bp, Bovine  19866880519459
tttgttgttcttagttgctcagttgtgtccgactcttttgagacaccatggactgcagcacaccaggcttccctgtccttcaccatctccaggagtttgctcaaactcatgtgcattgagtcggtgatgccatccaaccatctcatcctctgtcatccccttctcctcctgccttcaatctttcccagcatcagggtcttttccaatgagtcagttcttcctatcaggcggcccaagtattggagcttcagcttcagtccttccaaggaatattcagcgttgatttcctggtttgatctccttgctgtccaagcaactctcaagaagagtcctctccagcaccacagttcaaaagcatcaattcttcggtgttcagtcttcttcatggtccaactctcacatccgtacatgactactggaaaaaccatagctttgactatacgaacctttgttggcaaagtgatggttccgctttttaatacactgtgtagttttgtcacagcttttcttccaaggagcaagcgtctgtcttttaatttcgtggctgctgtcaccctagtaatcctaacaaaaacagcagtacgaccaccacctggcaggggggtcattgcttcgttattctttttaaggaactttcattcataccaccctgcttgtctctcccaaattcgcaagctcagtaagctctgcaaggggaggagaccacttctgaatattttacagccccatcagtcttctgtgaagtagtgcggtacacagtggcacttaataagtgctgattaccttgcctggactcttgggagctcccctgacttggctcctccggtcaacacacgggccctcccagtgagtggctgagggggccggtccctctgctttgatctggcgctttgttttcccagagctcagcccttggtgcagccaagaccacaacctctgggcttgtccgacttggaaaagcacgaacgacatttgcagctggctcagaccctgagactgaagccttgtgcgtgtaagggtagcttctggcagggtttttgtttgctatggaatacagacttccctggggaaagtcaggcatgttttcttctttttttcccccttttcttaaaaaaataaaataaaagggctgcagccttaatctaagtggcatctgctgactttaaagcacacacacacttaatccttaccccggagcactcttgaccaggacacagaaagccttttggtttcaatcatcaaaacacaaggggaaagtcatccattttagcagatacactttaagccattttggccacagttccttagatttttcagtggcccttgataaatctcattccaatttctgaccctcctgattcgaactcaactgtccttatagaggaacctgaaattataataatcagagaccaggttctcatgcatatggttttacttttacgtttgcaaagttgagaaacaggaagttctggtatctaccttttaaattcatgcacactgtagctttctccaaagatgatacaaagtaaagtgatctatgaacgagggtgaaagtgtgagagggcaagagaaaagggtgggaaggtaaagaggaactagaaccaagcccccagcagagcaccgtcagtcctcccagcccgcctgctggacaggatgagtcacgaaacaggttctgaagttttctgcactcgtgttttagttgcaaaaataacagctatgttttatttaaagaccaactgttcaagaatcactacaatagagctcagtattaaagtctgtgctcagtcatgtccagctctttgtgaccccctggactgtagctcgtcaggctcctctctccatgggattctccaggcaaggatactggagtaggttgccatttccttctccaggggaatcttcccaacccaggatcgaacccgcatctcttacatctcctgcactggcaggctggttccttttactactgtgccacctgccattcccttcttcaggggatcttcctgacccagggatcaaacccaagtctcccagatttcaggcagattcttttaccatctgagccaccagggaagcccacaattaaa

SEQ ID NO: 54717 - DNA, 1195 bp, Bovine  19866880669579
atgtgtgttaatactcaggggtacccaggggaagcctccacagactttcctgattaccagatgtcgccctttctatgtaacaaccatctaatcaccaattctcttgccaagaaatgagaaaagcatttttgcatttggaaaaccacactaggacacgtgaagcgtattaagaaggactgtttcccctgactccacatgcacttttcctgtctgggtttgtttttctaaaagataaaaaccacacagccatgtatgcagtacagttagatctgagaagtgtctgcgcttgcacaaggaggtttcagtttggccagcgtaacttcatcattacctgagttgtattgtaagtaatctctgaaatggtataacatgtgtggccagtgtttatcttgttatgctttggactctttcattgtttaagtggtgattcatgatttatggctgtttaacatgcaaaataatgctgtattcccaggagctctgggaaaacaggcgggttcagtggagtctcagagcgctttccctcgagcaggaagagggtgttagttaggcagttaagaaaaagcagccaaggggaacttagctcttcattgagcaggtatttaaatgaagtagtccatcctgaagctcagattttctgacagagctccgtagcctttggaaagcatatcaaatccgtatgttatttaatttcacaaaaaagcaaatgacaggtgaccttgggctccactgtgtggatggtcccaagcccttgaagtgctcagaaaggttagagggccccagtttaatgtcttggatgtagaagaagagattataaggatttcattcatttgtatgaagtttaaaatgctatagaacatctcagaggcaataccttagatgtgccatttaagtagaaacagacagacagaaccgtatctttaaatgtgatgttatacttgacgtatcaaaaacacatgctttgcccctgtatctgactttctcatgaatcactcaagtttcgaatcatctggtacactgctcttcctccgatggctttctttagggcagcctcaaggagtacagtcagtaataaccgtgagattttctgttaaactagtgttctttttggttgttaggatcttggactttttaaaccatggaaaactaggtagtttagttcatagattgtaaaggtaggtcttaatacctctgt

SEQ ID NO: 54718 - DNA, 1285 bp, Bovine  19866880902223
agaacgtctggagagtgcagggcaacaaatgtgacgtcaaaatgcagcctggtgacgctgagcactgtagccagaaccaagagccgacaagcccaggtggtcagggcacaggacaagagccctcccgcctgcccctcatcatttttgattggcccactaagactacctcagaccaataaagcgtctgggagccaatccaagctacttaactccgaattgctgaggtgccaacaggcactaggcttataaatcagtcttttattatctggttggcttagccaggtctccaaaaggaacagtaaagttttatgatgcacttcaacaggctgatcttcagagccaggctttgtcctggatgaaattttcccctgcagccaccgaggtcagactagatcacccagccttgcattgctgcccccagtcggcgggctgaggttagagggtcggatctgaatggagttcgcatttgatataatgaaatctcatcttaatgtacacttagcctttttgtgagaggtgtaactacaaagaatttctggttgctcagtctgttattgttgcttttttttttaactgtttaaaactccaccttagggtaggcaatttgaaaatatcgttgtctcattcctctgaaaacatttttaattttttattggagtatagttgatttacaaaattgcaaaatagtttcaggtgtacaataaagtgattcagttatacatggacatatatccagtttctcagatacttttcccttataggttattgcagaatattgagtagagctccctgtgctatccagtaggttgaaatcattgccagttatttctattcaatttatcttcactttatttgctcttccatagaaatgccatttaaatgcagccaaattgttttaaaagtaaatggaaataattttttagggtgtctactaataagccctagaaaataattaataatttggctgtaataagaactcaaaagaaatacttaatgttctttctaggagtaaataggactgtggttgaggagtatttcagtcacggtaacaatcatttctccggctaaaattttgttagtgaaagaatgatttttaacttgtgtcgtggcatttcaaccactcagaagtgtccacaggaatctagagcggatggtagaaaatgacaagaagtgatcgtaagaaaaagaaaaaaacaaattagtgatccatcccccagtgagagagcaggtccacaaaccatcacggtatgttcatcaaaagtccaagtcagaattcctttcttag

SEQ ID NO: 54719 - DNA, 1402 bp, Bovine  19866880905754
ttgggaagcccaaaatggagtataacctttaaaattatataagaataataattaaaaaatatttttaaaataaagacttttaaaattgtgttttaagtagatctcatacttgactttggagaaggcaatggcaacccactccagtactcttgcttggaaaatcccagggacaggggagcctggtgggctgccgtctgtggggttgcacagagtcagacatgactgaagtgagttagcagaagcagcagcagcatacttgacttcaaggcaggctttggaatgcgtaatactaggctgattgtagtccatctctgagagaaccctggcacaggaagtggttagacttggagtctgaaatccatgtcgattgccaagtaactgtgccaagcaccgcaccctctgtgcttcagtatttctggctataaaagaggcaggggcttccctagtggctcagtggtaaagaatcgacctgccaacaaataagacgtgggtttgatccctgggcggggaagactgcacatgctatggagcaacgaagcccatgaaccacaactattgagtcatgctctagagccgggaactgcagcttctgagactgtgagcctcagctcctgcaggcctccctagagcctgtgctcggcaacaagaggacccagcacagcgagaagcccgccgcagtgagaagctctcgcactgcaattccagagtggccccgctcgctgcaactggagaagaacctgtgcagcaacgaggacccagcacagccaaaaataaataaatacaaattattttaaaaataaagggagcaggccacctacatttcttgcctgtcatgcaagaaagtcctgtgaaaacccaagcagcatataaaggcaagctgtcacaggggtatttggggtgggaactaccatgatgttaaactcacaattcctggatttttagggcttattagcacatgtgcatggtaggcataaatgatggagaggcaggggcattgttccagctccataaactgggttagcagcctcccttgtcaccctaagccctgtgtaattattcctgtcccccatgctccatgagtccctctgcaaaacagcagcattggagccacgaagtaactctcctctctcactcttgtgtgtgtggtggggaagacagtcacatgattttctccctaagcatgagattcagaagcaaaaaagttttctttatgttgccctaaagcagttcaccttcagcattgtgtgtgtttgaatgatggctataaattcatactgattccgcttttaaatgccctgtgacttctagccagattaatgtcactttaaaacagccactttgggaagctgtacttcctgcctatgatctttacttgcttaagacacgtcaaaaactcttctgg

SEQ ID NO: 54720 - DNA, 1340 bp, Bovine  19866880970654
ccttttccaggggatcttcccaacccagggatccaatctgggtatctcgcgttacaggcagattctttactgtcttagccaccaggcaaagttcatataaaaccaaataatttgatttgttgtttaaaatgaaaggccacttcatttgggaattaagatggactgctggagaaatagacacaggtgaacaaacatgtggatgccaagggggcaaggatgggtggcgtgaactgggaggttggcactgacatatatctgctgtgtgaagtaggtgactagcggaacctcctgtgtagcatggggaactctatccagggctctgtggtgacctaactgggaaggaaaggcaaagaggaggaggtgtgttatatgtgtgtagagctgattcactttactgcacatcggaaacaagcacgacattgtaaagcagctttacgccaataaaaattaattttaaagaaagatgaactgctggagaatgtgtaatagcaacatgctgctttaagtcttttccaccactcaaagtaagcactttaaagcagtagccatttgttgtaatgtggcaaggaacacacacgtggttcttctgaaaactggcctgagttgtgaaaacaaaaatgttaaataaggagatccaagacacagccctgtctataacgcttagttctgggattttatctccagggctctgttccttgtctccctgcctgacatgggagcttcacaaaaaaagctgctctggcgcacaggcaccctggaatacaaaccagggccatcaggacgggcacacaggcctctatctaaaccatcaaattccaaggaattaaagacaaaaaattctaaatttatttcaatcagaaatgtctgagtcaacaatcaataaagtctataattaatcttaaaatggacttttctcaattaagtgaaacagaaattaaaaacagtaacagcacaatatctacccaaatcagcttggtcttcatctaggatattagattgggagtcccagagctgccgtttattgagaataaaaccagaccacagctgtgagaggacatgcagaagactgatgagtctgtgatttagaagcgagaccatcgtttattccttgaattttacctttagtatgcttctattaaagcacattagatttctatactcgaaattactgtgttccatgacaccacagaaatggataagacttctaaaataaagtttaagtggctgagaaaaaccattctggaaatcaaaaattgtcctagttgttgacaatactcaaatttggataatcaaccattcgtgaaatttctttactaaccctttatttgttaaccaacaga

SEQ ID NO: 54721 - DNA, 1514 bp, Bovine  19866880985488
catgtgtcctttcaaccaccctcagctactgctgggttttcacaaaacaaacacggctctattcctttctcacagaagaaaaaagcgtacaccagggtcccgtgcattagggaactccgggtccaggtgtgggagctccaagagtagctaagccaaggccactgtcaaggagctcagagaacagagtccccagagaaggaaggagctacgaaaggctgctctgagggctacatgggaaaggagggagggggcttggccagatttttccacttgttttggtaccagtttgggaaggggtgagagccagggttacttagttggggagccgtctcccagagcccctcttcctcctctgcctggttagcccagtttcaggggtcacagacgtgatgcgaaatatggcaggatccatggaactactcagaatggcttctgtccacagaaccaacaaacattcccatggaattgtttaagatgagtaaagaaatgcaagtgtccttgaaagagaaactgacttcttacagagagcccgggtccttacattttacacagtcttgtgtactaaggaaaatagtttaatatttcattctcagcaactgcgctgattcctaaacatcaacttcagttgctcttttcggaatattccccttgtgatattctgggtatgtttatgcagaggacacaggctttttgaggctgcaattaagcatttggtgaatataaactatttgaaccacatctatataaatactactcaagttcaactttgacatgtctgtgtgttctttaccccgtccgttgtggggagtttataaaagccatgtccacctaagtcaaagacgtggttctgtctctacaataaatgaaaacccagcccaatttgttttgcaaaggtataaagtaattcccaaattactcctgagaggctaaaaaaaattagattcacgaaagtactcagctgaaactattctctcattggaataactccgtaattccatggccaaaatggcagtcaaccacagatttacaaatgccctttttttgccttgacatcccagtacctggcagactctgggactgaagggaaacgtataaataaatacatctttgtaaacaatttcctcctatgactacttgatgatcatgtactggtaattttttttaatatgtatttccccccccgaccaaagctattttccctggagatattccaacaatatactgctaacatactcccattgtggaattcagctggaaaattttgcaacttaagaaaacatctcagccatctaaccagtgtctctacggacctacagactggagaccaaaaaaaaaaaaaaaaaacccaccaagtaaatatttttggtttagctctaaaggagtgggtgatgtgtgtgatggagcttattgctgttgttcagttgctaagtcgtgtccaactctttgcgaccccatggactgcagcacacaggcttccctgtccagcactgactcccggagtttgctcaaactca

SEQ ID NO: 54722 - DNA, 1857 bp, Bovine  19866881290699
caggggaagggctgacaccccaagaatgaggatggactcgtgggcaccatctgaaacctggagggcactagcagctttttatagttcaggaacgtgcaaccatgccgagaaaataagcatgtaacttcccgagttcacggccactgcttacaaggaacactgctcagagtgatcatccacaaacccagcttctcctgtgacactgttcgggggtaaaactgattgcttaacacacttgtctaaatctcggtaggagtaggtgccttcataatataccacatctcactaatcagagaagtatctagaggggactgttatagacaattttaatgaaaagaaaccacaatgtgggaaacctgggcttggaaaaatgtcaggtttttattcactcctgttttaaaatgaataagaattaagggcagagtttctgattagaaacagaagactaagcttaggtcaatttcaccaacctcgtaacttgctaggagtttcagaagcagactttggacttaccttacttacatgctcaaaaggcatacgctgtcttgctaccacttctgatttctgaggttccacccatgtttgtttttaatgagcataatcacacataacttttaataactaaaataattccagcatctctctcccacctttatctacagagcaaaatatactctatggattccgaagaaagaacattttgctcttcccttgaggtacccatctaatgcagacgctgcactggatcctccccttgtcttttatcatttagccatggccttggtatctggggactcttagctccagctgttttcaatggccttccagaaaacagtatgtgtgttaagacactgtgctccattaccaggctagacttcagctttaataaaggaaaagcaaactcattaagacagacctctttgtaaaaagagtacttaaaattaacatcctggggaaatgaacagaactttctgttatctgatttctttccacctatggttcaatgctctgctaatggtttccatttgaaaaagcaaattcatttagaaagaaagacgtttcatcatgtatataagatttcacggtcttcagaatacaccagttttttagaatttgagtgattcaatctaagaattgacggtcctcagttctaaacataattaaccagtacttgctcgtacttcgagttgcaattgccattggttcacagttggcacactcaacccctcagtgaactctttcacaaaagctaaagagattcgtgagcactgcagctgtgagggattaacatcctttcctcaaacgtctgcctaagaaccgccccgcctgtccccacacgtttcccgtgctcatgccctctgctgcatgccctcttcagtctgcagagcagcctagcttctactcctgtgcattgctccaagtaccaaaaatctctgtgaaaatgatgggtgctgaggaagccatttaatgagaaaccgattcgctataaatctgcctcactacatatatttccattaagacccaagtacgattttagcatcagagtattttgactgaagtcagcctcatctgaactgagatacatggggagagtaaaattgctttctcttcttcacgctctgttcttaaacaatacaggtctctttcaggacagaatcttcggagcaaaagcaaaggaaacttcaaactgaaaacagctttcccagtgtaagtaaatgcaatctaataggagatacacttaaaaatattatgaaatatgagttctgtccatggacctgatttgttaagagtcaacatataccttgatctctctgtgcttttgagccaatttctttagggggtttggcacatgaataa

SEQ ID NO: 54723 - DNA, 1409 bp, Bovine  19866881375517
atacacacacatatacatatatatcaatatgtatatatactcttctccatacgggctagtcctaggccggtgaacacagctccctgtgctgtcgagcagcgccttgttctttagccattgtgtgtgtaatagtttgcatctgctaaccccaaactccagtctgccccgccctctgtctcctcccacttgacaaccgcacatctgttctctatgtctgtgcactgttggctttctgagccagataactctttgtttcggggtgtcgtccagcgcattgtgagatgttcagcaacatccctggggtctacccactgaatggcagtagcatgcacaccgcccccccataccccccggtgggacggccagaaacatcccagagcttcctgaatgtcccgaaggggtgggaaagtcacccttaattgagaaccactgttttaaagaagggggaaggcgatggcatcccactccagtactcctgcctggaaaatcccatggatggaggagcctggtaggcttcagtcagtggggttgctaagggtcggacaccactgagtgacttcactttcacttttcattttcatgcattggagaaggaaatggcaacccactctagtgttcttgcctggagaatcccagggatgggggagcctggtgggctgccgtctatggggtcgcacagagtcggacatgactaaagcgacttagcagcagcagcagttttaaagaaaattaggattcagtttggctaagtcaaatggcagaaaccactggccatttttaactaaggtggtaataattcagacagtgataaaaataaaacaaggtcttaaaaacaatccaaagctctggaacttctgattcttatggtcatcataagtatgctgttactgatgagtgggaggaaaaccgaagacgtgttaatggcctgacaggtagattttctgaagccatctgcaccttctccaaagtcaagctaaaatttccccactgcacacactggcaggcagcttgatgggacccgcagtaccccaggcattgtactttaggctatggcactggcaccatgaccaacttaacacttcataaaaatgaacagggaagagtggaattctaactataaatgaggaatttcgaacaccaccttactcaaagattccatttctatcagacaaaagatgaagcaaaatttaatttcctggcagtttatatgcttcagcaggaatgtgggcaagagccagttaaagtgctgaacctgactctgggacatgtggttaaaattaagatcaaaacagagctcgtattcacgattatactcctttcaggggaactcagatgggattgaactctcctttaacactaggaacttttaacattgggtaccagatcttcaaactctccatgcaatttcc

SEQ ID NO: 54724 - DNA, 1249 bp, Bovine  19866881326517
atggatgagtcgagtgccccgacatggcgtgacagtgatgggtgtgctctcaccacaaacttggaaagaagggactcagcttgccctctgagaattaggctcagaaaccaacatcgaaaagtattagcattgaattacgtgaaatctctttaaagaatccaaatgactcacaggccagaattaatgctggctacaaccagagttgacattcagaaatgcaatccaggatgtatttgttgaaaaataattgataaagaatgaacgtgtctgaaagatcacagagatggctggtgcccatctcagcaggcctcagtttctctttctccgtgataagtctgcccagtggtgaattggaagcatcataatattatcctgctgataacaataagcatttgcatttagatcaggttacttctctgactcttatcagggttaggcccactgaagagcctgctggtctcttggctctccatgtagcctgtccacggctggtcaggctgacatgagcatccatccacttgatggtgagtttcctcattgcgaattagcagatttggcagcaaatttgatgaatgtctctgtgagcattgttagaatgagtcagtgttctgggtccagtcatgttcatggctttgacaggaggaatttatgaacccaggaggggagtggccagactgtggaccctgggaattgcccaagataagagtcccctttgggccttgtcaggcatcctctcaacctcatttcctcaatactatgaattgtatttctctttgcatatggcagttcatttttttttttttttgcagtaccctgccattccatctaatgttgagaaaaccaatattggacaagaaaaccaatcttgttcccctgggtagggcagcagaacccagtgaggtgaatgctacaggaaccaggccaaaggacggagagagacctgggaccctgacccgacttccgctgggggttgagtagtttcaggtatctaacgaggttggtcaggatagctcatatcgctgtcgccatagctctgctgtggtgagagaaacattaaacttggagtcagcagggcttagtgccatgattttggcctctttatctgggtgaccttgcacaaggcaactttttgggtctttggccatgaagttaagaatacatgttatgcatgataataatatgtactgcacagtattgttgtaaatttaaatgctatgattgatggaaaagtatagtataagctaaagaa

SEQ ID NO: 54725 - DNA, 791 bp, Bovine  19866880541920
gggctcaatgaatatttttaaattgctcaaactttaattttggcaacgatgacaaagcagtgataaggtctgtgtcacatccagagcaactgccagagtttctcagtcttttactgaaagggtgatgtatgtgcgttcatattctgcagatgctaattgttgacaacataattcagtggctcaacaaattggaactgacaccatcaacctgctcgattcatttacaatctttcatcatcaatgcaggggactttgtcaactgagcagggccagtttcccctgtgagtccagcatcttgtttcccattagtgacgagcattacaagtaaacagagcggcttagtagtgttcaattgcatcgaagagcccagccaaaaatcacaagcaatgcagaaaaagcaaagtaatgagaagacagactcaagtcagtgcacctttactgagcagaagtttcattaactagtttctctcccaccagcctggctgcatcccactctccatagggtacccagagtgatctttctaaaaggccagtcagttcacatcacctccctgtttaaaatggtttagtaatttctttattctctccttgtcattcatgttttcccagatgccctggaatttgagccttgcctacttctctagccccaaactgccccattctcctcattctacactgtactacacacacacacacacacacacactcactcactcactacactcgagagtacaccatgactgggagtcccttccaacaggacctttgcacatgcgacatcgccgcccccc

SEQ ID NO: 54726 - DNA, 1358 bp, Bovine  19866880688281
tattctaacatcaatgagaatctaatgaagccttttgtttcactggagtgtttttgaggttttgtcgggggtggcgggttgccatttgtttgtttaattattttggccacgatcagttttgcattctgaaaagatcattctgactttcttatagagaaggactggagggagtaggtgggactagagttgaaaggagaagggagcgcccaacagacctacaggctgagaactggaggacgtgcagagaccactgtccccagggcagcgcaagagggcagagtgaggtctgtccatgagagagacaagccttgccaagcaggcagagaaccctggcagcctcagagtgcacgaatcaacaaatttggctgaaacctctcctttcaggagcaccaggcacagcagcttcaacagctccacttggcacagggctgggcgacactggcacgatccaggcagcccgccggaagccatatgccctgcttaattcctccactaacctactgcttgcagccatgcagacatatgcagccttaatacagttaacagcgtttcaagctcccaaggaagttgggtggagggaggttcccgcccaggcacggtgatggagagaaaaattgtcagcagtgattcttggctgagattggcaacatacactgtcacttaaacctatcaatagatggagctgatgatgtttttcacttaacacctagcgacgaggctgtcagaaactggcaggagatccctgcacaccctgccaagagagaggaacatgaaaatctgtcaaaattcatgcttgctaataaatatacccctggaattcttttttaaggaacccagggtttcagatgtctaggcgacacttgccagggattcaaagagcttgatcaagctaagaggtttctcctcagcttcagttttcatgtgactttggcttgctggcaaaggaaaaggggcgaaccagaggcttagtgaaggagcggccccaaagatactaatcgttgtaaattctagcctgggagtctgtagtctacgggcaaagaaagcagacacatgacattgcccctaggctccaggcacgccctctaggccatgggaccagattcaggagagggcatggtggctcaccagagggttcaaaggaaggctaaataatcagaagttcatgctctttggcggctgtgtagtcactggtggctgttcaatgaataggcccagtaggataacactttcccattccccggaagctgggtgaggtcatgcgacttgcactggccaatggaaatgatgcacatcacactgccgggtggaagctttaagaggcaaagtgcaatgtgcgcttgtgctttcctcgccccagt

SEQ ID NO: 54727 - DNA, 1434 bp, Bovine  19866880741007
tgttcttgcctggagaatcccatggacagaggagcctggtggggggccgtctatggggttgcacggagtcggacacgactgaagcgacttagcagcagcaacagcagcccagtctctccctacagaagtacctactaaaatgtactagcaagcaggtgttctcaattaacaggctttaagcaggtatttcttaagctgtatgcaaatgtttctctttgtcttccttattctaaatatacagcagcctgtctaccagaaaaggggatggaggttttgttctttaattaagaacactgatcatcctctattagtctatttaacaccaagaaaagaagccatgccaagggtccaggccccacctgggcactttcctaccggtctttctgaacaggcccatctatgcagctcactcacagttggctttgccgagatgactgatgaaaaacctaacgggacactgtcaccctttactgagaccctctatcatctacattcatggtctggtaacataacaaatctcttgatgaagccatatgaaaagtgactccccctttactagtatagaaggggcatactactctgtcaggaactctacacagtaagagtgtgtgaagagacagtagccaaaatgcagtgtcttattcagtcgtgaaattaactgaggagaatttcttaaaggtggtaagatctccctgtagacttggtcattctccaattaaccaaatgtatttattttataagtctcctataaattgtaaccctggtaatttatatgaatcaattaatgcctatgtctagtaatcatccaaaagaaaaattaaacatattgaaacatatgtaagttaattttttgtttcacttatcacaacatgaatcttttctcacatatgttcagtcttatcaatgtacagctgctattgcatgattctgtgctcatgacttttaaaaaaggaggaaagttaattttaagacacccaaattaagcatttttggtaggaaaacactatgtcaattcaaaagagattgctatgctaatggaacaaaagatctagagcattccttacactgacaaaagtaatcccctattcaggttggcccccaaatgatgggctacccaaaaggaaatgaaattgcagcaaaatgggccctatgaggattaataattttataatttaatatttacatgatcataactaaaacattaactccaggcataaagacatgtaactggttagtacaagtttaaatacttaacagttatcaagacagaggtcattggcaagcgaaaccacaagaggagaggcccctgctatgcctgatcctgctgagcaattttcagacctcagctcattctggcagctacgagcaaagaatatacagaaaccagaattataattacatgattttacattgtatcaattagcatgcttccat

SEQ ID NO: 54728 - DNA, 1121 bp, Bovine  19866880872990
cgaagaagatgaaaatggagacataaaaccagttaaagcaaagaagatgttcttaaagccccaagattaaagtgtaggccttaacatatagctcagggatgagagcatattttggaactcaactctgtaggttcctctatagttattaatggcgtaatgtttatttgtaaagaaatgtatacttttggaaacatgctgcttttggaacaaacatgtgatggatgttatacatcctttgcttaacggtgttcatcaagagtggactttaaacccttggtcttcaaatgtacataggtatgtggtagcttcctaaagaatattttgtctcagattttttttttaatataactctccagtcactgacctgaaattgaactcgtgaaaactaataccagtgtttaaattgcctttatgtttataaacatgtcaagtcagttcatatgtatattttggaatcatgtcatgagaatttattatatgttaattcatcaagaacaaacttgcctcttcaggctaagtattttcatgctacaaagtcaatgtcaatgtgtggaattgttttttgttgttgtttaagccttaatttttagacatggttctataataaatacctgttttcatataaaaaaaaaaaggataaaaagaactaaatttaatttaaaaaacccaaatggccagtcattcaaataaagagtaatgtgttcctatgaattactacagctattttcctgttaggctccatgttatatccaaaacactaccactttacaacaaatagaggttcatgttgtaagactctcacactgtactccccaatcaattcctcatgttatatccatcttgctttatgaaaacatggatgtatcacgagtaaccccagaactccagccttctggggtcacattttctttaagatttaaagaaaggagggacttccctggccatccagtggttaagactctgcgctcccaatgcagggaacatgggtttgatccctggtttgggaaactaagatcccgcaggctggccagcatggcctaaaaaaaaaaaaaaaaaaaaactaaagaaaggaattcgagcgtcttcttctatgacaggaaattgaagtcctcctgaatgtt

SEQ ID NO: 54729 - DNA, 1199 bp, Bovine  19866881341043
ttgcttcctttgagtctgcaatgtataacccagggttaatccaatgctttaacatgatttcttcttttttgcagactaatgttggaaagttttatttgtatttcggaaggcattctcaaaatgtaaatgctttggaggctgtggaaacagacatatgtatatgaaagtaaaatcaagagtgcttagaagctggataagtaaagagaatgagaaagccagcaataagtgccaaattactttttaaatctagaaaccgatcatgtcactttctcagcttaaaatgtttctgtggttctctatcacactgagaataaattcaaaactccttaccctggccctgtgtgacttggaactgcctttgcaatctcaccttactatctaactctcttatgatgatacggtcaatcagatggccttctcgccacacttctcaccccagtagggtttgtgcacttgctttgtcctctgctgggtaatgcttttccagaatgtaaacaagtctgctcaaaatggaggacaaaacagatgcagactatgccctaagtttaaaaacacagagccaaacctaaaaacaaaagacagtgttcccatggccaccaggggaatttagcccgagtaacaaggagaagtcgaaaccgtgtggcctgggaatgcaaaatgggacaaccactttggaagacagttggcagtttcttacaaaactaaaacacgttcttactatctgatccagcaatcatcgtccttggtatttatccaagggagtcggaaatatgtacacccaaaacctgcacacggatgtttacagcagctttattcataattcacccaccaaacttggaagtaaccaacatgtccttcaagtaggtgcagggataaataaactggtacaccagacaatggaatattattcattgctaaggaaaaatgagctatccagccatgaaaagacatgaggaaactttagatgtatattactttgtgaaagaagccaatctgaaaaggctacatactgtatgattgcaactatatgactttctggaaaaggcaaaactatggagacaggaaaaagatcagtggttgtcaaaggtagggaggaagaatggatgaataggcagagtacagagggtttttagggctgagaaattatctgtatgatatgacaatggggctacatgccattatacatttatccaaaccta

SEQ ID NO: 54730 - DNA, 1025 bp, Bovine  19866881374858
agggctggcccagattggccaggctttgcagtgttactttcccccaaggactagttgggactcccttttcccccaccccaccctccatccatttctgtttttggtgtctggatgcagctctggcagtcacaaaagccctaggccatgtatctgcaccagtgcacccatccatttgccacgataagtgaaagctgatagcacagttctgtgtttatttatgactttccttccagctatgagaagttttttattcctcttccctcaatcgctgggagctgctgtgaagcaagtgtcttctcaattttatagtagagcaaatggagatgtgaagacatgtaattggctgtctgagcacctagtgagaagactgttgtgtctgtgggtgtaagatgttagctgtgtgactggcaggagcattgtgctaggaggttacagatatgtgcgttctgcttccagttctagcatggagtcgctgagagagaccgggcaggagacattgcctctctcagggtcagttttgtcatccaccggccctcagtgcacaatgaaattctgaacctgcagagggagcagggaaggaaagaggattgagtagcaagagccggtagagcaaatctgagagtttcagctgtgcggatggggagctccagagtagagacggcccgttagaggagcaccttggacagggactgttgggcggtgttgcccccgtcgcatccagcccttggctgggacccacccagcctgaaccctggggtgcgtgctgaagaaggttgtgcagctgaaggcttttggctgcctggactcctcgtgactgaccctccctagaaaggagctctggtgatacacctccatggcgacaacaactagtttgtttgggtagtttttttttttagcattcagggattattctggacccctctgaaagcgctgtaagtctggagacatagttactccaggatgaagcactgtaatactcctctgtttctactatgtcttcatttataaaattgttaaaattctat

SEQ ID NO: 54731 - DNA, 798 bp, Bovine  19866881511794
atgggtgagaatacatacaaataggtttaaaagaatctaataagaggcttctcatatggaagaattctctagaaattgctggtgatggtcaaggtaacttgaggcttatttgtaatatttattctatttttcaatgttcatgcaccacctgtgttgaaaaatattaaaacatttacatggtgctttgtagatatgttttcagcaaggacattctgtgatcttccactttgtcacaagtgtaaaactctcatagttcctccaaaccaacattatttgcccatttcattgttgttcttgattaaactacagtgactctctaacaattcactacattataatgttgaactttccccaagtttcagaattagtgtttgaaacacattttttcttccatttataaatgtacatatccctctcaaagcaaaagcctcccatcagactcacatgcccaaacttgaaaatggaagcaggtctaccaaagaagcagagcctgaggcagccattctaagaaagacggtagcatcaacttcattgtattccacaggctgcgatgatgaagtccccagtctctctctctctcagctgtctgtgagcaggaaacacctccgggtttgaacctgaggcagcaggagtacgatctttggcagttattcctgactgtggcctctagtcctgtattccagccctcccagacacaataccattttgataaatttattttctgctgaaatgaatcaagggtgggtgtctattatgtgcagctgactctgtgatcttgtgaaagctagctaatttctt

SEQ ID NO: 54732 - DNA, 1982 bp, Bovine  19866880483100
ctgcagaggattctgggaggtgaccctcacccagagccaggaggctggtggctggggctccggagggcccctcagcccaacaagcagacagcattcgcttctcgtaaggccctctcctcaaggccccagagcaaacatccctcctgggtctgaccctggccaggcagccggggctctctggggagggttttcacaaagacccgttcagcccctaggccgctgcaggaaatcctggaggccagaattacaatacattgcttccggccacccaggggtccccgtgcacaggaaagaggtgccgatggccctggtggtttccaaagggactggccaggtggccccctggtgagggatagaaaggctgtcctgggcgagggtggcacgcatttaagctggagagggacagccttcctagcacccctgtctcatattactcttctgctcccacacctgtggctcccccttacaggatcaactccagacaccgaagctctaagctcggcagtcaaggctccctcaagcctctccaccaatggcagcatccatcccagccaggctcctgtcttgactccaaacattccaggcctgactgaagtctttgtctgggcaaccatcactgcactcactgtctcagctccaatggtcagcccagtttattttagtgctaattgtgacagaatctgacagctcctccaattctaatcacttacatccagaaagcgaaaagacaactcacagaatgggagaaattatgtgcaaatcacaaatctgatatgggatctgtacccagaatgtataaagaatgcttcaagttaagttcacttcagtcgctcagtcacgtccgactcttggcgaccccatgaatcgcagcacaccaggactccctgtccatcaccaactcccggagttcactcagactcacatccatggagtcagtgatgccatccagccatctcatcctctgtcgtccccttctcctcctgcccccaaatccctcccagcatcagagtcttttctaatgagtcaactcttcgcatgacaatccaacaataaaaagacaagctagtttttaagtgggtaaagtattcgagtggacagttctccagagaagacatacaaatggccaataagcacgtgaaaagatgctcaacacctttagtcattaggggaatgtaagccaaaaccacagtgagatagcacttcacatccactaggatggctagagtcaaaaagagggtagtgagtgttggtgaggatgcagagaaactggagtgctcatacattgctgatgggaatgtaaaatgaggcagctgctttggaaaacagcctggcagcttctcaaaatgtgaaatgtagagtcaccatgacctggcaattccacccctaggtataggaaaagtgaaaacattcacccacattatatctcatccacaaatgttcagagcagcattattcataacagccccaagtgaatgcaactcaaatgtccatgcatgggtgaatggatcaatgtatatggtttatccatgcacgggaatactattcagcctcaaaaagaatgacaaacaacatgcatgaaccttagcagtatgacgtcgagtaagagaagccaatcacaaaagaccacatagtgtaagttctctctacgtggaatgtctaaagcaggcaaatggcttgagacagaaagtaaatcagcggtagcttagggctgtgagttgagcaaaatgggtagttggagggaatggagtttcttttcggggttgatgaaaatattctgggttttggaagtcttgggtggttgcagaatctctgaatatattacaaatgcatacacttttcaggggtcaactgtatggtatatggattgtacatcatggacgcagttacacgttaaaaagcagatggacctttaactgctttggttaagttctctgcagatgacatgccccactcctgccccaccgcctgcaagcccccacggc

SEQ ID NO: 54733 - DNA, 1239 bp, Bovine  19866880637980
tgaccccacagacagcagcccaccaggctcctctgtccctgggattctccaggcaaaaatactggagtgggttgccatttccctctcctaaaacagctggactaggacataattcacataccagaaaaccccacactcttaaagtctacagctcagggggctgggttgcggtctattcgtggacttgtgcaactgtgcaactattaccactatctgtttctgggacattttcatcatctcattccctgcttcccccggatcctggcaaccaccaaatccactctgtctccagggctttgcctcctggacactttatgtaaatacactgcgtggtcctttgggtctggctttggtcatttggcagaatgttttccaggtccacccacactgtggcgggtgtgggcgccccattgctttacgtagctgagtaacagcccatagtttgtgcatctgcatggacggacatcaggttgttcccacctctgggctcctatgaacagcgtgtcatgaacgtatgtgcacagattttgcctgagtacctgttttcaattcttttgctcatctacccaggagtagaattactgggtcatggggtagaactctgtttaacctctgaggaactgccaggtcgtcttccacagtggctgctgcctcggacagtcccaccagcagtgtatgaggttctaatttccccgcatccccgccaacactcgctattgttatttctaatggggacgcaggcgctggcagctgctgccctccaggtggagggtggccttaccagataggctgctgcttcaggtgtgtgtacaggtagatcttctctcctttcctctcctcctccgggctgcacacagtcactgtgggacggggagggagacttgagcagggcaaaccgccccagcagccctcccggcaggccccatgtgcccccagagtcacacaaacacgcaggggaaattccagggcccacactgaggcccacatcagtaacggcatgctcaggcctggccctgaggactcagtccaggggagggtcccaggaacggctcccccaccctggaaacggtccttgacgtccctgggatgagaagttggtccctagagaagtggtttttccgtggaaattcagtaagaaattacaggctggagcaggagcaactggagaatcacacagggacagtgtctcctgccatggggagctcgagccccagatgtgggtcacctgcccggagggtt

SEQ ID NO: 54734 - DNA, 1783 bp, Bovine  19866880709769
ttcggccttgctggcgccgtgaccttccccacctggccccgtccatctcaccggctgcccgggccaccagggagcctttcacagtgaggggaccttctccatctgcagggcctcccgggactttcctctccagctctccagttacattccattcacaaaaaacaatctagatcttagaaggaaaaaagtgaggtggaaaaatgtggtcagggagcgagtaagctgggattggggcacaggaagtggctgctccgccccctttccacccacccacacacatgccagctggggagcctttccatctgctgtgtggactgcctgcactgcggagggggcgggtgctggcccaagaggcaaagacactcagaggtggaccccctccactaaccagccctttctttcctcgctgctgggggctgttgggcaggttcactctggagaggacctggctgtgtcctgcacgccgagtgccctggcacagggctctgccactcagcgggcagcttttcctcacacacaccaaggaccacctggacccacggtcctggctcctgtatctttacttcttatatgcctaaagcagaactttgctaagtgaggaccaccccaccacaactctgagactctccatggctcccactgacctacaagatagaataataacaataatagcccttacatttcctaaccatttactgtatgcccagactgtgctaaaggagtttgtgtgcaatgcctcttccctcttcccctgtcacatgcagtcttcacattacgaagcacgatacagaaaactgcacaaacatgtatgtactaacaaactagaaacctttaaccttcacagcggccccacaagtgggcactgttactatcccattttccagatgaagaaactgagatgcagagggttagctaggaatagttgcaggcctgaggtcacacagtgaatgagagaggctggatctgaacccaagcctctgggtgcataaacccatgggatcctgtgctgcctcatctcagggagtccttcagatccccctccccgaggcttttctccttgtgcactgaggtcagagggttcaatggcttgcttgtccaggaaaggaggagaccctattatgccaccgcacgtgcccatgcacagagtaggtgctgggttgtgcctgtgcgctcctctccaggcagttttgtgagaggcggtggggagacaacattccctgggaggccaagtcagtcacaaagtctgatgggagccttcaccccttcaccctctttttccgactttgctggtacccagaagaggtttgttttgggacagagtcccaagatcgccagcctttgcctcccactggcccctctggagcaggacccacaactgcattctcccctcaccccagagcgctttgcacacagtagtaggacctaaatagactgaattccagactgcatggtcatctctgccgctgggagagccagtgttcaaaccccacccctggcgttgccaccttcagaaaacgcttggctgcttaggacctcagtttcctcacctgcgaaatggtaggaacaccttgcctgcaggtttgctgtgcagcttcaaccaccccctctgcagtgcgcctggggggtgttggcacccgtggcagtggctgtgtccccaccttcacgtcacgtggcagcacgcatagatctggtggcttaaacaaagccctgggctgctcttcaccttgaatccttatcctcgttgtcccacaaagcttattctcattcgggaattttttttttt

SEQ ID NO: 54735 - DNA, 796 bp, Bovine  19866880518478
atacttcttttgatttctacatttggaaacacagaggaagttattatttacacagaggttgacttgtctagtttttaagaatgtctattataaaagaacccagtgttgaggtaaagacccatctcagcttatgcactgtttacttgcctttgaagtatgtgttattttaagtactgagctgtaaaaataatacaaaggctgttctgttatattatgaataaacaagagcacagtatttcagtgttggcagatacttgatttcctggactcatcttacaaaacttttatgtggtgttttcctgtgtagaatctaattgtcatgcttatgtctgtttgtcagtgtggagcataaaaaggagaggtgacgggaagggaaatttattaagtttgatatttaccaaataatgtactctaggtgatttgcttacttgcattaaaatataattctatgaatattacagtatactctaatattacaaaatcttggaatcttattctattttaaaagaaagataaatttttttgaacatggtaatactcctttttgccatgtacgctgagaagtataattgtgctcttttctaaattcataacaccttactggagtaggtaagaagccaatcctttctccagggaatctttctgacccaaggattgaaactgggtctcctgtattgcaggcagattctttaccactgagccacctaggaagccccttaaggatgctgctttgctattatttctctaaatccactttaacgtatgcaggtagagttaccaccttttgtctgtcatt

SEQ ID NO: 54736 - DNA, 1670 bp, Bovine  19866880560346
ctcactgactcttgtgagggtccagtatacaatctacttatgtttagagtagatgactggagtcctcacaaaggccaggcaacatgtttttctctacaacagaagagtgacattagacaaaccctcaaacagagatagaaatcaacgatttaaactgttcatctttatgttggtttaaagatggctgaaagaaaccaaaaagtgatcaggagtgaatccagtatatttagaaaccctctacaagaagtaaggagtaaagaaaagcagattttatacaaatttgaagagaaagaggttaatataatttataatatagtaatttattcatacaataatatagaagataattatgtatttttccaccccaagacattattgttattgttttaagcttctgtctgcaagctcagcacataagaggaagtttatattcatttagattctttaccttgggaagagctttacagctggacagccaggctttctggaattaatagagtgatttcaaaatttcttttgattcaattattcttttaaaatgttttttgatttcaaaaattactcatcatgattttttttaagtgaaagtgacaaatagattcaagggattagatctgatagagtgcctgaagaaccatggatggaggttcataacattgtacaggaggcagtgatcaaaaccatccccaagaaaaagaaatgcaaaaaggcaacatgattgtctgagaaggtcttacaaatagctgagaaagaagagaagtgaaaagcaaaggagaaaggaaagatacacctatttgaaggcagagttccaaagaatggtaaggagaggtaagaaagcctccctaagtgaacaatgtaaagacacagaggataacaatagattgggaaagactagagatctcttcaagaaaaatagagataccaagggaacatttcatgcaatgatgggcacgataaaggacagaaatgaaatgggcctaacaagcagaagacattaaaaagaagtggcaagaatacacagaagaactatagagaaaagatcttaatgactcatataacaatgatggtgtgatcactcacactcacctagagccagacatcctggagtgccaagtcaagtgggtcttaggaagcatcactatgaacaaagctagtggaggcgatggaattctagatgagctatttcaaatcctgaaagatgatgctacgaaagtgctgcactcaatatgccagataatttggaaaactcagcagtggccacaggagtcaaaaaggtcagttttcattccaatcccaaagaaaggcactgtcaaagaatgctcaaagtactgcacaattgcattcatctcacatgctggcaaactaatgctcaaaattctccaagttaggcttcaatggtacgtgaactctgaacttcaagatgttcaggctgggtttagaaagggcagaggaatcagagatcaaatctccaacatgcattggatcatagaaaaagcaacagagttccagaaaaacatttacttctgtttcattgactactaaagtctttgaccgtgtgaatcacaacaaactggaaaattcttaaagagatgggaataccagacctgcctcctgagaaacctgtgtgcaggtcaagaagcaacagttagaaccagaaaggaacactgctg

SEQ ID NO: 54737 - DNA, 1846 bp, Bovine  19866880980522
agcccaccgcagcatcctctctgacatgggcgatggggaaagatgtaaaagtgggactgtggtcattcacatccagaatcactaccttcgccatcagtgatctcagtcgccggtccgtcacgttcacagcctggtccgatgcggttactgtcaggacaacagttggaactctctctctgtcaaggggagacgtggtgaccaaagtgccagatgaggggtggatgagaaatggattcattccagggtggttggcttcaatgaagtattgtattctactgttcaaaaaacttccatcaccatctttggcattgaagatgtgcaccagagtgccaacaggggtgttctctggtacacttatcacaatgaactcctcccggaaagatggggaatggtcattctgatcttccacagcaacactcaggaagaccgtgctattcacgggaggatttctgctatggtctttagttaccaccctgagaagataatgagacatcatttcataatccagttccttagagaggaacaagtctcctgttgagctgtccacttcaaagtgaccatccttgtcatctgcagcgatactatgcaactttccaccatgctgtcgttgaaggtgatcaggtgactttatcaagctcattacttttgtaggcttcaagttttctggtataactaaatgtctaatattctgagaaatgacagttctccctttggatagtggtatcacctgaaataagaataaaaaggagctgtttatttgcagtattttaataatttaatcaacacaggtgctgctattcttttggaccctaattccgtctattcatgatatgtatatatacatattacaaataaatatatatacagtaattgatgagaaaatgtcttttcttttattgcctaattccagtatgtctctgaaaattaaaaattgcatcatatctaggagataagaaagtacaggattttctacttcccccgtttgctgtaatggatgcaatgatagtttgctgaggccacagatgagaaccaaggtagttagttccacaaactactctaaatcctagaaactcttgtctccttaatgacaacatctgcatacatttaagaatcatgtgtctgtttatctgaaattagagacttgaaatattatgatagaattttctcctaaaccacacatccttagtcagttaatatactttggaaacagaatacttggggatatatattcctgattagtattcatatctatgttaatattactgattatcatgtgtttgaataaaaaatcttcctatagtcatcttgttattgatggattggtgtaattttttcctactatcaagacttccaaaaaaaaaaaaaaaagacttcccacaaatcatttgctcattatgactaaagggaagccttaaaatatggacctcaagtgactttctaatttttaaaatagttacaaaaactatgtgatttattattggccatttgtttataaatgtttcttctgcaaatttgccaggtccttgcaattaggaaaaaagaaaagatattttttgttcttcattaaaaaagtagtataaatacccacatagtgattaaagtatcttgtcagtaatttacaaagttaaaataaacgtttatttaaatatagtcatttctcaaatagtagtaaagtcacttaatataatgtacacatacatctgcaatgctctttaaagggagtattcacatttttaaagtatcttcactctatacatttgtatataaagtaaaaaaaaaaactttcagggcatttttccccatttgggtgatgggtgctattacctgaatattaataactgcctgt

SEQ ID NO: 54738 - DNA, 1684 bp, Bovine  19866881000305
acataagccacgtgttataaaaacttgcatacatatatttgttacataattccaactgtcacattttttcttttagaattggtacttgcttctctaacacatgtttatcctataagagcatttcttcaaataattaaagaggtttactgagtcatattttataaaatgacttctcaagaattgtttatcattttatacttcatagacaaagccattgaaaaccttactttgtcttgatttaaaaaaatatgaaccttgtgagagaaaaaatagcccatctcatatgagtatattcagtaattagcatttttatgatgttaaaaagatctgaaacagccactgcaattgttgaagattcatgatatctatattactgagacacaattctatttttatccaccctctttaacaacctgaaagggaccttccttagccattctggaaagcatttgaagcattgctgaaacagatccttggagacccgagctctaacagaaatcagcaactaggtctggactctctctctgtcagttgggcttttaggtagtgtgcatgcaggcctcagaatggaaccatatgtacaggatttaataaatattttgatgaaaatttccaacagtacatagccagactataatcatgacttccaaatcctacacattcaatctcacttccaaataatgttcttattaacagttggaccaaatggtatacgtctgagatttttttcctgttgttcatacagaaatgactttattttgagaatgagatggtagtccatctctttaatattttctgaaaatcagggtgaaggaatttcattcaattatgtgtgtgtgtgtgtgtgtgttaactggtgagaaaatgtcagtattacaaggttgacactttgtatatataactgtccatcaagctacatcaaaacttttagaagacattatctggcaatatggtgacagcaagataagagcagtgacagtgagtgtcactgtcttgtgacaatgtcagtgtcatttctgcagagtactgaagagtgaataaatgcttccaccaaaaataaaatggttcagttgtgaaaagtgagggtcttgatgtccaaattaatccaactatttaaaaacacatgatttccaactatttacaagggtatgtttctatgatcttagagatgttttgatactaaagtctttgattaacatggttgaccagtcatgctctaccttgatttatcttggtatacctcataccctgtgaacacatacaatgagggcaaaaaaggtggctactgtaaaatgttcaccccaggaaatgtgacctagctacaaaccagagatctatattaacaaacaggccaactactgttggtttcctgaatacaacctctatgcctaccatctgtataagtgaaatggtaaatcaagtcaaatttccttaatgcatatgcatcttgagaagatcatttgataacagaggaaaatggaaaggataaatgcaagcaagcaatcacaggttgtaatcaacagtgacttagacggtacctgatgactcatctagcataaaggccatgttttcatttcctgagaggatgctaaatgttactcttccattccttcctgcatctggatcttgagcagttatgtgatgcaccaaggagcccaccgcagcatcctctctgacatgggcg

SEQ ID NO: 54739 - DNA, 775 bp, Bovine  19866881310643
atgtgagctttatatgactagatgtagcccatgatagaagaataaaggaggccaaagtggcaataaataggaagtgatgggaaaaaattgcccaaagaattcaggtccaccagagaaacacttggattatttctctgagctcattccagccaaagaatagcctcttctttgtgtgatatctgtaatgctagatgcacttaggttcaaaagcattaataacaaagtaaatgactatcatatgtgtccagttataaaattctctttctcccatgacgaaagctcaactgctcattttcactctgaagttccaattcatcttcctctcaaactaaattctaggggaagctcactaagccatttcaatatggtatcctctgagaaaggaagagctggcagcccagactcaccccactttccaaactcggaagagagccgctgcccacagagtccataatcataacatgttccaaaatcttgctttgtggctgaatttttgaagtacctctaaaactaaacttgcacaatctgtttctattttactataattcctctttaatttgtactccactaatccagaattttacataattgaaacaccactcctatgattcctatttaatagaaaattgaaaattatttccttattgaaaatattttgggcccttaagaataaaatatttgattttcaaagcagttattatttcaaaacaagagttgaaagattaaggattctttttttttgcttgcttcctggtctagcaacccccttccttat

SEQ ID NO: 54740 - DNA, 1726 bp, Bovine  19866880186521
ttcactttccccatttcactttcatgcattgaagaaggaaatggcaacccgctccagtgttcttgcctggagaatcccagggacgggggagcctggtgggctgccgcctatggggtcgcacagagtcggacacgactgaagtgacttagcagcagcaagcatactgtgctgggcactagatagtatgagttatattagaaattaagaatgtaagaaatgaaatcgcttcttaaaggattagatcaagtaagctgtcatagttttatcaagatgactgattctcaagccaagtgtattttccaaggatttaaggttttgctgactttttctcagatcacttggttatagaattgctttcttgaaattaaagtaagattaatcctccagttaagtggctttatgtcaagtatcaacatgacagtttccttttaaaaaaaagtccttctaaataaacactcagtttcctgttttcctactcttcattcattcagtgtactcaatacatatgtattgtctgcttccacgtggcagtaacctgtactagatgtttgtgatgcaatcggaagcaagactttcagttcctatgtttttctccattgaccctctctatttaaagggatctgaaactctggtctagattttagactactctagacctcccagtctacagtcccatctgcctttaggtagggagggtcagccctttcctgtgtcaagccattcgatgggtcacttgcatccacgcattgctatcaaccacctgtggtcacgctgctccaacaccatgcagcgtccacagcctcttcctctaactgggtctcaccttccttgagtcatggaaagggcaataaggcacaaatcttgctctggctttctcaactccatcgtggggtttctgttaccccaaaagacctacactctaggggaaagagacaaaaaagtgagaaggcgtcttacttggaacttacactcctctccctcattccagccttctctgctcaggccctaaagagcttttatcttctccctgtgtgaagtgtcctgtatctttcctgctctggagcttatagtaacattcttccttagcctcccagtctttggttctaaattattaaagaatagcttttggaattgggggaacccttttctctttgggggtgactagtttcacagttgaaactctgcccttcaaaactattttctccctatggactatgaatgtcaaagctgagagtgccctcattattctagtctgtctttgtcttcttcctcaatcaacgaatgggtgaagaaccacaagcaatgagaataatttcaggaaagagggttatggaacctcaggttaaaactgcagcagcagcagtagtaggattattgttgttgcttagttgctaagttgtgcccgactctttgcgaccccatggactgtagtccaccaggctccactgtctattgggttctccaggcaagaatactggagtgggttaccatttccttctccagaggatcttaccaacccagggattaaacttgagcctcctgcttggcaggcggattctttaccactgagccacttgggaagccagaagtagctactgctacttacattccagtaattacctggtaagtatcagtttctctcactaggctgcagtgtctctacaacagagactatgtctgtttttccctcgagtgcttccccagtaataaagacagactcttgccc

SEQ ID NO: 54741 - DNA, 2432 bp, Bovine  19866880460531
tctagtcagtaatttccttggttagaatgcatccctgctgtgtcaacaacccctcattctgatatttatattctataccttgtaaaacagatttaagctctacttttctgagaggcagtttgaaagtgtgcccgcatcaaaagtcagggtgaaagcaaaacttgctttctgtgttttccttgtgtctaagattatatgcccatgcttgcttttgtttaatgtttgaaaacttttattacctatgtttgtcttgctttattgttattgactgagtgagtgagtgagtgaagtcactcagtcatgtctgattctttgctaccccatggactgtagcccaccaggctcctccatccatgggattctccaggcaagaatactgaagtggatttccatttccttctccaggggatcttcccaacctggggatcgaacccaggtctccctcattgcaggcagacgctttaacctctgaaccaccagggaagcccactacaagagtgcagatctgatacttattgcctcattatgggtgaacttccagagaacttctggaagtcaactgtcattcttccttgtgccattctcatgtgtgaatgtgatacaaggaaactctgcatcttgttgctagtatggaaacgaatctaaaacctggaagaggtcacggtccaaagaaattgagccaaatatgttgaattaagacaaccttgaagaacatgttgtctctggatttcaagttatgtgaaaatataaatgccttcattgttaaacttaattgaattacatattctgttacttgcaggtaatctattttaactgatataagcccacacatatatttttaaaattgaaagttaaatcatgttaaacatactgtgaaagaatattaaatttattttttgtagtgactttttaatatgtcaatcattacatgaaataagtgcttcattggctggggctaaatataatagagacttttcataaaatcacattttgtttttactaattaattccttaatgttttaaatattttaacactctgtgaagctctggggaacaatggtataaaaccaaaataacacataaatttgtgtctctaagcacttatgtatatgtacgcctagttgttgttctgtcactcagtcttgtcctattctttgccaccccacggactgcagcactccaggcttccctgtctttcaccatctcctggagtttgctcaaactcatgtccagtgagttggtgatgccatccaaccatttcatcctctgtcgcctcttctcctcctgcccttaatctttcccagcatcaggatcttttcctgtgagtcagctgttcacatcaggtgccgaaaatactggagcttcagcatcaatttttccagtgaatattcagggttgatttcctttaggattgattgatttcatctccctgcagtccaagggactctcaagagtcttctccagcaccatagtttgaaagcatcagttcttaggcgctcagccttcttaatggttcaactctcacatctgtacatgactagtggaaaaaccataactttgactatatggactttttggcaaagtgatgtctctgcttttcaatatgctgtctagatttgtcatagctgttcttccaaggagaaaacatcttttcatttcatggctgcagtcactgtctgcagtaattttggagcccaagaaaatgaagtctgtcactgtttccattttttctccatctgtttgccatgaaataatggaccagatgccatgatcttagttttttgaatgctgagttttaagccagtcttttcactctcctctttcagcttcactatgaagctcttaagttcctctttgctttctgccattagggtgatgtcatcttcatatctgaggttaatgatatttctcccagctatcttgattccagcttgtgattcatccagcccagcatttcacatgatgaactctgcatgtaagttaaataaccagggtgacaatatacagtcgtgccgtactcctttcccaattttgaaccagtccattgttccatgtacaattctaattgttgcttcttgacctgcatacaggtttctcaggaagcaggtaaggtggtctggattctctttcagaattttgcacgtttttttgtgatccacaaggtcaaaggctttagcatagcaatgaagcagatgtctttctggaattctcttgctttttctatgatctcatggatgttggctatttgatctcttattcctctgccttttgtaaacccagcttgtacatctggaagatatatactatcatgttactattgccataaatatgggtgtgtatatagtatatgttgctttgctgcaacactttgttgccaaacataccgtgggtgactttctatgtcatttgagagggagaaatgtgtaaatcac

SEQ ID NO: 54742 - DNA, 1884 bp, Bovine  19866880599600
ttatcatagctttccttccaagatccaagtgtcttttaatttcattgctacagtcaccatccttggtgattttggagcccaagaagagaaaatctgtcactgcttccattttttccccttctgtttgccatgaagtgatgggaccggatgccatgatcttagttttttaaatgttgagttttaaggcagcttttccactctcctccttcaccctcagcaagaggcattttagttcctcgtcactttctggcattagagtagtatcatctatgtatctgaggctgtttttaaaataccttacaaaagaaaagagactgaagatagaataccagatgggggtaggaagagaatcataaaaagagacaagaggaatttcctgaggaaaatatgtattgtaccatgtgcaataggtacaatacatcttgtacctggacatggaatgaaattgttaaatggcatcaccgacttgatggacatgagtttgagaaagctctgtgagttggtgatggacagggaggcctggcatgctgcaatccatgggactgcaagagttggacatgactaagtgactgaactgactgaccaggtccaggagccaatagagaattgaaaagtggtgattcagtttggcaatgaggaagttactgatagttattgttcttgtaggatggttgtatttatgacagtttcaaacagtgaagttgataaggagtagatggtaagaaattaaatgtggtgaatttagactattctaataattttagtagtaaaaggaaagagaaaaagatcatagtagcctgaggtccaaagcaaacttatattttctccacttgagactttttatctatgattctccatgtgaaataatttaatttgcatttcactttatcgactcacacattgactgacaaagtacactctaaagggcttgtgaaatagacagggtcattagtcttggtgctaatgagaaattacagtatttttgctataatgataagttggcatgtgaatatttaacatatgaaaaagccttcagagagtcagctgctcccactgttcattatcttatgtgtggggttattttctcggcagaaaataccatttggttgtgaatctatcatcattaggagaggaataaagatttttaacaatacacattctccttctggaaaaacgatagttgctccctcttaagtttccatgtcctggctctaagttcctcccacacccttctgtttctctacaattaaagcctttttttactggtcagtcaaatttaagctcactagcaaatttctacattatgaaaatatggagcattttgtgcgaaaagatatttcttgtcactagccaacactttataaagtctgcacttgcttagagagctctgatgaacttcatagtatgcttcgtttttcagcagcatgcatccaaatatcatttagagagtactcgtgttctcacccagaggtagacctgaacataactgtacacaagcattcagttcctagctctgaaacaacacccaattattggactgaagtaacactactaccacttctcaaagccaactggacatagtagttgtattgatcagactagaaatctttccctttggtgttgtaggattcagaaaactttttctgtagagggccagataataaatatttttggctttgcatgctatatagtctctgttgggacttctcaaccctattgttgtagtacaaaagcagccacagacaatgactaattgtgtgactttattccaataaaaccttatttacaaaataggcatcaggctagaattgtctcactggctttagttttccaatccctgctctagaaaaggaccctgagtgggatatgccatttaaccatcca

SEQ ID NO: 54743 - DNA, 1743 bp, Bovine  19866881336411
cttcgtgcagtgcatccccaaggggaagttgtccatcaccttctgccaacagctagttcgaacgataggccacttccaagtgcgtgtccacccaggagaaagagctgcgggaatatgtttcgcaggtgacaaaagtgagtaacttgctgcagaacatctggaaggccgagccctccaccctgctgccttctctgcaagaagtttttgcaagcatttcctccacaggtaagggtcgtggccttcccggacagcctctcttggaaatgtagtttgtgtctcttacatacacgctgtgttcgtttccctgctctgaaaacgtcttcgtggaaaagctgatcttaacaccctcatccagattctcttccacttgccatattcagcctgtcactttggaccttaaaaaaaaaaaagggcagtgtttctattttaaaggttgagaatgtccaggtctaagacctttggcaggaaacaagtcgcttaattactcagcctctgctcaagttatggaatgctttgaggatgacagctactatataaagcatgtaaagcttttattcatgagtgactaatggcagcataatcatgtttaccgtatcataattgtgctgtgattttgtcatcttgttgtcatgagtttttccttagcttctgaattttcccacattttaattcctggactgtgccgttcgttttattgctggattatcctagttaaccgtgtagttgctgaatattggcattttctgtttgtgagagtggatgcaggggggctgagtgatcggtgtttcccgctccaggtgtatataggcctcgaattgtgtccttagaactacaggagggggtcaggtgatacttaacaggaaaatgccttctcacccagaaattttacctgtgtgtttacattccttgtccagacatggagcttccagctctgtaagttgtgcaacacgagatccaaaactgtgtttactccctctctgcttggtaccgtcatccttccggaatttgcatcatcggagtttaggtttattttttaattgtaattgttcttatattgcctgtgttgctagaacagttagatttccccagaagtttctcactttagcagtaaaggtgctcaccttggctttgcccaatttttatgtgttttaagcaaagtccccctaaaattcatcttaatttctacttctttaagagatttaaaaaattgtccttagaacaatgtaatgactactgtaattaatagggataagctactttggaggatctaaggagttcatttaaatgatgccttgcatttcttttctgactactgcttttacaaatgactattttagcacgacaaaaacagtattaaagaatgcaagaaaataaagtaacttatggactaaatatggtgataggaatagtttttatgttgcagtagttcttcctgtagagtgaacgttcatcgctattagctcttaatctctcacttctgcagttcaacattccttgtatgttagtgtctacacaggaggtggagcataacaaccacttggtggaaggggtggtaaactcttctctctacatacttcatttaaaccgtcttgctatattcctttgtctttttcattaaaacaatatagatgcttcatttgaaccttctgtagcactggcgagcctcgtgcagcacatccctcttcagatgatcacagttctcatcaggagccttacaacggatccaaagtaaaagatgcgagt

SEQ ID NO: 54744 - DNA, 1811 bp, Bovine  19866880181786
gacgcatatatatggaatttagaaagatggtaacaataaccctgtgtacgagactgcaaaagagacactgatgtatagatcagtcttatggactctgtgggagagggagagggtggggagatttgggagaatggcattgaaacatatataatatcatgtatgaaacgagtcaccaatccaggttcgatgcacgatactggatgcttggggctggtgcactgggacgacccagagggagggaatggggagggaggagggaagagggttcaggatggggagcacgggtatacctgtggcggattcatttcgatgtttggcaaaactaatacaatattgtaaagtttaaaaataaaattaaaaaaaaataatacaaaagagtctaaaacacacacacaaaaaaagaaatcaggttaaataaaatttcaactaatactgacattctagacaggagaattcaaaattaaaacattcaaagtcaaaggagaatgctaaaacattgttttaattcctataggtcacaactgcattttaaatgtaatatagaaatgaagaaagcacgtttattttagcagaatgatttgaatactaacaaatcagtttgataatttaatcagatgtcattttactttaaatctgtaactgtctctttagattcattgcaacaaaagattaaaagaaattttatatataattaatttaaatcagtttgtctggacataaaactcttagctgcccaaccattatgtaggaggcaccttcctatgaaaaataattctattgaaaatgtatacattgaccaaagagatcaattttttaaatgaaatgcaccaacattttcaaagttattaatcattttacatcatggcattcaaatactgtatttactatagtactaaaagtctaagaaaaccatcttcagtaaatatgtaattactgaagagatacagacatttaaataagtaatcaagattccagaaccacacactctcatagcactcaaaaggaaccaaccctactgacgccttgcttccagactcctagcctatggaaacaggagataataaatgtctacaatgcaggccatccaacgtgcggtactttgttctggaaggcctaggaaacaaatacagctaacaggcagccaataaaatagtgtatccctgcattcacacaacaggcttcggcggaagagcgttcagaccaaagccagccagctttgcagccactgcagactagcacgctctccttgacacggcagccacatcgttgtccaccagaagctaccctgcccagccccaggagcacggctacgcagcgctgcaccacagcagcagcaaaggcccgccctcagccaggcggcagactcatcaggaaggaggacccccatcacctgggttcaagcgacggctgcttcaggttctcggagcctttctaactcctggaactagagacctctgaagaaaccccacctgctgccttggctcctgcagcagaaaaggtgacaatgcaagctaaaatgacgtggaaacagaaacctctgttggcagccagacagaagatgccatacagagtaaaagctagaggtttgctttgttacttcccttaaaatcaaaatcacttcctataatcttaaaagcaagccctgttcttaggtttccatgaaagccctacttcccttcctgctgtgcaaatatcttttaaacctgagctaatttcagtcaccccttgcaaatacaatccaaagaaaaacagaaataaacactcaaacccagaccccactctccgggagttcattctagtacgtgtcaaat

SEQ ID NO: 54745 - DNA, 1579 bp, Bovine  19866880459335
aagtaaatttgatggtcagggaaaatgatgtgttaatgtcttaattataagagaaagaagaagagaaatgagagagggaaaaaagatgagaaataaaacaaaggcaaaggatgaagctttgtttttgaattctgtcatctgcatgcaagagtgctcccctggactttaaatcagttaattaagtattaaaatcaatcatcggaaagtcttaatatttaatattggttagattgtatatcaaagtagttttattatttatttactccaaacctttccagaatacttcatctgacaacagggggtctgtttctcacaagataaatgcatttacaatgccaaataaattatatataaaagcatttgtcttaatacatgtcattcaatattaaaaatcacccattggtaaaatcctgaaaccctaattcacttttaccaaccacacaattgtatgatcaagtgtcgcctattaaataggtaaggactacagtaagggtctacacactgagaacaatgattgaaagaaaattaacacagatttaatgcctatatttccaaattatcagaataagaattttagggtaaatgatccactataaaaatactagattcataaatgatacacataatcagaaacatgcagaatatatgaagggatcacaggtgggtttaaatgttttatattataaaaaacgaatatgtttggctttctgatatccaaatgctatgaagtaactggaaagtggccgttgttaccatataaacacgagaaaattgagcatttatgaagagttacagtggcctgacaaaaagctctccacatgtatactcatatggtttcagagttcccttgaacatgtactcatgatgtaaagattgggaaagctcagcctagtgaccaaaattcttgtcattatagccttcaacttatttactgctctgttttataggcatagacacgacctctagccattacactatttggtcaggttcttataaaatcaagagaattataaccaacaattgggagttcaggaagaatactgaaaagaaaaaacaactggacaattacattaaactgatgatgagattaagaacaaggaaaagaaataaatggccactctgcattaagcatcaaatcaaatcaaataattcagtcaaaaacaaaaagaacccctctttggttcaagcctgggaaggcctaaggtgtttgcagaagcacaggagtaattgtgaggcggtccctctaaaagtcctggtggatctgacatttagccctgagctattagtaagtggtagggctggaaaataaatttttaaaaaaactaaaaatagcatttttaattaagtaatagtaaccggaaaaacatggggtgtccccagtggttcagcattaaaggactgcaagttcaacccccgggtcgggagatccctggaggagggcagggcaacctctagtattcttgtctgaagaacaccatggacagaggagtctggcgggctatggtccacagggttgcaaagagtcagacacgactgaagtgacttgacaggcacacaggcacgcaatggcaaaaacaca

SEQ ID NO: 54746 - DNA, 716 bp, Bovine  19866880517666
taatgaagataatggcagtttagttcagttcagttgctcagttgtgttcgactctttgtgaccccatgaattgcagcacgccaggcctccctgtccatcatcaactcccggagttcactcaaactcatgtccatcaagtaggtgatgccatccagccatctcatcctctgtcatccccttctcctgcccccagtctctctcagcatcagagtcttttccaatgagtcaactcttcgcatgaggtgcccaaagtattggagtttctgctttagcatcagtccttccaaagaacacccaggactgatctttataatggactggttggatctccttgcagtccaagggactctcaagagtcttctccaacaccacagttcaaaagcatcaattcttcattgctcagctttcttgacagtccaactccacatccgtgactaccggaaaattattagagtagcttgttctttatgccagaactttccggaaatgtgtccctgatcacctggggctttgattcctccgcttgaaatatgccacacatcctgtcaaaataacttcttatagctgcctaatgactgtgggtggcctgtgatcaccttgtcagagtgtcttttacaccctgagatggtttccagctctgacttacttcccggttccccctccccacaattatactccaagtatcatctctttccttatttattttattctttttt

SEQ ID NO: 54747 - DNA, 1310 bp, Bovine  19866880573139
ggggggagctcggctgatactgacacagcttaaaatggagacacatctaatttactacactaacaacatgtgaatctgtaactatgccatgaggtggtcagtcttatctctgttttgcagaaatcaacatctaagggggaaagacctttgctgaaattactttgtccaggactaggactagagcatacctggctagaacttaccccaggctcacccacacaagttccatgtgctcatcacatgacccccaaaaaagtaaggtccaatacataaaagttatagaaattaactatatgctagataaagagccacttcatatagtaaatattgagatttggagttgtttgcaaacttgaatggtgtcaaaaggaacagaagtaaaagggggtaaaaatatacctgtcatataaacagtaatttgattagaaagggattcaaaggtgtaaagcaaaagataatttttttctagcaaaaccagtattaagactacaaaatataaccttagttagaagcacatgacttcaagcaagtgttggaaactgaaaaactgatttaaacatttaagtatttctatattattttagtattaccaatattataaatgtgatattttgacaaagggaacacaaaagtctataatttaagaataaaaagtaactattatcatcaacatttggccacaataactattaacacaagtggaatactacattcaactaaggctcctctgcagagtgtatagtttgctaaactttcagaggtaacagcagtctgaatcactgaaggtaacttgtaaatagctctacatacgttcttttgacgtcctgttcaatcattgaccgaagttctttatcctggaagaacttgttccaaagactctgaaataaggaaagcaatttatttaaaaccatactgcacctttgcttgacttttatgatctcaatctaatgattcaaataattaaaatttatccttctctgagttatgatttcacattgcagatagaaaacctggaactggaaagtgttttattaaaatctagtctaatctcagagacacataatcattctaacattagtttttccagtgatattactgtgcatatttaaatttttctactatctacttaaagtgaatgatacttttactgctagacatctgctgctacccctaaacaacaaagaggtcacctgaactagaggaggaccacaggccagcgggtccactggaacctgacctgcactgccaacacagaaagctatgtcaggttttctacagagctttggtttcataatcgcatagatttttat

SEQ ID NO: 54748 - DNA, 2279 bp, Bovine  19866880620405
taccaattgatattatttcttgcatgtttggcagaattcaccagtaaaaccatctgggcctgtagttttctttgtaggaacattttaaattatggattcagttttgttttgttttccataaatatcacagtattcaggttatctatttcttcttgagtaaactcaggtagtttatatctttaaagggatttgctcatttaatttaaattgttgtttatggaaataaaacttctcagtatattccccattctccttttaatatccacaggatttacgacaaattctcctctttcattcctgatactataatttgtatctcctctctttttttatggtcagtttggctagaggtttatccagttttatcaatcttttcagaggatcagcttttgatttcattaatttctctactgtcttttatttctggttttagctttacattttcttcttctgtttgctttagatttaatttgcccttcattttctattttcttgagatgaacgcttgggttacggactatagggatttttctttttttcaaatgtaagcattcagtaacactaaacatttctctctaaataactactttagctgcatcccacaaatttttatatgcagtgctttcatttttattcagttcaaaatgtttaattttctattgattcttaggttatttagaagtgagttatttaatttccaaataactaaagatattacaagtatctttatgtgattggttcctaatttaattccattactgtcagagaatatattcaattcttttcaatttgtttttattggtcagaatacggccttgtttcatatacacctgaaagcaacatgtattctgctgttgtcagagtaaatgtactgtaaatgtcagttagatctagctggttgatgttgctcacgtctctacatccttaactaattattttctacttaccctatcagtaatgagaggagcgttgaagtctcaactgcaatggtagatctgtctatcactcttctctgttctatcagtttctttctgttggtggctttatatatgtttaggactgtgatggctttttattgaattgaccctttgatcattactgtaatagccttctttatccctgctaagttccttgtttctggtattaacaaaactacttcaactttcttttgattagggtttatagaacttatcttttctcatccttttacttttatcctatctgaatcttcatatttaaagtgggtttcttatagacaggatatgggtgggtcttgcttttctacccattctgactatctctataatttaattggtgtatttagaccaggtgctggcaaacattctctgttaagggccagacagtaaatatttcaggctttgcaggtcatatgttctttacagcagctactcaactctgccgttgtagtgaaaaagcaggcacagacaagatgtaaacagatgagtgtggctctgttccaataaaactatttatggacactaaaatttgattttcatataattttcaggtgtcagaaaatattatccttcttttgattttcttccaaccatttaaagatgtaaaaaccattctcaggtagttggccatacaaaaaagcggcataagctgcagtttcctgacccttgctctacaccactgctcaaatcattcttctgcttaaaatccctgaggggctttctacagctcttaggagaaaatccaaactccttaaaatatagtctccgtttctcaactcttcctgccttacaccctaagctacagctacaacaaaatgtgaaagaaaggaaagtgaagtcgctcagtcatgtctgactctttgtgaccccacggactgtagcctatcaggttcctccgtccatgggattttccaggcaagagtgctggagtgggttgccatttccttctccaggggatcttcccgacccaggaatcgaaccaggtctcccacattgcaggcagacgcttttaccgtctgagccaccagggaagctaaatttcccttaatatctcaggctatatcctagcttctgaggctttattcattcttttacttgttcctgaactgtctggtgtttcttgtccttctccgtatggcacactcctgcatatcccttaagagtctgcttctgcacctgtacatcaagtcctcctgtacaccaagtacactatgctaggacagcactatcacaccaactgcactaccactgtactttagaatgttaaaggcactcattaatgaatgaatgaccgaatgaata

SEQ ID NO: 54749 - DNA, 1713 bp, Bovine  19866880686743
ggagaagagattctcctgtggttacttgtattaagcatttaaaagaaggtgtaaagtatacaggggtttatatctaaatgagaaggggaagggattaacaatgaaacaaaggtgataaattctatcaggagcaaaggtttgtgaatgaagagactgctcaaataaatatacattgctttgggcttcagatcttctgagttatatttctaatcatgggtatcactaggagtaaaaatgcagtctgcgtgcagcatcctaatcccctttgtactagacctgtaatgtcttactaggtaaagccgtgaaaaaggatccaggtgtgtgagagagagggctgctcacttgggggtgttctgtctcagcccctgcttgctgtgtccttttttgttgttttatggagatgttttattaatgttcaattttgatacttcaaatgaaatggatcatcaccagtatgtcccgtctagcagtaaacgtgaaatgccatttcacatggtagtatgtgagtgtgggtgggggaacaggcttcagctccgtgaagtcaacagtcgcaaacccattataaataaaagtttaattacacttgtgggagcttggcttacaaagctcagaaatccataatggagcttgctggtaataaaggcctgatctgtttgttaaactccactgttccatccctttctttgccttcttttataaagtgtttggacatctccgtggagtaagagctggtaaatggagctgactctcttgagttacaaaatgtatttcctttacctctttggctgtgcatctcccttttagtttaataaccaaaagaaaagaattaggaaaataggaaaaggcaaaggtattgttagaaaaataaaagtctttcgaaatagttacttttaatccacatttataaatgagggttttgcatacagataactttgtattcagatgtgtttgtgatataaatgtctaatacttatgtgaacagaagctaagtggattccattttcacagggaatttcatgtatcattttttctaagactgatttcaaaattaaatataaaagaagtggatggagttgtggtccttgcacatttggcatagaaatagttttatcatttctgactcttatagagcagtcagaccttttttatgctaatagttcttgctgggaaaggaagcattacaaactcctaaaaaagtaaaatgtattaaatgtttaatgtacttctatactgaattatcagaggttaacaacatttgttgtaataccaagtcttttacagttaacttcatttatgtgccactaaattgtctttttccaaagccaaatagtgatgtgtctgtgttggactatgattgaatactgaaaattaaaatccagtgacagaatggattaccgagatagcaatttgaattttaaaattacttagcaagcattttttcctgttatttgtagtgaaaacagtctgtttaagtttgtttagtgtgtttgacaacagacagtttgatatattgctgggcacagcggtaggttggacttgagtggtattagctctccgtgttttgattaatggtaattgtttcgatgaaaaggcatgttttacgtacaactcatagttctggaaagcagaagtcaacttgcaagatccataattactgttctgagttagcatataaaaagggcaaggagaacctgccagagtagcacagtagga

SEQ ID NO: 54750 - DNA, 999 bp, Bovine  19866880733187
ttctaaagagaagcatagaaatgttgggtgatttcctaaatgtttatccaagaagcttagtatgatattttaaaaatattagtcctccctgatagtagcagatgtcctcctgtatatcttttgtataatccatgttctttagtatgtttgagggaaagaggggtgggaggtgaaatctgcaatgcagaaacttgcgctactatttctctctaaaacggaacgaatgatcctgctctatagtttcctgaattgaaatggattaaatgctgtttgtcaggttggatattccaagcagaattaaaattaataagtggttgtctcatgcacacctaagcctttgacataaaaaagggagtatcatttttaaaaaaaattccctcgtagtgaatagctgtgtgtcactgtggcatcttttattgaaaggaactttatttaagtagcataaacttgttggatgggcttcaattaaatgatgatttgttaatgcaaatgtgtggtgaatgactggtggtacatctgtctcttcatccacaggccattactgtgcagcgttagcacatgattgtaaaaaaggagaaatcattatatgcaggtagtacatattcaatcagttctgaccttatgtctctggtgaaataaaaaaggtatataatgtaaatgatacttaatctgaataacaacaacacagcactttgagtctctctgactcaatctgttaggtgatgtgaggtgactgatatttcggtattgatggttattggtgccccagtgggaaaaggctatcacttgaatcctttgtcattttattccccatgcactcctccaaccaaattgtatttcaagttctcttttcattgtgtttttcttcttgaaaatggtttgtggagttgcggtgatgaccaccagcatgagcatggtgagcagtgacaattaatacaacaacaaaaaattggacaattagcttcagctccatcagtgtctaatgagccatttgtcagt

SEQ ID NO: 54751 - DNA, 1391 bp, Bovine  19866880907566
accctgaagaaatggcacccaaatgtacttttaagttaatgatattaaggactaggaataaatttcaaccagcctatataagattaaaaaattaaaaatttaaccctctcttcccttccccccttgtctctctccactctgggtgttttgtctctctctatacatgttcgcatatgtgcgtttgtgtaagtaactcattttaggaagctgaatcactaacacaaaaactaataaaaccttctataagcagacttagaaggccattctatttagttgacattaactctttgagtatgaaaatctggcaaatcaacttcactaggcaccagagtctgctcttagatattttggtaaacaaaaaatcttgtcttcctgttaaaaattcaataggcagagaaggaatgtctttgaaataaacaattgaatcatcaccctattatttctcagaacttaaaccattatcatatatacaaacattccctacattgacaattttaccaataaataaaattctgattccctgatgctatcttagcaaaatgcaccaaacctcataccaattaaagaactgacaatacatactccttaaaaagaaagaatcctgaaataatccactttgtttctaaacagacatcactgtctcagacttaatcttcaacatttctacaaaagaataactatcaaaattagtgaaatgttgcacagttcttatttgggagaataccctgactaaagcagaccactcactaataaagtgcaacttaataaatcatgtggaatcttattttgttcaaacccttactaactcctagcaccatctgttaccatcaaaactatatgacaagatatgatatataattaataggtaaacaacaatctaattaaaatggacaaatactccatgttcctgccatttgggagctctaattacagactaaattttaagcttgaattaaatatttaagctggaaaattaactttccttctcgagccttgaatacattaatacagatatgtgaagcgacttcctgatgggaacttaaacatgtaatttagtttcatcaaagcagttactaattgttaagcagcagtaccttaccatatgtacacaatagctattcagagctgaaaaggtggttccaaagcacccctctgcaaccctttcctgacataaatataaaatgtatatacagcacagcagtaaatacacacactgaaaacaaattacttcgagtcttcagctttcaatgcttctcaaagacaatgagaaattggtttaaataaacaaaatatacctatatttgacaaggcaaaaaccacacaaaagtaaaaaaaggctagaaggacaaaaaggatccaggtataaaattctaggataacacaaaattaat

SEQ ID NO: 54752 - DNA, 1152 bp, Bovine  19866880914645
ccccacacaatagtaagtatgagaacattccccacggttaaagacctcctgatatttaccactcagcaatttctcaggcacctgtaaaaggctttcaggttaactattgcaaacccaaacattatggccctgtcccatccatctttagaatccaggaaacagatcaatattctaactacaggccgttgactctatatgcaacctttcaaagttgctcactacaagcaagtacaattctttaattaatcacgtaacattttagaaacctattttgttataaggactcatataaatttttttgatctctgttaatggtctatgataggtaagtgtaaagatttatgccttaccaagaaaagtccaattgagcatattttgtttaaattaataaagaaccgtggagagaattggaggttgaaggcttaggtaatgaataagagaaacagatgcggatgaaatatgacttccttcgtgtgctgtatttcagggaatctttaattcacctgaatatggccgtgagttatgcttagagtattgtattagaattcctagtagaaagggatttagatatacacgtaaagttaaatatggttagacagtaaaatattgattgcttaccacaaacaatgcagcagggtatctaacacttgttttccttgtgggacataataaggtaattaatttatctctagctgagttttatttgtggaaaaatttttttttggtggaatagatttaaatgtgctttgtgtgtgtctccggcagctctctatttgtgctgtaataaccacgtgcagcttggagcagccctttaataatcatcaccttggaaatgggtgtgcttccttcttgttttaaacagtgcagtacaaggctcagcagtagagcagcactctggatataaaagctaatgactaataggagagttctgaccctctgaattgcgtttactgttcaccaatgattatgtcattaggaatgaattagatagtcaatggggtgaatcttcaaatcaaagctgccactttgaaattttcaataatctgttcacttgtaggattagggtgggatttaacagccattgctgttctagtgctggggttatgtagctgtaaaaacagttttcttagggatggttttttttttccctct

SEQ ID NO: 54753 - DNA, 1236 bp, Bovine  19866880928907
acctccattttccgcaaatgctagaaaaaaattttaaccgtaacaatatcccataaattggaacaaatatgtagtaagaatctgcatgcttacatgcagcagaaatgagaaaaatacatgtcacaaacatgagcagtacaagatatacatacttctaaatatatagagggaaccgcgagaatccaatattttgcttttaccttaagagttgtgaaataaggaaggactacaggccatttgacggaagaattgtttcttgtgttcctgaaaatctgcttctccccctctttaatatttaagaaacacacacacaggttgccgacaacccgcggagagcggcttgtgttgtcgttttcacttccgcggctgtgaaaaagtgcatatgtgagggctggtcgtgcatgcacaagcgtggacggcgccggcatcagacggagccgcagcacagcgccgagcacagccgctcggcggggtgtgcctgcagtccacctcgggagactgaaaacataaatacaagctgctattttggtgtgatcacacgaacgtggcagcttgtgtggtttttttctctttaacattttaacactgggcagattgtctgcattaacacacaccaaaatcaattctgctctgaaattgcttgtaaaatttttctttccctgaggaatttggtttttatttaactaaaaaaaggggggcgtggaggaaactatataaaacacaccaacatttaggatatcttaactttgcactagtgtgagaatcactgttggattagagaaccagcattatttctctgaaaaatgggaaatgtgtagaagatggactttaaataaggagggaaaaaaaaaaaaactttgtaaaatcacttttgtacattattaatacagaaaacattctcaaagtagtctaattttacactatccactatataataactaaatttgatcaaaaactcatataagacttgtacactataaaaactgatggaggtttcttaagggcagagacaggaaacaaaagtaagtatgtctctaaaagttcactgtgaataaaaagtaaaatgcatatattcctatgatatatagtacaaaaatataacaacaatcaattcattttcacagtactgtgcagcagaactttctataatgatagaaatgtcctgtatcttgagagggtgatgaagacttattttatttattctaaattaatttcaatttaaatctccacatgtgc

SEQ ID NO: 54754 - DNA, 1350 bp, Bovine  19866881014123
acgaccaagggtccaaagaattgtgaagtattaatctgggggaaaggacaagtatagggatgatatatgtgacactatccttaggaaacatcactaacatttatttaataatgcagtctcctcagactttagctggtctacgtaatatttattattgttgctcaatcactaagtcatatacaactcattgcgaccccatgaactacagcacatcagcctcccagtccttcactatctcccagagtttgcccacactcatgtccactgagtcggtgatggaccaccatccgtccctctgtcggccccgtctcctcctgccctcaatccttcccagcatcagggtcttttccaatgagtcagctcttcacatcaggtggccaaagtattggagcttcagcatcagtccttccaatgaatattcaggtttgactgactggtttgatctccatgctgtcaaagggactctcaagaatcttctccagcaccacagttcaaaaaacatcaattcttcagtgggcagccttctttatggtctcacatctgtgtatgactactggaaaaaccatcgttttgactaaacagaacttcatcggcaaagcgggacctctgtcttttaacacactaagtttgtcatagctttccttccacaaataaaaagtaatttttccagtctctacttaacaagaaaagccaaagggactataaaatacctaactagtatttcttcccacaatatgattctaatttctgtttctgtaaataggagaataattaattaaaagccatgtggtctatacggggccaataaaactcaagaaaagaacttgtagtctgtgatgaggagaaagaaaagcccttgttttctctctgctggaactgaagctgtctgtttctgagtgacagccatcctgggacagtgaaagaagcctgcagacaagcagagacacaggaacccaagcgggtgccctacccacacgatgctcgcagaccaaccctggagcctcccctccctctgcaatggccactgtgggagaaaacgaacttcattctggaataaggcaaattacttggggtgtctcccattcaaaggtgaaatcaccacagttttaagtagtttttaaatagtctcaaaaataagtacctatgtgaaagctatttgaaactaggaaacacttcataatttatatacaaattacaactttagaaatataatgtaagccttcttaaatcaattaagagcttaatcacaaacatataaatgaccggctaacaggcaaataaataatgggtataggctagttttgcttgattgcataaaactgtttacaatacatttctcaataaagaaaa

SEQ ID NO: 54755 - DNA, 1630 bp, Bovine  19866881184071
gaatattggagtggggtgccatttccttttccaggggatctttccaacctagagattgaacctgtgtctcctgtactggcaggcatattctttaccattaacccaccagggaggcttccaaagaagctttgagccaccagaaaagaacaagtgtacctacagatgaaggagaaccgtagaggcatcattagctgctggaagatactggaatcatcctttaaagttatgagtagaaattattttgaaccaaagattctattttatggcaaaatcatgcgtttttagacaaaaagtttatctccactttgttgttgttcatcactcagtcatgtctgactctttgtgactccaaagactgcagcacgccaggcctccctgtccttcaccatctcctggagcttgctcaaactcatgtccattgagtcggtgatgccatccagccaactcatgctctgtcgtccccttctcctcctgccttcagtctttcccagcatcagggtcttttctaatggtctccactaatcctttgtaaaaagtaacttgaggctctaaacagaaatacaagaaagcagacatggaatgtaagaaatactctttctaaagcaggagttcagtgaaaccatatcccaggaggagagctgtgcaacggaactaggagacagtcgttcctaaatagaaccagaggtgagggaatccaagaaaaacatgtctaagaaaaacttatcccattccagtcaatgttttttaaaaaatctattggagtatagttgattgacagtgttgtgttagtgtcaggtatacagcaaaatgattcagttatatatacacagatattcattctttttcagattctttacttgtataggtgttacataatactgagcagagttccctgtgctatacactaggtcctttggttatctattttctatatgctgctgctgctgctgctaagtcactttagtcatgtccgactctgtgcaaccccatagacggcaacccaccaggctcccccggccctgggattctccaggcaaaaacactggagtgagttgccgtttccttctccaatgcagggaaggaaaagggaaagtgaagtcgctcagtggtaccaactcttggcgaccccatggactgcaacccaccaggctcctccatccatggcattttccaggcaagagtactggagtggggtgccattgccttctccgattttatatatagcatatattatttgtaaatatgttaatacatagatatttgaaattgttctcatttaaaatttctaaatggtaaatattaatgtatacaactgacacaagcaaatgactttgtggtcctcaataacatttgattaaactgattctgagatcaaaaggtttgatcattactgccatatgtattcactatagtctttaaatatggatcagagcaagtaaggtggatgagagatgatagcacattccagtgggatgacaagaagacatgaagcattgtgtggcctattcaggaccttaagaagacatgcagatggaaatggagtatgtggaacagattatggagagaaagtttgaagaaggaaaggactctgccagtcagtcagaagactttaaacttttaaagtaagaga

SEQ ID NO: 54756 - DNA, 948 bp, Bovine  19866881234166
ttggaatatgtcctatgtaggattctgcagttagatgttttaacccttagccaactaatttttttaaactgtttcatgttttgaaagatttgaaataagtataggaaaattggacaagactgtaaacgtgtcagccacatccctcacatcttgttcttcagagcagagtaaggaaataggagacttgaagtgtcgcagacgtctcattgcacatattgcaataaacagctatagaattagatcatgaaatcagctaacctcatgtgcaatgatcaggtagttactatggtaacatttccatttgtgaatttttgtagagttaaaatttgtagccatcccatcataccaccattggcttttgattgtgctccctgcatcagccgcagcactgaactaccatccctatactctaggcgagggaatcaaaaataggaaaatgaaagaaatgagagcattttgctaaattacattttaagactgtcctgatattgttggtaaaattttaagcatgtcttaggagaagtaagagcattgccagttactctctgagatgcttggatttttataagtatatgatatgaaattggttaggcgtggtaacagtaggaggtaaggagggctttaatttatcagctaagtgggtgctaagtaaccagaacagaagtaatgacccttctgaaactaagaagattccttttgagagcagtccccttttattttaaccttattaactgtttgaaatttgttctgtgtttatatactcaaaagttgccctgcttatttcacttctgattataaaatcagactctaatatcttagattaacttggattaaaatagcctgtaatgttcccttgtatcaattactgtattccagtaaagattcctactgtttctgttttgttttgcttcccaaagccccctgctgctgtgattacacctagatctg

SEQ ID NO: 54757 - DNA, 923 bp, Bovine  19866881295114
ctctccgtggtgctgcttaagtgtcctttctctaaaggagccttcccctaaagcaaacaacccaagaaggaaaggcagtgtgttaaagaattggcaagtgtatttttaaaaccagcacagtccgtatgcagcctcccaggtttcccagatgcccttttccgctctgtccagccggaagtggaaatgtgggcggcgcctgaggtgggatgcactcaggaggggcgcttctgcggtcgcctgtcatggccgctctcgtcccagcggccacggcgccctggagaggatgctggggtgttcagtccagcttcctccctggaaagaggagagggcagattcggttcaatgtggcgtggtgaagccatcatcccaagcagggaggacaggaattgaaagtgtctgctcctttcatcccggctcacctcacccctctggtttttgcttgatttttatttcagttttcctttaataaaacagtgaactagagtaagacattatagttattttggtgtttaatcgtattctagggagttttcatcagctcattttaaattttagatggatgctggtggtggaagttctgggtttgaagtgtggacacagcatcagttattgttcctgcaagccctccggtgcggctccatcctcctgcttggcgataaaccttcaccaagggctttgctttttccctcgggacatcttattgaatacttgcatcttcagtaattcatctgggcccagtgctttgtctgttttaatacttctaattacctaattaggtgccataatgcagtgacaaagccctttgtcatttcactcttgtcttaacccttttcttgcttaggaaacactctttgtgtctctttgttgtctgaggaactctccatcatggatattccttggatatttgcctcactccctttttg

SEQ ID NO: 54758 - DNA, 936 bp, Bovine  19866881299929
ataatttttttaatggattttcaaagtgccttataaggaaaaacattacttccaaatcaatagctctttcaaaaagaagggcttaataaatgtaggaatctttaatgtgtcctttagatcctttatatattacttaatataaataaaatacttgttacttaatttttctgttataaattcaagtgttttgacatagtatttcatttaatagtgttcagttattgttcagaatatggtgttaaatatattactgtttcttttttatcagaaggacaatatgttacagaaaaattgcagagaattacagaaaaattggaaaataaaaagcacacacgatcccaccccatagaaacaaccagcaaaacctttccttttttgaaggaagattacggagctaataattcttcctggatctgaagatatacctgttcccttacgtcataattaattaatgaaaatgcactatgttcagatttgtcaagtaaacctaatttgaagggtaaattttgctacattggtttctatgtacaatattaaaatattaaaaactgcaaaagaaatactaacttattggaaggtttataattcagagtggcatgggaaattgaagtagaaaaatcttagatatggtagctctggtatggtaatctttagataataggtaatttgtattgctcgaggtgattaggtctttagaagttaatgttcttgtcagtaggaaactgaaattttgaaatataaataattgaaccaaggttataagactgcaatgtatctcaagctcataactaatttgtgtgtaaatattctttgaatgaatgtcttacatgcaggaagttgaaaattttgccatgcatgttttaaggaaagttatttcagaaaaattaccataaatttatatattaaaaaacaatgtttgcatttcttcaaaatatt

SEQ ID NO: 54759 - DNA, 886 bp, Bovine  19866881439066
atcacccctatccattaaataaagaatgcaggttaatgctgattaattttaacaaatgcctgcaaagatatatgccttcaggaagcataccaactgaactgcaaatggtttctagagacaaaatcctttaaaatccttccacagcatgtagcaattttaatactatcaaaagctagtttagtatatttcactatcatcagattgggaatgaaatatttggggcgcaactaataatagaccctgctcacattgtttcatgagagtctaccttttatgaagcgagtcctatctctatgaataatttgttccataacccaactcaatctgttggttagaatttggatattattgcataatcttgttgagaaaaatagagtaacatcttgaacagtcaaggagctcttttattcattttcaataataatgtaaaaatggaaccacaaattgatttgtgcatgtggcactatttaaaataaaaaagaagaaatattctgtttcagagggttcacttcttcaaggaactgcagcaacatccttttttctgttctgctagtgttttgttgagttttaaccatttatttgctcttataaaatttccagtgggatttgtctgcttgaaaaagacgtatgctcatgttagcaggtgttttatctgaaggaatacataaaggatgaggaaaataaatgcatcaaattgaataagtggattgatcttaatgaccagaatggatcattctgtgatgtagctgaatttcactccaaagtgtccgttttaaacatttctaccccattgccagtgagctgtcttagttacagcttcctatgtctcttgcatccttaatctctatctgccttgacttctgctggaaacttgtccctttctgct

SEQ ID NO: 54760 - DNA, 866 bp, Bovine  19866881639196
agtgccgctgagggctacacggctcgtcctcaccgggacctgagggaggagggcctcatctttttcatgatcttaaaccctgttcgagggtcaccgctcagctatctccttccggagagctgtcctcgcgggtgcggccttctcactcctgagagagggaggctctgtgcacggcggcctctccggccccgccgtgccctcctctcggttctcgtctcgctgaccctgagcgctcacagccccagggcctcccctccaccgtgcccgtgtccggaagcagcccacggcatgcccccagcgctgcctgcacacagcagggagtagctcccacccggctttaggtggactgacatggggtgaaagcgtcatgctaccggtgtagagtgacactgcctccatgctgactgataatgagacacaagcagctctggtgggcaagagcggccgaggcgcgaataaacaccaactttaccccttcgtcctgggaaagggggttattgatcatcaggtcttgctggccaacagccttcctagggtttgtgatgtgctggaaagaaagaaaacacacacgcaaaggtcagaggccgctggccttcaaagcctaattaagaaaacagttacgttacttaaagcacaacttactatttctttaacgctgctataccatgctcttagttctttaattttacttatccactgacttttatcttgaggaagaacacaaagaaaaagctgtcaaaaaaaaaaaaaaacaggaaaacttttatgaaaatcctaagaaaacatgaaactacgccaaagggcatcacttgaaaactgaagacgatgcattcgtggtgctgcacactcatcacccttccagctcg

SEQ ID NO: 54761 - DNA, 1422 bp, Bovine  19866880350644
ggtgcctgaagaaggaacgttgtagtccagggccctgtgggagctggtggtggatataaaggagcctggtggcatctactgatctaacaacagagtttacctggtaaagagcaccatgtttggagtttagaccagcttcatatccactgagaaactgaatatccctgagcaagttacttaacctctccatgcctcagtttcctggtctatacaatggggctatttatagtacctaacctataaggcctgtgtaagtcttaaataccatataaatagttaacctggtctcaaatacattgcatgtgcttaaataatataaaattaagtacaaattcaaaacatcactattattttacattcaggactggccctctgggactggactctggctggcaaagaccatttctcatcttgtttggtatatgccacaacttcttaaatctactttctctaccttgtgacctgggccccagtcctctctcctgaccttcttgatgtcattccaagcaaaccaaggaaccagactcaagtggggtagggaagagctaatgcagcggcctgccaggcagacagcccccttcacttccctcccatattattccccaaaatctggctatatcttcctagcataaccctcaggctccaaattgggaatgcgggatgtgtgtgctcaccagaacaaccctttacagaatttcctcccgcacatgaaactggatgcctctaccataaaaacattaactgcaagtttccataaagctgtgtatcaccaaaatacttcctttccaggctagaaaatgttctcagaaagcatattttattttcaagaagacaatctagaaactagtggctgcttctgtggttttccagctgtttaaaccagtatttggataccaccaaagtgtctctctctcttttttttccccggagaactgaattacaaaatactggtttctattagggtgtgtctagcactttctttgcggccaagccttccatttttatagtctgcacactagattttccatgaacaagctcaattttattcctaggcaatgatgtttagaaaatccaatatgaacatgaagactgttctaaggcagtttcagaatttgtgctatgcagttgcctaaaaagaacacttctgatgtataaaaaatatgtttggggggcatgtgataatatatgttggggaaaagggttctcactactctttatgttttctgagactgggctatgtcagagaacttatctgctaaattcttcttctcaagcctttatatttatacttgtacacagtacagcccaaacacccacctacacaggcattttacagtaagagttggaagccaagtgactgaaaaacaaaacaaaattatgtatatagtgtctttacagagatctacatgtgaattcaaatgg

SEQ ID NO: 54762 - DNA, 990 bp, Bovine  19866880394873
ttagcagcagaagtggaaagagagccaaagattcctgatggtaagcctcactgtctcagttttactttagaaagctgcctaacatttttctaaacccacataaaaataaaggacagtgctattggggatttttgtattatacctggcagtcaaagaatatcctctatcctggtagcattaaatcaaagttagaataaaatttttagtataaatttttcttttgaaatacacagtgtagacacctatccaaaaaagaatttacttacttagaatgttgaagtttatcttctatcaatggaagaacagctggaatcatttctcgggggaaaatctggctgacgatagtaagtgccatacatacttctactaggttagtgctctgcaagtcctgacataattattaagcaaagaaaacattcagtgcaaattctgaaactagggacagtgagctcaacattgcaatggtcctatacacttaatatggtagttttcaactaatttgtccatttaggaataccttgtattttataggaatatcagtgtttcacttgccttaatagagtcaatagataaagacagcccaaaagtaaccgatctaaaggaaactatatttctgttctgacactgatcaaagtagtcttctttactacagcctttaaaacttttctaaaccagtaacaaaaaaaattttatgaatttttattgttaaagcaatgagtggaagtttaaaaggaagcaattttttaatacatactataaaatgtatgcatttatatatacttatataagcacaaagtttataaactattttaatagaaactgaaactacgtttttgaaagtttggaaaggtttaaagccactagtgaccttaagagaatatatgacttaaaattcagaaagtactacacacacacacactctctcacatatcagaagaaataagataaacacgaaaaagctcaacaattcaattatacttcattaccaat

SEQ ID NO: 54763 - DNA, 2819 bp, Bovine  19866880491962
cttaaaaacagttcaactgagggcttccttggtgcttagatggaaagaaatctgcctgcaatgcaggagaccccggtttgatccctgggccaggaagatcccctggagaagagaatggcaacccactctagtattcttgccctggagaatccatctcatggacagaagagcctggcaggctacagtccattgggttgcaaagagtcagacacaactaagcaactaacacacacggttgaagaatatcatatctttgaaagaatcactcctgctctttttccaaaagtttaaaacacaataatcaaacatttattcatgtacaagatataaaagagagcctgaatattcaactagctatgttttttacactgctaagttgcctatcaactgatacacataaacattttgggtaaaaagttttactaaaataaatactttctaaataaggagagaaaagaaattagaaataagtatatttaaaaaaataaacatctctttaagaagtgaatagactttaattaaaggaaaacctataaagtcaactgaacctaaaaagatctttgcagataatatgctgtaaagtctttactctgtgctatgaaaaagagttgactttggacctccccagtagctctgtggtaaagaatgtgcctaccaaacccctggcccaggaagactacatgctgcagaataactaagcccctgcgccacaactattgagcctgtgctccagagcccaggaactgcaagtcctgagcccacatgccccagctactgaagcccatgcaccccagagcctgtgctccccaagggaagccaccacgatcgtaagccctcccaccgcaaccgaagagcagccctcactcccagcaactagataaaagccctcacagcaataaagacccagcatagccaaaatagtaaataaaattcttttttttaatagatttgttttcaaagaaaaattttttcaaaaagttgactttatgacttcatgaagtaaacagagaaagccttggtcaattaactaatcaactaaggcaggactaggcaaaataccattaaacccagccttcagcctatctttgtaaactgtgaactaaggatgatttttatattttttgagatataactgatatataaaattattagttttaggtgtacaattacatttttaaaggttaaaacaaaaggagaatatatgacagaaacctatacgacctacacaaaacctaaaagaactgctagtttaggtatagaataaaattaatagttcaaaaaatacacttatttgccaacttaggcatacacacagactcagaagtcgctcagtcgtgtccgactctttgcaaccccatcgattaaaaataggtttttaaattattttaaaataatttagagattttaagactgtttatactccaactctacaaaagtctaagtccacagataaaaaagcagtcactccactgtctcctcactgcagtggttaaaacgaaagtgcctctgaggacttctaaaggaaaaaaatgcaatgtggagttttgcttactcctccaaagcaacctaggtcctaaccaaaatatcattaagtaaaaattaccaaattaataatgtcctaacattttgtgacacactgtgactttatcacagatattttgggtaggattatgtacaaaatttgaggaattctactgattactctatccttcagactagactttacttacattttaaataagttatctactgtcaccactctggcaaggaaatgggggtaccagccaatgagggtggtagtccactttctccattctgcttcctttaacacttggaatggcaggggatgctgcattcttctggatggggaatgagggtaccctgtctgggagaggaaggggcaccccagtactgctcccgatgtgacctgtactgagaacaacggagtgactctagtgtacgggaccagtagaaaaagccctgtcactctactaagtttcctctaccaccaccccaggaaagatgggaggggtacctcaattgttctctgttccttgatgatgtaaaacccaggcttcccacatcatctccactggcaatgccagggagggtccctcttgacatacggcaggatcaaactgcagctgccctcttggtcttcaccaccgagctccatgggagggttggggtacctcattatacctgatgaggatggaaatcttgattcttcattcagcctttgctgctctgggtagtccatagttttttctatgtggtgcttgactgcaatagaaaaactattgtctaaaagtcttccatcttgctagtctgccctttttgcctgagtcctctggctagagagtaggctttttttcagggcatttttatctgcacctgttggcattttcagactgctggctctccagtaaccagtttggggcatacaaggcaaaaagaaaacccagggtactaaccttggagtcattccttacatgccaatgtccctaatcagtctccttcatttatccacgtttcagaatctcatgtgtttattttacatataatgttcaaagtttttaggtgtacttagtgggtagagtacacctaaagtacttctatctactttcaatggttctatcccttgtatttcattttatattatctctcagtttacttaatagtttactaaaaatgtccttctcatcttatcagtttcctgcccaaaactatcccatatctccatatttatacaatccaaactctgtggctaccataggaggacgtccgcaatatacccttcccactgctcccactattaa

SEQ ID NO: 54764 - DNA, 1944 bp, Bovine  19866880507903
aaatgatttatttctttatatgaaaatggctttagtttgtaccttggaagttgtgtttctagtaaaagagttcttattgcattgccataaaaaacttcttaaagttttcacctaaaagttaaaaacagtatgatcattgttgctctcttcaaaatctaagactaaggaagcaaaattgcatttttatttactttttgttcagtcactcaccatcttgtcctccatcattcccttcttatcctgtcttcaatctttcccagcataagggtcttttccaatgagctggttcttcatatcaggtggccaaaatactggagcttcagcttcagaatcagtcttcccaatgaatactcaggactaatttcctttaggatggactggtttgatctctttacagtccaagggactctcaagagtcttcttcaacaccacagttcaaaagtatcaattctttggtgctcagctttctttatggtccaactctcacatccatacatgactactgaaaaaaccgtagccttgactagactagacagttggcaaagtagtgtctctgctttttaatatgctgtctaggtttgtcatagcttttcttccaaggagcaagcgtgttttaattttcatggctgcagtcaacatctgcagtgattttggagggcccccccccagaataaagtctgtcattgtttccattgtttccccatctatttgccatgaagtgatgggactgtatgtcatgagctttgttttctgaatgttgagttttaagccagctttttcatgctcctctttcactttcatcaagaggctctttagttcttctttgctttcttccataagggtggtgtcatctgcatatctgaggttattgatatttctccctgcaatcttaattccagcttatgcttcatccaacctggcattctgcatgatgtactctgcatagaagttaaataagcagggtgacaatatacagctttgacatactcctttttcccaatttgaaaccagtctgttgttccatgtccagttctaactgttgcttcttgacctgcaactgctaagttaaaaagtggcctaagcaaatcttataaacttctaatgatttttatatgtcacttactgtagagggtctgaaaatactttattttgttataaataattttatagcagatttactctagtgttaaagctgatttatagtaaagccaggtctcagttttctgcgttaatggagaggagacatggacttaataatcccaaatcaaattcatatttggctttggaatgcagtatatgctttttggtcagcaagtcattactttcaataatgtttgcttagatcagtactgagctaagttggcacagcacatactaatacttcaggagacccataagcacgttggattttggggggatccaatctatggtagatggacttccctcacagctcagtcagtaaagaatctacctgcaatgcaggagacctgggttcaattcctgggttgggaagatcccctggagaaggaaatggcaatccactccaggtattcttgcctggaaaaatcccatggacagaggagcctggtgggctacagtccatggggtcgcaaagagtcagacacgacttagcgactaaaccaccacaatctatggtagagtttttattataacttgatacacataattgcaaacaatttggctacaaaatttgttttccacttgcattaatttttaaaattcaaaatgaattactgtgttcttgttttcaaaactcagagccatttacataatactatcatttagaaacaaaacctgttaagagcacacagtactaaagtaaacaggtataaaaggacttttcagttatggcaaatatcttagttaccacttagattttttgggcacattaaaatatggaatagagtacaaaggcaaaaccat

SEQ ID NO: 54765 - DNA, 978 bp, Bovine  19866880526556
ataaatggaatcttccagattggaatgtgtatttagcttttctaagtacaaaatgctttgaagggaggaaaaaaaggttccactcaacacttggcgagcggtatttgttctgtaaaataattagcgagtattattgaactaggttgtcacataatcacaagagaatttttttaaaaaaaggatttaggagactcaattttccctcccatagatcaaaagagtgactaatagaaaccatgggtggatggttaataaaaatctgtacaggaggagagagccaacatgaaatgaaaagagtgctgatctcaggtcaggagccttgagttctaatcccaattctgaaaatatataatttttaaaagaataatgcaggggaccagttacagggggatggaagagctaagaagccagagggaagtgtttgtgccctggagtgtttgtgctcagtcatgtccgactctctgtgaccccatagactgtagcccaccaggctcctttgtctataagattgtctcaaaaagagcaggttgccatttcctattccaggggatcttcaccacccagggattaaacccgcatctcttgtgtctcctgcttggcagatggattctttaccactagcaccacctggggaaccccaaggaagcctagatattagcaacagcaggaagccactgccatcctgggctggagggaaaaaaagagaggatgtgctattactggaacccagaggccatggtcacctgatggaagctggaactacagtgggtccatcagtgggagctggagccagggaagagatacagcaacagtcacaggactgaaggatggagggctggagagaatatcccggttctttcttgccctgtcctccagtcttctgccagtgcttcacattgctagatccagctagcaactagctcatatcacaggatggcaaatgcaacctgcaacggccagcacttcctccatacagag

SEQ ID NO: 54766 - DNA, 3304 bp, Bovine  19866880639680
tctctggggcttaaaatcactgcgtggcagaggacgcagccagcaggggatctttaccgaatccttcttgccatgaaatgcaagaatgtccaggcactgcctagaagcccatggtcatgatgctggcctgatctcctagctgaacccattgaaaggaattatttcagtaccaagaacacctttttccagtttctatccatgaaattgaaagtgttagtcgctcaatcacgtccaactctgtgtccccatggactgtagcccaccaggctcttctgtccatggaattcttcaggcaagaacactggtgtgtgttagttgctcagtcatgtctgactctttgtgatcccatgaactatagcctgcaagccttctctgtccatggaattctccaggtaagaatactggaatggattgccattcccttctccaaagaatagtgaagtaggttgctatttccttctccagaggatcttcctgacccagggatcaaactcgactctcctgcattgcaggcagattcattatcttctgaaccaccagggaagccccttccatctggatgtgaagagaaaaggcaaatgcctctctatgtgccagggcccagaaacaagcagaaacctcacccacagtggtggccaacatctgagtttttcaggagtctctctgaagaagcaatgatattcttctgaggagggtggggtgtggtggtgataatatggaagggggaaaagaaaacagctcagaaagtgaggattgtgtaggaggctgtcccctgggggcatgtctctgcttcctatgcatccccgcctgctgcactccaggcctctgtttccttcctccagcaggactagttgcagcaaaaccccattcccatgaaagagatgcatctgcacttgaagaggatttgacctatgcctggagaagcactctaacccatgtgtacctcagggtggttatcaattcccaccataactggaaagggcatggagtccgaagcttaattctcccacttagctgtgtgaccaggacaagcttttcaaactctctaatcagttttttcatttgaacttaagatatgtccatagggccatctggatgaagcatgattaaatgcaatctaatccattactttggcccaatactttggccacctgatgcaaagaactgactcactgaaaaagactgtgatgctgagaaagattgaaggcagggggagaaggggatgagagaggatgagacggttagatggcatcaccgactcaatggacatgagtttgagcaagctccggaagttggtgatagacagggaatcctggcgtgctgcagtccatggggtcgcaaagagtcagacacaactgagtgactgaactgaactgaactgaaatacaaattaatacataaaggatctacaaaatgcccacaagccaatgggtgctcaataaatacacttttcctgttgaaatgcctcattgttaacttactaaatgatgttatattactttgcagtggattattatttcttttaacttccagtctagatggtcccttttagcttcttgtagttttgttttggataatgtaagatatgttttatcttaccattttattttgcttacaattttgtgggcttcccaggtggtgctagtggtaaagaatctgccagccaatgcaaaagatgtaagagatacaggttcagtccctgggccaggaagctcccctggaagagggcatgggaacccatgccagtattcttgcctggagaatcccatggtcagaggagcctattcataggatcacaaagagtcagacacaactgaagtaacttagcatgcatgcacacaagatatgtttggtttttaataaagttataataaagctttatgttggaactagctcaatctaataacattcttaaattttaaggtgatttgagggacattcattcctgcattaattcatttatagcccaattgcatcaaaacacttgttccaaaagtatttttaaggggcttataaaaatagatacagaaggatataaagaaataagattaattgttatatgttggtcacagaattagtcctgagcttcctagaagccaaagcaaggaggaaaagctgaacaaaaaataatattcacagtgtttgtaagataccaactgctcccaagaaacacaacttttcctgcactgagctctaagtgaccttgatcccctctcaacagtatctctacagaacagctgcctctgatcctgtctgttggtacaaaccagggcaccacacctgagggctactcaaaaacaatccaaccgaggtaggctttctgttggttgggcttgattcgggggtgggattttactgacaggaatcaatgaaatgtatatctcttacagttactagagatgcataacaaattacccccaaatttagtgacttacaactaccattttattttccttacaattttgtgggccagaaatttggccagactgtaacatctttggacaatacaataccttttatgcaatcacccataaatactgtatctgcaactaagccttgatgagaattaagtagatctaaagggcttacagggtgtccttctggtgccaaacatcaaggaagaatgtcttggcttatatacagcaggttcgagagtcacagtgaacagacactgaatgaagcagcagattctcggtccccatgtatatcattctgctcagtctccacaacaagataccatagactgggtgcttaaacaaaagaaatgttatttactcacagtctggaggctagacgtctgagatcaaagtcccagcatagtcaggttctgacgagaggttttctcttgaattgcacctggccaccttctcatttccctggtagctcagctggtaaagaatcctcctgcaaggcagaggaccccaattcaattcctaggtcaggaagatcccctaagaagggataggctacccagtccagtattcttgggcttccctggtggctcagacagtaaagaatccacctgcaatgtgggagacctgggtttgatccctgggttgggaagatcccctggaggaaggcatggcaacccactccagtattcttgcctggagaatccccatggacagaggagcctggcaggtgacagtccatgggatcgcaaagagtcagacaagactgagcgactaagcacagcacagcacagtaccttctcactggtgtgttcacatgaccctttctttgtgtgagctcatgcacttctatctcttcctataaagacactaatcccattataaggacccta

SEQ ID NO: 54767 - DNA, 3544 bp, Bovine  19866880651940
cgtctgggagttggactagatgattctgctcatttgttttatagtctcaatttaataataacctcatcagaatcagaaactgagtttttaagtccattaaaaaaccccactgggcatgcttgagatagagcccctgccagtgggagagaccctcagctttccttctttcacactggtttccctccagcctccaagctcgctctcagctctgcactgccagtggtttccgcagtggaatgcctcctgcttttccgtccttctgaaaacctggggcatggaccttggaggctccagctttcctttcctgtggctttcctccaaaattacaccttccctcttcccccctccccgctccagccccagggcccttgacttctctgtcagacgtcagcctgtgcttgccacagagcggcggtcagcaagctttcccccaggcttctcccggcgctgacctcagcacccgcagaccaagctgcagacagccaagtgccggcgggctgccctgtgctgacgcagctgcacacgggagctgtgtcccacacgccaggccccgttcctatcaccaggcccacagccctgtcatcccacctctctgcccccaagagagattggctcatcctttccgcggtttcacccatggctcagtgcatcttctccccagatccaagcatcccttgctgtcctccttccccctctcctctgagccctccttctctccagaacaaactcggttcttggggcctgttcagggaccttccatttggcgtcacatgttcgttcactgcaagttccaggagagggggactgggaatgctgtgtccaccatggtgtccccggcacatagaaagagctcaatgatagatttaagcctcaaaccccaacactgactgggcagcacaggaagtgatgtcatggggaagagggtgagcccggagccccaggaagaggcctgaggagggtcagccacaagaggacagaggcgctgcggtcctgtcctgtcctgtctttcaccccagactcaatggcattggctctcacgaggtcaccttctagttgttcctggggagtgactggatatgggaggacattttgttgtcatagcatgggagtgggggggttctatggggcatcagtgggtgcggccaaatatgttacctctgctgtaatttctgggacagggaatgcctgtggcaccctgcgacacacactcgggccttggctcatctgaccttcaacagcctgtgatgctcctttggtctctgctttctggattcccctgtcttggtccttcacagcatcttccaaggcctcctcttccttctgcccaggcctgaggcctaggtgttctccgtttgctcaggacccttttctctcttgccacacactctcccagaatgtgagatgtcaccccttgctcttgctgatatgcctcccagcccaggtgtctctgctgaggcccagccccacatgttactgcttgccagccctctccacctagattcccaggcctcatgctcagagcttctctcagcccctttctcccacccctctgcagcctcctccttgtattatatgtggctttgctgcctgcccagtgtctggacaaaaatgtgggcgtcatccttgccttcacctcgcacatctaaggggacattagactgtcgattcggtctccttcacatcttcaaatgtatctatatgcctttctctgtctcactgacaccaccttagtaccaaccctgatcatttctcacccgaatgattgtccgtctcctcactcatctctctgccccagcttcctttctgttttccacactgggcttaagagttggctttcatgatactcctccatcagggagaacatcaattgactggctggcttcccatggccttgaagacagaggccagactcttgagcatgggatgctggttgctgagctcacctctccagcttcatcctccacagactctgagctcctgattccaggcaacgctcaggtttcacctgtcctgctccatcatgtctgggtcccctctgcacctttgtatattctgttcccctgtgcctgaactttggctctgccctcaccaccaattcctattcaataacctccagggctccccgaaggacttctaacatctcagcaacttttctctgcaactacttttccctttgttatattcttatcaccatggagagcaatcatccattggttgaatgagtgactttatatctcaccagtctgtgaacaacttgagggcaggaatcatagttaatttaacactgcaactttagccagggattgaaacatagagactgttgcatgcatgaatggctgacagtcttgacattttattgaaatccactcacactcacgtcaggaacaataatgataactggagcaggtggggtctcaggacgctgatgcctgcttcctccacacaggggcctgaggttgccacactgccccttccccacctgggcatggtcactctgagcttaccagttactattatttttaattttatttctaaaaatcgtttttcaatgtaatataggtacattatttaaaaagttaaatccttctataaggctcataatgctgtagactctggcccacttctgatcctggctttttggaggcaaaacactttataaccattgcaactaataattactagttattagtaattactaataattatgtttaacttcctttcacagaaggtgagaatttagctgtcttttccattcatttctccttccaccttcccaatttggttctatttcaatatttgtttaaatcaaacttaagtgattacattgctgtgatagagatgccattcatagctgagtcatatatgttctgtcacttccaatgacagcatttcctttcttattcatcttgttttcccaggagttaaacactgccttgtatttcttttggttagttttctatctaccgggcagtaattcactctgaaagtgaagtcgctcagttgtgtccaagtctttgagaccccatggattgtagcctatcaggctcctccatccatgggattttccaggcaagagtgctggagtggattgccatttccttctccaggggatcttcccgacccaggaatcaaacccaggtctcctgcattgggggcagacgctttatcatatgagccaccagggccttcaattcactctcagatcagatcagatcagatcagtcactcagttgtgtccgactctttgagaccccatgaatcacagcacgccaggcctccctgtccatcaccaactcctggagttcactgagactcacgtccatcgagtcagtgatgccatccagccatctcatcctctatcatccccttctcctcctgcccccaagccctcccagcatcagagtcttttccaatgagtcaactcttcgcatgaggtggccaaagtactggagtttcagctttaacatcatttcttccaaagaaatcccagagctgatctccttcagaatggacggtggatcttcttgcagtccaagggactctc

SEQ ID NO: 54768 - DNA, 1939 bp, Bovine  19866880651942
aaaaccctggaaaattaaggaagggtaataaagaatgcttactggaagtaataacccaatggttccaacagaccctctgtgcttatggaaatgttctcttatcagagctgcccaccaaccacaagagcccagtgggtccttcacatgaggctagtacaatgaagtcactgagttttttttttaacttgacgaagttttaattccttcagcgtgactagtggccaccacactgcgcagggcaaggttagacttctgaggtaaccacataggcagaggcgtctctccgtctcttgctgcactttccccaaacttccaccagtctttcaaacttgccatctgtctctcatcccagatatggtgagctgctggcagaaaagtgagttattttccttagcttttggaactgggataaagtttttcaaaaaactcacagtccttcaatatttaccaagtgctcgtgaatgaagatgaaggaaggagaaaatgaaaaatctagattttccccttgaggaagtaaaatatttagtaagatacataaatcagttaacaccaatagaaaattttggtttaaaatttataagcattcttctaatagaaaaataacgaagaaaaaggtttaggggtatcttttacataagatgatttcaagttatttcttaaaggtaaagtaagagctggaatgacaagaaaaggaaaaagccaaagaagtaagattctacaataaggccaaccaaaagaggcatgggcaagatcactgaattgagaaccaaaactttatagatttgagtcaatgctctgtattaaagttaaaattactattgtaatcatcactacaacactccaggcagaagaaaccagcatgtccaaaatgcttggggatgttgaagaaggtaagtgaagtgaagtcgctcagtcgtgtccaactctttgcaaccccatggactgtagcctaccgagctcctctctccatgggattttccaggcaatagtactagagtgcattgccatttccgtctccaggggatcttcccaacccagggattgaacccgggtctcccacattgtagacagacgctttactgtctgagccaccagggaagtcaataagagctcataagatcatgtaaatcatctgcaaatgttttcttattaaacaacttactgtttctgaagccatacataagtcatttctacttctttcttcactcacagtgtgatgtcagcagaaaatggtatttcccccttttctaatttccttttcctgtgaaacaccctttctcatctgtctttctcacctctccctcacctctccctcaggtagaagaatttaaacactgaattggtagaacaaaaagtcactgtaaaattttaggcagagtttgactttgtatcatgtagtctacaaaatatactaaaagtgttattctttatgtagcagtcaaaatggtttgtaaaacagcaagtgttatggtttatattagcattttaagaaaactaaattgagatgccatatcaaaaagcaagtttaatactaaatttacttttaaagataaccatattgcacttaaaaatactttatgcttaggcaaatccaaaagcctttacaataacattaaccaattaagtcttctgactaaaatcaatatttatctttcagtataatactggcatgtgataaaaacatttgccttaatatactttacttacttggtccatctgaagtcttatctttttttcttcttttacatatgcagcaaaaaagagaaactatatggctgagaatgataagtggtggaggcagaactggtttctcatgataagccataatgaaatgataacgttggtacttccatacaatattggaaattgccttcacttgcaaatacacattgcttaaataacaaagaataaacaaacttagataagcacattttaaagt

SEQ ID NO: 54769 - DNA, 3050 bp, Bovine  19866880715093
gacctttttaaggagttttgtcagaggaaaacatcttagggagaacttgaaaatatacggcttagataaaggttaagaaatgcaatcttgtacaattcacagcccctttttcccccctcctcttttccttgattggataagtaggcagaaaactagaaagaacagagtagacttaaacactatcagtcagttttacctgatggaactcatagaatactccattcacaacagtggggtttccaaggggcacactagcggtaaaaaacctccctgccaatgcagtagaagtaagagatgctggttcaggaagatcccctggaggaggacacagccacccaccccagtattcaggcatagggtcgcaaagagtcggacacgactgagcgacttgcacttagagaagtacggctatactctatatgggcaatcaacaaattttttctattaagagccaaatggtaaatattttaggctttttggaccacttactgcctctatcacctactgttttgtttttcaaccactaaaaaatataggaaccattctgagctcaggccctggccagaacaggccttggccagagttggtatacatggcatagtttgccaacccatgctctaaatctcacaaaagcgtcccacaaaaaaatctcacaattccactgagccaattccatctaacaagtctatgctatgtccttcagagtcttcccctgcactgtttcttggatataattagcgtcccttctaccaggcctacaatcccagtagacccttgtattaagagttgctttctaaagacaggaaaaacaagaaggggccaaagagtctcagatgtacatgaacaaagttatttttttctgcaggaatttcaatagaaaaggcattaaataaatagatgtaaacacgaaatgtaaacattactgaggaaaaaaatatccagcgttcgagtacatatacctagcttctttccccagaaatggtcactttcaatcaccaacaacttaaaacacttgagtcccttctagtactcatttagggcttccctggtgcctcagacggtaaaggatctggctgcaatgcagagacatgggttcaatgcctgtgttaggaagatcccctggagaagagaatggctaactactccagtattcttgtctggagaattccatggacagaggagcctggcgggctacagtccatgaggtggcaaagagtgggacacaactgagcagctaacactttcactttctttcggtactcatttgtctattatgataaaatataaaactacccaaacaggtacattgttaaattgcaggactggtacaaatgtactcatagttagtttcattttatcactcttattaaaaataataaacaaacagccagtactatctcttcacaacttcaaatctttcatagtagtctctgacaaatccatccaaaactttagtaaacccttgccaacaaaggtccgtctagtcaaggctatggtttttcctgtggtcatgtatggatgtgagagttgaactgtgaagaaagctgagcactgaagaattgatgcttttgaactgtggtgttggagaagactcttgagagtcccttggactgcaaggagatccaaccagtccattctgaaggagatcagccctgggatttctttggaaggactgatgctaaagctgaaactccaagtactttggccacttcatgcaaagagttgactcattggaaaagactctgatgctgggagggatgggggcaggaggagaaggggacgatagaggatgagatggctggatggtatcactgactcgatggacgtgagtttgagtgaactccgggagatggtgatggacagggaggcctggcgtgctgcgattcatggggtcacatgcagagtcggacacgactgagcgactgaactgaactgaactggttaagtcacttaaatagtgtcactctgatgttcacaaatttttatcaaattttgtgcctacagagacatacaaaaacattaccacgcttcaagactatcacagtttcccctaccttcattattcaccaagtttatttcaagagtttaccatctctcctgtttgtgtaaacaccaaatataaatatattctccccatacacagcagttttgtcatttatggcattcattgattacattagggattggcttcctatgcctgacagtgacatatcccagctgataatggcaaatcattcccaataataggtttctacaatttttgaaattctgagcttctgctctacaatcaagaatccaataaaatgtgccctggattataaatacatataaaaattcctaattttatccttattttgctagactgcattactgtattttaccaaaagatggcacactacaaacacaaatctgaaaattcctaaacttaaatgttctagataaagtaaaaactataaccacagaatgttagcaaaagaaggaaacgtgatcttcagtggtaaaagagatcagattctggagttcagaataacctgttcattgttggttattctattaatgcaaccttaagtgtctgaacttctgtttcctcacccataaaatagaataatatacctatctcacaaagttgctctgaagattatgatccatgtttttagcaaaatgcgccccacacagtcatatctcaacaatgcttcaaaattcaattttagattcctcctgtctcctagtaataaggggcatatatgctacaaagaagtctactaaccacattctactcttcaaacaaatcagtaccagcacatccttcttgactagatactgatagtgaaaattgagggggaaaaaaaaggactgctttaaaagttctacttcaaggtaacactgaaaatcaatctatttttacaactaaatacacccaacaattctatatattaatattagaaaggagcctccagctatggagcttctattggactaaagctccaaagataataaccataaactcaggataaaataaaaattaaaaaaaagaaaactacttagcagca

SEQ ID NO: 54770 - DNA, 1423 bp, Bovine  19866880716128
cagcttgtgcttcttccaggcccaacgttttttcatgatgtactctgcgtataaattaaataagcagggtgacaatatacagccttgacatactcccttttcctatttggaaccagttctgttgttccatggttgctgctgctgcttgctgctaagtcacttcagtcgtgtccgactctgtgcgaccccatagacgccaggcccaccaggctcccccatccctgggattctccaggcaagaacactggagtgggttgccatttccttctccaatgcatgaaagtgaaaagtgaaagtgaagtcgctcagtcgtgtccgactcctagcgaccccatggactgcaggcccaccaggcccctccatccatgggattttccaggcaagagtactggagtggggtgccatcgccatggttaggaggccccaaatattctgaaatatgctatcactgacattagacttagaatgccgcccattctgctcctggataagttgaaatacaacaacaatattttatcctccatcttgtgacttctctcctctcttccttctccctcatccagtttatgagggaggcatgaagccaaattttgatggacccatgactgaaacacactgacttaaaatgtctcaagggacagtttacaggcagatcagtagctctccagctggaatttttaaaggagactgagcttactatcttttgaaggagaacactcttcacacatattttgagaacatgtggaaacttctgtgtgagatcggatcaagatccatacaaatattctcttcttgacacttgctgctaataaagaggtgtatatgcctccagatgctttttccaaagtacatataagcatatttcttctttgtaaaaagaaaatctagcactttcaaatgatctttaaaactttattataaagaggactgttgattaaatcatgacatctgttaacctcactccctattctcttctcttactttgaatattcatggattttggtaaagctgtgttcaattatttcttatttaatttttaaaaaagttatattttgggctccttctgaattcttaagtgctattggcatttctgatacaaaagtatttttgccagttcctaccaactttatcttatcctttcaacttacaaatttaatgactgaacctaggttatattttttttagattaattcataacttttgaaacgtttgttgctctattttgttattgttacttccttagtttcaagcactgccaacttaaggtgggcttacggaacactcctgttcttcattctattatcttcaaaaaagctgtgaccctcatgctctattcattctttaacacttgcagtgttatggtgggttaaaaacagacagaaaatccaagactaaataaatagctgttttgggagaccacaga

SEQ ID NO: 54771 - DNA, 1753 bp, Bovine  19866880765089
atggaaaatctcaccctgctttttttcccccagtcccttggcaattaaagcaatttcagattggcttgcaacatagcctacttagtaaaagacactgttgaagtagaatgggagttctgtcattgttttccctagtattcctgctgtagagaaccgcttgttcaaccacctcagatttgatatcacaatactctatgactggctcttcaaaaaaagctgttcaatctggatagatgttgattttcacaactttcccaattcagacattttaaaagccaggagtaaaagaataaagcttctagaagaaaacataaaagaatagcttcatgaccttagaataggcaatgacttcttaaacaggacaaaaacacactaatcataaagaaagggaagataaactggatactgttaaacaatcgttgagttttgtttatcaaaagacatcaataagacaagaaaaagaccaaaacacagagtgaaagacgtcctcaatatgtaaatagacacatactcagaatacataaggagaaggcaatggcaccccactccagtactcttgcctagaaaatcccatggacggaggagcctgggaggctgcagtccatggggtcgctaagagtcggacacgactgagcgacttcactttcatgcgttggagaaggaaatggcaacccactccagtgttcttgcctggagaatcccagggacaagggaagcctggtgggctgccatctatggggtggctaagagtcagacacgactgaagcaacttagcagcagcagcagcagcagcagcagaatacataaagaatgtctataaatcagtaagaaacaactaaaatgaaaacaggaaatattcaagtgttggataaggatttggagcaactagaatactcatacatagctggtgagagtataaattggtacaaccaccttgaaaaacagtttacttgtatctcataagcaaatccagcactaagcatctatagagcagaaacaactgggttctatgcatatgtcttacagtagaatgaatgaataaatgtagcacacttatatagtgtaatactactcaacaatgggaatgaaagaaccgcaactacacacaacagtacatatgaattatactacacacatcatagtgggctaagaagtcagagttcatactgtatgattagaattcagaaacaggcaaagataatctaatcagttagaaaagaagatagtggttgtccctggtgtgtgtgatgggggagcaatgtagcaaccagaaaggggagcaagagaaatttctggagtggggataacattttctttcttgatctgacaatagttacacaggtgatttcaacttgtgaaattcactgagatgtacagttatgattcatgcactcttctgtgtatatgctatacttcagaatttattttttaagacagagatctccagtctgtcaaccttgtcctcatgataggctcaaatcaagacatgatcaggattgtaatttattattttctttcctttttcatccatttattaaaattattcacatttctcattagtttctgccttgcaaatctctaactggcaagttctccacatcttgaaaccctttaatgatttccacacaggagaatattatgccaagttctgtgctttgtggtctgtgcttttgtgttatagagaacagagtatctcccttaatccacaaatctaatgaaattgctcaaataaccaaatgggtaataacaaaca

SEQ ID NO: 54772 - DNA, 1993 bp, Bovine  19866880849272
tgtggtgacctccttgtcttcctaaattggccaaaaaccacaaagaaacctactgtgagcagccactcttcaatatacttcccgcccacgaatgcaaatcattacaactaccatggtctcattttacagagaagaaagcaggtctagggaagggagatacttcggaaggaatggagccaggctctgaacccaaggtattgggcagctgtcgctctttgctcaaacaagacacaaatgccagagacacatttaaattccacccactcacccttgtttggaagtatttttgttttgttttctgatgtagcaggtgagaatctcatgttatcaacttggatgggcaaagaatgaagcttcatttttctatatatctgagtttgacttctctgttgatcccccatcccaccagggagccaaaatggaatcttactcaactcagggtttcctcggtaaagtccggagattcctcttgaggtttcttctataggtttcctcctaaggcccggagttgtctctacatttgagtggccagggcaggggctgtgggatccacccctggaagcgagtttgataagtgcatttggctgcaagtaacagtcagaaaggctaaaagtaagggacttccctggtgatccagcagctaagactctgtgcttccactgcaggaggcatgagtttgatccctgattggggaacgagcatcctgcatgctgcatgccaaaaaaaaaaaaagggtaaaatataaaagaaaaagtggctaaaccacaggggtaacccatagctcagtaactctgtcctcaagagaggcttgcatgtgggcaagattggaagccgcgtcaatgacatggtatcttcacacagtggaggaatattatacagctatgaaatggataaggcacacgtgtctgcctgacctctgtgcaggcagcctgcaggtcctgagcaccctgcaagttctttttttaaaaatgaatgctttttaaaagttatctgtttgagtaaaagactccttacttctatttctgcagactccacctggctttcaattattctgatacattgtcttttgcagttcttcacttataacagtttcttcagcaacgtcctttgctggtactgttaatacttgttgtccatctggcccgaccacaatgatgggctgacctagtccacttgtttgagcggagtgcaaatttccaagctgaattccatctgttaactattgtgatgacctgagggatttttggtctttgttacatcatgctggttccttggttgtggcatgcggaatctttagttgtggcactcaaactcttgtggcatgcgggatgtagttccctgactagggattgaacccaggcccctgcactgggagcttggagtcttagccactggaccaccagggaagtccacctgcaagcttttgctgactgtgccagactgcagatgcgtacttctcccaagaccaagcagtttccatagctaagcacataggctacacaacatgactttcttttctttttagctgggccacgaggcatgcgaaatcttagttcccagactaggggttgaactcatgcccctgcggtggaagcaaggagtcttaaccattggactgccaggaaccctgcccccgcgccccctgcccagcatgacttctgcgtaactaattcgttcctgacagagggaagccggcttgtttaccgctttctacagaaggtgctcagcccttggccccctgcctctcagcatgtgagtccagtgtgtcacccatgaggcttgggggctgaggctcatgcttgctgaactgtgagaaagaaactgtcttgctccgatgcagtgagtcccacagttgactccacaccaatggctgaaggacaggcttatttctgccattctctaggaagtgagctgcttcattctgacgaatgaagtgtgatgatgagtgaaaaaaaaagtcctagaaggtttcaaagagcatgatactacattt

SEQ ID NO: 54773 - DNA, 1163 bp, Bovine  19866880879148
cttttgttgctgagcactggctctagggcatgtaggcttcagtagctgcagcatgtgggtgcagcacttgtggttcctgggcactgaagcacaggctcaatagttgtggcacatgggcttagctgctctgtggcatatgggatcttccaggatcaggaatcgaatctgtgtctcctgcattggcgggcagattctttaccactgatccaccaaggaggatcaatttgggagttttcaaaaaacacacacacacacacaaataaaatttatgccaacaaaagcacgtaagtcatgagggaaataaatgcagtcacaagtattttaaaggttcttgcattgaccaggaagtagtaaaagtactaatctgtaacagtaaccagttaaagatgtattttatagtatttataaaattaacctgcagaacagaaaaatatacaaataagatgctataaagaaaagcaataattaaaaatacgttaaccaaaaagattaaaaaagggaacaaagagaaagtgaaatagtaaatgaaactaaaaaaggttcaatgcaccaaaacacattctgtatttgtgtgtaccaatacaaagaacttcaaaataaagaaatgactaaaactgattttctgacacactattatataagctgtcagataataaacatacattatttaattaactggcttcctgggtagctcaaatggtaaagaatcttcctgcaatgtgggacacctgggtttgatccctgggtcgggaagatcccttggagaagggcatggcaacccactctagtattcttacctggagaattccacagacagaggagcctggtgggctctagtccatggagttgcaaagagctggaattaattaaaaggtaaatgaagtaagacactttaatacacaatataccttagctctgtaggaatgagaacccccttgaaaatttatgactccataagcatccgttgggctctgttctgtatgtttttccacagaccactcttctaatgtctgattaaaatggtcacccaatttcacatctgagtatttcatggcaagacttgcagtaaaacaagcatgttgcttgaccaagcgaccacaaaaacacctaaagggaaaaaaataataaaacttttaaaagatcttttaaaaaaatcagtcaat

SEQ ID NO: 54774 - DNA, 2335 bp, Bovine  19866880961667
gaatgtgagaaaaacagagtgggtcagttcctatcctacttaagcttgagcctccataggtctttttaatgagctctccagctgattctgatacaaagtttcagaactgatccaagatcccacttaaaataggatagtatgctatttgaaataataccccaggtacaacacaaccagtacaaagtaaagtggggctgacaccttgctcttcaaaatggcatttactttttaaaattttttaagtgttcattcatattaaatgtacaatcagttaaaatgatcgagtcttttccacactatttgtgcattaccatcttgggccctaacagccaacctttataatcattcccattaaaaggttaagagagccagggctaagaattttaggtttctatttctaagtggaccaatggccctacaggtggatttattttcagtggggaaatcacttaatggtcaagcctctaacactatggacatacttagcccaaaaaataaaaactgcattagcccaccaatgtctgaacgggagaggtggctgcaccaaagtatcttctctgtgcagaactctgttgtcaacattgtgaagtaacacacaggccctaatactaacactaataaactgaccagagagcctgatcgaacaaacatcttcagaaaaagttaaatatactaattatagttgtcctgaggtagacacattagtgctacagaaacctgattactagtggaaagctcagggaccaaagaaatgactcactggaaaactaagttgccctgaacttaaaggttttgtttcagtttgcttattagtatttgcagagagaagatatggagcctatccacgctcaacctgcttgcaaagggctacggcaccctcatcattaattcatgagtcaaaactttctcgcagtgactcctgaacccctcacaacttgttttacctgctattgctaacttaaggtactcaagggccaaaaaaaagtccattctatagaccatgagctcatcataagtatatctagaactgagggtgggaagtacaactcaaaatccaatctgatatttattttcatgtgagtagcaaacatcaaaaatatacctggcattttctagcaattacatgaagacagaccagatgcttcctgttgatggaacaggagagaactacagactgacagaatcagactaaagttcacaaaacaaccagaagcttcatttcagaaccattaaaccaaagcaggtatggctttaagtgttcacacatttacaaccgtcctccaacctagaacacccagactgattcagaaataggtaactcatgaactcttaagttacaagttagctctacatctgtatatgcgttacaatgcaaaagccgtttcaccaaaggtttcactgcgggactcctttttaatctggcattccgatagtactttgaagtgttcaacttcagaaattacatttacacacaagttttcacaagcaaatttaacatgggattcgtgttttacttgtgtacatcattaaaaataagttgtggaattaaaaattaagtttaatcatttaaatttttttcaaatattctgagtctctaaaatcatatgcagattatgcaatctttattcatgatgtttatgcatctaaatcccaaattgaaaaaaagctagagctcaagaaaaaagcacaggaaacaaccttcttatccgtatttttttaaatgagtcttttacaataatatcctgatttgatttgaatgagagcaggatagaaatgacacatttttcagcttttgaaaaaaggaatgagtatacagtggcgtttaccagcagttacatgatgtgataccacaacaaactgaacgcagaagtaggttcacgaatccagctatcttctgttaaacattcaaaacaatcagaaatgcaaaacaatgccactcttgcctaaaatatcactggcgttaacatgcaatagtcttttgttattttgtgggaaaataaattcgagaaaaagttaaaaaagacaaaggcatctttcgtttccttaaattcaaaatctgagcgtgaaagtggaagtgtcaaggtcgatggttacatgtcagtgagaagaaatttaaagcaagctgggtgggtctctgtgtgaaaaaagactatctgcaaaaagaacttctggcctctaacttctgcataataaactatggtgctttaactctgggaaggcaagttactgcactcattacaccaaaccattttctagataaaaactgtacttcacaaagtaacttgcctgaatcgagacagcaaatcaagtgtacagagagaacacttaagatact

SEQ ID NO: 54775 - DNA, 990 bp, Bovine  19866880981251
tggagctcagaaatttttgtgtccccagatcaatttcccacttgaactcatgtataactgccaatgctttcatgtgcttctactgtcatatagttgtcactttagatttcactgtggtccttaagttacctactctgaataaaataaaaaaaaaactatttttcaatattgtttcaatggttttgatagttaactaagaacttccagcatggaaaggcaaacagacagaaagcaccagttaatatctgcttctggatctactctctgatttctcaagatcatctgaaccaaactaaaagaagtagtgtggaggaattcagccaagataatgaactgaaatagaaacattttaccctattcagcgcacagaatgttaggctaaataataacttaagaaatatatacccaggttcaaaattggggaaaaaaattctccagaaatctatagacatagcagggagaaggagttgacactttgctgcccatgagagcgaccaaactgacctatgcctttgggctgggcacatctaggcatggaagctgaggctgttggtcctgcacctgcagggagctgtgaaactactacactgtccaagaatggggaccaggaaagccttgcaatcgtgatccagctcgccatggatgaaaacaagatgacacgcaagtgatggagaccgggggtactgttcagagtgagagttaccctaaatttggatggcccaaatcaagaaacaaacataaaaatgtgtgtaacctaaaattaaaaggagattgactagagaggaaaaacaatcggattgctcatcagcaaataagtgctagaaaacagtagaataatatcttcaatgtgctgagatttcaatatgattgtgtgactgtataatttcattttttataattgtcaaatttaaaatctataccaggcctatcactgaagaataaacacaaagactttttcatatgtagaatactaagagagttgtcatccat

SEQ ID NO: 54776 - DNA, 3203 bp, Bovine  19866881037504
agggatcgtgctcttaaaattcttgataaccttaatgtttcggatagatacagctattattttgttagcctaattttctgtcttgttttttcctcccaagaacaatggaggctgctgaaggttgacagacactgattaaagacaggtgcaaagatttggacatgaagatattcactgatgctattttagcagaaaattggaaacaacctgtatgcccaacaacagaggatgtttaaatacctatggtacacccatataatagaatatcgtgcagcttttaaaaatcatgttgtcagacagtagatggagtgatgttcaccactgttaaaaggaaaaagcaagttacaaaagcagattgctatacacacaaagaaggatatttttcaaaagatatgctaataattaatgccactggtggaattatgaatggattttaaaatcttcttttgcttgtaagtttttcccccttttttttttctacagtgatgtgcattgcttttgaaataaggcaaggtgggatgggtaacaataaaaattattttgctagccaggaaaaaaaaataggaaaatccccttctttcaaggctgtcttccagcatcttgttctgccagatggataggaagcaagctcaaaccccactggtccagcttgcccagagccccatggaggtcaccttggctctgggcagaagcttccttggtgccagcaaccacctcgagacgagttattaaaaatgaggcggtcccaggcgagatctggttctaaagtaccaagggccacttcagcccaaagaaatggcagttccagaaccctgtgaattttcaaagcagaacagcagccctagcttgggagaggaacctccctccctctctcctcccggctgcctgccgaaggttgcagacggctccctttccatcccacaagaggagacaggcagatgagtcatagaactggcttggattaaaggagtattatcgtgttagaagaaatggatctactttattatctgtttcttgtcgccttacaaataaatatgcttttcccaccagacagatttccttaaaaagccaccgatttcattagctgaagctaagaaatgaccaatatgagttagaaatgttcatgtctgaagagtagccaagctgaaaagatgtagtggaaacactgaggaaagtggtttataagtctagattcaagtctgcaaagtgatgccattcttctaaaaatatacagaggaaccacggaagtcctttccccttttctaagagctttctctttctttcttttaaagaaacatactaggattggtttgtaaatctgagattcaacacctcagatttccccttttttgtcgagatgatgatcaagcgatactattttaaggacttccttctcttatacagatttttccacactgggaggacagataaggtatgttccactaatgttcctgattaaacccacttgcgtgccagcagtcatttccctttgtcttgctatcccatgacaacagattgcatatcataggaaattggaatggagattttatttggtttggatctctcttctccattgtttaattccacattcagtttttcattctacatctgcctccttttgcagacatatactacgattaaaacgtcggagaaggcaatggcatcccactccagtactcttgcctggaaaatccaatggacggaggagcctgatgggctgaagtccacggggtcgctaaaagtcagacacgactgagcgacttcactttcacttttcactttcatgcattggagaaggaaatggcaacccactccagtgttcttgcctggagaatcccagggatgggggagcctggtaggctgccatctatggggtcacacagagtcggacacaactgaagcgacttagcagcaactatgattaaatacagggatggctaaacgagttggtgttgcttattgccgactcacttcgtagacttctcaggagcactctgaccagccctctctctccccagagttgcaaagagtcagacatgactgagcacacacacacacataccctctgccctcagaatctctggtctaaaatgtactatgtactcagtaaagagctgatgactgacgtacatatctctgttgttaattgcactcccagtactttgtttactgttgatcaagttccaatagtcagtttccctgtttgcgctaagatgtgtggatgtctcagtgatatttctgtcttcaacccagatcacctgtccattaaaacaaacaaaaaagaaaaataaaaaaagcttccaccaagtgccagaaaagtaggtctaggggggcagagaaagtttcacatttcctgttgctgaatttaggcatggcccttagaggaagctggatgacttttcaatccaatatgctctgttctctgatgctatcatccttgtttttccttaggactacaaagccatgttgccaaactttttttaatgacccagctatttgttttttgagtgtcaacttttatccaactgttgctatgactttttttcttttcacttaaaattgtgattttaaaatattttgtttttctaaatggaatccattaaatctaagagcgttctttccatttatcaaacatgaactgtgtgccaggcattgggtactaactagcttccacactcattatttcactcactcccttacaaccgccctatgaaggagatgccatcacctgagaaaactaagggaggttacaccatttgcccaagatcttatgtctagcgagggttctttaaacccttccaataaaatccatccagctcttactagcttaagtccatgagttttgccatccagaaaacgttttctgagaacccaaaggagaactgtatttgcattctgaaaagtccagacctcctccaaaagaggcagactccaggcagtcaagaggccagactcacttgtgacactaccttagtggtcagtagaaagtccagacatcagatcagatttcaaggcccaggctcacccacatatactgagcctgagaccataggctcagagactgtttccacatctcaaaatggagataacagtttaagttatcttcgaaactgccaactttcaaccatttttgacctccaaaacaaaatttttttttcaaattcctcactgggtcattgtagagattaaaacgagtgcacaga

SEQ ID NO: 54777 - DNA, 795 bp, Bovine  19866881242318
ttaatgaccttaagatgaagagtctgtctcatttccaaaaaaaaatccctgggccttgaaataacatcatttcaggtgaagaaatctggcagggtcagctgtaagctcttctagctcattatctcactttgtcttagacgcccccaatccacccacctcagcactgaggaatttgtaactcaattaataatcatgtcagagataatgttaactacaagcatagattatgtaccccaggtagtgtatgctatgtatttgaccctcacaaaagggctgcaaaaggaagtctgtgagtcctattttatagatgaggaaactcaggaacagcagatttaagtaattcatttaaaactacgagactagttaagtaagacagctgaagttgagccaaatcaactctagacaaagcctgcaatctttgcctccctgcatctgcttttagaaaattggccctggttccctaatgactgtgatttctcacttatttgagaaattaaataggtctcaattaaaatcaccatctagcactgagatttacatttcatcatttaaaaaaaatattatccccaaaaagccagtcttatgatgtgacagaacaataccacctattcatcaaaacttgaaggtagatgtaacctttcatttttgagagggcattctatatatttgaacagagttgcattctggctttgtttttcatattggattttatagctagctctgaaaagtgaatgagtgataattttacttaacagaactaactgaagcagatacttgtgaagtcactggggtggg

SEQ ID NO: 54778 - DNA, 1868 bp, Bovine  19866881242497
aactggacacacacaaatacactggcagccatttgtacttaattgccacccctaccttttcattatttccaaaaggtccagctgcaagttcaaccatgatactctcaccattctaaaattaagaaaggtaaaagaaattgttcaatcactaaaagtgaacaatcttccagtattcatgacctagggcttcccaggtggcactgccggtaaagagcctgactgccaatgtagcagactcgagagacatgggtttgatccctgggttgggaagatcccctggagaaggaaatggcaacccactccaggattctggcctgggaaatcccacggacagcggagcctggtgggccccagtccttggtgtcgcaaagagtcggacacacacgcacatttatgatctactgccacagctatggcctaccgtaagctgatggaaagtcatctgtagactgattttcctaaaatggtccctgtagatagcaaaaggaaatggcaacccactccagtgttcttgcctggagaatcctagggacaggggagcctggtgggctgtcgtctatggggtcgcacagagtcggacacgactgaagtgacttagcagcagcagcagatagcaaaaactggagttacctaaaacaaatttcacctagcatactactccactttattagagttcaacaaataagagaaacttacagataaaccacacaaaaattattcaactgaaggtttgagcactgatttatattgacaactaatatctagcatttcttctatgggctatacattttaagggcttttacttatattatggcatatactatgtgtcattagtcatttttagcaataacaatgaacagggacagaagaaatactgaaatttttcatatacagatttgtaataaatagatgactttatttaaatatacatttaaccttctgtctactcaccacattaacaatgaagccaaacttgaaaagatcaagccctaaagaacttgagaacatttctctatcctgactcttctccaatttcagctttgcctgctcttaatacaccaattaaaacattaaccttagcagaattttttccttgtgcatgtctaaggtctttttatgtgggctgtgtgagaaattcattaaaaagttctttcctgacagtaaagtctactggggagagaggaaacatttagatgtagcaaggtaagactgcatgagcaaccatcttacacttaaaataatgccccaaacaggtcatgggaagataaataaatgctgaatttttaggagaatttgactgattagctatactattttccatgtgggtggggagcatagaataaattacttgagtttatttttaagaggatttcactgatacccgagttgagtagaaaaaagaataaattccttggcaacagaaatcctttcctcatgttaagatatgggttacagaagggttaaatcacaggagtttatgaaaataaactaatattaaatacagttgcttacaggaaacgcccatgatgtgattcaatttccagataaagagtttattttagttcattttcaaattgttatttaaaacatttaactgaagaccattactgacatcctctcatacattcaaagatatctacctgagaaactactatttgcaagacactatacaaagtatggtggtagatgaagaaaaaaaaaagacaggctcttactacctgtactcctatggctacctgccctgccaactcattaaaaatatactaatcccagggtcaagaagttatttagaatgtctaatgtttaattcttgaaattttcagtgaaacccacaaaaatcagaaatcatgtatctgattttcattttg

SEQ ID NO: 54779 - DNA, 2052 bp, Bovine  19866881296857
cctttaaatgctctgtcccacattattcttcatctcatttgctttatttccttccacttctaactcaaagttaccctatgaacaaagcttccttgaccatccctcactatccctcctctacattttatgcgtctcccaaagcacttattatttaatttattatacacttagttatctgtttgttttctacatctttcccactagaatataagctccatgaaggcaaatattttgtgtaacgatatattttcagtgcctagaagagtgccacaataaggttcaaaaaacagttgctgttaatgaaatatatttttgcaaactaatttaaataataactatgttttactttggatattaaaattaattggccttccttctatccaaactgtgtatgtgaaaggaaagacttagaatataagattatattaaaaattaacttcaaaagctatttttttaccactgtctaggcaatgaatcggagaaggcaatggcaccccactccagtactcttgcctggaaaatccatggacagaggaacctggtaggctgcagtccatggggtcgctaagagtcaggaacaacggagcgacttcactttcacttttcactttcatgcattggagaaggaaatggcaacccactccagtgttcttgcctggagaatcccagggacggggaagcctggtgggctgccgtctatgggatcacacagagtcggacacgactgaattgacttagcagcaggcaatgaattgccattcttttctcaatttaccagcagttacaaagtgacaagaataacactttgctatacagtaggtcagcaaactttttataaaggaccaaatttgaagcattttaggctttgcaagacacacaatctaagaactatccacctctgctcttatagcacagaagtgtgatacaaaaccatacaaaaacaaacgtggctgtgttccaataaacctttatctacaaaaacaaggagtaggctggatttggtgcagggaaccatagtttgcaaacccttgctccaaagcacattattcttgggaattccctgacggtccaatgattaggatttggcactgtcatcacaatggcccaggctggggaactaagatcctgcaagccacaagacacagccaaaaacaaagtcttaataaaaaaaaaaaaagtaaatgataaagcatactattcttttaaaagaacaaacaaaaaccaaattcattttttcagttagcatttatacttaagaactatagattacttaacagaagactagtatacatttatactgtgttgacttttcaaatatctgatatgaaaaatttacaaacacatcaaataaatattataccaattttattactgtttacctgtgtttactcctccagttaaaatccaggctccggttgtaactgcagctttaataagaccctttccaagcaactgcttgattcgtgggtgaagctcaaacttctgcatgccaccatgcacagagataacaagtttgggtaattccatttgccattctttaagcagaagttgtagaatgatttcaggtttggtgtcatatgatagcctcacatactaacaagaaagatttttaaaaaataataattcataagtttcataatgcagcatcacatgacttaagaaaaactttatttgcataagattattataaagtagatttcataggctacttgtaatatatttatactcctaagaataagcaataacaaacaaacaattttaaggttggaaaatcattctgtaagagctagagaaatagtggcactctaattttcaaactttaagatgtaaatttgttactccttctgattatataaaccaaattaccattcacctggtttacagatttgtccacagtatttcttgccttgtaagaagaaatcaaaaatattcatatcaaatcttataatactccagatgttggggggaaaaaaacacttttaaccttctctaataaaggttctttccaaaacaatatattagccattcctttacagagatcaaacaccaagg

SEQ ID NO: 54780 - DNA, 1244 bp, Bovine  19866881359091
ccctgcaaataccttgattttggactttgggcccaagaactatgagagctaaattgctgctgttttaagcaaaccagtttgtggtaggtaattacaggcagattctcacacaaataccctgatgaatgaaaacaaataactcttagatggcctccatttggtcatgtattcactcattttctcattcattcattcatcaaatatctattatatacttggctgtaaaatatgactgagactttctagattctttgacactttattatccagggtaaatctggttactactaactctgtaggtgggagagagcttactgtagatatatgtacttcaaaagagctgtcatcttctaaattcttcatgagttaccttcatatcctgcctaacagttggctaacaaatggcaataacaagaaataaaataagatttttctgttttctcagaatgtcctttaagggcataaagttgaaaacaaggggtaataaatactcccacactgagaggaaaggtgctagatacatctctgcaggattatgaaaagataaaacccttaccacacatactctaaatatgaggggaaaaatgttcgttagaaaaacatcattgaaaggaattcatagactcaaaggtttctgttcttgggaacactccctacagctgtgctaagtgtatattgcacaaccacagtgggcaccgttcacctcacagtcaatggagatttgtatagtactacaccagtttaccagcagatggcagtaaaatatcttgtggagtaagatatttttcctgattctcacaagggtgtatgccctagcaaaggtgctattttttttcagtcttctgtataccctcccccaagccagctatgtagagttcaaagaaaatttcacagaaatcaggatagcctgcaacaggagagactaacatattagtcagtccctgaatgaatgctggctaagttacagaaactctcaggcctgcaccaagctgtttactatcagagcagagcctgggaatcctgggagagtctgataactgtcccaggagtcttgggcttaatgcttgctctatatctggagaggtctgaaggcaggagactggctagagctaccatgatagaagtcaaggggaggggagtcagaacttgtcaaaaactgctcttctaccacgtggcatggcaagaatacaggaattcaccaggccaaacggacacctgggtacaggtagccaggtgtgagctat

SEQ ID NO: 54781 - DNA, 1704 bp, Bovine  19866881619777
gaacaggtgtggcaaaacatgttggtgatgcccttaaagagcatgcttccagatcatctcgaaagatttgcactattggaatagctccatggggagtgattgaaaacagaaatgatcttgttgggagagatgtaagagtgtttttaaaaatttctttttttttaagcttatgtcagaacaaaattagagtaagaatagtgcaaagtcaacctaaaatattcatgatcatactacagtccttttgaaaacaccatcatagatttaaacagttgtaattatagtgttagtacatttggtttctgcccttttttgtataactatttcacactttttccatatcatgccagtctgtgtaattaagtttttgatgattgcatgatgttaagaattaattgtattgtctgtgaaagtagtaatcaaatgctggtgttttattcaagtaggttaaagacatgcgaattggttgtagatattttttcaagagattgttaaaaaggaattaattataatggtcattttcaaatgcagttgaatttctaacatcaattttaaagattctacttatgactggaaaagtagcaatatgacattaaactgcttttattcaatgtcctttatatattgcacgttattccctaataatctaagagtttcttaacattctttatttatttgcttatttgctgctgtttcctttgcatgggatgatgaaatatgatatattctgcagtgagagccaaaatataattgtttggtttagcccattattgaataatcttcagttgcttaaaagctcatgctttttgatacattcttttatattttgtatttttgcctttacagattatttcaaaatttgtttttactgtatgttatatttaatcctacccactaactctcatgtttgttattggtttaggtggttgctccttaccaaactttgttgaaccctctgagcaaattgaatgttctgaataatctgcattcccatttcatattggtggatgatggcactgttggaaagtatggagcagaagtcagacttagaagagaacttgaaaaaactgttaatcagcaaaaagaattcatgctagtaagggcatttataaatttgttgttaaaattattctgggctgtattaattgccagcagcattctatgaaaggtagaatgttcttttaagtcctcatttccttagtagcaggatgacattaaacaacaaagagtaactgaccctacacaaaatgagacctaggaaaggaagtttgagattaaacaggatactcaaatatcaaggccaaagccacaaaagttcattggaagctttgttgctactgtaatcccattgcatctcaaggaattcagaaatattcttaatgtatgatatattccagtacatgactttgaagttcaggattgaagaggaaaaacatactttattgtgaagtaagaatcactttacataaagttgataacataagtaggtatcactctttggtagatatgtcttaaaaattggtattctagaaacacatcttttctaaccatggttaaactttctggttcaacatctagatttttatttcaaaaagaagaaattttgtaattttaggacaccaagaaggtgagctctatgatgaagtgaaatataagtacaaaaattacaggatagtattttcagattacgatggagtcatagcatct

SEQ ID NO: 54782 - DNA, 918 bp, Bovine  19866881716095
agtctgaaatgcaaaataacagttaatacactggaattcattttctttttactatagagtatggcagcaatattccaatttcattctggaatggaaaggatatatagacagtcaagaataacagaattattttgacaacataatatagtcttgtcaaaattatgaggctttgttttattaaaagcaaaagtgtggtgtttcacacattgacattttgttcaaggatttaaaattaagataaatgatatgatacaaagattttaaaaaggttgaaacaaagaaatatcctctcaaacatcaagactctgaaacaccttgtgctaaatcgggaggggtgaataagactagcaagctccatcttactaaaaaatggaacatatataataatttaaatatcagtggattaaattacagaattgtactatttataaactttatctaacagataattattaatttacctgcttcatatctttaaagtctttgtggtttataaatgcaatcaatattttcacatcaagaaattcagatttgttccctgagggaggaaactaaaagaaaaaaaaattatgaaaacatatgaactactagtgtatttacagaataaagtacaaatcattcattaaatacaaatatctttttaaagttataaaacaatgtttcatgtcttctttcttaatattataatattaaaaaggattcaaactggaatctttttaaactgatattttataccagcacacacgttcctaacatatcatgtctattctaggagtggaaaagaaacaaaattttccaattaaacacctattataaccagaatgtttatgaatattaccatcagattattcaaaactcagccccgatagcacaggaaaccctatttaatgttatgtggcagcttgaatgagaggggga

SEQ ID NO: 54783 - DNA, 1920 bp, Bovine  19866880373699
catgacccaggaaaaacctagccttgactagatgaacctttgttggcaaagtaagacaggaagtaaaagatgggtaacaagggatactcgtgaatgaggagtactggagcaagaaatgaaagggaggagagaccaaacttggattatcgtaagctccactggaagtttaagggagttagttattcctgtgcccacatttatagcagggcatttaaagttgcgttaaaggctaaactataccatttttcctgcaatcctctgaacagctcctcagagactttgtccatcttaaactatttaatttctaggttatgcagctaattggtgtctttattctaggtctcccatctatcacattgattttacaatcaacattaggcttaatcagcaacaacttaaatggtattccatccatcatcccatacaaacttgctcttgtgtcttctcacccaatgggacctatgcagcatccatcatgaatcgtctgtacccaggagactgatcaacagcatgaaaatttgaactgagctcatattttgcttattttcacttttgcagttcctttagctatcaagtgtaactcacagaagacaacagacaaatgaatgagagactattcatcttcattacactattgatatgtgcaatttataatttttaatgctcttgacaccatcttcaaggagaaactcaaagccaaccattgcattcaattacctaaaacttgtcagcacagaatccttttcagtcagcatcatacccatcctaattaataaaatcatttagatatttatatgtttttttttcaaggcattttatatcctctcatcctccacatctttccattcgttttatcaatgtggctaccagttatcaattatcaagaaaagaacactgtagccattagtcatttagagttatatccaatctgttctcttcatgtcactttcaaacttctagaatctgtgaacatatgaatgtaggtgtagataatctctgatcctctgaagccaacttctcttaagggacataatcaaaataccactttatactgtcagcctccatgttctttccagaacacaatgcattgtcgctcacttctaaacaccttattggactttgggtaacagactataggaattacctattatatatttgactctcagactttttcttccttgatacatgcctttattcattcaacaaggcacagaacctactacgtacaaagtactatgtcaggtaaagtaggaattgcagccagtggacttttattcacttttcttgagccacctgcttcaagtgtgagggtctttgcttttctttttcatacttcacacctaatcagtggccagtgtatatgaagttttctttcacattatcttcttttttttccactttcttcccaccaccctattttaaatccttaccatcctgtacctgctgttgctgctactgctgctgagtcgctttagtcgtgtctgactctgtgcgaccccatagatggaagcccaccaggctcccccgtccctgggattctccaggcaagaacaatctgtaattctgtaatgttttgttttggaaacaaaaacaataattaaacttgttttgaagttaaaaaaaaaaaaagtagaactcaaacacttaggaaaaattgaaaatgtgtatgaagcaaggagtactggaaataaccaacatgaatgacatatagcatgttatttagtaacagactagagtacagtggcattctcctactccctaggtcaaatcacatgtgtgtgtgtgtgtgtgtgtgtgtgtgtgtctggatgatgcttgtatacaatcaggtcacaattttaatttctaaagctgaatgattaacataatcattatagatttctttttagatacagtgaaaaaagcgaagggtttattatg

SEQ ID NO: 54784 - DNA, 1441 bp, Bovine  19866880554297
ctgtaaattttggttgttaacacaaagtaaaatctctttgaaagtgaaagtgttagtcgttcagtcatgtccgactattttcaaccccatggactattcagtccatggaattctccaggccagaatacaagaatactggagtgagtaactgttcccatctccaggggatcttcccaaaccaggaatcgaactcaggtctcccacactgcaggcagattctttaccagctgagctaccagggaagcccttgatatctttaggttttacatatatagcaaatagtattttaatttcctcaggggatttagctccatttgcatttgagagagtgcaattttgcaagacttttttctttccctgtgggtaaatattcggcacaagtgcattacttgcgaaccttctgaaagataaagtgcttttcatgttttctctcaaggcctcactaaatggagcatgtgaggaaatgggaagctataatgacacccacctcctagccctcctggtgtgtgtgtgtgtgtgtgtggacagtttttggtgaactactgctttctcttggagccattcccatgtaagcggccacgcctgggccttgtaccgcattcagaaaatgacccgtgaccagcacacagaactggaaacgttgtcagtgtgatgagaatgcctaatgtccccagagtcgcgatgcagcagaagccaggcctgacaagtcgttactctgctgtccacagtgacagagggaatctctctcatatgcagttagtggctggggctgaatgcagtgcagaaggagcccacagcctggagccgaggtcgtccacgccctgtgcttttactgctgtccatctttgcctgggcaaaactggtagtcaaattggtgaccacagggcaatcatcaaaattcagaaggtaaacagtagcactgctacggcacgcttgtaataaattatccaatgctattcacaggaagtgttgtactcatggggatgaatgaaaggagactgccactccacaaatggctgcaggagagcagtctgcagattacagaaaagatgttgaactggtggagaacacttggatcatttaatcaggtggggagtcagcagagatagaaaggtgctgggaaaagctgtgtttctctgcctctgccacgtttctggccaatctaatgattagcaggcagaggagaaagacaccaggccatggcaggttgactgtgggtcctgggtcattctcaggtttgaagcccagcaagtgagaatgtcatccagtgatggggaaattagaaaggaggaattagtaatgagaatcattttggatgtattggttttaaacttatcaggggacattctaatggagagaagtgtgttaaagggactggatcaaagagcgggggcaaggtctgaacggaagatgactcaagtgagctccttaggacttagaa

SEQ ID NO: 54785 - DNA, 1586 bp, Bovine  19866880561159
tctgttttcttttcctgtaccttttctactagcttgctctgtattctctgaactaagccagactaccagaggtcttcgaatttctgggccctcgttctgcgtgttcttctccaaataacaacagagcacagtgagcttctgaaggcaaagcttctaagacaaagctttcatctgggaattgggtttaggggtcagagccttcttgagaacccatcaatggcgattagagaaaatgctctgactgcccttgagtgtctccagacccacttttctctgacatactccatttggcagtgtgcccagatttaatggcattctacaggcttgctttatatatatatgctgtgaaatgtgctttaaagaatatattcttaatgagggcttttgcatagtaaatattcccagacctcaccagctgtggatatcaataaggatacttttacatttaaaacttaatatccagagctttatcctttccctttacatgacagaaggaactcagaccatgtttaacattccccatatcttttagtagataccttgaccacctgatgtgaagagctgactcttcagaaaagaccctgatgctggacaagattgagggtgggaagataaaggggtgagatgagttggttggattgcatcaccgactcaatggacatcagtttgaacaaactgtggaagatagtgaaggacagaggagcctggtgtgctgcagtccatagcgtcacagagtcagacaggactgagctgctgaacaacaaaggcacttgaggtgcagttcttagagatccttccaagattgaattcatattgctgcctcctagctccaggctatccttactgttccacttgggctaccatttgtatccgcacaattctttacttgtcctaaacctgatgacctggtgcgttcgccagccctgccacctgcccattctcatgactgttgactgatgctatacctgcccagcctggacagtccatagtgctctgctgcttgagctctacccctgctgccaagcccctccccactgagctgctatgattgtgtctaggatgacattttatttttctgctcaactgtgggtagaactcagtgctccagggagatattagtgcatcatatatactttctcaaagttactgggcatttttcctctgcactgctcctccttcttgttttagaatggtcctataatatgttgttaggtccaaaagttgtgcagagtataggagggaaggtttactgatctgcagcttccccactctctccttaacatgcacacaatcagtaaggagcaccatgttcatatatggttcagccaacaactaccatgtaatatgcactgcagcactgcctttctctctgtggccgtaggtagaataactttctcaggggtttctcatccttaaagtatttcttctctttctcctcccacatatggtacaccgggttttcacacatgcctatatttgtgtgaacctcactaatgggcttccctggtggctcagtccgtaaagaatccacttgcaatgcaagagacccagattgatctcggatgggaagaactctagaggaggaa

SEQ ID NO: 54786 - DNA, 1544 bp, Bovine  19866880696705
catgggattctccaggaaagaatactttagtgggtagccactcccttctccagggaatgttcccaacccaggggacaaaccccggggtctcctgcattgtaggtggtttcttttttggctgagataccagggaagcccataacttgaaggtataaaccacagaatggggtttataaaacctcaaaaggcagaatttcaggagaaagaatgaggctgcataaagctagcaaattagaccagaggaggttgagagcaaaataaaacaatgggctatctggaaattttttgtgggaatcagcccaagtcatggaatgatttaatagctgaagtgtttagatatgatacaggattactacttaaaaatttttttaaattattttgtgagcagtgaagttagaccatatccagtgtttgtcttctcaaggtttgatgatctctgagttttatttatttctaaagtaggtcagtgtgtgcatatattatatatctatgtatctctacctatatctacctatctgtactgtgctgtgcttagtcgctcaattgtgtctgactctttgcaacaccatggacagtagcccaccaggcttctctctccatgggattctccaggcaagaatactcgaatgggttgctatgccttcctccagggaaccttccaacccagggatcaaacccaggtctctcgcattacaggtggattctttactgtctgagctaccagggaagcccagtgggtagcctatcccttctccaggggatcttcctgacccaggaatcgaccaggggtcttctgcattacaggaagattctttacctggtgagctaccaggaagcccatctacctacatacctatctacatacctacctatctatctataaatggtatggaaaagaggagggactgtattttgaattttctcatttagaatcatgattttcaaataagagaggaaaattttaaatcttaggagacatggaaggattaataagtgtgaatttggaagatctaatacacagaaagaaggtgctatatgtaagcctcctgaactaaaatatgaaagtgaaagaatatgaaggataaggaagatactaggaaattttaagcatgcacgattacctactagtaagaattaggaatataatttagatgcacttagcctgaaaaatctcttaaccaaggtcaagggaataaaatgtttctgaaggtaagagattgccatgtcccaaaggtatgtatataggaaaagtccaaagcttggtattcaggaagcttccattaagccttgttactcaaagtttggtccacagcctagcagcacaagcatcccctggaatcttgtacttaaaggcactcacgctagtttactgagtaagattctgcagtcaccaggattgcagggtagtttgagagcacattgagtttgagaagcactgttcctaagggcactaaatagcagtagggtttggtgaactgcttttgacggataacgagaacttcaagattatgaggagatgagcggtgaaaagattctataaagga

SEQ ID NO: 54787 - DNA, 768 bp, Bovine  19866880810659
acacacacagtcacacacagacacaaacacacttcatccacacttggaactccttttgaagattaaataaggttgctatgaaaaactctagtgaagttaagactttcacattttatttttgaagagagcactccagaacaatcagggcaagctcagagattaactgcagtccttcacttagtgagtcttctttatcatgcaaaaagcagttcttccacttcctttggagactagcaggtatgtttggtaataaaaatctactttgcatgttcctcttgcataagtgtattgctgtaagccaatctgatttgaaggacagaaatctgctcaagttatgaatgaactcaataaattggaatactcttacctgagagaaaacggaaatcccaatgttgagtgcatatttgaatctgactggtctcctgggaatagtgtgttttatttctatgtcttcaagttaaaactatctgacacttgaatctttattcccagggcctcttaggtctcctacaattttcatgcaaaaaatgattcagcaacactcattgcatacttgctgggtacaaggcactgtggtaggccttgggcgaaagagaaaaatcagaaatagaaagttgaataagatatggttcctgctttaaaggactttaaaatctcctgggagaagaactaatggttaattctgtcagttagattattgagatattttattgatttaacacactttaacagagaagtgtaaagaaaagtattgtgaagagaaaattt

SEQ ID NO: 54788 - DNA, 3281 bp, Bovine  19866880843882
taatcaccagctacatgtggctaccaggtacttcaagtgtggctagtgtgtctacagaaaacacacagcaactttaatggtttaaggtgtggcccccaacagcagtgaatcaacagtaacctcctactattcaaagtgcttagaacactgcctgatcactgtgttaactattactgacattatcattaccattaaatgtgtttgacttaagcatacaatggataccaattcacagctaaagatgctattcaatacacatatattattattgtggtatatttgaatgttctcaaaatttcccagggacagagaaaaaaagatctgtcttcagtcatacatgaacatacaaaaatgggtcactatggatgttaacagtttcacttagcattaaaaattatcggcaaatgaaaaggttaagcatacaactctctcaaagtaccatactacattgtactgttctttcaatagtgacatagcaagagaatttgcagaggaataagaattctccaaagagcaaatgtgtttaacttagaaattcagcactaacaaactggtttccactttgtgtgtttggaaaaaaagtttagttatggagaataagcaaataagtattcagaaaagaaaagaaaaaggaattagggcatgctttcattttaatcttattagacttgccttggttttttcaaaactggcgtcctcagtcattttcacagcttgcttcacctgcttataagcacttgcttctctttgctgcacctctgtcaagctgttcctcacggaaactagcacagacattaagtcatctctttctctgtcagcacaaaaagaacatcgaaaacaagaaatgatcaaatggtcaagtattcataagtcagggaggaaaaagcactgatatgcattagaagaagagccagggcaggccagcccagcacatgttcaagcacaccccagagaaagaccctctgttgtcacttggtgaggggcaggcaggacagccagaagagcagggagcactcatggcaggactgcatccaggtcgggtaataacctactgtggagaggactggcacactgagggctgcagaggaaagcccagaaaagaagaaattagttaaaaagctaagtgtaggcggcagaaaaggagaaaaaactaacaaagttgtgaacgtgtgaaggtcactcagttgtgtcagactgtgaccctatggatgataccatccatggaattctccaggccagaacactggagtgggtagcctatcccttctgtactggatcttccccacccaggaattgaactggggtctcctgcattgcaggtggattctttaccaactgaactatcagggaaggtgggaattgtacctcaaagtagaagtaaccatggtaagaagggactactgaggttttgtttacactactggctctctgctctactagaaccaacatgttttttttttcttttcgtcttcctttcacaaccctctttttgacacttcttggcttccctggtggctcagatggtaaagcgtttgcctgcaattcaggagactcgggtccaatccctgggtcgggaagattccctggaaaaggaaatagcaacccatcccagtattcttgcctgaaaaatcccatggttggaggagcctggtaggtttagcccacagagtctcaaagagtcggacatgactaagcggcttcacttatgaatgaaaaactttcacctacttatgaaagtattttttctttcaatgggtagtactgttggattactcaaatgccttgattacacataatacttgttattttacaaaatcttacccccctaggtttgatcattgcctaactctgcccccttctcagcaattctcataaagctaagctatttcttggggacagaactgaactgaatgccaaaatgctttggcatgtaaaatagcagcaaggctccaatctcatggattaatttaagcaaactccacataaaagatttcaggatatctggagctcatccactggataaaaatgatcaacagaccccccccaaaagtgaggtgggaaactttctattaacacaaaacaaacaaaaaaagtaagttggactgttacttatgctattccatactttgttaaagagctcaagttttaaactgtgatttcaaattcacttgaagtaactgctgtagcttctttttcattgccaagttctgaactattgctaaacagtcaactgtaaactattaataaagagttcattttaaggagtcctaacttaaaagattaaatctctgagtttgaattactttcaaaattgaccaatgtcttgattaaaaaattttcttaaaaataaaataatttaaactactttgtggcatttggaaaacagtcgtattttaaaaaatatgtaatactgaacaaagttacattattaacagtttcataaaagctctttttgttaaaagaagaataaattgctccaagtatcataaaatttgtgggagctgacttcactttcacttttcactttcatacattggagaaggaaatgggcaacccactccagtgctcttgcttggagaatcccagggacagggaagcctggtgggctgccgtctatggggtcgcacagagtcggacacgactgaagcgacttagcagcagcagcagcagtgatcttcattttagaatttcctgattcacttattttcaactgagaaaaataatttttttgtctaaaggaaatgaaaaaggagtgaattattttgatcaaatataatcaaacacagtaattatgtgaaaaagtggaagaatcaaagcaagattattctggttgagtaaaaaacattaagtaaaatgcaaacaaaatcaatttcatatttatttgcatttcagaaaatgctctaacataaaagggactagcttcattgagaatatgcaacccaactagaacctgtgtttccaagtagaaaataaaaattcactcttaaggataacaggtcaatatcatatagttacctttcctaaagttttagacctactaagaaaccaaagtcactattcaatgatactcttacctattcctaatactataccaccatcaaacctgaagttacaaataaaaagattaacaaaaaacctcagaatatatattaacaaacaggccacaataggatcaagtttctaacaaatttgcttcttacaggagacttacacttaatatatttaaactatttctagtatatcctcttgctaaaagtagtctggcacacagtacatactca

SEQ ID NO: 54789 - DNA, 757 bp, Bovine  19866880845130
aatagatgtatcacttctgggtagaagcagtgaagggcattacaggatccaccagcttccgtgtagctgatttgacaatcatgaaaacaaggaccaggatggagcttccagcagccctgggccagtgggcccctgtttgctccctgcctggccattctgaggctgactcgtattcttactttctctgtgggttctgctagtagagaccaactccttgccctatccctaatatgtgctttccttcacaaatttgtgctgcatggtgctcagaaagcccttttaaaattcaaagagaaagcagaagagaaactgtgaagagtagaagccagaatccttaatgttcatattatagtgagccttagtatcttgcaaggtttaataagtgcctcacttaaaaacaaaacaaaacaaaacaaaacaaaaaactcctcaaagtgtgaattttcacacttaaatagaatttatgttaccagtgaatagtaaataaatatcaagtgcacactttcctcctggagtaaattattcacataaagagcaaagaataaatggattagtgcaaacttggtcacagtggtctaggctcatattatgtaatgtcgtttatgtcccacagagcagatttgtccaagtaattatactccatggagcagatcagtcaagcaccagaagacagagttcaacctaagggaatgaatctttaaaatataccattaaaaaccaaccaactaatccaccaaccaaccaaccaaacaaggag

SEQ ID NO: 54790 - DNA, 1354 bp, Bovine  19866881024440
aaaagaaagatgtacccagagaactgtaatatttcagcctagatgaaaactttgactccataaaaactcatttgtaatttgtccctgatcaatcctcaaatattaacaaatgggatacagtggatctttcttccagcatactcataatattcttcatgacaagcacatattaaagacttgataaaaaaaaaaaaactcactttatactacagcagggaaatatgaaattgggcaaaatcaagagaattcctctcaaactcagtgctgtaatgaatagtgctggatcttcaattacagagtcatagaaatgaacagaattataaaggctatctacttcaatcctctcatttaaagatgagactaaaaccaacaaagataaaattatttgtctgaaatgactagattatacacagttggcagaacctacatattctttctttaatatagctacaatgaagggaccttagaaaatttattttatttgaagcttaacattaatcacatgtgatttagcatggggataaaaaaaactataatgcccatgtaaagatatgggtttccatgtcaccaacaaccccacatacagaagcatacttacttagtcagtctttcaatggtttgtatgtgaacattattatgggtttgggaaagaacagcttcatgctgagcacatttcaaacaaagaccaccaacacggttagaaatattagcagcaagtagagactctttatgctttagtcgctctttaagatcttcacagtttttctgatattcagctaagtctttcctaaaaagaagggaaaaaagctttagcaagtggacatagcaggggaagaagttaggataaactgaaaaaagtagcactaacatatatatactatcgtgtgtaaaatagaaaatagataagatagtggaaagctgctatataacacagggagcccaacctagagctctgtgacaacctagaggggtgggactggggacggggagactcgaaggaaggggagactcaatgtgaatgattcacatagttgggaggcagaaaccaataaaacatagtaaagcaattatcatctgattaaaaatttttttaaatgtccaggtaaaagtatactacttttaaatgtatcatcacagtgataactactatcatttactggtgtttaccttattaggtgctttttatacaataccttattcttaccacaacctggagatatagatgtgattatctgaattgaccctttgaataaagtgagacttgaaaatattaaagttgttttaagattttaacacagactagtgtgcctccgatacggctctcttttcaagggttcccatctcttcccaaaaa

SEQ ID NO: 54791 - DNA, 3436 bp, Bovine  19866881040911
gcagaagccaaacccagtaaaagtgtaaaggcaatttgagaaaatgacatgcagggggaacacttgcaaacagttgtttttccaccaactgaagggggaaagggtggcttgtttagtagattatgttggaaaaaatctactcatggttttgagaatttgaacttggatcactacttaatgctacaaataaaggagaatgctagaaggattaaaaccctaaaattgaaaggggaagttataattttaatataataggagactatctccatgacctagaggcatgaaaggacctttgtaaacaaaattcagaaacaatgccatatgcagaactttcaaaaaataggaatttttgtccagtgaagaatgttgaggactggtaatagaacgagagaaggtgtctccaacatgtaaaaccaatgcatttatgtttagaatacaaaaagtggtggtggcatgcccgtgctcagtcacgtctgactcttggacaccatgaactgtggactgtagcccgcggggcccctctgtcgatgggatttcccaggcacagatactggagagggttgccattttcttctccaagagctcttctcagcccagggatcaaacccacatttcttgtgtctcctgcactggcaggtggattctttaccattgcactacctggaaataagaaagcaactccatcaaatcagcaagcagcgggcagcaaccgcacacactctctcacctagtcaagagcatctctgcggcatggataccttttccctccggtattatcaatgtttccctctcaatggtatcattcccatcagcgtacgcacatccttttgttcactattcagttttaaaaacaccctttcttaaccccacttcaactccccaaattgttgcctggactacttgtttccaattcatcttattctcaattttttatcatgtaatatttcattaatgaaaatacatggtaagttacaaaacattaaaacgtgaacaccaatgaaacctctactccacttgaaaactggaacatctccagcttcactgcaccagcctacatgttcttcctctgtgctgtcactctgccctttcgcccccaaatggagaagccacgtccttaaattttgtgtgcattattttattttactttataaacttttatcatatgtatctgtattcttaagcaaaacatactaaaatctgggggagatcatgtttcccttagttttccctccatatttcgacacattccaaatttaacaggtgcagatggaaactcctgacctcgcacctcccacagtcttcgcagtctcacagtatcatccttctagtggctcggacaaaattattttagtcacttctgactcctctctttctcttgtagcacctatccaatctatccgtaaagtctgttggttctaccttcaaaatgcatacagactccgactgcttcccgtcgctactcctttcacccaggtgcaagccactgtcgtctttcatcctgacgactgaaaggtccacgtatctgtgtccttgcttttgcccttgcccccatctccacccacagtctattcacagcatagcaaccagagcgattatttggaaatccacgtcagatcacattactcttcagctgaacagtctgcagcagcttctgtgtcaggtggagtgagcatctacaaggcacaccacgctccgggcagccccccagacttcacactgggctgtccatttcctttcccacagtcttcctcgggtccactcccacctacttccatcaacaagtcagaatcctcctgtcccagggccttggtcctctatctgggatgaaactcttttctgagaatatcccctttccaaattccctcctttacttcttaaatatcatctagtcagtgagactttccctaacactctacttaaaatagcgtttgaacaccattagcactttttatcctgctttcctgctttttttccactacaactcatcacattctgataggtatgttctgtttgtttgtttactctctattttcactaaaatacaagctccatgaaggcaagagtttctgtctgtattgttcagtgctctgtccccagcaatgcctagaacatactacatctcaataaatatttactgaatgactaaatggaaggataaataagtgaatgaataaatgaatgcaaatgatttttcatttacctcactttcaccagctacaatgatcctactcccaactccacatcttaccaccccccacctaaacctaatcaaactccaggccaaagcaaactggtggttagcccctacccagtgacttctagatggtaattacagattctctcttttcctcctttcagacccaccagaggcatcccacacagctttgcctatttctcctttagcaatcccaaagtctgtcagagcactgaaagctttaaaatgcattcttccacaactgaaggcagaatgctatttctctggaagtcattacctatttgtcttccaccactgacataagcccattgtccattttaaggatattaaagcctaaagcctaacagcctgtgagcaaaacatacaattttttcagttttaagaggtggcatatttgggtttaaattacacttagaaaaataaaacgcaatagaccagattccacttactctatatccttcctctttcttggaaaatcttagatcagatcagaaaaacctaaattacatgaaatttacaaaattagctgcctcatgaataaatggatttattattcaagatgttggggagtacattttattactcagtatccttggaacaaaatatttgaaatgtgagatgaaatattttcaagctgcttcactaaattaaggcagaccaaaaagaacatctgcacattaacataaaacattcatcaggaggtctgtcacaaggtagaagaaaacggcccccaatttttttttctaataatttccattaaatgtgtggctcgtgaccatttctactctactgcattctggaacttacttcaggtaatggaagctatatccaaagagctcataaactattcactacaaagaaatagaaacttccagaagttttcttaatgatcaagaagatatgaatgaccaaataacctaaaaatcaattcggttcctttcatgcatagctcaagaactgaagttcaatatttgtagaactcacgaacttttaacaaatgtagcaaatgaggaacaatgttttcaattttcaattaaactgttcaattcaaattttcaggcttatctctgagttcccctcatcttctccctctgagtctgtttctgatgtactgtttcatcaaggtcaaatcccaaatgctagtcacctgcctcttaatatttttaataaatgttggacccttaggttcttaaaggaaatgcaacatacatttttctaagt

SEQ ID NO: 54792 - DNA, 1225 bp, Bovine  19866881047660
ctctgtacatcagttcagttagttgctcagttttgtctgactgtttgcaaccccgtggactgcagcatgccaggcttccctctccatcaccaactcccggaccccactcaaacttacgtccattgcgtcggtgacatgtacatgctggactgaaaactgaaaatgatacctcctccccattttggatggttcctttgcttttagtataccaaggataacataataacccaatagtaaatggttgttgagttcatattcagtggttctcagattatttcttcatgtggctatactgttatttcctttgggtgcaaatttccaaaggcttatagttcatctctgagccactttcatctatagataactcactaagctctaagagaaagagtgtgtgtgtgtactttaaaagagactcaagagcaattttcagaaatctgtttgccattctaattcctttttttttttttttttttactttctctttctctcttagagctctcccatgagttttagagcccatattctaagcgaggataattttatattcaggaacatatcacatgaaagatgaaaagcctgtatggtaatttttcttgcaatgaggtacataacacatgaagttatcattcacatgatttccatataagagtttcatattatttttaaaaaagtattgtcatttgatacattcaacaaagtcagctgatttaaattctcaaaagtagaacgtgtgactttggtagaaaagaatgttttaaaattgtggcagctttcctctttaaaaagtgatgccaaatttctattggatagtaacagtttaaatctcatttaatctagttttactttggtattttcctatatttacaatcttattaaagtatttagccaaaaatcagtgttttggtatttattctggcattttcttgcatgtttgttttttttaacttaaaattttttctttcagtctcgtagtgtggataagcaacatgctgtaatcaattatgatgcgtctactgatgaacatttggtgaaagatttaggcagtctaaatggggtaagttaagagttttctttttatcttatttgactttttgtttaatattgtaagaaaacagataaaaacacaaaatcccgtttgtgttttatttccttttctttagtgtgcacctacttttaagtgcttactgggtacatagcactttgaggaccttagctagaatataat

SEQ ID NO: 54793 - DNA, 1191 bp, Bovine  19866881297091
cttgctgtgtgatgctgtccaagttaagccctcttgggcttacggtcttcatgttgttcggagttctcagctttccctactcgtttccttatagcttcccctggagtccccaaactgtgcctttttagctagaaattttaaaaaccagcaggaaagcttccctgcaggaaaaggggcctcagagagaagcaattacagtctttgattatgaaagaacactcttaagggaatgatgtttaaatattccagccctgtctccttttgccttttctacaagaagggttttgatcaatagcagaagtacagaggcccagccagctaggaggcttggctccagttcagctccatgtcccagagagatggacggctgctttactttcagctctgccttggtgttataacatttaaaggaatatttccactaccttcaaaatgtttaggtccacaagccagttacgaaaatgtaatctggacttaatacagagttgtcaccttaccctggagatgatattgctgagggacttcacagtgccaaccacacaatgaatttcccaggcacctggctagggtatgcagtgaacagtccttggcagggaactttgtacaaatttgcaaactctttgtacagggttaaaaacaagccctgactggaaaagatatgaccttcctgaatagctagggatctccatttcgtgttctctgtagggaaagtgatgataatgatcttgactctctctcattgtgggtgagtgtttttactggcttgagtatcattttctacctacgtgttcattcatcaaaaattttctgtgttccttctctattccagctctttattgggtcgacagtgtaaaagtgacaatatgacaaagtctctgcttttttacgggtatcacttattagcagaaaaatctgttggaccatttaagtgcaataatagagctatggtctggtgttagctagtcctgactgctcgtgatctcagggaatattggctttaccactcctccttttgctctagttttatgggatgtgtgtgcatgctcagtcactttagtagtttctgactctttgcaaccctatggactgtagttcactaggctcctctgtccatgggattctccaggcaagaatacgcgagtgggtagccattcccttctccaggggatcttctgaacccagggattgaac

SEQ ID NO: 54794 - DNA, 1070 bp, Bovine  19866881305861
ccccagtttgagttccctgagtcatatggcagatttccattggctacctattttacacatgtaatgtacatgcttctatgctactttcccccactcatctcacccttctccttccccacctctgtccttgttcataagtcttatatctgtgtctccattgctgccctgcaaataggttcatcagtaccgaggctgaggattattaaagtgcttacaacacttggaacccagcacatatgtcctcaatatttataaaatattatttatatccatgcatttctttttctttcaaataacttaacatttatatagaatggattcagttatttgcatttcctttaagtttgtaaataaagccaaaaaaaagcaatgagaggtcacagcccaagccaggctgacttatttggtataacatctagcaagccctgacatgctccggattctaatgaggtcaaggagacggtttttcataatgtcttttctcttggataagtgagagaactgatcacatttgcatgatgagaaacaagactggcttccttttcatcatagaagggatttagtgaaaatccaacctatagattcactcttcttataatcaaagactggtttttcaacccacagttctctgcacagagctctcactaaaacgaaaggtgaactatggttccctttgcaaaagctggccagttaggacaccttccctacaaaagtgttaccatatcagtgtttgcagttaagaagagttcagttagacccaagcatttatttgaatatacagtggggtaatttttccaactctccaaataataactaatcaccatagccagaggatggcctggatgcaaacatgccaacaatctgcagtcactttcttggttcccaccgtcccttccccctactccatagggaagttcgctcctttggaggtctttatactttcatcaggttgtgctactgcatttaagtgatcggagcccctgactggctccttgtcttctccctaaatactgtacacaaccatcaccatgcttacgtgtatgctcatgcttaagacctgtggcaaggga

SEQ ID NO: 54795 - DNA, 1026 bp, Bovine  19866881416495
tgtttgaaaatgaagaaagaagcagacatataactggaagaaatatctattaatggaaaaaggagatttgaacttcttcattttaaaataccttaagaaaattgcaaaacaaaatgaaacaatgtgaagtattctgaagaagaaagctgaatataaatgaaagttaacctgagagatattttatgcattttctgtccttgctccagtttggtggagtgacttgaaatcatgatccagtaacatttttgttgaactaagtgatatctttatgcagatgtgaaaggtggatataaaagtgattaattgtggggaggaggtggggcgactcccttggtggttccgttggtaaagaatccacctacaatgcagaagacccaggtttgatctatggaacaggaagatctcctggagtaggaaatagccatccactccagtattcttggctgggaaatcccatggacagaggacactggtgggctacagtccgtggggtcacaagagttggacatgacttagaggctaacccaccaccacccattgtgtgtgtctgtgtgtgttcatgtgtgtgactgaggattggagttaaattttattaccaggaatcttctttttaaacatgttaataccctttggaggagtataatgttgaattctggccaccaaatcattgtgtgacactgtgaatataactatcccacaaaatgtcattaaatgtgaggatttaagccaaaaggatccaaaatattaactagaaaacaaacatttgggcttcctatcatttactcattatagtctgtatagtctagatattcttttggagcatttatcattccagttaactaataacaaatcaccacattctgatccaagaatatagaagatgaaaatgatggtgaaaattatttttctaaggaatgtaatggttatggcattgaatcattattatccacccagtgaatagtaatgctattcttatcttctgatttatgaattttctaaatctgtgggttggaatgaaaataataa

SEQ ID NO: 54796 - DNA, 1293 bp, Bovine  19866881538442
ctgagaagagttgactcttggaaaagactctcatgctgagagggattgggggcaggaggaaaaggggatgacggaggatgagatggctggatggcatcaccgactccatggacgtgagtttgggtgaactccgggaattggtgatggacagggagacctggcatgctgtgattcatggggtcgcaaagagtcggacactactgagcgaccgaactaaactgaactgtaaagggcccctaaaaaaggtaaacaaaaagcttaaatagcactggttatgagcatccaataggattctatgctaattaggtgagggatattcaatgaatatgaaatgggcttttccctcatacacacacaccagacaagatatatacaacaatccacagacaagacagcatgttctaagcattatcatacaggagtagatgagtgagcaaaacagaataaatgcaggttttgcataaaggaggggaatagatgagagccatttcactgtccttgaatttcaagccgcagctttgcaaaattgaatttaaaaaaaaacagaaaacctcttttgttcttgcgcataaagcaaatcccaaactacctactacagtgactaacgatgcctgagctggggatgtgtttttgagccatctgtgaagacacacttcttgcacttgtttccagtgggatttacagggaggagagctgcttgttgagcttcaaagagattgtgtgacattaggctttcctttactgataactgcctctcggtcaaataaacctcgattgtgggtcccctgtggcctcaaaatcatcacttgctgttgacctttcttgtgtctctctccaagggcagtttgtttaactctaggaagccaaatacaattatggtattttttccccctttttctctttacagatattcttaaagcattggtaaattccaatttatctgttttggccatgtcatcccaagattctgatcttttgtctctattatttccaaggtttttgtgtaagaaactttaaagattagagccaagtcgcattgctgaagactgccaaagtgttatatgctaataggataatgagtctctgagtttacagtatgttccctacatggggcttccctggtggcccagacagtaaagaatttgcttgcaatgcaggagacccaggtttgatccctgggtttgaaagatcccttggagcaggaaatagctacctactccaggattcttgcctggagaattccatggacaggggagcctgacaggctacagtccatgaggttgcagagagtca

SEQ ID NO: 54797 - DNA, 1118 bp, Bovine  19866881730747
cattgcaagcagattctttcatctgagccaccaaggaataactccccaatttgatgctaattagctatttaaacatgcagaaggtgggtgaaatgggggaatagcagggaaattggacctgcctcaacagcagcaacacacaggaatacaaaatacctcagagagttggggaactaaaggtattcctccgtctcgtcacagagcaaaagggtgaaaatattcagacgtctaagtaccaatagtgtggaaaacctatgtttgaaagagcttatctacgaagaaactgtatttttaaaattagctcacattttaccagtcaagttcaaattagcataagtgttcctaccttaggtggatctgatttcaatttaaaggaaaaaaacacctgacattttagttagcctgcacagtctgacaagggtaaacatgtaagttccttcaggactattgagatatgaaaaacagcctggaccccagagtccagggttggaaccagagctttgcaaatcaaacttccatcagcaatagcaaatgttacatagaccccaagccccttgagagagctgagtgcatatggctgacattatttttacctgaaccccttctccaaataccagtggcccgctggggaggtgccaaaataactccttataaaaaagcttaggtcatttttgtcactgtgttcagtgtcagaaatgtaaaagtcctcttccttctgagcgtcttcatcctccttgagactcagggtcaccttctctttcttcccagaataactctgctcaagagttaacagggcagaacggagaaggacatagggttctggctttggctttctttctcacatctttccctccctcccaaagggcaggaatatgtcaaagttgtgacatttctaatgcacctttgactcagcaccttttcttccatgtgttcgttgtggaaacacggcctcagttttgagatcacccatgcttatgtccacacccttggtccctgctgtccgtctcccgcaaccaaggagtgcctcccttgatgctgccacagctctggaaccacgcacatttgtagcattcttgccatattctcttattgaacacctactagacacaaggcactgt

SEQ ID NO: 54798 - DNA, 710 bp, Bovine  19866881883915
tgcatttagaaaatagataattaagctttattttctataaaactaagttaaatttctgtagacttgtagtaaataaagctcaatagaaaaagctttctatggatccaagcaaaaccgtttttcttaagaacaaaggaattagttaccaccagtccattttcagcagttgctgcatcttaatatgctctacttgcaagaaatggatcttgtcagacagtacaaattgatacagcacaggaaaactctctatggactttgacttcagaaattaactctctgaataagacagaatggcaaagcaggcaaaaccagcattaatatttatttattgaagttcagccacactgagacattaaaagctgtcctatttctgtgagttagtagtacttagcacacaaatggttggttctcaatagaagtctgacagagaagaaaaactattacatatcatgatcaagctaaattctgaaacttctaagattaaataaccataggaactatgttaacattatgttctcacttctatagtgaaacactttaaatgggcattaaaagaatggctattattctgcagtattaagcaatttttttctcaataaagtgtttcaactattgggatttttccagatatcacatgtgtataaataatttattttctttctctctttcatttttttcctttctctctttctcctcctttcttctctttt

SEQ ID NO: 54799 - DNA, 727 bp, Bovine  19866882050441
taaggacctgggagctgtttttctcaacatatacatcaagataaacagcaccttttcccacgccctcagtttctgtgagagggtaggatcccgcccttgactagacaccttgctccaagctgcaaagcaatctcctaccataaagatatcagaaatttgttatttctatggataaagccaattggctaatccagatggtcaccccaaccaccaagtaaagttaggatgaactatgtgtgacaaatggtgccttgaagtcctctgacctgaggatttgttatagtttacagtgagaacatgtatatactcggctatatctgcttggctgtctacaaggatgagatttctttgtgtctccacagtctctagcagactgcctctgatgtatccatcacattctggtcttttaatgtttatttggtaatgaaacttttctttctctgctacctttgtggagcagttttccgggtggggagaagattctggtttgaattatatttcccaggagtaggccctctgtcagtctctgaggtcccagatgacagccagcaccaagggtcaaccatgggagtgagccatcctcaacgtccagcctcataaacccatgaataatcgcagtctagccaatatccgaccatgagtacacaatagacttcaagccagagcctcctggctgagctcagtcaatcaaaccaagagcgataacaataaattaagccactacgtt

SEQ ID NO: 54800 - DNA, 1125 bp, Bovine  19866880733307
aagcctgtggtttagaaaaacttctagaacatagtattacatagaggttaagagcatgattagcaatgtcacttgaattccatttctgccactacctagtttgcatggtattaatatagaagctatttattccaactctcagtttctgtagcagtaaaataaaaatgatgcatacctaaaatgattgttgtaaggtctgaataagagaattatgtgaactaccagcacatagctacttttatgatgatgatgatatgatggaattcttatgtttagttttgccaaataaaaaacatacttttatctgttcacctttttggataccagagatatagaattatattagttggcgtctctgccctcaggggggtcaaatagttaccggcttctctactgagtgaagagaaatcatatttgggatattttatgtttcctgattctaggtgtaggtagtaatagtgttcaagctgaagcccacctttctgactttcttggcaataatcagcagtattgacttttttggaattgaagtataagatgagtaaataaaagagattaagggggaaattattatgctgtggcatttggccaagatagagtaacagggaccagatttaccctcttgcctgaaacaaccaaaaatctggacagtaacaaaaagtacaacatatgaaacaatggttctgaagacattggacctcagaaaatggatgggatagtcattcttgagagacagaaagcaaatgaattgagctttatgattgccctcacacaccacctagagaaagcacagaggccgtggaacagggagagggaatccaggcagagcccaatggtatccctgaattgagtagatgaagctggggatccagggatgccagtgcagctcaagttttcagggcagagtagcagagaagagagagctcactgaggttcctctcttgagtattcagttgaatactggtcagtccattcatgtgaaaaaactgtccaggttaagaaccactcagaaggattaaagggaacaataagcaaagtttacacagggccaggaatagtgcttattgccatcaaccagagaggaaagtcttataatttataagcaccaggtaagatactgggctt

SEQ ID NO: 54801 - DNA, 722 bp, Bovine  19866880836236
gaaaagactctgatgctgggagggattgggggcaggaggagaaggggacaacagaggatgagatggctggatggcatcactgactcgatggacgtgagtgtgagtgaactccgggagctggtgatggacagggaggcctggcgtgatgcgattcatggggtcgcaaagagtcggatacgactgagcgactgaactgaactgaactgaaggctaaaaaggataaagctaacccattcaagatgaaggaaatggcaacccactccagtattcttacctggagaatcccatggacagaggagcctggcgtgggatcgcaagagtcggacacaacttagcaactaacccaccaacctgttcaaggtcaatcaaccagtaagtggcagagatgaaactcaaatctaggtctagtttgatgccaaagctgttattttagccacttttccgtaacgcgctcctaataggaatgttgcttggatcactggttacggccatcattcagagagatactgaaactggagttttcttaacacattcttaagcctgtaaaaacatttaaacttcatttcagtggagaaatatctatttgagaaataatctgattaaattcatcagataattaaaccaagagagactataatcttaatatttttgtaaagaacaaacagacccatttttcagttaactgatagaagaggaaagagcgtaaataaagcgtattcttc

SEQ ID NO: 54802 - DNA, 1308 bp, Bovine  19866880850776
tcaatcatagtctgctcaaactttttttttttaatatttttaagcttcgagattcaccagaccagtttcaagaatattataggcaaagattgcgctatcaccagcacttagaacagaaggagcaccagcgaccagatataccagcagatgctgcttgaaggaggtgtgaatcaggaggatggtcctgatcagcagcagaatcttactgaacaattccttaataggtcggtcttttagtcacttttttatatatgaggaattatttaaaagctattaagagcatgcagtaaccgctactttctgtgtatagtttgaaattttaaggctttttaagtatttcaagtagtgtagagttacataatctcttcagtcacagaagtctgagggctcatccagttttgtccactttctgttaaatggtctctcacatctgagcaaagggagctgtgagcatggtggtttcagcatacaggctgaaagtggactgcttctggatctggccatgtcccagggtagctgaagacttacgggaaattactgtcttcagattgcttgtttcctcatctatttcacagggttgccatgaagattaaacgaattaacctacataaagtatttagaacagtacctggcatagagtaaacactatattaagtggtagctgttattttattcttatcttgagagcttaaactttcagattttattgaattcagaatattaaaatgattctttcttattaatttcttctaaaatgtatgaacttactatttttgactataggaggtaaatacatggtaacatttttttttttttagaaatctgtaaaccagaatatgtgtacttaattgagctagagttgttggaagattgagttaacatatattaaaaaaatacttagaataatttctagcatataggaggcatgccataaatgttggctgtcatcatgatttggagtaggagatggcaacccactccagcattcttgcctggagaattccatggacagaggaacctggtgggctattatagtccatggggttacaaaagacacgactgagcacacacacatgcatgcatcaccatgattataattgggcagtgcagtggtgactatcctttcttggttcagtaatattggaagtaatctgcttgacattctgtgtgttattgcaagtcagtgagcctgaaactgatcctgtcttcagaccttcacacaaggaacatttatagtggtatctagagtctaggtagtcctctgaacattcaatttgaagattattttcttatcacctctgatcaagt

SEQ ID NO: 54803 - DNA, 2789 bp, Bovine  19866881184406
gttccgatctttagaaaagttagtcaggtcctcaacaaggagtgagctgagtttttttgttttttgtttttaatatgtgtgctctttcccctcttatcaaacagccaaatgggtctttctccttccttcccctcctcctcctcactcccctcctttcttccaccaatatttcataattgtgataaatgtcattaaagagatacgagagggagagagtaaagagataaagtaggtgattacatagttaatcccactaggggactataagtagaaaaattatgggagaccctgtaagttaatgattactcgagagaggcacacacaaccaagcaggcttgctaagcaacaaaacgaggcagcagaggcacaagacgtgcccccaaacaatgaaaagatggtggcatgagaggcacatcccgctcagtgagctcgctaagttaatgatccctaggacatgccctctgaacacataaacaatttgtggacctagctggaccatgaagagacaagaaaactctcctgctcaacctggaggaggagctgataatggaagcatgatgtctactcaagaaagagtttttctccccctccctacttttccttggattgtgaaaaagactgcttctaagcctcacaagcatccaattctaatagatcacttcctattgatcactttacctctcactgaattttatccacactgagaactaaaggactaccgtaccagagctcttgggagccaccgaaacaccacccaaatggtttcacacagagtgctctgaaggctcatatcacgtgaaccagaactactacaggacatgagggaaggttctggaggaagaggaatgctaagagaccagtaagaaatatgcaggtagaaaaacctactgtatagcacagggaacactgatcaatattctgtaataatctaaatggggaaagaatttgaatgtatatgtataactgagtctctttgctgtatacctgaaactaacatacattgttaatcaactatgctccagtactgaataaagattcgaaagagggaaggtgggacagacactttttaagtagagtgaacagcacgaagggaagtccccaaggtggagaggaagcggggctgttggaggagcagaagaaatgacgtgcagggggtacgagggcagagtggacctcagcagtcttcgaggcaaaccggggccaaggaaagtgagtgcttgaagctgggggagaggatcctgtccttcactgaatcatttcactctgacccgaagcactaaggaagaggagtattttcagtcttcaccaataaaacacttttttacctttggagtagtgtttcttaacgaaggccctatcggtactggatgtgactgatctaggtacaagactgctctgtccctttctttcagactggtctccaggtaataagggcttccctggtggctcagacggtaaagcgtctgccagtactgcgggagacccggctttgatccctgggttgggaaagatcccctggagaaggaaatgacaacccactccagtactcttgcctggaaaattccatggacggaggagcctggtaggctacagtccatggggttgcaaagagtcggacacgactgagcgacttcacttttccagataataaatgccagcagcaacttcttcccccctagcccaggcactatgatgacctaaaataccccacacatttctgaaacctcctgagtggttctgcctctcactgagaaaatttttctctaatttgggctgcaagaatcattgccaccaacttcatgacttctttatcctttcctctctcaacatccaaactcctcttctgctagatgtcctttctacagacattctaatggtgctgatgtttgtctctatgacatattgggagtgtttttttaaaaagttatttatttatttggctctgccaggtcttagttgcagcatgtgggatctttagttgtggcatgcagaacccttagttccctgaccaaggacggaatccaggccccctgcattgcaagtatggaatcttagccactgaatcacaggggaagtctcctgggggcattttaatttcatgtagtaactgtggagtctgttatatatcaaggttgggagtacagatagggtagtgacagagaaagcttacacaagggacagaggagacagaggaggaagtgatgacctctcctggcccacgaggccagggaggatgaacattttacaggttgaggaggcagcagcacattttatggagacataatatacccagtgagcttggcagctgtaaagagcttggcattgttgaagcatgaatttcaagttgaggtgtggcaggaagaccggttggagagaagggcagccaccgttcaccaagggcctcacatgtcatgattaggagctgagagaacatgcaaaataaattcctaaatgtggtatacttacaaattttcaatcatcctgaaatgacatctgaatgagatgtttacgttttctagggacttccctgccagactccacacttccaatgcggggaatacaggttcaatccccagttggggacataagattccacatgccatacatcgtgaccaaaaaataataaaaaataaaaaataaaatacagcttccagaaaatctgttcattcactcattcactcattaaactttttaaaaaaactttctaaagagctatatagataaggtcatgtcagtgtgacacagtttctctctgactctataacctcatttatgaagttcctgtgtgc

SEQ ID NO: 54804 - DNA, 838 bp, Bovine  19866881191907
tgaaggaatttaagaatttaaagtaaatttaaagtaagaatttactcaataaaacaccaagtatttagtttatattgttccgattttttaatattttgcaggggcaaagaagtaggtcaatgcaatttataaagtttctttctcatataaatgtatttaaattccagaaaaacctaccagttccatggaatgttgtgccaacaacacgaacacagcttggtactcgaagatcccagaatctaacagtcttatcttgggaaccagatgcaatcatccagccactccaagtataaagtgctaaaatatgccctataaaagatcacagagtcagttattactgtgggacagtactttgctataacacattcaaagctaagtattctttattgttgagaatgtttataatctagttactcaaactgtgtggtagagattttccacatatatcaaatatattggcaattttcaaaaaattaaattcagtaaaacttgtatcaaaatcataaaccttttgtgatgagtcaaatatttcaggacatcataattagtactgaaaaaaaaaaaagtaccatttgaaattatggcaaattttccaaagaggaaacacaggattgcagggttacatcaccagctttggacgggagagacctggggagatacctctgttctgtcatgatcagccgtaagataatgagcaagtcattttgccttttcaaattttgcttttttcacgtataaaaatggagacaggaacttcaggcttataaggttgttgtgagggttaaattaaggaattatgtgtataagtaaaggctttagcaaacaggaaaatgtcagc

SEQ ID NO: 54805 - DNA, 1086 bp, Bovine  19866881259808
tgaaggtgggacaggctgggattatatttggttcaacttttaatgtaattgtttgttttagctacaaagtaattttaatattctctgtggcataaaagtgtataatttaaacaattttagactggactggaattgttgggagtaatattttcccagtgaaaagttgttttttttttttcccgaatttctggaagaatatattggagtttttttttttaagtattgtttttattaactcagatgcttttttactttttattttgggcaccttcatctggaatcctatttacctaagtattttttcaaaatagggcaaaatttaaactaatgatatattcacgtaaaacctagggcttaagggtagtacttatttatttttttttaatatttttatttacttattaatttgctgagtcaagtcctggttgtgtcatgtgagttgcagctcatagactccagtgctgttaatttgctgagtcgagttttagttatgtcatgagagctgcagcacacagactctccagttgtggcacatgggctcagtagtttctgtgcatgggtttagttgccccacagcatgtgggattttaattcctccaccagggatcgaacccaagtcccctgcattgcaaggcagattcttaaccactggaccaccagggaagtcctgagtagtatttaaatacattcctggatgggttgattcttgagatccttaacaggtctctttatctgtgactaaagatttcaaaataccaccttgaaagtgagtacttatataaggggcaaggtgtgattccttttctctttttattatttcctgctagctgctgtaattggaaccaggctgcatgctgctgtggcaatcgcctgcattgtgatggccttctacgtcctgtttataaaatgaattctgaagcatccatttcatcaaccgccagccaaggggacaaaggtgaagaacctgtcaggagcctgggcgcagcataggaaagctcagctaaaatcatcgaagtccccgggatgacaccacagcatcttcccctgcttacctgtggggaaaactcctcagattacaaacattat

SEQ ID NO: 54806 - DNA, 1740 bp, Bovine  19866881372157
tggccgttctccccgccccctcccatcggagtcctccctttggcttctccgtgtccctaactcctgtttcctgtactactccgcgggttcccccgtcgcgtgcacatctagaacccccagtgcctcttgtgcccacaccccgagtccttggtccctagcctgtattttcacttctctcttctagaagttcgttttggcccttacaagccgtttcgcgaggccactcctggttgagctgttgctgtgaagtgaaagtcgctcagtcgtgtccgactctttgcgaccccatggaatatacagtccatggaattctcccggctagaataatggagtgggtagcctttcccttctccaggggatcttcccaacccagggattgaactcaggtctcccacattgcaggcagagtctttactgtctgagccaccggagaagcccgagctattgctgtagcaccagggaaatgagagaatcctcctcacagccctctgttttctcatactttcggatagtaggcatcttgggaagaccaagaaatcatagagggtttttaaggcccacagtttttttttggggggggggggaaatgtgaatcctaaaaaaaaagttcttattttgttaaaatgccagaaagctttcttttatttgattctaaagtcttgcctgggcgatcccatctggagaccgtagggaaagttgcaagggttgggtactgcgtcttctaaagttgtggcagttgccaccctgtttatctgacctaattttgcaggcctcttcgaacacgattatatagacaacgatttccccattccagcgaaggacaggaaacgaggcctttgtgttctttagagtccatcttactggaaaaaaatgacaaggcctcttacacagtatgattagaggggcataggagagtatttctcaaaaagtaccttttccataagcctttcacctcgtgacttttggctttgcaaaaacttacaggaggaggagattagcaggtaaaggtattgttcatcctaaaaacttggtatatgtattaatttactggactgttgctgtgtgacatctagctgtgagatagttttactggagggagagagggagatagagtggtccagaactgggagatgctggttgtgtcaaatattcttttgaagctttctggacagtcagaggtctaaggttactagacacagtacaggaagggtcatcacctagaggaaaaagtcatctgaactgagaaataaggaagcaattgaacacatagtaattaatgaataaattttagtcaccgttcccccctttgtggtctgattgttttttttttccacttagatgattcattgtgcttaccagacatagctcagtttacatatgtaagaactagaactatgtgttcaaagcttttttctcacacttgttccaccacgatgaagcctcaaaaaaaattttttttggcttgtttgttctcaagaatctgttactctggcagaaatttggtttgtaagtagagtatgatgcatgaagtgtaagacaaaacacaggaaaattagtcatatgatttctaactcttgcagtttccattaagcttttgccttatcatattcattaccaacagatgaagctctgaaagacttggctaaatatctagctcttctttatcacatgagtgatttatagtaagaacacatttcaatctctcagctcaggcaccaaggattcttatacttctctcaa

SEQ ID NO: 54807 - DNA, 741 bp, Bovine  19866881423556
ctgagtgttggaggcaatgatgcaataatccaaaatcttcttacttctctatatgtgtgttgttaagaatgtgcctaaattacagttaggagctttaagtacaagacccaacgatactttgaacccataaatcaatactctctaagtcttcaaacaacacatgttgcagtcaacacgaagtgataagatgacagcagaagcaaaagaaactcacctccatcctgggatctctagacatcaagtagtgagctgcttgaaggatcttgcaatacagacaagcaatcctgttattctaaatcatctttcttctttcttcaatagttgaaagttggctgcaactgaataatagaacaaagtctgagcttcaaaatcatgctgcgtctgggtccctttgactgtaagaaatcagctttgaagactacatgaggagcctctgatgtgatctaagcttgtcatttttcattgtcttttaaaagcattcaaaaatacttagactctgttttaattttcaaactttctctattcctagctcaagatttctatttacccaaagcaaataggagataatctcggaatagtatatcccaggccacgcctgggataggtcaggtagtcatggattttgtatccaatggatggtgtttctagattaaaatattttcaaaggtaatgtgatacaaggctcccactgctgtgactgcattggattatgctctggtagtccttatccactaactctat

SEQ ID NO: 54808 - DNA, 1161 bp, Bovine  19866880350324
agaggactcagtctcatggtgccttttctgtggacaagtcatttttccaaggactaccctgattttggtccagctgttatcaaatgggaaaggcaataggaatatattctaagtctacatttaaaaggaaccgtgttcttcattagaggctggttttaatgtaacatttttgggttgtggtgatacctgcatattctccatgccttctatgccacaggaaagtttttaaaagacagtggatatcacagatacttctatctaatctcacaaaaggttttaggtaggaaagatgctttaacagagagttctgagtagttttaaggcaaggctgcttcaccaatcaattaaatggccaccatgatctgttttattattacaactagggagtgaatgacacatgcagtgacactttttaacttcaaatcggcaagaagaaatttgtgtcaggagtaggagactacccaatatattcgctttgtgatattagttttagtctgagattaattataggagttcaggaaacttagctaagtgaaattaacatttttaacttacaaaaacataaataaggatgctggtttaataccacttcttccatacctttttacttgttatctggcgtgcggaaattccaaacttgtatgttcaaattgattttccttcgcatggcaggcataataagtgccttcctgctcatggtgaatctgataacttcagcagtggcctggtgtattattttttttttttgtcaatggaatgaatagctagttcaagtccacctaattacttgggtggcagtcgggccaaaaaccagtggcagaacccagttttataggggcagaacgaagtatgaactgtgtgcgctcctgcgactctccttggagagaggacattttgtgaattagttgcattttcatgctcccgacaaccaagaggcaaggtgttaaaccattctgatgccctgccttatttatagccatgacccattctttttccccctcttacagttaatagaaagattcatgattcttcatgagttgtctatctagtgtctgacagtcccgactgcctgcgaaagcaagtcactatctataattgatatcctcccgtggaatagggtgctggctgcaattgaagggctttgctgaaagctcttaaatc

SEQ ID NO: 54809 - DNA, 1044 bp, Bovine  19866880352266
tttccatgcagtatttccaaataattagagtaactaaattaactagcaactcccatgtagagaaaataagatcaaaatcttcactcgttcatttgaggttttatgtgcacacaaaaactaatttctgtctcttatcagagaccctgatcacatcctaaattcaattttctcttaggtaaagatatacaatgcaactttagcaaagggatcaaaattagctggaaaatatttaaaatgcaaatttgggaacatggtattaatatgaaaataatgtcttcaccacatcgtaactcttcctggcgtttctacagatgcatcaattctttacagattagatgtgcttcctttatatctacatctctatgatattaagaagaaagtcttgcattttcatgctgctgatgtatagaatttgtgttccaatggcagcaaagatgattatagctgtgttcttctgataaagaaaacttcagcaagcttttcaagatcaaaatttgcagcatatgaaagcatttaaaatccaagtaggtggctaatcatcgtataaaacggtgcatttttgacaccatgcttaaaagatacaaatgaaggagtgcagtgacatacatgccacccagatgaagctagggggctaatacaaacacctctcacattctctgctgttcgatctcacatgcaggagacaggagcccccacagtgtaactgccaaggctctccctgcaggattattctggggggatcagcgtggggaataaaactgttaaaaaataatttgatctttttaagacttttgaacaaatattatatgtattattctttaaatggaaaagaactggttggaggggtgaaatagaagttaagggaatggcagtgagagagcaaacaggtgggcattagttctgatgattatattgtctttattcttctggattccaccagtgatatttttaagcataactagaagcctgacagtggtgactcacaccaagggacacgttcttcgtccttcacatatattccctttccttctttttaaaaagcct

SEQ ID NO: 54810 - DNA, 1214 bp, Bovine  19866880360682
acaaaatattgcagcacaagggaagtgaatattttctgaaaatgcaagaggaaaacatgccttctaactcaatttattatgcaaaccagaggaaaaaagcattctcaataactttgactgaaagtgagaagttatgacctcttgaggctggtggagagacaaatgatgtaaaaaggaaggtatgagtgatacgggaagtttgaaagataattgaaattgcaagcaaaatttaagtccagctgtaagtgttcaaaacctgaattgtcactacataaaaatgaatcattgatgcaaaagaaaaaaacacccaaagttgcaatgctgtctcagaatgtaaaaagaaaaacaaatgtaagaatgcgatgatgcataggtagtcaatactgcaaagaatggcagggctcagaacctaacagaatctatgatcaaacataattgaggaaattttggggggcttaaacaaaggcctaaaaatagagataaaaactaccatgttttatgtaacatgttaaaaagagacccccccccttttttttttatactttgtgctttttttaagcaaagagaaagaaaacaccatacgaagtaactaaataggaaaaactggttatcttcaaagaaacaaaaattgagctagacactgatttctctaaaacttagactagtacaagatgttggaacaaatcttatagaattttaaggaaaagctattgcaaaacaagtacatttttcccagccaatttatcatatgtgtgaaggcaacaaagagacatttggagataaataagagcccagaaaaatataaatttatatctttctttttaaaaattgcttgagtaaagtggtacagccactctggaaaacaatttggcagtttcatataaaacaaagcatgcaattaccatatgatttaacaattggcatgtattcaagaaaaataaaaacttaggttcacataaaacctgaacaccaatgttcatagaaattttatctgtagtatcctcaaactggaaaaaaaaaaaaactagatacacttcaaaagatgaatggttcaactatggtacatctataccatggaatacgactcagcagtgaagagaaacagaccatggatgcatgcaacaacttgtgttaatttctagagaattatgctttgtgaaaagtcaatccccaatggtaattactgtagattccctgttatatacagggcttct

SEQ ID NO: 54811 - DNA, 2209 bp, Bovine  19866880379930
cgatgcacgatactggatgcttggggctggtgcactgagacgacccagagggatggtatggggagggaggagggaggagggttccaggatggggaacacagggtatacctgtggtggattcatttcgatatttggcaaaactaataaaatattgtaaagtttaaaaataaaataaaattaaaaaaaaataaaaaataaaaaaaattaaacaataaaaacttaatgatccccaataaggtacattctcagcaaattatggtaaatccacatggttgaaaatcactaacaatcgtgctttcaaaaaatttaatcatatgaggaaaaagctcaatgatatgtcatcagaaactttatgcacatgatttcaattattcctatgtgtacacacacacacacacatatacatacatatatacacatatgagcacatatacaaaattaccaaaccatgtgaaaaaaattttgcacgtgaactggaaaaaatataccaagaaatgtatgacatttattgctagttaatggcatcaccaataacttttattttctcttctaggtttaacttttttccaaattttctatagtaaattgatttatttcataagtgggaattaagttactaaaataaaaacataattttaaattgaaggcgttacatagaattttatgattaaatcatgcatattccatcaacaaacatagtgagtgtttactatgtgcccagccttattctctgctggtgctagtggtaaagaaccctcccgctaatgcaggtaaacataagaaatgcaggtttgacccctgggtcaggaagatcccttgggcatggcaagcctctccagtattcttgcctagagaatcccatggacggaggagcctggcaggttatggtccatagggttgcaaagagtcagacacgactaagctacttagaatgcactgtattgttctaggtgctggggatacaacagagataaaacagacaaatttttctcccatgaggaactttatatcctagtaatagatcacacaaaaacatctccctcagactctactgccaatacaagtatgttttagggactcaaagtggttaagactgagagaggaatcttattttaatgcagctaactcaggaggagttctctgcctatgtgaacactgctaaactttggaccactcataggtaaatcacacattcacatccaagggctctggtacttgatgccataacagcaattatgagttatttaagtccagattcatcctcttttctaaaactcagaattggtaatcttgattttccaaagcttggcatttcaagtgtatgtatttttatagatgatttgtagaatttctgctgcctggtttgtgcaaattcattagtagtctcagatctgcaaagacatgcctacaaatctgtaaatacagccaatgggggtgaaaatacttattccatcaactcagtgtcatttaaataagttcagttatatccacatttgttcattcacattagattctaaattctgaaagaaagggaccctagaggctactctgaagtttgtacagacactaacttaaacacattaattcttaataagaactctaatgcttcaggatgattaacactgggttactcagtacacagtagcgaactgtgcacattatctgattaacgacttacctagggtggtatataaatgttctcttacaaacttgtctgtacatgctttgatagttgtgctaaaaatcacgtttccagactatttacactaaataaagctgaagctgccaaaaaaaaaaaaagtgttttattcttgcttgaaaggatgtaagtatattcttgatgtatatttttgtataggagtctatattatgatggacacaatacaattatgcatttctctgtttttcttggggatatattcagggaaagagaatatagtcagggatagattatttctacatcaacatatatgttgaatctgtgaagcaatggtttatagtaacatatttcatttgttctatctctttccctttctgagaaaatttggctattcttgcacattcaccattttgtttaattaggatacatgccttattattaggagatccaagaaacatccaaaaatctaaatagaactcagaagactatttcatcatcatttgacttcttaaaaccagtactttaatcttttgtgagcagcaaaatctc

SEQ ID NO: 54812 - DNA, 3295 bp, Bovine  19866880389201
aggtagttggtgagaattctgtgcagtgaaagggatccctatgtattcaagcagctaaaataaccttagtggaacggaggaatggactgggaggtggtaagtattgataaacagggtaaataaatggagtcttggtgatggaggtccaggagtctcgtgtggactttatcttgagggcagagaagaaagaatttaagtgtggaagatagaattgattatgttggaattctgtcaccgtagctctatggtacatcaagttcccttcatatgaaccttcaagttgagagctttctaagatgctgatgtgtgttcacgtgtccggtcacataagttagttcacgtgtctggcgtacttctcaaggtagtgtactgtaagattaaaagatgttttattttttgtgtttgttttttaggtattatttgtgtgaaaagtattggaaacctactacactacaatactatacagttgattgttagttgggtacctaggctaactttgttggacttatgaacaaattggatttatgaacatgctcttagaatggaactcattcatatgaaggggacttactgtatatagtaggttggggaggcaacatagaaaacaggaacacttattgggctctactgcattaactcacatataaactggtggtggcttagactggattggtggcaatggggctgagagaagtggagtgaatcagaggcatattaggttggattcagtagagtttaataggactgtggggatgaagcagggagggtcaaggatattacccagtgctctagtttggatttcttggatacatggtggtaccattcactgagacagtaggaacaggtttggagactatgacaacctccaatttaccaggttaagtttgaggccatccagatgtttggcatcttagaaaggaggcttggtttggaaatgttgatggtcattgagaaggcatgagctcagagaagcagaacaagaaaagatggaatgtaggcgtgaaccccaagggacagaagtgcatggcgcccagatagaggaagaagtctttccaaatacgctttgctgaatgaagacatggcagatgttccgagaatgtaaaccgtgtaactggggccaatccattctaattgtaaatatttatgagtcttgtttccttttcttaattctgtcctaagtttgttatcctcagtttgatgttgtgcaggctagaatatgcctatgatgaggttggtcattactggagcaaatagatggggtgtcagatggagagcttttctgagagtgatttgctgtacagaattactgctggctgggactagggcaaggaactgtcctttatgcattttgaaaagatagaaatcgatattactgtcatgagcaaaaaaagtaaaaaatatctataggaaagactgaggtaatttgctgtgtttgcatttctgatgtgtgcatgctaagtcacttcagttgtgtcagactctgcaaccctagggactgtaacctaccaggctcctctgcccatgggattctccaggcaagaatattggagtgggttgtcatgccctccaccaggagatcttcccaacccagggatcgaacccaagtcttttatggcaggatctttaccactagtgccacctgggaagctggtgagggagggaaaagaatacgtcttccagtatcagaggcggggagactttggctatgtctgttttatttccttaaaattatctgatgcaaatatgagaacctgttagcttgcttacatccaagttgtaggtaacatgaataactacccatagtttttagtccttttctgtacatttggaatatttcataattaagattttaaaaagaaacaaaaataagatgagatggtatatgtgctgactgttgcgtttatttctcagaatccatggaaattactactataagcagtaataactcattataaataaataataaataaatgtttttaaaaattgcacactaaaataaatgggagtgtccagccatgcaaacacatttctgtattcagaaaccgggcctttggtgaacatagatgttcaggtagttctacataaaagtttcaaaacttctgtttcaaaaacaaaaccaaacatcttctgctccttgttccacacaggagaaaatgtcccacggagagcggattcatccttggagaagatttgctgcttaccttttgctaccagtagaattcctgagtaattggagtcaggagttttttttttttttctttccttggagcttctgatcaaagctgtttccatccaaatgaaggcaggatggagctctgggaggccagtgctcagaggccaggaggggggtgggcagctttttcagttcaggagatagaagcttcctccagggatttttaaaaagcccttttgaatgggctcattgtttataagaacagctccttaatggaaaaacaaaaaggcaagagggtctggagcacgctttctgctttcctgtgctggcctcattgtttatttgatttatcaagtctccagtagttgctctgctctgtgaccttccttgagctatttctctagagtatccatttactttatttagaaacataatatttaaaaaacctggagctgagtcaaaaaatcatcacctttttgatctggccggtccctcttcttttgaaactttaaacttgccatgaggtttccaatctctgaatcaacagtgtgtctagggcctggtttctgtgctgagacccaactggaccgaaccagggtcctcaaggagctagaagcaagggacagcggctctgctcagctctataggctggtttacacacacctggagggcacaatgtcagagaattctgtgcgaattggtagactgcaaagacaccagctgaaggtgatgatattagggggaaagcctggtggaggagatggcctctaaggcagacgggaagcatgaggtggtgtggttctgtgaagagatgtcagggaatgcggaatttgtattggcatccctttcttttttaaaattttattaaagtatagttgatttatagtctcttcctattttaatacagctgttgaattcttcctgagccttactttcccacattaaacattctgaacgtctgccatcttttaaagaagttttctttttctaagatattttttcaattagttttttaacatttgtctttccatcttctcattgctctttttttattttcttttacttttaatgataaatattctaactgtaaagtttgaagaccaaagagtagatgtcaaacat

SEQ ID NO: 54813 - DNA, 2459 bp, Bovine  19866880458510
ttgtaggagttgcagttagagagagagtgagggttcctcttatgagaaaagtctggctgttactctgtgacgatacttgtaacatgatctgatggacttgggttgggattagagttaatttcaaaatccaggcaagagatgctaatagcttgtactgggttggaaacagtggaggggcaaaaagtggtatccattctcagattctctcaacaacccagcaaggtgattcttatttttgattctctgaggttacatcctctgatagtttgaaatctcttggtttatagataaagtacccatgaatctcataggttaagaaactcttactgtctgcccctggtagagggtaaaactgggtcttgagccctcattctccccagcccttcccccagtaatctgagaaaagctaaacgctctttgtcttctgcatcattagccaccagcctggatagacttaccgacaaggatggacgggatgagcaaatgaaaagaacaagaagtccatatggttttttctaacagagagaccccttttctcatcacattccaagatgctgaacaaactagatgcaagacttcagaaactatataacagccaattattgagttgggaagcaataattagaaaggaaatgaagaaaatgggcattgggggccttaatgtgaaatctgacattgataaatcaaaggaagccttgaattagagatgtggatatttcaactgattatccaagataactcacatcctccattaacctcgtccatcttgtttggcctttgtgaggacaaagagagtctttgcaaatcgccaggcggcaggatcctgtctcccaaatgtttatccaaaaaagagggtgggggagggaaggggatgaagcagttgaaaaataatttgcttgttaagcagcccggaggaatgttctcctttccaccgagtctggtatatttatgggaaagataataagagtagcttatgatggattttgacagtcaggcaaaagtaaacaatcagcccaggaccgaaagccttagattcacgtacccttgacttttgacgcttatcctaatagttgagtgtaaacaaagtgccacatgagtgcgtggaggagtagaaattgctcagctgccttctctttcccgaaaattccaaagcaaatggtgtttatttgggagactttgtttttctgtctctctctttctcctttttttttttttttcctgagaaggatgccgctagggacagaaggcattttgggacattggtctgatcacgtgtctccagattgttttgattcttgtgatgatgtgatgagagtctaaaggagaccaaagaagtgggaatggaaaagacctgattggattattccactgcagctactccacccttcctggcaggagagggtccctcgacaggagatgtaacacccagcctttgccaaatgtcccagtagtctggaaactctgacgacagacaaggaagttgaactggagccatgagacatctcacaaaaccctgcgggcagagttaaagggttggatttactttggatgagtgtgtttcttgggcgttttataaatactttggtgcttgatttctggtgggttatcttgtgttaagatcacggagaatcctttccggcctttttccagacctgtgtctgcctccctgttctaatatcagccgtttcttttatgaagacgcctgtccaacgccaaggctcacagaaagtgggtctggttttcctagtggtacgtgctcagttgtgtccaggctctttgtgaccccatagactgaaacccaccaggctcttctgtccatgggattttccaggcacgaatactagggtgggttgccgtttccttctccaggggatcttcccaacccagggattgaactgcatctcttacgtctcctgcattggcaggtggattctttatcagtataccacctggggtgacccagcaacgattcaagagtcttggtttctgctcaggtctggaaaccagagccagatttggcagtgagcatggaggcctgagggcttccctcgtagctcagtcattaaagaatctgcctgaaatgcaggagaaagtgaagttgaaagtgaagttgttcagttgtagccaactctttgcaacgccgtggactgtagcctaccaggcttctccatctgtgggattttccaggcaagagtactggagtgggttgacctgggctcaattcctgtgttgggaagatcccctgaagaaggatatggaaactcactccagtgaatggaggcctgaggtcttctagagctaacatattatgctacttggttactatctgttgggtgtttgggagtcttgatcccttatcttcaaaattaaattcacatttcacctcaattagcctcctcaccatcctttccataggcctttcttatctccacttttaatcttaaaaaaaaaactgatca

SEQ ID NO: 54814 - DNA, 1432 bp, Bovine  19866880476892
gggagacagggtggggtcagagattgaacggaggggagccaggggctgtgtacccaccctctgcagggtgtgtactgaggaaaatcagaattctaatgcccttttcatggggtttatgtaaacttatgagaactaggtatctttcctgtggcctgttatttaccttacatcctaatagtctgtgtatcaacaatggaaatttttcatctgttcccaagcaggcgagtggcctgaaaatcattttcagaaattttagaaatgttagtaacccaagtttgtggtgaggagctcaaaccacatctgacattcggatcaaaccatgttttcaaagcacggctgccccttgcatgtctcactggcgttttctaactattcctcgtctttgcagtgtattcttttgtttttggttattgactgttggctttatagatgccatttgttatctatcaccatagtaaatttagaggggaaaatgctttgtcattctatttggcagtgacattgtccccagtcttctcctaagtttaaaaagaaagcaactttttgaaagaggtttgaggattggaagttatgcgattctgataccatggattgtgcttcatctgattgcttctaaactataatggtctaacatttcctctgcaggagcattaatctatgtatgtggtgtgtgtgtgtgtgcacacccacacttgtgtctctcaatgtgtgaaaattagaccctggaaagatgtactgatttttaagcatttagatattaacatcagaactccttcaagggtagttctgcagccttgatcatctttcaagacaccatagccatttggctagaaggccttggttccaggtcttgccagactgccatgcgatgagatagaggatctttggagaacaaacaaaacttgtcttggcctgtgagttcagtaacgcagtcctcccacatcccctggctttaggatccgtgagattgactccagccctgaggtctcagggcggttcctgggatgggtaccagagttgggaaaaatcccaccccatgagtttggtcctgccctgtgcctacccgcttatgtccagtggtttgacttcccttcctgccctgacctagtgctcccaatcacattttcttttcttcaaaaaatgtttctctgtgaagttagttattttcctttgaatatagttagttattttcctttgtatatgtttactgcctgtctccacaccaggatctgagagtcaagaacccctcggtcttctccatgttggtatctctgcttggactggtggccagcacaggatgggacctcagtaaatgcgtgttgaatgaatgagtgggtgtaaaaatgaccttaaaccatagctggagggatctaggagaattttcatttcttttagaggagacattcctgcagagatcttcaggttttgatgg

SEQ ID NO: 54815 - DNA, 3425 bp, Bovine  19866880477553
acagttctaattatttattcttcgggcatctggggtggtcagctctgctggggtcactcacattcataagtgggtgactgggataactgatctctgctccctaagcctcagcctccagcagtctagactgggtgtgttatctgagtgaaggcaagtgcagcagaaatcctcatagcttctgcagaactaggctcagcactgtcccattgtcaagtccaataaatgctgttagtcaaggaaggtctcaaggtcagcccatttttaagaccctgagaaataaactctaagaagaacagaaatttaaaaaggggggtatatatatatatatatatatgtatatatatgtatagatgattcacttttctatacagtagaagctagcacattataaagctactgtattccaataaaaattcaaaaagaaaaaaaagaacagtgaagtcacaagacgcaatggatggatggatacagggagagttgaagtattggtattattatcagtgtgacctaccaaattctgtgcatgcctgtcctcttttgccttggagttcttagaaactgaaagtgttagtcactcagttgtgtcccactcttttgtgaccccatggactgtaacccaccaggctcttctatccatcgccttctccaggcaagaatactggaatgggtagccattcccttcgctagggaatcttgccaacccagggatagaacctgggtctctcacactgcgggcagattctttaccatctgagccaccaagtaagttttttaattgtgtcttattcaccttttggtctgccaattcctaggactgcccttgtatgtagacggtgcttgataagtaaccttgtgtaggtttgtgtaggactgtacccagaataagctctgacactccaatggcattttaaactttttcttataacaatcacatcagtactagagatgcttccttgttctctacgcacacctactttggcattgctttggacgttttcccatgttgcgtctaggtctggattctctatatttatctactcagagtccaatatggcttttcatgcacctgcttgttttgagaaaatatttaacagttttctctatttcttctccatcattctctctagtctctccttctggaatgcttgtgggatataggtcaaatttctctcattttagccttggtgtcccttaacttcttcccaaatatatatcatgtcataatctttctttttttctctctgtcttaagctctgtctagtttgtttgttgttgttattattattacgtctctcttcaatcgtgtctagtaattgacttaacaaagtacttcacagttcttgttgaatcttagaatcacctggcagactacaaaaaaaatgtatcaacgcccagtcctgcccccaaagtttctggtccaattggtgtgcgtcagggcatgaacatcaatagttttaaagctcaaaggtgattatgatgtataaccagagttaagaattgttgatgaaaatgtttcatggaagtttttctgtgaccatattttccacgtccagcattttaacaacttctactttttctttaaatccacttgatcttatttcataacccctgttcttgtttagcaggtgcaatttttttccttagaacattttaaatattcataatttgagtctctttcacattgttacattatttgtagctcctaaaatgtaaattcctccagcggctgcctctggcaactgtctgtcataatactgaacttcctcaaaagctttgtaatttttgactataagttcatcttgcattgtgtgccttgggatgtggggacctctaatggtctatttgcttatgcctggtcacatggatttcactggctccaagtcaatttttatgtaactgtatctttggatttatactgcccagacctacagctcaaatttagggattgtatcttgtcacccaaaagcttagtgttctgagctcaagtaagtgacatattttacattcattacctagtgtggaaggctaatttacagtctagaggataaaggtatctgggtttttattgtgaacttgcagtatcttcccggattccaattcacatagagagcccagttcgggctccttggctggccttcctgatggacttccctatgtccaattcctgggtatttttataccagagaactttaatgccacaaacaaacacatggcagggactcttaccagttgtgtgacctcatgcaagttacataactgctctgagcctcagtttccctttctgtaaattgaagatatatatctcatggggttaaaaggattacttaagacaaggaatataagatatctaagatatcttccatagaattgatatgagtgatcaataagtagtttataaaatattctgcttaataatgccttttactttctcaaattgttaaatataacattttttccttagtttctgcatctgtacgtactgtttttgtttttctcattcatccaggtgggaacccaactccgtcaccaatttcatgaaattgtcctcacactaaatattttgtgacattgttaatattattcaccttttctattcctactctattctatttccttcatttagagaaaccaggaaacccatactatttgtgatgtgcatggaggttctagctacacaagggtccttgctagtctttgctattgcgtcttcttctgaagctgctattgctgtgtggctctacccaggccccgccccccttaatccccgttcctactgctattctgtgatttcaagacatgtttcagaatttgcttctcacttactatccccagctctgctaacatcttctattgttcctcagcccacacagagcaatcatgccccagaggtgactggacttcaccaaaaagtaatgactcctttagacaaataaaacttaagctcattagttttatatgttcacctaactccatgccatgttacctgctactggggcttccaaagaatgtcctctatccacctttgactctctgagacctgagtctaaggccccttgagcagcaccctctgggaaattccataccccatgaatgcatggagtgggtgcaggcctgctcagataaggctccatttgccaagtaagtgaagttcttgggatctttttttgaaaatgttttctttaaatcttcctgaggcctggggccctatttagatgaacctcagttacctgattatgaccttcctctgctcttttctctaaagggctggtgtgtttagttctatcaggactgttgactcatggtctggtcccaagatgccacagaaagatggatgtcatatcaagctctagtgcagctctacttcccggtgcctatcagtcatgtgagcttctttggaaaatctttccttttcataacaacaaaaa

SEQ ID NO: 54816 - DNA, 2577 bp, Bovine  19866880558697
agtgagctcttgactcatactacgctggatttcctgtacaggtaatataaattatacataaaagttaatgagctcaccattagtacttattttaattgctagcattgcaatatcagtattctccattatttttattagaaatacaaaatatttcagcaatgttatgggttaagtagacttttataaggtagcgtggagattaaattgccatttataatattatttctgaaaatgtgttctgaattttaaacatcctaactaaaaatgttttgagtggtaacacgtttcaagttggggctatctgctgaaattagcaatactgggtaatgttgattcttggttctttaaccaaagaagggcttttctgtttgtttggttggtactttttgaagacagttatagaaaaggtcacaccaggttctctgagaactatccttatttttggaaaggttggtcataggatatgcagtcaaaactgcttaccccaaatgctcaccctggtctgatgacaccccaagtgatttcaagctcttgaaaaggggaaactaaacacagagttataaggacaagattagaaacacaagagacctttacccccagtttccacacatgttcacatactcatggcaaggagtctcctcctccccacggtggctcccactagccctgcccacttagtgcgacatcacaagccctgggactctggtaacagaactgccagagtttgactcccaagttcataacttactaactgcaactttggcaaattaatattacttcatatttgtttatctataaaatgaggctgatagtaactatttgtgggattccctctggggattaaataatatttatgttcactttcatgcattggagaagaaaatggcaacccactccagtgttcttgtctggaggatcccagggatgggggagcctggtgggctgccgtctatggggtcgcacagagtcggacaggactgaagcgacttagcagcagcagcagcagcatgttaaattttatattaaatataaatatcaagaaattggtatatagctattactaatcattattcttatcttttctattgtagtttatggtcagcttgaagacagatgtcctacaaatagaagcgatagagaggtggattgtcaccaaagccctgacgaggggaagttggggaagaggcagaggagagaggagactggaaggggacccccacacccttgctcatggcaaatcaagtctcaaccgaatgtgggattcccattagtgaggattcccagattcaggtttcattaataatttctgctctgaggatgtgctgatgggaaacagaaatatctttattccacctggattttacacagcatgtttattagctgctgccggcgctgtgttcctccgtgatgagcactgaaagcccaggcccaggtggggagaccggggaggtcagcagtgtcactcatgtctcgctccttctccatctacgtcaaccttagagaaagccctctagtgctgaaactcatcctgtattcactttctggaagattaactcaaatttaataggtaatgtctttaactgcccccaaagagcccagccttacaaattataccactattttaaaataaactttaaaaactacatggtaataacataactgaaagatccataaattagaagactcatacattctcctgagcaaactgaaactctgttctgtaagacacttcaatcagatcaggaattactgcgtatgctcagtttgttcaatgacacaatggagaaagtagaaataaaagtaatagagatcttttgcaccctagtcgttctgctgactgaaagcaaaaatatagcctgtattaagtcaatcaatagcaaaaccttctgttgcattttgttcagttgatgttgtggttagttcatatttcctctctttcttttgtccttgtaaaatatattttgagaaataaatcaataacatgaaggagattctaattttttttttcatttccttcaacctactgtatctctggtatttgacttggaaaatttcatttttttaaacacgttatattgtgtttctacaacatggctgtgccaatagtattgaaaactctagaaactaagagagttagtctaaaagacattaaattatttacagaaagtcaatcgcctattgaatgacagtgtcaggattcaatctctagtcctttgacatcaagatccatacttttccaatatgtattgacagtcaggtattcccaatacatattgatattgaaaaacgtcttagatcaatatttaagttggcattagaacattcttctggtaaatccaaaataagctaattattatttggatctcactaatacatcaattcttagtaattctcaagtggattgaggcatgatgtctatttgtgcaggaagactccagagccaaaacaactgttctcacaaaacttctttggtagataggtacaaagactccaaacttggaccattggtttcatctttgaaggttaactggactccactaagcaacttacttaaataaatattcacacaagggaaag

SEQ ID NO: 54817 - DNA, 1897 bp, Bovine  19866880614051
aaatcatcacacatccaggtaaatgtatgagttgcacccattcttgatgtcccttccttggtcacagccttaaaggctctgtgtttaagcagtgtgtgcagtggagacgaacagcactgagatatcccagctctcccagtccatcctctgacctgggcttcccacaagctgcccaggaagaacggaagaccctccagtggcagacctgagattttctctggagtaaagccaacacgaaccatcatttactgttaatgtcttatatttttattttgcatgttgcagcaggtagatgtcccaaagaggcttatgaaatgtcagcctcatctggagaaaatggagcccttcgtgagcaccaggctaggctcaggagctgccctggacagacatacgggcaagaacggttttaaagaaatcaattgaaaagtctgagatatcctgagagcttttctctctctttccttccatcacatcctaaacaaattgaagttacttcctccttttttttaatattttttatttatttttaaatatttatttattttgactgtgccgggtcttagttgcagcttgtgggatggaacctgagtcccccacactgggagcacagttccacccactggaccaccagggaagtcccaaagttacttacttctaaggctcaggtctggctctcatttctgaaaagggatgtctaaaactgcactcgtacttagtctctgcaatcaatctagagtaatgaatgaatgagcatcctgcacggagctgggtaatgaatttgcagtctgtttgcttttgcagaaagctgcccatttattctgatttagaagcaaataaacattctcatagtctcctacctttttccccccctgtattttccagttctccttccctttcctcgcttgcatccccaaaagggcctgccaaaagactggcttctcttatgatcaaaaaggattttctgagtcaccgattccccaaaagcaggaaaaccttcaggaattctttaggaacatcaataaaaatacagccaatgacccttaggaaggctcagtgtttcctccagtgtggaagtgacccaggggagacaagggagaacagtgagggttgtgagagcctaaggactaaagaagaacatgttcatttcattttggttcttataacattatattcagggtcattatatcctggatatagggcttctcagatggttcagtggaaaagaatccacgtgccaatgcaggagctgcagaaaacgtcagtttgatccctgcaggaagatcccctggaggaggaaatggcaacccactccagtattcttgcctggcaaatcccatggacacaggagcctggtgggctacagtccatgggaattgcaaagagtcggacacaaatgagtgactgagcacacacacatactggacatacacttgaccactgcctcatggcttctatttctaagacatactgaaggattatagaaatcttggcccactaagttaattctgcaaaaacattctaattttgcatttcttcttagggacaaaaaaggcaatgtaaagtattgccttattgtatagaactgaaaaaataaaatcaaatgtagaatagtttcttacattctatgggataaaaggcttgtaaatatgcacaaggaattagtaggatataatataaaatataagtcttctaattgttcaaaaacttcacatagtaattttatcaaatttaaaatgaattaagggtgtgcatcacctgttactatctgggcaactagttttccttttccatctgacttagtccacctaaatcacataacctcccccactcccaataatacacatggatatttctttggatgactcttctccgtgagaaaggagaactaaccctcaaa

SEQ ID NO: 54818 - DNA, 1827 bp, Bovine  19866880641068
ctgagtttttttagttctgtatgtattttagcgatctcatctcacctaactgggatgtgtttcaagtatattccttttatggaaaaggactctgaaaaaccctaaagtattctagggagaaactgtcttccatttcagttttgaatcagtattgttacactcaaaacatcctcttaaaaaaaaaaagaaaactgtaagcctattcctccctcccccttcttttttttagtaaaccggtgtaaatggtgatgtgcgcattctttcttttcagagagagggcaagtgaaaggatttgacgtgtctctccgttattccaaggaactaggaagttggtgtgcttgtgactaaggggttacacgtccagcgtttttccattttcctttacatatgctcaatgtttgtttttgtgttttgtttcttttgtttttgaattcccacactgggctcaggagtcggaagttggagagtgagtttgggaatctcttgtgggtgtactgtagccgaggtaacaggcttttgagaagctcccaacccccgttcagtttggggaatgcttcagacagatacacacaagtggaaattcagggctcctgtgcagaggagatacaactttgcccacagttgggggttaaaatccttcctgtccatacgtgtgctggacaggaaggtgggcacatctatatgtcagttctcagttatcgaccctgcctcccctctctgtctgtccaggagtgttcagcgctgttccagggggagacagggaggagtgttgggcgacgcccacacacactgttacttccatctgttctggtaagaaggtagatatgttatagattaaagctattgcatagaatttgggaaatatttgtgggttggcatatgattagttccatctcttgccccattttcatagataacagaataactgagaattgattatatctagttttgagtatataggtacttaatcccacagctggctatgttatcaacaatatattaattccactatagcaaaagagtatttctattctaagtgccctattttaggggactcatgaaatttggttgtaaaagaaaagctcatagaccaagatatttggaataaattgcttcaaacattttcagtatttaaaaactctaagggcacagtttcatagctgtgtggatacgttcttaacactctattacattatgcagccatttaagaagctaagtcttctatgcagtttgtccttaaggtagacttaagctagactttcagatgaaaaggtttaaagacttaaaaagtgcagctactccccatgtgtacagttgctacacataaaagacataccacgtgtgcacagggtatgtggactatccagcattttacctttaaaaagtatgtaaactatgaaaatacaacatcagcactgcagtcgacatgttgtattctgccccattcatcttggagttagatttatccaaagtgattcatgagtccgttatgtgttttttctcctttctgccatttaaattagtagtagacaaaaatcaaataaaagtatgagataatggaatattaggaccagctcatttttctcaggtttatgttctcttatttggaccaagaatctcacgtggggtaaaattcccctctgaattttagacttttgggactttagctgagacagttgggtttgctttcaactagatgaaagcagaggggtattgaggtcctcccgctgttccccatgtgcagcaccttcttttaaatcaaaggaagcatcccctttggaacagagccccaaatcaaaagacaagcagtgatctgagctagtagag

SEQ ID NO: 54819 - DNA, 918 bp, Bovine  19866880662912
ttttagtgtatttcttctagtctttttttctacacacatgtgtttatcacagggcttcaacatggtgacggaggagttagaaattctcctattttattccttaaatacttggactcactctccttctcagttctccttataggaaaggattttcaatgtcttgaagtttcacttaggagggaggttctgccccttactgaagacaaaaatgcgccccttagtgacacccatagcacaattatttctaccatagaaaagtccgtgaaatcgcatctcacccagacttctgaaccatctttgaaaattttgcaatcaatgcagtctgacacttaataggagcaaaggtgaaaagcagggtagagcgaactgttaatacaatgcccagagctactcagggtcaggagagctgggaaatggtgtgagttggcaagggaagacactgtggcttttatagaactgtgccattgcacatagtatgattaataaatagctgtgtgctgagtcaacggagtcgttgctgcagggaagagaaacaaatgaatcctcacaggttatattttgtctggggagtgagggttaaactgggcatgaactcacagaatgtctaatacctccttcccacccccaagggggatttaggaaagaagagaaatgcccaagcaaatacttgatggtggcaattgcagggagggttctggcatttcttttctttactgttaacttgtatttcagaaagaccaagggctttcttaaagggccaataagccctgtacataagaactatatctaagaaattacactgggactataatatttaagcttgaaacagctctgcaaagacacatttatttctaaattaaacattcttttaaaacattaagaaaattttttatggaaatagttgctttacaatgttgt

SEQ ID NO: 54820 - DNA, 1152 bp, Bovine  19866880709954
ctgctggtgggtgctggctgtctttggcactccttaagcttgcagacacgtcagttcagtccatctccatcttcgcatggctctgtctgtctctctccatgtccgtgtgttgtgtctctgtgaccgctggccttctgagaagggtactgtttggatttcgggaccgctttaatttatcatgaccctatctaattatatctgcattgattctgtttgcaactgagggtcatattctggagttccctgtggatctgaatttgggaggagacacgcttcagtccagtacaattgccttcattttttttggtattcagttaaaagaaagtaatgtcaatctggttagaaaagtacaaatcctagccagcagccataagaatgatgaatgaccgaactgatcccttttactttatgttcgtgtcatcatcagggataaactggataagcttgttcttgatttcttcttccttattaatacaaatgttaaatagccgtatcctacatgtcaaatttcactgtaacatttaaaaaacgaaatatattgtgggtttgcttaggaggaaaattatatccttataattttattgctaacctttaacgctacttagtaattttattctagataacacaaaacattgaaaagctctctttagagaattccctggcagtccaccggttacaacttttactgctgtgagcctgggtttgatccctggtcgaggagctaagattccacaagccaagccaccaaaagtaaataaataaaataaaagctctctttagctatcgttttacttaatcctaaaacatagaggtcatgggaagcacatatgttgggttttaaaattatatcctttttaattatatctgtttccagtgcagggggcacaggttcaatccctcgttggggaactaagattcccacataccatatggtgagtatgtggtacagaaccagaagtcaagtctgtttgaactaactgaagattcaggtgcttatgtgtaagataagttatttttttttactaaagtagagttgctgtacaatatcatataaattataggtgtacaatatagtgattcacagtttttaaaggtccattaactgttattaagaaatatttgctatattccccatgtgtctaatatatcctc

SEQ ID NO: 54821 - DNA, 1964 bp, Bovine  19866880729881
gagcggtgtcccttgatgctaagtaaatgcacttcggttacattctctgtagggacgggacagtcagaggacgtttcttttcctttttacaggggactggggagcaaaaactgctgtctttgttcttaagtaagtgaatgtccggacaacgacccctacacgctgccaaacatcagaacaccggagtaggctaaatacaagtagaattcaccacgctgcctggggtccccagtccaaacccttctccacggaggccttctttacgtaccccatggaggactggaaaaacctggtcggctctgcagaagtttcccctgcagctgcttccaacagttccggagaagtcctcgggctacgggaaacggcggaacaagcagcaccagcatggtgggcgccatgtttctcggccgaaagccactcccatcaggcctctgggtcccgccccttccttgagcatgcgcatagacacagaattcggcaaacgcgcacctggaactataactcccagcatgcttctggagcggctctgcctttcctccaatcagaaatctagaaaggaacgcccggggcggggaaaagaaacgaaactggcctcagtgcgcatgtgcgcggatgtgcgttgggttttcgggtaaagatggcggagcgtggttacagcttttcgctgactacattcaggtatggaagggactcccgaggtcttccacgtaaccgaggtagcaggagctctgccgaccaggtttttatcttcctggtctctgacttggctcttcctgagggcctagtaggaaatgggggtgtaaatgcgagtttgccaagtcatttgcgggggccttcccgcggcctggggagcattggtgcctggggaccgtgggaacgcgaagtcggggtatcctgggagatctaggcgctgtgggaagttgaggccctcacccagggattttctttcgctttggaactagagaaaaaggcaattttgaatgagctgcttccaggtttcctgtccagaactcaaaagatttccttcctgactcaagtaggcctgattcaggagcttctggaggtcggaatcttggtcagctctgtggggttccttttgcttggaaagacccaactttacagttcagttctagtcttagcttccatttggcgctgatgtctttggaaaccttttcccgctttcgatttcttcggtgcccctaccggaagcttaagaactgaaagtgaaagtggtaatgtttctagcccgttgtctttgtgtgctccaaaataggctgtatttgctttggggctgttatttttgaaaggggatatgtttatttaaagaaagattgtaggcttttaaactttagaatatttatgtaagcatatttttcaaaataaatcagagatgcactatcatcgttcccggtgtaagaaaaccgtcaccaaaggctttactgacgggagaaggattcaattttgccattttcctacagatcagtaatggcctatttaattaaaaatattatctgacagctaaagacaggcggcatctaacttgttgagtactttctgtgtgggtggagcttactccatctctgtaggctaccctgtgtgatacatgttttctaaacatcttacagatgagctgaccacaactcaaattcaataactcctccctggtcataggttaatatttaaactgggttctttctgacgacaaaattaatacactttgcattactgtgtaatgtcttcttaaaatactagaatatttatcttttaaaaaaaagatctcatatacaatgacaggaaacaaagtttgacaggtcgctactgttcgtattcggagacaaaacctggacctttaagaaagtgttatcctaatcctagctgaaacatgaagcaaccatatgttatcagggactgaatctttctatagtaaatttccttgtttaaacacaccttttttgtttttaata

SEQ ID NO: 54822 - DNA, 1712 bp, Bovine  19866880743027
atttgttgcatgactctagcctagctactgatagaacaaacttacttgtctgtacttgggctccccagccttcaacatattaagtggtaatattcatttcttaaggacttctctttctacattctcatgttttcctaaatgttttttattttttttaacttcatttttttctaccatctcaaaaaaaaagaccattggatttggagtaaaaaatttgggaagaaaacttttaaatggtttaaatgataacagttggtatgtgtgctcagtcactcagtcgtgactgattctttgaggccatgtggactatagtctggcaggctcctctatcattttcattttgacagttacccccccaaaaaaaaaatatatatatacacacatatatatatagtgaacccaaatacctggtgtcaatgatagattaaagatgtgacatatggggtttccctggtggtccggtggttaagaatcctgccaatgcaggggacacaggtttgatccctggtctggggggatcccacatgctgcaaagcgactaagcccatgggctacaactcctgaagtctgtgtgccttagagcctgtgcccctcaataggagagtagtgcctgctcacctcaactagagaaagcccgcgcacggctacgaagacccagtgcagccagatataaattaaaaaaacaaaattaaaaaaagatgtgatgtatgtacttgataaaaagtggaatgatacataaaaatctgcccctgcccagcacagcagactgcccgcacttaattccagctgtattctagactcagcattattgtagcccaccaaaaagtgtcctatgttttggatgggaggagtctgcaattgattttaaccaccaaatgaaccttttcagtacattctcagataatattaatgctaagattacttaaaaatcttagacctgggattacttggtaagcttaaataatcttaggatcttaaagtactttctttttcctcttaagtattattggtgagtctttgaaacattatgaaactttactaaaggtttgatttctcggctttatttttgtaaattgttataatattgccaccacacactgatcatattaaaatagttatacttaaggaaatttcttaagtaaacttgtgttagggttacactcttcatgatgtcaggaatgcacccccaataattgtcaatttcttattttggggacagctcagtgaggagactaggagaattaatctgtaacttaatatttttaagagtgtcttattaggtgtttaaaaaatcttatgttgttgctatcattgtgttttcttagtcatgaatcatcttaatagtgccataagtcattgtttttcttaaaaaaaattctttagatataatgaagatctggaacttgaagatgccattcatacagccatattaaccctaaaggttagttcaatatttaatgattggatttgtagtgattttataattaactgtttggaaaattgaccttttcctctccttcatcaggaaagctttgaagggcagatgacagaagataatatagaagttggaatctgcaacgaagccggatttaggaggcttaccccaactgaagttaaggattatttggctgccattgcataataatgcaaataatgaagtgactgaaaatccagaatttcagataacttctctacttaaacatgtttaaagt

SEQ ID NO: 54823 - DNA, 1284 bp, Bovine  19866880765491
cgtccgtctttcttccttggagcagtgagagacagaagttgtcgttgtgtggggtcgtccagatttacctgtcgtcctcagtttgaaggttgcacaaaggcctactcgagactcgaaaacttgaaaacacacttgagatctcacactggagagaaaccatacgtctgtgagcacgaaggatgcaacaaggctttctctaatgcctcggatcgcgccaagcaccagaacaggacacattccaacgaggtaaggctcctctgggagacgcctgttgggtccagagctcagggggtggaaatagagaatcctctggggagacgcgagcctgttccattgtcgtttcctctggccactcccagcatgagtggatgttaatgctgcaggtgaaggtttggggggcctcagaggaagggctgaaacctggtcttggatgggagagacaagctgaggaagggggaacaagtttcctgttgttcagtactgccacctactggtcaaacagtagtcgcatttaatttggaattccaccaactcgctctgcctggaatagcccgaatgcatttgaaggacgatgaccctgtaagcactaaggagagactgagaagagaggtgttgacagctgacagcttactgctaagacagccacttttatttgctttctccaggtggtatcttcaaatgcattatatcaaaaaagacttctgcagagcaacctgacttggctaaataggatttccagacagtctaaattccaaagggtcttggaagcttattctcagaaacccagaatggtttctagtcagttatttaagataatatattgagtaaagcttcaagggtttcctgatgtgttgttgttagtttgaggtatttatcccccacacatttcagagaagtgtaagaataaatgaaaatggtttctaattcacttcgcttacattttaactcgcttttgcctgcagatctccagcttctccttgaaggtctagctcagattctgcctctgtctgtgaaactttctcttgaatgaattcagagattaacacaaaggcttcccacatctgtggtggaaataggctagctaaccagaacttgttcatgagctgtagttctgccccacagagtgggtcatccgtttgcttgaaatcatttgagagagggaacattttgacccttggtgtgactctcatctgaccccacaaggtgccagccaggcccttcatgatcttacagagaagagctggaagagggaatttggtaaaagtgcaacattctgttcactgg

SEQ ID NO: 54824 - DNA, 1185 bp, Bovine  19866880778448
tgcagttcggttctcagattaatcttgtccagcaaagaagtcatcatatttactagtgggagacttccatgcagagatcttttcccaaccctgggcatacatcgtgtaattatagcgaactcttcgggtatgcacagttcttttcattccaaagattcccaaagcacttttacaagcttaacttgggctaaagatccctattacctcatccagccctgaattgtagcaacctctgggggaaactgtggcagctgcttaacaatgcacagacatactgtacgcagcatgagcacaggaggctgctgagttcacaactctcgtttattttgcatggcaagagacacagatcaagagaacagaacccaggaaattgccttggagcactacagtggtccgtatgaatgtgctcttcttagaatcttagaggaacaaaacactttcacccagggcttgcatccagccaagcaatccttctggagctaggttgaggagggaaaggattggcaaaaagatgtttctgagaggcagcctagaagagtagcacttcataaaatttcctggttgttgagaatttaaacttgtgcaattggttcatgtgttatgagcgctggacagcgtgcatattcccctccagatctattctatacttttccactctactttttttccctgagaggttggccttttagaagtgcctcaccttggtttcccctgaactctggtttctgggatcagctagtggttggagaggagtgatgctggggtccaactctaacatcaactagtgaatggataaacaaagtatactaaatccacacaaagtaacagtactcaacagtaaaatggaatgaatactgataaatgcattacaactgaatctgaaaagcaccacactgagtgaaagaagccagatacaaaattctgcataaagtatgataccatttatctgacaacctagaaaacacaaaaccctagaaacagaactcaagttagtggatgccatgggctggaaggaaggtattgaccagaaatagccataaggaatcttttcagagtgatggaaatatactatatattgattataatggtgtatacatttgtcaacactcatgaaactgaacaataaggggaaattgtacctcaactattcctcaatacacctgatttttaaaaaattcagatcta

SEQ ID NO: 54825 - DNA, 1905 bp, Bovine  19866880941312
tagtgtcaaagttgttaatatctccatgtatcttacaatcagcaccatatctgctatgtttttgtccataggttgactttaaaaattgaaaatcaataaagcatctctagcctcaaagctatagaaatgctcttatatttctttccataaatactagtgtctcacttcttttttttaagtccatttttatattattttattttattggcctcacctcgcagcttgcagggtcttagttctctgaccagggattggtcctagaccctggacagtgaaagcatggagtccttaaccactggactgccagggaattccttcacgaacttctttttaaaaaatatatttggctttgccaggtcttagttgcagcacttgctgcagtgtgtgggctcttaatatgacatgcaggatttagttccctgaccagggattgaacccaggtaccctgcattgggagcatggagtcaaccactggaccaccagggaagtccccatcactaacttctttgtgggtcctgatggtgatgtgtctagagttaagaacaagtggtttgtctattcttaccctgatttaatagcatacatactagtgtgttgcttttttgtagttactttaccttttcctctagtattgcctttatactatctttacatttctccctagcctcgcaaccatatcttttgcccttaagatggaatacttagctttcctgggcacttcgttttcccagttaatcttgaccaagtgtgttaggacatcccttcacagtcatctgggttggaaccactgtttcctgggtctgacaacttggtcattttaagtttattcttttattttactggggtacctcaagtaacttcccaacagcagaggacagacgtactttttgagttcttgcctatatgaaatacttttattttgcctttgcttttgtttaatcttttagctagaattctaactttaaaaatctgttaacactcaaagttgtagatgagaagtctgatgcctgtttgatttgtatacctttgtaaatggcttatttttcctgtctggaaactttggaaatttagtagtctgaaagcatgtccctagatgtaggtattttcaattaaattaagctaaattttcattcgttctgcttactacttggtggatcattccaatctgaagatgcatcctttatctcttctgttactctacttagttgaatgcctgacctcctgagttatgtctctgtgtctctaattttttctctcacattctccatctgtttactttcagttctgtgttctgggaaatttccttgaattcacttttcagtgcttttggtgatagtttcattttggccattgtacttttaatttctaagggctctttaaaaagaccctttcaatggctctctttttcagcatcttgctcttttgtacataatgctgtctcaaaactctccaaaagtttcctgcagggttagttgttcttgtttattttggtcattctcgtttatacccttctagctcctcataagcctagtgatcctgagtgtgagtgagtgttcgtgttaaaacctcggggatggaggttgccctggtttcctttctttggagtaagtatcctaacggtgcagatctattgccaggttcatcttttgggagataaagcagggctgtccacatgccaggaccaggagggctttatggcgggaagcagtgagagtcagtgtggcttggcccaatcaggggtcaggcaccctgcagtggtaagagctggtatgactctcgtggggagtgtatttgaatgagagacctgggatgggaagaaggctccaatattcataatgaacttgctttcccaggacagcacatttgtttttttgtttgttttacctttttattttatattggagt

SEQ ID NO: 54826 - DNA, 2125 bp, Bovine  19866880958781
aaaagaaagaaaacccaaagtcagcagcttatgaaccagaacaggcttcagggtgttctcaccatgctggtcgcgtagttctccaggtaaatggaaagggccgcctctacagcgcccccacctgggaccacagactttgactccaaaactctcttcaccacacaaagggcatcgtgtaaggagcgctccatctcgtcgcacatgaaatcatttgcgccacgtaagatgaccgatgcagaggtacgagccttagtgctatttaaaacaacagcgatagtctttaacagtagtaagtccatgaagaaattcactactacttacacaggacatttagacagggaagcaatgtctagaccatggagaagagatgaaatggtaacttcacctccatttacaagggcccagtattgttttatcccatgcgtataactgctcatatcactgaaggactatagcagcaaataaatgggaaggtgatctgtttttactcaataataaaatctgtacagccttacaatgtatgaagtagctcttactttttaattaagatcagttcatcatcacaaattctctcctgtaccacttcttctgcttgtcccaacattgaagcttcaaaagtttcttcgccttccaaattggccagcgttgacagaacagttgctattaaaaataattataaacacctgtaagcactgttctctcgtgaatattttcaaccctgctttaaacattcagaaacatggaatctaccatagaagtgacacataatctcaagtttaaggcttacagtaagacattcaaggaaccatcctatcctaagagaacgatgtcacttcgaggtgaagaacactgaagaactttcccagttacaaatgcacaaaagatttcacacatttgtacacaaagcattaaggaagttttctggatctgcttatcttaccatccaacgtaaaaagaacatgacagctggcaggagacatacctccggaagctttagcaatgcgtttaaggtccctttttaaaactcttcgaactgccatagcaccagcctccacaaaatacttcagacacatgtcgtcaattccaccagtggttaggataacgttggcaccagttgccagaatcttctggattcgctccttggtgatgtcagattctctacaaaaatgcagtacttgagtagtaacccaaagttatcttctgtatttttactattacataaagcttgaacttcccattaaatatttttcataaaataactacagattaaatgatactaatgagtctctcccttctatgagcagaacttacatcagtccaatttacagaaaaattcaaggaattaaataccagttagctctccccaccccaactttagtttctaaccaagaatggcgcctaagaaaggaagcttgacggacctggtagggagacaagaccatcaagcaaactcgaaggccagtgtcacttgcaatacacaatgcaatgcagggaggacaagcacacgagagccacgtgtccaggctggcagggggacaaggaaagcttgacggtctggagttgaggggtccagagttggaactccaggtaggaacagaaaatgaagaactctgtagcaatgtcagagtctgaattggtaagttttttttttctttttaatattttaaagcgagagtagtagtatcaatctgtgttttcaaaggatgaaagaatgaatacactctgaggcaataactggagatgagtctatctgatgtgaacagatggccttaacagagaaggcaaagcttatggcttgggtgactgggagattcagcgattgatttctggagtgaaataaatactaacaggttgggggcaagatgagaaaaaaaagagttcggttttcaacaaggtgaatctgaagcccccatgatattcaggtgaaactgcatgggaattacaggcaaactacgggatacacagatctgaaaaacagtcaataaatatttacttattcaaagaacagagaatcttttttcttttgccacaccgtgcagcatgtggactttgcagttcactgaccccctggtgaactcaaacccgagtcccctgtggtagaggctggagtcttaattgctggacc

SEQ ID NO: 54827 - DNA, 1136 bp, Bovine  19866880963490
gccgtggaacgtgatgagagcctgcagttcatgtacgggtgaagctccgtagttgctgtgcctggttcgtcagatgatctactaaaatactgtgacaggaaagcatctggtgggggatccaggatgtacggggtattttcccaagtgcaggaggggatctgagcagagagaaacgtgaaacccttccatacagcacacatagggccagtcattgcagggacatcgccaagcaaagtgttaaaaggttgctgttatgtctacagagcaagacgaatcccccaacaaccgagaccctatagagggatcgtgtgcaaattagggccaagcacaccaacaatcgtctttcctaggaaacataaagtcctcatagaccaaattgcctccccacatttcctgaatatctaatccagatggctaattggtgagcccttctacagtgcctgtctctctgcccttttgacttcccttttgtttatttaaagatgtcttgaataatcttcctaaggaggggttttctctgtcagaatcatcaggatcaagcaacagtctcacaggctaaggatagaatgactgggttgaacagataacaaaacttcagcaaggaaacccagaatgactttggtagacaatgattctgaattcattctaaatgaactcttatggatttttctcaatgcctgtgacaaagcagtctggggtttttcttcctgtctagttaaatgaaaaataattaatattcacttcacacaaatgcttacttattaatatgacaaattttatagaaaacagatggctactttgagcctggcccacaatatttctgaatctttcatgggattctaaaatttcaaggaaagagaacttataaaattttcagaaatgggtgtccactggttctaaaggtggtgatgggggtctgttttagacagtttcttgctttatccttgtctcagccttgttctcatagagataaaaggcagatacacagagtcttttcatacacacatcttttcatgatgccaagctataaagtaaaagatctctggaaaggctaaaaataagggaaaaggtacatttccatagaaagcaaaccagtaagtttttcctgtgaagaaactggtcctttgggctaggat

SEQ ID NO: 54828 - DNA, 542 bp, Bovine  19866880971773
tcattctttctatctcatcagtctcttataaccaatgaatactccttcctggacttatgatgctggatatctatctgtcttccagcaagaaggtttaaactggagttgtgtgtgtttaaaaccccactgacaagccttcattcatttaagtccacctgaaagagaagttctctattacctcaaagatatgaagtccctgggttgattgtgacttcgacagatgtatgacaagtcaatggccttgactgagagatgtgtcagtagcccctttatcctcattcatctcatcatgttagaacccaaatcagcagtgtgtgaggctgggcctgatttctctagcgaattctgggcacagtttttggagaatgttgaggggatgttattagtttgctgtcccagtttgtttcctgggacagcaatttcgttctctgactgctactgagttgaaggcgagtatgtgctattcttgtagactacattaagagcagccacaagcagacaagtcaggtaagtctgaggatcactggggcttggggtcctat

SEQ ID NO: 54829 - DNA, 876 bp, Bovine  19866881019425
ggattaaacacagtagtcttgtgtgggcataattgagagtgcacgtatgattcttacaaatgaatcggtccacttgttgtgggttctgaaagccagtttggtttgattttatgccacgggtctttgatctgctgttatcggaaaggccatccaatcacatttgcagagaactgtagtggaccgatggaaagttcttacagatgaaagggaacagaagtatgagggagcttgaatttcatcaagccgtttcttacatgtttgaaacgatgtctggagcccaccggagtgtggatgtagatcagtgtagctgacgccctccacacccacgctctatccccattttcctctcagcgctcagctccgctctgtgggccgaagcaggaagtgtcctgtaaggggcactgtaggtgctcatgattgccgtctttatcccttggaacctgtgggttttcggtcccatgtctggcactgtttcatctctcagtggatcacacacctgacttaataaaatcgcaaggataagttttgctttctaacaggtcttcctctgaggaacaggggtcccttgcctcctggatcactggaggcctggcttcctcaggccaggagaagctggcaatccatagccttagtctggcaaaatctccagctcctcaggccctgcagggatactggcaggtccctgatgggaaacctcacgggcagattcggctggaagccgggaatgagaatttgctgacatctcaatgtaataggcttatttcctgctccccttcctccttcaatttgtatcctggactctcattcataaacaattttggcttgagaccctccagtcatggctagctttcacagttgccaagaatgagaaatagg

SEQ ID NO: 54830 - DNA, 906 bp, Bovine  19866881201234
tctgtccatggaattctgcaggcaagaatactggagtgggttaccatttcctcctccagggcatcttcccatcctagagatcaaactcgcagttcctgtgtctttgcattagcaggcaaattctttaccaaatagccttacttacagtggaatctcagcccccagatctgtggctaatggcagtcagcagtgaggtcactcactgaatggattaaatgaccttcttgatgccgatggtgcaggcttcctgatgagaacagagcagggatagggagaatgtaagaattttctttcttgagacccaaaaggaaagcatccctgtattgtaaagatgtctgatttcccatgctatataggcctgtgaagttatgaagaccacgttcatctcaaagttgtgtaagcagaatatgagctaggaatactctcatttctctgtgtttcacaccctgccattcctcctgagcccttgatctcaccctagccatccttggtcccacaaacatgagtgtgtttacaacatacactcagcctttcctttctctacatcacttccagctggagtctcccacccaacccctgttttgagttatgatgaataaatacatttgacgttgaaatcattttttcccttgtgccttctcccttgctctgaattccaaccccattctcaagacatgataaatacatgaataattcattaccggctggatttgtcttctccttttgctgaacttttcccatttgcaacttctgagcattttccagctctaagagagaacttcctgttcaattcctgctcccatctaagtcactaactgtgttttgggaagttcctccaagtaagttgataagggtctaatattctttaagtgactgtataatattctattctgctgatgttccaaa

SEQ ID NO: 54831 - DNA, 1129 bp, Bovine  19866881211497
ctactcattgctcaaagctctggggatataggtagaagttggcattaccccgttttatagaatggctaatgctgcaggggtgtgtagagatgagctgggctgagtaatgtcacccaagcattcctgctgaacatctgagtctcccacaaatccctggggaaggggaggagagctgatctgctcctccttgtcactctgtctctgcagcacctaaggaaaaatgattccatgggaagtaaaaactgtccaaaagggggagttgaaatggctggggagtgagggctacacaaatctgtccagggctagtatttgctgaaatatttcctggaacaattcagtagtggcttcaggacttggagttcaaattagcttcaaatctccatcctacagtatttcttactggaatagacaatttgaaaggtttcctttgattttaggttggcagcctaaaatttaagttcttctgtaaaagcttatagacacacacatgacaatgttaagaatgactatgatccaagccatttggtaacagtgtcattatcctcagaagccagcttatatttgttgtctgtatttcttctaattctgtgaggaaatgtaaagcatgtactcatattgtattgagatgaatcattcccatgacaagaatctgaaagttttaccaactactgggcatctaaacctccgtgggctgccaagaacggctactgacagccactggtgtggacttcggcaaaccacacaccctctgatgcttctttgccccatcttaaagttgtgccctaacatttacaacagctaccttctacagtcaaaatacacacacacacacacacacacacacacacaaacacatgcgaagcaggctaaataaataaagataaataaggtgtcatgcagtcaatgtggataaaagataccaaaagaccataaaaggacattaaggaaccaaccttccatcctgcacactcaatcaggagagaactgagcacctctgatcattaaataatattgtcctggacagaagccagggtgcccaagactctttttctgcagcaccattaaatgtatgagaatcaaaagaaggtaatttcccagctacagtcagccccttcattacaagccagct

SEQ ID NO: 54832 - DNA, 1293 bp, Bovine  19866881299047
ctccaaagtttttgaataccaagtagcataaagaagttgcccaccgaagaagagtttatactagcatcatgcttgaggtttacacaatctcactgataaccctctaagactggtatggtatttggtattagactccccatttgtggatgacgacattgagatctagtcccagcatctgacccaaggagaactaacacatgggtggctggctgttggtccactgttctcccgacacagtgactgcgttagtcacggctctccagataagcagaaccaataggatacatacatttagacacaaattctgagatgtataatgaagagagagtttaagaataaaattggccacataatggacggattttggaagtggagggtgatattttatgtgagagctgagtgaagttagcaaggcaaatagggcagggccactactgtgaagggcatttgagagggttccaaagtggggaaaattttgtactttgatgataattcttgtaaaatccagtgtgattggggttgggaataaaatagtctcgagggtgcacagaggaatcctcagaactttgtagaatcaatctgaaatgaagaggggccccagaaagtcttatactggggagttacatgctccaatgtgcatttcaaaatatcacttttctttgtcagctagagagctggtgagcaaatctcccatccttggtttctataaatctatgagtatttctcctagagacacagttccagttgttacacattccttatggagtttactttacctactttctttgatttaaaagactcgaatgtctctgagtacaaggactaactgataactgatttcaaatctctttagcctctgatagcaaagttgaaagcctaaaataggtgtttataattcttcatgatgtttaatccattagaataaattaaaaatgcgtatgtttaaacataggcgcgtgcacacgcacagaccagggagtctgaagtccttggctgcgcttctaggaggttcttttgagcggtcccaagcaggcagggcagacacagggctgggggcaattttatggtccaggctgaatcttccccagtgaaattcccacccttgttttatagactcaactttactccatgttaagataagcatctgaaaagaatggaaacacctgcccttgtctgaggcccacattctcggggctgtaactctagccctggccgtaaagctttaaagaatgaggctctaccctgtcagacaggcctcttcaaaagttcatacagcacattgcttttacctga

SEQ ID NO: 54833 - DNA, 2198 bp, Bovine  19866881388544
tccaatcttgctaattccacacatccattcacacaggaatgtctcatgtctccaccttccaatatggagaatataattcttgatcaccacctctactgtgttcatcatggtcccagccaccatcattgatcccattgatgactgcaataggttctgtactggctttgttgcttccacccttgccccatacactctgtcctcaaaaccaaccagagtaatgttgaatatgagtcaaatcagggatatcccatttcactcagagtcaacatcacgtcagggtcagcatcattaccatgacctaccaagctcttcaaaatctgccctcccttcatctctccaaccttatcacctacatttcttcccttcgtgctcctctagcaacccagtatggtcccaccggaaggtcttacactggctgttcctcccatccaaaaagccttacccctgataccagcacagctaatctcctctccccctccaattcttcatccaactgtcaccctctcaatggcagctcccctggcacactctgcccccaatgctgctgcactccccattcctgtttcctcacttaattttttcatcgtgtttatcctgttccaacatactacataacgtgtatttattttgtcaattggcccacagtagtcaccagaataagtgccatgagcttagggaattttgtttgtttgcttcacaagtccctggaatagcacctggcacatagcaagaactcaatcagtattaccaaataaacaagtgagtgaatcctggtatcatcgggcctagtgatggatcccagaatcttcttcaatatttctgctaaaggatgtgatggaggtaaataaatctctttgcctgatatccatgaattcccaaactaaatatgtcagctggaattttactatcactttcataaaattcactaaaatttctaaaattctcactaaaattcactaaaatttcataaactcactaaaattcatcagtcatctatgattgtcacattgcaaaagtcattttgtaggtttctggagttttctcttaatttttttacacgtttgtctttgcctgccagtatagcataatttggtattaagatgttcaaggccaagattatggctttcaacttaactggtacataaagggacttaatatcattcattgcacactagtgctgatttttctttttttacataaacatttaaacaattctcttaccctttatttctaggcaaattctcctctgcatacagacccaggccatccaaccagtccattctgaaggagatcagccctgggatttctttggagggaatgatgctgaagctgaaactccagttctttggccacctcatgcgaagagttgactcattgggaaagactctgatgctgggagggattgggggcaggaggagaaggatgagatggctggatggcatcactgactcgatggacgtgagtctgagtgaactccaggagttggtgatggacagggaggcctggcgtgctgcgattcatggggtcgcgaagagtcggacactactgagcgactgaactgaactgaactgaactaaacataagaggtaagctcaggaaactggaatattttctcactcacccaagatcccttaaggacgagacttggagaatagctctagccatactgggctgccagaacctaataaatgagcctccttttatctggaagaaagtctggaaaacagaccaaaagttttcaagaccatttctgtctcttttcccaagaggctgggtcgctggtgtctggacacaagctgagcattacagtcattgttttacataaggagtccctttgatctggtttaaaaacacaaacagaagggcctttgcccaatctgaatttgacatgtgtcctttgattctgtaaataatcaaatttgaacacagtgttataaccacaactgcaaagtgtggaatgaagcaagtttttattataagaagacaatttgcatttactaagcaatatttttcaacactacattctttttttctgaacttcttaacatgttccttcatcagtacaatttatttctttttctttttcattcccataattctcaacaataaaggaaaatctatttaaaagaattcattttccacaaagagacaaaaaaaaatattttcaaaagaaaccaaaaaaccaaagttattcagat

SEQ ID NO: 54834 - DNA, 799 bp, Bovine  19866881391079
tattcttgcctgggaaatcccatggacagaggaacctggcaggctacagtccatagggttgcaaagagtcagccagggcttagcgactgagcacacacccactaccaaaaaactgtttctgattttaagtcactcaacaactttaatcctcagtttatcatcagtaaagtggagataataatatctatcttattttcctcacagagttttttaattttttatttgtaaggatagaatgagatcatatgatggaagtactttgtaaactctaaagcattattcaaatataaggacgaataaaacccagaagtagcaataaaaaagcctaattaactgaagaatggagagattaagatttttcattagactaagaaaagaatatataaatatgttggtaatttggttgtgccccctcacctttgtaggctctcaccagctacaatgcatctttgccatatagtggccactacacaaatttcaggcatagtattgagaagacaaaagcttcatgcaagttagacttatggacttggcgttgagaacctgagacactcatctttctaaatctatccctttaagttaggagaacatacagggcaggccgttcaggaagagacagggccaggtattgggaagacagagcagtgggaaagaaagtaaagtgaaggcacagaagaaggactgagagaaacgtctagaatagaagtcagacaactcatctagcagtcaggtcgcctatgaaatggtgcttgaaatattatcttgaaaaagcaagggatgtaaaaagggaaagaccatt

SEQ ID NO: 54835 - DNA, 1267 bp, Bovine  19866881447788
cggtgtatgattctataaactaactttatttgtggatcgagaaagactcaggcattgagaacttccaaattgtggccatctaatcagtaatagtagggatgccatagatgcaaatgccatagctggacctttgagcaccatccttcagcagaaagtgattccctcaaatgatgccatctgatctatgcacgtagagccaatgtctttgaggatgtgtgtccagtgtatgcccagtggctaatgtaagatttcagggaaaagagagatacaagaaaaatcaggaatattttggtacttgcattctcatgaactacaatgtatgaaggagaatttttctttccccttagaaataggggagcctcttccttttctctgatttccttgcattcctacaagggaatcatttcacttcatgtgctttgttattttacaatcatggtgaaagaagcacttaaataaactctctgcttaaaagctttgtgtgttcctgcttcctggtgcttcatcggcagtgagaattcagggtttaaggggcaggaaagtggagcctttcagggctcccagtgtgcaatcaacgtgctggaatttcaatggattccaaaggcgtaacaataatagcattaacaggccaaggcctttgatgttattgacaaaaaaagggggagtgggggcaaaggggcccctgtcatttctgtcatgagcttttaaacttttgacctctaaccttttgtgtcaaagagctttttccttatgggtgttagcaggctactcaagtctcctgaattccctggagcgtccacatttccttggtgggaaaggacattcagtgtcttggaagagacccagcgtagggtggttttccctgagtgcccactgttatctgccccatcttagtggggtgatgggatgggatggggtagggacactgcttgtctaaacatgaagtgactcccggcccagcaggaggcaggcagacttgcggggctagaagatgaagatgaacttcagagagatgatttagctcagggcatgtaggcatttgcctggagtaggctctgaacatggggaggtgcacaggcaggattctgaagagatggcagggcctttcaatgcccgagtttagcctgttattgaggcccactaggtagttgaaagagtcctccacagctgtacgggcctcgtccactgctgctattatttggcctccagtccaaccagcacaggcttccctggtggctcagactgtaaagaatccacctgcaatgtg

SEQ ID NO: 54836 - DNA, 839 bp, Bovine  19866881798683
cctgaattttcaagccttgtgaggttaactgttaaaagagtaatttgtaaaattccatgattaaatgtggaaaatacatctcagttcagaactaaaattacatatattatggtttcaaaaactatattttagagagatatacttaataattactgacattaattaagtatccatgaatattaaatgcattgctttcttacttttttgagtgaaactatgaaatgctaggcttctttaatagcacagatggtaaagaatctgcctgcaatgcaggagacccgggtttgagtcctgggttgggaagatcccctggagaaagaaatggcaacccactctagtatttttggctggagaattcatggacagaggagcctggcagactacagtccacggagtcgcaaagagtcaacacgactgagcaattaacacaaacaaacacacataaaatacagattgtccttggcatttgtgagcatttgaaggggaggagggaaatgaactttaaaaattcctgaggggtacctctcaaataaattacttaagtctcattctgctttaccaatgaaactttcacagactatttggttaattagaggacatatttcagaatattccactcattttttttttctggtaagaccaaatgacggaaaagaagtatgaagcataagaaatggatgaatttatgacctaatataagtggaatcatgcagaagttgtgtgtgtgtgtgtgttttcttattttggggcccatcctgattcaccactaatatgtttttaaaaatcaaggaggaacttttccaaacctcagttcataggaatggaattaatattgctat

SEQ ID NO: 54837 - DNA, 1129 bp, Bovine  19866881815225
aaaaatcatttctagttctcgtctagaataaattccaaagtcagtgaacagatgacttcaggatttaaataagccaagagaatttatgccctgggcggtttactcttggtgggtcctctcatactgtttcctgggcactttccaggccactaaagtatcatttggtgaattactccttcagggcactaatggagctggctttgatctttcttttttaatctacaatttttgtatgtaaatttcaaaccttaaaagacagtctccccaaatggcatccaagagatctcatagcctgaggatattaaaactatttcttgagagaagcacgcagcaactgaagataaacctctgagtgtctttctctggctacaggttttatgatcaacccaggctattgtaaggagacccaaaaatcaatgcctctcattcctaatgagaccctcaatgcacagcctgatgacagccagcatgaaattgaataccaacaactatacccagcataaatattgttactatgcatttcaatttaaacatgcgtcaagccaattacatatttatggggtttaaagactcttccacttgtgcctccgataatacgcacttggcaaatctccctttagtctaagaggcatttggtccaatagtcaaacccctcgcgagtctgtaataaatcatctttgcaacccaaagcatggacagttgactgcttcccactgctctgcagactcacccccacctggtagaattttaattccttcagtaaaattgattcccccagttctgcacattattctccctgtcttccatttagcccgttagtttgctgacagcagagtacacagcacttaacagctggtttgtggaaccatcagtcaggaaattgtatgataaataggagggagccaggtttagtggcacttccttctgcttcagcagttttcgcctgactttggaaaagtcatcatgtggtgttttgtcgagggccagagcaggagatggctgcggcgcggtaacttattacacatcctcctgagttatgatgctccacagctgtgctgctcatgtgtaaataataaactgggaggtggataattatggtggctgctggcgacacaggcctgttctcgtc

SEQ ID NO: 54838 - DNA, 858 bp, Bovine  19866881876238
tttgttcatgaacatttaagtagtatagtttaccaaagagtctcaccagagtagcagttttatgtgtgcagcacagctggaagtaaaaatgcacacaaaagagaaaaaacaaaccactgagttattaagctgagacagtagagtagcaatgaaactagtctggatttttttttttcttttccacagaaagataccatttggttgaataaacagtgcattctttgcatttaaataaacttaattttaaacagcagagggaagaggagagatgaaactaaaccaaacataaaacaaaaccagagatcattaagaaagggacttcaaaccaaatttttatttaattaagacaacacccaacaatagaaatctgggcaggatattgacaaaagaaacaaacttaaaaaaaaaaaaaatctaatcgattgagatggttggcctccaaatacctatataaatggaaaagattattgtgtgccccagtggattgatatggcaagggaagatttttccttacaagatgcagaggtttcttacagaaagtctgaaaacaataggcacttcccagctctctaactcataagtagaacccaggaggttacaaaaacaaatgccacattcttccaagtctaaacaaactcctttgaagtgtcatcagccatatgaaatgcacctctgttccttctgcaaagagagcataggaagattacagaaagaactcctctgaggaaggagagaatttcttgcatattttggaaatccatgactgcctcaagggacatccattatcctaatcttacccaagtctggactgctgctcaagctcggccgaaaggcaaagcttctccaacatgttctaat

SEQ ID NO: 54839 - DNA, 703 bp, Bovine  19866880340202
tgtttgttgacagctttctgcacccaggcctgccactagggtcccgcatgctggggctgggctctttgcttggcccccttgagagaagaacctctttgatactgtctgattgttttctctcctctgggctctgggggtctgcacagagaaagatgctgcccagagagggtactgagcccccaaacacagccattctgcctctcgtcacttctctatcatcacttctatttactaagccgggtcatagctgatccagccagctccagccagtggctttggggggattaaagcagaattacccaagcataattacatgtctctctgctatctgctttgcacagctctcttaacgggatgtttgcattcggcctccctgtttaattgattaggtttcctgagtgccgtgctcccagcccccaagcaactgggccaaggacaggatggtcaggccagaaccttccttgagaggtgctgagatgggcacagagaggggcagagttggatcccaaaggctcttcaagagacccagggcttgagaaccatttgtaaacttgatcttcccttgcctcctcccagccccaggcctgacgtccacaaaggcactatgggaacagagattagcccacctcagtcagaacatctgccaactttaggtgtaaaactacaaaacaaattgccttcaaatccattggcatccactgcc

SEQ ID NO: 54840 - DNA, 1703 bp, Bovine  19866880345320
tgtgagtctgatgtgtgaagcgcttaggacagtgcctggcacagagcagatgctgagcggattggctgctgttactatttctatcatcacgactgtcttcgcagaggcttcttgctccctggtgggtttccagctacagaggatctccaggccacagagcttcagagaaccccctggaatgctcgaggctcagtcctgaagccccaaagggagcagatggcttgcagagcagaaaggcgcctcccaccccaggactgatgggccctgctggagtatccgctctcctgtttcctggccccagcccagtgaacagccctcaccacacactctccttcacacagtactttcagaaacatctttgtctcaactccatgtgggggaagtggagactgaggcccagagcagctgtggggctccccgatggccctacagctggccacccccaagacccaagcccgctgcctgagcccagcagccggtcttccctcaaaccatttccaagtctcccgtctccccatctgactgcgtgacagtaaatcattttaaagacttggcatttccgagaggagctggaaaataccaggccggagttcagagcttgtgaagcatctttcatttagggagtcctccgaggcagctgaaagaggcgggagggctgggaaatgtcacggggcggagctccagcggccccctgccctggccctgcccctgcctgcccgcccacagacaggccgcacacctgctgacatttaagtcctctggagctgacagggaggaaggcttccctcccgcgcaggtctaaagacctgccatgatttccccaggggcccggggagatagcctcagagggcggggcccaggcagagaccggttgggggcgcgggaggcggagggactgggaagcctcaagggagcggagcttccctgtgaggtcatacacagtggccttcaccttctctgatgcatttttaactgaagtaaaatagttaatggccttcctggtagctcagaggtaaagaatccgcctgccaatgtaggagacgcgggtttgatccctgggtcgggaagatcccctggaggaaggcctggcagcccactctagtattcctgccaggagaatcccatggacagaggagcctggcaggctatagttcatgggatctcaaagagtcggacaggactgagtgactaaacaagaacaaaacggtgtataacgtgtaagtttcagggtaggacattgtagctccgcatctgtgtaggttacaaagtagtccccgatgaaggtctggttaccatctttcactacacagttgaccctccacactttatgcccacccccaactcggtgcctcactgttaaccaccaatctgttctctgaagcaggtgcatctttaaatctccatccccaagtccagtccgcagttccctgggcttcataaactgcccccactcagcttggacacagtgaccccagcccttcagctctgctcagcacagaggggatctgcctggcaccacattacttgggacctgcagagctcagcctgtctctgagcctcagtggccatgactgtaaaatggggacaatcatgacacccacctgataggactctgatgcgaaccagatgagctcatgcgggggaagttaatcacggacgagcctcctgtgataggtgtctacagaggtggcccacgtgatcat

SEQ ID NO: 54841 - DNA, 1965 bp, Bovine  19866880353631
gttcgatccctggatcggaagatactctgcagtaggaaatggcaacctaccccagtattcttgcctggagaattccatagacagaggaacctgacgggctacagtccatggtggtggcatacctaccatctaatgggtgtcacaaagagtcagacacaacttagaaactaaataaaagcaacaacagactagacagtctctactgcagctattcaactctgaagctacagcacaaaagcagccagagacaacaggtaaatacacgggtgtgactttaacaggaaatggatccgtgtgtatcaccagacatcgtttcccaatcctggctttagaagacggagcctttctcagtttagacccgttccttctctgaacctctgcctgcctctctgttaatgatgctaaaagcaagaaaaagtagagaaagctaccatttattcagggctcaggttgtacctatggacatgaatctgaaccaactctgggagacagtgagggacaagaagtctggcgtgctgcagttcatggggttgtggagaatcggacacgacttagctactgaacaaaacaacaacaggttgtaccaagcaccattctcagtttttcatgagacttacttcattctgccctcatagtgttttggtgaaatgggtactgttattagttccgttttacagatgaggaaactgaggcagcaaggcagaatgaaatccccaggtcacacagctaactgaggttggaccctgtattctgacccgtttttaactgggacatgagtggagttgggtgagagacctgctctgtcagccctggctctctgggggttactctgcctggtcctacagccagagctggcttggcctcttgactttctgcccctcggcaggtctcacctgccacagtctacccacttgcctctttgcccctccctggggacctgacatggaccggactctccccttctcatggcttcaaggcgggggctcatctgagcgcatctgagatcgatgttgtacacgagaaggtgcaagtgtaaagctggctaaagaacataatagaatttatggaaatcgctggctcgcaccacagccctagcaatgatggaagtgattattaattaatcatggtcttgggggaacagtatcagtgcaaggagtaattaaaatgaagcattgtacagttgtaccgaatgatgatttatgagcccgaggaattgctgctctgccctctcccctccggcaggctcaatgggaaggattaactggacggattgttttcaacaaaaccagtggcttacggacggatttcgacctggacatcatcagcttgaaggaagacggcttggagaaggtgtgtgagctcagcagttgggggggcaggccaaggagcaggggtattaaatcccccacgacagatcccaggcagagaccctgagcaatagggcaagaccccatccacctaccccctcggggctcaacacgacccggtgtggccactgccttggcccctcttggccttctcagcctggaggggtgcagaacccagtggcctggccgtggcagatattcaaacgatcaccctgtcagcaagggccatcagagagatgcttaacctgggaaaggctcatgggacagacagactgtctctaagtcctctgtcatggggcagagggacagacgtgtccttgggtaagagaaactctctaatgactcacagatgcctgcctggggagtcgtgagctcactgtccctggagacatttcagcaaaattgaacaaagggattgcttgtctgggagactggaggtgattcttatccttggaaagaggttgaagcacatggattctgaactccccatgctaagcttctaaggcctctgtgattctgggaattacaaggaaaagcaagcccacagggctggcctcccatctggctaccatagaaatattcgtaatgggggccagtt

SEQ ID NO: 54842 - DNA, 1104 bp, Bovine  19866880386754
gccggtggagagaacctgccatctgccacagtgtcatcagaggctggttgcatgtgacagagactcagtgggaacaggttaaggcaaaaagaaggactttatcatacggcagctcccaggacctggctttcaggcacagttgcaactaggaactcaagagccatcaggaccatccccttcctctcttgatcctctcttgtgcgttggctttattctttatttttcagttctcctgcagattgatccttctagggactggaagaaccatggcaccagcgactcctgccttgtggtttatgcccttccgtgtggttggggggtcggggggaggtcaaggaggggtggggtggagtcctctgattggcagcaaggactgcctggtatgggggaaggagcattctccagataaagggctttctcttggggaggggtaggtgggagctgagcagacccaacatgcacctaccactggtggtggtgtgtgtgtgtgtgacacttccccgtctgacacacagacaccaaccaccttctcagattcacgagttaacctccaggactcgggttagcagctctcatctgctctgctccttcctaaatgaaaagatagcatcccaggaggatggcagctatttccacacctaaaattctcctcttccctggctccttggtgaagattcactcaggtgggcttgatgaaggggtcatcatgagtagttctgagctggagggcaggagaggagaggagggatctgactacctcagtgaggtctcagttaagatcagcaaataaaggatcatttcaggtcttctacccaagatgcctggctaacagtggttctctctgtgcctggcgtttcttgctagccccgaaagctaagcagggggtgcctggtgctgtgataaatgtcaatattaaagccttattagtggtgtcttctgatctgtggggccatccagtgaagcatagatgacagggtctccatggaggctttaggagaccagaacagtatccttgagtcccctggaggaggaagcaacaaggatggaggcagccaccacacatgcctggcacaggtgctgctgcggatcctgtggtggggtggg

SEQ ID NO: 54843 - DNA, 4441 bp, Bovine  19866880455066
ccccgtgccgtggaactgccgtgtcctagtttgcaaaatgaacaaagtgaatttcattcaggtatctgtgacctcagtccatgcaggccacgttgccttatctcagctctgcccagctggctttctataaaaaaataaaagtgagatacagagagagaaggggggaaaaaggaaggcaagaaccgaagagggtcgtaaagccttcgtcggccaattcatttctgtttaatccatctccgcactgcagaaagctcctttgtggtgatgagaccaaaggtcggtaatagatttcaacaggttccgagaggctgttgactgcttggagccgagcgggagagtgtgaggctccccgagaggcagggggagagagataattggagacccagagccctagcttgccctctggttcctgatttcacagatttaagaagaaaaagagattgtctggaattccgcctgcaggattgtgtgtgagagggaaagagagcagaggtggagacacccggcctcgcctggacccccatggagctgctggcatggggctgctgcttctgctcaaagagaatgggctgggaggggaggttagggagcctcagagccaggcctgctggttgggagctgcccctggggagctgggagggcctcggagtcatctggaggctcactgtcttgatggagagtcagccacccacacagggcgcagggaagggctgggggaggcagacaccaaagcgaatttaccagctgttctctgcaaagcccctctgagtgtgtgctgcagctgtaacaagacaagaaactcctacagccagggtttagtgcccactccctccaccccagggatgcaggcctgaggaaccacagtggtttctataccatcactcaaacctttcactgtggatgcccaggtgaacaaagaagtgtgttacctggtaaactggacatgtctgaacaaaagtggcgtgccatggggcagtgaaagcgacgatgttaccctccttgctatgcaaaaccactggctgccaacatagggcttagaacaggaccctactcacggtgggtaaggactgcctgtgggacatcattttgatgacaggctgagccaggcttggggtggagggctggctgtctacacccttacttgcaaccctccctggcttcccatctcccagtgaatctagcagagacctcagcctggccaaaaaataaaaattaaaaaaataaagcccccacccctaccttttcattcatcctcttatactctctgctttggcccctcgctgtccccagttatgcagcaggaaaatgctcttgatggaggtaaagttatgatattctcaaagaaggagagaataggggcaccttaatcagcctggagacacagcttctggagaacaattcctggagaaaatggcacctatgttaaactctgcaggaaggacaacaaacgtaaggagaatagctcatgtttattcgatacttactatgtgccaggcacacaatcagtgctttacttctgttgtttcactgaatcctaaaaccttccctgtgggccagatattactgttattagtgccaacttacagatgggaggactaaaccagagaggtgaaggaacttgccccaggtcacacagcttgtaagggacagaactgggcttcagaatcaggcattataacatctgagccttcatcctaactaccctgctaaaccccactggactgtgagcctttgaagatagggactgcctgattcatttctgtactcctgggacccaggatgggttcctgcagagatgaggcaggaatgtggttaaatggatagatgaatgaatttagatatactttgaacccaaacagatcctggggtaacacaggtttaagattacagtgcattagtaaatttcaaatcttctatttgtcctagaacagtagttccccaaacatatgatatggggcatgaattcctggaaacattaggcacaaaaaggtatccatagtcaagtgagtttagagaactctgggttcaacaaaactaaagaggctcctttatttcagggcttcttaagttcttgtggtcgggacccctaggagcattcttctcaaaacctgatttggagacccacccgcctctccaaccaggagctcagccacccacacagcagtgggaccattgcccctgtggatgggagagctgtggacactgggctgcctgctgaccctgtatctctggcccagcttgaatctgtacagagcactcacagggactatgtccttcgagacacaggggctgcctttctggtcagtcacgagtggctggtggagccagtttcaaggtctcacctgcactcagtctttaggactcaaaatacctgtcgcaagtttccatatgcatgttttctcgctacaaactaattttgtcaaattattacagtaaacctgagatgatgataaaatcaagataaacggggaattcaataaggagcaagactgaatagaaatagaaacgccactaccccgctcatactgctgaagtaagctccatctcagacccagtgtcccctaaagagaggcaagagtgagtcttcattattctgcaggcctcagcttaaatatcaccctcctccaagagccctctctgatcaccttcttaaagctttagtcactcagttcatcttcattctgaatcctgtttgtttctttcacagcacttaatttacttatccacgtgctgttggcttgttcactatctccctttttagactgcaagtttcatgaggatgtggataataacagtttgattccctgctctgtccccagtgcccagcccagtgcccattcactctgtgaatgattgttctcgccttaataggagagggttttcctttgccatatgcccaagagtagagacatctggaggagagtccgccttcctaattttggcagcaggaccagatgagagcttctccaacccactcccacagagaggcatgcacatccccttctgtctgggtttcagatgctgtgtctctggcatccagcaaggagtcttgcctgctcctcagctggctggctggggctgacccccgctcttgtcagcccctatttctcaggagtggactgtccattgccccttcatcctgtctggttctggtcggatctttcagaagcttggcatcagcctttctgccagcctacttctctttctccaccatgtccagcccctccagagacaagacccatcttggaccccagtgtttgctgggacagcctggcttcgttgctctctcctcttactgagtaaactcagtttatgcttggggcttctttgggggccagcatcccatttacctactggcctctcggcttgttcctccttctccaaggcaaagatgagggatcttcagactaggattccgatgctggcaatttcctaatgactgaccttaatttgactgaattagtttctacgtgacttaatctaatcttcattttaatttttatcatgctatagatcttccaggcatagaaagccaacccagagttgtggtttgcacccaatctctggaaactcggtgaatgccactcccaagcaagtgatacttgcagtcagctctggcccttgggactcggatgtgtcacaagttccctcttccacccaagaggggggtttaggagatacctgagcacctcaaaggccttccctgcctttctttacccattgctaccacagacacttggagtctgaagtcagaggacatggaggcaatattctcagggccttgatcttcaacaagtatccagtcaccatgatggccactttacagccaggggtacctcctccattaagaagcttcttggctaaaataagatccatgctgttttccaaactgccaattcacatccatccactccacttcctaagtgaagtctccctttccctttcattttgcacaagagtagagaggcagtccctggagaaggaaatggcaacccactccaggtaatcttgcctgggaaatcccatggacagaggagcctggagggctagagtccaaggcatcacaaagagtcagacacaacttagtgactaaacaacagagaggtggtcacacgtggtcactctgccaggcgcctctgtcatccggttttgcttgtaagcaccccagggccaggtaccatatctgtttgctcacagtggcatctctagcccagtgcctggcacatgcatctatgctgaatgaatgtcctgggataatggagggggaaagtgaccagaaagaaccccaagtcactgttaacactaaaacccaaaacatgcccaagacacatttgatgtcagctgattctgttacagtcacatccaatatgtacaaacacatttaccgttcattctgcagtctgttacactgtctgcttctatctagctatcttttttgtgt

SEQ ID NO: 54844 - DNA, 1735 bp, Bovine  19866880514960
tggacatggaaaggccccacttggtaagattcttcttccatcctcttctgatccagtgcctgatagccacccttccccctccatcagtgcctgtactgtgaagggcttagctcctgaaggcaagtgagaacacatgtggtactagaaagtgatgtgattagcaaagcaggacctgacttcttttgggtcctcccgggacctagaatgccctgagtcccactgagagaggcattatggcagaagaacactgactctgagtcaaaggtaactgaggcaaaacctgactctgcttcttaccaggtgatgacctgaggcagagtcttaacattggcctcacctccaagatggagcttgccgtggaatccatctcaaagagaattgggaagatgaaataggagagggagtgcacatccagggcttagcgcagtgcctgcctccagctaagtggccaacgacgagtggagactctgaagacccctggtccagggctcccaagttctctcctgcctgcccccaggtcccctcagccagggcagggtctcctgtctgtctctgctcgtttctcttggttctaaccctagctcagatcaaaccctcccagtgggacagagacttcccttgttgttccagcccttttctgagcttgcaggttgtcctggtctcccgcctccatgtccctctcctgcactttctctgtcttgggtttagcttgaccttgtatccaatctccttacttttgtccatcagcttcagactcaatgggtttctctggtggcttagatggtaaaaaaattgcctgcaatgtgggaaacccaggtttgatccccgaattgggaagatgcccaggagaaggggatggctacccactccagtattcttgcttggagaattccatggacagaggagcctggagggctacagtccatagggtcagaaagagtcagacatgactgagtgactttcacttcacttcagacccggcactgggttctcagcatctcccaccacctgggagtgtgagattcacattccacctgcttgagacctggaaactctggcctctggttttctcagatgggattcttgagcctcagagctagagaacactccctccctgagatcatcaggctcaaccccctcattgtgcagagggggaaagtgcctggacaggggagggacgttccccaggccctgcaaagtgctgggggtagggtgggagcctctgccttctctgttgaagtcaggaggcgtggctccagagttggacaggaaggatacctgtgtgggtctcagaactcctggaggaacttaccagggaagtaagggctccgttgactcttcaggggcgctgtgtgcaataactcgctttcctggtgatctaagtaaaaagctctgacttcattatcccagttaacctccaaggaaataaaaatatttcactcctctgacatggtttttgtgctgttttgcttttacgatcattcccttttaagtgcatttagttttaagctcctcaaatcctgtttaagtacatagggataaggcgtccatgaatgaggcaataaatagagaaatcagaagggctgggagttcactcttcttccctgctttgcctccctatctccctaaagcttatcctaaatgccctgaccaaatgccacaccagctctgggccagtgcccccaggcaagggatcaaagttcaccagaggccacataactcagtgtctgtgcag

SEQ ID NO: 54845 - DNA, 1196 bp, Bovine  19866880577831
tgggctgtggagtcggggcaagagttaccttgaatagaaagcctctctggggttgtgaatcactgtggccatttaatgctttcccaaacctacccgttgtagtaacaaagcaaaaaaaaaaaaaaaaaaaagccggaactgtgtacgtgcagtcgaatttattaaataatacagcataacaactaactaatctctaatgatcgcatacgaaaagtgatagctagtttagaacaagatgtagaaatagccatttaggtgaatcagggatcctcattagcccttaattgctaataaataagcttaattttactttgatttttaacttctctcatgctcagggcaatttagttttggcctctatgaagtttgtctgagcccctgaggcctcaggtcagccagacaagacgttaaacccccacgcctcccacgccttgctttctgtggctttaactgccctggtgaaagagccttatctgtgattgctttctgcaaatccctggaaaggccttggtctcctttgtctgggctcacagcccctcctcatctcccttacacagagggaaagagagagaaggggatcacaccacacatgtgctgcacttttcctggctgtcttttttccaattaagaaaagcatttcctcatcctgatcccttcccctggtcaaacttctcaacctttggtgatgcctcttgtatccaattccagcctgcttctaattcttgaggtcaaccattaacctcgtgtctttgaagtgctttggcgcatataacctcttctttgtagaatgctgctctctgttaccatggcttagagttagggcaattccaaattatttcagacttagctttttggaaacatgatgaaaactgtgtaatgacatttataaatgaaaacacgtggttttttcataggtagctgtgaccatagggaatctctgacctgagagagggtgtgctgtagacgaggggatcttaggagggctgaggatgggggccatagaccccacttttttctgccccagggaaaacccacatgcactgcccttgttgcttctgggcctctagcaacattcacaccccaggtcaggagggaagaagggatggagctgggagcaagagaggagagaaggagggacagaggccccaaagctcagttcaattcaatttaattcaaagcacctactaagtgccagt

SEQ ID NO: 54846 - DNA, 1731 bp, Bovine  19866880635019
ccaggtccttggtgagactctccttgccttggtctgttttgatttcataaatactgaaacaccactgacagtaagatgcataatttgatgtacttccctaagaaagaaaaaaatgccaccaattaaactatgacacagtgctttcttatcatctattgcaagactcatctccatttcagggatgttaaaatgcggaggaaaaaaaaaagtgtgattttgaatcagtgaaatatggtcatagaaacaacactcactgcagtttatcaagttctctgctgagggctatccgtgtagcatctctttcaatcctcccaaaccctgtgagtcgagatattgttcagagaggttaagcaacgttacaaggtcacacagacaatcctaataatacttagtgtatgactaaactcaaataccagcacgatcgctctgcaaatctgtagttaaggagtttgagacacccagagcttgacaagcttatctgagtgcctgtagcctgtaggtggcggaggagttggggctggctgacctctctaccatcctgtgagcagctagcaggggtggaactgggcctcaaatccctcccccctggaactccaggctgtgctcctagccactgggcatcaccacctcttttcaagagaaaagggtaccaaagaggacgggtctacataggcgtctacctgcaggactcaccctctctctggccctcccaggcccctgcgggctactcctcactgtccaccccccctcctctggatgggcatttgctttccctcctgactggccggtagagggtgattcccacctctctggcctccttcagaatcctaagagccagtggaatgagagggagcagcaggcaggcagagatgaggcagaaacagagagcgagagccgccttcgaaaactcacaaattggtcccagagagaaatggagtctcttttttgcccatcagctcactcccccaaccattacccagcaagcagagtgagggccttggctggagcaaaaccccggcatgggtgtggggaatggcattttagggcagtcatggctccctctcagaggggcagggacaccctgggagccagcctgggcccagcctcctcagaggagaattgggcaggaacacacagctggtacctggggaagacttgaccctgctaacttcaggtggatgggagaggccaggaccggcttgatgcagggagcaggggcaggtgctggagagacagacccagagggctggggtcccaaaatccaccccaaagcagacagtggcttctggggatcaggcatgagcaagaggtggggcttggaattatagattcaggaatcagagccttatcccaagctacaggcagagagcttcgaggaaggagaatcagaggaacattcactatgtgcccagcactgggccaagagctttaggtgtatcacttgctctagcccatccagcagcactgggggaggtgaaatttccatttcacagatgcgaaaactgacattcagagcagatgagtaatggcttagtcagtggctgagccttggatgtgaactgtaccaaagcagtctggctccagaccactgtgttctggtgcttctagagaaatgcaggcgttagacaagcaagccaggccggacaagatgagctctcagagctggacacacagtcagtacagactaaccttcaggggctagtacactgtggctcctgaattccctcccag

SEQ ID NO: 54847 - DNA, 1558 bp, Bovine  19866880680109
ctaaagctggtggtggctcagacttgggaggctgtggcccatccttggaagcccatggtcccttctggatgcaaggttggtgatagaggggaagtgggaggtgggggcagagaggaacagatctcttctctgccgtggcaggtctgttctggcaagctcgggaaaaatagtttggcagggggtctttgtggggcacacaacatcacaaagcctcccctccctccctcaatgccaaaggcagcttcctaattagaacatccataaccctcagcatctgctccaagagaattcagctgctctaagatggagaagtccattaactttattgcaaaaacgtcggacgtgcttttagacagaggatcactgccaagtgagataaactgccaggacctgccaggggacaggccagaacttcctgcggtccccatttgggtcctcctgactgcctcctctccctagccagtgccctgggtgggactgcagcctcctgggaggctggagctggggaaactgtgaatttcaaatgcaggtgcagtctgggcacgctggctttccccatgcaattcacagcctgctggatggcagcgccagaattggcaccatctaactcccagaatgcaccaggagcccactccacggtcgggcccctcattcctgcgtcagcaggagttggatttgttggtgtccttgggagcagtggagcaaggtggctaagaacgggctttggaattagatattcctggggctgaatctcgattttgccacttaggagtcactgtgtgaccttgcaatagtggcttaatgttctgagactccatagtcacctctcagagggttagacgagatgatgctgggaaccttcaactcggtgcctgtcacgcagcaagggctctacaaacaagagtatccctgccaggtctgtagtgtggaaatggagaggaaaccaaaaccctgaaagtgtgtcagggaagggagtaaacaccaaataccaagatggtcctggcgtctaatcccagctctgccctatgctttgttagcctagcccctcagtttcctcatctgtaaaatgggattgatggtccctgccctcctttccccaaaggagaattagaaagacgtgaaagtacttggaggccgctaaagggatattcaaaagtgccactttattgctcctgttactctggttgtcaacctaatgtctagtgctcgccccggacccaccaggcctgaggctggctgtgccccagcctggaattcatctctgcctcagtaccccatgccacagccctcctgccttgtcctgggcgggcacggttctccacagggaacaaccacagagctcccaggctttgcaaacgtcttgccaagtaggcctcctgggcgtcctttctcagattcagatcgttcttaatatgaataattagcagaaacaatccgagtgggaggcggcagccatagcaatcgacccccatgatttccgagccacggggagagcccaatttcgctccaatccggatgctgtaaattcccatcaagctaagaaaatatagtgcaattt

SEQ ID NO: 54848 - DNA, 1687 bp, Bovine  19866880748126
caaggtgtgatgcgagacatctccggagaagcaatctgagatccaaggacttggtgtgtcggcctttttctctgctgagtcttctttgaaagctttctccccaccctgctccttttcgctccctcctcccacacagacacagaccaaagggaaggatgtgagagaggaaattgtcctgcctccgaagccctttgctgccggcaggcctggtgctgcctgcctgctcgcccagccggcagcccagcctgccacagagagaccttcattatgcctcttgtctctaatggtctaacaagcctttgaaagccaggagccattctccagagctctcaccataattttagcagtgccagccggcctcttggctccccaccccctcgaaaacagctcgagctttcccagcatcagctttgctcatttgatgtgtatcccatccccctccaattcctggtctttcatcccctgcagccgagcctgctttccaccccttaccttctggccaggcaggtaggagcccctcctcccaaggtcaggatgagaagactttctgtaagagaagggatttctggagctgctggaatgacacagaatgcctggagagagaggagagggacaagggtcttgatcacagagccatgaatagcatcacaggacgattatcagtgtaccactcacacaacacaattcacacccatcctgtcaaatccttacagcagtcctggtaaggtcaatataattatccccactctacagaagcagaaactgaggctcagagggggtaagtctttgcccaaagccagaaagccttttgtcgcagagttgggcttcaaaccaagacttgccagacttttaatcaggggtggcacacacaggaagcatgagggagtgaagcactctgggtggtaggcagcaaggggtggtggggactgaggcaaactccagcacacacccggagaaaagggtcattaccactcggctccaacagaccatgccaagcaggaatgcaggccagtgctgtgggggttcatgattttagagagagtttcaggtcttcatgtgatgcctcatggcttttataagtagccactaatttgattttttagaatgccattgaggtcaagcacagcccatctgtagtgtgaaagtggccctctgtcccctccctctgtatgccctgtgtcctttggacctctgcttgctggctaccagagagctagacacaactctgcaagagatagggtctgcgaagggtgagtaggtgtctagattctttctgggcagctccagcaagacacaggactgtccatcgtacaaactggctggcctatgcctggctagcactggagtctaggcactgaccaaggcctttctctgtgagaagaaaagggaggcagggagggaggcagggagagaaggtgaaagggagggaaggaggggggagggacgatgcttgccatcacggagaccaggccagttggcactcacgacaaggagataatcctaagtgcttgacccgggaaacaggactgagggcgagccgccagtccagccccccaggagtcacattccagccaaatccagtacagatgagagccccagggaagaggtgatcccagccacacttggtgctctgtctacacctgtcatctggggcggagttagccttcacccttcaggggagacaggg

SEQ ID NO: 54849 - DNA, 2100 bp, Bovine  19866880762809
cactggagatgctacgaaatacataacaaaggtacagaagcagaaactgtggacggtgatggatcagaaatgagactggtttagacaatgtgtctggggaccaaggtgtgctcaggacttgggtgtgctttgcctcagtttcttggccaacttttgtgtctgacttccttgggagtccctactctctgccttctctgcctggctttctccctagtgacagacggggcatctcctaagcttggagtggactttcaggaggaactcctgtccagctcacctctggtacacgttccagcatcatctttagctttgtatagaccaacacaaagggaccctgggccagggacgccagcatctcctgggtcactcccttccagctaccttcgtggtgggtacctgcccttagcaccctcatcacctgaacctagcttctcttgtctttcatcctcaaactggcccacaatgcccaagatccttgccttatccctgcactagctcctgggggcgaggacggggcgggggggtcccaagatgccctcatgttctcaagttacttcctaatgcagaagccatccatatctgactcacatactagacacactgatccaagaaatagaaacttctgtggcctggccagggcagatgactttatggtgtcaacagagaaagtctttactgataattgaactgagtgaggctccactcctgatgcatctgaaaccataacaacgaattatgggttgcagaaccttgtgcaagtggcttagcctctctgaacctcagtttcctcatctctaaaatggggagaggcctggctcattggatcaagtgaaatgagagcatatagtttacccttaggaagtcatagttgttgttgttattactgttgttttttattcttttttttttttttttggagtacagttgatttacagtgttatgtgagtttcaggtgtacaatgaagtgaatcagttacatatatacatgtatccattctttttcagtttcttttcccataagtgttattatagaatactgagtaggtttccctgtgctatacagtaagtctttatttagttatctattttattttatttttcttcattttaaaaaatttattggcgtatagctgatttgcagcatggtaaagctgatttacaatgttagtttcaggcgtacagcaaagggactcagttgtacctatacatttatccattctttttaaaattcttttcccatttaggttattacaaactactgagtcgagtttaatagtattgataccatattatatattgcatgtgtatatatgtgttctgttgtccttcttccaatcacacagatttttttttttttttttttggtcacctcagaacaactcatgcttgaagctcagctgcacagagttccatttgtcacaaagtctaaaacactgaaaacttgactcaacaaatttgtcattattgtctgagcaagctatagcctttgattgaatttgtcaaacatgataattttattgagcaagccaaagtacataaggttgcatttgcactcctaaattaagagagtgactttagatatgaaaagggtgctacaaaaataagaattgcatatgtttcgaattttcccgaaattcctatttttccccatacagaaaaattaaaggttttggttaattttttttaacctaagctttccaagtttccaaaaatgttatatctcagccccataaggtgagggaaacatgccagaagcacagctctgcatttctaggacactctcaagcttgacagccccatctctgagtcactccacctacagcccagctaggtaggattgagtcggaagccctatcacactcccctccccaggctctgagccagaagcttcagtcccttccccaggttcaagccctcaaaacaagacgccagatctcatctggccccagtcccagacgaatctagtgtttcctccccgttttcagctccaagcattttcctgtctgttctcccttctcctccaccagctgtatagtaggttgaactgtatcccctcaaaagacattttgaagtcctccccctactccccccaccactgaa

SEQ ID NO: 54850 - DNA, 826 bp, Bovine  19866880771540
aaatgtggctcggtggactctgaatactcaggctgactattcatcctcatcctatgtagggcatgaggagggggcggaggaggacaagaagcccccggggaagctctttcttcctctagaagaagcagaagcttgagaagaggggcaaggattctctcctcccctgcactccatctaaccaatcgaggaaatggaggagaaggcatagctagtgaattctgactctcagccctgtgccccttctatactctgctgttctgaacttggaagcaacattggagaaaagtgtgtaagacatatgaaggacttcagctgcctcaagccagccagagcaactggagatattctgcctttgattaggagagagtcactcagttatctgtgggtaaattaactggcttgcaggtaaaccatggaaaaacacatcataatacagaaaataatggggcagggggcagacgtggaaaaaaagtcaaattgattaccgatcagtaacaacctccttctttcagaagatgccgactgtgtggaacacatgcttacacggaggtccacgttgtgcccttggcaacatggaaacctcccctgcagcagcagtccattccggcagcacatgggtgaagacagagcagtgaggactccaggagtgactctctgtgacatgtgtggactgaggtctggcaccttggcagagtggggttgcatgggttgggggaggggctgcttactaaaccaagcccccgaaactgctgggctttgtcaccttggcccgggcaggctgccagaatgtttagaaagcaaagagctcagcctgctcagtgacaga

SEQ ID NO: 54851 - DNA, 736 bp, Bovine  19866880833187
cctcggagcctgggttgcaggggtgagcgtcataccactcataagggctgaacctgcagcaggaagaggggagcaatgaggcaaatcttcggggagatgggaggaaggggtgttcacgccttacaagctggcggtttagcaaacaatgatgtgccgaccactttagcatcaattccctcattgttctgctagggagtcagggaatgggaaaccagagtcattttgcttctcgttttttattgttagtgcccttttctggtgataaaagtaattcagcagtatctcttaaaattaaaagtgcacatgcccttcaacctagcaattctgcgactcattatccatcgtagaaaaaacactcttccaggagcataaagagaagtgcatgggggtgtttatcaaagcattgtttgtaatagcaaaaaactggaaacaagctaaatgtccttcaatagaggaatgattaaatagactacgccaccatcgcactctgaaaccgcacgcagccgttagaagagatgcaccaacagggaaggatcttcaacacatattgtttgttttttttaagtgataaaaataagaacaatatgatcacatttacataaatagattcctgaagacatagttgtgtacctatttatgtgcatttgaatacaaatgcatatacagtctgggaaggatccagatctaaaaaaaaaccactattgacctctggggaggggaaacgcagaagaaattt

SEQ ID NO: 54852 - DNA, 1622 bp, Bovine  19866880854518
tggtcaaggaggcgggcgcctgccatcccatgatggtagccacaccgtaatctacccgccctacttctcaccccctgctctgccacagacctagaattccaccatcagggtctctcctttgattaaaactttgactctagaagagccctgtacatattacctggggagggcaggtcattgtgtgtgatttgattaaactgactgctgccacttagagagtacctaagtataagagaggagagggttgatgagtggaggagggatgagtgggagacggattggtctgagcaaaaggtgtggtcccgctatgtcaggatggtgtgtgtgtgtgtgttggggggtggtcaggcatgacccaggtggggaagcagactcatcgtgggacctcttgggcaggggtacaggctttggaggagggcagggtaggagtggcctgaaggcatcctttttgtctgcagttttcagaatcacgcatgcaccttatgaagtctatgtgctcctgagaccttcagatgctgccctggggctgcgctctggggctctggcagagtcctctcggacctgggctgtgccccctttaccttccctcagagcaactctcccttgcaacagaagcttatgatgtaggagagtgagtcctgcctcttggcgtcttttccccactggcaacatcaaaggtaactgtaccctctccttccagttaatgcattttggactgagaagatagactgtagcaaaacagcgatgaagacaataacatctcgacagtgacagcaacagatgccattttaagtgcttgtttcccaccaggtgctggtcagcactttacaggtgctgcatgtaatcctcacaaaggtcccacaagtaccccattttaccaatgaggagatggaggcgcggcttgttcagggtcatgtggtgagtctacaaaggatggggaatgcacatgcaggtctcacttcaagtggatgctcttgaacacctctcgaggtcaaataaagtggaagtgatccatcccttaattaagtcaacaggagagtgtgcaggaggaacccctgggggtcctgggcccagctgggttggggataggagaccagggcgagcccctggtctgtctgggggagacggggtggcactgttggggagcgctttctgctgcttgctgctgggtagcccttgtccttggttggcattcacagtgggacttccctgactcgtcctcagcaaagtttatccaaggagaacttggctgtaaatttccccaactccgtggccatccagccctggccctggcctcggtcagtggacgctgctgagctgacaacagattcgtcactggctgagtcctgagccagcacagctgtcagcagggaggagtggctctgcaccacgaccgtggcaagtttacccttgagcctgacaggtgcagacagagatctcagaatttgtggctcttctctctgaatgatggatggactggctccttgagtctctgctccaccaactgctgtcagagcaggcgagtctgtggaaagtgccgtggatggcgggacatgtctgctataggcctttggggcaacttggtcagtgggcagggctgggcatgggtgccatgaccctgg

SEQ ID NO: 54853 - DNA, 1158 bp, Bovine  19866880878136
cttccgcttccattccaggtggtgctagtggtaaagaaccagcctgccagggcagcaaacataagagacacgggttcgatccttgagttgggaagatgccctggaggagagcatggcaactagctccaatattcttccctggagagtcctcctggacagaggagtctggtgggctgttacagtccgtggggtctcaaagagtgggacatgactgaagtgacttagcatgcacaaacacttcccattcagtcactagtgtcctgtcagctctccccttcgagcatctctgaaatctgctccttccttctgtttgtggacaccatcactctagtcctggacagtagtatctcttgccttgatcactgacgcagcccgctgtggcatcccagcttctacttccctgatcccagcaacagcagcagtgctctgtcctggggaggtgtccacaggtgtccctgagagaggtctcttgaacctggggcagatctggagttctggttccttgtgaactggggcctggctttggggagaagagatatgtgcgtgtgtgtgtgcgtgcgtgtgggtattttgtgtgcatgtgtgtgtgcatcgcatgctcgtgtgtcagcctgctgcctggggtgatcaaggagggaattctttccccacagtacctagaatgtttcccaagagcctgtctcctgcccgtcacccacccacgcgggagaacaaagctctttccagctgactgccgctcgtgtttgctgagacaagagttgtacatctcaatttttatcacatgaaaatgaaataaagaatgctggaataaacccgaagagacaatactgcagaaagcgactacgcatttgctgtacagtcccctcgtcccctctgcacctccccgaagaactgtccctgttgagatgtcagcgctctctctcttttgggctttcaaagagggtgtcgtggtttaaaacacagggagagttaaacgcgccacagcggcaggaaaagcggttccaaatcgcgttgagtgtttgctgccagctcgtgccgcccgccgccacagtcctgccttgatgtagctgccttgactagacagaagatgttttccttctcaattagaaaaaatccgcagcttctcgcccggcatgggaggtggcagagctggaatta

SEQ ID NO: 54854 - DNA, 1885 bp, Bovine  19866880890110
atcttctccattgtgagggaaaacctcatctgtgattacatgacaattccaaaaaccactgtagatgactattccattattacgatttgcatctttctttgcccacattttttttcttaatttaatttacactacccaagtaacatcactacgataatccttgccctagtttctgctttccagaaatcctaaactagagacatgtggttataaaatacattccactgtaagtgttgtgatggaaagataatcattcattataaaaataatgttaatatttctaaatctctgatgtcctgttatatttttgaaattaaagaagtttgggataaataagatggatgtatttttaaaccattttttaacagtatcaacattttgtttttcttggagctttattattaataatatgtgatttatgtatcataatattaactcttttaaagtatacaattctatggcatttagtttattcacagagttgtgtaattatcactgctatccaattttagagcattttcatcacccccaaaggaaatcccatagttgttagcaatcactctcagctccctcctcttcctaggccccaagaatcactaatctgctttctcagcctatgggattgcttattccagacattttatattgatgccatcatatagtacattgctgttcggactgacttatataacttaacatactgtttctaaggttcatccatgttgtagaatgtgctgctacttcattcttttcatggtcaaataatgtttcatatgaatacagaacatttttatctattcattagttgataaacattatggtttgcttactttttggttattatgaatgcttctgcaattaatatttgtatacaattttattttgtagggatgtatagttaatttctcttgtgtataactaggattataattgtgtcaaatggcttacatttaacattttgaggtgttaccattctgttttctaagcactgtaccattttacaatatcaacgaggaatgaggattccaatttttagtcatccacatcaatatttgttattgttgttgttgttctattttactcattctgctgctgctactgctaagtcgcttcagtcatgtccaactctgggcgaccctgtggactgcagcctaccaggctcctccatccatgggattttccaggcaagagtactggagtggggtgccattgccttctctgcacccccccccccagtgatgtctaaagttatgtgatgctccctctggttctttatattacttctgatatcttgtgacaaatatttagatggctcttttgagattttctcacttaatcatgaaagttaaaaagccacatatcatcaaaaaatgcttgtacttctttcctcaggcgacatggatgaaataatctaacggaaaacaattcatggaaaaactaaaatgtattcctttgtcagcaaatgtggtcagaagatgcaaagagagtaccactgaagatgtgagttaacaagtactagaacaaattatgcaacttgggagctctgctcttcaactggatgaaaatacagatgtttctaacatgtcttagcttatggtatgtgccaggtttaagttccagaaatgaagtacacaaagaattacttttttatgagatatactggggaagagatcatttcaaaaaccaatgatttatgtaataaaaacgatgttttatgggaaaatatataagcacaaccactgatagaggggatggtttaagtgcaatacacaaaggattgcaggttagggttatagagattactccaaacatgaaattcacccaaagatgagctgttgaagcaaagaaattaagtcaagaagttcacaaaatgatgcaggatgtc

SEQ ID NO: 54855 - DNA, 2189 bp, Bovine  19866880896550
acagtggagcctggtggcctacaagtccgtggagttgcaaaagagttggacacggatgagcgactaagcacatcattctctcaagtggtgatgagacaatggggccattcctttgccactgtgaacccctggaactggctgagcctgaaggaccttcatcaggggtcctcaggtgcagaaacccaccagcagcctcttgcaaggctcccactccagaagatgggctgattgtctggccctgtttccccagcaacactagttctcaaaatcccgtcccaccccatgactgattcactctagagtttcaacagccctttgggatgctgcagagaaagggcaagggagtgtctgtacccctaaggggttctgagaaaaccactttgcagtctagctgggtggaaatctgggtcctttgactagactccatgctaagtctcagtgccccccatccctgcctccaaccaagtaggcagctcacaaggttggagaaaacagtctaggaggtgccggggaagggactgggactgcctggacagaaggggacttaggctagagtggaccctgctgcctggaaccccagcatggggcctggtgagagggccagcgtggagatttcaatcctgtctcaactgtaggtcagatgctcttgcgcagtgaacaccccgcaccgctgcactagctggccctgctgttagctcaggaacgaattaaagagaaggcaacccctctgccaggagaatcaccaaccacacgtagactcctaagtgaaatcgacctccttctgtaaaatgggaataataacagaacctaccttacagaattgttgggaggattacatgggttaatctgtgaaaagcacttagtgcctggcaaatataaactgcaatattattattattatgaatatcataattgtctttctgtgcactgcgtggcctgttactgcagcgacctttccagcctcgagaccatgcccaaagtcaccaaaggttaaaaatcatagctagcagtggaaaactatttccggaaaggtccctgagatggctcacttcctgaccctatctcccagcccctccctggccctatcctctaaaattagcacttcatttgtgaagccaccaaggccccagaatctatacatctcccatataaatacgctgccttcggagcagctgtaaaatgccattaatttctggaagtgctttgcggatggcatacatatttaacagccaaagcccagagcattaaaatggtgctcgccttagtaatgtctccagacctgcaacatttcctagggggtaattctgaactccgccaactacttattcatggactatttcacaatttattactggaaatgtccagacagccaattcacaagctctctcggctgctaatcgattgctcagtgaaggtgccctcaatttcataacttcacgctctcctattgctctgggagaacagcagtaagaacaggggtaatatttctctgcaacaagtcacaggaaacaagggtcctgaaaaataaccttttctgacttttcatcgctagggctctcagtttcttagtcgagcttcaccatcatgagagccaggcccggtgctaagattctcccagtgacgggacctgtggagttggaagagggggtcttggcgggcggggagccaagggttagctacctaagagctgcgttcccaagtcctcctggcttaggccatctcaacacacatctgcacgcgcatgcgctctgtacacacacaatgccacgggcatgaagacaccactttctcggatgctctgccctgctcagagacagaggtcaaggaccctggccctcaggccttggcttctgtcagttagaaccagggcagagcattaggagtccggctggtcttcccagcaggtggggcccagaaaaatccccagcctggcccggaatggttctcccagcccatattctggtctccgtagcttcccctctcctgtgccggatgcacaggtccggcctgcctggcagttgagtctaaatggtcacaatgcacacacggcacaaacacatccatcggtttgtatccagacatccctgtgtatagccaaccccacacccgcacaggtatccgcacgcatgccgacacagctgctcacttcagggccccaagaaccctaaccttccaaagcagggccccca

SEQ ID NO: 54856 - DNA, 1274 bp, Bovine  19866880946420
gaaggcctggcgtgctgcgattcatggggtcgcaaagagtcggacaggactgagtgagtgaactgaactgaggctgcttctaccatgtggctccagcatctcaacaggaggccttctctgtaatcacctcaacaaagaaataaatggactgaagcatcatatgagtgctttttactgcctctgcccagaagaatggtatgatgtccactcacatttcatagccctggtggttcagatggtgaagaatctacctgtgatatgggagacccaggttctatccctgggtcgggaagattccctgaagaagggaatggctacccactgtactattttggcctggagaattccatgaacagaggagcctggcaggctacagtccatggggtcacaaagagtcagacacagcacttccagccttttcatgtttcatagaccagaacagcagacctagatgcggcctaactgccatcagcggttggagtgcgtctcccacgtaccccagatggagaaaaaactgggtgccagtgagtccctgtaacttcttccaccatcctcagctgttattgtccttctcctgcatctgtacccaagtttgttttctagacccggagccagccctactgcccaagagtttcttcttcccccttttcatttctgccacgtgtgctgcaggccatcctgagccccctggcccaggggaggtgattcttgcagaggaagggctgtttctgaagccctccctgaccctctccccggcccctcttctgctgactgaagagccctcgtcaatttgttgacaacccggaatcaggcctccggcatctgattacggcagtgcctctgactgtcagggataaatgtctgttgtctttacgaagatctatgttgatggaggtgtcagcagagacagtggtggcggaaccagatccctccccagtgagatgtcatttgtgggcaagtcagatatttccagttcccggcagaactcgggcctctgaagagagtggaggtaggatggctggcagatatgtgaggctgcctggggtgaagggcggggaaccagaagccagaagtgagcagatcatgtgtgaagtggcatcagcagcccagaggggaaactgcttgaaagaagctaagcttctaggctgcaggagaccacgaagatcccccaagcagaacccagcaggccgacaaacaaggaccagaacacggtgccggtatggtctctgaaaattagatctactccaggtcctatcaccagacagctgtgcgcc

SEQ ID NO: 54857 - DNA, 1707 bp, Bovine  19866880966451
gcactggagtgtttctgctccaggcaggcccgctggagcccagagctgaatcacgaacccaaggagcaggggttgccttgattaaacagtgaagccttgcctcgctgctgctggggagggcatcgatggtgtcagtcaggaactccgtggtgcctgcatttctgttcactgcagaaatgtgtttgcagcctggactgactctccacgttcttcctgctgagaggccaggagatgaaatgcccctcatgtgtcagtcataaacgggagtgattttgcccagttcactccatccccccagtagcaacgtctgtgtcgcccccacactctgccacctccttcaggcagcggcctcctgcccttgtctcttggccagcgttctggatgggggctattatcctctttcttgagtcaactccctgaccacagtcattggttgtaggatcagtggctccaaggtggatcaactgagtcctttcctggtgtcttttaaacaggagatggaagagaagagacttttttttttccacataagaccataacagctgaaaacctggagttccccgaggctgtgatttgggcctcctggagacgccagctagaaagaatgaagttgactcacaggaagagtcagagatggagggagacagagacaaagaaagaggaagagacagagacaggagacagagagagaggcacagagagagacaaagagagagggagagacaaggacagagagagggcctccctggtggcccagtggtaaagcatccacctgccaatgtaggagacacgggttcacttcctggtccaggaagatctcacatgccaaagagcaaccaagcccatgcaccacaactactgagaagcttatactctagaacccaagctctgcaacaaaagccactgcaacgagaagcctttgcattgcagctagagagtagcccccactggccacaactagagaaagcccacgccagccacgaagacccagtgcagccaataaatgaataaataagtaaataaaatcataataaaaagagagacagagataaagggagacagacagagacagaggaagacagagagagacaaagaaagagggagagacagaaacacatagagacagagagatggaggcagagacagagaaagaaagagacgaaggtggggggactgacttgcccctgcctccctgcatttggctgcatgagccaataaaggcctctactgatacgtcacctgcttgatacaaggttcccaccactcgtaatcaaggcctaatgtccctctaacacatgccacacagatgccggacacacaaagctgatggtgcagccagagagggagccggtgggagaggcccagtgcctgaggaataatgcaacccaatggggattgacatggtcagaacagcagcctttctcctgggagattgccaccaaggaagaaactctcccaagcagaacaatagagaacgaccccacacttgggtttgtgcattttgccagtggaagaccaatctgttctgcaaacactaagaggtccatgttgacacaaggctgcacatcccagcttggagcgcgtgggacaagaaccactcagagaacaaagagatcaggggttgactccggtagaggagcaattcggatggtacaattgcagatctcaggcaggggttctcaccaagccttcaaggagaaagaagta

SEQ ID NO: 54858 - DNA, 1261 bp, Bovine  19866881060769
cttcctttctctccttgcctcagctccctacctcattcttgcatacccccaccaggattggggatggttctcaccccttgcctgggttggctggaatctgggcaatgactccttctccaggaaactgctggtgtgggcgtgtgtgtgtaaaactcaggggaagtcagcaaggtaggtagatttgcagaaccagtggcatttcaggctagggaggatggagaactcaaatgggccaattcaccctttccacagatggacaagctgaggcttgcagaaggacatgcaagggcatctgtgctgtaaagggaattagggccgctcagcactgagaccatgtctctaggttcctctaattcttctggaggccttgaatgtccaactaaagccgtggctcaatcttgctgcctcagaagtcactgctgccttttgagttggggagtgtagctaaatgactggatttctttccctttaagctttttgctactggggtggagctgggagcttccagccaatgacatggtcttgccagggtctgccaggcattgcaccatcggggtctggatgctaggctgagccagacagcaggttcccagccttggctgcatgttagagtccctggagggtccaaaaaagaaaggtgctcagcccaccaggctctgggaagccctctctacaggtggtttgaggctccgtggggagatcacaaactccctgtcagagtaaggcttggggaatgggttttctggagcagagcaggctgggagtgtgacttgttacagctgtatttccacgggaacaggatcagggcagggacgggaaacacgtgccccatgccccgtgcccctgctggtccttccctggtgcatggttacagtcacatgccactgacctgtcggaggagcctcaccctgtggctgattctaatgacgccgagggccctgccatctccatttgccttgaattcctaactatcgctgcctccggtatggtcgttagtcactcaacattaatatctcccgcatccgtcaccgcagcgatgacgatcctagacttgcctgccatctcaccggccgagggatgtgaagtgggtccccggggcctggccgccctgccctgagtgggtgggggagaaagggggacaggccagcttgttagatctaattacctggctgcaggcagtgggcctgagcttggcccaccgcgtaatcctctgcctgcccttccgccataacgagcctgcccgccatcagctgccgcgcgg

SEQ ID NO: 54859 - DNA, 783 bp, Bovine  19866881094260
aatgaggcagttcccgagctgtgtgtttctagataagagggtttacatcgactggaaggctggcagtgagcctctggaaggtggtgactggttgggacacgagcactttgtgtcgaaggagagcgcgctggtgtgggagggacaggtgctgtcagcaagaatgccacttccctctagtgacctttaccggagacattttccctgaatgtcaggttcattagacacaggactgggggtagaggagtctctttaaaactgaatgaaagacaggacggacagacagacatcatccaggctggcaacaaccagtccatcaggaggatggggagacatacactgtctatgagctaggttcgtccttcttagacctgggttctcctggttggggccactattctccttcagagtggggttcccctccccagggcaagctgtacccagaaagcaccctcagtccacagagctcaccaactgactgaccaagatccaagccctgggaggcccctgggcttggagccgtgttgcctgcccagccccacccctcggaccctgtcaaggatctacatggctcagaacccactctgtctccaccccaagctggatactcggaacacagaggtaaaccagacttctgccctaccctcaaggagctccaagtttcatgaagaagacacaaatgcacaaatgttaccaaagggtaggctcactgctgggacagcttcaaggtagacatgtgccccagaaaagaatcaagaagcactttctgttagaaggaacatctga

SEQ ID NO: 54860 - DNA, 1114 bp, Bovine  19866881166900
cttcagtgtccttctctgtaaaaagggacaaaatagtagagcctgtttcatgggttgcagtgaggatgcaaatgagtagggctaaagatatgcacagcacttaagacgctgcctcccacatagcacactccatggacatgcgagctgttattttcaatagctgaggaatctattatcacctggaagtgggtagagtctgcaatgagccccaaagtgtctgcaaactgagccctcggggttcagtccccatctccccagggtcagcagctctcagggtgtcacctcaactctcctgggataacagtgcccaagagtctttgggaggtggagccagtttggtccctgacaccccagttccccttcagctctgggagagcaagcagcttgcctggctccttccagcttgagctctcctggaattcacagaaggtttgaagagagagaattcacacttcactgaaaatgtgtttcaaacaattagcaggtctttaccagaggagcctttgaagtagaagcccagacccatctctgtgaaggatttccccagaattgacaggctggcagacagcaccaccagctcagcccttccctgggtgccaggagctcctgcgagtccctctgtgtggcagctccagtgtcctctgcagcacagaggctgctgctgctataggttgtaccacggggctggactcccactcgtgtcctgtgttaaatccatgggatttttcccttctccagatcttccaacgtataggccagggcaactgaagcctttgactgtgaactcagacctcctgcatccttaaacaatgcctaaaaccatatgtaattatcagttgaataaatgtgtgcattcctccagtgattggccctgtggcctggggccgcccccatctccccatctgcaagctagagacaggtggggtgggaaaggaacgggctaactgccctctagaactctcagctaaacctcggtgtccttggaagggccctggtggcagtggaatgaaggttggatcctaattccgctccctaaacttttagctgcatgaacttgagcaagtcagtgaatgcgtctcagttttcccatctatgggaagggtaaaataatccc

SEQ ID NO: 54861 - DNA, 1902 bp, Bovine  19866881176808
gtctggaatcttgagattttcctttctcttgaacaattttgtgcttttgaatttggtccttgccaaagcaaaggctggcgcagccagcccagcccctggcacagtgagactcaggcacggtctgcaacgtgctgccactgtctggcagctgagtcccaggagacactcacattcccagcactgggcccaggcacctgtccaggcatctgtcctccagggcccgagtctgttctttttttttctaatctgctttgttctctttctgaagtttccaaggtgtcatagagattaattgagacactgatcagcaaggtggttgctaacagcctcttcccggggctgcctccctgtctgttctgatcagggttctctcttctccctgctggggcccctgaagctctgtgcagcctgtgggttggaagaacaaggctctgctctctgctgcaccagctcctggggccccggcattgcctggggacttgcttctggggctgtttcctggtctcagaggaaggagctggggaacacattggctggctttccctgctgggcatagtaggtggtttatagaaggtaagcagtgcccagtggaaaagggccagggatgggctttctgaggtcctaggcaagggaatggagacaaggagtatgaatgtctcccctcctgtgggtttgttgactcattcattcattccccaagcagtttacaggctacaacctttcacaaggaaccccactgggcactagatgagtcagagagagattaagcaatattcccaggtcttcaggaactcacagctcagaagaagaaacaagaggaggggcataaatcaaagcattttttgatttgtggagtaaaagggtaaaaactgtccatgtgaacagaaagctggggaggttcagagaagagggagtcatggatggctccatgcaagaggcagcatagtctccactcagagctgagctatggaaggaatgtggcaccagtgagggggagaatggccttgggtgggttcccggggatgaggacttgggcttggacaggccaggatgagggagtgaagcagggggccagacaggaggggagctgctgggtttgcttctctatcaccaggactggtcagggattaggtgatgaagggaggcgggggcctggcagaggcagcatcagagaagaccccggatcccgaaccagggtgggagtgcagtcaagccagtggactctgcagccagcctgcctggattggaattgatctcatcacttccgagctgtgtgaccttgggcaagtcccttccctgccccatccctctgtctgatcaactgaacacagggatattaatagcacttacaatatagctctactttaaggcttaaatggcctaaatcatcataggcatattgtaagccctcataaggacaagaaattattattatgcagtgacaaggaagctgttgcagggaggcctttaaaactgagatggaggtatccagaaaaacagcggatgagaggagaggattgcaatcctggtggggggcccaggggagggctcctgatggagtcctggggcccggtggcagttgttttaattgatctggcgatatgccgagctttgtctgtacaactcggggacgcacaagtcaaatactgcaggatcgaccgtgtcgggaggatggccggaggctcccatgctgcccagagaccctgatgaccgatgggctgtcatcaggcggaggagctggagcagggttgctgggaatggggctgcggtggaggggcccaaggggccgtgagcgcccttgctggaggggctgaaggaatgatgatcctgaattccgaggccctggtggggctctctcacttcctggacaggtggagccgtcacacgacccgccccttgcat

SEQ ID NO: 54862 - DNA, 1566 bp, Bovine  19866881194458
atataggacagccccatttgaagctcacagccccttgactccctagtatctccatccccaaactgctccttatccagggccccccactgcagtgactaggaccatcttacctgaatcatttcgggtcagatatctaagcatcaccttcaacttgactctccctcctccccacatctgttccacactcaagtcccccggactcctcttccttgttcagttgctcagtcgtgtccgactcggcgaccccatagactgcagcacgccaggcttccctgtcctcttccttaacgtcattcaagtatgtcctggcacagctgccatcccctgccaggtaacccagaccctggaggctggaatagctcccccaagcgcacttcctctggggaggtggtgagcctctgcttgccagcactgcaagtgaagcatgacgggagaggcatccattgagggaggggacggcagacttggcgtcctctggggaggagaagcaggcatggaacagaactgttgacagactccaggctgctatatcgggaagatttgacaacacacacaaggagagagtgagggcgcgttgacggctggtgagaggcgtgggggctggctggggacgtgccgccaccacccacgcaggaggaagttgggaacagattgcatgggaccggtgccagcctcctgaggagctgtctgctccctctcccctggtgctggtacctgctgagcaactggggagggggttggccaggaacacgggctgtacagggtgtgtcctgagatgggagcctagctctgcacagaggggcctctctgcttcgggcttttggttctctcactccactccattccatcccatcccaaacaatccaatcctaatatcacttgacacctttgtattcccggcctgtctcctccctattccattctcctcacctttcctatctccaaatcctccaccatcttatcccatcccttactcatcagcacaggatgtttcttcaagttttgtttgtttttctctcaaagtggaggagacgacaagagaataaagtttatttgtttatgatggggggggggggatgcttgaggcaatcatcacattcagccccccaggttgacatggaatcaactggttaataactcaagagttgggcacagagtcccagagaatgtggcttggaaacatagccacgactgccccccgcccaggccccttctccaagcccaccctccaggcacaggcacagctgggctatcacaggtgcttcctcttggggtgcctggggtgggtatacgttccctattccttctccccaacttccaccagatgaatcattcccgaaggagccaacaggctgtgtaagttcagcggccctggggacatagtaggattgcacttcttggcccctcacagttgagccagacctgcctgtgaaagcagaaatgtaaatgatttttaattatcagcctgctctcccctctgccctggcccaggtgaaatagaacagtgatcagactcccacatcactgatgagatcttacaaggaaataagaaaatagaaaaacctc

SEQ ID NO: 54863 - DNA, 607 bp, Bovine  19866881538353
tgtgggggaggcggagggcttggactaagcaggcagggtggggcagggcagggaggaagtaagtttgtccagggaccttctgggaggatctttgcttctagcttatcatccaaggtgtggttaatgtagccacactcaggttcctccctgcctacaaaacagtcccatggctggtgccattggtagggaggctgggcaagaagcacttcatttgaattaaagcaggatacaaggtggccagacagcaagcggaattcactggcgatcaggagagtgaggaaggggagctggttcttcaggggctgtgcagttgctcttcctggcccaaggccccagtgagcctgggcccttccgccccagcatcccagctgggtggtagcatctgcatccctcccccggtcctcctcgttgcaccatttgcagggaaggtgggtgagggcagtgcgggctgcgggaggtgctgcttgatgccgaggacagtagctcggtggggagcagggaccgggctcttggaagccaatctgagcatcttagcatggagggaggcaagggcatccaatcagcgccaatgagcctgcactgggcttatttatgctgcttctctttg

SEQ ID NO: 54864 - DNA, 958 bp, Bovine  19866881652936
ccccccacccccaggcttggaatgactgacccaggacaggacctgaccctaacactaacttgacttcatggcatccgctctaccccaggctggcttccactgtgctccctgggctctccttatattcctcttctccctctgcatttcccttccatctgggatgggtttgccagcaaatggggagggaggagaattcaggagactcgacatctcaggggcttcctctgggaaggaggaaggcagcagggctgtcagaaaagttggctcaaaacttgtcagtgatgacaatgctcctgaaaggtgggaacaagatgagttgcttgctgattgaagaaagggtggagacactgtggactcagcccctgtactgcatcgtctgtccatccaggtgggagtgtggagtcccgctgaggggctcaatatcacggaggtcgccaaaggccgaggccctaatgtcaccgactctctgaccaacaggtctctcatcgtcaccaccgtgctggtaagagctgcagccctgcaggaggccccctgtgagctgggagatgggctggccgttggggctagagggacccctccatcaccccgccccgcatagaccagctgcctgttatggggctgctgagaggctggaagatgagggaggggagctgaaggaagctggaaacactgagggtccctcagaaagcccccagagagaagttgaaacatagcaatactgctcacagtcacaggtcagagacaccagggaggtaactgggctgtctcttcccaaaggtggagcaggccagccttcctgcctggacctgcttggccagcccctgctccagaggcctgcctgttttgtatcccagccccacccactccctgagcccctgatgcctgtgcaggaagctgtgggaaggaaggaagggggtgacctgctctctgcaccaggacctgagtctgtttcttccaa

SEQ ID NO: 54865 - DNA, 829 bp, Bovine  19866881687474
tcatctttcactgccccttcagttcacttcagtcactcaatcatgtccgactctttgcaaccccatggactgcaacatgccaggcttccctgtccatcaccaactcccagagcttgctcaaactcaggtccattgagtcggtgatgccatccaaccatctcatcctctgttgtccccttctccttctgccctccctaaacagaactgagcattaagtgaggacccattagaaactagtttatacagaagggtggtcccctcccctcccaggaccttgaagcccaggcagcctacagttaattggaggctgagcttgcctccttccttccttccaggcccactgcccctttatgcaaagagaaatttaagatattaaaatggaagtatcccctccctcacccctacccgccctacagagctcataagccctgcctgaaaacacggaggaggaatcttgtcctcaggaagctggtccaacactcacccaccttgaaaaggacaaggtttctttctgttcaattaacctgcacaagagaggcagaggtggtgggggcatcagggagtgaggaatagaaaaaccctgcgtgatttcctccttggactctaagatgagggagagcttgcaattctgcccccaggatccagaagcccttttcttacctgtgataatcgtgagggtgtgttttctttcatttaaactctcccaaacttaatttaaagtttctctctcctttaaataagtcctggctgcagagtgaacagcgatgagctgccaaagggaagtggaaggggagagaggattgcctgtgaggatattgctgctgcttaa

SEQ ID NO: 54866 - DNA, 1752 bp, Bovine  19866880420425
tccttccaggagtaagcgtcttttaatttatggctgcagtcccatctgcagtgattttggaacccccccaaccccgcccaaatatagtcagcccctgtttccccatctatttgccatgaagtgataggaccagatgacatgatcttagttttctgaatgttgagctttaagccaactttttcatgctcctctttcactttcatcaagaggctctttagttcttcactttctgccataagggtggtgtcatctgcatatctgaggttattgatatttctcccggcaatcttgattccagcttgtgtttcacagcccagcatttctcatgatgtactctgcatataagttaaataagcagggtgacaatatacagctctgatgtactccttttcctatttggaaccagtctgttgttccatgtccagttctaactgttgcttccttatctgcatacagatttctcaagaggcaggtaaggtggtctggtattcccatctctttcagaattttccacaggaggagacgtacaagttcacaaatatggacaaaacagtgtcatagacactgccaccctgggcatctgtatatatggcagtagaggtacagaggaggaaagagttcactggactacggtagaaggggtggaaggaatcctgagaaagaggaagatacaactgaactgagtccacaaagacaaatagcaacttgtcaattgacaaagaaggcaggaaaaatacttatgcttatggtagatggaatagaataatcaggacatggtgtgggattctgggaattgcacgtggttcctcacggctggggtgagagtgtgctgtgtttgtgcagattgggaaggcaggcagagagaggaccccggaagctagatcctggaggcctttttacaacacatacaaacagggtatctaaatattttgaatattccttctccagcaagaaaatacaacaaattaatcccaattgatgtcactagtcactagatgatccacttcaagtacaggaagacaatttcagaaggctctattctaccgttcagaaaagaaaaacatagagccaaaagggaaatacgttctgagttctggcagcctcaagagtcaggtagaatttataagtaggcttaaacaaagaaaatataaggttaaattctgggcaatcaaaaagactatatccctgtagaagtcacaaaagtgctcataaaatttatctgccaagtaaaaacttgaaatacacatgatgtaaattactaataatacttattttttaacattttgaatagaggatcatttatggttgaatacaatctgtgcctaacattataagcacagctggctttttatgaggtttatttagggggttgtgatttcatattcagaacaaaacaaatagcaggcgaggggaaagaagtgtggaacagttgtgcttaattagactgtgagatcccagggggcatctttgtttcctgagctaacactagataacaaaggaatacttgttgacttatatacttcaaatcaatgtaactctatggcctggttatcaactccccttgatgtgtaatggaacccagagaggcaaaataatcaacaatcggtgagcattagcacttgcaagaagtatccccaagtctgccctcccctctaaacacaaacatatttcaaaggttattattctgccaactacctagtgctacatgttaggagggtcacagaactatcatagtaacaaaattagcagcta

SEQ ID NO: 54867 - DNA, 1225 bp, Bovine  19866880451902
tctttagagactaataatactgtgcagtgaaacaatgctatatctaaaaagaggcattttcaataaattctatatttttgcttaagaataagaaaaaggtggcaagccaagccagaaaaaaagaaaaggtataattgttcaaaccatttgtttgtgccactttcccaaagagctcaattacactggagtaaatattaatcgcacgcttagcattttggaatcctttggtcaataactggtttaatgaatatgtatttatttatatagaattccagactgagccagaaaagtgaatattaaattttttttttttcccggtctgacagtaacctttgaaataaacaaaggcattttattctgcttaaatacagactatggggtacagggttttggttttctttcttctacagtcaaaaagaacggacaaaagtgtacagcttttctcaacacagtgggggaccagcttaagttatgagtttacacgtacgtgcttatttaggctaatttgggtctagaagtttcttctttgcctctcctctccccacaccccaagtaaaataatcagaagatgaaaaggaaggagcagttacatcgtgtagggaaaactccatgggaaaccaaattacagtctctacagaatccccgcaagttcaacttccttttctgtattgattttaagattaaagcactgcagcttcaccctgatccataattctgttccttggtgtttgtgtgtgaatgacaggaattgattctgctcagctacatgtccctgtgctgctatgaagaatcaaaaatcctcatcctgattaagaacacaggatatcctaccacacgtggaacagcaattaataaaaggagagtggactccagccatcctaacaaaggccatttaaaatctgaaacactgcagggaagatgagcacaagcagatggctcagatcactgagaaaaagggcctggttctatttcctattatgctattgataatccactctgggacagttttggggagctcctgcctttctgatggctccatctagctttctggtaaccaaggagaacttgatggtcctctacgggccttcatcactcaactggtaccttggtgcttgcagactttgggaatactgtgttactgtcccaggtcatctcaggtggggtttgttcctcctaattagactatcgacttctcatagtgacactggtcttcttcttttctgaa

SEQ ID NO: 54868 - DNA, 2383 bp, Bovine  19866880552210
tatgtggataaaaaaattatcactccctttccaacagaacagccttttttaaattctgtaccctccagttattttccttatgcacatatatatttatgcaagactacaggcactaatttgtattctgcttttttcttatatatcctgttttccatatttttgtgtaattttcataattatcattttcatcataaaaacagtacgatcccattacagaaaataagtcacctctaatcaccatcttgatgacacttcctgcttgttttctctaagtacctgtgttaaagtttgcagaggaggttagggatgtttcaatgcttaggcagcctccattgccattttactttctttgatgatgtaaatttttttgtttttgttttcaaaacacctttgaaattgacataactgttctgaacttccattatcccacatattatgctaaatgaacatgcaaggaataacttgaaaagaccttaaggtagttcctatcttccaagaaatacacagtgagttataggatgttgcagaatgttcaaagatggataagaaaagtctcaagaggatgaagagctttccatgggaaaataaaggaaaacatatcctccaacttgtaaaggctcaaggagaggcatactttcagttcagttgctcagttgtgtccaactctttgccaccccatggactgcagcaagccagacctccctgtccatcaccaactcctagagtttactcaaactcatgtccgttgagtcagtgatgccatccaaccacctcatcctctgttgtccccttctcctcccgccttcaatctttcccagcatcagggtcttttccagtgagccagttcttcgcatcaagtggccaaagtacctggagtttcagcttcaacatcagtccttccaatgaatattgaggactgatttcctttagaatggactggttgaatctccttgcaatccaagggactcgcaacagtcttctccagcaccccagttcaaaagcatcaattcttggacgctcaactttcttcgtagcccaactcttacatccatataacctgtttaacatataacatatgttaacatatctcacatccatataacatatatactggaaaagccataactttgactagacagacctttgtcggcaaagtaatgtcctgctttttaatatgctgtctaggttggtcatacttagatgctatcaaatctttacagcctgggcacagagtgaattcaaagacatttacatcaagtgctgatatattggaacaactcctgccctctgggtctatcccacctgtagaatgaaggcattgatcaagcttgtctctgagattatctctaagtccttttacgtgataaccagtctatgactctttgaatgtaataaacctctctaacattgatagttctttatcttttgtgtcctacactccattaagaatatggcaaaagctttggattctctccattaaaaaatgccactgtgcacaaacacataaaatgtttcatgatcaagggaccaagaattttttgccctaagcaaagaaaagaagctgtggaaatgacatagaattcagaaagtatttcacatccaagaagtagcagaaatgatatggttcatttttctctaatgttgtgtaacccagaaagaaaatgagaagacattctggaagacatgtataaaacactttgaaaagttacataaaaacattgaccaaaatgagtttaaaatatttggatgtaatctaattatataatttaggagaccgtagtaaaaatggtgactcttggagctatacatggaagtgctgagttcaggcttctagaatgagagggacaatgggcaagactacagttgtctggctgtttttagaaaacatgtgctaatggactaaatatatcccctagctcctttgtacattattagaagctctatctgtgaagttggttatttgcaattttgttttctatatgttacactaacatttggttttaatacagatgaggccactctttcttctaacattgtctccttctgtgtgaagtgagtggattctcactttaaactgagattatagtggagaagtgatgtagtgttgactataagccattgaacataagttgcattttgtggctctagttaaattgctcaggatttttctgctgtgctaaagtcgatagaagaagaaagctgttttagaaaaagaatatgaagcatctcattttttaaaagatgtggaccctgttcgctttgtgattcagatgcttaaagacgtgtcataaggatgcttcagttttggaaatgcatagtttgaaatgagaaagaagactgtcatcagacagcgcttttcccaagagatttggagtcaaaacta

SEQ ID NO: 54869 - DNA, 943 bp, Bovine  19866880576129
aaaaaaaaaaaaaatatatatgtatgtatatgttaactcctttaaaattgaaaacaggaaaaaaaaggaatagaaatttaaagactatgtacaacatttgtttgtaattgccaagattattgttccaccattaaagggaagagggtttagtttaaacacatttttcacattaagttagtccatattttacccactcccctaaaaatgcctcaagtatttcatgaacttaaaagaaagcattattcatacatttaactgagaaactgattattacatagttgtacctagaaaatgaatgcagattaaaatacgtagtaattcttgattaatttcaagctttatctgaactctaagaagccacaattctaatgctgttattcgatgttccttttacacatttcctgggaattacatttataacagatttcagggcaaaaatggttttactaaaaaagaaaaaaaaaaaaaaaaagaaccaaaatgccagctaacagttccttcaggaagcatttcactgtgggtgttttcacagacatattttggctttgatcaaggaataaaaagcagatgaattaacaaacatatgacacaggtcagaagcaacgcgtgaggggaaaccacttagcattctcattctccacgcacgtgctcttttaagtacgaaggagaacgaactgttggatttggacagttagtgtcaggagaattttctttattgttcagaactcagtaaaaatcatgcatgttttatgtaccaaacacctgtatctcacgtcctgacaggttctaagcatatgaatctaactgtttattcaaaataaaattctcatttttttaagaagttcattaaaaaaggaaaactttgatttttgaaatcacatcattagcgctgggctcatgaaatctctaggccatttggaaaatgtatgtatcagttaacggg

SEQ ID NO: 54870 - DNA, 1032 bp, Bovine  19866880619557
ttcgtatcgattgaggtataaaaaacaacacaccaaaagttagagacaaaggtattataaactgtacgaaaacaatgaaaaatagcattccaaaatgatacacctatcactgttgatcttggaaaccaacttacagaaggcagggaagatacatgaaatttcaactgtttgacagaaaaaatatgacattgttcctctacaaagtagccttgatattaataatttggaaaatagattagcaaagataacacataatacaggactcctaattaaaagacgcttactctttggaaggaaagttatgaccaaactaggtagcatattcaaaagcagagacattattttgccaacaaaggttcgtctagtcaaggctatggtttttcctgtggtcatgtatggatgtgacagttggactgtgaagaaggctgagagccaaagaattgatgcttttgaactgtggtgttggagaagactcttgagagtcccttggactgcagtccattctgaaggagatcagccctgggatttctttggaaggaatgatgctaaagctgaaactctagtactttggccacctcaggcgaagagttgactcattggaaaagactctgatgctgggagggattgggggcaggaggagaaggggacgacagaggatgaaatggctggatggcatcactgactcgatggacgtgagtctgggtgaactccgggagttggtgatggatagggaggcctggtgtgctgcaattcatggggttgcaaagagtcagacacgactgagtgactgaactgaactgaatattggtactcaataaattttgatctgacggatcaaaaatagtgactcagtcacagaacaaaggagctacttatcaacattttctaaatgcatcatataaaatgattgcttcaacctcttcttggaaatatattttacttttgtagttcttcaaagatcggtgaatctgctttttacatgttgtttttcgaaagtctaagataccggcaatggtgctccactccagtact

SEQ ID NO: 54871 - DNA, 1201 bp, Bovine  19866880637123
caggctctcagttttccaatttgtctcaatctttgaaccctcaacttgctctgtcagacattattgcacataattgcctgcatctggccccttgttttctaatgctgccctgtgtagatgaaacctgcttcctttccctgaaatttgcttgctcctgcttctctgacatcattcctcttatccccaacctgcagaatactcttgatgtttttctccaccattttgaccatctctttcaaaaatcaaagaacttatctctttagaatctgatttgtgtgctctgaatcttttcagcttaaatttataaatataggaaacttgaatctaataggaacatgaacaccaagaagctgagataactgttctctcctaagaccaactttgtagtcctcattgtacctatttattttttaaatctcttaccttatggcaagtactagaagtgattcactgttctatcactagcacacccaagaatatgatgcttggtagatacttgacagggcttccctgatggctcagatggtaaagaatctacctgcaatgcaggagacctgggtttgatccctgggttgggaatatctcctggaggagggcatagcaactacttcagtattcttacctggagaatcccccatggacacaggaacctggtgagctacagtccacggggttgcaaaaagttggacacgactgagcacctaagcacagcatagatacttgacaagattttttaaattgtttaaattaatttttattggagtatagttgctttacaatgtctggtgtacagcaacatgagttagccatacgccccttcccatttggagtttcttcctattgaggtcagcacagtgcattaagtcgagtccctgtgctatacactatgttctcattagttgtctattttatacatagtagatgtttttaaataaaggactgtattaacaaatacttggggatgaacttagattacatctaaataaactctagagaaactctagaaatgagaaatgtaaatatctaataggtagagcaggatgtcatttgagctgcagagatgcactggaagaattaaatgacccctgcctaacatggtccagaaaggctctatgaccatcacaccactgtcttagttcattcatgctgctataacaaaataccatactggacaacttgtaaacaacagaaatttatttct

SEQ ID NO: 54872 - DNA, 1011 bp, Bovine  19866880657847
cagagcactgttatttggatgctaaaatccaagcaagaaaattatgtgtataataataatcaaactgtagcccctagcctttactatttaactttgttcagaaaggtataattcaaaattttctaagtaatgctatttcttggagaaataagataaacctaatttcatttataggctaactaaagactgagggtccatttatcattttaaaaatgctagccagcagataagattagtttctgtcattcacagcactgtcaagatgactcaatatgattgcaaagtcgatttttatggccatatttgaacaaataataaatgttcccatacaggcttcagtttgagggtctcaagaatttgatacagaggataaacgataagcacacttctagcaggagattcattttataatctcatcctactcttttctaaagaagatctagaagaagccactaaaatcattaaagcctggataaaaggagtatagaaataaagcttaaaggaagtgagattattgtggctgaagaaaagacagcataaggataatctaataatagttattaaatataggaaagcttattgtataaaggataggtgaagctgctcaagtgagcaactcaagcaaaaatgggaatgaagaaatcacataaaatgaagaaaggaacgtgcccacataagtgtaagcagtagatactgaaagttataaaaaatactcctctgaaaagggatatcagggaacagcaacgaaacagcagcttggatggagtcaatagaattaattaaattctatctggatattcaccataatctactgagattccccacaaaatactgaattaaatggaaataataaactaaatagaaacataaaaatccactttagggaaaaatcttaggccactgagattatgtcagatatacaatttacatacaaagtggattttggaagagttacaaaaaatctgattgccttcttaagtcattaccaaaggcaactaaatatcaaaaaca

SEQ ID NO: 54873 - DNA, 938 bp, Bovine  19866880721784
agctgtgcattagtaaataaaagcataggtttggaaattatgtttgcaaatttggaagtaaataaaaaggcaatttagcaattggttataaaaatgaagccaggcatggaaaacttattaatgttcttttaatagttttctgaggtaataagaactgtgatggggtaatcagttggagtttccttggtttttaatatgttttcttctcctgcacaccccagcaccatatgttcctaaaaaatttcccattagtggctcattgacaaatgggacagaaaccagtattctaaggctggagtttcaaagaaacaagaaatccaaccacaacatttagatggtatgtgatttaccactgattacataatgacaaaaagtggccatcaggaataaaattgcagctcctgtaagcaattgcattagtgagacaggtgctccataaatgacaacaagtaatggtaacagtaataacaaaaaatgccttatgtttatccaatgccttccttctaaaatactgaaaactaccgatggaaaatggctctctgctcctcccaggtttttggaggttgctggtactcttttttttttttaatctcaattatagagatatttatcaaagaatcataaagcaagatgggattctgagagattatctacagcaaatccaccacctctaaagagctgagtgcccatcgaaatgcctcctgagaattttctggcaaagagtccataaactttcagatccaaagactcataaactttactgagtgatgaactttttccagataaacaactgaaaattcagttatatccatgatgggatctagggaaagtttccttgcttatgaaactatatgataatttcctttcctatgtggaaaacttttaggtcacataaagggaaaaattccctattactaaactatcacaacctacacaga

SEQ ID NO: 54874 - DNA, 1231 bp, Bovine  19866880764587
aaataatcacataatacacttgaatagcaccactacatcaagaaaggggtctctgtgaatacagatgctttgcagcttgacagaaagtggtctgagtcgaaaaagaatttgaaaaccatagccacatgcaagcatttaggaccacctttggtggcaacttggtgttctggagttctttacaaacctctctcgaactgttatacttgttccttgaaactgctttaagtgttagacttgctaaaacataggggtggtaacgactgctctactttctcacaatctgttgggatattgattgaaatatttatgcagtactccgagttctcaggaaaaggggtgttagaaaatgcgacagtgatggcagggcatggaaaattatgtgaaaatataatctccagaaagataagtttgagacagtttgaattactagtcggagcctgtctggcagtcttctgtccttctgtctaaatcttttgtctcagttatcagttctgggtgatgtaagagggtggggtataaggaaagcgttataagattaaacctcttgctggcgtagcattgtccccgaagagtgtcttggctgctggcattggagtggcctatccttccagatggcaggttagccaggagagtctggggccaggagtctccagtcttcactccttgccctgactccatcctgtctgcttgctgagccccttcacagcttcctgtagacctggttatggtctcaccagtcacaagactgacactgtcatctgaaggtcatcataaccttccaaaatcagtcctcatgcaccttgaccatgctgtactggacactgtggactgcctgaaaagattaactcatcactcactctatctgtatttctttctagaagcaactacagattcaggctgcctggctggaacggcagctttctagttgtgtgatgttaaacagtttggtctcttagtatttggtttccccagctatcaaatgggcttccatttccccaactatcaaatgggcttcccaggcacagcgggtaaatgtattcacctgcaaatgcagaagacgaaggtttgatccctgggtggggaaaatcccctgtaggagtgagagagtcatttcctaggcaggttgatagggagtctcggggtccccaaggagagaggggtctggaattctcaaggaagaaaaaaggacaaactttttttctttctccacattccttaggattatatacca

SEQ ID NO: 54875 - DNA, 1490 bp, Bovine  19866880785737
tgggagaagatcatgttaagatggaagcagggatcagaattatgctccccaaagccaaaaaaaggccaggaccaccagaagatggaagaagcaaggaagggtcctcctttagagcctttgaagggaatgtggcctctggcctctggaactaggagtccatcgatttctatttttttaaaccacccaagtctgtggtaatttgttttacttgccctgggaaatgaacatactagctttaatgatcataaatattgcatgatgtttctgctgctaacaaatgatcagtgggcaaatccaggaaaaagaggaaggaagtgaaacaataccatctcctgctcactctaaggtaataggaagcaggaaacacgagttactagctgggtgagggagcacagagaacaggagtgagtaaacagttagtgatgagaggagatgcaggctgaaatctacaaagaaacaacaggagtggtgaggcgtggtgagaagtcaaaaggctgcgatgttgagagataagctgtgggcaggtagcaggcatcagagtagtcaaggctgaagtccaggcatctgtgacatggaaaaggaaggaggcatgttttacaaccattattccatccaaaccctagaaatgatgtctgtgttcctaggacacatattttattattcttattttatagagcagggaataggtatggagaggtgagaaacttggtcctgatcacagaagtatccactgaaacatctgggatttaaatctatttgtatctgatcccaagtcttatataccaagcttgattcaaagtatccaacagatcctttgttacaaaactgactgaaagaaaggatcccttatttataacttttttgtacttcctctcagggcagtaattgattctatggagtagaaagatgcaggccagcgacaagtgatgctaatactgtctgtatatgttggaatcatctggacagctcataacacctggatgcccagacctcatccctgatctactgaaccatatctctgggatggaatcttacccctgatcaacagaaccaactccctgggtgtgttcagaaagcctttgggtgcttctaatgaaaattgttactgatacccacacacccccaggcagcagtggggagctcagaaggatgaggaagacagaagaatgtagggtttgcaggctgcctctatctcacttctcagaagggctctgacacacactggggcaatgaggaaaatgaaaatgtactttaaatgtttgaatattgtttcaactttttcacttgcacagtttatgggttttttcctcctgtgaatgtgggaatgtaagcctcggctttaggaaagctgtccttgtctcacattgctcaacatgagccaggaaacgtacactcagccctgtgtctggaaagaactttgcaacattcagcaatgtgctagactaggaagcagcttctgctgccgctgcaaatattgtttttacaaattt

SEQ ID NO: 54876 - DNA, 1639 bp, Bovine  19866880804283
cctggggaaagagtaaaggcgtcagagtgccctgggcagtgttgagccagggtgactaggaggtaattaagaaacctcgtcgggaaagatacaggcagtcagggaagaaatgaatttcctcatagataacatgtcctccctccttggggactcataaaatagggtttctagtatatggaagttttttcctaataagaaatcgaatagtgcaccgggtgatctctgtcattcagcactggttctgtgaatgcgtgaataagggtttgtaaaaatcagtcctgcatgagagaatatgccttagtaggaagttaaaggagtgccttaaattcattaaaagtctgagagctgtaagtttaaccctgaaggcagaaatactgttgagattcaggtgttagagtcaaaccatcaaagttccattcccattgtagttactgagtgttgataagtctcagtttttttcatctgtaaaataggaataatgccattagcttagtggcattgtcagacaatgagccaagttagttagctaaatgacttagaattgtacttgaaacacagtaaagtctgggtatacggtatttgtagagattgttgtgacagaaactgaaaatggatagtttaaatgagttactcttttagatgttctgaacggccttagcatttgggggtgttattgataaagcacactgagatggtgtaaggagaacgtgtggataatctgcccataataggtgtagaatacctgtcctcatatctctgctgggctcagcaactctttccttttcctgtttctttgggctcattcatagtaaactcataggaaaaatggctcctatattgatgtatggaagaactgggagaacatttgctcacacttcaattattaagggctgatttttaagctttcagttcagttcagtcactcagtcgtgtccgactctttgccaccccatggactgcaacatgccaggcctcccccgtccaacaacaactcctggagtttactcaaacttatgtccattgagtcggtgatgccatccaaccgtctcatcctctgtcgtccccttctcctcctgccttcagtctttcccagaatcagggtctttcaaatgagtcagttcttcacatcaggtgcccaaagtattggagtttcagcttcaccatcagtcctttagtgacaaaagtaacatttggtgggacttccatactaatgcatggaatatgccattttcttttctgcctatgcaaagacaagagtgaaattggagactggaagaaatagaagagtatccaaagtatgtaactaaaatagaattatttttaaattctaaatacatatactgaataggtaacaatatgcaatacaaatgcaaaaaaaaaaaaaaaaaaaccccactctactaaactgatgaatgacctgttaaataatggtgcaaatggaatgacatgtgggagatccgtgtgttacaccagctctctaagtggttcccatgcacaccctgaagattgtaacctactagggtcgtggggtctcactgacttcccatttagcacaatattaagtaaagctgcagtcactttcctgttctttttactgtatgagctttctgcaactctgcttcctgagaaaccccctttg

SEQ ID NO: 54877 - DNA, 1028 bp, Bovine  19866880968901
acaccaggaaatcaattcaggaagaggcaatcaaagaaaaatgatagagcttacatatatatataaacaaatcaaatagccaatctaatctgatgaaaggagatgaccaagaggtcaagtgtaaaaaagggagtttgagaaggtaagttcagagaaggcccgagtctacattttctaacatgccataggtcatgagcatcaaacagaagaccactgcacaaacctaccatctagcctcacactctctaaatgagggcctgcctctccactctgttctacgtaggctctttattcacaggaaacagaagtaaggaaatagactaggacattcatggaataaaaggccttaggtgagcagtaatgataaactgtataaaaagaggattcaggaacatcacgagtactattttagtattaggatctgacatggcactgagaaaaatgtaaagctctgatacagagagaagaaaaagtcaaatatcacagggaactagtaacctttggagaaagtcagtccgtttcactcaccaaggtttctccatagtcaagcacagagtagtacagtcatattcagtaattttttcccactaaatgaatttccattctatctgtttcatgaggtctttgaaattcttgtcactttttgtaaaaagcaatgcttgtgtgtgtttgagtgtgaaactgtttttttatggaaaactttctgcttatttgttactcaagatcctagtaatatttgaaaattcatgagctcacaaaggaatgcacattgaaaattttgacctccagctcttcagataacctcactaggtccagtacaatatagaattttatggctaaagcatttatcaactgcttgtagaattgggagattagtgcaagatccatctcattacttcaggctgccaaataatggtctgttttgctaattgacacctgaacatataattataactggcgaccctacatagcagagcaccttaggtcaaaaaatcagctagcttccagatcccaagggcaaactgagg

SEQ ID NO: 54878 - DNA, 858 bp, Bovine  19866881177981
cctcagcatcccttgttgcttttttcatgttgcctatacctctgtaagtccctcttcattagtatttcttccgttaatcatctgaatggaattctgtttttcatttaggatcatgaatagatttccctacttagtcactattttcaggttttaattttttttctttcttcgcacaacagtcataggtgtttattttctggcttgttgatggtgggggacagggaggcctggcgtgctgccgtccatggggtcacaaagaattggacacggctgtgtgactgaacaacaacaacaggcttgttgatttcctatcttttctcactagaaattaagttccaaacacataggcaggaggaatgtgctcaggagtttgttggatgaatgtatatgtgggtgggtgggcagatagatggtcacagtgaataggttttgagtgtcttaactgcagagtcagagtgggaagatgagaaagagagagggacaaaaacttgtttacttttatgttatgtctgaccatatcattaatttcttctccattagaaagcctctcagtatgtatatccctcaagtatcatgctagatgctgtacagagcaactttaatacatttagtgtggtgaaaataaaagaaacattgcactacagacagaatctgggacctaaagatactggctcattagacatgacaattttcaacttgagtaacagagacacattcaaactcctaactggttgactgcagtctgggccatgtcagggccccatactgctggctccatggcgtctctgggccgtctaccaacgtgcttatcaagtcactcctaacctcatcaccagccatttgtacatgtcattacac

SEQ ID NO: 54879 - DNA, 1394 bp, Bovine  19866881215507
ctatgcttttatccatggcactgttaagccctgtaatattaaatattttcaagttagtaaaatagtgtcagcatctcaggcatctctcatgcttcatctgctctgaacagcaagtggcatcttgttgcagcttgctgtccagtcccagcatgcattctaaattccaggtgcttgttttgtgacagccatccactccagcaggttgttctcctgccatcctaagcatcctctgggtccttgactcttctctcccacaaaaccttgccagaccccacccagtggcaccaatttgtttctcagagacctcatttcacttgtctcatggatttttttttaggtgagttaaatctacacccattgtttgtgtagtccattcccctacccctgctgttcttaaaggtaaatggcaccccagctactgctaggtttcaagcacgcgtcccacaggtagcaagacttcctacatcaatcttcagtgccacctggctccctgatacgctttcttttttagacgttgctctgttgtcaggagcttccctcccactcctcccaccacctctctggaaaagcttttctgaatatgacaaccatctgaagatgaattatctgctcgaaaagttaatttctgtttctcagcagggagccatgggttcccgctgggtttgaaagtgctgttgtttggttaatggatgagtgtttcttggatccggaacccacactggaactgcagcagagtctggcttcccatttactttaatttcctacttgcagctggcgttggagacctaaatgggcttattcacaggatagtggcttccggttgttagcaccggaaggaagtcaaactgctgcttccctgccatcttcactcacttgggaggatttgattggctttttttttttttttttttttgacagtgaagccacaaaatccttccagaggtagaacaaatggcttaacctaggaaattcatcatggagttttaagagttgaaaaagaatgggggttttgtatgttgtctttggtgtacaggattatgaaaataaaataagatgctaggtaaaaattgctttgagcacttataataatgttgtcactcttttgtatgctaaagctttttaaaaattcaagaaattttgtaacaaattgttgtattatcgtctagaaagcagagccagaaaccaactagaaaattccttagaacacatctgtaatgcttccatcaggttatgaaatcacctctttccataggtcacacagggcaaatattggcaatttcatatggtctgccctatacagaattctggctttttagacagaattctgaaggccaacaacattatagatgcatttttcccttgacaaaaatccaaagcctgtaggccaatgccca

SEQ ID NO: 54880 - DNA, 1014 bp, Bovine  19866881281569
gctgttcgtgtgtgcttctgagaaagaagagctgactattggatctcctaattcctcttgcttcgcagcggcatctgttcttatcacagtaacaccaggctctcctggctcagtcaatacttgtatattaacaagagacgatcgatagaaaaattaaaaaggaaagtcaaggtaattaggctaaagctgctgcttatgagttttcaataattactttagcttcctcttgttttcccatctccagaaaaatagggcctgattgaaggactgggtcgtgtttgactgaggacatgtcaaaattatacaaagccaggcaggaaataaaattaagccgtatttgtatgagagcagtaaaaggggctttgcctgatggcacgggaagaataggcgttgatttaaatgcacccatgagcagctgtgccattgtggatacctgcttcatgtcatcagtttttgcaccactggcagaagcccactcagaagtactgtgacatgtcatgtatcaaagctccagaagaagagagcagatgaatttctcccagacacaggatctttggggaaattagatgccatcctttacaaaaccacgaaataactcaaaaccctatggctgccatactttggccactacttcgtatgcacgttattgacagggttcacacaccaggctgttgtgagcaagctgtccgcgttaggggaatgagcctaatctttgatttttgagctactttgtcatttttgtgccctgatgctgggagtcctaaataaatcagaaccaccctttttctaattgctccgtgtgagcttgttacatctgcctctttgtgcatgctcagtcgtgtctgactcttggcaatcccacggactgtagcccgccaggctcctctgtccatgcaattttgcagacaagaataatggaatgagttgccttttccttttccagaggatcttcccagcccagggatcgaacccctgtctcttgagtctcctgcattggcaggtgatactttacca

SEQ ID NO: 54881 - DNA, 825 bp, Bovine  19866881323621
ctggaattgtttataggaataagcagttgtcctattttgtcataaacacagattttttttttttctcactacagatacagagagaacatttccttttaactggaaaaaaaaaattccctttcaaagcaagtttccatcattcaaaaagatatctggagctgaaatgccctttacctgctttatttacatgagaaacagggcagaaagagacttgaagctctccaccatctaatttctctaagctacagccattgattctttgtaagtttatttattcaaaacaacagcacaaacaattcttttttcttgggtcagcagcttactgaattaacatcaatcatcaaaggagacggggctgaaaggaagatggaagcccattttctcagagattgatttttttttttaagccaaaacacacaggcataagcaggaggctatttaccattgaaaaggttcaacttgaaagtcacagctgaaaactgggcactcacaggactgtccaggttccttgaaatccaaaagaatttttactcatgtatttctttatgatggcctgtgaagtttgattacttcaccatctaaagcccacctgaacaattcaaaacacggggaggggaggttctgaaggagagggaagtggatcaatgctggtgtttattataatgatttcctaatggctttctctactctctttacttactttgatgtatttaaagtgggaaaagttcatcaaagacctctttgattagaagcttaaatgtatttaaataactatctttggcatgttttagagggattgctccataggtccggcaaaaaattctt

SEQ ID NO: 54882 - DNA, 618 bp, Bovine  19866881355012
atataactgggtcactttgttgtagcacagaagctgacacaacattgtaaagcaattatattccaatcaaaaataaaatataggtattacatatgtacagatttttggagatcccctggttgatggtaatttgaaaataaaacctttggtaaaatagttataaacggcaacattagaatttaggaagtaagatccatgctttagacattcaaagacaataaggatagattgcatacactctttgttttctggtatatcctgcgctactgcttgaggattgggaggctgatctgaataacgttcttcaaaaatcccgtaattagatactctgcatctttcattatgtagatccttctctttgattctcattgtctctctttccatatacacagatgtacctgcgttttgtgtttgccttctcatcgtttacaagaagaggaaatccccagtgtgaaagcacttcacaagattagataatacccttttgacggggttccatctgtgttccattttaactttgaagtgaagtgttttctttcctaatgagattcctttcactgttaaaaattcaatgttttcttacttccaaagagctgattaggagcattgttggaaaaa

SEQ ID NO: 54883 - DNA, 905 bp, Bovine  19866881458789
tttcctctctgcacagactatgagtttggttcacctcttagatgcctagggacaatcttcctctgtgtccttcctgtctaagaaagggcgttttgcccatttggtgtgattgcttctcattcttgaccagagtgtggagaagaggctggtgagacggccctaatttttctctttctttctcccctcatgtctcatgtcttctgcacagtgggaccctcccagctccaaaagcagatttagaaacatgttgaatgggtcccctcgagtcagagatgacaccatcaacctgactgtgtcattttagacggatgtgtatgctttagggaataaatgatttgtatccgaaaaaaatcatttggctgaaggtgatggaagctgctccatccgtgctgctcagagtggtttcagattcgaggggcaccaaaggcaaataagggactagaaaaaaagaaaaatggggtaatttagagccttctgttactttgtttaggagcaggttaactactaaaaatctcctccaaataattggtcgattttgaaaatacaagaagtatttctgtcagagaacgcttcttctaagacccatgggaaagaataaatagggattctgatgacaggtgtatttatttgttatcagattggtaacagtggttgtctttcagagtcagaccaagggaaccgggatgcccctgggtggagggtttctctgtgagttagatgagatcagaggggatcactctagcatgatgtgggacctggagatcttaaaactataaccatagttaactatctgctctttatttcttcatttctgctcccccccgcccccccgcccaccttctacgcaatctcttcttaaagatttattgtatcttatttgggtcaggcctaaaaacatatatata

SEQ ID NO: 54884 - DNA, 830 bp, Bovine  19866881815449
cactactttggtcattttatttattgtttcattaaaattctgggtgaccatttaatgttttaaatgagccaagacccttaaaaatgcgcagattgagagcatatgggggtactcttccatattatttagttttctttaagcctaaaattgccctaaaatataaagtaagatgattaattttttaaaaagtgctcaaaaaaagggattagaaaatatacataagtttgacagttattggagaagaaagatcccagatgtgcaagttgatttttttaaaaatccctcttcatttatacatccaagcatcaacagatgtatgatttagcatttgccctgcacctctggccctagggactgtggagtttttgtatatagattccctgctgcagtgaactctgtcattgttatgaacagctgggaatggagtatagctcattaagacaggagatgttatccaagcctcctctggcatcctgaagagtagtgaatatgttttgcttacccacatctaaagtatccatttcgttaccacctagtgttctctttgcttttattgaaaaactctactggccccattgcctctttgaatgatgtgcacagttgctaccagctgttcccttgttatctcttctccctcttctttggctttttattatgtttatggtgaacgttgtggcttttatttcaaaaaataaggccctcgtgtactttgtacatatcacttgtttatgcagtttgaagaatcttaagaacagatttccacaaataaatccctaatgttcagatatccttgctcccttgcggatgaaaagcaactttgctgtggaaag

SEQ ID NO: 54885 - DNA, 1584 bp, Bovine  19866880276003
attagaggaacatttcatgcaaagatgggctcaataaaggacagaaatggtatggacctaacagaagcagaagatattaagaagagatggcaagaatacacagaagaactgtacaaaaaagatcttcacgacccagataatcacgatggtgtgatcactgacctagagccagacatcctggaatgtgaagtcaagtgggccttggaaagcatcactacaaacaaaactagtggaggtgatggaattccagttgagctattccaaatcctgaaagatgatgctgtgaaagtgctgcactcaatatgccagcaaatttggaaaactcagcagtggccacaggactggaaaaggtcagttttcattccaatcccaaagaaaggcaacgccaaagagtgcttaaactactgcacaattgcactcatctcacatgctagtaaagtaatgctcaaatttaacttagtatatattattaaatatttgaaaaaatctttcactattccaagcagtaacctatttgatggtctaaaacaggtgtcattcctcttttacatgttagctctcagatattaaaaattagcgattacctccccactgcctcccaacctccttctcaagctgtccttccacaggctaaacacacctagctccatttagtgttttctcatcatttccagttttctcagcctcatgattttctaactctcaagctaagtcaagtaattgaaatatgttctaagtattacattactcttactttattctgccctagatatttatcctctattttgttgcatatatcacatttcactgaagattacaagaggctacacttattacgaggagagtaaaaattctaaagcacaagtcactctttgggataatatatgcacttccatttttgcttcagatcttcatatcttacacaatgaattctaaacagcaaatgtaatactatttatactttaaaaattagactggcagattttatctccaaagcattaaatactaaagaagtagccagacctgagaacctagttgtcatcactttattactttgacagtacaaaaatgtcatgagattctttaagttaatttttattggagtatagttgctttataatatttagtttctactgtacagcaaagtgaaaggacagaatatacatatacgtatattccctcttttttgatttccttcccatttaggaaggaaccatagaaacaactgagtagaattccttgtgctatacaataggctctcattagttatctattttatacatagtatcaacagtatcaatcccaatctcccaattcatttctcctcagatgtcatgagattcttaccccaccaactgcctcttttagcataataaattattttacataatttgaggaatgaaaacacgaaatcatctaacagtagttgatatctagactatatatactattctcacatttttactcctctttcctgtttttgtctatacaaaaattttaaaatgccaatgtggatgtgtgcatactaagttgcttcggccatgtctgactctttccgaccctatgggctgtagcccacaaaat

SEQ ID NO: 54886 - DNA, 1628 bp, Bovine  19866880340052
aactgcaagctataggagcacaagggatagaaaaagatgttttaaaaagaccacaaagatgtaatcagataaattgaaaatttaggaaatctacaagatctagcttcttcaatatatgttggcaaaggaacagaaacttgttaaagagtacaagaaacttaaaagattcacgtaaatgcaatgttacagaccttgtttggaccttgacttgcacaaatcagaagagaacttcagaattggggcaatttgaacaaaaaattggctataagatcatatttaggactaattttttattttgttaggtgtgataatggtaatgtgattttgctatagtaagatattttttaaaaatctgtaagactgaaagcatgacatatattcagaaattcaattagtagactgatacggagcaaacagtttgatttatagctagttccttttcaagaaaaaaatgtcatctttctggtagatcttggaatttcaaatcactaaaaacacactgtcacccaactttctactttcaaaggaacataccacctcagctgggtaaatgtcagacaaccaagttttgttactgcttcaggatgtcttttcccatttaaaatgtaaacatattcaccacatacaatactctaaaatgtcacaaatacataattatactatgtctctataaatactgtattagaaaacttactaaattgaagaactgaaggacaagcacgtgatttcatgatcttcttgaagcactgaactgattttcttccctgtagctttgcttatagatgttttcagtttcttagctaatttttttggtgtattagttatagaagatgcttctgtacagcaactatatacttccaccctttatctgaaagtctggccctgcttcattactaaaaacaaggacaatcataatgttagaaatttaacttagaagaaaataaaattacaacaccctctgatgtttttgtaacttctcaaagcagcatttggaacaggtttatgttaatatatattaataagatagaatctccctgagtttatttagtatctaaatgacttgagagggtcactgcaacttctagagctaccagcttctgaagtagggcgattttaactcaatgtaaacaatatattcaggcaaattacttaaagaaaaagaataaaatgccctggtcgttttgttgccaatgctattgttcctttttgttcccttaatataattattttaaggcatttacattatatgtgtgatttcctgaaatgaccattcctcaaaaggaaaagatgtgaaaacaaaaaggaaagaaaattaaacaaaaggcttcttctgctgaaaccttgagttttcgttatctttttcataaagtgcttacagtccactcaacaatgtgcccctccttcctgctccacctttgtacctaataactctaacatttcactacttggttatacaggagaaaacaaacgaatataaagagatatacttcaccaaacattagatgtatctgtaaaaatgcacaatgctacaacaaataaactttgtgcattagcacccagcataaatataaacagtaccaatcttaaaaaagagagagagacttcaaggcatgaactccttgaggtgg

SEQ ID NO: 54887 - DNA, 1479 bp, Bovine  19866880392902
taataaatgtgtgctgaatccctttgttcaaagaggctagacagcagtcacctaggaacttcagccaaagagattttggcaccatttcatcttgaaaccctcttccctgcccttcttgccacagtttccctttcttctccttcagtttccctttctggctccttcttctttgctcgctacttttggttgacgagttgaaggaaatatccttggttttctgtcctcacaggacatagctatcccctgccatgattttaactaccaccaacatgcaaacgactttcgtatttttctggtcatctccgacctgtcttttgagcctcaagcccacataactgactgcacgatgggcatgtccacttggatatcccacaggcatctcaaatccaacacgcatacacctgaattcattctctctcacaccccctgctcgccacatcatctgtagtcactcaaactagaactctgggcgtcatcacaagtttctcattttccttcaacttccacttccttccctgttacatgtccaccaagttttggaaattatatctttcaaaacctctaatccacacacccactaccttaagttgcaattctcacatttttcttgaattctttttacagcctctcaatgagttttcctgcctcctgtcttgccatcttcagacccattctcctcacaaacacccaagtgatctttccaaaatgaaactctggtaagtccctatcttccttcaagcctagtgatcaacttcccattgcttatacggtggaataaaaacccattttcagagcctaccaggggttctttgatttgactactatattttattactactattctccctccctctctccaacttatattagaacttagaacttctagaaattctcccaaagaccacgctgttccatacatttccatatatttttttaaatgcaaaagaatttttttcttttgtctttgcatttcattctcacctagataagtgtctatttattaacaaagggctatctctttagccttctctaactttccctctccttaggaaattgactactttctctgatctgccacaggatatctctgtcaggtatctaccacacttatttacatgtctgtctctctgctagactgaaaaaagttcagggtgaggaatgacatcttattagtctttactctcactcctgtgcgcagggcctgccgtaaaacaggcactgattccgtgtttgattagtaagagaagacagcacctcatcatccttcatatcaaccggaattgaaaatccaagaagccacttttgagagcgtcagtcagtttcagtctcagttgctcagtctgagcagcttcgagcagcttcctgagccctccaccaatacagaaagtatccaacctgccaggaggtgtgcgctgcattcactgatcctgctgattggatggccttctcctcccttcgccccagtctcacaccccacaa

SEQ ID NO: 54888 - DNA, 1669 bp, Bovine  19866880570322
gttacccaaattttgcctgtttcaaaagcgtaaatcacaaaaattttataacaaaagcttattataggtgctacttaataaattaatttcttgagtaatacttggtgaggtttaagtgtaagattttatattcatagtctaagctatgtttaagagaaaatattactatgttagtatatttaataataaataaatattggttttgatggtcagaatccattatggaatacagaggtttatgttatgctaagaaatgaaatttaccaaaattattccttgtcatttctttttcccctccattatagatattcgtataccactaatgtggaaagactctgatcacttcagcaataaagaacgtatgtatgattttgattgtaattgatgtattttctttagtatgtagtaaatttgagataattgggagaaaaagctgcatccacactgaaataaatgtcatttgacggaataagcacaatcttattgataggaacctgtgcaaggatgccaacaggtaatagagaaggaaattgtgaaacaaaaggagatgtttgagtgaagtagtaaaggccacattgtttgaccagaaatattggagattttttttgccttgttctcttccttcagattatttaatgggatataagagaaaaagatttttatcttgatctaatttttcttccccttcagcgttatatagctttatatagtcttaacaaatccatgcatggcttgggtcgtggaaattaacctcaaatgatttgtagctgttagaggcaatgcagaaaagttatgacaatcctttatctttcttgtctattatgatagctttgttcctcatactttaagcctgaatcatattgagcataattagttttatatgaaaaatacaaaatcaagttagtatatttgttattcatttaagaaatatattagtttataaaggaatacatgtgggaattaagtgtatctttctgattactatagagaattaagtttatctgaagagctccattttctcagtaatgaggatttagtcttttaatcacctaatacttaaaaaatatgtatattaaattagaaagtccagcagctatggtttttgtgttcacatctctactttttattgtttttgtagtttcccccctctctatttggtggaaaatgttttgttgttaatgtgtctgctcctaacctcttaaaatagaaaacttatttttattaagtatatttggaagccaaaatgacaggggtaatagtatatatgtagtgctaaatttgctattaattaaagcttaaggagtttcctaggaatacaatttatgagtttggtggttactttagactgctgagaggcctatatttttaactttattttttgatactccgtagtttagttgtatttgagttgggcaagcaattaatatatactgacaaaacagtctcaataaaaagttaaaggactacagtgtacaatgtatgaaaataagaatctattagcaaatatttaggctattttttcaagtagattttaacataatataggcatgactcatcacatgagtcatcgttttaatggttgtttttcttctctaggatcacagcactatgccattttttgtttattcaaactgggagcctgaagtttttgatactgagatggtgattg

SEQ ID NO: 54889 - DNA, 1041 bp, Bovine  19866880639213
ttccctcactatacctgtggttcctaataaatatgtcaggacacactgacataccatgactctttaataggagtgccaccaaatttccattgttctgtaaaatttatttttgcttcaactgaagatatgtattatgttatgtgataggttagatgaaacactgtcagaagttcttgcaataaggttaaggtacagtttgcaaaaataagaggttaaaggaatatcattatgtcaaactggtgacagtttagatatgtactagacagttcagacatggcagtcattagtcacatgtggttactgagctcttgacacgtggctagtccaaactgagatgtgctgtaagtgaacaatacttatcaaattttaaaggcttagtgaaaaaaaagaaaatatctcatttaatattttttatgttgattacatgttgaaatgttaatattttggatagatcatattaaacacaatatgttgccttaaaatgtggtactagaaaaattttaattcctatgtgactcctattatatctctcttggacagtgctggtctggagtcaaatgtttattgaaacatgaaaaacctgtgttagtaactatataaacaaacatggtcaggtcaataaagttctcccacagttgcatggttctacctcatgcgaagagttgactcattggaaaacaccctgatgctgggagggattgggggcaggaggagaaggggacgacagaggatgagatggttggatggcatcaccgactcaatgcacatgagtttgggtgaactccgggagttggtgatggacagggaggcctggtgtgctgcgattcatgggtttgcaaagagtcagacacgactgagtgactgaactgaactgaactgaaaggatgcttgaatagaaatattgttatattgtagtcatgattatcttaaaagcattcacgactcatattgtgtccttgggttggaataattaatactgccaaaatgaccacatgattcaaggctatctacagattcagtgcaatccctatcaaaatacca

SEQ ID NO: 54890 - DNA, 1029 bp, Bovine  19866880644013
caatgttcaaaggacaaaagaaccacttaaatgggcttcccttagccaagctgaacaccataaaatagataaataatcatgttgcaactgtctaggaaaaagtactgttcttaatgattcaaaaaagggaaagttaatataaagtgtatgaaagcataattgtaatgcaaggaagattaatataataggtcatatttcatttcttattgattttgtaaattaagggaatataattataagtgaacattttgttttcttctctgaaaaaaatgtatagttaagtcccctctattttctatattagcaggaaagaataaataatgaaaattgagggtaattccaaggaaagtaggtgcttttaagcaaaaggagaccaatcagaactggccatacagagccccacgtccatcagcgccagtgcacacacagcaaccaagtggaagggggcgtgccatcacagcgcgttacaaagagatgacttggccgcctgggctagagaagagcgtccaccacacagactcagtccctgccctctgtggagacgactgtcctgaccagtgctccccagacttttcattttgtgatgcgtgtcgagagtgctagcatttatctaacggcacattaactcgtggcacaccaaaggctgtgtttggtgtcccctctctgccctccccctcccctccctcctgaacactgaggctcccagggactcaggtgacaggggatcgctgtcccagcacctctgtgattcaggtgtagcaatagggattggcacagtgtactggttacaaagttctgctctagatgacccgcagaagtataataaaataccaataaggcatgcattaaataaaataccagtaaggtttatattagctttcagtaatgctaatagaccgaatcagtatacaaaatggcaagacaatgtgttaggtactaccagccgtgccaaattaaaacggtgttttcagaaaaacactaggtttgaaaaaaattaaatcggataaaggcataaaattaaaactccaa

SEQ ID NO: 54891 - DNA, 3109 bp, Bovine  19866880656839
ccatccttacctcatgcaaccttaaaaagctaattgtataaaactaattatataaaagagagagatgagaagactcagagtagaagggagggaatgttgcactctcctcgcaagcccaccaagcttatgccagatccctggcatggagccatctaggaaatgccccaagttcttcaattgcacaagtgggagtcacatttcctcccagtgagttcactggccctgagggcaccatggcaggatggaatcttgcatctagaaggagctggccttcctgtgacacgcccagttaagccaccagctgtgaacaattatccagaaggccaatcaggtgcaggcagctgggtagtgtgggagctggactggaatcttccagaaagctagagactcttggctgcctaaaacttcaattcaatttgtatttatggagccccttttaaaactcagatggatcttattgaagctcctgcatctgagagatgttaggataatatatggaagtggccaagatcagggatggtcctctgagaagctgtgcagaggcacattgaagaaccttcagtctacctgtctcacacctattttttgtaggtagtgggtggaaagagtcagagagactctatgtcctacagaccagttgtctattgtgttttctctgcactcaagagaaaatttttttcttaagaaaggacttcaaattcctttgccttgatgagtcactgactggtgacatactttaattattttaatgcaaatatctctagggagatatagccttgattttttcagtagttttcaaactatgttcctcagaaccatttaagttccacagagtttccacaaagcctgacttaaaaggaaaagtatgccacaaattggcttctatatagtattatcttccatgtattacaaaaatgcttgctttttaaaattctaagctaaagaattgaaggcttaatttgggatatcagccaaaattggatagatattttggagtgatgagaaacattctcaaagacctgaaattcattcttctgttactcactcagtaaggccccagctaagatcacagttcaggttagatcaagaaaaagacattgttctgacacctaatgtcaaagaagccattaaaatcaactaagatcttgtgctaggaagtctgaatacagttttttctagttcgtcctctaccaaagctctggagaaaagccaggatgcagaagtctaatagttaaggacataaaatcagatgtcaaactatgataagagctggatctgaataatttctataattgaatcctcattgttctaggttatgaatgctgtctcttagcctgatctggatttcaggaagcagagaaataccatacactgatttctgctgttagggcatttgttgactggaacccattcatctttcttgttctatctttaagatattagttgacaatgtccatcattcattattgaaaagggaagatagttgtctattaaaatccaactttccatttgtaattacttttgtcaccaggaagaatatgggaagtgaaaaccccaccatcttgttattaagtttattctctgctcacttatcatgctaggtgagagactgagagtggagcaagactcagtccttgcacccaagcagcttacagtctaacagaagagaaagaacctaatgtcattctaaaaaaactgcaagggggtacataaggtggtaagagctaattaatgatcgaaagcctggcatagtttttttaagatgaagcagccgagaaaaagggaccatattcagaaaaagaacattaagcaaaacaaatgaaaagagactcacagcttataaatattctggtgaaatttcagaatacaaggataaaacaaagatctccaaatttttcggagcaaaaatataaaagcaactagaaagtccaggaaaaactaaatgctactaatatataaaaaagtaagtgtagcaaaatcttgtgtcactgaatgatgaaagttttctccttcaggtaggtgaaattttatctttttctttataagtccagtcacaagcttggaaccatggtaaatgatttttatataatcatactattgttaggatattttattgctgtggcagtcagaatgagcgaggttatactgcaagtggcctcaagttgcagatgcttccaacaataaagaaataaaattatttcttgcttacattaaatgttcatcatagttcaggtgaggttcagatgtatgtcaaacattattaatatcatagcagagagaaaagagacatgtgatccacatctcatgacactatgcttaagaatgacagtcatcattttcacccacatttacttgcccaaagccactcttgagttcaatataaggggtctgtatcatcttcccacatggaaaagcaccacaggaatggaaacaaaaatatttggagaatccaaactctcacaggccacctttctggtattccactatacagaacagaattctccttttcccatatgttgaacacactcaccccttctctcaaagaggcaactagaagtcccaaacagtaacttggtcttcacctttacttccaaggcaaaggctggtatctgcagatgatatgagatagtctgcctcgggtctggatatagctccttttgacccaaagctgcaggaataaaaggggaacctatctgcccctcacatacccagtatgcaatggtggagcaaggacagggaatccataataaacactcctatttggaaaggtgaagaatgggagacacagatgtcaccagtttctacatattctacagttcccttggacaggtgttatctgggagaaagatgtatttcttgattaggccttgaatccactccctaggaatagttcctagacattttcttccttagcccctggacttcattttgggggcagactgtcatttccactattctcttcagctacatctaaagaaataattgtagaacatgatatcctggaagctgaaaacttttctcccccttctttcagctcaagcaggaaggatgagggaacagcaaggggttgttgaaagtcttgaacagtatctttcaatctagattagtc

SEQ ID NO: 54892 - DNA, 1748 bp, Bovine  19866880666951
ctacaactgaattccatctccatggcagcaggcagcctctgacgatgtgcaactgtcacaagtgccgaagaacagctttggagatataattctttgctcatcttaaaagctgcatttacttttagtgaagaggtttattatatctcccccactgctattgaccatcacattggagaggggagttgttttcctttatttccctgaatcgagcaactcattggtttcattttggctgggagccaaaacccttgcaagggcaaagacaaacaggaagggggaggggtggaatgggacagaaggtctggcccgtggtggagtcacatgaacttgtacatcaaaagagcagtcctagctttaaaagactgtggcactattcatgaacccggtaactgcccaagaaggaacacaactgcttgttgtcaccaaagataaaaagctgcagctggttccccccacccccaccccaaatcaacttagacccccactgtaaggaaggtggagactttgactccagtcggtctcattaactggtaataaatggcagacacacaaaacaagacagacaaaaggaagttgacagagagggaccctttggagaatgctcttggacctgtcattctcttaattttacaccatttgcttggcaatgagatgccctttccctctgctgctgctaagtcgcttcagtcgtgtctgactctgtgcgaccccatagacggcagcccaccaggctcccccgtccctgggattctccaggcaagaccactggagtgggttgccatttccttctccaatgcgtgaaagtgaagtcgcttggtcgtgtccgactcttagcgatctcatggactgcagcctaccaggttcctccgtccatgggatttttccaggcaagagtactggagtggggtgccattgccttctccaccctttccctctaccttaatggaaatgaatttaatcagataacactagtcctcgaaaagactctagagtctctactctagcaattccccaagtgtgtctatcccctggaatcctaatccatatatgtcaataggtatcgtgtggggacacaatagtcagacatgactgagcaactaagcacaacacagcacatcacgtggggaataaagagacttggcagcttggctctgtgctgttatgttcactctttgtgaccccatgaactacagtccaacaggctcctccatccatggagagggtctttaatcaaaatatcatatcatgtataatatcatatgtgagacgaatcaccagtccaggttcgatgcatgatacaggatgcttggggctggtgcactgggatgacccagagggatggtatggggagggaggtgggaggacagttcaggatggggaacacctgtatacccatgggggattcatgttgatgtatggcaaaacgaatacaatattgtaaagtaattaatctccaattaaaataaataagtttatatttttaaaaaatgttgaaaaatactacatttaaacaatattgagcaagttttatttaccgcaagactccccagaccttgtaacattcctttagagcaaataggagacattatacccatttcccaagcttgaatcacccaattcttcttgattaactcatgaattataagattaacccactgtcagaagcagaaccagaagccaatgacttggcctctccagctctttttatttgcctagaaaaatacagagcatcaaaaaaaaaaaaaaaa

SEQ ID NO: 54893 - DNA, 2120 bp, Bovine  19866880671217
tttgaaacagtgtatgacaagcatgtccttgggcagtttgttagtatttccaaaagaacacaaatccttcaggctaatatttggttaaagaaagaaagtagaatttaggtctatttgatacaaaacacagtgttcctcctactacaaacctcacccccatcttctttctcatttttgttgcataaagatcaattcctgagtacatgtccatgaatattttaaatttctatcgagatttttaaatcaatattttatatataaaattaaagacaagaaataataggctaggtcagaagcaacaagcagagacagatgggagcagagaaaaactctcctgtaataatctgagcatagcaactctggttagctcactgcattcacgcatttgtgaagcaggagcagaaagtacaagtactttggctattattacacatatagatcacttcgattattttaagtgatgttgcttaatacaatggacagcagctttttaaaacaggcagagctcttttccaagtattgacgtcagcagggccttgtaattgttcctctcagtggctcaactgccactccagtcacagatgtcccctgcacgacagggactgctgctctccacactgcagcacagacacatggaagtcaccctctacttggggttggtgggggtttggtagtgacctctgcctctagcttattagttgtgcgcatcatttccagtaggaggtgtaggatggttgtgggacgaggctcagggtgtgcttaggtagggaatcttttatctcttttatcatttaggtgtaagaaattcagtgctagaaagagacagattggaagccctctctgctgctgctgctaagtcgcttcagtcatgtgcgacctgtgcgaccccatagatccacctcaattcagcactggtactgcccctatccatagtcagagggctgtcttcctaaatagtttggtttttattaacaggtaagaaccaaacaagcccttttccccctcctccaattcattttcccacaagcactaacatgctgctagaaatattaaggttattaaatctggatcaatattttgaacagatcttttggttctttagcaaagagcaagacctaaaggggagggacacggggaagataaattttgataacgactctaaaggagagatagaaaaagggattagaagcagcaaagagtcttgagccagggatagaggtgggattgggtcgggagttcagggcagagataagggaacacagagaaaaatgtagaccagaaataaagatgaagttactaaaaacaatttttcctatctgtcagaagaggtttacctggtccttctaaagttcagtaataagcaaatgactcagtaattagttattctctgtgaacaacccccaatatcacacttcgagtaatgtctgttgaacagcaggaaatcctaaagatgttgggtttcagtgataaagcgaaatgtatcaacactttcaagttgcttgtcttaattttgcctttctttgctccagcaagacttggaaaactataaaactctgtgcccccgcccccggtcatgttcccatgtccataacaatgcttccggaaagaccaaacttgagtcgtgtcccggatgtgaccaagactggagtattatctagtatctgtataaaattctcattttctaagagattgcttattaaaatagctcttgaaactccagaaagtctgattggctttcccgctgcatttgaagacctttgtgcactgactgagatctgtacatgctccgcctttgtgataaatggccatgccctagggtctgggtaagggggaggatgactgtacacacagaacagaaaaaacagaaatgacatcttcatttcctgcaaaaatctttttgtataaactgtgtgaactttactgagtttaaataagtactttcgaagtctgagatgacctggatttctctctgcactgtctagagtaacttccagaaatgtcagtttctcaggtggtggacaagagccaccagctacctcaagaaaaaggagaaggagaattcctcttctacttcatagaagggtctaatatggatgcagataatgaaccatgtaataaag

SEQ ID NO: 54894 - DNA, 941 bp, Bovine  19866880677518
ctttactttagtagtagattcaagtatgtgatcccttaagtaatgaacacagcccaagaaaatatattaaatcaatactctcatttttgtaactgtcccatatcttatatgtcagtatatacatgtaaagatagtcttgtcatcatccattagttacttttctttctaataaattaacaaacccatatattctttgaccttatttaatacttttttgggttatttttttctgagcgttgccttttaattattggagagcatgtaaaaatgttaaagagtaaaatcacagtcataatctattgagggcatttacatcagatactaatctttaaatgccatacatgcattaagttattaaaactacattttaaattatgacactgctgctgccaagtcgcttcagtcgtgtccagctctgtgtgacaccatagacagcagcccaccaggctccaccgttcctgggattctccaggcaagaacactggcatgggttgccatttccttttccagtgcgtgaaagtgaagtcgctcagtcgtgtctgacgcttcgcaaccccatggtctgcagcctaccaggctcctctgtccatgggatcctccaggcaagagtactggagtgggaaattatgacactattctataattattatcctctacttttaaccattttgcttttctttctcagctgtcaccccaaagcttatagctcagagaaagtccattttttccctcccttggaataaaaagaattccaatatattaatactttttttacatcctaagttaacttgaataggccttcatgtaaatattagtcttttatgttaagattgaaaacttttattaggtctttgttactagccctggagtgggatttaaagatgacagaggattactaaattcatgcatttgttcattcttataacaagaatttattgagt

SEQ ID NO: 54895 - DNA, 1105 bp, Bovine  19866880715849
acagtacaagaaaggagggcagagggaactccaccactggtgttgcctttaccaaacggaacaaaagctttggtgttttctgaccaaaaacctttcttccttcctgtgcccagacactgacttagttctttgcaaagcaagccccacccataagtaaaagacagccaagtatatctccttcccaatgactaaaattcccatatttagggtcaccctacatgattaaggcgtcatctccagaagattccagcccgtgaccgagcatgggctgtcctttcaacctcggctattcattacttcccacatctccctcattctgctccatccccctcattctgctccatccccctagcctccttgccactgttccaacacttcagccttgtatctaactcaggggttttgcgtttgctgtctctcctccccacacctgcactagaatattctttcctggatatacacatggctcacctctcctcttctactaaaatgtcactttgtcagagagactgtcctaaccaccctatttgagacagcagtttccccacccaatttccagcctcccttcttgctttatctctctccataggacttaccattgtctaacaaaccttttgcttatttattttattcatggttgcttcccctactaaaacgctggtccatgagagcaaggatgttgtctgttttgtttgttgttacaatcttaacagtaaaatgtctagaacagggcctggccgtggaagacattcagtgactgttccttgaatgcatgaatgaattgcaagctaactgccgcctaatagagatcaaggccctgagacaaggggcaataggactggtcagttttgaccgtggccttgataaacacctccaggagtagaatctgtaattagagggctccacttttaatacttatttatttggttgccctgagagttgcagtgtacgggatctttagttgtagtatgtgggatctagttccctgactaagaatcgaacccaggtcccttgcactggaagcttggagttttagccactggactaccaggaaagtcccttccacaagtgtcctctcatcaccagaaaattacaatcatgtctt

SEQ ID NO: 54896 - DNA, 904 bp, Bovine  19866880777920
tctttgtttcaacctgctttcattctcttttcccaaaactaggttacagattcttaactgaaaagttcagactacttagacactgttttccggtattctgcagggtcattttgttgtatggaagttggaatatttgttcctggattttaaataaaggtttttagattataaaatattataataataaaactatatttatgactaatgtgttggtatgttttgtctagctgaaatgtttctggggagccaagctggttcttcatgaataagctgttcattgtacatatacacaccatgatcttgtacctgtaagttttcttaagagcttagctggatcatttttgtttatcacaatgcctctatccaaaggttctttttacatatgttcacactgagaagtcctcattaaaagctcatttggcacttttctcccatcttcctccacaaccatgagtaattttcctacaatgtatttttaaacttgtcagctcttagcaaaaaccatgaacagatttcacagtgtgtatctcagatggtatgtgctatacatcctagtcattataaggctcagaaagtgatcaggatagttaaccgagttgtgtcacaagtagaactactcagccatggtcttttaagaaccatggaattaggaaaatgcaggggattctgtttgttcaggagctgttagagccgttagggagatgactcggtctgttcttatgcttacttgtgttgaaattaatgggttcaccaggttataatgctcctgagaaataactgtgacattcttgattatctatggccattagaaaacataaataaatccccgtatctcaattctgttcagtctgggtcctgaaaacgaattccagagatggcatgcatgcaggaaccaaacacaatc

SEQ ID NO: 54897 - DNA, 1341 bp, Bovine  19866880835703
gtccactagggcccccaaagtgcagtcgcctactttttccttttgtttctgacctcggctgaatagagacgcggactggggcttttcccgtcgtccagacagaacaacctcttgaggacctgaagccgggcccctccctcactcacctgctgggccgcaggccccgccgcgcggagttcgtgtcccctcaggaggtgccgctccatctccagcgtcacagctagggccgccggcacaactccgaagctaaggtttgaaaagcccgcccctggctggagccgcggaggacgccaaccgccgccacgtctgtaccaagtcccagcgcaggggagggggcgagggggctgagagccgccgtgcgcgcacgcgcagagggtaccccgcgcagcccgtgtctcgagtttgccgagacccgagttcccggcgccggctgggaagtagggagcagctggcccacttaagggagaggttgcggtgtgggcgggcctgggacaggagtgggcggggtcgtggggaaagcaaagcccactgaacgcacctgacgggaagcctggtttaggctggtggtcttcgaggcaagccttttgcgcgcggacccttcggcctgcatctcacccaaggcccgccagagctctcagggtcagctgacccaacgctgcagtccttggactcccacagacaacctcaattccagaaaaccaagtgacactaccctcagcgatcactctctcaaacaacgcagattgtcacccgaggtcacttagaaaccacggccttattaatcaggctggtgagacgtcgtgacaggcatttcacaagcctttttcttttgtccccaatgtttctttgtaattccagatgcccctccccgctgctaagtagtctgttctttcttggaaaaaacccttccattactctttccccaccaacatccaaagtgacaacagaatgaggtattatttccccagactctgatttcttgctgtccctaaagaccaatataaagacccttttaattatattgggaaattaattattgggaattaattataatgccaaaatatggaatctttaaaagtcaaaattgaagtgccaaagatttcaggcctttgtaagttctttaaaaccccactgtcctcttgaaaaagcaacagaagcttctttggcttctaacatgttttttctcctaagggaagaatctatcaaaacaaccttcccaccctcatctcttaaaggcctagggcacttttcattccataagtaaaatgaaacattcaacattttttgtttgcctgagacagtccttgtttgcgtctgttgtcccaatcaatattccacgga

SEQ ID NO: 54898 - DNA, 1598 bp, Bovine  19866880882344
taggttaaaccatatgaaattcccagttttgtagatcagaattggtagaatattagcaatttcgtatggtccaacctattatctttgcttagaaaccgattttcttttctggaaatcttagaatcctcagcagatacaaaaattattagaaagtgttcataatggtgtgaaaactaaagcatgacatttagtctttctgcagagagtgcagtagctttatcggtaatttatactgctttatggcagcatttaaaaagtttctaacatttcgatgcagtgtttctttttctatctcgttgtgtaccttttttaaactgtaaatttggtatccagctgggtcgctcactgcttaaaagccaataaagaggcaaggttggtggaaaggaaagtttacttcattttggaggccaacaaagagttggggagggcagttgttgttctttagtccctcagtccttccactcttttgtgacactatgggctgtagcccaccaggctcctccatccatgggatttctcaggcaggaatactagagcggtatccactctagtatttccttcttcaggggatcttcctgacccagggatcaaacctgtgtctcctgcaatggaaggcagattctttacctctgagccaccagagaagccctgggggagggcagactcgtatccaaaggctgacttcaccccagtgacaagtggccaaaagcttttataggcagagggagggggctgcatgcagaaatagcacagtcagctttgacagtcatcttgaaattgtcattggtagtctgaccagtggcatcttgattgttttaaatagttaagcttcacttccagggtaggtttgttctcatttctttgagaccagttcttggagttatggcggcttctgtaatggctactgtctggtcttgtattgacagcttgttctgcctggttggggtttcagtatccataagacagctcatgggatatggcttagaatattatctatagcccttgagaaggaactaaatggcattgactttccttactaactaaattattgatattattgttttgtcctgttttcaagcttttctttgcttctgtattttcttacttctctgattaaacttattgttaagctaaagatgtttcacaggcaaaaaaggcaagctgaggacgtgggggggcagggaccttaagggtcctgctctgtttcacttcgattgtactaattattttttaaaatttgatttctagtgaattggtggtatcttgaggctcttgcatttatcacataggtgttggtggggctgatcaggcgtacttattgagttgtgtgtagcagcagtattttggaatggtacaaaagagatgagaataaggtcattaaagaagttttatgtggaatcacaagaaatacttaaatatacataaaggtgagattatttacatgtaggaaagcacaatacttaatgatttcataggtagcaacaaattaagataattgagttgtggaactccttctgtttggatcgtggagaaaaattgcaaatagtaataggctgtaatctaacaggaatattgagggtcagtaaaaaaattttata

SEQ ID NO: 54899 - DNA, 1537 bp, Bovine  19866880896925
tggagacacagctggcgaggcagttttgagccaagccttagagaggtctgaatttatcctatggacagattttgagcagaggaacagcatactcagaactgtacttcagaatgtttacttagaaatatttggtccagttgatgttttccccctttttaatttcataaggcaattctgattgttagagagcaaataatggccatcttgaaagactgggctttttttttttttttttttggtccttttctgctttttagtatgtagatttccttaggtaagttcttaacaacagtgtaaatttaagaactcactgtctgaacctcacatattagtctttcattatagaccaatgttattttcccattcaccaaattacttcaatacagcaaatgtagattggttgccaagatatttcaatcagctccacttggctaataaagactatgaatgctgatggataagtgaggccccatcagtgtcccctctagaggctgtgtcattataacctcacctctcattgacatcagctcaagtagatccacattttaggatgcaaagccaagttaactggccaaaaccaatagagacttaatttggaagcaggaaaaaaagaattctacatgaagataaaaagctagagatgaatgtggtcctctttttttgttgtaactcttcagtgagtgctacctgacaatctattcaatttaatataaccccctgggaagcccactttcttcctaagcaggaaaccgtaaaatgtcagaaatacataaaaggcagcttatatctggaagaggaaagacaggtacacttttagaagaaacacctatgagatgaaccctgaaaattaggcagttggcgttgctcatctattaacttttctttattcccagcacaaggactgcagcttagggatctgttgaaaactcctcactcagtattccaaaggagattgtgagcaccgctggtagaaatgaaaatcaaggagcagaagaaggtataatgatcagtcctgatacacacatgggaaggacagtgactgtttcctctcttccctctacttccccctccatcccaggctgagatgcaccacctcacacctgaattctttcacaatcactgctttctcaccatccctgactgtgacagccctctactttgcaatgctccagattttcaagcagctaactaaaggaaaacctaagtacagtggtcaagcctcaagggtagggaaaggggcatggcatttaacaggtgggtcccagacccactcgtctacttcagccagaactaataattttcatctattttgttcactgagcttccacttaagatttcttaataagaaaatggtttcattctgtgttttcactgccaagggcactggtttgatccctggtcaggagagtaagatcctgcaagccatgcggtgcagccaaaagtaagtaagtaaaaaaaataaaataaaaattggacctttcctggtggtccagcagttaagactgtgtgctcccaatgcagggggcccggttcaatc

SEQ ID NO: 54900 - DNA, 604 bp, Bovine  19866880947452
cccctgaaaggacaagctggggaccctatagagaaagaggtctgctttgtctctcctctgtttcataagtgaaacttgacagcatagattagaaaaataataaaaggccatctcatctgtgttccttatttattacacattatccaggtatctggttgcaaaacatgcactcctactcttctctcattgttaactacatttgaaacagaacacaccgacctgcttcatcagataacatcggcatttcagccagcgctctctttccaggtgacttccaccctctctctccatgacccctcttctcagcccccaaaatgttcaacagggggagatgctttaattagatcacccctcctttcttgatatgactgctcctatatccagtcaaggaaaaatgagggaaaataaaataacatccctttaaaagaagatgggcagactatctggattcaggaagagggtcagaaaatggagtctgaaggaatgtgacacagttaaccaaggtgggcaaggggcagatacctcaggccccttcctctggtgctgttcagtgacccctccccaatctatggaggacacacagcttgtatgagaatgtagttct

SEQ ID NO: 54901 - DNA, 742 bp, Bovine  19866880970280
tttaaacacttcaaatgaaaacagatttgggaatgtaaaatgtgtatttccacaaatcatgagaaatccaaagtgtaaattatgtaactagaaattaggggttcaaaataaaacagatcctcaccaaaaactcaacctatttatttttggctgtgcagtataattacatatttatacacttcagaatctcgcctaacaattgaacattcagagcggaagcacagaaaccaaactggagctaatacagagttcctttctccttgtagaaaagcttgcccggtcaggcagtgtgggaaactttacaaggctcacactctcttcttattctaaggagaagtaaatggcttgagtgcccttgggcattctttgggaggagtgtggtcacagactttcaaaaagtgggctttttcaccatgaacttttctgttaatcctcttccagtctgtaaatacatgacttcccctgtttcctcagaataaatgctgagctaaaaagctgtttaagcagaggtgcttcagtcatataaagaaaaacaaaacagaacaacaaccaaccaaaaagttatgtaaggccctcagtaaacatagtgaggttgtggggctcctagacaagtcactaaacctttctgcatctcagtttctccaaccatgaaatggagataataacacatgtccttctacctcacaaataattctctcataggatactatttgcctgaggggaccaagagatctcctaggaa

SEQ ID NO: 54902 - DNA, 769 bp, Bovine  19866881007941
tttcctgcattgcaggcagattctttaccacctgagtcttgaaataacattatttcttttaaagaaggcattgactacacagattgtagcttggctggtaatatggaataccttaaaatctttcatcctccctggttatttcagttagccaggaaatacagcagtggctagacacgagggaccttatgatgagactgtgagtttggacactctcagtgttgggcttgtgcaaagaggaaactaagaggaggaactattcatcagtacccatcctcacccacgcgtctataattaccaacaacggttgcaacgcaacccataaacacgatgtgttggctaaagcccagggtgctatttatagtctctatggacccactaataaccctaacaccctccttgaaacataacccaaattaggagcaggggacaaaggggcagtctcagttgagagaaaaagtagctactcttgtacctccagtttaacactgtccatgtatgaatgaccatcaaaaacatccagccgttctgagagaggtatatctcaaaataaacattttcctgagcaggccagacaagagcacagagccaaaggatttccaactcagacttggaaattatagggtgtaattggaaggcgtgacgggggcacgtcatcgttgtttggacgtttgacctaaactgtgtttgttcaggcacgacaggaagtggtcgaaaagaagtatgacacagtggaaaaagcaggggctgggagtcagtcagacggtccacg

SEQ ID NO: 54903 - DNA, 1638 bp, Bovine  19866881047947
ctgaaaatgtttaccatgtgtccctttacagaagtggtttgctgatccctaacccagccaaattaacatacatagtgaactgtgaccttacctctcttactctacagtgagtggatgtggatcttggagggctgatacaagtgggataaattaagtgtatttttttttttctggagaatcccagggacgagggagcctggtgggctgccgtctatggggtcacacagagttggacacgactgaagtgacttagcatagcatagcatagttgatttaaaatgttgtgttagcttctgtttttaatgtattcatggagaaacaaaaggaccagttttgtgttcttcatgcaagttctcttactgtagtatatactatatgatctctgggtcaagaagatcccctggagaaggaaatgtcaacgcactccagtattctggcctgggaaatcccatggacaggggagcctggtgggctatagcccatgggattacaagagtcggacatgacttagcgactaaaccaccactaccagactagaatgtacagtacacatctatgctttatatacagagaaaacatctctggtcaaggaaactactctaaccaagaaaagcttcatggagtcaaaggacttggttttagttaagaaggggtacaaagcgctccaaggctaggagtgatgtctagtgccaaccacagtgagaacagtgattgtgtaatgacataagcattcgatggtgatgcttactgacctcagagaggaagagtaggcaactaaaatcatattggcagagtcaagaccgactaggacacatgacaaaagcatgtctctaaataagggcttgctatcgagtcaaacagaagccttatctcgtaggtatttaaagttaggttgataagactaaccggctacagcaaggctaagaaggaaattgatgacttaaatgtggaaacttagataatgtaggaaacagaaatatactaaattttaagagctagaatggcacacaaaggaaaaacaaagaaaatgccagagcggtggaatcaagcactgactaaaaaaaagaaaaagaaaaacgaagctggcagctggtaaaaaaaaaacaaaactgcatgaatccagatagaacctacacccacctaatgcatatagttaaaccatgttaagggagagactacaatgaaaaagactccaaaatggcatatacagatacactgtttccaaaagaaactgtgtgtattttaagaattgtttatgtacagagaaaagtctggaaattgttaacaatgctcattctggggaatggaactagaggaagagttcataaattcatttttctatgattacttttctgcaatgagaaagtatgccttgaattttaatttttataaagactgcaaaagcttaaacatttataagaaaaggtaggtggctgttccaagtattcggataaatgggacaaaggtagtaacaaaaccagtcatctttcaagcatgtatgagtgctaggtactgttaagtggagtcgctcagtcgtgtccaactctttgcgaccctatggagtgtagcctaccaggctcctccatccgtccatggaattttccaggcaagagcactggagtgggttgccatttcctt

SEQ ID NO: 54904 - DNA, 1242 bp, Bovine  19866881132245
ttgtgtgtctctgcttgccagtgaacattatgtcataacagagatcattattaacttgttcaagagactaaacaggacagaggagcaaggcagaaaggatacatgtgagccaaggagaagaagagtaacgccctcggcttgtttatccagagacagaagcacacaggatgctagttagcagggcctgcttgtgaaaactcaacagtctctttatatcggtttcactaattatcccacccttaattcgagcgatttcataaaaaagagagtcatttctgtcaacttggagttaactgatttttataaataatcgaattgcattgatactccaaacaagagtttcttctagataaagaatgacaagcaaatgccctacagaatgacaaatgttgcaggtggatctgatagggaccatctttacaaggagaccaagttagctgaatactttcggcttatactgtgaataaggatcctcagaaacaagtccatttttctgatcctcatatgtaatctttataaataaatatttctttgctttacatctgcgtggaaaatttgcctcctacacaagccccaccttccagccaggtccaaatctctcactaccaatgttatcattatccttgggagtccagctgctttgggttatgaggattttttgcaaatacgaaccgaagggagcaaaacataaagcacttccatttttttccttcccatttccccaagttaaataacagtttattctgcaggctttcaaatcactcccacaaaattggcaatccaagacaatcgacacattcatgctaatccacccagaagtaaatacactgtggtaaaactgtgacatttgcaaaggccgtagctccccaattactgaggaattaactagggatataatgagggagggccaagtgtgattcagcccagagggaagtggtcttgccatcctgtttctatcctcaagtgaaaactttctatacatttgagtatttagaagtgtggctcactttgacatctgctttaaataaaattgttacaccatatttttcttggtttcaacctaacagctgccataacactcgtaagaggttactggcatcaaaatatttctcaatttagccactattggaacctgctccaacccttgcagggacatttgtatcatgaaatcatagtccattgggtctaatatttgttggatgttcactgaaagaaaagggggtttagtacatgtagattatg

SEQ ID NO: 54905 - DNA, 1717 bp, Bovine  19866881152976
cagagcctgtcctaccacaaagcaataatttgtttacattctccactcaccctcaagtatgtgctcttttagaggatgtggcatctttgccttcctctgtcaagcccagaaattgaccccgataatgctcaataaatggttcttgcacaaatccaggagaacttatttttaaaataactttttgttttactaaaacagtaagcgttcacagtggaattagaaagttcagataaatcaaaagcagaaaatgtaaagcacacaaatcccatttgtcagtaacacttaacatcttagtaatttccacaggccactttaaaagtttcgaactttcttcattcatggcaccctcagtgtttcagtcatttctttctggtactttaaaccaatataaattatgttttttttttttttttttgtaattaggtccaaaccacctaatagtagtagttcacacagtgtccaagaggtgttactgtgtttctcttgaaattttaaaatattctgtggggctcttgtgaattcactgcaggatgccttcaaacagtttgggagccactggtctaaactttctaaaagaatcttttaaaagaaaatatatcgttatacttacaaactattttgttaacctataatttctagttataagtaaaaatcaacttccattcttgatagctgcttaccttagttcagttcagttcacgtgctcaatcgtgtccaactctttgtgatcccatggactatagcatgctaggcttccctctccatcacgactcccggaacttattcaaacacatgtccattgagtcagtgatgccatccaaccatctcatcctctgttgtctccttctcctcctgacctcaatctctctcagcatcagggtcttttccaataagtcagttcttcaaattaggtggccaaagtattggagtttcagcttcagcatcagttcttccaatgcatattcagggttgatttcctttaggattgactggtttgatctccttgctgtccaagggactctcaagaatcttcttcaacaccacagtccaaaagcatcaattcttcggtgctcagctttgtatatggtccaactctcatatatacggacctttgtcaacaaagtgatgtctctgctttttaatgtgctatctggatttgtcattgtttttcttcctaggagcaagcgtcttttgatttcatggctgcagtcagcaaccacaggtgatattggagcccaagaaaataaaatctgtcactgtttccacttttcccccatctattcactatgaagtgatgggaccagatgccaggatcttcatttttggagtgttgagttttccaaccagcttttccactctcctctttcaccttcatcaagagactctttggttcctctttgttttctgccattagagtggtattttctgcatatctgaggttgttatttctcctggcaatcttgagtccagcttgtgattcatccagcccagcatttaacttgatgtgctctgcatatcagttaacaaagtgaagtgaaagtctctcagtcatatctgactctttgcgaccctgtgaactgtagcccaccaggctcctctgtccatggaattctccaggccagaatactggagtgggtagctgttcccttctccaggagatcttcccaacacagggatcaaacccatgtctcctacatggcagacagattctttaccg

SEQ ID NO: 54906 - DNA, 860 bp, Bovine  19866881188570
tatgaatataaaatatttttacaagaataactttcctcaaaaactggaaaatcatcagatgtgttattattcatagacttgatatgagtgtactgtcagaatcaatcctcatcaatgttttgatgaagttagtcatcagtttctagaagaaaagtctttgaactggtaggattttccatctctgaagttaatattaatgttatcagttcacatgctaatcatgttatcaaccagtgtaccaccctcctagcagagaaagtataactatttaattggtcacttgtcctgcacttggcaggacatcaagttcaagaacttttatattatctccaggaatgtcattaaaataacttactaatatagggacaactttttgatttttgtggttagctgaagctgtcatattgctgagacataaaggttttacccagttcttattgttgaatcttttgctatactggagcaaattgtttttcttttacattttatctttggtttgtgctaatggaaatttaagtcaaataccatggaacttagctcagaggtgcagtttaaaagatcagtggccatgattgtgttctgtggcattctatggaattactgcttcttttctgagctatttatcactgaatcatggaagctccagatctgacagataagggctgtttccttaaattgaaagtgcaagaagatagcagatttggtctcaacatttatctaactaccacataagaaacaaaattctatgtgtggattgacacctttttttatacgagagctttccttttgcaagcctccttaaatgttttttttttttttcttcttgacctccacctttacaatcattttgatactaaaat

SEQ ID NO: 54907 - DNA, 834 bp, Bovine  19866881211733
acaaacaaattgtgtgtaattgtgtgtgtgtgtgtatatgtaagagagaaagcagggtgatggtggaatgaatgccaactgattaagaaatttaggagacctaatcagtcaactgcagtatatgggccttatttggatcctgattcaaaaagctgttaaaaaaatcacaagacagaaatttgaacactgtctggatttttgataacacactatctttatatataactatagattttcttaagtatggcaatagtaatatttacaagtaaaatgatatgattgctagaatttgcttcaaaataatcctatggtggaggtaatattctttctacattttgtcttgaaattttttccaaaaaaaaaaacaaaccataaaatacaactacaaaaatgaactgcctgctttcttacttataatacaaagataagattgcactcacatcttcctcagaaacatgttgtaaagataaatgagttctttgaaagatgtctgggctaaagtcttattaatcaggcatgaagacaaaattgttgatggctaaaaacaagctttagaacttatacatactctaatgacaaagaaggcataccttctacaaacatatggcaaggaatgtttgaaataaagcataaccataagttaaaataagtactgggtgtaattagcattagtgtgatataattattttcaatttatgtcagtgaaattagatgcaaactctgaagaaaaaggttgcttaaaaaattatttttgctgtatttaataaaggaaaatctaaatagttgatagggttcatacattaaaaggactaacataatcagaagaaaatcccg

SEQ ID NO: 54908 - DNA, 768 bp, Bovine  19866881240849
tggaagtcctgaaggagcaggtattaagtcattaacggaaaaatgtctgagtgcaacatggagtgggtcaccttgttgaaaagtgaggattcttctaagaccacttgcagccctaggattctgtcatatgtgatactgcattattgtaaatattggctgggtaaaactcagtgttgacatgacattgatcttggagattttccccactggcttggactttgtaaaggtttctgtaaggcgtatccacagttatcctcatagaatgcttttgaggcaggcagggatgaggtggtatcagttgcttctcttagcagatgcaggaacagcagtgggggaaatgagagagacacatgtggtggcgttacctcagtcagaatcaggtgcttcccaggaagcatctcaccttgctaaaacgtcgtttcagtgtttaaagagaaggtacattccttgcttacaacatggcttctgaatgcaggccaaccacttcatctggcgttcagttgagtcaacagcagttctgtccgacgctgggagagaaattggcagcattggacttggtaggagatggtgcagtgtgtcaagctcagcaatgtgccctcctcgggcatctttttcctcagccatctttcagatagtgttggtgatatttaactttagcctttcttcttaaggcaaatttaagtcacatacttaagaaggtgattttatcatatttaacaatgaaggtgaggcttatagggttgaaagagtgtctaggggccaaaatct

SEQ ID NO: 54909 - DNA, 1288 bp, Bovine  19866881259522
tagatggagaaacatggaaacagggagagactttatcttcttgggctccgaaatcactgaagatggtgactacagacatgaaattaaaagacgcttgccccttggaagaaaagctatgaccaacctagacagcatattaaaaagcagagacattactttgccaacaaaggtccgtctagtcaaggctatgttttttccagtagtcatgtatggatgtgatagttggactataaagaaaactgagcactgaagaattgatgcttttgaactgtggtgttggagaagactcttgagagtcccttggactgaaaggagatcacaccagtcaatcctaaaggagatcagtcctgaatattcattggaaggactgatgctgaagctgaaggtcctatactttggccacctgatgcgaagaactgactcatttgaaaagaccttgatgctggaaaagatggagggtgggaagaggagacgacagaggatgagatggttgaatgacattaccaattcgatggaaatgagtttgaggaagctccaggagttggtaatggacagggaagcctggcatgctacagtgtctgacaaagagtcagacacaactgagcgactgaactgaactgaatataaatgcatactttattttattacatatgtatatataatgtttattatatatataaatgtatatgaacataattgggcttccctagtgactcagcagtaaagaatctgcctgccaatgcaagagacatgggttcaatccctgggtctggaagatcccatgcagaaggaaatggcaacccattctagtattcttgcttaagaattcccatggacagaagagcctggtgggctacagtcaatggggtggcgaaagagttacacacgacttagcaactaagcaacaatgacaatagacataaatagacttatgtgtttcacacatatatctattccatttggtagaagaatttggcctcacttattcatttttattcattcatgtgacctatttattgcaaaacaaccattttcatgtttttaatataataaatcatttcaatatgtgaactgatagtattaatatggcaccaatcttcatttcttcacttctaaagggagccagataggtatactcacagtgaatactgagttttctttgtaatcatattttctttatgcctgatacttttgtgtaatttggaagatttcttattaatttgaccaagctcgtctagtctgtctcctttcagtatatagtacttcttggtatattttcaagagaata

SEQ ID NO: 54910 - DNA, 743 bp, Bovine  19866881260640
ttggattttagtctatcagacaaaccgctggtcaattgctgaattagagagaaaggaaatactgactcaacccatttgagcagagagcagcgtgggcagggagggtcaaccttacacatcttttattgcagaatagtttcaaatctcttgagactagatgagtgggagagaatgtattatgcttctgaagtagaagctatctaggaggacaggaaaacaaccctttagtgcagaaaaggattgagagcctgctttccacacaggtcgccatttgaccattttggtatctgtgcagcaactggaggtttcagaaccttaagaatctacagtcattaatacaaaactggaactaatcttagccttggcattttgtctgaagaacagaattggccctgtgatccataagtgactcactgaggaaatacttgggcatgctgcacaacatgagggtaatattttaacaacagacaaacatgtattgcatggggaagaatcataaatgaaaggaaaataaattaaggagtcaagaaaccagagggaggcttcacagcaagaggcagataccattatcctgaaagtgaaacgccagcactttggaaacaaaacatatgtatgctgcaatcatcaatgagctcgaatgagacttaagaaataaccacaccagtttgccttcacttccttttgtgcttgccgcatgccaaatagttgaatataaattttcctaatgggatgtaagaacattt

SEQ ID NO: 54911 - DNA, 749 bp, Bovine  19866881271969
tgtgatatcttgaaggcagagcctattacttccaatctcttgatgacagaaaatagaaaaaataatagattgaagatttttgagtggccacggatcctgaaatattaggtggcaatttagaattcacaataaacttttcctattcaccttgacatcttatgagaaaaagaaggagatagagagagaaaaggaagttgaagagacatgtaaccatacagcatgaactattactgtaatctgatgtgcttcctcaaaccaattataagaacctttgaaggcaaggtccctctggaactcagtaatgcagacaatttcagatgatttgagatctaatagacctattttgttagcagaagaactattggaaataatattaaaagatgtatttctatttgagagaatcaacctcaataaatgtacttactttgtttaccaaatgaccatttatattgttcctaaaaatttctaacattggtcatcaactccttgagtctatttgaggtaaacatactattctttctccttattttgtgtcatttttattaatacattagcccaacgctgattattactgtgcatcctgtctaaagtgcttagagtagtttattttagtactttgtaccatggcagtcatttaaaaaaaataccagtaatgattacagcggataaaacattcagtagtctttcataaatagaaactgctctaaacatgaacaaaatgtcagtttcatttctttgctaatatcatg

SEQ ID NO: 54912 - DNA, 1539 bp, Bovine  19866881301254
tttcccctacaatcgggttagggatggtatcatcaccagtatgtgtagtacttttgctggggattctccaacgtagaagcattcttcttctggagagtagtgggtttatattgcaaacctttgcaatcattttgctagcgtgaaggaaaccatcctgaggatggaatcagtacacagaagaggcaagattgaaagaatcacatagtctagagccttggtcaaaccatatggaaagcccagactacagctgcattttcaggtatgggagccaagaagtcgcctttattgtttaaaccactttggtatggattttctcttgctggtgctttagtcacgaaagagtgtctgactcttgtgaccctatggactatatcttgccaggttcctctgtccatgggatttcccaagcagaaatactggagtgggttaccatttctttctgcaggggatcttcctgacccaggtatcaaacctgagtttcctgcattgcaggtggtctcctgcatttcaggcagattctttaccactgagccaccaaggaagccacggatttttctcttacttataaccaaaagtgtcctaattaatttaggtctcaacatctcagactttagtgactaatgtcactagaactcttctcaagaggtggaagagagaagcaatatttaatctatacaacatttcctaacattttctttggatatatttctataaaaccttgagttttgccaagaaaatagccagcattttcctggcttcatcttgagtgtaaaagtgtgtacacattctgatagtactagggaaggctctgcccccagcctctctcctagtttctggtggcctcagaaattccttgacttgcagatagccattttctccctgtattttcatatcattttctctctctgggtgtttgtctttgtttccagatttcccactttaaaaggacactggccatactgaattaaggcccattctgatgacctcattataaacttgattgactctgtatggacctgatttctaaatgaggtcacattctgaagcactgggcattagaacatcaacatatctttattaggggacccaggccattccataacagtgtgggtagagggagttgcttgagagggtatatgtgaaaatgacaagacagcaaacataggaaagttaacaaaaacactctatcaaacacagttttggagtcattcctatgtaagaaggccttactttaatttgtaggaaaatggaaagcacagggttcttgacagaagacatgtttcttggctgagacacggtgatgagttgaaagaatcagagccaggttcctgaaacacagagtctgtgttgcctttattttttttctggcctagatgtttccattacaacaatctctgttttgttaggtcatttttttgagggaatacacacaaagctttgacttatattattctcactgcatccaactgaatgaaatttatgaagctttttgcacagtgtgttcattgtttggattgggataattaagtgtcaggaata

SEQ ID NO: 54913 - DNA, 898 bp, Bovine  19866881311408
atggaggggaggaggaaatgtttgttcctggtgtggtttcagattcccactgcaattaacctttgagaaactaccaattgtcaagctttggcacagtatcagagcagaatagccaccattctctaaaaggctattaatgtacctctccactttcctactacctatctgtgtgagactagatttccttcagctacttcaaccaaaacaacaaatttgcaacagattaaaggcagaactaaggaagttcagctgcctcctgttaagccagacattaaaagtatttccaaaatttcgaaaacaaaaccattcttttcactaaattgtttttgggaaaattgttcttttttgaaatattttcattgtgttaaacaagtaatggatttaatattattatttttatatgaattaataactatcctttttacttcactaaattttaatttttaatatagtaaaccttgatagataaaacctccacagagaaaagtttcttggggtcctcagattttttaggagtgtagggggaactaaagccaaagagtttgagaactgctgccataccatgtacagttcagttcagttcagtcgctcagtcatatccgactctttgcgaccccatggactgaagaacgccaggcctccctgtccatcaccaactcccggagtttactcaaactcctgttcattgagtcagtgataccatccaactatctcatcctcagtcatccccttctcctcctaccttcaaactttcccagcatcagggtcttttcaaaagactcagctctttgcatcatgtggccaaagtattgggagtttcagcttcaacatcagtccttccaatgaatattcaggacggatttcctttaggattgactggtttggatctccatgcagt

SEQ ID NO: 54914 - DNA, 861 bp, Bovine  19866881313891
cgcatccgagccctactccaaacacacacatttaagaggaatatccttcctttccctggccaagagccacctcggagagcccagagaggtccagagtgatagcaaacggtgacgctaacgtcagtttcaagtcgccatcaccgtacacacttttacatttgagagttcaaaacaaaacaaaacaaacaaaactggccccgacaagaacctttatgcttagttctcaaaacaatttttaaacttttcagcggtccagactctggtcggctgttctgacctctcctatctcctggcgcgccctagcccgccttgggagcgctccgagcctggctggggcctcgtaggaggatggtctcaattgctcaaacctggagagcggccgcctgccacctctttcccgcccccaaagcagccgaggcctgggaccgtgcgcgggactgcctctagggcccggccctgccccagcccgcggccagccaggacagccccagcctcgtgggggcgcgggctaccgagagccacggcgccacgccgtggaggcagcgcggcgctgcaggcggctctcccgccgctcacctgccgcggcgaaccagctcccgcccggccccgcgcgcgcggcggtcagggccccggggcggcggtgagcggcctcagctcctcttctcgcgctccacttctccctcagcccgcctcgaaattggccggccatcttcctgacttaaaacacccagagaaattttgggaaagtttgttgctggcgctgcgcgcacttttccaattggaaattaaaaataaaaggggaaaggaaggaagtcgcggcaagattagcacccttggaagtacccccaccctcgacaaaaa

SEQ ID NO: 54915 - DNA, 1300 bp, Bovine  19866881344897
taaaaatatgtagtatttctcacttttgtttctgttctgtttttctagtagattataaaggctccctaataaagcaagaaattaagattttgcagagcgtatttaacaatttttatactatcacatattaaactttattactttcctgatatgttataaaattataatactagatagtacgtttcattttttaggaatataaagaaatattattctgtgttttgctgccttttaaaatgctttttttccccctctctcttttctaagaactgcagcattcaagaaaaaatggatttggaaattcgaatacgagaaggaatatggaaactcctttctttgagcactcaaaaaggccagattttgcaggcagttaagaatctcatggtgtgcaatgctcgaataatggcttacacattggagctgcagaagttagaagagcagattgcaaatcaagctggaaaatggttagtggcattgtttacctttggtttttaatgtacttaaatatttacattaaaaacactgtgtgattcaaccttaaatttaatctaaatgtcaaatcaccaaagtttttaaaaaatatactgaagtagcctctagtatcataaatgttttgacagtagggctcagagtaaacgtactattaaggcagcagtttttactgggcagttttattgttttcattactttaaggttgtaaaatgaagtggttaagaagcaaggagtgaggaaatattttgagaaggatcaagattgatactagagtattaatgtgtacaaatgtaaattttaaaaagctaattacttaaactgttaaaaaggtactatctgagagaaagggaaacttaggtatagaagttgaaatgagtgggcaacaaaattaaagctatgaatagaattaaagatatcaacgggagggaacttaaaaatcagcacgcacattccttttgcatggtgagtgtaagttctagtgaagcaagtcactcaactcatattttaactagtgacagaagctaatgagaggttacttatgatttgctaagtaactcctggtccttgttctctctgtcgatttgtgctgccttttacagtgccaggttttatttggaccttagaattgactcagtgactagatactggcttcctttatcatataaatggttttacattatccatggttaatcattgttaaagctatagcactagttaaaagtttctttttagaccttagtggccattgatttggatgttcacagtactcctccatgaaattcttgaaaagtaagggtaaagtcacaca

SEQ ID NO: 54916 - DNA, 1183 bp, Bovine  19866881346240
tccatcatcaaagccagcaatggctgatcgagtctttttcttatcaaatcattctgacactgagtctcctacctccatgtttcacttccgagtacccctgtgattacactgagcccaaccagtgattcagaataatctccacttctccgggtcaactgatcagaaatcataattttcacttgctgtttagcacagtatattgaatatactgtctctaggaattaggacatgaacaccttgtgttgtcacttcagtcgtgtccaactctttgcaaccctatgggctgtagcccagcaggctcctctgctcattgaattctccaggcaagagtactgtagtgggttgaagtgccctcttccaggggatattccctgacccagggattgaacctacttctgttaagtctcctacattggcaggcaggttctttaccactagtgccacctgggaagcccatggacacctttgcgaggacattattctgccttccacacccaggctcaactatacatatctctagttcatggtaatacaattacagttattctaagtatgagcttttaaagtagcgaacattgtgacttggtggacagtacacacaattgcatctacaatagcggaggaaagctaaaagcctaatgtcagagaagagatcaaaattgaaaattagccacagaattagcaaatcatagagtctgaggtctcagagaatgggggaaaattctctctaccatttcagtggtgcctgggaatattttgtcttatgacacaaaactttaaacactgtttataaatataaccctgcctgagtcattaagaaaatgttttattcagttttaaaaacaagtggcacaccatattttttaaaagaggattttaaaaaatgaagccataagatatccaggaaaaatctagtgagtattcatctgatttctgaacaagaagcattttctaagcatgaaaacaaagaaatgaaaacagaaagggagtcatattttaatataaatagatactaatatttacatatttaaaacaatgtcaaattaaaagataaataacaagctgtgaaaactatttgtcacaaatatgacattcaataaccttaacagagttcatacaaatcaatgagaaaaatattaaggccacagagaaaaatgggtatgttatgtgtagacagttcata

SEQ ID NO: 54917 - DNA, 1344 bp, Bovine  19866881487358
tagctctcgaaagtgacaagtggaaacaatggattcagtcttcaaatagttgaattagtgtgttcttgtcctagttttattctagtgtgggtaactggccctgaaaatcagtctaagatagcactccaaattgtgactatgattcgtcagggtataaaagactctagaataatatcaattttctcctttttatcctattcaggaaaagatttctcagtcagtaattgcagtgaacccacaagaaggggtgatggtgagaagaaagaatatcaattaaggagtgatacataaaaccccaaaatataagtaactaatttcacaatcattgtgaatagttactttatctaaaaataataaactatgacatttaaatggcagcttacacaataattgaaaaagtactaatgcaaggattaaagagattccatttttggtagaaatgataataccattaagccaataggatgatggaaaataaaggaaaaccaagaggattatcagcagaagggatctttaatgggaagcaggacaggttgcatcacaggatacctgatgaagccaaaaactcatcaaaatacaattctatcttggaatggactctgataaaggaagctgagatgatggggtggaattgtggattcaagtatggattagtctactgagtaagataatatttgtgatggttatagttaaatgtttctctgcaagtgcttgttttccccaacaaaataactgggtttttttttgttgtttttttttttttactactttagagcagaattttcagttcatgattgttgctaaaactatgtttctggttttagcataaagatatcagcaaccacaaaataaagtcaactctttgaaggttcagttcagttcagttgcacagtcatgtccaactctttgcgaccccatgaactgtagcacgccaggcctccctgtccatcaccaactcctggagttcactcaaactcatgtccattgagtcagtgatgccatccagccatctcatcctctgtcgtccccttctcctcctgcccccaatccctcccagcatcagagtcttttccaatgagtcaactcttcgcatgaggtggccaaagtaatggagtttcagctttagcatcattccttccaaagaacatccaggactgatctcctttgaaggtatatattcacaaaacccaccagactattaagataatgaaactggccccttggaggcagaagacactcaacgttttgacctagaatatccagaaacttcaccaggttagtatgtgcctggcgtggagaggattttgtttttgaataactttttaggtatcccatacaaggatg

SEQ ID NO: 54918 - DNA, 793 bp, Bovine  19866881491939
actaaagtctttttttaataagatgaaagacattttgatagttaaattgattacacagtcacttttgccttgatgtaggtttggtgacctggcattgccataccataaggaatacaccttggtgttttttcagagccaactgtctgggttttactccttgatttcaacatgttaggtcaatctttaatcgtattttactctgcttgaaacattcgggatacttttcacaggtgtctcattttttttactccgcccaagaaataaagcatataaagctaataggtctgctctcttttagtcaatatgctttattaaataatacagatgtttcagctgttactgggaattcttattaaaaataaatgtccagagactaattccttaaagattataatgcagttgagatggttcagtacacattaaaaataggtatactaattttaggttaggtttccaactatttgtaaaccaggctatttaatttcaatatcctaactgctaatgaaactaaggcaaattgtttggtatatattaaaaatggctgtagtgatattttaacagttcaatacaactttgggggtggtggtgggaaggaaaggtcgctatcccctcaccacaagtgcctacaatgctgccaatccgaagtagttaaacaagttttacagaaaaagcaaagacaagaaaatatttaagtccatagattctttcctccaagaatgaaagttgtttttcttttttctgcactagcttattttccttaggttaaatataaaagcagtatttttggtgcagc

SEQ ID NO: 54919 - DNA, 854 bp, Bovine  19866881822170
ttcttctctgctgggccggatttggagaaaatagcagatttccgagtgttaatgttcaccacgtacagtaatgggtataaagcacagaaggcaagacagattcgtttgacagatccaccactccagtctattgaagctggcatgtactagccttgtaccttgccttgtctaattagctgctgagctgggccctggctcctcactcctgatggaaacttagtgggaaaactcctgtcaccaggcatgatgaagtggtgcttgattgtgctacaagatgtcctgtggctgcagtccagacagtttcgactaatcatcaactttgcagattccaacaccagggcttgtctaccaaggaaggagctttgcaaagtcagcctgaatgatctgcagaaaggacataagaattgctttgttttatatatttttaaaggactgactgcaataggcagcaccatgagtgtacctgagaaacttggggtccactttcatgtcaagactcctcacagcttaataagaagggagcagcaccagcatttgccatctgctaatggccacatccatcaccgccttcaagtcattttataactatgtaactattcagttaactcctcactttcttcccctgaataggagtttacattccctttgcataacatagttgcagctctgtgcctttgaacaaattacttatcctttctgggtctcagtttcccaatcttaaagagcttagaacagtgcctgacgtatcttgggaggtcattaatgttagctgcttatattattatttttatgatatttgaacccatcattctaaaagtaaatggataaaacaacatctgtgataagcatcatct

SEQ ID NO: 54920 - DNA, 1352 bp, Bovine  19866881914400
tggcaccccctccgtactcttgcctggaaaatcccgtggatggaggagcctggtaggctgcagtccatggggtccctaggggtcggacacgactgatcgacttcactttctcttttcactttcacgcattggagaaggaaatggcaacccactccagtgttcttgcctggagaatcccagggacggaggagcctggtgggctgccgtctctagggtcgcacagagtcacacacgactgaagtgacttagcataacttagcataacaggcaatcagattcttatcaaatttagctttttgaaagggcattttctttgttgttgttattgttttagtacagattcttggaactaggattctgatgagccagatccaaagatggaccagcagagttactggccagtttctgggtcttcacgtcagctccttccaaatgtattgactcccttgcaacccttcagggcaaggaacaagaggggaaagcagtgtcaggcattggacaaacaagttgaaatgggccaaattttagccacaaacataaaagattttacctaaaaatactattgcaatcatctctaagcagactgtgacacaggttagctaagtttgggggaaaaaacaaaaacaaaaaaaaacccatcaaagccttcttttgatgaagctggtaaatttgtctcctcccctggtcaggctggtcaccccagtaagacatacccaagcacacttagccatcccacagagatgagaatctcttctgattgcaccacaggctgataatccggagagtggtaatcagtgagtcagttgccaatctcacagaaatgagacagatgaggactacaggggctggacccaaaactgccttccgtgacctggaagcctaggatctggttgttgatgttgaacttcatgctaccagtcttcacccactggggataaaatggcatggaggaacagaacagggtcagtacacacctggggaacagagatatgacctaaatgttacctggccaccagccataaaagtgtctccgggatttcacaagtgttcacatgcctgggcctacccaaccaggagttgaggcttgcaatagacagagctcccaacatcagcaccaggagacttggctaggaatgctggctctgcttccttattacctgtgtgaccttaggtaagtcgttgagcctctctgggtctcacttggcttctgtggacaatccagaagagaatgtggccttgccaacatcatggggttgtatttcaaggcctaaaggaagtaccatttatgaaaagggcttggaaagggtagagtaccaaataaaatgtcttgttaggctttatgatcactggga

SEQ ID NO: 54921 - DNA, 1438 bp, Bovine  19866880614182
ctgtaaacacacacacacacacacacacacacacacacatacacacacacacacacatacagatcagagggaactttccaaaacaagatatgggtacatctccccactgctgaaaacatcaatggatccattggcttttcagttgccttgctaatctggcctcatctgatctttctacactccctccagccttgccctctctccccctaacccctgccttgttgttgttgcttagtcgctcagttgtgtccagctctttgcaaccccacggaccatagcccgccaggctcctctgtccagggatttcctaggcaagaacactggagtgggttgccatttccttctctaggggatcttcctgacccagggatggaacccatgcctcctgcattggcaggcagattctttaccactgagccaccagagaagcccttactctcacctttactcacaatttgtatgtcatgaacataccaggcacagtcccttctccacacctaactcaaaccaccccatccactggaaataccctctaccccagccctttctgaacaatacccctttatcctgcaaagctcagccaaaaaaaaaaaaaaaaaaaaaaaacctcctactttcatcctaagcaaagagggaagagcttacactactttgcggatccccgtggccgtgtgcgtcctcccaaacagctgtcttattggccccaccaggaattccgggacagggtttctcttgaaatcattgaaggtgaagtgagtctggaagtcgtccgagtactgcatcagagagaactgggaacaggcacctggtgttagactggagcaggcacccctcctcccacttagctatctcccagaaagttctccataaatcctgaaatactccaggctccaaattcctccaaattctgccccatcccagcccttctgcctcaccaggaggacagcgattggccatcagctcccacttctcagcactagaacttagccagagatgacatatgggtttcatgtcccatgccaacccctatcgattactgtgcctactttacagagggctggaagaaggctgaagctgcatccagtcagagcaagacagcaaatcatgaaagaaaatgctgatcaagtggcaatttggcaccatctggacaggaagtaggacaggacccgctataggcaggctgttccctaacctacccatttgcactcaccaaggttttggacttttggaattgactcatcacagttgagacaaacctcttcatccgctcaaagtctactgggtcgatgctaccagagccatcaatcaaaaaggcaatgtcactgtcttgctcagggcaccctgggggaaaaggaaaagaaactgtaagtacaagagactcgggttcatttttttttttttttttaaatcagctgtctgctgagcaatgagaatgaaa

SEQ ID NO: 54922 - DNA, 1592 bp, Bovine  19866880852066
aaaaataacttagtaacaacagccccaaatgtgtacacacagactttagaggcaagtgcctcctttcataactgggagatgcccatgaattccttcactcctctatcagctgactgtggctacaatactgctttctgttgtgtaacaaccacaaattcccagtggagtgcaacaataagaatgcatacaactcctgcatctgcagttgagctgatgtaggcgcagctgggctggctgctttcatctgggcttggctggggtaactggctctgttccacgtgtgcgtcatcctcctctgctccagcagactagccaaggtagatgcttctcatggttacggcaaagacacaagacagcaggcaggaatggaagaggtctctcatggcttaggctggaaactgacacgcggtaactctcaccctattctatgggccgaagcagtccatgtggccaaacccagtgttcaggggcagggaaatggactccgttcttttggtgcaaggagctacagagtcacttggggcaggccatgcgtagagggagaagccacctgtccacctcaataggaagctgggacttccactggaccagtgttctcactggtcccccgcctggaatgaccccccaccagcttctctaaactctatccactctataagtgccggccaacagtccacctcctttcgcaggaaatcttccccactccccggggtgcaccacgtgagctgctccaatcccctggatggaggcctgtggctcccgtctctccggccagctcctaactgcctcctagaagcacatatggaatgtgtctctttcagggcccctgcctctggggctcactcaagcgctggctggtggactggatccctgagaaacggaggtgatgctggtgctcaactttcctcccaggaaggggaggctatgttgattgcctttgatatagctgccagacctgaaatccctggggagctgaaaggtgtgattctgaggtcatcaaatctgaagcaacctgcgatcaccagtagagggcgctgtactttgtcatcttggccccacagcctcgctgcctgtgcatcgtttctcccaacaccttcttcaggttgtacaaagaaactccactctcctgagagcccagaagcagcctatggaggctgagaagcagatcacagcatcacagggtcccatcttgaatctctcgtgcagccacaatacccaaaacttcctcaccaaagaactcttccctctagaaaatctgcctgtgcacagacaaccgtggttgcagatccacaccctggaccttaatttagtttatccaatccacccccaatgacacagttaatgtttcaaaagcaagaaaattaggaaggagagaaaacaaagaagcaagatgaaaccaagagtgtgtaacattgaaattaattatgcatgtgcatgcatgctaagtcacttcagtcctgtgcgactctttgcacccctgatggactgtagcccatcaggctcctctgtgcatggaattctccaggaagaatactggagtgggtagctgtgcccttctccgggggctctttccaacccagggaatcttccca

SEQ ID NO: 54923 - DNA, 1085 bp, Bovine  19866880923986
atcctggacatggcttagctggccccttagctcagggtccacctggctactgtctcatctagaggtttgactggagaagcatcagcttccaagggcattcatattgttggtagaattcattttcttataaccatagaactcttagtggctcctttgaagctaacagcaaagtgagaatgacttctcagagtcactaaagaataaatgtaactctctacccatcaatatctatatagatagatacagatacataaaataatataatgaagggagtagcatgccatcaccctcaccacatgacatagcttaaacaaagaagtgataccccacccacgacctttgccatattttatctgctagaagaaagttataggtccttctacaccaaagaggaaaggactgaccaggacattttaactgggggcaaagatcatgggagtcatctcaggattcagctgccacagtagatttcatctgaaagacccaggactgatagtggtacctggcttatggggttgtctgtacagtcgaaaagcttagaacactgcctggcacactgaaatggcttgatcatcattattatcctcatttgccactatcatgactaagaagctttggccatattttatcgagctcagaggtcattcagtaccttcaagtgatttgggatattgttatgcagagcaaccgctttcctatgtgtccagggatttctccatgcctcacactgagtccacattccctctgatgtcttggaatctttaagctggacctgatggctcagtgccatctcattttctaggtagaaatgtccctgttagagatgggttatgtcaacttttgcctataatctctgagcttctaaattccaaatgctacgttgttatgattcaacaaattcatctcacaacctcttactgcatgcctacagcatgccaagtcctgtgttttctccctctcagctggcttgctccagcctcgatccccagaaattgttctctcgtttgcctgttttaatttggatttggtgtcacttttttctctatttaaaattgagccccatattttagaagcaatatctacaa

SEQ ID NO: 54924 - DNA, 707 bp, Bovine  19866881031961
gtgtgtgccttatgtacaatgaatactccctcccccacaggaaggcatccgggtttgtagactggctgtgttaactaatgactgcagaaagctactgtcttatgctcaggatcatacccaaaatatctgaccacctgtaggtcaggagcgctgaatgcatgctgggcagattctggagccccccttgctgtggcaggtggtaactttttagttcttggattatagtgggtggaggcctgggagattccgagggtgattgttgactactgtgggaagatttctttatgttaataatcagtatgatcatactgctgctctgagttaaatatcggccttgccattgtagtcatatttaaaaaattctgataagaatgaagtgagcttcctatacgctgatttgcgagcggcggactgtgaagtgggccccacagaggtgaggcgtccagagctgcttgacccagcgctggggactggctgccctgggaacagaacccctgccctggatgcaacattgccacgacagctgtatcacaacctttaagagaactaacatcctgcagaaaacttggtataattagtcattaataaccagaacctggcttccccacggtgcaaattgtttccatattgatctctacctgcattgtcagcacgctggaaagattgaactttaagtgcttaattcagccccattcaaccgataattt

SEQ ID NO: 54925 - DNA, 944 bp, Bovine  19866881103556
taagatctagtagaaagatgtaattcccatgagtaatagttatcatgaatattattatgctccctaggagggaagggggggaaggagagaggagatggagatgaggaaatgagtctaacctgagtgtgtgttgttataaatgaaggcaattattccttgcatttgaatactctatattatctgatacatattatatatataatatctgatgatatctcatacctaacatagtaacatatgtaatatgttgtataataatataataacacacaaccttttttatttcatcctcacagtcactttgtaaaaatgacattttcccattattcagctgaggatctcagtgtgtgtatgtgtgctgagtctctagagtcatgtctgactctttgcaacatgatggactctctgtccctgggcttctccggcaagaacagtggagtgggttgccatgtccacctccaggggatcctcctcacccagggatcaaacctgcatctcttaggtcttctgcattggcagccgggttctttaccactgacccatctgggaggctctcagaagcttgcgcaaatcccacccacttttctaaactccaggttcagtgcgtaaactgtaacacagcttttctggcatgaacccaatgcgatggtttacagcctatttctctgaccttttctccccacccgcttcatgccccacagttgacaagtgaattatttggtggacagaatatccacattaactgagagctgctccagagcaatacccttagagctaattttcagaaagttggaaccaactttattctaaaaactccataggggcaaagaaatcttttgattcagagagcacttcaagatctgatatggtttgagcatcttgtggctaagagcatcaacggttcttttaaaattccaagggaaccttcctgcttgtttcgagct

SEQ ID NO: 54926 - DNA, 1205 bp, Bovine  19866881302125
tgatgatgagtgtattgatcagctgataccaatttgtcccattacagctaacgttaattttattcatttgattcaggggctgtctgcccaggttcctcaactgaaaaagctagtaatttccccatcatcgttaatagggttttggagggctttactgagagatgggtattaaaacccaccacatttcaagtgaatactccccctgactgcttcattttcctttacttgtagatggctttgaaaaatggaggctcttacctttgttcaggcttttgtaagtaaatgttctataaatttgcaattttattccacagtcatgtacaagaattcattttattacagtttgtatctccaggacaagaaaacaagagtcctataggactcttaaaatgcttaaaattcaggtaccttaaaatgctgcaatcagcacaggtgagaagtaaaatcattttaaggaaataggggtttgttgatgcaaaaaagaatcttcaggatgtttcatcttgtcctcatgtcttgagttgatctggctctttcactcttgatcagtgatcattctagatatttaaaatgaaatgagatgttgcccacatcttaaaatcagatatctattcctttaaaaaaaaaaaaccaaacttttttattttgtattggggtatagccaattaacaatgctgtgatgatttcaggtgacagcaaagggactcagacacgtataaacatgtatacatggttttgattgaatagtactcggaagtagagttaaggaactgcaaattagaaatgcttcctaagtgttttaaaggggctgtcaggaaatactatttgatgaaataattttctataacttaaagtgacctatcttctctactgaacactgtagtagattggaaattgtagaatctcggggatgactcatgttcctttttttaataaacaggtcttgctgtctctaagctgaacctcgtcaccttttttgagcaaagaaaggagccctgggatgtgaagaaaaggagacaacagtcatgcacccaggtgggtagggatgaataacgcagattgcgcagggatggtgtctgaggcgaaggagaaactgaggccttaaaatgtggtttgggcggctctgcttcacgggggattccttcgagaagtccaggcctctgtgtcccgctgtcacagaggtccctctcctgctccactcccca

SEQ ID NO: 54927 - DNA, 739 bp, Bovine  19866881660135
gaaacttctaacggacatctcccagctggacaggtttcctcacataggctttttccttcctgcatataccacaattgtgtcctgattgtgtaattatttgattaatgcacacacacacatacatacacaaaattataaagaccgatatttttagtatttagtacagtgcctagcacatatataccctatgaacatgcagtagttaattaatggcttaattaattaatcagcatgaacagataagagagatagaggcagaaataaggtcatagatggggctaaattccaaagttcatttgtatgtctgctgctgctaagtcacttcagtcgtgtccgactctgtgcgaccccatacactgcagcccaccaggctttccagtccctgggattctccaggcaagaacactggagtgggttgccatttccttctccaatgtaggaaagtaaaaattgaaagtgaagttgctcagtggtatctgactctagcgaccccatggactgcagcccaccagactccttgggattttccaggcaagagtactggagtggggtgccattgccttctcctttgtatgtctacctggaacaaaatagacatggacactgtatgaaaataatggatactgaactctaattctaatgaaattataaccaggcctgggagggtgtgcatctgagacttatgtttaaacaaatattgaaaccaccatggtatttctcttccccagttatccccaaa

SEQ ID NO: 54928 - DNA, 845 bp, Bovine  19866880380632
aaatattgcttgggactacaaaataaaatattatttgggactacaattaaaatattgctatttgaaagaaagaataaaaaagaaactggaagatttggtaatatacttcctgaaaacccaatcaaaataatatgcactattttttttaacctctcttattagggacttaagggggaaaaagcaaatgactattaacaagatataggaaattagtttagatctgattgcataccataactcaaagagtggggcttccctggcagctcagtggtaaagaacatgcctcaaatgagggagacacacattcaatccctgggtcaggaagattcccctggaggaggaaatggcaacccactccagtattcttgctttggaaatccaatggacagaggagcctggtggactagagtccatcgggtcactaaagagtcagacacgatttcgtgactaaacaataaacaacaacagtttaaaaaacacacacacaaattaatttattttcaccttgggaggagtactaatggattgggaggcatgggaagaaaggagatacagttgttcttctgtctcccagacacagccccatttccataccaaaatcccctgaagctcaatttgtatacaaccaacacatatccttccacatactttaaattaactctaggttgtataatatctcatacaatgtaaataatttctaatacaatgtaaatactatgtaaatagttgccagctcacagcaaattcaagttttgcttcatggaactttccaaaaaattttttttcaaatatttttgatccatagtgggttgcatcccaggatacaaaacctacagatatggagg

SEQ ID NO: 54929 - DNA, 3933 bp, Bovine  19866880395842
attataatgtctcctccacaatatgacaacatccatagggaaaacatggaaataaagtctgccttggtccatttccccccatcttagatccttgagaaagtgattccatcatcctttccctgaagtactagtacatttcccagccacagtgggctccagtgctgtagtcctgtagatttctgccttcagatgcttcccgtaagcagacaatcccttcttctacgccttctggtgattttcagacaaaataatccaacagacaaaaaaaaaacacaaaaaccgaaaaacatcctcatgtagattgtttactcttttcaaagtttactctttttacagtttataaggccattatatccactaattaatttttcatttgagtccacctactcagtgcaaaactgtaatgcccattaaattaagctagaatggtgacagtgtctattcatttggggacataatctcacctggatccttgactaagcatgagtacacattattatttttctcacttttatttgcttccatgggattggtataaagtcgcagatacagaaactgtggagactgttgtgcaagaaactggcaattatgcttctttaaatttacttctggtacaaatctgccagatagaattgtattttgtgtcacctcttttaggctcaaaaatttcctcatttactcttatttgtcctatattgaaaaataagggaaaataccaaccctatcttcctgatattacaatgctcttgttctgtttaacgcaccatgtggatgcacgtgggaactcttctttcagtggtagatgtaatgaatgtactgcttagctgataaaccctggcacagaacagtcaacgaaaaacttctcaggctacatgctttctcatttcactgtgtggaaaacagcaggcaactcccactcaatgaatgctccttattcctcactgaagtaccaccctacagtggctgatgaaggcctattttagggatgggcagatacggagcagaaaagccgactcagacacctgtgatttcaactactgccccatcacacttcgtgcaaaatgcaggtgagctaagtagaatataatttggcataaacttccatgatcaaacacttagatcttgtccttttttttaaagggtgttcatgcagatatcatttacttaaaaacaacagcaacaataaaagaccaaggcttccacatgcccttctgacatggaatagaaatgaatcaacactcctagcaactcccttactcttttgcaagtctgttatacctaccagactgtctacacacaaggcccattcagcacaaaattgccctgagtgctatcatgtgccaccagtgggcagaggctactaagctctccacgccttcagcttcctcaggatgccggctgagctgcaataagtttgaaagactttcctgtgggacctgggtgaccttctctggcgctttgatgttaaatacagctcactggtgtcacggctggaagttaagtgagttaactgtgctgtctggagcaggcccacgaatttatattctctgcacttgcagtttgcagaccttcaacttcaccctgattttgaattattttcctgccaatctccattcccccctgcaaagcatggagaggtaatagataagaaatacaacttcattgtcatatggaacaagccattatagtatctctatggatggcaataaagcgggccctaggagactacatctgccatctgggaagtatagtaggttttactcgtgctcactcgtcacctgaattgcaagagaacccgcaagcaccaatacctacgctataaatgcaggaattgaaccatcaagaagttgaatgtctttaccttggtaggaaaaaactggacacacatgttaggtcatctttccagatcttctccaaatgatttacacagactgcctgagggttaagtacaagtgtggggattaaaagccttttttcaaaaaagttttattcagaaccctattaattccttcgctgctctgaaaaattattttctacttctgtgtcaatgttttcactatgaatggataaggacattataagccctgttatataaccctgctaaggaaatagggccctccacccagcaggaatgtcaacataattgctagctctatatcaaatctgagagaagtggataaattgtatattaataactaacaatggggggatcagttgaagacgctcaactttatttatacaaacatagagcagcattcacacctcagttttggctagaaaaaaagtcaatcaacctattcaagtggaagccaccaatggagcttgctaagttctcccctcccaacccctccttctattgagtggcatgaattttttaaaagttacctttacttgccttagtgtggtggtgatggtttagtcagtaagttatgtcctactcttgcgaccctgtgaactgtagcctgccaggctcctctgtctgtaggatttcacatggcaggaatactggagtgggttgtgatttccttttccagtacctcagtgtaacacttgggtaagacattttttctgccaacactgaaaacaagtatttgtttaatgagtatgtacaccaataccaaaccctcagaagaacatggcacaacatcaagaaacataaatccttggactgatttttactcctgtgggactctttcataaacttttctcttctattgtgttgaacacaaaatatatttatattttgttaaaatgataatcattgttttaattaggggagacttttctgatagtatatctaatgctaagagaaatttcaactgttatgtgatatttggagtggacggtcagtgaaataaatctgttcacaaacacatgaaacctcattctttctaaataaagctaaaactcaataacatactttctgcttaatgctggcaactgcaacttcctggctgaaagaaatagagcgcccaacagtttataaaatgactcaaaagatttctcaaatataataagtgtctttggccaaatagcatttggatgagttaaagatagacaacaacaaaattcagtatgtatattgatacattgtgatcagatttcctttgaaatccccaaagtctcaagattaagaggttaagagagctttgtagttaagagactcacaggctttgaacaacagctcattttttcaatcctcaaaaatgtttggtaccacatctgttaataaggaaacagttcgatgagtcagtgtctgagctctcatcgccttgaaggcagtccaaaatggggatttctggcactttgggccaattttatgagctttaaaaaatatgctgtagttttagaatcactgagctatattttgctattcaaatcaccaactctcagatatgctccctgaagtgtcacagttgatcctctcttcccaaggaaggctcatcccagccaattaaccgtaaaggagaagcagcaggaccaatccagaggaggtcctcaagtcatcctcaacagacgagaagaacgacttcccaccagcaacaggtcattcccactgatccacagaacaagggcttggacaaaacatcaagtacacaatgttggtttgtgtttaattactctccactccttccctgatggcttcctgatgagcttccctgatagctcagttggtaaagaatccagctgcaatacatgagaccccagctcaattcctgggttcgggaagatccactgatgaagggataggctacccactccagtattcttgggcttccctggtggctcagctgataaagatctgcctgtaatgccggagacctgggttcaatccctgggttgggaagatcccctggagaagggaaaggcgacccactccagtattctggcctggagaattccatgccagactttttcagtttcatactctaa

SEQ ID NO: 54930 - DNA, 954 bp, Bovine  19866880602092
atacaaaatttcttttttgagtttagccccgtggtttgattttacattctccaggatttagttgaaaaaaaaaaataccattttcctctgggaaacatttttatgataatacaatagagcccaatttttgttgtttttggaagagggttcagttcagtgctagtgttcatttttcttttatgttaggatttatttataaaatgcttaaggagccctttgaaatcttttggaagtggtacactccctctttttttggtacactctttaaaattatatggtgacaaactgttgattcttttcattgtcagttacttttatttctcctaatgcccatgacactcctgttattaattgtgcatttagggtcatgcattaactcattcaagccacttgggctcctcccgatatacgggtgttcgattcattaaatgatgcattaattgttttcaaatcactagggcctctcttaataacttgctggagcctgcaattaaatagtgtcccagtgcccccaaaatgtatcctcatttaatgactcagtcactcttgaaaagggaatttgttaagtgaccacaattatgctagagttgggaagtaaactgagttacttttctgagttcctttcttatcttttgtctatctgtggccttcccaatagcttgctgaggtatcaactgcaaatatatattaatatcgtaaaagcttgtagttttgcaatttcaaaatctaacacattcctcaaccttaattttaggcatccacagaccagaaaatcaatgaccaagacagatcttacaccttgcagtctgagatgggctccattacagtgccagcaggtagcccatataatggaaagtgttacgtataggcactggactaaatctctatttcagttttttcactgaattctcccaaactatgggctataggtttttatattcacctagatttcac

SEQ ID NO: 54931 - DNA, 1003 bp, Bovine  19866880661679
attttaaaatttttttatgcatatgttttttctgtagtttttctttcttttttttttttttgagccttcagaggttctttgtaaattgccaatgcatctcttaagtggccactgtctgatttggtttcacttgcttgtatttataaaaggtaaattgagatgttaattcactcaaaactaccccagattctctctctggtggattctttctcacccttctaagactgggagcgctctcccaagtttattcttccaaaggttaaaggtttctaccaggaggagataaatgtatactattaatatatccagatagaaattgctatttgtttcatttaataaatgagtcaaaacaaacacataccaacacattccaaaatgcctggagagctaagcagccacttaactgaattatggagctttggttttgttattatcttgaaagatcataaatgaatatattatgcttgcttgtacatatactttacctctctctacatagcatgagacatgatctcatctaaaagaaactgttactgggaaaatgaaaattattttataatggaaatattgctgggatcccattttattctgtcacatagtaagctgacctcacaataaattcacatacacagcatacacacacacacacaccaactaatcttacattcttggatcgtcatttaactaaactcttatgaagaactgataaattaaagagtctagacaagatttctagggagatagaccacactgcaaatagatcaagtaggtaaaaacccttagagaaatggtagaggaatccgtgagaaactgaaaatgtgtaaaagatatgcataatgagaactggcgcaatgatctgatataatcaacaggagacagaattgattttaattcttctgacaccataacattaagttgaattttttcctgcataattgttcagagtgtctgaaaaagggtattgctatagtacttgctgatgtatatcgaaggctatttgaag

SEQ ID NO: 54932 - DNA, 1491 bp, Bovine  19866880700412
cctgtggcctgttattctatctctccgtctatttgacattggctgtgggtatgacaggccagggcgaaaactacaggtaggaatgatatgatctcagaatgctgtttatggcttgtgttctgcctaatggtcatgatcttccctgtactgtacctattaaatatcttatatttcgccccttgcctaagtagagggagtctgtttgtgggctgggcaacagcagtggcctcactcactgccaaatgaatttgattgcggggtctctggccagatgtcgttgttgtcctcctgtggacgtccataaaaaattgacccgataagaacctgtctccaaagtttgcccacttcttagactctgtattctatgtgtagtatctggttgcagtacgcctcttcatacttaagctaggtatatcacagaagaggggtggaccaagattgtaagggtggtgcagggctgtgtaggggtgtgatgtatggtcaagccactcaagatggctgttctcttgctgcctgtacatcccctggtcgaccagtccctgctccaagtgtaccctacttatatgaacttgtttgtttcctgtctgagctagtgattgttctcatccttaggccagaatggctccacctgctagtttattaaagagaaacacttgcccttgtgatgttctttaaactgaggggctataaaggacattcccaggctgctggtttccctggtaactgatgaaccaacctgatgtcaattccccctataaatggtagctgccttctctactgagtagtgaatatggctgccatgtcctgtctgccatacacagtgaggtgttgctccaggagtctttatttcagacgtataagatcccctatccagtgtcattaactctggtgccattttcagattcttttttcatctttggggctgggtcactgcaaggcttataggcctgcagggtgctacccagcaacccctaaaaagggtgagggcattacctgacatttcttttcatgtagcaacaatgagtactagcaacatagaccttattcctcggttatttgcaaagataaattcaactcctgcattttgctaaaaaggaaaatgggcaagtactcagcaagcacttagtgaattaataaatgaaatatgttaaggaatatgctgcataatgcctaataggaaacactcagaaaagttctgaaaatgcggatttgttgtggacattgtcaacccaggcttttctgaactgatcaaaatatgtgtgaacctcaagaaatatgttttctaagtgtgggacccagccgaagttgtgcttctgcaaaccccgggtggagactctcactcctagcacagatcgtgggccttgtgttcactgctgaagtgctctgcacacaaaccaccatgtgaccaatattcagccttgaaggcttctcctgcacttccttttctcaccttgcattaatctttgtttttccttttctctaaatttcctc

SEQ ID NO: 54933 - DNA, 1599 bp, Bovine  19866880759684
agttggacacaacttagtgactaaacgacaatgacaagcttttagtaattgctgatctcacaagttcatgacagcaacaagtccaaagaatataggtggtgtccatttatttaagaataaattcatgggttaatcattaatttctatacatgtatttgaacgtgctatttttattttattttttttgaacgtgctatttttaatcattcaaataatttcatgtttgtagggcacgtgtttgtatcttgaagctattaaataagcaggatgaagatggtgatgactgacaaagtgagatttgtattaatttttccaaaaaattaggccaagtaaattggagtgatagcattttcagtttgtttattgatgccaagtattattaaatattatattaataactttgggaggagttgaaaatttaaaggaaaaaatacatgttgttttatttacatggctatttctaatgatacaggttttcatccaaaatacctgaataaatgaccaaatgacacctggaccttcataagctctgagtcaatggagtcaatgatagttaacattgtattatatacctgaagggtttggcatagcaaaagttccttaaaactagtttcctgaataataacagctccttatctgatttctaataaggaggtggaaatgatttgatatatgttgtttctaatagcaatcgaggcaaatcgcttttgtaatagaatcacatcacaattagatattatgtttcacagaaacattatgatggcttcatttttgttatattgaaatgatcataactagtgtatttactggtgttataagaatggaattagcttttaatgtatcagacatcattctaagtattttgtctgcattgaataagtatgaatgctaaaactaggtgagagtatgacaagaaagaagatgttttgtatgcacagagtatctcctccaaagatacttagtaattagaaaaggaaaaatagtaagtttacagtaaagaaacaaaatctggtagacatcaccttaagcaggtgatcaaagttaacatggctggtaatgagacgtgatgacatcaggtacctcctgatgtatgcatgatgacagacaaaataccattccctgggtattcttttttttttttttcttccacactgtgtatcttgtgggatcttaccccaccagagatggatccctggtcctgggcaatgaaagcctgcatgttaaccactggactgcctgggaagtccctcccctagtattcttgctaaaatagagacctgtatttaaccatgaagcagcagtagacaaacctcaaatcaagatcactgtacagagactggtaaagactcttcaaaatgtcaagttcatgaaagataaagaaagacagaaaatgtgtcatagattggaggaggtgcgactagaagatttgacaaataaatgcagtgtgggtcctatattggattccaaataggaataagggtggtttggggacagttcacaaaaggtgaatatagcatgtagattagttaagagtatcacaccaatggtaatttcttggtgttagaaatcgtaccatgagtatatcgtgttactacttgg

SEQ ID NO: 54934 - DNA, 825 bp, Bovine  19866881115257
acgcatattcctaacctttgttttccaaagcaagaacatactttctttttaaaagtcatccttgagttcatcgtatttcagtttaatttcatcccatttctccatgttgtgtctttagtagaggacaggcaccattctttacataaatttagagtcataggaagtaatcatacattcgccgttgtctgtgatgactgtaaagtaaatctaaatagataactatctactcaactttttaaagtcacaagtgaggcaaatacttggaggtttcacattaatcttctataattagggctgctaaagtgggatcccacagtcaagcagctgtgtctcaggtgaaataaataaatccagttactcctatttttcatcataggttgtcttatcaaacccatttttaatcatcctttctgatctctctaggaccctatgaagacttaacaagggttaattttagataacctgagtgtaaaacatagtctcatcctgaagttattaaatgataaagcttccacaggactcttttcaaggaaaacattttgtagcacagaaaagttagcaaaatgtagatggaatataatgttccctaagagtaaatacaacgaaaagcagctaggtataagtcttgtggaaaatcttagaagataaaagacttcagacattttggaattgaaatttcctgaacaagttagtattctagtatcctttaaaaattttttttggtgtctgttttcagtaactttatttttgtccatttcttcttactaaattatagcctatgacttaggtggatgattacttcggtgaaatagtcaagatctcaca

SEQ ID NO: 54935 - DNA, 1317 bp, Bovine  19866881133641
ctccgcctataggaagttatattctagttggagagatgtgagtatagataaataaatgcaactaagttcatttttctagacagattcttacacagcattttcaattttaaattgtcaaagatttagaaagaagccaatttctaggtgattgctaggggaaatcacaagactgataattaacttcaatactgcaatcagtttttaagcaaagagattatgtgtctaagggaattcaataaggaaattagcgtgagttttcatatggaggaatttacagagaaaaatatttcatttcaattaacaaaaatatcatgtagcctgatggtaaaatgcacaatgcacacctgaagtacaaagaagagatgtggtttacctggctccaaggctggcaaagactctggtcgatgagaagggtgtgtgcgtgctgagtggctacagtcacatccgactctgtgacactgtggactgtagcccaccagggtcctctgtccataggatcctccaggcaagaacactggagtgggttggcatggtctcctccagggcatcttcccaacccaggaatcgaatccacgtctcatgtctcccacattggcaagccagttctttaccactagtgccacctgagagggtatttaagagcaaaaataggaattatgaaaaaacatgacctacaaaacctagcctaaggagtgtagccgcaacaggaggtaggtagatgttgagaagaaatgctaaaaagagaggaatcaggaaagactgcaataaggatcttgtcttttaggtaaatgatttacaaggagccgggcaggaccgaggcaaggagctcattcaggggaaacacctcgttatcttttccaaattggaaaaccatcacctcaccctcaagattcagatacacagcagcataatgaatggaattttggaaatacaacaaagtgccagaaaagaattaaagattatatttaatatcaccatccagagatgcagactgttacattttgatgtgtcttcttccaaacctttatccgtgtgcacacacgtacatacacttttcatcttgaaagtctgtgttttcctctgcatctggttcccactacatggctgtggatgtgctaacactacactcgggaggagagaccgcctttctgttggcaacacggggtctccttagagttaagctacggaaacctgggtcagctttattcatcctaactgcctccatattcctgggcatgttcccatttaagcactctcccacagctagatccaattaaacagtgacagtttttgcggtcagtgatatttatttcctgc

SEQ ID NO: 54936 - DNA, 1634 bp, Bovine  19866881233188
gccctctgctaatctttttactattttaatctgcatagtgctctatgaagtgaccattattcttatttctatttaacagacttgaaaattgaagctcagagacaagtctcacagagctctacagtagtggtgcttccgggaactcaaatttcccctcaaatatcactgtgttagaaataaacaccagaaataaacaccccactccagtactcttgcctggaaaatcccatggacagaggagcctggtgggctgcagtccctggggttgagaagagtcggacacgactgagcggtttcactttcacttttcacttttatgcattggagaaggaaatggcaacccactccagtgttcttgcctggggaatcccagggacgggggagcctggtgggctgccgtccattgggttgcacagagtcggacacgactgaagggacttagcagcagcagaaataaacacatgaagtacctgacatacacttgatgttccaaaatagaagatatagaataattatgatttttttgtagtttaaaggttcatttgatctgactgtgttcctggttctccagcagtaaagttcaagagcagaacacaggaaaattttctagctaaataaagctgttgaaaacaggcaatatttagccatgataaatgcattgccaaaagagtctgaagacctttcttctttatagaagtctcacttgcagaaatcaactgattttcatcatttaagttagaaggctggtattaaaaggtctcaactcttcttagaaaattgtggagtttgtttagtcagggcttgactcaattctgacccctgctttgtgttactcagagtagcacagagctttggttccagccatgccatttgagcaaggagcactctcacagaacctgagcattgctctgaatgtggccacagaagcagcatggacctgggcttcacgtacttctgtaaccaaatgaaggatctttttatgtccttggtgggctgtgatttaagctgtgccagcccttcttataaactacagtgtccttccatgataccttcgattcaccccgaagccgatcttcaaaactattacagaaacttaaatcatgcttcatactcatcaaattctacgactctcctttaacttttggacataaattctcccagatggttttgcagttctttagaatgtctgactcaattaaactccaatccttttagcgatgagaagtgaatgcagtttctagttgttaaatgctcatgttcaatttgaatttcaataactatccttttaggtttaggctgtttgtgttttctcacatcagtaagatagggattcagacaatgtgggtgtcttattagagattgctggagaagactcttgagagtctcttggacagcaaggacatcaaaccagtcaattctaaaagaaataaatcctgaatattcattggaaggactgaagctgaagctgaagctccagttctttggccacctgatacgaagagtcaactcactggaaaagactctgatgccaggaaggattgagggcaggaggagaagggggctacagaggatgaaatggttggatggcatcaccaactcagtggacatgagtttgagcaaactctgggagatgg

SEQ ID NO: 54937 - DNA, 1404 bp, Bovine  19866881493351
aattctgaccttagcatctttacccttgagcgtgacccctttgcaggctaccaactcactaggctatgcaacttgcctctcttgcctcagaatataatcccctcttcttaggccttttatttcttccttacctctgatttagggcatagcaaccttgactgtcaaagtcgaaacattaactagtctatagtgggcttccctaatagctcaattggtaaagaatccacctgcaatgcaggagacctgggtttgattcctgggttggggagatcctctggagaacggataggctacccttctataaaaaaaatctatagtacttttccacatatttatgataagagggaactgagattgtgtgatagacccaaatacacagggttttgctttggttttagtccataattttcatctcttaaaacaattcattgatcatgtaataattagcatattcaaatattggtttatgctctctctcatagcgtgctgaagtccatggggtcacaaagagttggacacgactgagtgactgaactgaactgatagctccttgaaaaatagaaataattaaaaggtaagcagtagaatgcaacagtaatatatttgcataatttagcaacctcaaaatgtacaaaataatcacaaactggctctgctataaattaatcatatctatttaaaaattgtacttaaactcaaaaatcctactaaggaaaagagaaaggagcagtgcaggatgtgaaagacactgggaacagctgcataatttaatcctaacacatccgagggattttacacttgttaggcccaagccaacttctgacaaatgactctgtgatgttggaatgaaaatcggggcgcgactcccacggtagaacatgtttagtctagattccttgggacttgttcaggaccactcaggggtaccagagggactccaggtttgtcgtccatgacattttcaccaccctagttcttggaggtgccagcaagttgcatcttattccccagaaatcccttcctgaaccatggttgtacgcttgggggctacgaagccataccagaggatctgcatatcttatagtcaggaaactctaaaagatgccttatgtttgcacaatgtaactgctggaaaaatttaacaactgtctcctaaataacaagagtatgccaaggtaatgtcttcacaggatgtagaggaagttactacatgtgcttcacagtcagaaactgctcagaaatctgaaggattatgtgaggtaatccaatagtgtttccattggaaacagaaagctgaagtccacttttacagttacacacaacacagaggcatttcgctgtctactgcttaattctatctttctcacatgaactgccttggaaatgtcactgtagtctgccaag

SEQ ID NO: 54938 - DNA, 1112 bp, Bovine  19866881661251
tgaaagtgggtagagttgtaacatgggagctattgaaatttaattcagatgaagttctccatagtaaattccctctcgttatccaatagctgaaataggctgacatcgataactctctaaataggagaagtatttgtgcattatcaatggttacatatagactaactccttgatacggtgctacttgagcaatctgagaaatgtgaagtttatcctttagtgcttagcttcctttcaactttgaatagatggttcaaaatactttctgcatttttagtactaaatatatgtatgtgtgaattctaaaatgtcctaaactgagattaagaatgtgtaactgaacatcatgagaatacatttatttgtaaactgagcttacctgtttgactagtataaaaataacaagggattactaaaggcagatttaatgtttggattacttacagtactatcctagccttttcaccctaataatctcttgggatagtagtcactttaagtgactttaagtcacacacttaattgtacatataataagtttatgattactattctgctaccatattgtatattattctgctaccatattaatccagactcaactattgctgatcagatattaagatattaattatgtttctttttttagctactgtgatttttcaaaatgtcagtgaagtggagttgggatattttaatttaaatattctgtttttttcttaacaacctcctgtttttctaattacaggtttcatatacactggtgaagttgtgcaccgaatgctaacggccacacagtacatagcacctttaatggcaaattttgatcccagtgtatccagaaattcaactgtcagatattttgataatggtatgtgttggttagcctatattttgctgaatgtatacttataaacactgatcatcagattcatattaatatttttgtaatgttgggtttagactggatttgttaactggtgcaaatagcctgaggtaacgaatgttatactgcaccaattaatactataacaagtggataaagtatatggtaaaatgtcactcacgtattcattcattcattgctcatttaacaaacattatttttccag

SEQ ID NO: 54939 - DNA, 1416 bp, Bovine  19866880284664
gtccgaaccccaagaagtcttagttagcaaagaagcctgcttacagttttgtagataatgtctctctggggctgcgattgccctcttccggctctggctgcctgtcaccggagggggttggtctgtagccggctatctttgttcagtcctttgttccctgcgctggcctggcggtgtcttaggttagggctggctttttgcgtagtagttatcccacagtctggtttgccagcccaagttagttcgctcagatagcgctcggggcattcaggccagatccttactctaagcgatacagcccgcgcctccctgcccagcccccacttgctagtggtgggtgcaggtgtctgcgatgcttctccgctgggggagttaccgttggactcgtaatatgtgggttttaattgtttatttatttttcctccctgttatgttgccctctgtgcttcgaaggcttggcacagaattggcagtgagagtgtttcctggtgtttggaaacttctctctttttaagactcccttcccaggacggagctccgtccctccctcttttgtctctttttttgtcttttatattttttcctacctccttttgaagacaacgggttgcttttctgggtgcctgatgtcctctgccggcattcagaagttgttttgtggaatttactcggcgtaaacgttcatcaaacattcatcaaatgttcttttgatgaatttgtgggggagaaagtggtctccccgtcctgttcctccgccatcttagctcctcctctatttttatttttaaaaagtctcatatcaagaaatgttttgaatccacatgctgtagacatgtaaagaaagaactggtctgagacaacatatgtttgtcaaagctatcagctttctgtcactagttagttcccttgtactcttcacagaccaggaggatgacctaggtcttattcctgcctattcccttgggaaaaccctttctatactacatgggtcatttgcacttaataggatactgaaacatgaaatttggaaaccacatcaagtggctgggtgtctctcctccacacccacagaaacctagatattttggataaatattcattaagcgtttagcatagggtctgctactaagtagacagtcactaaatattagctgaataattggtccttatttaagaaatcttaaacaactgttgagacttctaaaacttatacaagataaatatgttttgcttttgactagatttttggtccaatgggaattatgaaatatgccatctctctggcttgggatgaacaatggaagagaatacggacatttgctgtctccagccttcaccagcggaaagctcaaggaggtaagaaaagaagaggactttcaattagaaacttacggaatgactctagggacaggtaaa

SEQ ID NO: 54940 - DNA, 1475 bp, Bovine  19866880587123
cttctcgcccgtgtgggtccgccggtgcaccgccaggttggcgttcctgctgaagcgcttgccacactcgcaggtgtacggcttctcgccggtgtgtgtccggcggtgcacctgcaggtgctgccggcggctgaagctcctccagcagtccgcgcactggaagggcttctcgcctgtgtggctgcgctggtggaccgcgaggtggtggcgctggctgaaggtcttccagcactcactgcacacgtgcggccgccggcccaggtgcgtccgctggtgcttcagcaggtactcgcgcagcgcaaagcccttgccgcactccccgcagctgtacgacttctcctcctcgtgcgtccgctggtgtcggaccaggttggagctccgactgaagcctttcccacactcagggcactggaaaggcttccagaaggagctgtgggtctggaggtcatcgggcagcggggcaacgctgtgctggggcaggagcggcccgggcgcgtttcccaccgagctcccggcctgctgctcgcttggtcttcccgactccgggccctggagagcggcctccccacacctctctgcccgcccgcaagcgagctgccccttggggtctgccagctgggtctttgcctccttgtccttgctccccaggcctacaggacaaaggagatacagaccaacgctgaagagatctgaagggaaacttctagccagaacctggcttctaacgtgtcccattaacaactaccaatgacctctgtgcatttcacttgctctgactctaaaaccagacattcctttacttctttccacctgttatggactgaatgtttgggttccctccaaaattcacaggctgaagctctcaggcccctggggctgctgttaggaggtggggcctttggaccctaattaggtgagggtctgggggtggagcccccaggatgggaccacgtcccagaagagcagaagccagggctggctctctgcacacaggggtcatgtgagtgggagccctcgtgatggattaacggccttacaaaaaaggaggaagaaacatgagatctctctctccctccctctgccacatgaggactggcaagaaggcaactgcccgtgaaccaggaagagaggccctcaccagacaacaaatgtgccagcaactggatccgggacttcccagcctccggaactgggagatattaagtgtctgttgttaaagccacccacttggtggtattttgtgacagtagcccaagctcagaccatcttcctgccttctcacggaaccatctgctaaattacaatgccttccctcttaatttcctactaagtcaccctgtgctttccttcaaaatctgactcaatgccatcctctaaggaacacaccttgatttctcccccgctgtgggtctctacagcacatgcattcaattagcactgtttattccacacttacttacacagaccttgttaca

SEQ ID NO: 54941 - DNA, 1691 bp, Bovine  19866880648022
aatgagcccccccccccgccctgccccccggggggctggcgaccacacaggtcccatgacgggatgacacaggactgatctgcctggtcacgcactgtgacctgaaaggcagaccacttcaaatgtccatcctggaaggccgggctcgcagggaggcgagcatcgcagactagcatcccctgtgcttctagctcattttcctcttaaggcttaatgacatttctttaacacagaggcagtggtacacattccagacaagagaaaacatatccttatctgaaatatttacaagccagcctttcacaggacccatcaaatgcggaaattcgaggcctaacaatctgattctgtcctctacataacttataggtctaaaactggccaagttaactcagggcaaaaaaaaagacctgaagacccagaggcctgctcttatttacacatgcccataaggctctgacctctttgaaatgctccagcgatgcctgaaggggtgaaatcccgcatcagtatccagcttggcaactcccctagtttgacttccaggagcttcttctccttcagtggtactgaaaaggacaacacaaaaacacacccagtgaaagggtctcccgggaacacaaacagcatctgtctgtgtcacgtcaaccactcaataatgatgcattcagtaacatcactaaacagaggctgcacataagtaatactacaggtaaacatatcacaccaaatacattatcttaagctagagtctatatatcgcagaacaagatcctgaataacagcctgctaggaataactataaagagagaactaagggccatgaagaagagataaaagtggaggatggatgcctttattttatgaggaagagtggggaaaactgactcagagaagctggcgaatcctgaacaaaggcagagagcctgcaggccgtgggggcacaactcgacctcaggtctggttcccatgctcctgaagccaatctgactcctacctcaagcatcccacctcagaccacagacgtcaaatgacttagtaaaagccattcccgaggccccatgggccccagatcatttcccaatgagaatctggacacaggaagggctcttgttttaggccatactgtattcatatctgggcttaagagtaaaacaggaaagtggccagggagaggctggccctgtgaatgctcataaaaggagggaatggcctctccgctgtcctcttcccagacgtcaactttaaaacattgtttgacaggcgcactcttcagagcaaggagtcaagggcgctgctgcttcttaaagatgaccaagaggagctggatttcaccattccaaggtttcttctccattttcaggatctaaggaaaggcttgggctccttaagaactaaccttgagagttcactgggggagaatcccaccgtgaactcttatcaagggcaagggccatcatcaggcttaatggcacattcacacaaactatgaaaacattcacattatcttgcattctcgttcaggggctgacaagtgccttggcacatcacgggagaaaaaagccaaccattaatttttcttcatattcatgtctctgtggtaatggtttagtcactcagctgtgtctctctctttgcaaccccatggagagtagctccaagagttatgtatctgtactataagaaaagag

SEQ ID NO: 54942 - DNA, 2543 bp, Bovine  19866880694184
ccctccaatgaatctggtcagagctcggccatccagaaagtcagaacaccagtctgaaagagaacccagaatactatcaggtggaacacctcccttgtttgtctcagggttccttcactctagcccaactgagccaccagtccattgactcagggggctggcatggttggaatctcactgaagcctccagaaatgttgcagaaaccagcacttgagaaaccaagcactacacttagagagttggagaactcaggtttattacagcagggccagaggagttgacactccaagctctgagctgcaacaaagcggttagagagtttttatgcacataccggcatgattaaattagtttgcagggccgggtgattgcaaacagcaggacaagggttagtgagataagttccagttcctagtattgtgagtccccactttctgagactatgtgatccatggcctatgtgatccagattttgcaaggagcaagctgagttacagaggcaaaaggagtaggaggctatgtaaaattttaacttttccctttatgagaaggagataatggtgttaatgactggttgtcaagtaaaaaaggtaacaactagtttgattacagatatattttaaaggtacggccattggatccaaaggatttgaagtaaaggttaaggaaagtgagaaactaaggaaaacttttggatttttgtctgaacaatagggttaagtttggtgctatttcagccacaggaaaatatgggacaattagatttactgtttttcttctttcaaatatcctctgggtaaagggtgatagcaggctgaattagttagaggatcttttagggagtctgtaaaatagatgagaacctcacctgaggatttggaactgaaagcattgtcctctacatttaggctggatacaaacatctgagacagcagggaaagattactgctcacattcggctacaataatattcaatatggcaacccactccagtactgttgcctggaaaatctcatggatggaggagtctggtaggctgcagtccatgcggtcgctaagagtcggacacgactgagtgacttcactttcacttctcactttcatgcattggagaaggaaatggcaacccactccagtgttcttgcctggagaatcccagggacgggggagcctggtgggctgccgtctatggggtcgctaagagtcggacacgactgagtgacttcactttcacttctcactttcatgcattggagaaggaaatggcaacccactccagtgttcttgcctggagaatcccagggacgggggagcctggtgggctgccgtctatggggtcgcacagagccggacatgactgaagcgacttagcaacagcagtactattattattatgttttaaaaggaatttgctgattccagtaattaggaagtaggtggagaaatctggctttagttacatttgattccaggagctcaaattatgccaatagttatctctctttctctctctctttctcattcattagtgtttccattctctttttttattcttttttttttttaatggagatttttttctttattgagaaacttaagacttgggtacatcaaataaaaccaatttcttgggggaaaaaaaaattaaaacccacaatagaaaaaaaaaaaaaaagttaacactgtctgggccatagcagaacccagagaatacattctttaaattgaaaaattctaggtgcttcataattgaccttttgatacaaaatgagctaataaatttgcaaatggggttcttggtgttgaggtccataggacaagctaggaagtcttcaaaccttgagctgaattccatgagagtttatttggcttttgaatcggttcatccttgtctttagaggtagcagcagcaacagcgtccaccttctgagcagcttctttcttggcatgataagcctgaaggaccgccacagccttctccaccttggagcagagagactcgggagactccagcatgtgcagcaactccgagctgttgatctccagcagcatcccagttatcttcccagccaggttcgagtgcatcgtctggataagtgggaacagatgttaacccagcatctgcttctgttcctgagcgggggtgggtttgctgtggccagcatggaggcagtcagcggctcctgcccctgaacatggaccgcaggtgggggtgcctgcaggggctggatggcagggtgaggactgcggatgctggaggcatattagtaaggtgcaacagcccaaggagcagtggcagcaacagcagcacgaagcgctaagttctgcacagctgtaggaacacctccagactggcagcttttactcagcccttgctgggcagcaccagccccaccaaagtacatagccaagcagtcagggcactcagaccggactctctgagtggtagtaaggaggccaccagaggctggagcattaccagttggagccagatggcaaagagctggacgaggcccagactggtgtatagcacttggcattc

SEQ ID NO: 54943 - DNA, 1337 bp, Bovine  19866880878769
ctttttcttggctctgtgaggcagacacagtagtggaaatcgctctcagtttgactctaaattacttttacctgatttcccctaggggtttgggagtttcactggaatgtctcatcatctaaactgtgatttttacattgccatgctttacctaaaatgtcttgactttctttttagctctctctgaccaagaactcatggcccagagtattatctttatttttggtggctatgagaccactaagcacttctctttccttcattatatatgaattggccactcaccctgatgtccagcagaagctgcaggaggagattgatgcgactttccccaataaggtgagtgatgatacctggagagaggggggaaggtgaagccttcgcatgattgtcttctctcctcttctcaggaggttttgcccaaagcataagcatcaaatcatttacctccattcccaggtggtgcagtggaaaagaatccaaactaacagtaagcacttatttctctggtgtctgcatttgttgttgttctgtcgctaagtcattttggactctttgcgactccgtggactgtagcacaccaggcctccctgtgcctcactatctcctagagtttgcccaagttcacggtgtctgcatatttatctattgatattggctggacttgctgtggtctgggtgttggctgatctaggctggccttagataagcggttggactgactcagctccacacatgctcctcacgtgtctcaatctccacatgtctgcttctcgaggcagtggtagatgtcatgagcaagaggcctaatcccatgggtgactttcaaaactctggtagcattacatttggtgaatattccagaggttcaaagtgagccacctgaccaacctgagtcagaatgggagggcaccacagagttaatggcgaagggaatggacagaggaaatggtggagaattgggaccattaattcattctactgccctgtgtaaactttagactaggtgaagcctgatgtacaagaaaggatatatggtaggaaacagaggacatgagtatgagacctgactggtttcggacaagtcttatgacctttcaaatcctaggtccttcaaatactttgtagggcctgcagaaattagagataatatttcttctctggtaaaccccatattgggaatcttttgattacaagaagattgaaaggtcactaacagaccaaggctagctaaggcattgcattctctcctttacacccatggctgattcatgtgaatatatggcaaaaaccaccacaatattgtaaagtaattagcctccaattaaaattaaaaa

SEQ ID NO: 54944 - DNA, 1665 bp, Bovine  19866880886132
aggccgacagggggcctgtctcatcagcatctgaaccttcccacacgaggaacacagagggcaaagccttagcccggccttgcaggactcactctgagtggggagcaggaaggaagggatggccccaccttaaacacatccaggcacatcctgaggtccgcgcacagggcggccatcttcagcagggcatggtacgttttcaagttgagttggaagtttctggcctgaagctgctgccgtagcttcagggcgctctgcagtgcggagtccttccagggggactcggcgcacacgttgaacagggctgtgtaggtggcgtctgagggctccaggtcccgcttcttcatctgaggagacagggagaaacttggaggtggctctggggtcagctggatgcatgggacatggggataggaggctagagaggactctgctaagaggcagagccgactgacacacagagctgggctctccaaacccgactcaacctgaggggccctgagagctggccttgctccccagaggcaccaaacaagaaagcatcctccccaaggcactcagcagcccaccctgggcctgaagtgctcttacagcaggccgctgtaactgttcctgccctctggccgcccaggttgccctaactgttaagatctgtgggatagatctgatctgggaaagggcaggaggggtaatcaaaccccagctccaatgtttagtaactgaggggttgtgggcaatcagcttgtcattggaaaaacgggggtgatacggtcacactggaaggctgttaccaaggagaccgtcttgggagagtggcccctggagcggcagccgggagcacagccctgcagcacatctcaggcctccccagccctcctcctgcccggctgacactgcttcgcaagccctcccggtgatgaagcttgagaagctcctggtaaagccaagtgctctctatttcccagagaagggccacctgaccgagggcagcaagcagctgccgcagagcacacagagccctgctctcaggccgtggctgggctcaactccaaatcagcactcgagacaggtaaccttagacacggcacttcatctctccaggcctcagcgtcttcactggagaaacaaagacagtgatcccagcttcgaggatgggggtacgctctgtatgtgttcacatattccacagacgcatactaaggacttaatacaggccaggtactggccactggggttaccaggacaggcaaggcctgtcttcactgagcttactctctggaggggagacacacgacaggcaaataggtaatcaacaacaatgataaagatgtgaaggacactcagtgaagagcagctggaaaaggcaccttcgtgatggataaaacactctggcctaggtaatgtcacctgtgctaagaccacaaaactgaggctggagaggcgaaactggccacccagggtaatgcactagcagggaacacattcaggaccggcatccaactcttctggggcccaaagccccgtgttctaggctgcctggcctgccgcccccctgccccatgctcacgtcgttgtagagcctgaaggccttcttcaggtagccggcccgcccgcagcccccgatcagcactgtgtagttgcactcgaggggctggaggcgctcct

SEQ ID NO: 54945 - DNA, 889 bp, Bovine  19866880913606
cccgtgcatggctactgagccctcgaaaatgcagccagatcgaccgaggagctgcctctgaaattgtgctgaattaagttaaaatagctgcatctggctggcagctcagtcctgggcagcactgctgggcagtgctgggtgtggctcctgcagggtgagccaactagggggttccctggccctgggaggactagagtcaggcctggggcctccccacctgcttctccttctccatcttggccagcatggtctcccaggccctccaggtcccgcctgaggtcgctcagctccccctgcagcttgcgcctatcagtgctcaatgaggctgacaggccctcctcctcctccagccgctctcgcgtgttggagatctggctctccagccctgtcttggctttcatcattggggtcaggcgctcctccacgaccagcaggttctcacgctcctggtggaggaaagagcgttggccaaaggcagggtcccagcacctacaggggacaacaaatgcaaacaggcctggggccccaagcaaacgtgtcctgggggttggatggagagctgggccatctccaagctccttgccaatgggcgggaccaagcgtcgtccaggagtgcggtcccagaccagccgcagcagcatcaccagcaagccggctaggatgcgacatctcaggccgcacctgtggcctgttcatctgaatctgcatcataacaagatcccaggtgatcaggtgcacctcgaggtgttaggagaggggtctaggagaagtccaggctgtgccgtctggtcctctgaccccgggtgtgacagtgcttccattcacccacggggaggggcctctccacccaaatgactcccagcattggtttagcacttttgtgttaaca

SEQ ID NO: 54946 - DNA, 1226 bp, Bovine  19866880915709
tggtggggaactgctgttcttatacatcgtttaaggacacttcccaccttgacatctttctttcccaaacaatctagttagacacgagggtgtcttacactgaataaacaatacttctgtgccagttttgtgcggaaaggtctacaactcaaggacctcttcctagacggatttgttaccgcttcctacaaagaatgtttcatgcacatactaaagttcacgcaaaatgtaataaggaagtaaagaacttctgaaacccatagcatccctcacacctccatccccactcccagaatacttccactcctcacctggcgtgaggtcccagcaggctgcctctgaagagaccgcaccacggcggccgcctcctccccgctctgcgggcagtgcttccgcacccaggcttggatctcctggggcaggattgtcaggaactgctccagcaccagcagctccaggatctgctctttcgagtgcacctctggcctcagccatcgacaacaaagttccctgagccggctcagcgcctcttccggtccagccacctcctgataacggaactgcctaaaatgacatcggaaagtttcgggatccggacagtcccagggccggtcggactccccacttccgaaggagtcttcctccactttcactgtccaaagtccatcacctaggcccggaggggcgatcgtgctttgacttgcggtccagctccaactcatccttctctcgctcgtgcgcactttcccggagttccaccttcagctgaggtgacagtaaacccagcaagaagccgcagaacacatcggatctccccaaagaagcggctgccgactgtcgggtcttaaacgagatcccacctccccgggtccctcccagactcctcctacccagaaaccgctaccctacctcagttcagttcagttcagtcgctcagtcgtgtccgactctttgcgacaccctacctgaagctgtcaaatcccgcgacaaaaaattacgaacagcccgagtcggaagtgcgtcaccggctccctgcggtgcccacccctcggggcatttccggggcctctctaggctcctgggaagagtgacgtgcatctctgtggtttgttatctttaaccttttccagaggtactcttggtggctcacacggtaaagaaaccgcctgcaatgcgggagacatgggttcagtcccgggtgggaagatccccggagaagggaacgg

SEQ ID NO: 54947 - DNA, 1445 bp, Bovine  19866880932945
cctgctgagctgaagcccgtgggccagagccgaggctctccacagaagctaaccagtgctgcagcctgaagggaccgtgagaaagagggcatctggcctgacctcactcatgggcagctgaggggctgtactcacaggccgctaacggcccagtgaccctcctctgcgcctgctgccactccccttcaggggcgcctgcgcacggagctcaccactgcaccccagcaccgttccctagccgctccgagagttctggcgcaaaatgcagtgaggctcaagttaaagtgtcactggagcaacaggaggccgggaaaaaagagggatgaacccctactgcctggcccaccctcccctggcttagcctcccagccacgctggggtggggggtcatcacccgcatttcctgtgtgagggtaggaaccagtaacttgcctggcatggatccctgaccagaggggctccctctcacagagagggccagcagaacacccagccacaggacagaacataaaacctgttgtggtcagctgaactgcttatgctagcatcacactcagttgtcagacaggaggggggcggtggccttaccacttccagcttgcttttggggacccggcagatgcagtttgtcccaaaattggtgtcccgagtctgaatgcaccgcaggcagcacaggttctcatacccctgctttttccattttgcaatcaagtttttatctgcatagccttctttaatacagtactcatacagttctgcaaaaagacggggaaaggccatcagaccacagtgtaacaaagctctccggcccgcagcccatcactgcccaccctgagaaaaagtgttgagtcaacactggccccttttcattttttggaaacagcaaacatcatgatacttgctgaggtttcaagaattatttaaatcggacgccattcaagctggaaaggccaagagaacattcggccagttacctctgcttatggctttccgcttgtagaagaggtcaaagatgtagcgggttttctggtgatggatcctgaagatgggccacagagattccactttcctctttccttcgtgaggttctgtctcagctgtggagaaaacatgggtgtttgctttgttttggagactagggttagtctgcacaggatatagtattgtcatatcactggggatttataactcagctcaacaaacaggattctgtgatctaagccaaaggcaggtacgaggattcggcaacaccacgtgtctgctgtgggtgagagcatgctctgggtacccagtgtacagcagtgaacaagacagatcatagagccaaggtctggggaggaggaggcagaccagcccctggtggtgcagggtaacggccacggagaagaaagaaacatggaagggggtggtgagtctagtgtggaaagccatgtagccggatggga

SEQ ID NO: 54948 - DNA, 2079 bp, Bovine  19866880994770
aaatgtgtctccagttcaagattttggagaaggccacgagcaccagggcaagttggagagaaagcagggaatgcccatgaaagagatactaggacagccctcttcaaagaggatgaacttcagcgaagtcacctatgcccacaaaaagccctccactggagagagaccccataaatgtaacgaatgcgggaagagctttattcagagcgcacatcttatccagcatcagcgaatacacactggggagaaaccatttaggtgcgacgagtgtgggaaaagctacaatcaacgtgtgcacctgactcagcatcagcgggtccacactggggagaagccctacacctgccccttgtgtgggaaagcctttagagtgaggtcccacctggttcagcatcagagtgtgcacagcggggagaggcccttcaagtgtaatgagtgtgggaaaggctttgggagacgttcacaccttgctgggcatctgaggctccactcaagagagaagtcccaccagtgtcatgaatgcggagaagtcttttttcagtacgttagcctcattgaacatcaggtgctccacatgggccagaaaaatgaacagaatggtgtttgcgaggaagcatacagctggaacttaacagtgatcgaagataagaagattgagttgcaagagcagccttataagtgtgacgtgtgtggcaaagcctttcattatagttcagacctcattcagcattacagaactcataccgcagagaaaacctataaatgtgatctgtgtggagaaagcattggccagtgtccccacatcaaacaacatcctaaaagctattccagcctgaaagcccatcagtgtaatgaatgtggcagaggctttgctctgcagtcacatctcaatcaacatcagaggatccacactggtgagaaaccctttcagtgtaaagaatgcggcatgagttttcagttggagttgtagcctctttaaacatctgagaagtcacgagaggacagatcccataaagacctgaagtgtctagaggttcctatcatagaacagctcttacacaattttagagacgcctttctgaagagtaaccctattcctataactaatgtagtcacaacctcaagcatcttcttcagcgtagccatcaaacgtaccacatatgttgagatccttcagttagaaattaggacactggagcatccacagcaagtacagatctgctttcccactgggaaatgctttcatttacatcttcatgtgcgagagtctagatgaaagagaacgatacagtgggtggggggaagccttcagaaggcactcattcttcacgtgaatctaagaacattgacactgggagaagcctcatgaactcagaaataaacttcatttgtagtttctgcattgacagctaatctattcagggaagagcacactgaaagagagaaatttcagcatgatcttggtgttggtatctcagcaacgaaccttagcggtaatgccagccactggaatgctccaggtgtcattcccatcttgagtattttaaaacctttggaaataaattgatttttaaagtatttatatctgggcaaaaacgaggttcagaggctggatggtatgtgttcttactgccttattcagtcaacaaattctccatgaaacacactctacctttttgttttgtctttgattctcctggcaccacagttagctagtagaagagaagttatgtttgtaaattcaagagaaactgttggtctgtcacgtcttagggagaggggagtgggacctttgggtaatagagctgacaggccaggctgtggactggtttttactctgttaccaaacaaatgagggtggctttatccacagaaggagttggaccaaatcgaattgagaattgagttgtggtccaagcagtatgtgtgccaactcccagttgccctgagatggatctcccccataagatagtggataaagaatgagtttcaacttgggttgccactagatttgaaagtaaacattcatagaagcaggggaggtcctggtctggtgtgccctgcctttcggaaagctct

SEQ ID NO: 54949 - DNA, 1371 bp, Bovine  19866881188448
gcagttgatttggagagtaagacggagaagtgaaagtgaagtcgctcagtcgtgtctgactctctgcgaccccatggactatagcctaccaggctcctccgtccacaggatttttccgggcaagagtactggagtgggtttccattttcttctctaggggatctttccaaccctgggattgaacccaggtctcccacattgcaggcagacactttaccattgaagccaccagggaagacagagaagagtgagagctaattacaggttatggtcctgggaggtcagaaaaataacagtagtgcttacaaagagggaaactaaagggacctttcttccttctttgcccctttctctttctgaaggggggtgatgataaagagtttgcttggtcaggctgtttgttgaacctgtgccccagtacttttcgtactgtctgccatgctgttctcacttccttactgtgacaagaccctcttgcaggcaatgacagtcacctctggagcttggaaaaaagtacagtgtgatggcagaggaagatttgagaatcatctgaaatgtaggtataactaaaatggaagagagcaatagtaagagtaaggatactggacattcaaatacttaagacaaatgatgtagtcagattcactgaagtgaaaacattccaaaagtttagtgataaatattagcagaatcctacgtttagtgattgagaacactggcttctcattgtggtggcttctcttgttgaggtctatggtgcgtggacttccatagttgaggcacacgggctccgtagttacagctcctgggctctagagtgcaggcttagtagttggggtgcaggggcttagttgcttcgcagcgtgtgggatcttcctgggccagggattatcaaaccagtgtctcctgcattggcctccagactctgaaccactggaccactagcgaatttcttccttaattattaatgaggttaaatatttgtgttttttgagtagctgtgttcctctttaatcaaatgctaatatcctttgcccttgtgatacctattggagttgctttcttttttatatcaagttataggatctctttgtataataaatataatttatatggcaaaaaataaagatgaggaaccaaggttcttggattcagaaaggtagtatcttagttacctggttcttgggattcatttaagaaaaaataccaaatttctgagcctcctcctcagatgtagtagcatttgtgagccaagcattttcagttcagttcagtggctcattcagttcagtggctcagtcgtgtctgactctttgtgaccccatggactgcagcatgccaggattctctgtccatcaccaactcatggag

SEQ ID NO: 54950 - DNA, 1093 bp, Bovine  19866881303690
tttggtgcctgtgctgtttcctgcttctgttgaccaaggacatttaggggagaggaagaaagacatcagcactttttttttcagttaagttagactctctcctcctgccacaaatgttctttactgtgtcatgacagcagcacattcattttaacgtggcgctgttcttaagacagggcctgcccaagtgtttgcttatctctgagggaaaattgattctacatgaggggataaatagcagcccccatctccctccaatatgaggatgtagtggaggtgattgagtagtggaagttggaggctgtggttattgggtaccagcaaaatcgctgcagcaaagactcaaaacagtgcctcctacaagtccatcacttctctgtcattaaactgtctagagggaggcacttccagtccccttttggagccatctgggaccctggttcctgtgctgtttcctgcttctgttttccaaggacatttagagtagaggaagaaagacatcagcatttttttttttttttcaattaagttagactctctcctcctgccacaagtgttcttctttggggagaagtgatcttctctctctgttctcccctggagtgtggctccctgtgtgtctgctctttagctgttcctgccttgggattatttctttatccttagccatctcctgtgctgtttcaggggttgggcccatttaaagacatggccctggctttccctgaggaggagtggaggcacgtaaccccagcccagatagactgctttggggagtatgtggaaccccaggactgcggggtctcacctccaggtaagacatcagaaatgctggctgtctcctctgtattttgtcaaatcaggaagcattaagtgtcctttttccttttctcttttaatggccttgcctgaaaggactttcccgttgaagcgtgacttgtcattttcctcttttcttggcttctttgctccctagtatctctctcctctcttcttttccttttcttcttgatcttatgtaaccaattattctgttaatttagagagagtaaaagaggaaacaaaggaaggacctgtggaaaagcgtttcatt

SEQ ID NO: 54951 - DNA, 1177 bp, Bovine  19866881386057
ctctgagctccaactccctgaaattctgctcaccttggaatcgcttcagcatttccttcatcattggtagccggcacacagtcttcaccgttaggtcttcaaaggaataattcacatcctgattctcacacctaggaaaagcacagaaggctgctcttcttaggagacaaacaggacggccaagaccctcaactcccaccgaaggttccaagcccagagttcagactactctcctattcctcctggtgcaagcaagcaggattcctccccctcggtcccctcacatcagtgcccagactgatccgtggggcccaggcctccttacccctctgcttggcctgtatctttacaatctactcaaccacccataagcagaaaagagctcatacctggtcaacacctctgctggattctgtgaagagaagaaagaaagaagttatgtaccctcgccgtgagatctgttactcaacttggtgagcagctacttttctgtcagttgcttttgtgagcatcacacatgatctcctgctgccaagcccaacagggttaacacagggcagtcttttttcgtgtgagccctctgccgtatttaacaacgttgacccatcctttcctcgaaaccctcctcttcctcctttggcactatgacatgagctgtctcctggctctccgtctacttctccatctacactctttcaatcacagacaagtgttaatgaggatgtggtgggaatataaaatggttcagccactttggaaaaaggcagtttcttaaaaagttaaatataaatataccatcagttcagttcagttcagtcgctcagtcgtgtctgactctttgcgaccccatgaatcgcagcatgccaggcctccctgtccctcaccaactcccggagttcactcagactcacgtccatagagtcagtgatgccatccagccatctcatcctctgtcatccccttctcctcctgcccccaatccctcccagcatcagtcttttccaatgagtcaactcttcgcatgaggtggccaaaggactggagtttcagctttagcatcattccttccaaagaaatcccagggctgatctccttcagaatggactggttgggatctccttgcagtccaaggggatataccatatagcctagcaattctgctcctactacttaacca

SEQ ID NO: 54952 - DNA, 1100 bp, Bovine  19866881416608
cagagcaatttctctctccggtgtgaggttagagacctacccattggccttgtaggatggaaatgagggatggcagcttagcctatacgggacactgtcaaaagcagaaggaagcagggcgcagagagtgtgcaatgggaggcaggagggaggcaggggtgtacacgacaccgccagggggccggcctggctggcctggacagagtggtgcggggacagtgggtgacgagcaagggagggagcagggctagttcgtggagggccctgcggccaccgtgaggacttggaactgaagctggcgtgaggcggacgtgagtcagtctctgaagactgtggtagtctccgaagactgtggtagtggccggtcagcagatgggggccgaggcccaggccagtgcatttcaggaggggagtcgggtctcctccgccccagacagacctggcgttccttcagtttccgctgcagtgtggaattcagagactgcttgtcctctccttagagttgacagagttgatttccatatccctcctgccggaggaggtttgccctcctgaggaaaagctctgaggctgggctagtgggttggcgtgggagtggagccgggggagaccttgaccctgctgagaccccctcaccccgacccctggccttctcaccctgcagatgagtcaccctccactggcttctcacggacccacccattccttcactccctcgtgcatttattattttctttcttacgtactgagtccctcctggtgccagacgtcacctgggattccagggactcatcagtgaacgaaacggacagaactcccttctctggtgcagcttacagtctacagaccccagaatcgcacaaaacacttgtcctttttagggaaaacgttccttccaaaacttgcccgcaaaaggctgtctcctcctaatgcgtgagtcccatgtgtcaggacgccacatgtgagaactaagaagccagagaccaagcagatggatggggaggataggtcagggtctcccacatcttctgggtgttcctcccgagatccatgctgagaggtggatttcgctgcacacgccctcggggcagccagtggca

SEQ ID NO: 54953 - DNA, 692 bp, Bovine  19866881525589
atggtcctgccagaatgtagtaggcggaggccaatgatgctgcttgacatcctgtgaggcccaggatcaaacagcccaaaacgtcaacagagctgaggctgagaatccaaggagcggagggatgtggtaaagggtagaaagcagcagccatcaggacacagtaagtaggaaaaggcaggaacatcaagaaacaccaaggggatgtggaaaacagaatgaaagcaagggaacaagagaaagtacagaaaaagggtaagtgatgagggtagaaaaaaggagtatctagaatggcctgagagctgtcagaaagcaccagcctgcctctagtagaaatagaatgagctttattgcaggagaaagaggatgagctttgcagacttgaaatccagctggggattatctctggggaacaggggcaacgatcatacccaccaccatcaggggacagtagggatgaacaagcaggagaacacaagccaaactcccggcttggtatccgggtgcaggcggggtctcctggatggtgtcaccaactctacatgacccccaggggccaggtctgctcctcatccacctgggcaggcactacccggaagccttcctagtccccgctctcggcagatccaggatccacggctcttcccactgttccagctgacagatcacctcaggtttgggaaactgaaatccta

SEQ ID NO: 54954 - DNA, 1389 bp, Bovine  19866881548410
aacatccatgcacttacccacaaagaacactcagcaatacttgtttggttaccctatcttctcccacccttcactctatttttaatgcatttcaatcatgtgccttttctttctttgtgtgcaatgtgtgggatcttagttccccaaccagggatcaaacttgcgatccctatagtgggagcgtgggctcttaaccaccggaccaccacactcaccctgacagataaggcattccttcatactcacagatgcatctttgccccgatacttaaattttctcagcctctcttccggagcatccaaagttggcatattgactggaagaagtaaaatacctgtagggaggacagtttcaaagagattttcagggcccagtatgtggttactatgttaaagccatttagactctaagcccttaaaggccccgcagcacaacagggagcagactcaggaggtcaagcatccataggcaccacacaccagctgagtaagtaatgagcatcatgggagttcagaggggaccagcccagggttgcaggggtaagggaaacgtactacttctggggacagtttggcttgaagtttattctgacggctagggtaggctggaaacaaagcacagaacccttccacgtggctgggtccaaggacttctttctgtacagaatatatgtataggatgcggaggagcccgagcaggctatgacatggagatggtcttctccttccacacgggcacatttaggactttatttagcacgacccactcctaattctcgggaaggcttcctccaccaggtcccgcccatggtcgtctctcacccacaccctggcaactgcctccgctctcttctccctgcttctactactgctgtgttccactctgttctcgacacaaagccacacaatctttgaaaaagaaaccgaccgtgtaatttcccccacttttttccccctaccctctactggatgcccactgatcttggaagaaaactcagattcaccaagatggccaccctacacaagctggcctcagcctcctcgccccagcaactctttcctgtgtaagaagccaagtatcctctcaatcggtctgtttcattttctccacagcttttaccatcgcccagtattttctcgtttgtgcatcttcccctccaaactcccaaggacaacaggaccgtgagtgtcttgggtacaattcctcagcccctgcacaatgcctggcatgcagtaatatctgttggatgacagcaatgagcaataagctcacaaaaggagttggcccttcattagaaggaggttattcaaattgggccaacattggactttctacagggcagtatggaatgacctttcttacaagtgtgcagtggatatccatctaag

SEQ ID NO: 54955 - DNA, 995 bp, Bovine  19866881822210
agggacagagggacctcctaagctgagactggagggggaagggtggggagcaccagtgaggggagcaggcaggagggggtgctaagcacggatggcactctcgccagtggcgggagggggaaggcagggtgtcaagtcccagcagggctggcggaggccagatcacacaaggtgggtgtggagcgcccgcgctgcagatgtgcagggccgtggtaagggagagcccccacaacacaggagcagggacccactgctgagaaaacaaagctctaagtggtcaaccaaaggcctgccgcccgccccctccaaccacaccccaggtgttggcttcctccagaggatgggtggtccttgcccggcctctctgggtgccaccctgggccactggagtggcccgaagagtcgcgtactcacccgggccttctgcttttcagcctggagctgcgcatcaatctcctcagggctcgtgtattgccgggcccggcctttgtggcctccctttctccctgcacaaggaccggaagtttaggaaggcaacaggaaggcagctagctcccttgattgccctgaacttcagactgtgtcccgcttgagctgctctcagcagaggctgccgacctccattgcccctcaccaagaccgcccacccacctgtacctccccctcacctgttcaaagggacaaaagaggggacatgtgatcacctgatgcagccccaaaccgcctgctggatgcggctcccaccaccgaggcctgaggggggatccgggtggggggcaccacagggagggacccgctaagtcccctggtcccttcatccacacgcagaggactcagatgcaatcacgagaaggggtaaccctcacccctgctgtcactacagtgctctttatttgcaatgctctgtcacagccaggggctcattttgagtcccagattaaacctaaggtgcacatcacggctggtcacattttatagacaagggagacttaaag

SEQ ID NO: 54956 - DNA, 1480 bp, Bovine  19866880406879
gggagcccagttatttgtcctctttgtgtgctaagtcacttcagtagtgtccaactctttgcaatcctatgggctgtagcccgccaggctcctctgtccacgggattctccaagcaagaatactggagtggattgccatgccctcctgtaggggaacttcccaacccagggatcgaacctgcgcctcttacatcttctgcattggcagttgggttctttaccaccagcgccacctggaaagcccagtgtcctctttagctgcccagtaacaagtggcagagcaaacctcctttttactactctgtaccacctctgatattcctttcccacagaggatggtaaagctatggaggaaaagtcatacactggaattctgggactcccagcaagggatatggtaatatctgaattgacacaatcaagtcgtgccggaaggggagttatcttcatggaatatgaatctagcatatggcagagcctgctgaggctggtcaaactatcaactgccaagttacagggaaatgaaaagccatcaaaatagcgtatggaagcatctcaagatgctgtgaaatttggaacataaaagacttagggcacaatgcagagaataaaaatatgatacaagaaaaaatgaatgactgggtacacagttggtgcaaattttcatttcagggccacagcttcaaatgtaggaatgatggatatttgacttagaatggagaacatttttcaaagactgaaaagaatgtgtttagtcagagaccaactcatctggccaaaagggctgtaaatggaaaacagatgggaagggaggaaaaaaaaaaatcacctatataaaatgaaatgagtttccatggatgacatgaaggagggcctgggaaggatttcaacagtgagggaaacagtgaggcaggtgctgagtgattcaatgagaaaacaattgggaaggacatcagaaacaaaacgtaggcagcagatgtccagatagcatacccagaacatagtaagtaaccttgagattacagcacagcgtgacaaacaagacctcacagataccgggagagttggcggggtggaaccggtccatgggaacacagtgatagaagggtgtgctgtacacaaaagacccgttgagaggagacggagcagcattgtaggctgtaataacaatagatgcagaggaatccctgaacacttggatgaagatgaaaggagagaggaacagaagtgaggtttttatggaaactgagctgagacacatgggggaaagccacagaattggcagagcacacacgctggggataacattctggatatttcattcagataaaagcagagtttttcacttgccttcccaacaatttcacatcctagatgctagaggaaggaataaaaataactctgctctgactgattccagccagtgggaagaagccatttatcagagaggaaggattgagaccctgggagaccatgtcat

SEQ ID NO: 54957 - DNA, 2982 bp, Bovine  19866880516938
aaacctctgagatttagattttctgtagtgtccaaggcctagaaaatgtggcagtgggggaaggtagtggtggaaggatgggtgagagagagaaggagagagaggaaaggagtggagagaagcccagagggctgggggtgggaggaaagagaaaggaaagggcaatgacggaaaaggtgctggaaagagcacaggctttacaatcagacaactagcttgttactctgtgaccttgggaaagttacataaacactccaggtcattaatatttgttttccatggtctacgttgggtatgtacaatatctggcatatacaaggtgctcaactgtgtaagcaatgtcattccacatgcacatataggtagtaaaaggaaatcaaataaatttgccagtccagttttcttatctttaataaaggcttatgtgaaccgatacagatgggcacaatcgcaagacattctgtgagcatggcttctatctttgagcaagtagggttctgaataccaaactccaggatttgaccaacttattcatcagtctcaggcaatgccagaataaggcaggcttcctcaggtggaaggagatgcccgctgtgggtggcttctaagaagaggaacagaagcaggagctaggccatgcatgatttctttctcctcctaaactctccccccgagggaagtcagttcacctccccaggggagggatgggtcaggaagctgaagaggccaggtgtgttatgctgatgacatccttccacctggacaaggtcaatcggaaggagctggggcacgagcgtcccaccatccagccagttcccaaagtcagcagcgggacatttgcagaactaggagaattaatgggcctctagaactggcccatttcaatactttgaacaactctctgaataaaaaattgtatcagtttatacattttattgatataaagggtgtgtagcacacgacttataaacaataataaaatatacaatactctttatcttaacttccatatagccagctgattctcactgaatgctttcactcatttttgctgaactcttatatccatagccagcctatggttgcagttcaaccatgatttgataagtggagtaatttccaccatccagataacaatagatataagtaactcataagtgtagaaaacattaaaatttagtaagattatgaaaaagtgatgagttttgagtatttatggcctttgtttttaatgtaagttaattttgtctacacattactaaattttaataatgacagtgttaatagtccaacttgtaaaaagcctacaaatttatcagttggcacaccatccaggaatatcccacagttctaattatgtttttttacaggtgtggcaaattacagtttaatcctcgtttgaggagatatttggttactacacttagggaggggtgggctggctgcagggatgttcaggcaggaagaatggcacccaccagggggcagtgtgattccaagtggtcccttacatagagagccagagcccttcctgcccttactagaggaagaaggatgtcacgagtccgggagactcagggggctgtcttctgggtgctgaccagggttcagttcagttcagtcactcagtcgtgtctgactctttgtagccccatggactgcagcacgccaggcttccctgttcatcactaactcctggagcttgctcgaactcatcatgtccatgaagttggtgatgccatccaaccatctcatcctctgtcatcccctttttgttgaccagggtagcaatcaggaaaccaaaacagaagtcctgaggtgataagagaaggagttgatgctgagagctcagcttctctgtacttctgtgccgaatctcagagacagaggtttgggttaagtagaaaagaataactttattgctttgccaggtcaagggggacacagcaagctaatgccctcaaaactacatgtcccaacttggggaaatagacattttatagtaattgttcaaagagggtgtgatcagctcatagacattcttctgatgggttagtggtgaggtaagtgggagtcagggtcaaacttcaggtcgaactggtcaggggtctacaggcttgtgggcagcatactattaactcctctcacctggaggagttttagtatatacgtagaaaatctcaaagatatcgtcttgtgtgtctgttgatggagaaataggaccttgccccaaggctgctcttgactatttcaccctggtctcacatcccctcctttccataattaacaactgcttgaatctgcctgtgggaactcagggaaggctgtttcctacaatcaaataaatgaagaacacagaaaagccttgtgcccaggagcccaccaagccctgcgctgtgtcagagtgagaggagaagccttctaccccttgcatccatctggcgacagggcaacaaggccccctccagacccttttctggggcagggtttggtggctggaggggtggttgggggggtgggactcactcaagtcagaggatgaacctgggctcaggagctggagcaggacagaacttaattaccccaaatggggctcaggggcctgtagttgagagggtcagggaggagagaccagtactagaagcaaagcagaattttctagtcagttaaacaatttggaaccttggagaactcaagccggatcacaaaaatccagtttccagactgttccctttgctccgtacaaggtctgtggttgagcttttaagcaaaatcaaattacacagcaccacacatctatccacaggggctctggtacgggaagtacgttagatgtgatttttcctcgttccattttttactcttacagtcactttctggaaagcccatttcagtcttaaaggcctctttcaggcgcttggaagtgtaatgtcttggtgacttacttttttcctaactaagataaatccagctgccttaaca

SEQ ID NO: 54958 - DNA, 1701 bp, Bovine  19866880561977
actgaatgatgagacttcagtagttatctgtagttccttatattggtctttgtagggacatggattttttttttttttttctagctgaatgtgtaattggcactataacccttgggcatcagacaaactaaaaagcttgtgtgttaggggccttccagcacgaaccatctgcagttctgcaataagatcaccaagggccttacatgccaggctaaggagctcagattccatcctgtcaccatagcagatgcaaagaagaaaataaagatctgctggaaaaaatggagtcatgataccagcaactttattaacaattattgtgctgaggcctcttcccaggcttgctgtgtcaaactgtggcccttattactgccatttcctggtatgacagaaaggcaagactgataccatttcagcaaaacatcaatctcaaaataaggatgaacctctgtcagttgcagttgtcctcagggggttgatgtccttgcagctggacaaggcttcatttccctagttgtgtgcttgtccttattaaaagctagcaaataattgctccaaggttttacagtatcatccatccctcactgcttgtgctggaaacttgtgaaataggaggtgaatcacctttgtgagggctgatagaaatctgtgaaatgagggtttatcaccagagaaccctaagaacagctctactctaagaataggttacttcatgtgatcctttcagagtctccagcagggatggctaatggagtttatctgttatgttgactctactggtaacaatttgccctccctccctgaaagcatgtgtagaaaactgttaacttttgaccatgctcagtggagagagggctattttcaattaataatgtctgacaagtacataggaggggaaagaggcaacatatgtgccatgaactagagtcaagcataggttcctacaatggataatcagtttctgcccctgtgatcatatgaaagtgagtcatctaaagataaaatgtttgagtctttcaaggacagtttaggggtgggaagaagaagttagagaaaacgattattgttcctatatttagttaaggtatgtaatgctttgaccttgtaagaaataattgagtttcttcctatctacagtgtcaacattttccattttcgggccctgtaaccttcataaaatcatgagatgttgaacttggactatactttatatcagatgaatctaatagccatatattaaaacattccactcaacagcagcagaataaacattcttcttaagtgcacacagaacattcttcaggatggatcatatgataggtcacacaacaagtcttagcaaatctaagactgaaatcataccaagtatcttttctgaccacaatagtatgaaatcagaaatcaaaaacagaaataaagctggaaaattcacaaatatggaaactaaacaatacattcctgaataagcaatgtgtcgaaaaagcaaatcaaaaatagaaataaaaatatcttgaaacaaatgaaaaaggaaatgcataaatcaaaacctatgggatgcttcaaaaacagtcctgagaaggaggcttacagcaataagtgcctacattaaaaaaataaatcaagtaaaaaaacctcactttatactcaacaactgaaaaataagaacatactaagcctaaaattagcaggagaaagggaaag

SEQ ID NO: 54959 - DNA, 2105 bp, Bovine  19866880643427
aaaattaatgtgtaagaaagcccattctttctgataatacttggggttgaaggggggagatgggggaacattttcttaagatgaaaataattaactgctattttaaatttcttgatccttgaatgtgagacccttctaacatgatttgcgaagctgtacaagtataggcatgagttatttttctgtttacatttttttttggtttattttgggggtaaattggtagctgcctaattactgtttacttcattgttatattgcagtaaaaagttataaaaaccacggttgcatgtttgcttttgatgtatccctttgtggagttagcactttggggccaatgaagaaatgcagcattcactctccctgtcttccccttccctcagcagaaatgtgtttgtcagcaagtcgtgaattccaactgctgccttttttaaaacccacaaaatgctgattcagttcaagattaatgcaaatgtctcaaaactgggtttctgatatttgtaaatgttttttccttattaggtaagaatgtatgaccattaaagttgttaggattcttttgcttttgaaaagagaaggtggacagaactacaatccagcatcttttattgcattggaaagactggcaaaatcttttggaagggttgggagatgcagctggaatagtactttggaaaatatacaatcaagatatctcatggcatattaaaagaaaaatcttaatagcaatgttggcttttatttggatttttttcatctcagcttttttctttggaatctcctttgttggcattgttatttgatcatgaagagggggcaggtgtgtctacttgttttatttttttcagctctcttcctgagtattaaaaagactaaagaaataattttttttctaccatcttatactgagttaagaagatgaatttgcacagattttatcctacataatctcttaatccttagcacagtttggtgatgacttttaagcttttacatcatgcactcataacctatctcttatgaaaataaacaaaattatgattttttttcccatgttaatcatgtagtttaatcttcatgtgtttattccataaacacaacaagacctttggactttgtattaccctgtatgttttataatggattgtgcaaaaatgtctcagaataaaatgaggatttgtaaatatgttcatctttcgaggtagagcaatgagttgggaagagggatggcatttctggtgagataatggagtattcgtttattttcacgatattttatctgctacttaattgcttagagcatagtgaaaactagaaaaggagagaaaaaaccaaccagcagccacctcttcttttctctggaaagtgacagcaggaggtgttcgatcacatggagcttttctccttggacagcaaaactacaaatagtgggattaataatcagcagaagacagctcaggccacgtttggccattctttgcagtgctctgtttatctgtggaaagaatcagccattacaccatgaaagaaataggctttatgtggccttttgctgttatcttttaatttacaaacattttggtaaatctcttaagtggctacatgacttcggaatttttgcgttggaggtattctgtcatctgtttcttgaaatctgttgattgtttagttgctctgtggaagacctgaagaagcttaagtttatacttgttaaattcttactgccgtctagtcaaatatatttttacattgtttaaaaatactgaagtgttccaccatatgattttttttctcctgtactcgatggctaggattctagagaattaattataaaatattttcaatatatccaacatggcatttctcattttttaaaatgattttaccgtatagaatcttagattggaaatggacagtgccccatcactgatccttctgctttctttgttggtggtgaattagggtgtggaatgcccagcactagggtcggttttattgggtctcctgtttgtgttcacagtgcaaacatcaacacagagatgggacacttcctagaatgtatatatcaaagttcatgggggctttagagatgtcagggagttctc

SEQ ID NO: 54960 - DNA, 2739 bp, Bovine  19866880646283
tggaaaagctggctcaggagcccagctgggctatggcacaaggggaatggtaggaaattgaaatgcgccatgggaacttgaagaattgataattaagaggaggggcccatgatgagaggtttagcaatttggatgccctcagctgagaggaacagaacaccctaaatcaaattagcttaaatggtgaggaaatatgtgagttaacccaccacatgaccagaagtccaggggttagggtatcaccagaggagagctgagagggctctcttacaacccaggggtgctgcgcttcatgatgtgtattggcttcatcctccggctgcaggaattacagaggtcaccttcaaagagtaccttatccagaggaaaacagacactgtctccttaggtctctcattcggagaaaggaaacctttcccacaggccttcccaacagacttcccctcatgcatcagccagaattaggtcacttacccatgcttaaaccagacacagcagaaggcaagaattctcacgactgacatcatctagagtggaataatttcgaggactcaactaagcggccaccacaagcggaaaaggaaggaactcacatgttctttctgagaccctgggtgtttctcaaccatcctctctttcattctctcatccacgctcatccaggtgtgtgctattacgctctccgtactgagaagaaatcagaggctctgcccagggccccatatacgtactgtgctccaaagcccctgctgtttttattactgggcactgcagacttggagtgcagtggaaagacagaagctgtgcccagagagaggatttgcagtgttaaatatcttgtggcaacatttcttttgaagtgttacacgcttggttggcttcaatgaagacctctaggattgaggaccgtgagagcaacagttgaagacatcaaaaaaaaaagagagagagagagagagtcctcaaacaggtagggttccctggggaataattttggaaatagccagtttgattggggagggtgggtcaggtaccagacgctgaggggccccaggacaaaccacacagagtaaacagctggtcagggcggctgggtgaggagccagccttcccgggtaagttggctcagacatcattattttctttgcttcctccttacatcacaccaaatatggaaacagatacctgcctaccatctgtccccaaagagcaacagctccacaaggcattctctggaaggtgggagccagatggggtgatgttttcctctttttcctgggcattcatagaatgggaaatctatgagctggaagcaatatgagtgatcatctagtcattctgaagtgaagaaaaatccagggcagccaagttacttgccctgggatgggaggagagctagacttgagctaagcttcttgtctcccagaccagggctccccctttttttttaggctgtaccagggggcatgtgggatcttatttccccaaccaggaattgaacccgtgccccctgcattgggcatagagtcttaaccactggaccaccagggaagtcccagagaccaatgccctttccggctgaactgtgctgcttcccttcatccagttgaccataaaactgaaagccgaccccctccccaggagaaccccagccctcgtggatctgttgtcttagcataggtgagcaccctcttgtgtccccactgaactgacttttctcagacaaatagtgccagaaaagtctctgtctctctgggtcagccttagagtatagagtttgcaaggactgtatttcacattctactgcacaacgactcctgttttgtgccaacagtgtcccttcccctctaggaacttaatgcagtttttctctttggccatttaatccacactccgaatagatgatgctttcaaactgtggtcctgaagaagactcttgtgagtcccttgaagagcaaggagatcaagcctgtcaatcctaaaagaaatctaacctgaatattcattggaaggactgatgctcaagctctaatattttggtcacctgatgcaaagagctgactcattgggaaaaaaacaaacaaacaaaaaaacaacctgatgctgggaaagactgaaggcaagagaaggggatgacagaggatgagatgttggatgacatcatcaactcaatggacatgagtttgtgcaaactccgggagatggtgaaggacagggaagccaggtgtgctgcagttcatggggttgcaaagagtcagacacaacttagcaactgaacgacaaccatagtaataatataaggccaaaccattaggaattactggagttgaagatgtggaggcagaggtgacctggagtaacagcttctctttatttaggataaacttgtttataattcctaaagagcagatgacaccaaccttatggcagaaagtgaagaagaactaaagagcctcttgatgaaagtgaaagaggagagtgaaaaaattggcttaaagctcaacattcagaaaactaagatcatggcatctggtcccatcacttcacggcaaatagatggggaaacggtggaaacagtggctgattttatatttttgggctccaaaatcactgcagatggtgattgcagccatgaaattaaaagatgtttactacttggaaggaaagttatgaccaacctagacagcatattaaaaagcagagacattactttgtcagcaaagttccgtctagtcaagg

SEQ ID NO: 54961 - DNA, 2373 bp, Bovine  19866880666597
ctcaaacctatgacacccactaactggattataattatttatttgcctgctagactgagctgctctcagagcttgaaaaaccagctggcgtcgctgccagtccgacgtttctcctagccagaggccatcctccaatacaggaagcgcacttttttgcaaggactttgcccacaagcagggcagcagcagctcgtgttgactgccaaggtcagttttcctctctgtccccctgaacccagatcctgggacatccttctcttctagacagcccagccctcttaacttgggcagctaaccagaggcagaaagacttgccaagtcaccgattcgagactgtgattctacagctgggtgcacacacttgccaacagcagagtttctggtgtgtaggtggtgaccagcatggatcctgtgcagtggcaagggatggccaccagccagggaggcaggtgctgggagcagagggtgaccaagggcagagggggacgtgcagcttggtctccgcagctcaaggggcagacctgggagctctcagtaggctgtacaaaacaggcagcgggctgcatttggcccctggactggagcttgctgccctctgctctagacaatcaatgaaacaataaatcaagccctggtatgcagtctttgccaatttattgggtacaaatatccccactatggaggatttcaagctaccaacatgatatcactgaattttgggttgggaagagatatgcagtagcatgtcattagatagtacttctgccataaggatgcaatagacatgaataacttaaggacatagcttatagtaaaatgttgtaaaatgattaggaaaggatgatttttgagtattacctttgttattaatataatttatttagttgtaagtttatagaatttaatatttaataatggtcgttggacagtcagcttgcagaattcctgaaaagtcagcaagtttaggcttggctgcagcataccagtgcccttggttcctctgactacaccaagccatatggaagggaagagagaaaagccacccacgatgagagacctgagaatcagctcttgacatagaagtgttaacctcttccattccttcccctgaagagttctacacctggcatgatgtccggttgttttcttaatcttagaacaagagcaagatttgtttcttgatgatgtgaagggggctctggagccacccctagtggttaaagagtgtggccaacatgaaattgacacagaagcggagcaaagaacaaggacaaaaccaagtccagacaggaagtgtccaagataactgaaggacagggtggagataagagacagaggggtcaacacgtacctcagttgggtactgattgtgtcagacctgtttaagactcagagtcaggatagacttatggttgggccatttctgatcaccacctcagtcaattaggccaggatatgctacattaaggggcttcccaggtggctcagatgataaagaatctgcctgcaatgtaggagactggaagcaattaaaagatgcttggtccttggaagaaaagctataacaaacctagacagtgtattaaaaaccaatgacatcactttgccaacaaaggtacatataggcaaagctatggtttttccaaaagtcatgtatggatgtgagagttggaccataaagaaggctgagtgccaaagaatcgatgccttcaaactatggtgctggagaagactcttgagagtcccttggactgcaaggagatcaaaccagtcaatcctaaaggatatcaaccttgaatattcattggaagaactgatgctgaatctgaagctccaatacttgggccgcctgatgcgaagagccgactcattggaaaaaaccctgatgctgggaaagaatgagggcaagaggagaagagggcaaaagaggatgaaacagttggatggtatcatgtccaccaactcaaaggacatgagtttgagcaaactccagtagatagtgaaggacagggaagcctggcatgctatagtctatggggtcacaaagaattggacatgacttagcaactgaacagtaacagccagtatccttgcctgggaaatcccatggacagaggaacctggtgggctatagtccatagcattgcaaaaagtcagacacgtgtggacaactaacactttcacttcatgctacattaagaaataatcccccaatctcagaagatgcagtgtacatacatcatgagttggtagggagattgaggaagtgttggcaaggctttgcttatcagaatcactaggagaccaggctgatggagcaggctcatctcagataatacccactaagtatcagagggagagagccccggaggt

SEQ ID NO: 54962 - DNA, 1485 bp, Bovine  19866880714064
aaaatgaaacctagtatatttaatatcttatatctagaggtgagagcaaagcttgaattcaagtatctttactgactagcacccacacttgggttggcaaaggtttgactagaaagcaaagcctagagcctgtgagaggcctgggaatgttcactttcattctttcttctgtaaaattgataaagtaattcaaactgttaattttgaagagatcattcctttatgtatttcctagctctaattatggcagtcagttctggttcataaaaatccctaagcactttgtgtacagtctcccagaggataagctttcatttcctgagattcagcatggaaatggaggaagcagagctgtggttcaggtttggggtactgtcccgttcagtgacacttattggataacttagtttctgagtcttgttttcttctgtaaaactaatgttacacaaagaagagtaaataaccctgatctgtggccattttaatttgaatgattgtcttgaataattcaggagataagaatgtacatcagaaaattctcactaatcttcgtaacctcaaaagcataattcttttgtatacaattaaagagggtaggtttttttgtgtttcttagttttggtatatatatttcttaggaacttttgtgcatcagaaacaacttttaatactttttatagagtatatgcagggcacaggttctcagtattatttgataaatcgagtgcccaaggcagttgtaggaaaacttccttctttgagtgttctgttttctctacattgtgtgctgtgctgagttgcttcagtcgtgtctgactctttgcaaccccatggaccgtagcacgccaggctcctctgtccatgggattctccgggcaggaatactcgagtgagttgccatgccttcctccaggggatcttccccacccagggttgaacctgcctctcttacgtctcttgcattggcaggcaggttctctaccactagtaccacctggcaaacccactctctacctgagctagtaggaataatttctgcagtgtaagacttgcaagttggtacaatttgaagattgtcattacttacttcattttatatacatcttagaactcaaatcattttttttcttcacagtgtttgctgtctaaattatgtttgttattgtttaaaaatatccctgtttattttaggacaccctcttgaatttttacggaatcagcctcagtttcaacagatgaggcaaattattcaacagaatccttccctgcttccagcattgctacaacagataggtcgagaaaatcctcagttacttcaggtgactgtttaatcagtttcaaaaatggttaggatgtattacattttgtagaagtcaatgggcactccttcccctctaccaggtgtataaactgttcttccaagctaccctcaggagaatgttatagaggtactgataaaaagagaattgtgggtggggggggggg

SEQ ID NO: 54963 - DNA, 1753 bp, Bovine  19866880724036
tattttgacccagtagatttaaaattttgaggtttaaaaaaaaatgaattactattctcacagttgctactatttagcatcaaatgcaaataaatagatgagaggttcatggaaacagtttatcctttactttcagttgaagcaggcacctgttttgatgctttgaactgttgctagtttttgatgaatctatataagtgaaagtgagtgtgtagaaagaagaagtaatgatctaacaaaaagctaagtcctgtgtgtgagaatttgaggtagatctgttgcagtggtgattaacttttactttagctaacttgtttgagaatttgatggaggcttttggaccctcgatctgtatatagtttgtccacacttgatagctcctcatttaagggtttgaattgggtggttcgcagtgcctagagggaacatctaatacagcaattattatcctgctgtttagtgtctttcattctctatatgtttgtgattttggcctctaatttactgggaagtggaagtgattactagtaccatctcatatttatatgcagtattttctcctgtattccctttccaaaacctataaagattacataatttgatagctatatgtgagaagtcttataaatcatttttatcaaaatagggtattccaaaaatcttagtgcagttttaagttataacaacttcagaagataatgtcacaaacttagaaaaatcatcacccaaaacttgaagattcttttatacccatttacttttttctttctttcttcctttgggccataccacacagcttgtgggattttagtttcctgaccagggattgaacccatgccctttgcagtgaaagtgtggagtcttaaccactgaactaaaaagtcagatatgtcctaataagatttgtgttgatattttgaaattttaaataattagctttttaatgttagacagtattatatgtaagtttaggatcttgcctgatactttggtgttagatattaatatgtgttgctgtataaacatcatttcatgactttttttaattaataaaattcctttatgtcttacatctacactctctagttgggtagctgttgagtactattaagtataagtaagttaatacttaactcttttttaagtgtcttagtaccattagccacatttcaaggtctcagtagctacttgtaatgggtatttttattggacaacataaatatagaggtgttccaaaatagtaagttctgttgggcagtgctgctgtatataatagcaatatgtatccatccataccacattgaggccatttctgatcttgaatatgtgcagactttgtttgtctttatcctttgctttgaatgaagcagacatctgtttgatgcttttagaaattagacaaggatattgaatagacttataaagtctcttattctgtgtagtatttaactaactttgaatgatgagctattctaaagcttgggaattatgttacagggaattcctggagatcgagaaagtcaggctgtggttgacccccctccagcagctagtactggggctcctcagtcttcagtggctgcagccgcagcaactacgacagcaacaactacaacaacaagttctggaggtaaagtggcatcttttgatggggaagaaatggctatgagtcttcagtgtaaaataatttaacctgaagtacttttgaggtgaggttcattctcagagcatcataattctaaaatctctttta

SEQ ID NO: 54964 - DNA, 1128 bp, Bovine  19866880852304
cttgcctggataattccatggagagaggagcccggcggggctataatagtccatggggtcacaaaagagtcacagagactgagtcaaacacacacacatacatagtgagcctgtgacctttaagatgtctaatctaacctttccttgggaagactattgactcatccaggtggaaactggctttgacgcacagaaagatggaaggaagagcttggtagattcatggcgccatgatgccttgttcctttgttgggtcgggacgccctgagaaactctccacaccgcaagtctgcccggggacatttagctagaccctccgaagtgaacttcaggccaaccggcaagagatttgcttccaccagggctgtaagatagttctcactccctgactcaatttcctcagctactctagcaataatttccaaagctgagaagaaaaaccagtgtcatggccaaagatgaaaatgtcatgtgagatattaaatgtcatccgagagactgtacgcttaacggccccgaagtgctttcaggcttctgagaggatttcacttcctggccctggagaagctaagtgctgccttctattcctcctcggcattcgaaaagtcataaatagttaactgtgtgagtcgttttttttaaacctccccagagcacctaaaaatagcctctgggggcttgatgcctatttcctcaggtgttcctcttaatctttcaatattggtggtgacgatttactgttactgtcatccacagactctcagagacaaaagcagggaagcaggaaggtggagaggcagagtgtcaggaggctcccttgagaagtagaaccaagcatcaatccactgcacacatccatggatgagagatgttgcctcttcttgccttggtttccctgctagcaaaaggagagggaagtctccatctccccaggtgcagcaagaatctgcccttgaatgggaagcttctacagattcttcagcaaagcgggacctgccagcagccaagtgctattatgacaagtcaagtccacactcattatgtgcctctgcaccgcacgtcacccctgctgtttcctatcttcaggccagagtggggatttcctgccagttttccagccctgtggca

SEQ ID NO: 54965 - DNA, 1909 bp, Bovine  19866880873102
tgagcgggaatttgccagaaaaaggagatatccagtaagcctgagatgtgctcagattaaaatttcaaaaagttccagccagcaggctatggagtagaaaatgttttgccctcaaatgctgatgcttattggttccctaaagactaaggaccagacagctgagtgtgcactcggttagtaaactgtgaggagagagaagccctttctctaattgtgtacacgttatgaggattaaatacaattatccatggcaagtgtttaacccagtgcctctcctgtagtctgtattcgattgatactaacatcattatcatcatcactgctgttgctttcaattctttaatgacctggaacctttgtttccaagggctctgcatgtgtgctgtagaagctaggcaggatcttccagcatcttcaccaggtccataagccagagtcctgtactgcttatgtttaaaccaggacagtgactatatttctgtctctggccagactgaataactgattttaggataatgaatagaaaccagacatctcttcacatcacttccaccaaaccatgatgagctattgtgtgagttctggggaaggtgctttttttctggctgtggtgggagtgttgaggggggtgaatgggtaaaactttaaaagtgccctctgaacacttgcagagaagcattttgcagagcaatgattctgtttctagaagactcaagaagaattatgcttaaaaaattaaaagatatctacaagggtgaccagtccattctaaaggagatcagccctgggtgttctttggaaggaatgatgctaaagctgaaactctagtactttggccacctcatgcgaagagttgactcattggaaaagactctgatgctgggagggattgggggcaggaggagaaggggatgacagaggatgagatggctggatgggcatcactgacttgatggacatgagtctgagtgaactccaggagttggtgatggacagggaggcctggcatgctgcgattcatggggtcgcagagagtcagacacgactgagcgactgaactgaactgaacaagggtgacacctgctcctctgacatgaaggctttgagaacatgagcaccagcttgacccagctgagctgctggtgaaatcatgaggtccctttggaccatgcctcctctcagaagttgatactaaagttctcctgcctcatgcatcaggcaatcaggtggcagatacttactgagcatttttaggacgagcagactttccaagtggtgctagtggtaaagaacctgcctgtcaatgcaggagatgtaaaagacatgggttcaatccctgggtcaggaagaccccctggagaagggtatggcaacccactccagtatgcttacctggagaaccccatggacagaggagcctggcaggctacagtccatagggtcacaaagagtcagacacaactgaagcgtcttagcacatacccatgcgtggtgggcaggtgtgctcataggcatgcaaacatcataggaagctaaagagcacctcccccaggaagcatgcatctcacactctgtggctctcctctggtccacaacctgccgtatctcactgcattttcacagtagatactattctccatcttatgaagaatcgaaaggctaaaaagctgtctaagcttgtaaggcaaagaagaggacctggcactcaaacccaaatttatttgaccccagagcccatactggaagctaaatctcttctgtgactacacagtatacttgaagaagccaactcctttccctttttgcagggcccagcaagaagaagatcagtagatgtagaaattcagtgaccatctatcaaggacctaccaagggccaaacacatcccattctctctttcctgctgtta

SEQ ID NO: 54966 - DNA, 1212 bp, Bovine  19866880941790
gacatgagtttgggtaaactccgggagttggtgatggacagggaggcctggcgtgctgcggttcatggggttgcagagtcaggcatgactaagcagctgaactgtgtgtgaactgtgaaagagcaatggactacatttggactcacagagtccaagtcaaaagaatggggagatctgaagggtccccagtcttggattctaaaacttagaaaaatataggggctgctccgccatcctactctcaccccactcagttgaacagttatctagcttgacttggaatcctggatcttggtgatacaagatgaacctatatctaatactcatttatttggcttcactgggtctcagctgcagcacgtgggattgtcaatctttgttgcagcacgcaggatcgtcagtcacagcatgtgaacccttaattaagacatgtggaatctagttccctgaccagggattgaatctaggccccctgcgttgggagcgcagagtctcagccactcgaccaccggggaagtctccaagatgaatccatattgtaggaatttctagaaccaccctctaggcctagtgtaccagaggttggtacccagacaacaggaaaaagtcagtggaagtagtcaacacccaccactgatttgaggagacttgcaaaatgcttttaggaatgcaaactggtgactgtgattgagagcgtgacagaaggacatggatataatcaggactcatctccaacaggaacgctgaagacatgtaatactcctacagttgcagtgtaggagtaggtgctgtagacactcatgcaacgccctgtgtgggtggttagttggaactttgtccagtcctctctcctccccacagctcatcacattttaagggtgcagatccaaagtcgtgttcgtccttcagtccctggtagctccctccaaggcccggactagggtgagacagccaggcgcctagggcacaaaatttaaggaagcacttactccgagttaaattctaagcacctgatgtgcctcaccctatgtcctccaccatcgccctccttaatatccgacatgcaggaggtgagtgatgagtatttgtttgcataatgttcactccactactcgaattcctcaaatgtcttcccattacctgtgagcccagactcttgaatgggccacacagccctctgtgaagggctcctgtcctcaccctgagtatcag

SEQ ID NO: 54967 - DNA, 1782 bp, Bovine  19866880954535
ccatggactgcaacatgccaggcttacctgtccttcattatctaccagagtttgctcaaactcatgtccattgagtcgatgatgccatccaaccatctcatcctttgttgccctcttctcctgccttcaatctttcccagcattagggtcttttccaaggagttggctcttcacatcaggtggccaaagtattagagcttcagcttcagcatcagtccttccaatgaatattcagcattgatttcctttaggattgactcatttaatctccttgctgtccaagggactctcaacagtcttcttcagccccacaatttggaagcattgattctttggcgctcagccttctttatggtccaacacaaatctataattttatttattttttacttctaacacttgcactgtgaaatagatctttctcttgagttacatagggaggaatttggtgtcagttccctgtcattcacctctggaaagcagcgcatcattcataatttttcactcatttgtaagcctgtggatttgggggttggtatcactacttgtattgagaatataaccaggaaaccgggtcttcctgttctcttccatgcaccccactgtgggattaacttgtacagtagcatttgtgagtgatgtggactggagattgtgtaaggaacaaagagggatcgcaccccacattaaacaaccttgggcttggaaccccaagtccatatatctccctcttcctcgcttccttgtctattgcccaaccacaagaagtcctacttttctatcctattgtaccaatggactggtcaccatcctttccctttccccataggtcagctctgcaccacatgctatttccaaatgacaccctggagctcagcaaaagctccggctggctagttcacagacccaccagcttacaaggtgagtcaggaacccccttttacacttgagcatgactcctggtcttttactcttgcatacgtagcattcaccacacattcccacgaagtatggaaatactctatggaggagaatttctgttttctactcatcattggggtgatatgtgactaaagaagatgatgcacttcatactttctggatgaaaacacagtgttacataatggggagcagggagaagcacccccaaagtcactgactgtgctgtggtgtactcttctctgctcaaggcgtgagctgtttgattaagaccttctggctcattcagcagtagctaacacaaggaaacagcttcaaggactggttttctgatattaaatataacttttgaaacccaaattgttcttcttattaagcctgagatcaaaggagaacttcattagccttaggactagaactgtaaatagaaaaggtgctcacgaacacacacattatccttcctgacagattatcttacacatcatggacctcttcatgatgatgggaaaacataatgcatttgaggaaaaatattagcataccgccattaaggggatttgcctgatgtaaatgtaacatgcctctgtatacatttatatatgagaaaacttattttataacaatttcattacctctctccacctcttatgatgaatcattttgaagccctttgcttcgatattttttctaagatttttctcaccaccagacgttcaaaattttttcttgaaggaccccttagaataaactaatactgctatattaagactcttaaatcctttaataattctttggataattcctaaattactctaagaactgtatccttggaaataaatccta

SEQ ID NO: 54968 - DNA, 1182 bp, Bovine  19866880969934
ttatagcaaaaatcccacatgcattttgtatctattcctatcttaattcagatatactcctggactgttcagttagatgagccaagaaattccctttttaatttaaaccactttggatcagttatttattacttgaaagtgaattgcaattcacataattgatcatttctatttctcgtgaaggtatggggaaggtatcaattaggcagctggtagcacattgactctaggggacccctttctgcaatgctagttgtatcagtcaggtttataactttttccaggaagcctcctgttttaagtctgtagagactgtagaaagtcatcacactgaagggtatctgatgaatgggacttaatgttgggcaagagtggacctgatctgtgcaagaggtgttctggatcagactgtgttgtgccacttcaaatccttgtgtttcctcagcctactttttactccagccagttttgcagcaaccagctttgcgcaaacatgctctgacagcatctcacttcatctgcctcatgtcttcctgccctgggacttctctaatgctgtgctgaaagatggctgtggaaatccaatcaggcacatggaacctgaaagggcaaggaagttaaagtcaacgggcatctcttttctaatgagggatgagagctggtggataaatgaggcatattccgtgtggctcctcggaggcgctgagtgggtcaagccccactaacacagcagtgatcgccttgatgatataccctggaataggtgttcactctcggcctcgtttttctgaatcacttcccaaataaactgcttgcgtactagcccttgtctcaggttctgttttggaaggagaatccagaatcaccacagtttgaatgagattcccaaatataatgcaagtttcctccagtgttacgtgcataaatatgcacaatggagcacagcatgggtaatgaccaaaaatttttggctcttgtcccaaactacatgagtctacaaacagttgatctcaaattatttttctccagcttacacaatcaatgtccactgaaggaaaagtccctcagtggtcacattccagtactttcagtgatgccagcgcttgggggacaacagctgtctgctctccaagtgatacccaaggtgcagaccccaactctccagctcccaggggctctgca

SEQ ID NO: 54969 - DNA, 861 bp, Bovine  19866880980007
cttcttggggagttctgtgacactccagtggccggactccaccctcccactgcagggtggcccaggttcaatccccaccaagatcccacaagccacacatcatggccagaaattaaaaaaaaaaatcaagcaaacaaaaaaacccttcctcattagatccagttctcctcccttgctctcagccaacaggtctagactccccagtctttgagtgtggggcactgttctgcacagaatggtcgaaattttgagctgggccttgcgggatgactagtcagacaagcaagggagaggttgccaagaccggtaggtgtgagaatgctgggttttccaaaaacgatggctcttcccatgtgtctggaccttgcaggtggcctgaggggatgcaaggagggacaagcctaaagaggtaaagagggaccatgcagcaaggaacggatgatgaaaccagcttggagggtccaagatggggtcaaaccagacctctacatctgaggctattttaagcaggatggaaaaaaaacccagaactttctgggtgtttccagctaccccacaactgatatgcagcaagaacaatatttttgttgttgggtgaactcatctgtttctcttcccaattgtaagttccttatggataattctgttttccctagatttacccatctacccttcccattgctagggtgatttcaaatgaagatgatcttttctgaatttgaaagtagaaacacttaggaacatgcaattgtaaagtcagaaaggttttgattattggtatgaaagaaggattcaattagaataagaaaaagcaaaacagaagctgcctctagctggcctgtccgcaacacagcaaaacag

SEQ ID NO: 54970 - DNA, 1007 bp, Bovine  19866881328328
ctcagaaatcacctgggcatcttaaaatgcagattcttaaaattggacaggtctggggtgggggcccaagagtctgcatttctaacaggctcccgggtggggcagagggctgctccttgacctcacttgagttaaactctgcacgtggtcttagccaggcccctctgggtgcaccagcatcagggagacagccccaatagagctgtcgaggttatcatttacagctgatttcttcctctttcactgactggcttttgatcggggttccaatggatggctagcgagagctaattacaatcccagctaattcactgtgtcagttgttattcattaacaaattatgttcctgacaaactgctctagtgtggtaccctaagtactgtaattaaaaccttagaaagttgcatgtgggcctaattgatttccttaatgtattactcagactaaacattccattatttcgtgtcttaatgtttatgaaggggcggaactgccactgccacccaggcagcagatagacaggctctgggttaacagggagccagcctgctctggggacctgtccacttctgcagcaaatgacagagggaactgctctccaccagaaatattcacggataaagggatgaagggtgattggatttgtgtctataattaattagtgtccttggatttccaggctttggggatattatgactccctagtataccgaaggaggaatgaagaggtgctccctgaggctctcagggtcccatgttgtataagcttgcctttttagttcgtgagcatcacaggcagaataggagaggaagtaggagacaatgtctatatcccatctagaggtgtgtgagacgcagacaagtgcaagtgcatgtggcaaatttggaaagctacagacagccaatatctctatggcaagccattgagttagactacaggtattcattcatgcatgtgctcaatggcctctgtttaaaaattgtatttatttgactaatatttattt

SEQ ID NO: 54971 - DNA, 1068 bp, Bovine  19866881794655
ttccaagttctatggccaacctcctgccccaggatgcctcaaacattttggcatctggattagctccaaaagcccatctgggtacagtcccctccctgacctgcctctgaaaaggcagcggatggcacagacctggacccaagcagttggattaggtttccctcttctctttgctctttgatgacccctctcctcttctggcctccgcaaccattccttaagcagcatctccccttccaacgtgcccgcagccttcaggctgatgccctgcaggaggcagagaacacagaggtagggcttcctggctacacaggcccctgagagctgaaggcctgcagagtctcggatgggcccaggcctgcagctgcagtgttccaaacagccccctggaataggttctttcagcttcaaggagaggtcagcatttcgatctcatgttttcacacgtcttaaatggatttcagaggcactggcgcggcctctgctccgctctttaaacaatgtggtgaagccgctgtagcgtagctagaggctgcattcctcctgcattgtgatgtggtttttggaagtcatgcatgcagttagctaaaccaaactaagctgcttcattaatgggagcaaactcaagagggaaactgtgaatagaaacgaggcaagtttgctttccactcctaattcaaaaagccagataattaagtgggcggagaaaggaagtgtcccttctgattccaagagctgactctctctctctctccttttcctttctttaggggggtgtgtgtgtgtgtgttgggggcagggggcctccctagtggctcagtagtaaagaatccgcctgacaatgcaggagatgcaggttcgatccccaggtcagggagatcccctggagaagggaatggcaacccacttcggtattcttgccttaagaatcccatggacagaggagcctggtgggctacagtccatgaggtagcaaaaagctggacgtgactgagtgagtaaacagcaacaacttgggggccggtgaggtcggtattcagggaagttcttgtagaaagtctatggatc

SEQ ID NO: 54972 - DNA, 1339 bp, Bovine  19866880548031
cactaaatatatgtgaaaataaataaataaatagatgggaaaggattatgtaagtgggtttccaaagcatttttccagtttcatttgctccaatctaagactctgattccttgcactttctactttcactcctctgtgaacagaataataatggcataaaatgttcatcaataaatgtctttccaccacattacatagcaatcatactaactcactgcctccaagtgttttgaaatgttttgactcctaaataatgtgactttaataactttgtagagaaacatattcaattgtgataatggttgagaaagtgatttataaactgcaaagtgttatataagtgagtcatatattttcttcctatcaataacagattacttattgtctttgtgttttccttctcatggaacttaaattccaaagcccatctagaatttggagtaactgtatatattcacagattcaggaataaataacgcacagatatgttcttgaatcacacttcacctttatgcttgtctcatcagaagagagatacacaaggaatgaggccaaacttgagccgaagttagaacacatggatccaaaattcatctgtctcatctgagcttgttattcaattaaacctatattttataatttttaaaactgtaatgcagtaaaatatattctcttaagcttcacaggtagcgcccaaagtgttcatcaggttgtgttttcttgttttacatgtttaccattactctaagaagtttggataaacatatactttaaagagcttatccatcaagtaataataaagcttttatttcaaactttaaaaaaagatcctgccctaatagcctcactttttgaatagaaaagtgcttggtaaatactgtgaagcgctatacaaatgtcaattatttgtgtaatagttaccaagaggcttcctaaccaggagaggtctgggagtgattaaataacaacaaccaaaaaaaggtgaagcatggaaagaacacagtaggtaaggaaataattgactttttggcaagaggtcaggttcatggatatcagttaaaatccaaaagaaagtagttaggctggatgaggaggaggtcagaggcagtcatcaacaggggcaacagcaggcaggtaattctgaagggaaatctaattttagggaagagctgtttgatttcacccctttctgtaatagctgattcgattatcctgtctctaatgtatccaacaaactagctaattctagctgacatttaaatgtgcttaccaggagccagacataatactaatcatcaaattcaatctttacaagtattatgtcattttattctcaaaa

SEQ ID NO: 54973 - DNA, 1815 bp, Bovine  19866880581485
aagtgtgggtctaaagaaatttttgtacttagcagtaacagcagagtgaaatagggaattgtgtgaatatgtgtaagaccaggaaagggaaggaagtgtcaggagactgggaactggtgcacattttaaacacaagagaatatactaataatcaaaacccaaaaacaaaataatttaattggctaaaaaaaacaacacacatttctttgaaatgatcaaaaatacttgtatcaaaaatagatccacatagagcatttcatttagtatgactggactcatagccttcctcttcatgccatttcatattctgcagtttcctggttattatctccagagagcacatttaggtactctgcagagcctgaaaggaaaagagcgaaaacaaaccctgctcactaatttcaagccagggagaaaggctctcttatcagaaggactaactctgtgtcagctgtgaacttcatgaagtttctcatcagagcttttcactttccacgtctttgccctctccttcagcaactctgtggttagtttggcaactcaactgagaaaaggctttcaggtaaccaaagctatcttctaaattaataaagtgtatcacttgagagaaacaggaagttaagacaatgaacccacagtctttttataatgattctgacatcataacactgaagtacaactgatagttttgattttaggacatctatgaaatgagggaaaataaagagcagatacctatttgtgtgtttgttgtgaaactgcatgaaaaatgtaaaaattcttgatagaatattagctgatatttgttgtcaacatcttcattatcctttttgtggattctggagaatgagatgctatacttctggaagttgtagaacgaagaaaaatcttgctgtatcatagaagatttaaaagggagataacagtctttctcatacagatagattttttcagtttccaaatatatatcttgggaaaaaaacgtattttttaagaagaccaggaagatcttcagttaaagaaatatcaccatgttacaatacctgaaattcaatagctagtggagacttcttatattgataaatgatcccatattaagttaaatatagtgttacctgcaaatactttctgcaacatacaacattgtatgttgatggttttcttcgatgtacagaagatttttaaacttgatttagtctcattggtctatttttgcttttgttgactgttcttatattgtcatatccaagaaatcactgccaaagtcaaggtcctgaagctttccccctacattttcttctagaatgtatatagttttaggtctcatgtttaggtttttaatcaattttgagttaaagtttgtatatggtataaggtaaagtccagcttcattcttctgcatctggacatttcgttttcccaacatacaatagaatattattcaatcttaaaaaggaattaaaccctgccactactacaacatggataaaccttggaggactttaggctaagtgatataagccagtctcaaaaagacacatactgtatgattccacttgcaggatgcatctaaagtaatcaaagtcacagaaatgaaaagtagactgttgattaccaaggcctggggagaagaaaatgaagtatattccatggttatagggtttcagttctgcaagataaaatgttctaaatatctgttgtactatgatatgtatatatttaacactactgaatggtatgcctaaaaaaaatgggtaacatcagaaattttaaaaatatttaattttaaattttaaaaataaactttcaaaaata

SEQ ID NO: 54974 - DNA, 979 bp, Bovine  19866880735488
cccatggtgagtgggaactggtgacggatggagcacttggcagtgatttgctcactgccaactgtgtgtcaatggagatggtgctggcctacccactgtcaacttgcctcagactttatagcactttccttccttggaagagatgactgagatttttactgtacatctctttaattcaaatagaatagggctattcaaatagaagggctacctttttgcacatggccaagtcatttttcttcatgtaaaggcaaatatttcatgcttcacattgagggtgcctgggacttgcagcaccaggaactagaaattattcactccagcgtttatattagttgcccatgtaatgacttaatgtgacagcttgtcaagaatgagatttaatatgcctgttgtatggaagtcatatttcatttgcattttgagacaccggccccagggaaatgggctttatgagttttagcaggaactgttgggcttggttcatccacccaacactcacacagaaaaatcttttacggagcccttctgaaactaaatactaaaactaaaatgaatacttttaagtaaaggaacagttgaccaatagctcttttaaccatacagtgagggtgtgctctctgtcagagcttcagaaaatgtagtggcgttcctctaatttctattgctttcctcttaacttttcatagggatgagtatttgtgctttaaaccaaagacaatattttaaaacataaaaaaacagtctagaagtctatccaataaaaaccttccattttgattatttcctctgaagcaaaagactggatactctgagattcagtaagcaataagaggctttttcatgtatcagagaatgtttattttctcttgtatccaaactacactggaagtattacatggcataataaacccaacagataaaaataagcccctgggaaagcagtcatgttttaaaaataccatggcacaatacaaaa

SEQ ID NO: 54975 - DNA, 2146 bp, Bovine  19866880761562
gagaccgaacttggatttgaccactccgtattttctactagaaagcaaaaagcaatgaactctcattagaatgtgtgctttagttctctgattagcaattttgactaagtagttcccataaataaagcaattgtttaggtttttcagttacgtatcacttcacaaagacatgattcaaagcatgtttgttcttccctcagtttttctaggatcaaatttacatttcctgtctcagaaacccaacttagtgatcatgcctgtcatcaggcacgtacaacagaaacatctgtacaatagaaatggttatccctagcttgctcttcttcttttcttccccatccttaagtataaaaagcctgggaaagttacttctagagtaggctatttcaacttgaacaatacgtgaaacaaagtatatccacccaaaacactttttgtctaccaagaagacgtgctgcacccagatattcaaaagccagaatactcaggggaaaaaaggtgttttacataggacttgggccatggagattgttgggaaaagaaacaggacaaagacaaggttgtgaaactgtaagggagacaagcaactattttagagagaaacccatcttctctgattactttttttatacttcactttttttaatactttgagaatcctgaatataattttttaaattgagtttatatcttgctaaccaacatttatttccacaaaatagtttcttaattctctaaatagacaaaataatgcaaaatattctcccatatcaaaattacaataatttctatatgctgaggctaaactggacaatgtaatgaggatatgcgaaatatacatgcctattgggtcagtttcacaagagaacgagaagtggctgcgtgtcttcatttccacttctcctctggaggactttcattctccaggctccaatgccacctgtcctcctaactacgctttaaaagacaaatggtgcaagcactgctgtggcatcattatctccatagagattacagaagtgggagctcagtcttctgcatgctcaaaagctacagactgagagggctattaataaatccccccttttttaagttagaagggaactggagcttagccatccaagcacagaaaacttaagagacagaaggatttgtaacaacagcaacaacagatgcaaagttaatgccttgaacttaaaattgttgctgaatgacgttttaaatgtatggtttcaagcaagttgatattaggttttaagtcataatacagttagaaagtgagtttctacctgtaaaagtgtgttttagaaataaatttggcatatatatttctaaaatctcaaaatttctagctgaaagacagttcttttttcaggtgggaagatgattctcacatttcagagattctagagaaagttcttccatagtagacagaatggaacggaaagaaggaacaatagaaattgatggtattaaaagtggacgataatgtgcaggtaacagaatgcccaaggaaactcacagtgggtgtatgcattgcattaactgagtaggtcaatagaaataaaaataagtggagtactgacaaaaagatattcaaaatcacagatttgtcctaaatcatccaagacacaaaagctatttccttctcaactgacccctacacacacacacacacatacacactctctctctctctctctctcacacattcacacacacacatacttcatataatttgtctttgaaaaaggaatcacctcagttgccatctgtttacaatgttccatgttctcttaaacaagtagatccatgcatcacacatttacttcactatttaagactaacaaccacagaaaggggtagatggcctagaaatgtaaataatttgttaataataggcatatgaaaagtggattctctaggcttatctaacatgtttacctcatatttcatggaggcatggatttattgaatcatgtgttgatgacaatttctggaagaagttaccatattctataatggaagcctaacaatgaataatgaaatactaggaaataaaccatacctgtttatcctctttcaaaacctagagggatgggatgggttgggagatgagcgggaggttcaagagggaggagagaat

SEQ ID NO: 54976 - DNA, 2132 bp, Bovine  19866880768078
cagtccgtggggtcgctaagagtcggacacgactgagcaacttccctttcacttttcactttcatgcattggagaaggaaatggcaacccactccagtgttcttgcctggagaatcccagggacagggaagcctggtgggctgccgtctatggggtcacacagagtcggacacgactgaagcgacttagcagcagaagcagcagcagaatcagttaggttcaagacggtagaagacttgactttccagttgaccttgagcctaattatatgctcactgtaatgcatgagctaaatgacactcataggcactgtgacagttctgaggccaaacataaaaggccaaaatgtgagtggtggtccagttcctggaagtgtccaccccttccccaaaatagttggcataatcctcccactctttagcctgtgaaattacctagcccatgaaaactaaccaccccacatttcaggcctctcacctgctgaaatggtccacatctgtctgtggagtttttctcctagggctgttctcacttttagagacaccacattctatctataaaatgtgtatctctctcaaaaaatccacttcttacctatcacttttttctcactaaattctttctgtaatgagaaataaaaaacctgagcttcattaagttctgagaccagggatatgatttcagttaaaagacatggattcaagttcattcaatttgagttatgcagtttcagaaccagcacacaaatgaacctctagagcagtgaatgcaccttttcatattgtgtgatatctggaaaagtgaggacctctagaaaatgtattatgttaagaggtctttgacttacatttttttttaaacttttattttgtattggggtatagtcgattaacaatgttgtgatagtttcaggtatgactttcatttcaaagctattttttgcttttcaacaattaaatcaaatctggccatgcttccccaggaaaaaagagttgcctccaaactctctttgtaaagatgacatgccttatgtattttgattgccttgctaagaaaagcatattgaaaagtaaaagaaaagaattttagcgaggaaaatattcctttatgattctaataaataaattttcatccaattactttagctatagcatttatgttaatagttatttatagcttctgtcagtaaatgatgaactttatgcttgtgcctttctgtgactttttggaaagtaaatccagaatcaaatataaaatataagatatactaaaattttaaaataaattaattatacaaagcatgtatgtgcatgtatatgtgttatttttatctgttttcaggcaacgcattttatcaaggatgactggtattcttgtttaaaccatgcaattcctctactaaattaaaatgggcaaatactattcccattttacaaataggggatgggtgatcctgcagtattaaatggctagaaagagatgaggctgtggtcaaaattcagcccctctgagtgatttttcagtattctgtcttatgcacatttctttcttgcttatctttttcagttttgggcatagtcacccaaggagaggaccaggcacaaaaccaagaacagaaagggtctgcaaaggcataatgcgagccctggatgagcaataatttttatttggatctgagaattagaaatctggctgaaaaagctggatgaattataaaagttgaaaaaaactagatggcaaattaatattcatccagaagaaactttattgactaattacttaaatttcaaaaaggttaatttgtgttgcagcagctttacagttattttctgaagagcggaaggactagccctgtaatgtttgaactgcacacttggttttcagagagggttgtgtgcagggccttagagtaggaccatgggtcagcatttccatgacatcgtgaaagaacttgagcttcaagaagcttttgtgaggtcagtggagggctctcctgggaccaaatcctgacctatgatcagaataacccagtgttctcttgaaatgagatttctaacaggaattaaccagggcctctttttcctctttttaaaagcaaactgcactgttattctttctttatgggaaattat

SEQ ID NO: 54977 - DNA, 750 bp, Bovine  19866880791688
ctgctttatgtgggcagaactcaagaaaggctggttacaaagtcagtactgataaattctacagatataaagttacatgaatggactagaactctctcattccactcacaaatacatctaagttaactctaactttgtaagtttttttatacgcatataggtatagttaaatcatattggaatgcttaatttatcacactgaatgaattctccactgtcacctctagaaggagtgtcgtctgaatgatctaaatttacagtgagatcaaaatagtataatactcttgaatgtttcacactataaacttcatactcaacacatgcaattctttcaaacgtacaggtaaattattctggttgttttgtttcattgggtatttttcttacagcacttcttttacatttactttttaaaattaggaaaaaaagatgaagatggagacaattttcactcaagtatataagtgggaagcatatggcttccttgactatttttgctgaagtatttataagcttgtaggtccaggatatttgaaaactccaattggtagctcgggaaattcatggtctctcatacaaaaggtggattagattttatttggtccaatcatttggcttccctgacggctcagtggtaaagtattcacttgtaatgcaagagatgtggatttaatccctgggtcaggaagataccctggagaaggaaatggcgacccattccaggattcttgcctggaaaatcccatgaca

SEQ ID NO: 54978 - DNA, 971 bp, Bovine  19866880867729
agtcttctccaacaccacagtttaaaaacatcaaattcttctgcactcatctttctctgtagtccaactctgacatccatacatgactactggaaaaaacatagccttgactagacagacctttgttgacaaagttaggtctctgctttttaatatgctgtctaggttggtcataactttcctccaaggagcaagcatcttaatttcatggctgcagtcaccctacctgccttaattcacctgcatagaatttataaattctatgcatgatagcataagcttaggttatttgagaaaatgggcttgttctcttaaataatgcattaaatttgttaaatccagcatacacaactattttgaaagtatacgtttggggccaaatccttatgattaaaaagtcacaatggaatatgtttaatacgagctctttaacattgggggggatggcatttttctaagacagtagaaagagggcatttttctaagacagtagaaagaggaaatttttctacatcaaataaaaataaatgtgggggacatatttgtttccatattgaaataatcacactcgatggggttgaaactaaaaattcatactatcactgaattgatgtttattgatgaaagtagaaaatatttctttctatagcttaattttggacaagtctgtcattgtcatgagagtataagctgtacttcaaatagtttatgtttccttaattttagctgcataaaatccatttattaacaaaaaaaatgtacttactgattcaggacaggagtgtaggcagttttatcctcatcaataatagtgaccatcagtgtaataagctggggccaaaaatccaaattcttggtggttggtccctgatcttcccgaggaatgtcctgtttcttactctgctcagaaggtcaggcaacatgcaaaataaaaggttaaacggcagactttagttagaaatcactgtcaa

SEQ ID NO: 54979 - DNA, 1065 bp, Bovine  19866880983854
acttcatttgcatttttgtcttaccagcttgtgactgccttgttggttcaggtcaactgcattttttccgaaggaagaatttaaatgtgggtaaaaacagacctctgtatttctacttgtatcttatttttgatttcacaataggggactccttcgtagacttgactgtactataacctgtctaagctttgattttttcatcaataaaatgaaggagttggataaaaccatctctcaatatttcactcaatttcaattctcaaagtcttatttcagcagtacttccttcctacagcaccttgttcatcagactaatcttggcctcattattcagaatggaactttttcaatatataagtattactgctatgtttcctcctgggcacaaaggatatgatgtcactaatgttaatcactgtaataatacaactgccattttgaatatgcttaacaggtaacaaaagctctatatacattatctcaagaaatatatcaatcctatgaagtgtgcattatcccagtttttcatattagaaaagcgaaagttcagaatttaaacaaatggccccaaatgcaagctaaagtcacaccattaataagccatcctattttcagaacctcaggacatgtttttacactccagttcacagggcagaactgtcaggttagtgggaggcatggatgagttcatctatgacatatatgcatttttcaaaatctgcacataaattctccatgaactcatttcctcctgccaaagaaagccccttataaagaaagataagtttgtaattttcataccattttcatggtcaaatgaaaacatgcacaggtagattcaaaatagtatttctagaaccaatgatacagaacatcaataataaaaatggaatctttgcgttcaggtagctggcaacaaaattaattactgttgaaaatttagacattcatattttacattctagaaggaaagaaacaaaatatttgtgagcatagttttacttacagctcataaatattgaggagaggtaaaataagcaatatatatatatatatgtatagcag

SEQ ID NO: 54980 - DNA, 960 bp, Bovine  19866881171751
taatttcagcctaatgatcggggtgtgggggagcttcccagagaggaagaaactgcaaaaatacatctattttaagtgtgagcagggcacagggtgccccagtttaggtcatttgaatgaacactgatgctttccttcgaagtaaagatgaaaggaggcaagaaacccctaagtatctgagaaataacatatttggaaggtgaaaagcagggtcaggtaagcttcatgtctagtttccattttatttcctgttgtttgtacccacttccagctcggcagagtaagcatttattttgccaaccctacctctcccagttttaaattttaattcttttacttccttattctgatttcagttcttttggaagggataagtaagatgtcccaaacaccctagtatattcaatctgctggaaagttatgagtgtaccagatgtttgagaagataataaagattgggtcaagacaggtggggagtaagaggaaagaataagacaagtggaggaaggtggagctataatacatctgtctacctggatcttgccctgttttttttttaacatttattctcaatgatttctatttacccattaaattccactggggatggcagctaaaggttttagaccttagagaatagcttgacagctgatttgtattaccagcctgtgaaatctgtttgatggataaaatttgactctatctcatagaagtagagttttaccatatgctttgtgtgctgtgcttgctaatgtgaaatagactgtcatatgttggaaagcctttggctaagggttgaatctcaaaggcttacatgatgaaagagatcttgatgaactgaagctttaccatgctgttgtccaaatatcaatatggacaattcaagtaatgaataatgcactttaatacagaacgcactggaaacatacagaaagttttaccaatgtgcagtccctggca

SEQ ID NO: 54981 - DNA, 1096 bp, Bovine  19866881231437
ttgaaaaaatatgtcttaatttctcctgcataaatacttaggaatgtaattgctagaccttagtataagtgtcagtttaagtctaccagaaactaccagatagttcttaaagtgattatattctttaacattatcttctttaatgcatacaaattctagttacttttcatcttctcttgaatttggtatgtaaccagtcttttaaaattttatccattctcatctgtatgaaatgaaatggtatctcatttttggtttttaatttgcatttcctgatatttaatgttatagaacacattcccttacccctattggccagctttcttgcctggaaaatcccatggacagaagaacctagtgcgctacagtccatagggtcgcaaagagtcggacacacagcaacttaacatgcgcgcatacattgaccagttagaaatcagtatgaaatcatcactgattactaaccctttgtgttgctttgaaggatatgctcttgccattatagatcaaaagcaataaaatgagcaaaataagctagcaagtgcataatcatctataaagaatactttgtgaacagatatttaattgagacactcaaggttcagagctctttagatttcattaattagacatgtggacatctaatcaatgtaccaatttgccagcaatactcataatttcttgttatagatatattcaatgtaattttagcatgaggcatatttgtggttgaaatattaaagcaactcttggagaaatacaataatatataataaatttgaaccttgcttttatagaatgtgtaataattacttcagccaggagggtattaaatttgtattaagaacaggataaatccatttccctgccaccgtactaacatttaggtcaaattctgtttatggttgaacagattagtaatagttcatcaaatattggtacattttttattgcttttttcccaataaaaattaaacaactattaaatgttgggtacccttatacattccattagggaagatagatgcaaaaatgagaggttatattacctcatgctattgcaataatacatgtaacacagtgtagtgtagtgtat

SEQ ID NO: 54982 - DNA, 1279 bp, Bovine  19866881305762
tgctgtgagtatgtagccatgagactaacatgacgaaagcaatgttttaaaaagactggtctggcagtgcggttcctgatggattagaggatggatcaaggagaccgagagatggtcggacagactgttgaagtaattctggaatccttaacgagggtcttgactgaggtggtttttactactttctttggcaacaccttcattccactttgtgaacgctggtaaagctcccaattcaaactgctataatattttaaagagtaaatggtctcattgtcaaggagaacctttgtattctactaaattactctctcctttcctaggcattgacctcttgccactctgcaatgctctttagcactttaaagcaggctttttcaaatctctgttcttttgaaacatggtttcagaagtgctgactacctcattattcatttttacattatttttcaaaagctaatgtcattttaagtttttaaagacataaaggggatgtgaaagagtcaccattctggtagtaaaggggattgcaggttatagtttcaatgattaaaactatttttcataacaaaacaaccaaatggtcctaggttttagtataatgagatggagaagtgaaaagctaaaatgcagctgttaaatgtgcttctgaaaatttcttaactttagtcttatgaggacaacgccaggtgtcggggattaatttctaacaattcaattattatatgtatcttccagggctcatttccttcacagattgtttaatcaaagagacaacagtattttctaaagcttgcaattccctacaccaggaacctttcttacccctctgttaacatcatctgcactgagattaaactcataacatcacatgctacacaaaagaaaacaagtaaaatatatagcccctaaagtcacttgtaactaagcaattgttatgatatgaaaataatgttcatttaattaaaattcataccacatagggtctcgatttagagtgttagtttttaaacacctaaaccaggcttctgtggctcaaagctatagtagatatgaaattgtatatatcaacattttttttggtttaaagctaattttataagtaatctctctgtaaagactcaacattcacttatacatagtttataaagtacaattatttgtaagttaatgaaacactaggttcttgtaatatgctttacttgaaggccattaaatacaaatacccaatagcaaagaactacatttctcaaagctaaagccgcatagcctcatgttc

SEQ ID NO: 54983 - DNA, 728 bp, Bovine  19866880348890
aagaacccctgtgcggcccttctaagaggggaagggttggtgtgtttgaagaactaaaagaagtcagtgttgtcaaccccaggagcaagcaaaagcagagtgtgacttgagattggagagacaagtaggaactacattattcagtctttgatggactttgagcaatggaagcctgggccaaatgtcattttggcccttgaataggttagagagtatgagaacttgttggggatctgggttaggagtctacttgagtggtctgggttagagatgattctggtttgaaagagggcattggcagtggagataaaaaaattctgaggaggttaactggatgaaattgctgaaagatcctatgaaggtaggaggaaaagaatatactgaaatgaattccctgtttctggcttgagatattctaataggctccattttgatgtcttcaaactgtttaatttgcctaaaatatccattagctgtcatatactgaacactttactcaacaacatttactctacttttccccatcctcctagtaattacaaattaaggattagctcccttttatagaagaagaactggggactaaaaaggttaaataattgccttggaacctgttgtgagtaactgtcagttttgggactcagttctcattagtctgcttctgactcctgtcatccttccatggcagtatcttgcactctggcttattatttatttacaatcctcat

SEQ ID NO: 54984 - DNA, 1399 bp, Bovine  19866880464108
cgggctgaaggcccacagtctgcagcctgacgccctgggtgtagagaatggctaccgtgtgtacgcttgtggtatatatgcagagaacttctggaaggagacaggtcacagtggctgattctacgcagggttcagagatggacatggcaggaaattcatttttttatttgtaaataacgtggagctagtggtaaagaagccgcctgccaatgaaggagatgtaagaggcacaggttcaatccctgggtcagggagatcccctggagaaggaaatggcaacccacttcaatattcttgcctgggaaatcccacggacagaggagcctggcgggccacagtccatggagttgcaatgagtcagacgtgactgaagcacatagcacacatgaatgaattaacagagtgctgtcttaaagttaattcttaaacaagaaacgaggctgtgtgtggggtgacgagcccatgctcagaagttagagaccatggctggaatcctaactcttcctcacctgctgtggacccaacaggcaagttatttgccatctctgagccccagcatcacagggataacatcagtattggcttcacaggcagttgggaggcttccacgggttaataagccttttgcacagcaccaggcacctggaaagtgctggctattattatcctcattaagagtcattcatggggaagagccttcctccgaagggaagcctgaaacataactgcggctgtaaaattcccctcgagagtccgcccagtcccacagcaagtcatccgactgtccacataatggatgccttgtgacgtaaggaagctcatttgtattagcaaccacattccacaaagatgcctcctggagccacgtctgcacgtcctgtttggcggggaaggaggccagtttcccagcccggggtctgtccctgagtgtcacgtggggtggactgtggcctgcatccatgagatcactcagtgcccatttattaaatgcctactgtgtgccagggcatgcaggtagacacccctttgcaccatgccctagaggctgcaggtacaagcatgggcttcttttaaattagctgatgagggacttccctggctgtccagtggctagggctccaagcttctactgcaggggacaggggctctatccctggttggggaactaagatcccacagaacagccaaaaacaaacaaactgatggaatcagagcaaagatagatgcactggtggtgtgctcccacaatcctgtgcttttcctatgtgtttattcattcaacaaatacatactgacctccgaagagccaggcattattctaggtacttggtcttaaccaggccccttgttttgcagctgcttccctctgaactttagacctgtcaggaagagaccttgc

SEQ ID NO: 54985 - DNA, 1962 bp, Bovine  19866880494970
atggagtaggacacaactgaacagcaacaacacaatgaatctcaagtacttaatggctgaagtagtcacataatagatgagatggccgtggccgtggcggtgatggtggccactttcattcattagcctttattgcatgtcagaagttaggcatcctttagtcgccaacctataagataataataaacactcactgctgctgttaggattgtttattcctcagatatgagtgttcacctttcgcccagctccgagctagcagggtgcctggactgtgctctgaaaacagctgagacctgggccagacattttatgggagaatagaggagtttgttcagtgtgtattggaagcccaacagctttcagtctcccagtcccctttccatctagtccccgggcctttcagcgagctctagcctccaacacataggctgcccttgacctctgtggccagaacgcatggatgccctctctgctcagcccatcagccgagtcccaaattagacctgacagtgtgatttattctctgggatggagccgggagggcagagccccagtgggtgattccaagggaaggttgtcagcccgaattagcccaggcccttcatgcagccttgctgtttcagcttccactagctaatagggttttccagggtgttgctggctttggagcggcctcctccccactcccaggggccaagccttggctgtgatccctaaggggctgcgtttgatgagggccccgaggcaggctctgtctgaagggagtgggggctctgggtcctttcatctgctgcagcaggcactgaaagtggcgatgccccagcgagagttattcagtctccccctctcatcctttcagtgagttcagtactggcagctgaagccacctccctgctcctcacctcccagtctgtaatcacagttgtctctgccttcattcatccacggagaatgccagtgagagacaagattcggctgcaagagcaaattaaccctgagatcctagaggttgcatgcaacaaatgttgacttcttactcatgacccaagtcaggtctgctggggtctttacctcgaacctcaggaacccaggattggtggggggagcgtggggggtgtgagaggctcccatgtcttgaacagtgggaacatgcagactccaaggtcaccactgcagggcacgggaactagagggtcacacagcagagcttagatgccaaggccagagtaacacagtccacctctgcacacccggaactagctgcatggccttgcctaactgcaaggggccgggatgtgggtgctcatgggtattcagtgagcagtaaatatccgccactgtaggcagatgtggtgtttaataaacacctactgtgtgccagttctcgtaagggggctctgaagatacaaaggggcccttgccttcttggggcccatggttccatggaggaaacacaacctcagtaagtaatcactgaatgatccaagttattacctctgcactacgtgtcctgatgggggaactaggagagcctgtccaggggagatctgtcccgttcagagaggtcagaggatgtctctcatacagactgccatttgaggggaggcctgaggacgtgtggctccccaggtggctcagtggtaaggaacccgcctgtcaatgcaggatacgtgggttcaatctccaggtcaggaagatccccctggaggaggaaatggcagcccgctgcagtgtccttgcctggagaatcccatggacagaggagcctggcaggatacagtccacagggtcacacagagtcagacacaactgagcatgcacacgcatgtatggaaggctgtgtagaccttcatggatcagggcacatgcccagtaaaggaaacagcatcagcgagttctggacgtgggaaggagcttgacttggaaggaacggaaggcggccagcctaacggcaggatc

SEQ ID NO: 54986 - DNA, 1391 bp, Bovine  19866880582169
aagtagatccaatgtgagatagggcaaggatcatgccatgatttgatttggtgttgagaattaaatttggaggatgatgcctctcttggtcaggttgaactgctgcaacaaactactttagcctgggtggtttaaaccacagtcatttatttctcacagttctgaagctggggaaacctgagaggtgccagcatgtgtggttctggtaagagccctctacctggcttgcagatgactgccttccctctgtagtctcacatggcagagagaggaagctctggtatctcttcttttccctttttttttttggtggctatgctggttatgcagacttctcttgttgtggatcacaggctcaggagttgcaacacgaagctagttgctctaaggcatgtgggatcttagttccccacgcatgcgtgctaagtcacttcagtctgtacgacattttgcgaccccatggactgtagccccccaggcttctctgtccgtgggattctccaggcaagaatactcaagttggttaccattttctcctccaggggatcttcctagggatagaatccgcctgtcttacatctcctgcattggcaggtgggttctttacaactagcaccgccagggaggcccttagttcctccaccagggatcaaacccgctactcaacaattagacatttagccacttctatatggcttccccagagaaggcaacggcaccccgctccagtactcttgcctggaaaatcccatgaacggaggagcctggaaggctgcagtctatggggtcgctgtgggtcggacacggctgagcgacttcactttctctttccactttcatgcattggagaaggaaatggcaacccactccagtgttcttgcctggagaatcccagggatgggggagcctggtgggctgctgtctatggggtcgcacagagtcggacacgactgaagtgacttagcagcagcagcataggatcatataaccatggagaaacatgtggaaagatacatacagtgcttgattgttcccatgggtgaaggactgtgagagaatgctggcatggggatgcagtagagaggaactccccaaaaaagggactggagacatttttaaatgacttgaaaaaaaattgtaaaaataattatccccattaagtgagttctctcaatccactagacacagtgctaactaactaggtcactccattgcactttaaactgctcacttaatgcaggtgctattaattattcccattttccagatagggaaactgaggcccagagaagccaagtgctgtggccgagaacttgggcagtgctgggagcactattatgcaagagggtcaattccaaaacccactgcacttggagctcagaggacagagt

SEQ ID NO: 54987 - DNA, 984 bp, Bovine  19866880605923
gctttgccacagtcgttgcattcaaagggtttctctcctgtatgtgtcctctgatgatttatgagacttgacctctcccctgaaggctttcctacattcactgcattcataaggtttttctcctgtatgagttctctgatgtctaattagttctgatttttcaaagaaagctttttgacaaagactgcatccatacggtttctctcctgtatgaattctctggtgagtattgagctgtgacttctgggagaaggctttttcacagtccctgcatgcataaggtttttctcctgtatgggttctctgatgtgttgcaaggcttgacttttcaccaaaggctttcccacattcactgcattcatagggtttctctcctgtgtgtgtcctctgatgtgatatgagatgtgacttctgacaaaaggctttcccacactcactgcacacatacggtttttctcctgtatgaattctctggtgattagtgaggcttaatttttcactgaaagctttcccacattcaccgcactcgtagggtttttcacctgtatgagttctctgatgcctgacaagctgggatttcctactgaaagccttcccacacttagtgcatacaaagggtttctctcctgtgtgtgtcatctgatgtgataagaggtgagatttctgggaaaaggctttcccacactggatgcatccatgaggcttctctcctgtatgggttctctgatggttaattagactagacctctctctgaaggctttcccacattcactgcattcatagggtttctctccagtatgaattgtttgatgtctaattagctctgatttctcaaagaaggcttttctacaatcgctacatccatagggttttgttcctgtgtgggtcctgtgatgtgtgacaagctgtgacttcctgctgaaggcttttccacattctctgcattcaaaaggtttctctcctgtatgaatcctttgatgatt

SEQ ID NO: 54988 - DNA, 945 bp, Bovine  19866880680907
atatgtggagggaaaaaaatccccacacattggaattgggagtacaaaaccctttaactctggacctgagtttacttaataaatctcagagctttgagatttaatctctatgctttgaggaattctatttcccacactcctctctgggttctgaggctcatagatatgaaaatccctttaaattataaacaatgggaaaaaattctagttatgcctatttagggaacataacgggttaaaattaacatcagataaaagtcagttaaaaagggaaaaagtgaaaaaatattctttgaaacgaaaagctatacaaactaccctgttactgatgagtcaaatgagaaactgacctgcaatctacaaaatcattggaagaaacaatagtgaaatacttcagattgaaacctgtggaatgaggttacctcagtgccgattaaaaaaggcaaaaacttaagttctactttcagtaaggtcaaaagtttggataaaaatgatcacaaaagggaagaacaaaactccagaactggggaggaagggctagtctaaatcactgatgaaggacttccctggttgtcccctggctaagaatccaccttgtaatgccagtttgatccctggtcagggaactaagatcgcacatggcatggagcaactaagccagagtgctgaaactattgagcccgagtggaacaaccagagtcctagcactgcaatgaaagatccatcatgccgcaactaagatctgatacagccaaataaataaatactaaaaaaaatcactgatgagtcaaattattacaaatttaatttccaatgaatgatgatgactgaaacagtggttagaggtaaactttttagcccgaaagtaatctatgacttagaaattaaggcagaaaaccaagacgctagcggtcaactttcagatcagaaaaccaacaaaatagg

SEQ ID NO: 54989 - DNA, 2048 bp, Bovine  19866880791080
catcactaccaccaccaccagctcggaggtatctgtcccagggatttctggatcgagctctttgcccaaattcagactcttcacttctcaaaatctcgggcacactagaccagagccactcccactgccattctgtgagctggcccaaaccaatcctgctctctccaaaaacagccctgtctatagcggcgcaccctcccaccgccggggccgcaaagccggtgtagctcctatctgagaatcccaatagagtatcaccccgcagccctatcccccacgtactttactccgagccgctcccacacccactcggctcaggcccagcccgtgactaccctggtttcagctccaggaagcggacaccggcagaagcttgagtgggggaacttagatcccaccgctgaagcgcgcacagtctggccacccggctgcaggatcgtctttgctagaatcctcgggcgtgtccaagcccgtgtgtagatctcattgaccctcagcggaggaacttgtgaaccccgcagtccgggcaccttaacaatgggctcctaacgttggctgtgtatgaagaggtgcaaacggccgaggcaccttacttgggagaaacttacgcctccctcttctctatcccaagactacactcccgagaaccctcagcggccacttccgccgtcccttccgctcgccccttagcgtgtggaattgacgtagcaggaacatttccggttggtggattccgcccattaggtttgttggtggcgactggaccttgccattcaggtatttcctacacttctgctcttggttcccgagcttcatcctcaggattggcagcgtgcactccgagttccgtgagttccctacagtcacggcctcgtccattcaggacgtttctctgcttctcactgttttactcacgagggcacaggcagcgtctgaactcgggagctctcatgtaggcacctcaagaccatccattttcctttcattccaactcacggggatagagacaaaccccttactctgctgctgggggacatgggtttcactgtctggccagagcttggggctgaacttgaggggctcggtcaccctcggccctttctccagggcgctggatgggaatgggtttgtgctggtgatttctgtgacactcccaaccctcagtagtgagcctctggagcagacccagcctgcacatgggaagggttttccaactagacatgctctcatttcttttcacatcctcagatttgccttctgagatttgcccttcttaggaagagcactcaggagattaggaaaatgaccacggagctcctgaaagccaaaaaagaggtgagaatatgtgtaaaattgcatcttggctgccgagagaatgaatacattccattttcttgcgttggaggctgctttattggtagttgggcaaagctcactttcctggtcctggaggagtggcttattaatacgaggagtccctcaacattttctgccccatgcatgcttcagtcattttctaattaagttaattgtgaacagctcacatggggcataaatacaaatacagggacgtccaggcttaattgtgcagtgataaggatgcttttgaactgtggtgttggagaagactcttgagaatcccttggactgcaaggagatccaaccagtccattctaaaggagatcagccctgggtgttctttggaaggaatgatgctaaagctgaaactccagtactttggccacctcatgtgaagagttgactcattggaaaagactctgatgctgggagggattgggggcaggaggaaaaggggacgacagaggatgagatggctggatggcatcaccgactcgatggacatgagtttgagtgaactctgggagttggtgatggacagggaggccttgtgtgccgcgattcatggggtcgaaaagagtcggacacgactgagtgactgaactgaactgaaccgaaggatgaaaggcagggacaacatagtagtctgtggcctgaagggctaaggaggacttctaggagtagggctg

SEQ ID NO: 54990 - DNA, 1494 bp, Bovine  19866880899677
cgtatggatgtgagttggactataaagaaagctgagtaccgaagaattgatgcttttgaactgtggtgttggagaaaactcttgagagtcccttggactgtaaggagatcaaaccagtgaatcctaaaggaaatcagtcctgaatattcatttgtaggactgatgctgaagctcccaatactttggccacctgatgcaaagaactgattcattggaaaagaccctgatgctgggaaagattgaaagcaggagaaggggatgagagaggataatatagttggatggcatcacagactcgatggacatgagtctgagcaagctccgggagttggtgatggacagggaagcctggtgtgctgcagtatggggttgcaaagagttggacatgactgagcgactgaactgaactgattcagaggaaagaagtttcagtactataaatatttgagttcatttgtggcagaagccagcacaatattgtaaagcaattatcctccaataaaaaattagaaaaaaattgaaaggcattaatataaaacagctgtggtataggaagaagtgaaccttcatattcactgagctcttacctgacacataaaaataaccactatctgaattcccatttaaaaattcagaagccaaagaaagatttgtttatatactttgacacttcttctgtcccaatatgagtatccttgtcttgatatgttacaacattaacattttacattatgcatgagtggtcttttccccttagtttgaaaccaacccaaatgcaggtgatattttttcctaaatttgtttctttgctggtttcaaatagggaggaactcatgtttaaaataaaaaatgaaaaattttaaagctctcttcaaatagatgctgtatacttctgatttgtatatgctaattaacatgaggtggtaagcaaaatatcttaattcaggtttggtttatgtatcattattaaagataactttctataaatgttatatctgatcaaaaataagaatccatataggtccaggttttctctatccacttgattattttagagaaacaggaaaatacagacaagaaataataattttaaaaaactacaacacaattttgacaaccagattcattactactgtcatatttgctttgtcttttattaaagaaatattacagataaatataacaactgccttcacttcctaaaaggcaatgtcatatatgtatccatgatcaacacacagtactgttctttgcattgttttattaaatttatagaaatgttttatttcattgtacattttgctttttctgtcagtattatggagtgtaattatgtcaaatttgtatctttaaatattatgttctatcatagaaataaccatattgtatcactctatccctctattaatggaaatgtatgtattctatttagaggaatacaaaccatgatccagttaacacaaagatatatgtatctctgtgacatatgtgggt

SEQ ID NO: 54991 - DNA, 1206 bp, Bovine  19866881023732
aatgatttctggctgaattcccccaaagcaagatccagcccagggccctggggttcaggatgtgtgactctctggaggggacataccagaggagagggaaggcctttctcccaagtccagaccatcgctctttagccctccccccacagcctgagcctacacagtcccagtacctcctcctggacactctgggctggttctctaccacctactctgcccagttactgatccagtcccgccatgtgagtcatgccaaacacctggcaagagtccaggagtgcccttccctctgcaagttatctgtgatttcaaaactggtggcaccaagatgcagaaagccaaagaatgactaatgccacccccaggtactgtcctaggaggaagaggcagcatcttgtcaggcttaacagcaagatgggtatggggctatgagtgagcagggggtttacacacactggtgtcacggacactgttgggccagtcaatgaaagagatgtgcgggtgcagaaagggggtcccgacctctgaccaccaatccctgaggcaagaaagtgttcatcgtgtactactctttgcgaccccatggactgtagcccaccaggctcctctgtctatgggattctccaggcaagaatactggagtggggagccactcctttctccaggggatcttcccaatccagggatcgaacccagtctcccgcattgcaggtattttctttactgtctgaactatcagggaagccccaaagaaaggatgggtcaagttccttgggccctggaaaggaagctgttaggctgaagctcccaaaactgtcaacattcacccattctttctgacccacaaaaaaggcagtttcatatggttcaatcaaatgtaggccaggaaatgactcaaataatgcagtgccaaggaactggtcaccaacaagaaacagggatggtggtggcctctgtggaagggaaccgggtgctctatttttgttcctttggttccatgcacatgtggccactaataaaaacttaatgaaatgtttaaaaatatttatttatgtatttacttggctgtgtcaggtcttagttgcagcatgcgggatcttagttccctggccaaggatggaacctgcatcccctgaattgcaaggcggattcttaaaccctggacccccaaggaagtcccttaatggaatttaataactcaacacg

SEQ ID NO: 54992 - DNA, 777 bp, Bovine  19866881089292
acaggtgagaaaccctatgtatgtaatgaatgtggaaaagctttctctcaaagaacttcccttattgtacacatgagaggtcatacaggtgagaaaccttatgaatgtaacaaatgtggaaaagccttctcccaaagttcctcccttacaatacatatacgaggtcatacaggtgagaaaccctttgactgtagtaaatgtggaaaagccttttcccaaatctcatctcttacacttcatatgagaaaacatacaggtgagaagccttatcattgtaatgagtgtggtaaggccttcagccaaaagtcacaccttgttagacaccagagaattcatacttattagaaatagaaactttatgaatcttgtgagtatggaaaaagacttcagaaggaatttgcatttccttgcacattacataatgggatctagagcagaaaactgtgaatgtgggaaagcctttttaagaagccacacatttgtgaaacagaattcttaccaaggggacaaaatgtatgagaaagctgattatcaaaaaccttcagtagacatcttacctaatgatatttatccagcattctcactaaaatctgaaacaagatatttgctatcaggttatcaacatgatacttgagctcctagccattgcagaaaaagaaatactcttaacctttttatactagaataataataattagaaaatatgttgatataaaatatttatgaataaacatgataatgaattacaagacatatatatgtagttaaatattttga

SEQ ID NO: 54993 - DNA, 1474 bp, Bovine  19866881141548
cccccgtgtggcgggccgcccggggctccgccgtgtcctccacgtcgcactcgctgagggtgatctcgctgctgctgcggttccgcagcgggaggaaggcccggccgggggaccggggccacccatcctggaactccacatccttagaccgcctcctggcgagtcggtgcaaggctttggaccctgaggaagccggggtaggggtaccggccgggggctgtccgttctgttgtacgcttctcatggcatgggccgcctttgtggccttcgtgccatctgcgtccagggaggggctggggttgttctgttctctcagggcctcccgcttgggcggccagtcggccacgcgggcgcgcacgcccatcttgggcatggcgggggtggtggggctggggcgggtgggggcactgaccgtgctctcgcccacgggttggggcacgctgccgttctgcacccagaatcccaagggagcgtagtcccctgtgtgcggcccgggcaggacatcggccgccctggccccacagccggctgccaggtccacaccatcactggggatgggccgataggtggtcatagtccacgggcgctggagtgctgctggcccctgaaagctgtagactaactttatggggtcccctggccctcagccattgttcagggccaccagtcctaggatgaaggatgctggcccctgaagcctgatgggaaggttgtgagcctgtggagtccaattctccaccatcgctgtggacagcagtgcctggacagcctctcaaggcaggcgctgtcccgtggcctccagactgagtgggtcagcggggcagagcgagcagcagttgtgtgtgaaggctggtgggctgcaggaccgccttccctgccatgctgaaaagggagaaaagacagaagtgagatgtgaggttcctgctgccacagaatgacttattttttcaactttacttattaaaaaaaaaccaaaaacaacttttattatggaaattttcaaaggtacccagaagcagagagaagagcatgattagccaccctaccagcttcaacaccattatttctcattccttccatctgttccccaactcctccatggtgtttttgacaggactgctcttgtttactcactcaactgtgtccgattctttgcgaccccattgactgtagcccgtcaggctcctctgtccatcgtatttcccagtcaacaatactggattgggttgacatttccttccagaggatcttcccaacccagggactgaacctaagtctcctgcattggcaggtgaattctttaccactgagccaccagggaagccctttgacaggatattttagagtaaatcccagacatcaggccatgtcacctattgggcttcaaaaaaaataaccacgatacctttatcataggggcttctctggtagctcagatggtaaagaatctgccttcaatgcaggataactgggt

SEQ ID NO: 54994 - DNA, 835 bp, Bovine  19866881269165
attcttgtgaggatgaccccacccataggttggtagagaagggaatggtgtcataaaaacataggcctggccaattaagtcactgcaccccctcttccagagccctaacctcagggatggctcaaggtgaccctggcaccaaagccagctgatcaggtccacagatgagtctcaggacgtgagctgggataacaggaaaatccccagggctgctaagctggttggatatatacctggagctgccccagagcccatctgacaataaaaccaacagaggactgcagagccaggagatggaaggaaacggggtcccagcaaccctgaggtcgttacacacagaatgtcccagactgcaagttcaaacatttcctctcatatgtaagcaggctgacctgaatttctacttgttcacacaaccgaatgactctcaactgacacagaagggaaggcgtgagtacagttcttgacaattcccacagctcactaccaagacacttcagaaagcacaaaataaaattagaaacagctactatacatagaatcatcaaatacagaaaaacacacactctgtaaaaactcagaaataatctcttgggtggttgcagtccctaaagctggtctatgaaatactaatgattttgattttcaacgtgcttggaagggcaggagggaaccagaagcacctagaacaccttcctttatcaccaggctttccattaaaaaaattcttgggatgatcaggaagcccctgcctgtaaaattgtaatcagtgcctttttaactacatcggaaattgcttttctgccactcatttcccgcctttctttctctagag

SEQ ID NO: 54995 - DNA, 1940 bp, Bovine  19866881289335
ccatggccttggcgctccaggaccctcaccacattctcacacatggcaatcagggagccgttggggccattcagcatgatgtcatggatgaactcgtcaccaggcagggcgaccatgtgagctatttggagacccctgccgctgcgctcaatggtccaggtgaccactgcccccaggatgcccgacagaagcatcttcattcctgggtcatagcagaggcaggtgatgttaaagcgacagggtactacccccagggatttgaatgaccgaaggtggtccccaaagagccgcaggagcaggtcaccacagtagaccacaaggatatgaaaggaacctgtgtggaccatggactggatgggtggcagccgatctgtcatggagaacgttctcttctccaccatgtcctcagtcttgctcttcatccatactacagcctgagagagaataagatggaaactatctaggataggtagcagaagaggaaagggcataatagtcagctattttttcttgctaaggagaagttggaagatcctagagtgactttacccactagtttgaggaagtagaaatactgtaaaatcaggaaaccgaggactctttccctaaccctggcctactttaggagaagaataaaatctagtcaacatggagatggtaactggagaaaggatgaaggaggactcctgggtccagatcatgttcactcaaggggtatatcttcctggattaatctagggtcagaagttacatgggcatggccctcacttagaatgggctaaggagaagaaagactggggagttttacctgtatttcttttgtgcttgttgtcacccaagagagggaagaaaagaagtgggcatcactgaagtagtagcatataagcggcatgttttgaggatggcgagactctttgaacaggatctgggaccggtcactcaacacaactacatcagtcttcaggtcatctaaattttgctgggaagtggcatggcattaaactcagagaccagaaacacatatacaataaatatattctcacgccaagtcacaatctaaaccattgtcaaagttctgcctcagccccaaggaccactcctgtgacccccacacatgcagtttatcacctgtgggacacctgcactacacaagcgtgggacaaaaccctcaacacaagggtgagccaaaccactgtagggcctatgtggcgtcaggggaaactgatattccttccaatgtgaagttagctatacctgtccttgaacactttcccttctgtctaatagggtacatatgtcatgaaagaaacatttaacagattatcaaggcaagtacactgccatatgcccacatgtaaagtaacagggtgtcccaaaagtcagtgcagctttattaaagcctaaaattgcactaagtaagacttttaggacatgctacctggcctttaaatttgacagaggacaataacctatctctacacacacacatacacacatatgtataaatgatcccatggtgatcaagcatgtgctatgaaacatgcacctggcatccttctacaaagagccaagccacagcaaacctgacgttggcaaatgttttctgatgccttcttccttcttgtctagaaaaatctctctttccagagggtgagttcttctgacagtgctccaaagtgttcacctctcactatcaaaatgtcccagcgagaggtctctaggctcacttggaagttgatggcccacttcctgctatggggatagttgtccttatgattttccctgcctgcttcctctttccatagatgatctatgtgcctctaaaaggctcataactgttctgacagataggggccaataacatgtctgtcctacatatacattaccttgcttttctgtatcatgtcacttagaaggtatttaaagtccttccacagggg

SEQ ID NO: 54996 - DNA, 3064 bp, Bovine  19866881306594
ttgatacagagcccctatttgagttccctgagacacacagcaaattcccattggctatctattttacatatggtaacataagtttccatgttactctctccatacatcttcaccctctcctccccctcttccctgtgtccataagtctgttctctatgtctgtttctctattgctgtcttgcaaataaattcatcagtaccatctttctagattctatatatatgtgttagtacatgatatttatctttctctttctgacttacttcactctgtataataggctctaggttcatccacctcattagaactgactcaaatatgttcctttttatggctgagtgtaatattccattgtgtatacgtaccacgacttctttatccaatcatctgtcagtggacatttaggttgcttccatgttctagctattgtaaacagtgctgcaatgaacattggggtgcatgcgtctttttcagtgtgagtttcctcagggtatatgtctaagagtgggattgctaggtcataactgagacatttatatggcttccctgcctgacatgacacattaagacttcggcatgctgaatattcacatctaggagactataatacagttgacccttgaacattggggtaataggggccaataccacccctctattgcaaacctgtgtataactttacagttggccctccatacccgcagttccccatccacagattcgaccaacctcagatcatatagtactgtgcgtgtatgctaagtcacttcagtcatgtccaactctttgtgtccctatggattgtagcctgccaggcttttctgtctattggattctccaggcaagaatactagaatagtttgccatgccctcctccaggggatctttctgacccagggatcaaacccacatctcttccacctacactggcaggtgggttcttcattagcaccacccgggaagcccacagtactgtagtacacatttattattttttaacccgtgtatacatggacccatgcggtttaaactcatgttgttcaagggtcaaccgtataaacaactgaactgtaatcttacaacttctgtaaaaagtcagccattatttttcccaaattcatttatgccagttctttccccttcaagaaactaaaagacagccatttcagtcaatcaaaactaggttcagtgctttgctagttctgactatagatgcacactgcattgtttcagagtagacagtgagaaaatagtaaagattgatgggaaacataaaaattcatgaaggactctgcacacagattgctttacaagtatctttagattcttgttctactttaaataaattgaaactggaacttatagcctatgcactatacatgtgattaaatcaagaaaaaattggcccagcactgaaacaaggacaaactaaacatcaaaagacatatacaaaatatttagctactcaaaataaaccaaatactagtttgtagtctattgaatcaaagggctttattctagtaaatgatgctgatgcaaaagcaaaatattagcccatcttagagcaatgtaaaaggagaaatgttatttccattggcaggataacaactttaattaaaaagaaaataaggagctaattacctggtcataaagttaatttgtttcctgagatgatgtcttcaataactttgctgatacaagatgatatgaatgtataatatttatgacagaagcacttttagtcacattaacaccaggggtaatgtatccagagatctgtaaatgttaaaaccttataaccacagaactgtacttctgaaagtcaaaactgattaaatactaagtaatccatactgaattccaaataattttcacattctgctaatttcatcaaagaatcagaagcaatggaaagaaaaatgatattctcccctttaccacgttatccaaccacttaagttcatattcttatcatatgcattggttttccttcataaattggctcctacttctactcatttgctgaaagtcactgcttacagaaatcaccctctctcttgatgccatcagttttcctctttgaaatcattctcttcagcctttacacaggtcctaatacctcacatcttaagatactttccctgtaccccatgtgtctgcttttatggcaaaattcctctttagtgttacatacgtttattttcaccactgtctcactttcttttccttttatctcccactaactttaaaagaaaccaaaattttattacagagtatttctaacatacacaaaagtagaagagtaatattaaatgtacaagttatctatggaccagcctcaacaacatcaaccaagcccaatactgacctatgcagacccttatccactggtctcctcacattgtctgaagcaagtcccataatatatcttgtaatcacttcaggatttatctctaaaaggatttaaaaaataattgtaataccattacccaaacctgaaaaaatgaacagtaactctttgtcattgttgttgttcagttgctaaactgtccaactctttgcgaacccatgaactatagcacaccaggcttccctgtccttcaccatctcccggagtttgctgaaactcatgtcaaccatctcatgctcttctgcctccttctcctcttgcgttcagtctttcccagcatcagggtcttttccaatgagttgggtctttgcctcaggtggtcaaagtactggagcttcagcatcagcccttccaatgaatattcagggttgatttcctttaggattgactggttggatctccctgctgtccaagggactctcaagagtcttccccagcaccacagttcaaaagcatcaattcttcagccctcagctttctttatagtccaactctcacatccatccatgactactggaaaaacaacagctttgactagacagacctttgttggcaaagtaatgtctctattttctaatatgctgtctaggttggtcatagctttccttccaaggagcaagcatcttttaatttcaggctgcagttacaatcag

SEQ ID NO: 54997 - DNA, 706 bp, Bovine  19866881529025
ctcttcccaaacttagagctaggatacttaccaatctttcttacctgtcagccctttgtataataaaaccctctacccatgcattatctcttatccccatgagctgaccatattccaaactttaactgaagctgactctgctgggtcatgctctgtggaaccagcattaaatcagccatggtttctgtctcttgttctcaggtcaaacagacatcaagagatgggctctaaaactgctgttacaacatccaggatactgtggaagaagtgttcaagtatacttgggaagtatattggaatcatatcaattctctaatttcaacctacttaagtactctcttcatcaagttacatgagagaccttccaaaatctaccatccccagtagggaaaaccagagtccctgaaaacaggccagcaacaattcttcttcaggtggaatggagatactgacccttatcattagtctcatgaacactcccatcacacatagatgtctctgttttagtgttagccaatggctgacttattactgaagctacagccctggatgggacttccattgtctcgtgcagtgtgactactggctaaaggtttcactgcttgtacacacaaagtttctctcctgaatgtgtcctctgatgtctgatgaggtttgatttccaactaaagcttcacccacacttactaaaaatgttaaggcttct

SEQ ID NO: 54998 - DNA, 1389 bp, Bovine  19866880421496
cttttcctccagcttcagaacttggctgttcactggagtaccccatggcctttatgaggtttcagaaagcccctctctccagccctccatgacaataacaagttcacgtagacatgcattattattacagggctaattactgtgcctcaagatagcacccaaagagttgcaatatgctacttctaattaagccctggaacaacttcagctagttaaataaagatattgctcaaaatgactggggaaaaaaaaaaagatgccacgctgaaagaatatgaaagctgaacaaaaactttttaatgaactgacagctgagcaagagcagtgctgagagagattctataatttagactataaattttttaaaaagccaggacaaagaaacaaataacatggcatatcagggcaaagctgaagggatgatcaaacaaaagcatcattgatgctgtcaacaaaggcgagccactcaggctacaggtatcaaaggccacatcacctttacagaaccatcattatatcctacgcttcacacttgatgggattgaaatcttagcgatgccccaagtccacttgaagataagtcaactaaccagacaaaaagaaacatacacagaggctaactttttggaaagaatattttcctgtctgttgtaattcatgagttatttctaacacatatcaagctaagggagataaatacgaaaatcacattagaagcttctgcagaacaatctgctttcagtcaatgattatgaaagatatcgcagctcagccaggcgatcgcacagcaggatgcctactagatggggagtgaggggcttcagcctggctcaagggaactgacaagcaagtcctgtctaccaggagaggggacatgagatggggaaggggttgcaagtgggctccgctctgcatccctggtgaccctgtccacactgggcaccactggcattgcactcaaggacagaaaagccctccagtctgttcccgaatggacctgtttattcgccactggctgcaatgcctaattggcatctggcacatcacagatgttcactaggtattagccacgggaaaagaagggcatgatgaatatgggtggcgcacggacggatgggtgggtgggtggatggctgatggatggataagctggctgacccacgtcagagcgaaactgtttacttcagactggaacgcgaacatagcccaaacccacaggcttccaactgagatcacagacctggtttcaggacctaatgaagctcaggttcctgatgtctcatcacatcagaattcagtgagagacaaagtgataggtaagaagtagatttgttcagagagaaacacattccacaaacaagagtgtgggccatcgcagaggcgagtgtg

SEQ ID NO: 54999 - DNA, 4437 bp, Bovine  19866880501039
caagctgctgcctgctcctcgagttaatttaaggggaaatggacatagagcatcctttttctccatcccccccctggggggtagccgtgaagagtcaagagcgggtgagtttggctccccaggcacttgtgtgtgtcctggactggaagaaaacctgagatgtctgacttctccaattcttgatagtgtcagcagggctcagtgggctgcggagcagaggcctctgtttttcattctctttgcatcagatcacagtcattggggctccgtgcagctctgtctgactcacgctctgccactgtggatacatcgtgccaccctcgggcactggagcttcctgggctgggaagtgacggtggagatgcccccactgccagggggctccttggagccaccaaatgtgcgtggaaattggggcaagcccagggcagccagctcgctggggtgtgggaaggctgtcatcagtgggcctgggtgggacagacagcgtccccagaacaatacatcaagtctgatagccccaaggaggacacagcgttgttcagaggaagctgaaggtcaggcgcgcccccttgcaggccaggtggagcaggcaggtcacttttcacttctgggcacgggtttacatacacgaccccagctgtgccttcagagagtagaagaaccaggacccaagacagccatcctcctccccggacacatctccacgtgactcctggcgagtcccatccagccagcatgtccagaattgcgttgtttccacagcctcctgctctgtccttcccagactcagccggcgagctgggcaccttggctctggctggacgtgcccttcccgcccgctcccatctgctgggtctggggcagccgcctctcagcaagctccggggacttcctctgccctcacagaccttcagctgttttcactctggctgcggaaacagccttccggtgtgtcttctctccacctcgcccccaccctaacctgatttccaagtacccgagccaccttagggaaacctgagaccccgtgactgctcatcctgtgcacctaggtcaccgttgcctcttccttccatggatgttccagacccatcacgtatacctgccccctccctgtcctgtccaaacccctctggaccaacttctgagggtctctacacatgttcaccagagcacttctggctcatgttgatcgtagcgccttttctcagttccctcactcatcgagggataggctgtgttgacgtcagcgtcttctgtggtgcctttaatactgtgacaggctcagcacagaatctcggtttactgaaataaactgatgacctaaacccatatcccatcaattccattctcggcagaatgctgctgctttgttccctagttataatactcattagaagggacatacggggacttccctgccagttcagtggttaatatttcaccttccaatgcaggcaatgcgggtttgatccctggtcggagagctaggatctatcacacgttcctcttgggtcaaaaacaccaaaatgtaaaacggaagcaatattgtaacaaattcaatactttagaaatggtctacatcaaaaaatctttaaaaaatgaacatatatacatagaatgtgcccatgttatatacctgttatgtgtacatggatctcattctgatcgtttccaatattaaggctatgaacatagaaatgattcattataatgaacctcttttgccaccactctcgcacacagtaggtgcatgataaaagtttacagaatcactgtaagatttaaaataccagaaataaatgggcattcagtaatattaatccccgaactataagatctatccctttttcatgatatcctatggcaaagaaattatgggtataaaaagcaaaacattggctggctagctataaattatactctgaaatagctaaaattatagttggactgtgacctttctgaatacatcctgttacgtgtcctgcccacacgggagaatagtcattccttttaggcttggctgaagccccaccattggtatctttcttatctgtgacttcctctggagtagaaagactgatttaccacccatgctgcagctaagagctcaaatctgagggctggccaggtgcacagggatgagggaactgtgtttgagcctcccataatttcgagccacagtgaggtcaaagcagaaagactaaatactgtttgtaacctctacccataataatttcttgggtaagaaagggaccagatcactaacgagtggtatcaagcgtaactgaggccacactcctagcaagtcatcaagatcagagattatatttagaaggggtggataagtattaaatgtggactgccaatctgctgctgttcctggcctcaacaaagagcacacatttttaattaaaaaaaaaaaaaaaaaagaacaaacatctttaggcaggacatggatggtaagggcagttaaaaggagagaacacaggactctccaaaatcatttgcagtgagtcctgcaggtgccagggttgaagcgcccagccaggtgacctgagtcaggtcagcccgaggtcttggccatcaccgtcttctgttctggatcccgaggatggacagtctgctgctcagggaagaatgctttcttggggtcacagtgcttgagctaacatgcaaagcaacccagctcctcaaagcctcccgagttgaagatactctcaggagctccccatgttctgacatgagcagagagagccaagatatggacccatgacagctctcagcagacagaccagaggaacattagcttccggtgtatgtcctgtggtgtcagcagtgaccagcctgaagccccaagctctccactgcctccccagagatgtgatgtctatgggaccagtaccttcagggaggctgatgggggaagaagttttcagttgagggacccctgccaactccaggtggcttctcctgtcattgagtcacccaggaactttacatggtcattgctttaaggaccggatgctatatctaccccaaaggaaaatttccacggtcgtctaaaaaatgaattacactgatttgctcatgacactaacaacgtaaccccttcacactgttttggacatagatgactacctcattaatattgacttttgagggtcttaagaggagggctggcagtataattagcctttctctgctgaataaatgttaactaattgctttacaaataatatgttgagatgagaaatcagttttcaattttacagctgtactcagttacacattagaatttttgatacgaaaggttagtaaaatgtcactaaagatcttcaaacctaatccttacatactggggaaaaagaaatagaattctaatagaacagacaaagcttggattactgggttggggaattttcagggagaattttgaggtctgttaaatcacttttttttccctctcacttttaatttactttattaaaacatatttccttacatcagagcaacatcacctaaggtattatattctccagggaaatctgttctgttatctcttcccgccccatcactcactgtaaattctaggcaagagcactaagtattagacaaaaggctaatttcctccacatcagttcatgttgtttaagaagttaatatgcacaagtggtggtaattgaagcagggctggaagccacttccactaagagataatcactaaaggacaaagacggcaaagattccactccaagtgggctctggacaggccagcactggccccagttctgcatacaaatgcagttacctctcttaacaataagacttcattagtctccagacgcccagtcctgctgcctgccctgacgggctgccaccctcaccagctccctttttgcagtgctctgggatcagtgacacttccaggcacatttcatgtgggatctttgcagcttcaggtttatgttcttatagatgatgcaatgaatttccatcgatgatttgagaaaatgcaaaccgttaattctgtgaaatccttgtttcagtctcataaaatgagagtatttttctcgtctttcctgaaatcctccagtctctttggagaagaccttgtggaatctgggagcctctttgataagcaattaaagattgcagcacagtggagagttccccagctgctgtaaggatgaatgctatgtgccagccacaagccctccccttccatccttggaaatgctctggctgtttatccccctggatccctctggttgtttctatccctctagcttgggagatgggagaggtgttctagcatctagacccgctctaatgtggtgcccctccaaggtggtcccgtctcctgagtccaccatccccccgccggagcatcctggtttccttcggctccctgtcctctgcctttcctcactg

SEQ ID NO: 55000 - DNA, 1980 bp, Bovine  19866880779198
actctttttgttgttacctgtctttgagaagcaatcaaaataaagaaatgaaattttcatttaaaaatagtcttctagtttctgttgactcaagactgtgtgtgaggaaaagttttaacaatgaagcacaaaaaacactcagctcccaccccagatcactgcaacacagcgttgctggctgccctgggggtacctccgattgtagaggaaattgtaggaacacgggaaacgagaaggggtaagtacctgacacatatccaagacacacctaaaggggaaattgcagtaaacaaatcttataacatggaactctgctgaaccagtggtttgtcttcatgtcccaaaaaaaaatatggcagaaagaagaaggggccgacgggtagaccacataaatcagcaaagtgattgtcaagggggatggagccacagtgctgctcccctgaaggacgcattgatgggaacacatcacaagagccatgacccaccaggaaccaaccagatgatccgcctgacaaatagcagcaagaatagtatttttttttaacttaaaatgaatcatttaaaagaaaaataatgaaaggacttggcagtcacctaatttctcagtcatagcacctctgtacttaatcttgagtggtgaccctataaaatgtgtaatgccacaatgtgtatttcctggaattctatgaaaatctcattttccaaaattaattgcactttagttacattttatttaatcagatgatgagaagtgctgctcttccttaatcacattggagagaagacaatttatgcttcaaaaaaaattagcaagtctaactaagaatcaatcactgtatctacaggttacacaggcaggaatgaaagctgcttgattttaataagatatgccttttatagccttctctttcctttaccgcgcccctaattcaatgtaccatattggatgtgtaggatttcccaagggaaaaataattctccttgaattataaaactgtcacattcacagttcatagagaataatactgctcagcttctcatcaaaattgttctgcctggcactggattctaaagtttacagtgtaacttataaactgatttgggaatatcacagaaaagccatgggctgaagaagggaaattcaaggactgaccctccctcccaggacaactctggttatggtttcgtcactaagtcatgtctgactcttgtgaccccataaactgttgcctgccaggctccactgtccatgggattctccaggcaagaatactagagggggttgccattcccttctcccacaggacaactctatccctgcgtaaattcctgaaaaaactcagatgtgactttgcgtgcatgctaagttgcttcagtcacgtccgaccctttgtgaccctgtggagcatagcccaccaggcccctctgtccatgggattccccaggcacggatgtgaacttccccctccccagctcccatattaactacataccagtgttaactacttgagagcttttaaaattcaacatctagtccaagatttcatccatacacacacgaaagtaatttattccatcataaagttctgaaaaatggctttaatgaaactttgaaattatttgatataatggagctgatcattttttaaactcaattatgaatttattttttcatactttctaatgctctagcactagccaacttgtttctcagtaaaattcttcctgggcatatttaagggctgatctcttctcaggtctcagcctgggctacttggcatgcaggttggaacaccaaacctaaatgagggctttaagtaccctttccatcagcccagtagacaggtctggagaatagctacagaaaccattttacaaagtcacaaattagcattggcttcagctacactcaccaatgtcaggtcaacccccctgctggctgctttatccctctctctccactgctttgcagcaggaacc

SEQ ID NO: 55001 - DNA, 1047 bp, Bovine  19866881003313
atatgtgcgtaaagaaagtaaaatccctggaggaatataaggtccaaactcaactggaacttaagaccaacacaacttaagaacctcccccacggtccattagtccagtagttcggactcacctcttccactgcagggggcatgggctcaatccctggtcaggaaactaagatcctacaagctgtacagccagaaaagaaaaagaacaacacgtgtctgcctgcatcacactcatttcagattaattttctgccatcagctttgattggccttctgcttgtcttctgatcatcatctaataagacaaaacgggagataaatcagcgtcctagtttggggcactaagagattgtagtaacatgttctagcagcccattggagtttatttccttccatttcatgacagccgaggcattaaatagtcttacatcatcaggctgtcccctgccttctctgtgaccactcctgtggctttgaaaatccaatatgagacatcattctttatggcaacctccatagctgcaagcaaagcaattttagagaacacttttccgagaatagtttctacatactcggcgtctgttacaaattactccctggttttgacaacacttgtaaaatacggagtttaagtaatacaaatgagttgtcaaattttcatgatgtaaacagtcagaaaagttgtttcctatcaacaaatccataataagcagccataaagctaaacgattggacttccctggcgatccagtgggttaagactccaggattccaatgtaggggcagtgggtttgatccttggtctgggaactaagatcccacatgtctcataacatggccaaaaagaaaaaaaaattacttaaaaattatatatttaagaaagagtcaactacttatttgctacccagccattcctgctaactgggcactcggtggttggcagagaccttgagaccatttccttcatttcccagagtaaattcccaggggcagtggtgtttgggctacaacataccccatccacaggaaatcccaggtccagctctc

SEQ ID NO: 55002 - DNA, 1683 bp, Bovine  19866881005548
ccttcctggtgcctgacacgtaggtgtaaaatattcgtgagcgcctcttatgggggagttatggattttgttttagattctacatacatatgagatcatccagtgtttatccttctgtctgacttatgccacttagcatagtgccctcgaggtccatccatgttgtcacaaatgacaggatttccttctatctcacggctgagtgacattcttttgtaatatgcaccacatcttctttatccacgcatccttgaacctcgtttcagggatgtgtgttgcagtcatttttttcttagtgacttctcccccaccctactgaatagtagcttttgttggttgacattaaaattttttgtctgataaaattttttaaaaattctttgaggtgacttccctggtggtccagtggttacgcatcctccttccgatgcaagggacacaggttcaatccctggtcggggaactaaggtcccacatgctgcaaggccaaaactagaaaagcctgcccactgcaccaaagagtcagcacagccatcaacatgaatgaataaataaaattttaaaatctctgaggattcttgcagaaagaaagtcagtggacttcctgttggtcaatttgtcataacaagcatggtgaccatacagatagttaggctcagtgtttttcctatatggaagctccaggaaatgcagtttttgacatgaaatcatcttgaagattgaacatggaatgacatcattatgtgtcaagctcctcttttctagacccaagatcggaaataaagttgagaaatattttgtctccatcttcagcttgacagtggaatactttaaaaaatcacatatgtaatacatttgtaggtctataaagaaatgataatattgttgatataatttctccgtagactcgaaatgttaggactatgacagcctctctgcatttttgtttgtataagatgctttcatgtgtcacgtggtatgttttcacggaatcgtgtgcatttgtgcacgactcttggatgctatgtggggaagtcacttatcctcagagatgctgagtttagtgtcgctgtccaacacagagtaggtgctgaacgaacagtgactaactgcccgactgaaaagaatgaatgtcagtaggaagtgttattacaaggtcagctgataaagcacatgacctactccatagtggttcttttccaggaatgaaactccattacccttgttatttttaggtccacaaataaataaataaataactccagatgcaggtatgcaataaacaaatgaagcctcttattcttttgaggctgtattagctagtgcatttccttaattgaaatttgttctcagtgtatcataaaactgtgcacgggagacctgtgtttgtactgagccagccactgactgcaggtcaggcagctgcagggggttgcttgctgtctgctggagcttgctgtttcttcttaacctttccagcaagacttcagaggagggtttttacttaatactgtacctgtcaaattcccaaagctgcaagaaaattgaaaatacaaattatattgtaaagtgaaatattttgtgtgattctacagtgtggttgatttaggaagagaatgaactctgacagccctgctcttttcagttcagggattctaaggttccaaaacaaaagcccccgca

SEQ ID NO: 55003 - DNA, 2204 bp, Bovine  19866881075938
aagccagcctgggagactctactgcacacctgtgtcttaatgtgtggtgaccctggcctccctgggagatgctccactccaaccgctgtcttcactgccacatactcgccctgcgagctggtgtctgggcctgttttcacatctcataaggacaccagtcacaggatgaggccccaccctactccagtgtgacatgcaaactcgatcacatcttcaaagatgctatttccaataattcacggacccaccctactccagtgtgacgtctgaactcgatcacatcttcaaagatactatttccaaatgatgttatattcacaggtcccaagggataggaagtcaaggtaccgtgccagggacataattcatcctgataggtgctgaggcaggctgcacgctaccttccccaagctcctctgcatcatgtgatgctttgtgagtgaaactttatgaaactttacgagtgaagcaatcaccagacttctgtcactgtcaggtccattttctcgtctctcacgagtagggcttcgcattccttccccaggccaaaaaaggcaggaaattgctgacaaatgtgtccaaagtgatgctctgctcgctgcaggctctggatcttgcgccatcaacccagagaagtttgtgaggtgtttctcttgaaatcaacccatagcggcttttacgcatcttcatcagattgaacggagcctgactctgagcagatcatcagcttccgtgctccccggggcaggaggcaatctcgggtgcgagacagttgatggcacagttggggaggagaggaacgctgaggggaaatgctttccagttgacaatggtcaaagcaattgcttggctcactcaaggagagctgaaggatacaccagtaaatttaaaaagaaaggaaaactcctgattaactcaaccatgagagataatttaatgaacagatttcattttagttaatgaatgatttattgaaaatgcaagcaaatttacccttagctacaattatcactagataatttcaaaagggaatgtactgtctaattagtcacagtcttaaactaaccttaaacaaagggatttcatctctgaaacatttgattagctgacttgtgctttttgatactaattatcatgcaggtattatttgtatggccattaggttttaaggtcacagaacatggtgtcattaagtatacataagcaaagactaaaatgatggtgttcataactaggcataaatgtgatgtgaataacagtttttaaattcacactgattcacacttaagtgattatctcccttacagataggttatcagacaaggtgggaataattacttttccaatatgatgtttggtgagataattaagtagtgtttgtctcccctcaagataaaataaacaaaaccttgaaatgaataatcttcagatcacgaagcacagaaggcatctcaacaggtcatgatggtggcattggaatcttgctgcaaaaggatgctcagaactgccatcactttattctaaaaatgctttctgcctcctcctgtctcatggaactgactttcattgcaagggtttcttaagctaatggtagaagagtttggttttcagtgttccaagatgctgaagtcttactacagagagttactaacatttattactataaaagtgatgtaacatgatggagaggcgcttcctttctctgagaaacatcattctgttgttgcattagaagaactcggtgagaacacaccccatctgaggcttccttcttcagcatcagttacccaggttggtccttctcttccttctccttccctgctcagtggcccctcccagatctaaccacacccctggtcccgaattagggctcattattctcatgacctatcgcctctctgccttccaccaggataacctacgacttgcttctcggctccagggctatacttgcatgatcctactggtcagtgcgtcctacctgtaggcgtctcaaaccacgcgtgcgtacatgctcgtgcagtcccctcagtcgtgtctgactctgcgactgcagggacgatagccctccaggctcctctttccatgggattctccaggcaagaatactggagtgggttgccatgctctcctccaggggatcttcctgacccagggatcgaacccacatctcttatgcctcctgcactgccaggcagcgtcac

SEQ ID NO: 55004 - DNA, 1657 bp, Bovine  19866881260193
tatggattgttacagttctgaatatagttccctgcactatatagtagatccttcttgtttatctgttttatgtatagaggtgtgggtatgtaaatcccagtcttctaattccctttggtaagtgtatgttttctatattgtaaatttatttctcttcactcctccaagttttcttattccatctgtaaaataaagggaaagggtttagcctgtactttcttgttctgtctccatttccagccggtgatcttctctccagaaatgaccacccctttaaattggaccatgaacaccaagacaaacttcggataggctgaaaggtcaaacgccatcctcagctggcactggggcatgttttttttaaagtgtatacagacatggatgtttaaaagaagtccgctgagtgtgtaatatggtagtcagtcctttagaagtgctttgtctttgtattttaaactaatcagagctccaaaattactataccagttgtgcagcttttgcctagctcatgatttttgacactgtggtaagtttagtggagcaaagtctcattcacaccccactcatgcataatttgggataattaaggcagtgctgggccgccattcaccttttccagcaggaaaatgaagctttaccagatgaatccgtattgcgagtgggattaggtccctgatggtgggcgtatacctccccagagaatagcatcttttttcggtatggcagtgtacatcagtcctcaactcttctttccacctgatttctaccaaggactttagaagtgataaattctaggtcctcctacagctcagaagttctgagttcttgccagtatcatgctggcaagaaactgggacattagtttcctttgaaaacttgaaagtgatagcaatttcatttttgaaaaagttgcccttctttactcagactgtctcttagccccctgcttcctgtccccgctccagagtttgattgatacttgcttttgtattataattgctagttaatgtctaaccatcgagaagttcttccctgcagctctgttccactgataagaaaatgttgcatcatctggagtgttgggttgggtagtcgtggccctctgggttatctggcccagctgactcttgcctctcactgagttgagcatgcatattcttgctggaaggaaccctgagtaggtccttaccattccatatcatcattcacacagagtctgtctccaccagcctgtcttcctcgctaggctgttacaaatcagctttatttattctgtgtttgaatttggagttccctacccaataatttaatatttttaaaatgacactgttggtctctgatttgtcgtgagcgaggatggagttagccagcctgcaatttgctgctctccccttcaccctcccagcatctactcattagctcataattgttttcataaccttctcggagtctggtgtgatcttactttcggccctctgtgacccctccaaggtagttaaatgggggttttgctctctctatgaattaaacatgtcatctctatttgaaatgttcctgaacccacggtgctatattttagcaaagtaaatactattttcagagaatttgcaatccatccatttatatttccttttattaggagatataatgatctgat

SEQ ID NO: 55005 - DNA, 707 bp, Bovine  19866881294296
cggctgtgtcctgggaggtagggatgaggagccggtgacaggcagcatctgccttttcatgaaggcctcacagggagatctaagataccagagccctggggggtaggagagggtgctgcgaaatgtcagagaaaggtcacggaaggctttcttcctggccccatatccgagtggctcagtgtctctgagaccttgaagatggggcctgagacgagactgacaactgcgtgtctctaccatcccccgccccccaagaaaactggtgaaaaggtcaggaaaaggaaaaaaaaagaggtctctgactgtgcctgctatcagaagcaaagttccaacaaagttaaaagcatctcgggaggagcatggctggcaagtggaaatgattctggggtagcgaactgtgatcacgggcactggattgactttcccgcatgcttctcctgccccgtccctcagccctgttttctccagaagatcttaaattccaaggaaaattctcttctcgtgtttccccgggggcttgtggatggagtgtttggttttagatttcagaaaagaatcctgctctcaaccagcatcccccagagggggccctcctccacctcggcttcggggcacaggacagaggcacaggagaccccgctgccaagttgttcgtcttttaagtgacgtggtgatttacagtaagttcagatctcctagcatgtaag

SEQ ID NO: 55006 - DNA, 704 bp, Bovine  19866881380512
aaagcacacctgctgctggtgtccacggagatgtgaaacacctggagccgtcactttctgggacacctccagacacgctgagcatcgctgcttcctccacggttcctttttccctagcgtgccctgtgcctgcatctcacctctcacgccttctttgtgttgactcctcacctcactgcttgggcttgacaaaccctttggctatttatagtaggagttcatgacacgatcaacacactaactgaacttcatagtgaggatgtatgcttcctgttcatactcagtaaagcagagtggaataatttgaattctttatgatggatatgattataaatgatatccctatttacacatataaaaggctaaatggaagatgattagtgaatcctgttttccgtttttcctaaggtgatttcttaatcttccaaacagattcctatgatacagagaagaaaaggaataagcccattagaagttacttaacatttttacaaagctgtttaaggctttagaactgagtaatttttgtccctttattatgttttgacataggagaaaaaaagtatagacatccatttcttctgtacgttgttaacctggtgacagtgtttttagatgttttactgatgacaatatccagttactggcacttgtcataagcagaatggtgagtctttagatttaacaaatattttccctctttt

SEQ ID NO: 55007 - DNA, 1084 bp, Bovine  19866880379104
gatgcgttttgaactgtggtgttggagaagactcttgagagtcccttggactgcaaggagatccaaccagtccattctgaaggagatcagccctgggatttctttggagggaatgatgctaaagctgaaactccagtactttggccatctcatgcgaagagttgactcattggaaaagactctgatgctgggagggattgggggcaggaggagaaggggatgacaggatgagatggctggatggcatcactgactcaatggatgtgcgtctgagtgaactccgggagttggtgatggacagggaggcctggcgtgctgcgattcatggggtcgcaaagagttggacacgactgagcgatgacagaacaaggcaaaagcaggcatttccttggatgctctgatacattagcaagggcttagctgagtattcaaaggattctattaaacagtctttacaaatcagctttatttgctaaagtgatcaaatgatgatcttccaagtgaaatggacactgcatttcattaattcagcaccctctttaaggaggaagtttaagcctgaagaggtccagtgatcttctaggtccctgcgaatgattggaacatgaaccagccttcagactggagtccatagaatttttcataattctatgaaatcaagttaaaaacaaacatcaaaggcaaaacttcagagaaaaggttttgcataaagaaagcttacacttgcgatggtgtatgtacatttttttctcttcttggttataggaatttgaggatggggctaagggagactatgtaagagaaggggaattacagggtggggtgaatgagggaaccacttctctttctgaggcaggtggcccctcaaccattgcatgttgtgttggactttgtaatacagtgtatccctaaggagagagcttgcctgtgaatccttgcaatctaagaaaaggcattagcaaatacaagataaagcacaaaagcttatttttcaaaaggtttaacttttgagctgaaagataaaagatgacgatatccatttctactgggtatacaagtcttggtaacgggaaagcccaaggag

SEQ ID NO: 55008 - DNA, 1470 bp, Bovine  19866880436345
ttattttttgtcatttgcactagctttgcttgtttcactgggtatccatccatagagctcttcatactggtgtcttgaaagtggcatctcctgagcttgagtcttgaaggtaagataattaatgatgatccaaaactatttaaagtctttatataagtgattttcattctttgtatcccactaatttattgttgtatccctggtatggaaggcgctatgactaaacgtaattttctctgctacctatttaacctatttaagaaaaaagatttttacaagtatgttttacatcaagaccaaccatatagctttatgcccatttaatcctctataattattgcttccaacacaatgacagaatagattggtatcagaaatagaaaaacttcagattgccaggaggagtcccctaaaaggaatatttattttggggtttatgatgaaaatgacatgattttaaatgccatcaactcagatctctaaacccaggtaattatttgtattacttgaaataatccagaagaatttttggactcttgtaattctagaattagaagtgattttactgggcatttggcccaactatttcaatgatatagccacaaatatgagagatcacttgtcagagatgagacaaattcatatcttttgatcaaagatcactaataattccttctaccatgctgctttttccaactgtctcttgtcctcaatttaatggttattctaaaacaaaatggataacaagttcatttttatctagttatgaatgaggatatatctgagcaactctctgcttctattgtttacttttaacatgtaatctgaaaaaatccatttaatatatgtgatttctaagttgttatgtctatttactcattactattttctaaatctttaattttgattctatacattatgcatctttttcaagtagaatctcattttgtagttataagggtaactaaagttcactgttattattggtttctcataaacagtatttacagtaacaatttattaaactcctcaaaatctgttggcacaatttttccacccttttccaactaaatattattgactaatgtatataatattttcatttattatattcttcccagttggttgcaaagccctctatcattacctcccagttgacagcaattcagtctcatccaagcaaaagaactgccaagtaatattatacaaataaaatttcaggttaaaacaaactcagatccattttatatgtgcaaataagttatgcatgttactatttttctcttaaaaatattatattgtatgagatcaaagcatagtggcctccattaaaatgtttttaatttactacctatttaaaatcacagctcaattcttatctcatgattacctttcctactcaaccagttatttccataacacttatcgcgcctggcgcattacaacagcgctcgactatcacatccaggg

SEQ ID NO: 55009 - DNA, 854 bp, Bovine  19866880543222
attccatggactgaatagtccatggagtcacaaagagtcggacacgactgagcgactttcactttcactttctcaggcaagaatactggagtgggttgccctttccttcccaggggatcttcctgacccagggattgaacctgagtctcctgaactgcaggcagattctttactgctcagtcacggggaagcctggacttgcctggggagaatttacatatgcctttttgaacttctaatagagtctctcttctgagtaaccatttaaaagaagattaaatttaattaggctgtatctttttcctgtgacatgctgccttcaaagcccactttattacatccgtctaccccagcagagtactaatgctggctgacacagggcaccttcaagatgcaggaggaaggacagagatatttgcacactcactttatcctctgggagtatattggaaagggctgacatgcgacacctatgccagtccagcaacatgcctgagtaattattactcagggaccaattgacaggctgaaggagtcacctgacacccccacccccgacctcagccacctgccctaggtaggagctcagagccaccttgagttctatcatccatttacaccctatctatttcttttctaacactctatcattctctgaatttattaataacaactgcacctcaatagtagttggtatgaactcacttaaggagaagcatctgttttatcctgaaacctaggcatgatctaatttatgaacttttcagtctcattcactcttgagacagtgttcacacatatactgtgaatagtattcattcaaacagaagcagtgtcgaggctttaaaaggatt

SEQ ID NO: 55010 - DNA, 2542 bp, Bovine  19866880571784
tggaagtggaaaagattctgatgctggaagggattgggggcaggaagagaaggggacgatggaggatgagatggctggatggcatcactgactcgatggacgtgcgtctgagtgaactccgggagttggtgatggacaggggaggcctggcgtgctgcggttcatggggtcgcagagagtcggacacgactgagcgactgaactgatctgaactgaggacaacatgatcactggctactagtaacaggtggttttcttttgacacagaacttaaaagtttttaattattattttgaaattttcagtttcctaatgaacacagggaaaatgggcagcacagggctagtattctggaaaaagactagaagttcttaaacaaaacaacacaataggtgactacagggagacagcattatttaagtgttaaaactacctatcattcaaatgaatgtttttattcaaagtaacctccactagaagctgttatttcagtgacaactttgttctaagtattttgaaaatgtcagtcttggaattaattttgtacacaataccagctgtgcaagaaatcaggcactatagctttgcatgtcctatgttcttggttctttagtcactcagtcgtgtctgactcttgtgatcccatggaccgtgacctgccaagctcctctgtccacaggatttcccaggcaagaatactggagtgtgtcaccattttctcctcctggggatcttcctgacccagggaccaaactcacatctccccatctcctgcattgcttgtgaattctttaccactgagccaccagggaaggcttgcacattctatgtaacagctcaaattccgtggcctccccccaaaatagcaaaataaatgttatttacttagaatatttgctgcctcctcatgtcattgataaagccatgcaactaaaccgaagagcttttagaaattttaaacttgtactgagaactattaatttcaatacataatcataggcttaaatttttgcatcatcatgtgctaaacagaccatgtgaatggtcatgaaccaaatcactaatccactctgatttcaccattgatttggttacatgaggtactctgtatcaccagataaacatgtaggaagaaaagttgcctacatagcgcaggtgagatgtcacaaaccagttaatatattttggtcctcgattgccactttataccagctcaatattagtgcaaattctgcagccagctaaggactatcacgcactcctgacactgctgtttacaatttcaagaatgatcatgtccctccacttaggaagacaaacattttaggagcaaaactccttaaattataatctccaatctaaacaaaacctctcatttcttatcatgctgaatagaattattcctccttaaaaattgttgaaatattggctgatggagtatagcagcatggcgggttttttaaaggaaaaaaaaaaaaaaacaagcaaatgccaataataagtagtgaaataaaaggacataattcctgtcttacaaatatttatactgtttctataatggataatggcaatatagagtataataatcctccaaagtcatcaccatattgccttcattattgttttcaataaaacatcttgctttcaaagggatggtgggaaatgtgactaaaaatgtttgtaggttaattgcatagattacgtgtctactgtgtgctctattagcatcagttcagttcagtccagtcgctcagtcgtgtccgactcttcacgaccccataaatcgcagcacgccaggcctccctgtccatcaccaagtcccagagttcactcagactcatgttcatcgagtcagtgatgccatccagccatctcatcctccatcatccccttctcctcctgcccccaatccctcccagcatcagagtcttttccaatgagtcaactcttcgcatgagcataaaagtagttaatatttctagagaacttactatgatctggacactatgtttcacctgtaaagaaagcactaccagccctatttcaaagaagagtaggcaggagctcagagaggctagtaacttgcttttggtttcatccctaagaagttagtaaagccaaaatttaaatctaggtctaactccagtttgcattcttactatttctgagagttctgactaatcctagttgttgaaatttttagtaggaaaactctcagtctcttgaggctgaaataaactgttgtaaatgacaatatctgtcagctagagaaacacagtttaaaaccatgtttaaatctgagactaaattccatgtcctatttatcatttcaacaacaattaaacaaatttctttccctgatggattaacaccagtgtggcatatgatatatttggaatccaccacccagtctcaaatggccagaaaacagcagcagctttcatgtcatttctaagcaaaagttgaaagccaaaaaaaaatcactggcaaaattcactctggtgagactttcaattttattctcccctgaggttcaaacaaa

SEQ ID NO: 55011 - DNA, 2048 bp, Bovine  19866880593861
atgtcagatcacagggttaagcctaggtcccccaaggctaggtgagaagatgctataggtacaaggaagggctgccttaagacaagccgtaaccttctatcaaagggtctccgtaacttactagcccttcctgccttaagacaagccgtaaccttctatcaaagggtctccgtaacttactagcccttcctgccttaagacaagccgtaaccttctatcaaagggtctccgtaacttactagcccttcctgccttaagacaagccgtaaccttctatcaaagggtctccgtaacttactagcccttcctgccttaagacaagccgtaaccttctatcaaagggtctccgtaacttactagcccttccttccagtctgcttcttaggctctcaatgggccacattctgttagaagccactaatgttgtccacccaactcagccttctgggagcagagaacagggcagagaaaagtagagagctgacagggaggggcaaagggattgattcagcaagcagaatcttacataatgttcctagatttttaccaggttttctagtaaacaaatgtgctgctagagttttgctaaattaagaatttacattacaaaggcccatggcaacccagtgatagatttcactaaacagaaaacagtaattaagattagtagacattaagaagttaataatgaatcaaagcatgccttttaatgcactgatcaattgtgtattgtttaaccagtgcataagaattgtttattcacctgcacatttcttaggagcttgacaaagttttaaagaactttgtcgaaaacctcttccagggaaaaaaaatttaaagacagctaaatcttctttccttattctaaattagtaacattatattaattcatttacttatcactcaagatacattaatataagtctactacttattcagtattgagtccttgaactttaggagttcagctagtcaataaactctaatggaatgccaaccactatgaacaaattaaattcacttaaaaatacactgagttaataaaactttcaaaatgtaagttcttttaaatcatttacccttcacaggaaactatgccatttcccttctttctgtttattgctgttgtgatccgtgctgaaaaatcagcatttcaaggatcagctatgtgtatggctttactttttaaaaaatatattgaattatttggtctgcaaaacatcaaaaggttggaatatccatcaaattgcagatttcttaaggtcagaaattatgttctctattccactggcaattttatgcttccttattcagggtcacaaacagagcagttactaagttcatatagttgcagatctcaaatttaagctcagttcttaatctctgtgctagactgactgaactgagtcatgccttattttttctgcacatgtgaaaatatcaagcattccactgccaaatatttatgattttatctaccctcttaaaatgttaatatttctaccttccatagtattctgctagtgaatcactgctgttaaattaaattagatgatctcacatttttacatactttaatggcgagaaatattcccaactcaacagctttaaaacaatatggctacatcatctgcaatcctgagagtctgtacagttcagttcagttgctcagttgtgtctgacctttgcgaccccatgaatcacagcataccaggcctccctgtctactatattaagaacagagctcaaacttaataatccacactcacaactgaggtctgaaaaggaaagctgcggtgaaattctagggatatatctaaaaacaagtgagtcatttaatattattatgatacagactcctaatgtggcaagttgcctctgcctgagaactataatttgtaccactcagaaaaaatgggaagtcatttttgacagttctttttttttttttttttttttaagcagaaagctcttttccatctgcttctagctttctactgggtggcttaaaaagttccttcgggattttctgtaacatcttacgggaa

SEQ ID NO: 55012 - DNA, 1282 bp, Bovine  19866880756829
atataaattataagtataaatgtagatataaatatgtgcagtttaaatatcatgattcttatgatatttccatttcagaaactcaagttataaacgaatcacattctttgatttcaatcatgatattgagtcatcacaatataggtatagtcaagtctcaacttggatttccactctttgttcttttaagaagcaggaaatcttataatccctgaaaaggacacaccctttactgctactgacagcataactacaatctaattaatgtcagtgttcagtagattcattgttagaggccctgtacttcatatcaggaataagcttattaaagaaattttccaaatagtagttacaaattaaatcattgctgtatggaagggagggtgaaatccttttctctcagttcagttgctaagtcatgtctgactctttgcgacctcatgggctgcagcatgccaggcttccctgtccatcaccaactcctggaccttactcaaactcatctccatagagttggtgatgccatccaatcatctcatcctcggtcatccccttctcctcctgccttcaatctttctcagcatcagggtcttttctgatgagtcatttcttcacattaggtggccaaagtattggagttcatcttcagcatcagtccttcccatgaataatcaggactgatttcctgtagtatggactggttggatctccttgcagtccaagagactctcaagagtctactccaacaccacagttcaaagcatcaattcttcagcactcagctttctttacagtccaactctcacatccatacatgaccactggaaaaaccatagctttgactagacattttattcacacattttatctgttaaacaaaacaagtaataaactgtgaattcaaacctagttaattcagtcatgagttatatgaaaatctcattgtgaaattcagggccaaaattcaccaaagtaatttctataaaatgtctaactcactttagcaggtgtcacaaagtactataaataaattgcaaaatcaaaaactagtaatgtaaaattatttcactgaaattagattattttaaaatttgcttagtaaggtatttgaattagttttttaacgcaaattctctttccacttgaacatcccgcaaaacgcatataaatgatatatgaagtcgtataacctaccatatatagctcttagatgagaacatgcactttggaagaaccaacccaattcattgacctcttcaatctatgcttttcccatgtgcat

SEQ ID NO: 55013 - DNA, 535 bp, Bovine  19866880793753
tttctacctaatggaatgttatacctcttcctattgtcaatttcctcttatgtgtgcctataaattcatgtagttttcctcagagaggttttgcgtattcttattaagtttatgctaagaattttgtatttgtattgattgtcaaaggattacttttatgttatattttctgtttatacttactatatttgattgatggctttttaaatatttatttataactgactgacttcactgaattccctgggtagttataattcaaggacattataattcaagtcttctctttgtgtgaagaatgctgtgtgtagcagctaaatcttcattccggtttaggatgggattaagagacagggtagaggggataaactatcctcaatttcacctttagagttaaaaaatgtgctatcccttttagttaaagagtctatacttcatttttggagtcaaatattgtcatgactaattataaaaagttttaggtaagaaggtgactaagaaaatataatgttgttgttcagttgctcagtcatgt

SEQ ID NO: 55014 - DNA, 1354 bp, Bovine  19866880989887
ctgtgattcttcttacatgctagactgtagtctctacccactacggggttttgtgaaacttccccttgcttcccccaaggaatcatataaagattgttcaccagtgttgtatgtcattccatgtgacgtctgcttacttctccagctttatgcttttatacctcccacaaacaccacttgaggtcctgtagtagagaagaacaaacttgattccatactggatctgttccttattcctaactctaacccttgtgttctgttgcctgtgcttagtcatgctggtccagctccttttgtaaaagaatgttacctaaagcctgaaactacagaatggccccattctcaaggctctaatctttaaaggaataacacttttccattcatatagagataaaaagttgcagacagagaataacataggaaccccatgacctgacccatgtagacagctgcaagaacaaaggattcctgaaataaggagtgtgcaacaaccagccacactccctcccctttttgtataaaataagcctgaattctaacctaggtaaagatgattctttggaacactaacctgccactttcccggtctatttgctttccagataaagtcgctcttcctttccccagcagcttgtcttttgatttactggcctgtcccgtggtgagaagcacaagcttggagcctaacatggtctctgtgcactctgtacaatttcttcctccatggcattacacacattgcacccactagctagaatgctttccacagtctccacccctcccataccccctttgcctgggtaacctttaacgccaggttgattcattacccctccaggatctcatctctattctctttaggtgggatttggttttactcttaaaggctcccataagccccccatgcatgcctctatccagcccttataacactgtcttaaatttgtttatgggtctctttttcactgttaattagttgagaaaaacagtacacaacagtcaactatggcacacagtagttgcttttctatgttgcataaatttaattattccattaaactacataatattgtacatctatgcaaagactagtttctaacaaagggatggaaataatttaacagcaaattggaatattgagaaactgtgatagaaacatatgtcaccagtgagagaaatcttaacgcatgttataaaacatcacaactcattctgttatttataacctggaaaatccatctaagataggaaatggtgtataaaacaacccagggttgcaatggtaaatttctagtttaaaagtagaaattacctttgcattggtatgatgcaggtaagactcatattgctcaat

SEQ ID NO: 55015 - DNA, 349 bp, Bovine  19866881142449
catatgatgtatagaggctccttgcatgggcactaagaaaataccaagtaaccaaaagattaatgtggactgtgtttacttcaagatcatgagtataaattgatttatacagtctgaattcaaggacgaataacattctcagagtaaaaatctgatgaataataatattgtgaagcagcttgatttatacaacactaataaaaagtccttgcactgcattggtaaaataggttttataataccaattgtcagtgtttcaattgaacatatattttttttaattttcaggcaggagatttcatttccttgaaaaattcaagaagtttagcattttgaaattgataaattt

SEQ ID NO: 55016 - DNA, 856 bp, Bovine  19866881174274
gcattctttctgcaaggaatgtctccttccactcgtcccaatcatacgcattcatcaaaacccatcttaaacaccgtattttccaagaaacctgtacctatcccttcaaaagaggccactgtccctctttttcacttcatcagacatggttggtacttcttcatggcctttcttaggtagatcatatattacagtcttcagtttattcgtccctttactatattatataatactgtaaaattatggatttcttcttaatatcaactctgtgtgtgcacgcacaatctcagtcatgtccgactctctgaggccccatggactgtagcccacctggctcctctgtccacggcattttccaggtaagagtactggagtggagtgccatttcctattccagctgatcttcccaacccacggatcgaatctacatcttttgtgtctcctgcattggcaggtggattctttaccactaacatcacctgggaagcccaatatcaagtgtagcaactacaaaccctggtgcataactgtaactcaataaatactgttaatattattttaactaacatctaggcagggaagaaatatttgcatgatctatggaacaaggaaaagggtaaacggtccagatatgtctctagatgttctcccaggcggccagcatcactggcgttcccacgatatgttttacagagataactagaaatgttcagcttatattgaatatttatcatgggcctacttactcaatttgctcatgtgtcagagaaaaatcattcactatattctcaaggtatatgaagaatgtttaataaatatcactgcagaaatatagaaatgtccatttcaatattct

SEQ ID NO: 55017 - DNA, 1085 bp, Bovine  19866881186504
taagagcatataacatttaagtatttataaaagacaccttgggaatactctaagaatgaaaacaatattactttttaatgttaaaaagatcacaaaacaatattactataatctgtgcatatatacactatatgctattttctagcaactattacattagaaagctagaaagcatttaagaagacttgtctttcatagaaaattacatcctttaaatgccaaaatgcaagacaaaagatttcaagtcaacttttaatgttttgtcatgcaattttgcttcagcatatttggacaatttttaaattgcgttgttttaccatgactttaatcatattaacagtttcgtatgtcctataagcaataggcatataaaatcataaaatattattaacaaatgcctttactctggcttactacaaatcaataaggataaaaacatacatactaagaatttaagactgcatcatttgaactgaatgtaaataacatggttatggaccatttatgaaccactctgatcgatcccaggaccttaaaggtctttgggcatttttcccaaaccaaatttctcctcttctaaattatcattggtataaggtgtgatgactttcaggcatcaattcatacaaattgaaagcaggcaaagtattaattaaacttgacactctgattatttaaaccttctattaaagctgattaatcatagcatgttgatagcctgctcttcagtaatgacagatgatatcaaggcttactgactttctccaagtccactatttccaactcttcagaacagaaggaataaatgaagtgagaagaacactggaacaagtctaatagacagactgactaatctcagacccccaaggtcaaactaaagcaatccatttcttggctttcatcaacacaagacatgatttatccatctgaaagcaggattacaaacattatacatctcaatgatatgttctttgcaccatgtaactttttgaacaatgatagattgcacagtccccagaaaagtaatgtcatgaagcaaaaactcattatattttcaaataaaaacatttgacttttaagaacaa

SEQ ID NO: 55018 - DNA, 629 bp, Bovine  19866881225134
tagtgaaagaacaaaaaacatagggagttaacgaactccagaagagtggctacttttgaagagaaaagagaggggaagagttacaggaatgaggctctgctgggattgttaatgttttatttctttcaaataaaacaaaatgtgagctccagaaaacatggcaaaacaacctctgttaagttcaaattgtgcacgctgtgtttgttatattattttccaagttttccgtgtgtttaaatgatttcatcaataaaatgtaatggaatcagatgacaaaaatctgacatttcaaagttcatgtaaaatcccagtaagcaccatcatctccaggaagaattcacaacacacaccagtaagggaatcactggaatctttagtatggtaggatgtgtctagtcttgcttgtaattattttacttaactaagtctaaattgtgactcaaaagagatctggggaagaatacttatcctcctattaacatacattttttatcagtcatcagggaatgtctgaaagccctcttttgtaacagatggttgaggctatattaaacctaaacaaactaaaatcattcataaatgagcaatttcaaaacacctagagtaattaagatcttcagctttctgca

SEQ ID NO: 55019 - DNA, 753 bp, Bovine  19866881260489
tctccaagcttaggcctgaattcttgcctaggagtgactaaacaacaacaggcaagtgcacataggtggaagagtgcagattttagagcctatgttatatcttgattgggatgatggggcttcagtgaagaaagaccagtattccgtggccccgagagcacatcctctgctgtcaaatgggttcaagttcatggtcttgaaaactgtacttttcctgtcttcaaatgttctcatgagtccttctctcttcagttcaaaggagaaattaaaagggattctaagtgtttattcttcatcctagatgttgggcagatgcctaatttccactgcttccttacctcctgaagagtttcaggctttttgcttctgccaaaatggagcaaacatacagcttggtactttgaagtctgagttaaagcaaaactaaatggaccatgtttatctgatcaattaaggcattgcctacatccttaaaactgatgtttctcatttaggcggcattctatacaatcctcaggaaattaacaacagaaattgagtttggggaatgggggtcattatacaaagaaatgcaggaagagtgtgggagaatttgactccactccaacataagcttcataaactgactcggctccagtataaactaaaaaatgtctttgtagaagtgggcctgtagaaaatattaatgacagtccccaaaatagaattttgatttaaaactcccattatgtaaagtgatctactagatttaag

SEQ ID NO: 55020 - DNA, 1045 bp, Bovine  19866881308209
atacacacacacacactcacacacacacaaaacctttaaagctaccaaatctttttctctaccacataacaattatgagataactttaaataaatcaatcatatttcgctttgttttgttatccttagactaacttgagtacttataattataataaaagttgagcaatcaatagaacttattcatatttacaaaaatacatgtcatctggctctgtctggagggaatctataccctagttcaatcttaattccttataacatatccataaatctccaaacagctaatcatgaaaatattaatgaaatgagcacatgctttatttataagtcttggcttactaggcccttattacattgccagagagaaggaatattaaaataaatgatatctgtgttcagcactgaaaataaatcaaaagagtcacaatgtcacttataatagattccagtcaagtgtcactttgttgccttaaactgaattaacattttcaacaattctagaatactttcagataactataaatgactaaatggaataattaaaaaccctaaatatatgaagtactgaaagataatgctttatattgtatacataaagcaatatccttactaatttttagattattcagaattatatatcagggatttacacactgaaccataagtttaaaattgactaaaccatgtgctttatatttataaaaatcatcaatataacttgtgctgtgcttactctctcagtcatatctgactctttccaaacccgttgattgtagcccgccaggatcctctgtccatggaattcccaggcaagaatactggagtggattgccactcccttctccaggggatcttcccacccagagactgaacctgtgtctcctgtattacaggcagatcctttactgtctgaggcactggggaagcccgtaacatatggaagtgctttataaaaacataattgatttcttttttaccttgtttgttaggggaactattgacttaaaaaaaaataatactgcggaagcagaatccttcacaga

SEQ ID NO: 55021 - DNA, 711 bp, Bovine  19866881320009
gtttacagaagaaaaagtacagtcctctaagtgaactgacaaattctgcaaatgttaaatgacattcagacttgtttatataaaaactacattcacaaataactaataattacccttttcatcagtatattcatatttcaacacagctccatcccctaaaatttactcagtaaattttagctcagtaaccaaaatgagtctagatacaaacatgctaatttcttatgctgctttaccagcaggtaacttgattaatttgaaatggaaatacatctgcaatctacctcttcttttttcttcacaccacctaattttgaaggcacagagtaaattaaaggtcactcagtgacgcatatctaaaatcctcaatttaatcctgaacacctactttctgagagattccatcaattatgttctgggcgccatgatcgttaaagtgtactggagtcctgaatccattgaagtgttttaaaattcagccggtataacccttcctgcaagtgtttcattgctttttccccaaagtgtgagctctctggggagctgacacaaagtatctgctccacacttcagaaagggagtaccagttgccagagttgaaattgctgctgggattacaacaaactcccaaaccaccccggagcagaaataaacagatcgtctcatatgttaaaatagtgagatgagactgaagcgcctgaaactcgtaca

SEQ ID NO: 55022 - DNA, 709 bp, Bovine  19866881320756
tgttgccctgttagcattgaagaacctaacttttaccgtaacacttctttggggaagaatgttgctagctaggaaacaaaatgcaggtataaatagtagtataaggtctaatgatatcaaataccaagctaataaaaggcagtagcttaagtctatgttaaaggactagcttctaaatgagtttgtacagcacagtagagatgcaaaatgtacataaagttgtttgtttttttatatttagtaacactgacattatttattaataattttaccagaactctccctgaacttttcactagactttaaaaaattaatgatggtaaagtaagtaaattaaaatgaatgagaagaacaaaagaggatttctaaactcaccagcaagaacacatttgctcctctggatatatttttacttctttctctcttcccccaggcacccagtataaaaagagcatgaatttgaagtccagaagctatggcttcaaatcgcagcttaataacatggaaacatatacactgctgctgctgctgctgagtcacttcagtcgtgtccgactctgtgcgaccccatagatggcagcccaccaggatgccctgtccctaagattctccaggcaagaacactggagtgggttgccatttccttctccaatgcatggaagtgaaaagcgaaagtgaagtcgtcttagtcatgtccgaccctcagcga

SEQ ID NO: 55023 - DNA, 787 bp, Bovine  19866881394782
atcagcatcctgtcccattcttctcagaaatattttgaagtagtacttgttgggcttcctttccagctggcatgggacctgggcacatgacctattccagacagacagttcattctctctctcatcagaaacccacatacattccttaagtccttggtttgagtgagctccatctttccagttggtgccaacagatttatgtgttttttcatgtttggcagattctatgaagattgccttccaaattccaaggtttgtttccagaactgtggcttggcaggaaaactaatgcataatcttcaggtgtaggttttttgaggttttctgttggatattaatactataggtttagaggcaacctgcaattttataaaataactttcctcaggtgccatgttttaagcccttatacttgccaactgtaaagggggaattggtactggggaggcagagataaagctattaaactctctgacccatatgtgctatatgtggtcagtcatgtctgactctgcgagcccatggactgtagcccgccaggctcctcagttcatagggagtctccaggcaagaatactggagtaggttgccatgtcctcctccaggggatcttcccaacccagggatggaacctaggtctcagcattgcaggtggattttttaccatttgagccaccagggaagctcctttgacccatattccccactaaaagttgccttctacctgcctttacttttccatatgatttatcatgtgcatttgacacttccaccaaagcagaagatg

SEQ ID NO: 55024 - DNA, 2791 bp, Bovine  19866880246975
cagggtgacaatatacagccttgacgaactccttttcctatttggaacaagtctgttgttccatgtccagttctaactgttgcttcctgacctgcatacaggtttctcaagaggcaggtcaggtggtctggtattcccatctctttcagaattttccacagtttattgtgatccacatagtcaaaggctttggcatagtcaataaagcagaaatagacgtttttctggaactcttttgcttttttgatgatccagcagatgttggcaatttgatctctggttcctctgccttttctaaagccttgtgaagcaatagatattcaatactgagaattttcagactttatatcatgaatgagaactgcctagtttatacagccatgagttcaggaactgaatggttctgactctgggtttctcatgaggttcagctgaatgttgcccggggttgtggttttcataaggtttgactatagctggagaatctgcttccaaggtggctccctgataggatggataagcaagcttgtgatctttgttggctgaagatttcagttcctcactatgtgagcctcttcacaggttagcttgactctcttcttgagatgattttcactaagcaagtaatccaagatatcaaggaaaacgtctttcatgattagctctggatatcatctatcatcacttctctaacatccagcaggtcacacatgtcatccttttcaactttggagggactacacaagagcatgaataccaagagatgatgatcaatgagaaagggcaaaaaataatcaaataaataatagaagaaaattccaaagatgagaaactcatgagattctagattaaagggctcttcaagtttgtaacacattggctttaaagagacccttgtcatgaaatttccaaccacaacatcaaagagaaaatctcacaagattctggaaaggaagaaaaaagtatgtcacatataaacatttagaaacagaatgacttcaaaatccacaacctcaaacttgttagacaaattataatgatatcatgttttaaaattctattaaaatattttaaacatagaattttatatccaagacaaaccatcaatcaagtttttgtgtagaacagagacatttttagatatccaagcttaaaaaattgtctcccacacaccctttctcagaaactttgggaaaacagaagatccaggaaacaagggattcaatacaaggaagaggagaaggaaatccccaaaatgatggagaaaggaattccaagaacaacagctatgtgccaagtccagagggcaaagagaacttctgacttgaacagatcagaaaacttagaatattattccatgaaaatattcagtctatagacctcaaaatgtgtttgaacacagtaataagagatttacacagctggaagagagtttgaagttgagtttataaaaaagtaaaataataggaaaataaaagaagtattaattccagagaaaagaaaatactatgtaaagaaagataaagcaatcaaagtttactatatgtctcaactggaactggcatttaaaagtcacagagaatgtaaacacagaatagtgatcaaaacaaattatgatgtaactgtattgggaggagaaaagaatgaaaagtgtgatgatcggacaggccaggggttaaaaaaaaatgctaaatcctcatcttccattgtgggaaatcaatacctagaactggaaaatcaataaacagcagtattagaaatgtgggcgtaaataccaaatgaatcaactaaatttgtttgagactagttgcctctaggaagcagcaatttgtggaaggtatggggtataggtgctaactttcataataaattttgtataactagtgtaatcttccaaatatgttcatgtaaatttagtcaaaataaaactaaatagaaaggattctgagaagatgacagagtagggagcaccaggaatctgtctccccacctggacaataattgcacaggcagaatctgcctaaggcaactattttggaactctggagtctattgaaggcatacaacttccaggaaaaagttgaacattaaattgctgttatccctaggcttggaagatcccctgtagtagtgcatggcaacccactccagtactcttgcctggagaatcccacggacagaggagcctggtgggctatggtccataggatcacaaagagtcgaacacaactgaagtaacttagcacagcatgcataaattgttaatttcagtcaagttcaactcttatggctggtgcagtgacctgtcccccaccctcagtcctaaggcaggcagcagagcacgtattccagaagagacctacatacagtttgtgagaaccagtgtgagaaaaaaagaccccgtcctccaagtatcacagttctgtgtcccatagttgactgctgcttctgatcatagacatgcagacgaagaggctgccagccattgttgctgcatctcccccataagttgcaagtccctcttcctcctattgaaatgacttccaaaaaacttaaagggctgatgtattcttttacctcccttccatttttctcttttccccttttgtaagccagagatgttaaagactatcatattaaaaagcaactttgtaaatggggaaagttagacagtgaccacacatgctcagatgaggtgaaggctcaaaagagaactgaaaggaccttaagcttatacctaaggcagatacccggcacacagtcagccttcaatagttaaaaaaaataaaca

SEQ ID NO: 55025 - DNA, 1479 bp, Bovine  19866880389679
tttggagccccatacctgcccctagtgggcacctgtctgtacctcctcccccatactgcacagccttagctgaagcagcccagcatctccgtcactgacctcttcttgagcatggcgagatggggtgtggcgggggggagccccaggggcgctgcccccacggcctctgcgtgccggtcttcaccaggccacttcgtgggccccagctgtagtggtgggtcagggggccactgggtgttggaaatgccccccatggaggagaggggggtgtaggtctgaccacagcactgcagcagggacaccctgctcccaccgtcaaagaaggcgaaggacacacgccgctgctcaggctccgtcttcttgctttccagctgctgctgatacttgtccaggaggaaggtgctgtgagaggccatcggagccagtggctggaagatgtttgacatggtgctgaagcagtgctggggggccgactggggggtctccggcaggaggctctcctcagggcagatggggctaagctggaagtcctctccgtccatggggatgtaaggtgccagggtctccaaatccagctcgttaaagtcagtctagaagacacagagcaggggcaaagcagctcagcagtgggcgctgcctcaaggacgctgtctcatcttagcccctcatacccccgctcccacccgaggcattcctcctgcacagcctggcagcgccaaggtcttgggggcccaagagaggaaaacacagatgtgtcttcaaagtgtggaaggtcttctgacaagtgctaccagccttcctgcgcgtctccttccactcagtcattcttccacacaccccactggtgtcgaccccacctcttccttcctgcctactctgatgagcacgatggctcctgggggccaagggcagctttgtcctcatctcccgcccgtgcccagggtgtatctgtggacagctcgtagggtaaccgtggcccagtgctctctgtgggaccttcattcagatcaacaaggactcagagatggcccccaggttccctgtatgggcaccatagggaattctcacaagcagatgcagcaaaacaaacatttcacccctcgctgggggaggtagcttattaatggttacaatgacatgaaacggttaaagagaagcagcagccagttacccactttctcttttcaaggaataaatcttagagttcagagaagaaagtgcagggttgaagtagggaaagattgcagaataaagacacaaactgaggaggcaaggcagaaatttggatgaataacccagagtaagacaaatagggattaatacatttcctttgggttttgtgacatacttaccatccacccacaccctagcctgtttacacaggttttacaagactgtttggccttatgtaatatgtttctgaaaagttatatgtaaataaaaatttgtcagatgtcattttaaaatgtgtttaacata

SEQ ID NO: 55026 - DNA, 1586 bp, Bovine  19866880523010
aaacctatatgcaggtcaaaaagcgacaattagaactggacatggaacaacagactagttccaaataggaaaaggagtacatcaaggctgtatattgtcaccctgcgtatttaacttctatgcagactacatcatgagaaacgctgggatggatgaaggacaagctggaatcaagactgccaggagaaatatcaataacctcggatatgcagatgacaccactcttatggcagaaagggaagaggaactaaaaagcctcttgatgaaagtgaaagaggagagtgaaaaagttggcttaaagctcagcattcagaaaactaagaccatgacatctggtcccatcacttcatgggaaatagatggggaaacagtggctgactttattttggggggctccaaaatcactgaagatggtgattgcagccatgaaattaaaagacacttactccttggaaggaaagttatgaccaacctagataccatattcaaaagcagagacattactttgccaacaaaggtctgtctagtcacggctatggtttttcctgtggtcatgtatggatgtgagagttggactgtgaagaaatctgagccccgaagaattgatgcttttgaactgtggtgttggagaaaactcttgagagtcccttggactgaaagagatccaaccagtccatcctaaaggagatcagtcctgggtgttcattggaaggactgatgctaaagttgaaactccaatactttggccacctgatgcgaagatttgattcattggaaaagaccctgatgctgggagggattaggggcaggaggagaaggggatgacagaggacgagatggctggatggcatggacatgagtctgagtaaactccgggagttggtgatggacagggaggcctggtgtgctgcaattcatggggtggcaaagagtcggacacgactgagagactgaattgaactgaactgaagtagctattaaattttctaatagcattttttgattaattgtgattagttgtcatggtacaagtccagacaaaatattctgtaatatttagaatctatggtcacaagaacatttttaaataaattcatttttatatacatagctttgttggagagaagtatgattgggtgaataaaagatattctatcataaaaatgtattaggataaaattctgttggggaagtagaaggaaacataaattcaaggagaaaaaagagacgaaatttttccaactgttaagggagaatttcatgtattttttaaaaggattatgctgggtatccaatcactatactatttcatttagaaacatttttcagagtactgtaacagttttatctttaaatgtcaatatttgcatacaccagaaagtacaccctatgtaactatttaaactatggaaaaattttgaacatttcctcctaaaaatgtgcaaaggggtacacagattttccggaaaaaaaatggagtccacaagaaaaacgtttagagcaccagggtcacagagcttagctcttgtctgcaaggggatggccttcagtgaatgccaaatcagcacctttaaggatttcctaag

SEQ ID NO: 55027 - DNA, 1154 bp, Bovine  19866880525229
gtaaagtcctatgtggtacccacaatctacctaaaacacaggtctggcacataggacaagtgaccaatcaatgggttacaatggataatctttcagttcatatttttaaacaggcacatatgaagtaagttgtaattacaatctacaacactatcattcctcaaatacaccatctctaaagctattttttaaagtatttctaaaaaactacacctaatatatacagcagaaatttctatcatttttaagagtctccatttgaatggctcttttcattcaaaactatgtattgagagcccctactataaaccaagcaattaaggggcaaactaagattcttttttagataaatttcaataacacaaactttaaaaaatgtgttgcaatataatttttggagaggtatgtgatctgagagatctcaagggaaaactgacttatctgcagatcagaaaacctagaaacacttagaacaacccacaaccattaggattactgactctttcagataaaaatgaagataaaacccaggcaattctaaatttcacacaaactactttttattatgttttgtttatcatgcttaccatagatttacatttgcatgactgatacaattcatctttcaaaaccgacttacttccaaacttcacctggttttagatgattgtgtgtattttcttctgaacctggttttaacgctgtgtttcccagatgcacataaagtagatgctgccgtcttgtgtaagaatacacgagcagatgagtctactcatcggggtaatttctctgcttggttgtaactcagagttggttggtccagaattggttgtactctgctctgagccatgattactctaccactctcctgtgactaagaacacagatttaggaagagctatttgtgggagaggtccacagtctccaggctggaacttcttgttaaagtgacgatgtaaggtccctgccaggaccatgcaaatgagttttacctcagccagcactctcctctatcacatggaagtcctactggcatatcattttcagtatcactgccctacaatgaacccaccttttaaatcgcaaaccactttctatcagttaagtattagtatttttcccacgccgaagtatgtaactcacattcatataaa

SEQ ID NO: 55028 - DNA, 2206 bp, Bovine  19866880566862
aaaaactgctttgagcgatatttaaagatatatgaaaaggctggtggtattttaagtgtgaaaaagcaggaatcaaaactgtagcatgattacaactttgaaaaacatacatatgtataatgtgtaagaaaaaaattggtacaaaattgtcaaaatgttaatctgttggctctaggtagtgatggtgaatatttttagaaatttacttctttatactttattctgttttccttcaatttataaaaaaaggttgctttgttttattgaagttatatatacaaatggcttaagttttaaagagtcaacagttctataagatcctgttatggaaaaacaaaagattcctctccacttctctgtagaaaagtccttccactcccccaaggcaagcactttcaattcttagcagtttattttggtaaaagaaatcctctgttgccttcacactgtgaatgatgaggctttagctctctttcagagtatcttccacgtcccatccacccatccccaggagcaacacggtcattttcgtttgattattgacccatcgttatatccttactgctgtgttagcacagctgagccatgtaatgtactataattacttttccttctttgtgctactttttgtttccctggaattactaattattttgcttcttcccttgctaagttttcattgtatgtctgtctcatcctgaacttgcctttccaggcattccagtgtatcaagtcttctgtccgtctcttctgggagacttttgccatgagcctgctgttctgcttcagactgggctagttgcctccagctgctgcacagctgtcatcctgggattttcctacgtcattattgggattccctttggctctatcttatgtattacattcttatttttacttttcttatctgcatagtctagttcctcattttggtagagcatctattttattagtttcctgagaaaaggtgcgttgtaggcaaattttttgttgcctgtgtgtttgaatgtgtttttatttccatcatacttgattgacattttgaaaatagattagaaatcatttttttcttcagaactttaaaggcattactccattgtcttccactttcagtttctgctgtcagaaagtctgatcccaatctggatctggattcattgtcaagaacctggttttcctctctggagtttcacactcatggtctttgggttagggtccagccaactgttgtgagccctttcactccagagattcgtgtccttctgttctgagaaattttcctggtttatttctttgatttcttcacttccagttaatctcttctgttacactagaacttccaggttttagatattggagctttggggtggttctctgaaagtcgctcagtcgtgtctgactctttgtgaccccatggactacccatccatggaattctccaggccaaaatactggagtgggtagccttcccttctccaggggatcttctcaacccagggatccagcagattccttaccagctgagccacaagggaagcctgatatgaggatagataaagtttcttcccctgagaagctcatttgctggcttaataagaaaataacatatattctttcttcaacgttcagtttaaatgctacttctccagttgttcatttagaatttcccccattctcctgtgttcccacactggtctgatcttgactgcagtctttcttagggaaaatgaacagaacttcatggttgactggatgtgggcttcagtccatctttttgtccatgggatctttccattagcaggacttccatggcattgtgttacaaagtgggtgatgggggtgaggagacactggttccctgtgttgaggaggaggaggatgggacctccagaggaggctgtggaaatttctgatcattgctatgggccagagagatagctgactttaagataatatagtctcccagtctgcaactaggggcaaggaaaggaaccagatgaaattttagaatcatttcagcctcaccatttatataggctggaggtggagccacacttagccacagattctttcccatgcaatattttccataaatttaaatcttgttgctatacaaagtacagtggggatgcctcttgcttggtataacagctcagtttctgggtattttctatgtaaattaaccctctcatagtaataggatcat

SEQ ID NO: 55029 - DNA, 1350 bp, Bovine  19866880579892
actcaggttcctattcttgcttttccactgcccctgtgctgcccctttggaggagggtttagctcaagaggcaagtgctgattctgtgttgagtgctccctcctccagacagatggccccaggcagaggccccaggaaaccagggaaggaaaccctcgagtttgagaaacttgtgctttgagattatccccttttttcagaccagcaggagtttttacagagaaattttacggggattaaacagctacatacttaaaaaaaattaatttatttattttaattggaggctaattactgtgcaatattgtggtggttttcgccataaagaaagtagaagagaaacattcagcaaacctctggagggagaatgtcttttttaaacctggaatcatcgatgaaatcacaaatgaaagattagcaggtttgactacagagaaattacattttctgcatttaacaaaaagactgaaaaggggcatatgggaagaagtactgacaacaaataggggagataaaagattattgtctctttttatttatttatactctgcctccttcctaaaaagtcttgaggaggaaatatttcaaaaagagtacatgcaaaatgatagtttaaaaataagcacagggctggacttctctgatgaaccagttaagaatctgtcatccaatgcaggggacatgagtctgatcccttagttcccgtaatggaactaagattctgtcacggggcgactcagcctatatgttacaactaagatctgatgcagccaagaaaaaataaagaaagggccttatatacaaatacccaaggagcataaagaagcaatttacataaagcaaattatgactatagtaaatgtgtttatagaaaaatgtccaacccagctaatcaccaaaggaacacaaagttacatagaaaaaaatctcaactaacacccggtactcatgcagagataacaattacgctttataattcgtaagggaaatatggtggcagatgctcagaactataaacatatttgttttcttcaacaaagtaatcttactattggagatttatgctaaagattctaaaatatggaaaacagtacatgaaggtatccactgcagcatcaaaaacacactcaaaagagctgaaaattgaaaatgacctaaatgtcttaaagcagagaagtgcttaactaaagcctgacctatccaataaaatataatgcagcttttatcaaagttcacagaggcttatggtaaaaaaaaaatgcctacaacaaaatgttaagtttaaaaagcaggctatagaatcatagcattcacaatatataattcatgggatgagtatttctatgtatg

SEQ ID NO: 55030 - DNA, 1459 bp, Bovine  19866880585485
ttcttaaaaggccagataataaatactttcagctttgcaatgccatatggtctctgttgcaatgatctaactcagccattgtggtgtggaggcagccatagaccagacataaatcagatgaatgttgtgggtccaataaagctttatttacaaaaacaggccactggccagagggccatggttgccaaccctggacctagtgtttcccacggacaaaatcacacatgagcaaaactgaaacttgcattacgctcacattgttccctcatatcccagtctttagggaacagattcgtattttcaaaacaaacattatggcagaagtgactgaactttatagggttgctatgaaggataagtgatctggtgcctgtaaggccctgattgagttgctgatggctggtggtcaatcggtgtcagtgattatcattaactgtggtagaggattgttgctgggatcgtatttgcttacagatgtaatgtccttagaacagtgcttggaatgcagttaaaaaaaagctaccattttcatcaaatctaatacatacttttttattgtggtaaaatacacagggggcttcccttgtggctcagcagtaaagaatccgcctgccaatgcaggagatgcgggttccatacctaggtctggaagatcccctggaaaaggaaatggcaacccactccagtattcttgccggataaatcccatggacagaggagtctggtgggttacagtccatagggctgcaaagagtccaacacaactgagcacattgcctgtactccctcaacagtcaacgtccagtacctgacagccctgccgcactgcagacttctacctaaaaggctttctttcacacaactgtaagttccctgcacctagaaagttaatgctacgaggatacagccctaagcaatgacaatgagaactagaggataaatatcacactaattgctaacctatctaagcattaaaattcagccttacccacagtcacattagattattgtctaatgtcttacttcaggttaattaatgaagagctttttataatagagaacaaatgtctccctgtagatgtaatttcaaatagggccctcagtttaaaaactctacataccacaatattttaagtctccacaacagagttttacttaggaacatgttagtttaatagcaaagattcagcaatttgatattcagtgaggatatgttaaccctggcagaaaagggcatagtaaattacttaactaatcctaaaatgtggagatcaagtctcttctcagtgatagctgataaagaagaaacaatcccaatatccttaaccaattgatggagttggaaatttttacacaactctttaaatgttaagcatatcctaaaacagagcaaaaattaatttagtgactgattgtcatctataggtgtaaaattctagaaacctcatagccattttca

SEQ ID NO: 55031 - DNA, 1819 bp, Bovine  19866880649579
cagctaaaggaacagtctcccactggcttggctttaagagtctcctttaaaccagatcgtcccctgtgcggtaccatctttgttgctccctgaaaatacacatttctcattaagtcgatttacctcctgcgaacttcctttccttctctgagatgctgcaaagattgtctaggcagtactctccctctctgggaagcaatgaactcagcttccttcacctgatcagcaagttattttggcagcatttctgagctggcaatgacagcattctttatcagaatgtgtcttaaactctcatctgggagatcccagattattaaaaattaattaaaaacaacctctacacttgtatttgccactgattttgtcaaacattactgattggatcatggttgttctttgttcttgttcctacagcctcttactcccatgaaagacagtggtgactagtgggctggggtcttgacttttctggaaaacagctctaagggggtctagcatgtgtttgtgttcgttttcaacgaactatccttctatgttcctcctgccagtgccccaggtccacacaaatatcggtgctcctgtcaaagaacatgttagttgcttagtcgtgtctgaccccatggactgcagcctgccaggcacctctgtccatgggattctccaggcaagaatactggagtgggttgccatgccctcctccaggggaatcttcccgacctagggactgaacccaggtctcctgcatcaaagacagattctttaccatctgagccaccaagaaagcccaaataacagtttgaccccaacaggatctgaacacgcaatcaacaggcagcaatactgcctcagatagttccctggagtccagcaacctgggggcaggcttagcaaaggattggagagagaagagggaggagaggttttccttattttgttaggattcctcttatcagctctgcttttctatggctgccctagggctgactctggggaatgccagactggggcaaatcacagggtgtcctcaggccgcctccatccaaaggacacacacagctctctccaagtgacatccggttctggtgaccagcaagggcagccaaagggtaaccaaaaggagtctgtgtaaactgagtaaactgccaaagccacccccatctcccttcatctatctccttgtctctaggagctcaggtcagaccctagagcagcagccaaggtgaggaattctgcctcccaagcaaggaatggagctgcatttggaacctggagaagaggacatctagggcttccctggtggctcagatggtgaagaaactgcctgcagtacaggagacctgggttcaatccctgggtcgggaagatcccccggagaagggaatggctacctaccccagtattcttgcctggaattccatggacagagcagtctggtgggctacagtccatggggtctcaaagagtcggacaggacggacccactaactaacactgaagaggattacggcgggggcgggggcgcaggaaggctgccttcaacagacgcccccttgtggctgcagagacaaaggcccagcagcctgagctccacttcacaaaaacttcccgcaggttacagttgtccagaagcacgaagtagtgtctcctgacactgaaggtggtcaagctcactcccagggttacgtatcaggcaggggctgcggaagaaggtgtgcaccttctagctcttaggggtctatactcaaaagcttgctctgactctccggtcttctggaatcttcggtctgtgccatgcactgtcacttaaataaccctg

SEQ ID NO: 55032 - DNA, 3258 bp, Bovine  19866880669695
catagccctgtaggtctagagatctgagggtgctgaatcaaagggcaaattcccactgcatcaggatggcagcagccctagaccctggaccctcatcttcacagatgaggggagaacaggccaggcagggaaagaggcatacccagggtcagaccatttttcaggagtcctggaaggttccttagtctcttgatgctatcagattttctcacatctcaggatatgggagaaatacaactcaaatgtggaaatcactcttggcaagagcccataatcttggggacagctgcgggtgagggcagttaaaagcccttgataggcttgagagcaagtgagagacctccacttagagtcggctaagactccctctcagttgcagtcaaatcactccaacaggcagtgatgtgccaagtgattataatgctgtgcttgttaataccttaatggtctgtacgttatacttttcaaaggtctttctattgagataatcattgcaaaaatgactttcaaagcataaaaaatatgctttttaatttgtcttttttaaaagtattttttattgagggaaaattgctttgtgatgttgtgttagtttctgctgtacaacaacacaaatcagccataattatacccacatcatcgccctcttgtgcctccctctccccccccatcctactcctctgggtcagcacagagtaccaggctgtgttatgtagcaatttctcaccagctatctatttttacaaatgcttattaaaacacttttacaatgcatggttttagggaattccctggaggtccagcagttaagactgtacttccactgcagggaggatgggttcgatccctgcttggggaattaagatcctgcaagctgtgcatcacagacaaaaaatacatttttttttttttaattaaaaaataaaaggcatggttttattgaaatcctagctcatttcaaacttataataatagtactcttagaaagcaggtaatgtgtgtaacccccacttaggtatgggaaacattaccttcctaggtcacacaagtcagaaaagatctagaacagtctctcagtcctagaggtttctgagagctcctctgaacctcctgtggaggtcagctttgtcagggacacagaagaagtcaaaggcggccctgggggcatttacaatctgtttggcaagacaaagggtaagaaatatggaatgcttgtggtcatcccctgacactaattttggaggcaaaggaattcaagtgggtgaaagtttgtccctttccaaaataaacacatcctctgcctggacccagaagatctaactccaggagaattaagtgacgtcattcccctcgtgacatctagatccatacaggtgacccagaatctcaaggcttgtgtttatctgagcatggaaaatggttcaaatgtgcacaagtggatggtctgggaaagaaagaatcgactttcgtggtcatctcagactccttgctgccggggcactctggtcaccaggattttccaagaccccacgctggccagcagctgccatgaccacaccagtaccacgtgtgcccatgacctgtcaccaaaatgacccaagtgggaaaacagcttgcttggagtttaacagtggcaaaaactgtcatttttaaaggtaattttagtttggaaaggaaaaaaaaaaaaaagaaaaccccagagaggagtaggcatggtgacagtgtcattgcagattagccagcttagatctccctcctttcccctccggaggcctgtctggagctgtgggaggcagatgctagactcaaattctagctctagctagattagggtaaacgtcacctcctgggctgtggggtgtctttggacgttccttgaggctgcttcccagggactgcccaagcccccagacagcccctgtgtctgggctgcctgccctggggtccgtggttccccgccacctgcgggccttggaggataaaggctctgtccacctggctccagagggggcccttcctgggctgctcagacccacagtggagggggagggaagaaccccagctaccccaccaggtgactccaaaagatgttctttgactacacctgtccaagaacaccagagttcaggttttagggaatggtatagccacataacaggaaaggagtaggccaaggaatagctcagctgcctctttgtgcaaaggacacaactcccagtgattggtacaaactgccaaaaagcatggatgcctctctccctacaaacagtggagcactgaatagcctttcacagtgaccagactcagaaacctagaatctatgatgacaaagggcaagaagggagaggatgaaagcccccatcaaattattagggggaagcaggcttcaccatcaaaatgagaacatgagatgagcatcacacactcatccacagagcctgatggaagctatttagaacacagcaagttgtccccttctggtctcccactctggaccccaggaggcatttgttaccctcaggcatggtacagtccaaaaagaaatatattctagagcaagctgggcacatttgcagatgactgatttcctgagatgcagagggcattttcagtctctgaggtcattcttacaaaggataaccatggtaccatccacccaccctttggtgcttatgctagagtcaactggaagataataggtgtgccctgggcatcttccttaggttcaaataacccaagagaagcaggcactgctcttgtggccccaaggcagccctaagtccatcacgtcatgactaagatatcatggtgtcctcaacttctcagcaccagcctgggcctgacccctttctcccatacgtttatacagctccagattcagttctggaaggagccgattcaccagtactgctctgtacaccctaattattcctacctcctcatttaactccagctgttcaccccactggaatgcccaaaacccatctgcttatctaaattctacctaatcttcaagacctagctcttaatgctcctcccttaaacctctaactattcacagtacacaagatctacttacccttattcacactcaattactatcaatcttccagtttgctcagtgttttgtctgagctctttttaacttcataacaagacagcaacatcgtaaagatgggggtgaggacaacctttaacatcaaccatcttgcatgattttaaacaaatcagtttaggaattctctgactcaccaacta

SEQ ID NO: 55033 - DNA, 1125 bp, Bovine  19866880702713
aaatgtgtttttaaaaaagctcaaggccaaggtctgccatgataatgtcttcaacagatcaagtcaagtagaaaggaagggctgagcttctgtttcagcctaaatctgactatagttttctggaaaaattcatcctgacatccatggcttgtgaaattcaaaccagtttagaatctgcagacttaacatatttttacccaggacctgattaaagcaaataccttcctcaaaaacacaagcaaaattagtcacgggaatgaacgtgtgagggagttgtatttggtgtcattgctcatcttttccactcctgtggctgggaaccaacttgcgcctttgttgtcgagagatgaagctgattcccgaagccacacccagcacctgatttgagctgaggagcgatgggctggacgtagagctgctgactccaaggaggcaacggtgccagggagtgtagcgtcttggcgattagagaggggagaactctggacaaagttattaggactctatgaacacttgccttataaactgaagtcatctgtggttttgccccaaggtctcctgagtttattggagcctttactacctctgagagagagaggaaaaaaaaagagcttgcatttcaccttctcgtaaactgtaaatgtcaacagcttgtatatcctgaacagggacccagtgttactcaggactgccacgggggagaagtgctccagagggcacacggtctggcccaagctgctacccaagaatccttcacagcccaacctccgatgggacttttctataaagaaataataggcacttgtgaaagaaagtgaaaatataaaaaggagaaaggaaaattcatccatcattccaccatgcgtgtgtgctaagtcgcttcagttgtgtccgactctttgcgaccctatggacagtatcccaccaagctcctctgtccatgggattctccaggcaagaacagtggagtgggctgccatgccctcctccagggtacttctctataaagaaataataggcgcttgtgaaaacagaaagtaaaaatatgaaagggagaaaggaaaagtcatccatcatttcaccactcaaaccttataagaggcctttcagactttcggaaacatt

SEQ ID NO: 55034 - DNA, 1849 bp, Bovine  19866880754117
gatggcaaagacttggacacgacttagcaactgaccaccaccaacaccaagatatcaaacttttacactccaaaatattccacctatatgcaaactaccaagctaattacacgttaccttaccaactcataagctgatggcccatggtgcgttatatactgatactttgtattagatttaatttcatatatctgaaataagggattaagacacaatttcctatgtacacttttcagtgattttgattgtcctccaatctagaaattatgacactattgaatgaaattaagtttcataagatggtaacttgagtacaaatgaatctctatttcccagcaatcactgagatggccaagagaatataaaagaaacctttattaatactataaccttgggaatggtatcagtgacatcacacatgccaaacctccagggatttctataacatataagtaggtgaagaactattacagggaagggccaacctaccagacttactgaatgtaaaacaactcatttgttagggaaacacaacatctaatagaaaccacaaagaatggacttaaaaagtaggcagttaagtgcaaggcatacaatctagctccctcagtggcctttggaaagtgagacacgtatcagagattcactacctaggaatttattttaaagagaaaactggacaaactaagaaaaatttaaggagaaaactggacaaaactgccaggatgtatgttttatgataattatggtaattaataatagtgaaaactgtaaataatctaaatatccattcataagaaattcatatatgattttacacaaataatacagtattacacccatgcaacttgttgctgacatggaacgagttccacaatatactgctgaaggggaaagaaacagattaaaaatagtatgtgtactatgaataggtatagagagagagagctgcaaagattgtcaccaaaacacaaatgggagctgcctctgggtggctggatatttgataatttttacttactttttataattattagtactgctgaagttttctaaataaatgtatactgtctttgtaatcaagagaaaaattctcattctggaaaaagaaagtatatttattttttaatactaagcttgatttaggagaaattatcttgataattggaaacatccattaagatacagattaaaagatctttatcataacgtttataacagtataatagtaaaaattattattagcaataacttaaatgatcaatagcgaatttgttaaattttagaataactatctaatgatttactacaaagccattaaaaattacgacaaagatgtattcatcactagctcagtgaccttggaaatatcatatgtcctctaggtatcagttttctcatctgtaaaatgcagataaaagaatacttacggtgcttcacctagcttaatagccataccctattgtgatagaaaatgaaaaatctgatatttataagtttcctctaatttcacaaacacttatttcaaaatcaactttgctctatgttaaacagtgctggaagacagaaacaggctaatctggatacctgtagcactgaggccccaataagtcccccagattacagtgacagagggaaccgacatccctacttaactgaacaatgaaacaatttatatatacactcgttggcgtcatcagttttaccctcactgtacaaacatttactttgctgctttaaggaattgaaaccaacctgccatggtcttccccaatccagtggaataggaaaggctccaagccatattcctacaaaactagaaattgtaggatcgaagactgttctccca

SEQ ID NO: 55035 - DNA, 2450 bp, Bovine  19866880763758
tggagcaagacagccaccaattgctctggacatttattctgcctaattagtacctaaaggagagtttatctttcccaggagttccagcaaaagtcctaagtctgagactcactggtcaggcttgggtcatgtgtccacaccagaacctatcatttggccaaaagatggaatgttctgattggccaggtctgggtctggggcccaccctcaattggaagccagcccactggaaatttacaaagactgatgaacagggagttccacaaaagaaaatcaatggggaatgaacactgggtacacgtagcaaatgtcactgaaatcatgctataaactgacctgtctggggtctatcctactaacttatcatacacgtttagatatgcctgaatcctagtagtagacatacctaggctgaagccaagacccctgctatgtgtgataaattaatttatgagattctagaagtttatatccaagatattactgttcctaaggagggtttgtaattgaacatgaacaaatccttagtccaagaatttttgccctgatagttgaattacaggcttccatagcaggacagtggagaaaatattttttaattcaagaggccttttggagggacttcccttttggtctggtgcctccgactccatgctcccaatgtagggggcctgggttcaattcctggtaagggaattagagcccacatgctgcaattaagagttctcatgccacaactaaagatcctgcatgttgcaactgagacctagtgcggccaaataaatatttaaaaaaaaattttttttaaaagaggtcttctagagactgatgcgaagtaagtagttacacatcctatagttacacatataggatctgaatgtctttgacatcagttcatagtattttcatttcatagtattttatccatgccacggttgagtggaatcaggtgggggaggtggtagagggcccaggagttatagacaaggcacctggatggaggggagagacctggctgtagcagcacaatatagctcttctctgagattcccccccctccctccttttctcccctcctccttccttattcctttgttgccatggcaactgatgatatgccctcatcctcttcccctctctggctggatccagtccccaggctccatctctctgtctcaccaacctcacagggctgttgccagcctctctccacatccctaagcgagggcacccagctttgccctctgcctgcaacgcactctcttgcctcatttctccaccccaggcccaagccttgccccttctttaatcctgtccaggcttgagtcaaattcccattttccttcaagttgtatgaaaattagatttttcccattctaacttgatttgaaatgcataaagagatctgtctcttgaaacacctcaaggtgaggcaatttgtgaagggaagaaacatcttttagtgctgcttctctgcttaatgcagggctagagtgaatcacattctatttttgtaactaggtgtattttctgtttaaagaattcccccagcacatctctgagtgaaacagaagactatatcataagggaaatcacatctcaagttcaaaggttgtgagttggtgggcctgcagacttttgttaggtccagagagtgcctaaaaagatggagtcaacagttaaaaatcagcaggtgtcacttaaaaagactggattcctggctgcccttaaactagacacagggtgaaaatgggcaggagggtgggagtggggtgggggctgcctcttttgcactgattcttcctttcttgttagctccacctggccagctcccctctttcacctgccccacccgagccagtgagtgaggactgacatgcgtgtcccctctcagagatatttccctccacaacctttagtgggaggaagggagagaatgggcagaataaaagggcagatttttcagttgagtacctttgaagcctctacccctaggtgtgcacaatatagagagatacagcggacctcacaatagcatttgaaatacagtaacatcactcctcacatttattatcaaagcagctctgaatctcattgacatccaaacagacgagatagatttctcagcattctttaaagccactttcagctctgtgttatacttggtccctgctcaggaagctcaggcaactcctgaacctgtctgagtctcattcttattggcagagtgaggatggttatagtactgtctcacagggtggctatgggatgagatgagttgacatggacgggaaagaatatacagtagctacagggcaagtgcgtgagcccttccctcctctccaagacatcttcacagaaggtttgagctcagagtcttctctcaagccgtctactgcatccttttgttcatcgacttgttcattcatttgctcctcaagcattgaccg

SEQ ID NO: 55036 - DNA, 866 bp, Bovine  19866880779379
cctgggtcgggaagatctgctggagaagggaaaggctacccactccagtattctggcctggagaattccagggactgtatagtccatgcggtcgcaaagagttggacacaactgagcaactttcactttcactttacttcatcacacttaaagacaagggtgggaaaaccatattctcaagagttttaggattcccattcctgtcttagatgaaggggaattgtgcattatgtatctatattttatatttaaaatacgtatatattggggggattttgttgatttttaatgcgatagcattttcccctttggctggctaaagtacctatgaataaatatattaatacggtatattatcatatttaataaaactaatagaatttttttcattcataatcatcactttgactccacatgcaaaaaacttttgtggtaggtaatagagatcaaaagtgctgtcggccacatgaaaaagtggtacactgaagccttgtgggtttgatttgagacaaatgctgacaccacactcagagaccattttaaactgtgtgggcagggctggcaagtactggccaaggatggctactaacctggagtcagagtggaccacaagttggaaaacctaaggatgcatgttgtcactttttgaaactaaaggctggtgagccctgttaatccagaatatgatacacatgaattgcagagtaacttttccctgtatgccagtaatcgctgagcttcattcctggcaccctctctgcgtgggttgcaggagatagaagttggcatttgcctaggagaaggacatggccatgagaagagtgtatatacatggagtgcaggaggtttctgagttctatttataa

SEQ ID NO: 55037 - DNA, 3439 bp, Bovine  19866880840054
ggaaaggatgctcttacacctgactttcccgaggacagggctgagcacccagtaagtgacacttgctgacagatggcctgacttcgtgcccagcatagggcagacatgtggcaggagtgtgatagctgcattgtgggcgagtgaattgtctgtgtgcccagcactgagtcagagattagtgatcccctcaggaggcctgatgctcccacgagagaggaaaaggggaaaggcagggtcatcttcagccaggtgatgtgcctggggccccagccccttgggtaaagtgctccctccggccccgcagcttcaaccctcagctccaagctgacagcaagctggccaggttccgtccgaagtccccaggaggataggcaggtgctgcgggagcaaatggttccacagaggaaagaggccccgttgtttccaggtccccgcggggctggcctgctggcttcctggtcccccagccattgtgactttagtcccaagatgctctgtttccattcgtgggctctgtgtgcccctctccctccctcctggagtccagctggccagctgttgcagccaatttcaccacctcctggaagcaagtgtactgggcacggatggaaaccagtttggctgtgctggaactgttaaaaacaggaaactttaagcagaacaatttcctctgggcctagctaacccaaatcaggttgtcttgggatgactccagattttgaagtcagtgttgccactgagatcaaagaaattgaagagaagaaaaatcttctcactaggccaggaatcacaggactggcctctgctgtctggagaaggcgctcacctgtctggtgtgatttttaacagtgctgaaaatctctccttatgtcccccaaataggtcaccacttgccaaaacatgttgattttcccagcattgctaagccacttcagtcgtgtccgactctctgcgatcccatagatggcagcccaccaggctcccccatccctgggtttctccaggcaagaacactggagtgggttgccatttacttctccaatgccatttacttctccaaagtgaaaagtgaaagtgaagtcgctcagtcgtgtctgactcttagcgaccccatggaccaggcttctccatccatgagattttccaggcaagagtactagagtggggtgccattgccttctctgtttcccagcattagggtgtcttataggactttaagttaaggcagtgatggtctccacctgtggtcaccagcattcacatcatatgagaatttgttagaaaagcagattctcagcccccaacctgcatgcgtgcatgctcgctcagtcgtgtctgactctgtgaccccattgactgtagcccacaggactcctctgtccatgggatatcccaggcaagaatactaaaatgggttgccatttcctccttcaggggatcttcccaactcagggactgaacctgtgtctcctgcattggcagggggattctttaccactgagccacctgggaagccctgcccccaacctgagacctactggatcaggaacgctgggcacagggcccatccagggctggctctatgactctgtgactctgcggtcccatggggacttccaccattagaagggccctgggcatggtttgatgtttcagtgagagatcccacattttcactttgctctggtctcagaaatccttgttttagcaagtcctccagtggtcctggtgcttgctccattttgacagcactaggtaaagtcgtggtctcttctgaagcccctgtttaaatttaagtgttaaccaggagtgtgaacattggccacggcaccacccacacctagaactttgcttcattatcatcagttcggctaaccagttggttggcagggaccctaagcggggatcaggtatgggcatgtgtatggtaaaaaggccattcccagtctcccatcccataggctagctgcctgaatcagggtatgaagaggaaagaatttccctcattttgttctaccattttagcaaaacagagggaagtcactaggataacactctgtatggcccagctcttggctctgaagggtggcctgtccctggacagcatcagtgaccccggcacattcactgatgctgtgtcctgaaggtggctggtccccagggatgccactgaagccccttggtaggaacatctcctaatttggatttgttcttctggaggaataacagtgtatggcccagagcttaaatttagtggctgaagggaaaagagaaccaaataaatccagtgcccttgcaggaaggcccttgaacttgattgcacagcatccacatgtctcttgccaagtggcccataaattcagttgcattttatattccctccaatagtctgtttgaatgacttcttttttagttaagtgaatattaactttcgtgacaaattattctatgatcctcttgttctgtaaattaaggtaagcatacttggcttgatgtttgtagtttttataagtaaatgtatgtttggagttaaataatgagctaggagaaccagggctgaactaaagtctgtggtctgagcaataacaaccaagggtctggggcctgagagctttattcgctggggccagagttgaggctatattttgcagacagcagaggtctacttgataggccagggccccccagagtggttggggagtggatgccttcctcggttgcccctagcaaccacctccacagcctgccactaacacagcagcctcctcctgtggcttcacacctctgatcctcactgtctccaaatcaccttgcgtgccattgccggacaaatctccccaaagcaatggtctgagatgccgctcctccaggccactggactcatgaacccagtcgatgagcctggggcacagaccctccttcttctgccgggtggacctgttctcatccccagagagttccttccaggctctgcctcctccgtgctttccagtgtctgcccaagccagtaggcccagaaagccctactttcatttaacagagtgagatacttgatcttcctgagtctcttcaaatgcctttctttcaacagttgtctctgaccacttcaaagtgaccccctcttcctgtgaacccttcagcactgactgtctatattcctcttaggcacccacctctgtcaccctgaattttttacttagatttgtggcttagtgtaccacccagcccccattcaggttctgagcaatttgaagacactgacagtgttgtagaaggagccagagagggagagaattcatgctagttggcatgttttaggcattctccatacttacctaacccttacaagaggtgggcattataatctctgtttggctgacgaggaaactgatattcaacgaggttttcacttactctttgttacgtcagttagagccat

SEQ ID NO: 55038 - DNA, 947 bp, Bovine  19866880848393
tgcggggctgacttaccggctgtgcatgatacgcacgccgtcagggttcaccgtgagcgcctccttgtacagctgcttggcctcctccaaactgcccttcatctcggccagccggccccgcatgtagagcaccgaatgcgaggtgggaaagaggcccgctgcctcctggatgcagaagtctgcttccttgaggtgctgctgctccatgaacagctcggctgtgaaaccagaagggcaggtgaggcggcgggagaagtcagaggcggtggccccctcccacatctgaccgtccgcccccggagttcaggagccgggcttgggtgatggcaccagccccctggaacagcacaggatgggctcactctggggcacggccgtagcaccaggcagtggtttctgagtgctcaccctgcggcaggttcatgccatgtgctgcacggagaccaactctgccgacacgcccaaaaccctacagaaccatcacttctgttacccacttcggggaggaggaaacaggcgcagagaggccgaggaactctcctaaggccacagggagagagagcaatggagccagggttcacactgggctgtctgacatcagagcctggcagtgggggcatgagttggggtcccctgcagctaagtctttgctcgggtcctgttcatcacttgttcatctgctccccatgtgtctggggacagggtggggggcagatgaggtggctccccagggatgccaatggactgaagagctaactctgcctgcatcatcaggacgaggagagctacatgctgctgccaaagatgggactggaaggaagtcccgagggtgcctgcgaaggggcaaggctgggactcagagaagctagaaagccaccagtacatactgagagttgactgtggaccctgggccaggcaagcatcttctcataggtctgggagggagg

SEQ ID NO: 55039 - DNA, 1226 bp, Bovine  19866880886354
tgtttttgtatttttaaaagtatgtgtgtattttattgttatttttaaaaagctgatgccttgattgcagtcttgtgaaaggccctgagcaggagaaaccagctaagctgtacctgtatttctgacagaaagaaactgtaaggtaataaattttgttgtaagctctgttttggaatatttgttacacaggaacatggaactaacacagtagactaaacccagtcccttctggaagtagagcacatgcggtgaaacacttgcctctgggaggctgcagctgggtggatgcagcacatgcgttgggtggatgcagcacatgcattgagtggattcagcacatgcattgggtggatgcagcacatgcgttgagtggatgcagcacacgcattcggtggatgcagcaaagtcaggatggtttggtttttttagcaaatgtcctcacctgcgccactttattttgtttcaactcttttctagccagatgaccttatctctgaagactttattcaaaatgggctttctttacgaattcattttgttttcttttctagcagtgagtttttttcaaccctatcttttatctgaaaattgcagtttgaaagtgatttagttaagaatcatcccagattccagtttattactctatacaattattttctgtccttgactgctttgctccattgtctgccttcttctacctttctttagagcttttcttaattctttcagcgcttggatggagcataagaatctacttgagtaagccctcctattattctcccatttcaacattttttcttttctttttctccctggaactacattttttatattatagtcattgctctgaaagcttgtgcatgacttccttttatttctcatttaattaagaaagaaggaataaatcctcctgtaagagatagaccatcagatcagatcagatcagatcagtcgctcagtcgtgtctgtctctttgccaccccatgaatcgcagcacgccaggcctccctgtccatcaccaactcccggagttcactcagactcatgtccatgagtcagtgatgccatccagccatctcatcctctgtcatccccttctcctcctgcccccaaatccctcccagcatcagggtcttttccaatgagtcaatgcttcgcatgaggtggccaaagtcctggagtttcagctttagcatcattccttccaaagaaatcccaggtctgat

SEQ ID NO: 55040 - DNA, 1609 bp, Bovine  19866880889284
agttagacaggctaggtttggggctgcaggatgacttttggggcacttttcctgtttgtgagtcccctcctccattaaaaatagtaaaaattatattttacgattgtatagaaagtatagaggtataaagaagaatatatgaaggttgtatattaaaacatttccttcaacctaaatttttcttcttactctgattttaaaagaatgttttaaacattttcacaggctcctaaatatcccaagcccattgtgcttgcacctgcatttggtctgggcctgcctctttgctcttgtctttctgatctgtaaaatggggttgttggattaaacgatgatgacattcaagaacgtgacgcatggtgatcatcgatgttggtttcttttcttcattttcatggatttgattttctattttactgatcatgctgcatgtggttttcattttgagtcaccttcaaattctcttgggaagtaggtggagtataatttataaataaaaattccttttcactgcctcagcacttagcacaatgcctggctttatagtcttgatccttatttgttgactgtgctggtaaacagctcgctcccttcccagcctccacccaccatcccgtcccaccccaggcctgacagacactaaaatcatccttccttccttccccctcgaaattcttctttccttagtagtctgtactcggtgggctgttgaagagtggggaagccacccactaaacggctgacctttgaactaggtcatcttcccatggccccttagtgtagaggggcctcacaaccctcgctccagcactgaggaagctctggctcagaggacgtgaggaatctgctcaaaaagtaacgggacaggatgtgaacccaagcctatctgaccgtgacttggtgtgatgtgttacgccttcatgatttgcagttttcagacaactacttggaaaagtaactagaatgtcttaccagtgctgagggagaggttttagacgatttgacgctgctcaagtcacacctgtagggaagcacctaagttgctttaggtgtgcactaacttttgtcattgtcacctgggccattcatcacgttgacagtttgcactgaaacccccttcctaaatattagagaggggtgaggccagaagtaagaggggatggtcatgagtcaccaagaccgagatgagggttttaaatggtgtgtagagggtacagactgaacaccgtttcatgctagccagacttcagagtgcttactatctgctgggcatggggacattaagatggtatcagagcatcagcgagtgagtgtgtgaggccctgagagcaaacagcacctggcataaacatccgctctcacagaacccagcacgtggcacgctgggcacctcctgccctgcgtgctggggagatgggcatgaataaaacatcctcccactgattccagagaagacaaagcaaagattgccctgtgatgggataaaatctgcaagtaaaaaccaagaagcatgttcaagtttatttatgtcctattacacaagctcctccattctccacccccaccctaccccctcaatctgtcacagtcagggatctggggctccaag

SEQ ID NO: 55041 - DNA, 1032 bp, Bovine  19866880935242
ctgaaggtattttcaagtcataatgacccggtcctgggccttcacgctgtagaaaaaaaaaagtttttgtttcataaataatgatagctgatatattttgatgttctacttgtcttttacgaataaacatatgaatcagtgtgatatggtagaaaaatccccggactgggacatggaagatcgtgttaaggtgtgccctggcaccaggcactgtgaaatgggaataatacctgcttttcctgctttacctgccttgtggatgactgtgaagactgcaggggaaaagacatgtggaagtctcccctctccctgcctggataccctcgcctctcccaggccccgtgcccacaccagcaggtctcactccattcttatccctctgctgatggtaacttactgctctgggctgttagttttataaaacacacttattccttaacacaaatgcagcatatgttctcttagtcccccaaaaaagtattcatagcaattcactgccctacatagaatgccatgcgattaacataagtagatgaacacaattttaaaaagacaaacagctcaatagaaaagttagcaaaaggcaacttacagagaggaaatgcagtgaggaaactgcgagtgaggtgggcggagctctaatgtcattaataacaaactcactggaaaagaccctgatactgggaaagactgagggcaggaggagaaggggacgacagaggatgagatggttgatggcatcattgactcgatggacatgggtttgggtggactccgggagttggtgatggacaaggaggcctggcgtgctgcagttcatggggttgcagagtcggacacgactgagcaactgaactgaactgaagttctaattaaaagaacaatgagatatacttttgttggggtcaggaaagaaagaaagagataaaggaaggaaaaaaggaagaagggacggggaagccaaaaccttttacgggggtaggggtatgggggtgggtggagcccagggcacgcacagcttggcttgcagga

SEQ ID NO: 55042 - DNA, 973 bp, Bovine  19866880937951
ctaattttgtgtttgacaaattgagctgtgaaaagaagaaagccataccatctgcagtgaaagctagagctggacccgggtgtccccttgggctcctgttacaaggtagttaagcatgagcacaaagggggcgactcaaacttcagggctaaccactctcattactaatgagtaattacagcaaatatttacaggcctccttcctacctttacgacttcctgttgctgaagcactttggagtattgagaaagatcctggaaagtacgtcatacccagttgcaggaaagaatgtctttaactttaagtgcacgcactctgtttatgaattccatgtggaaacaacagaaaattgtgcttgggagggtctgttcaagggcccattcttcagaacttgaaaacaaaatttgaaaaatcaattctggacggtcaaatgtatggagagtggaacacgtgatgtttctgcagaatgttctagaaagaataggagtgtgcaagcaaagcacaagtcgcttgataactactttttaaagaacatgtgacctctgcactgtttttctgaatgaagataatcaagcttaattaagtacatcacagtatgtaaagtatgccatgtggggaattcaggaagctagaagaatatcattcactccatcaggatttcagaataaaccacaataaggcctccttcctctgtacttggtttaagaagcactccagtgaaattgctctcttcggtgtctgtaaactacatacccttgtgtttctctcctgtgtttccaagagttctcagatgctattttagaatggcagccttcactccagcactggctgaggttgatgaagctaattttggtgcccagggtagagagagagaagtcctctctggagctgaaagggctttctggtgcctgggttcaagagctgcatggtgttactggacacaccacgtttcacctttagaacctttatttg

SEQ ID NO: 55043 - DNA, 803 bp, Bovine  19866880948301
tgttctgacttcacttggatattcaaagaaaattgtttatttcaacccagcaaggctccaaattgtgcgactcagctactttaggctgtgagctgtacctcatcaagtcctcctctctcaccaaggccttattttctttaacctctgctttcaaatccgttctaatctggatttgccactctcttgaaggactttgctgaaagctactttaaaaaggaagaaaaaaaggcaacgctctcaagtgttctgtattgttcctgagatttctccaataatacaactttggttagcgtgtgggttttttccaagtgacagctgtctagcaagtgacagcagttcaactctttactacttaacatgttggtcaccaactttccaatatggaatagagaggcttcaccactggctaccttattacttcagttagccaatcccacattttattattggtttttgtgttctacttctagtaacaagttatttgcctgttaggaatgggttcagctacaagttctagaacactcctctataaatggcttaaacaaatgtctcatggactaaaatggggcaagggaggtcaataaggaacttctcacagtagtttaagtagcggatgatggtttcctgggtgttagttatacctcagtaaagctgggggcaagggggaatgtagctcctagaatctggcttgaataactaaatggatggcagtgacatttgctaaactgggaaaaacagagaggtacatgtttgggggtgaaaatatttcagtgggccaagttaagtttgggatcctagttaga

SEQ ID NO: 55044 - DNA, 1635 bp, Bovine  19866880963881
tgatgccatccagccatctcatcctctgtctccccttatcctcctgccctaaatccctcccagcatcagggtcttttccaatgagtcaatgcttctcatgaggtggccaaagtcctggagtttcagctttagcatcattccttccaaagaaatcccaggtctgatctccttcggaatggactggttggatctccttgcagtccaagggaccgtatgaccacatttagttgggagaacaatatttgcattaatttttgcagaattttcagaatgcttagttctttgagcaacataaggaatcccagatttaggaggcctgatattagaggaatgctcttccctcccctcccccaacttctcagaaaatggcaactcctcagctatataggagaattcagaaagataagtggaaaggaaagatttttgaataccattttccttgtttactgagttggtgtgagatacaaggggacttaaggatttattttgaaagaataaaaattatagactctctaagttacaaataataacaataataacaaaacaaaacaaaaaatacatgatttttccttccaaagtatttgagacgcactctatatgaggaaaatggccttagaagaacatagcaatatatatcttctaccataaaaaacagacatgagattgtgtgaaataagagatcaaaaaagctggcaacctatccggcaaggttttgacttgctctaagtgtttcacccctttctacggtcctgacgttataaacatattcttcgacaatcaaaccgcagcagtaacaacaacaaagacaaatgcacaaaagatttgttaaactttattttgtttgtttgttttattagcacatggcctcagagaagctaactaaagattccaccgtccaactctgtggtgttgctcctcagggcaaggctgacattagatacaggtatttgaaaatgaaagagactcctttccaacccagaagaaattattcaggaatctgggagacagcatatgatgttgtgccaggtgccaccagtctttctcaataaaacatccctagtgaaaaaacgtggaggccagaaagggctggtgagggaaaacatgacgaggagggctggcagcagcatgcccgcaaggaattcaatgtcagggagagcatacagggagacaccgtaaatgtgcttttctcaccaagctccttttcgttttagagttgggaaaactgaggtgcgggcataatcaccaaaggcatacagctagctgctgacagagctggctgtctctactctatcacactgcttcttcacttccctcatttctgttctgaactgcccttgttaattggcactaaagtctctgcacctagagtttcagacatgtttggaaacttcctttaaatgtgttgatcgactgagcactgaattatttgtgaaagcaagaactccctccaggatgaggtattcagagatcagtcatgatatgttccattcttccaggctctctacattttcacacaggaggcatcagtttcttgagagtgcacagccccccaaaagccgttgcaaaggtatctgtggagaaaacaaggcaaaatcccatgggtccagctaccctccacaatcatccttaggatga

SEQ ID NO: 55045 - DNA, 1316 bp, Bovine  19866880968798
aaatggacggaatagacaaatttcaactcctaaaaatgaactgcttgaatgaccaagacaccgcagtccaagtctgcccccatcggatgatatcctttggctctaggataatatttagaatatagagaaacagatgaatggcttatccttcaagtcatcctccttgaacattatttctttaaaacaagcttctgataagaatagagctgcagagtttggagttatcaaggcaaaagtctgaggtttaagataatccattgttcccattaagggaagactgaatatgctttggccacaaaccaagtggaaggtggggccaatgtcctcttttgccaagttaaggagcctaatcaggactggagccagcatgaaaatccactgaacctccatctagaagggggccaagaaaagcagcaaagtttcccacaggaattagttctacatcttctccaacctgtggcaaagtcccaagagctgtacatcatagaaatcagccactggcaagttagcctagaaaatgttcaaagcagccattacctactggccattaagtccacaaaacatttaataaaatgcccagggtgcttagaatcttaatacaagttcacagctttaaaaaaaaaaacaaacaaaaaacactgcattgagccaaaaaaatgagttacatgctgttatctttacaagtcacaaaatgagagggctagcgtaagaaagagggagaagagcacaccaatgttaaaagagaaagaaagaaaaggtttggatatcactgtgcattattgtctttgaaaatagatacttgtccccacaaagtcttctgatgacgtgaaaagaaagttctaaggaatttctatttgtttgacccgctcccactgtccacagctcactcagctcacccagtaaaccctgagggtctgtttcactttttccttcccacacaagcatcacactgacagtgtggcctttccaaaccaccactggaaacttcaactgaattgatcatatatcaggccaatcttgatgccagaaacctgtgacattgtccctgccaggaatgacaaccctcatctgccaagctggactcattgcctgggcaagtgaagggacaaaattttcacttcactccatctggagcaacaaattcaggacacaattgaaactagccttaagcgttaagcatcttaagagggaaggattagtttatacacttatctgattctcattgatacctagtattgtgtacacagtgggagctcaataattgctctcattcgatgaatacttaatttattccaggtgctgtgcttgaagcttta

SEQ ID NO: 55046 - DNA, 729 bp, Bovine  19866881014934
catatgcctcaggacctgctctgatgagaaaaccacttctggtattgttgccgccaacaaattctagacagtcagtgtatacagtggtcacttctgcaccaggaactcaattacaccacaaccagcaccaccacccaccctatgtgccacttcctgtattcagcactgagttgtgggccaagcaccaaagctgcaagagtgcgctctgtatttaactgtagtcactccagctcttgagtctgacaaggaaagcaggagtctgtaacagcttccacaagagtgatctttttcttcccaccaaaacttacaaagtggaagattccccaaattcaaaatgcgcatataacactcagtgaccacaggatccactatggaaaaaaaatcatcaacaatcttggatggttttctggcactgttagaactgaagcctggaataaaatcattaatttcatttctggaagatggatctatgatctggcctcctttgaaccttacaggaggtggccactcccagatcatagaagtattctgtaccagcagcctctaagaagtgtccttttctatgatttagcaatagtggcaatgccatctgttataatgactggtctcctgacctaggatgcagcaaaagatggttagaaatgaagatgggaaaacattattaagggtgcttgagctaaaattctcagaggctgggatttactttctgagtttctagtatgtaacaag

SEQ ID NO: 55047 - DNA, 1453 bp, Bovine  19866881016889
cttcttggctgtgaggaaagaagagctaaggaaatgaaaatgtctgataatccacgtgaggcaagtagaggttatagagatagccaacagtgttttctctttgggaaagtttaacagacatcttattattccttcttggagacaaaagtagagaggagcgcaggccagtgaacaggcaaggtctcagggaaaacagctcatcttagcaggaggcctccttggccctattacctttcggccatcagtttctcttgatcatcttcctgttctgctccaggcctcccctttcctcaccctgggacagcctacatgctctgctcctgcctggaaaggacccagagtggagaggctgagtcctaggaaagtcagcacattctggaaaccacgtctccccctctgctgttgtctagcacccagatgacaatccccaaaccagtgtcagtagccaactgtaggtctccgcttttggacacggcctaatcatccaggaatgatttctggaagtgcccttattaaggaaaagaaatgtaatatgtaacttgactgaaaaaaatccaggaaactccaacactctatcgagttcttacgacattttctttcccccataatccttggccaagttcaaaggtgagcactttcccagaggctcattaggaataatgtttatttcatacatttggaggttgcaaagtttgattccatcttgcttatttggggaaaaaataactttttttatgaaaggaaaggaggggggaatggggaatgagacaagggtacaactggggagagaagaaaggtgcccggggtgcagcctggaaggcagacctgacttctgaaccgttctcatctctggttttctctgaagggttataacagcaagtcaccgccccttccacccttctagacctcctgaccccatctgtcctctctaccttggtgggtgcctatgttgaggtgtgttttgatggcaaataggatacatccttgtgccttcacagagggtgctatataaacgaaatgtacagatgtgtcgtgaggatttgtggtctgctcatctgaagccaggatgccccgaactggcctatcaagccaggccgtccctgaccacttgggtgatgagcagggattctcagtgaccagttgttggctgggggggtgttcatgtttgtgtctcctctgtcctttctatctggcttcctttccgcgcatctaactggctttgccacctcccatgtttgcttagcgaggagcagtgggggaggggtcactgtgggggaatggacgtacctggtatctccacccaccgtatctgctgacctgacctggcctctactcatcctcccaggtccgctcaagcccccagctgaagccttccagcaggaggtgcccctagtttcctggacggggtaaccttgctgtctttatcagtcttcggcaccatcaatatgccaag

SEQ ID NO: 55048 - DNA, 3008 bp, Bovine  19866881068891
ctgtgccccctgtctgtccccccacgtctgccctcggtaacgggggggcgagtgggcagctcagtgccctgcacaggcttacttctcatgtggctcattttgttactgcttcttaaaatggccatgaaattttatcttcacattttccaccatcctcaaacagttactggaggtctttttacatactaggaatctgtgtgtccttaatattaattatatctgcagtaggacaaaacaaacaaaaaaaaccctcagtcttgtttgtgtaggcaccatcctcagaactttccgtgcacgagctcttttaatcctcataagcatccataagataagccctgttattatccccatttccctgatgggagagctgaagcatagaaaggcgagatgccaaaggtcaaataggtagtatggcctatggccgaggctcagattcaaatggggcaaaatgccttcggagcctttactcttaaccagtgatccacaccaccttaccttacctaagatgtctataaataccattccggacctgtggcaagtactctataaatgataactgcttttgctgtatttataactattataattacttttctctttcgtgactcatcacttgttttgaccctgacatgcagacaacgattgaagatctgaagggcaggcttggaagccctggaagctctttatttttcattggttttcctccgtgctgtgtggggttttctccagttgcaaggaccgggagctgctctctacttgcagtgcacaggcttctcattgcttctcttgttgtggagcacaggctctagggaaagcgggtttcactagttgcagcaggcaggctcagtagttttggcttctgggttctagaacacaggctcaatagttgtggcacacaggcccaggctgctccagggcatgtgggatcttcctggaccagagattgaaccgtgtcccctgcattggcaggcagattcttaaccactagaccaccagggaagccctccatgtcccactcttaacaggtggcagtaattcagtaattactgtaaccttcggactcgattgtgcagaagaacctgttagaagctcttcctccataacttttgaagagccatctccaaatcaagatgcacaaaacagcttctggctctactgatcttttgaaattgtaatcacaggaaggagagaatggaggggagaataaagaatagctatgatcattgcaatactagtacggtacatctttatagggccctttctctgatgagtcctaagctttcacagtcatcacaccattggcctctgcactgtgaactttgaagggcttcttgagttttcccagggctctaaaacacaattgcatgaacatatatcactaaggagagaggcaagccatgttggcggttgcacatcattgtgtgtatggtggccatgcaaggcgtgccattcacagcatctatgattttcaggtagaaatgaaatgaaatgttagtcactcagtcatgtccaactcttgtgactccatggactgtagcccactaggctcctctgtccatggaattctccagacaagaatactggaatgcggtgccaagtgccatgcccttctctaggggattttccccacccagggatcaaactcaggtctcccgcattgcaggcaagttctttaccatctgagccaacagggaagctctttcaggtagagattgggtgcaatctgtcaccaatagtccggtctcaagaagagtgacagggccctatgagccctctggactcaagacaggtgtggaatggactagaatgttacctacttctaagtggtcttttttaatttccccgaattttttaagactaccagttagcaaaaaaaaaaaaaaaaaaaaagactaccagttagcttgaccaccttagactgtttccagagatcacttgtacatcagaaaaacttatctgtcatgaccatcagaacctttgcatgttcctaggaggcacattccgtgtccctccccgccacttggaaaaattcttcggttttaaagttacaagtaacttctatgtgagataatgactctgggaagcagttccttttctcatgtggaaagctatttcagaaaagaagatacgtcagtaaggaaaacaactctattaaatatgtatatattgattttgccatgcccctgtctggtttactttcccaattctacaaaaccaaggaagtggattgttagaaatctctccttatatttctccagtgactttctgcatcccatctccatggtaccatccaattaaaaaaaaaaaaaaaatcaaacctgagaggttagtgctaggaatcataacagattaatgattttatcagaggagactatgcactaaaatacatgagtgaggaaatgagtccattttctgcagtcacagtagtaatgttggaggttaactaaccctgcttgtggtgctggttgctctcaattgctggggatgcagccaatatgagagtcttttagaagttcatcgattctgtaacagctttagttgactcttctggtctcactttcagtctgagtctccttgcttatgacctatcactgtgtggaatcagtggttccctataaataaggggacacatggcctcaatctattccaaagcattttatacatactttaaaaatacatcaaagtgtatgtttggttttggtggggggggggggttatgtaataatcattgaaatcactatgctgggtatctagtcggacagttctctctctctctcaatgctgtatttgtattaacaaactgtgtgttttcacctctcttctcagctatttgtaaggcatcctcagacaaccactttgaattgttgcattgctttttcttggggatggttttggtcaccacctcctgtacaaagttgcaaacctgcatccatagttcttcaggtactctgtctaccagatataactccttaagtcgatttgtcactgccactgtataatcacaatgg

SEQ ID NO: 55049 - DNA, 1382 bp, Bovine  19866881135011
ttctgagatttgactgtttggtacatttgaggtcatttcctgctaggttttttgaaaagcctaaatgtgtctcctctctttgcaaatagaaggaactaacatacagagaaggaaaaggcaacccactccagtgttcttgcctggagaatcccagggatgggggagcctggtaggctgccgtctgtggggttgcacagagtcggacacgactgaagcgacttagcagcagcagcaacttacagagggcgcttccctggtggcttggttgtaaagaatctatctgcaatgcaagagagttggttcaatccctgggtcaggaagatcccctggagaaggaaatggctccccactccagtattcttgcctgggaaatcccatggacagaggagcctggtgggctatagtccatggggtcacaaaagagttgaacatgacttagtgactaaacagcaaaagacacagagaggtatagacccatcctcatgccaagtctaaaaattcagtattaagtttaaaattacttgcctgcttgatttcttgaccaaccctcaacttgtaccaggtttcaaggaatcagaagcaacatgataatgttgtctcaaaatgtttatgttacagatagcatcatttcaaatacatttttctttacatctctgatcatatcctatggcttttgtcctaacaacggaatgattgagttccgttgttaggacaacgaatcccgattatgcccaagtgtgaaccagatgtttggggtttttttcccccatcttgaaatattcctcagaaaagaaggtatcacttattgtcaggtgcttatgaatacttattagcatcactctttaaattatttttaatagcaaacagtcattggaagaagatccctaagtctcctgcttctcaagcctggttggagacttcgtggagtttaagaaaatcctgaagatcggtcccacctgagaccgatcataacagaatcttgggaaggggtggtgctaggcactggtcttttttaaaagcttcccagttgtttctgtgagcggtagggctgagtgtctcgggctgagtgtctctgcccttgaaatgacctcaatccttgctaattttgtatacttatgaacgtcaccactcagagtcagtgtccaaggagctaaaaaaactgaagttggattttgtcatttttcttgcgggcatgtctcttcttatccacccatgctcaggaaactagcaagttcagtcacactgaggtgtcagtgactgatagcaatcaagcgttagttagcctgttggcaggacagcccttgtgagttgggggccttctgtatccacccaggtagtggttgcctctcctaagtctggattcctgaggagtactctagccc

SEQ ID NO: 55050 - DNA, 877 bp, Bovine  19866881158919
ttgtggcctttgattattagttttattccttccttagtgccttgttttaaaggctgttgggcaaatttgcatagaggtttaggtgggtcaatctgaactgaacaccatgcatttagttacagtagaatgtaagtggaattgtttgcccacaagagaactgcagtctatgtttgatttaccaccaaaagtactggtaaatcaatattcacattaaccaggacctcattatgaacagggaggtcctcggggactgaaaggaagaggccatcaggagagcatttaatgtggcaattccattcacacagtaaatcccttgctgttaagttaatgagtataatgtcacaaaggagaaaagaacattccttggttaaaagtacagggtgatggttaagtgctggggcctagggaaggtgtgagaattatcagatagattcctgaccacatagtttgttgaatccaaggagagggttgttccagcaggtccctggcttatgatgatgcaacttcttccacctttaagacggtaggaaagtgatattcattgggtggaatccatacttcaaattttgaattttgatctttttaccagtctagcaaaatgcagtaagatcctcactagtgatgctgggcaggcagcaagtggcagctcccagcagccacgtgatcacaaggggacacaaccagtacccttacaaccactctatacctggacaaccattctgtttttcattttcagtattcagtaagttataaaagatactcaatactttattataaaatagtctttgtgttagataattttacacatagtctagtgtaaattctgagcatgtttaagggcagcaaggctataatggaaggtttacaaaatgcattt

SEQ ID NO: 55051 - DNA, 1424 bp, Bovine  19866881175456
tggtgttggagaagactcttgagagtcccttgggactgcaaggagtatccaaccagtccattctaaaggagatcagtcctaggtgttctttcgaaggactgatgctgaagctccaatactttggccacctgatgcaaagagttgactcactggaaaagactctgatgctggagggattgggggcaggaggagaaggggacgacagaggatgagaaaggctggatggcatcactgactcaatggacatgagtttgagcaaactccggtagttggtgatggacagggaggcctggcatgctgcgattcatggggtcgcaaagagtcggacatgactgagcgactgaactgaactgaaattgaggagttgatcatgcagaccactgatttccttttcaccctaattcctggcatcatctcgggaattttgcatccacgcaaatagctagcatcccagtctccaggtccttcacattctcagctccagggaccttcacctcctatccacattgggctgcccattcccttggtcccacctcctatattacaaccacccaaaaccacttcatccttacagtcttaaccttaataatccactctcacatctttgatttctctagctctcactcaggtcctcccactacacctactctctgacctcatcttgacctctgagctcctaactctacctggctctccacttctgtcagcagctcctgacctcacttcctcccactctacatagtttcgcttccattgttctcgctccagcgctatcatctgcttggctttctatcacatctatcccataaactcctaaacctgggttaacctaaatctctgccttctttaccatggctactttcaggactgctagagaagagctcagtgcaatgaagaagtgtgctccacaaattcccagcatcagctgcaccctcaccactcgcagccactcaacttctcccactcccctcaaggtttctaacctttgtgtttttcctcaacttccatcctcagttcccttctcttttagttgaccctaattcttatctcagagagatataaactgaaatctctcaactttttgcccctccactgccactacctagaaaactgtctcggtctacctttcacatggcccttcttcagaaaacaagacattccggatgttcagatatatccattatcatcaacttcctcaaggccttggctccattaggaacaatttcccttctgtacttgtcagcctatgaattccttgttttttcttcctgtaaacaagctcatgcttctcctttaaaaaaaaattctcccaatcaatcccttccctctcacgtcactaagcagtcatacagtataccttccttccaagcttataggacagtctccagtttctcacttccaatccactcctcaatacagacaat

SEQ ID NO: 55052 - DNA, 991 bp, Bovine  19866881267809
ccagtcccgctgcccacgtgtgtctccccggccccggcatctggatcctggccctcatgggagtcctctgtgacgggagagggtagtggcaggtatggggaaggcacgaaagggggcattatctctttaaaggacagtaattagtaattccagctgacggccacgctgcgttgttttaatgaagagttctatttttatagaaaacacataattgagtggaaaaagcaggctattatctgagtcaccacagccacacctttggaaagtcttaactcctcagccaggaggccagagcctgcacacagcgtgggcttcagtgggaagtgggtctcttcccagaaaacggggcctgagtctgaagacccaagttcaaatcccagcttcccttcctctagccctgggacccccggccagtcatttcagcttctcagagctccagtttcaaatctgtaaaatgggacaacagtatcgctaccccctcggggctttaggagaaaagaaggcatacgcaaagcctcgccttcctaaagggttcagcccttcctcactacttacccagccccggttatgcacaaccacttacgtttgcgctctctgcctctctttcctcatctggaaaatgggagttaacaacagtttctacacctcccaggttgcgaggaaagtgagtgaatgcgtggaaggtgtcaaaagcagtgcctggcacacagccaagcacgaggtgtgttgctattttattattatttgaagtgcttggggttcaagcacagcagggttgttcagtgaatcagctggctggtcagggttgttcagcgaatcagctggctggggttctagtccctgctttgccactcatcagctatctgacctggagagaccagctaactctccagttagtttctttagagtaggagggtaagaccgaaaactcaacaaatcaaaccaagacaatgacaaaacagggtagggggatgtgagagcactctgaggg

SEQ ID NO: 55053 - DNA, 740 bp, Bovine  19866881308437
catcgaatgccaatcttgtgatcatctattgctcctgcaagtcattttagtaaaaagcttagatttagtggatatcttttgtctctcttctttttgttttatattaagagttgaattaagggtagaactccaggcctcactctataaatgaaatgtacactcagtctgtatactgaatcaatctgtatactgaaatggaataaaacagaattaattatgctgacttggaacctctcaggaagctgcttgggttgggagactcccaagggaattacgcaagggacaacagtatttcactcacctgcctttagagtcgggtgggatgtggtcagctgtagagctcttcttctgctgagcagaggtacaagtttgggtcagaattaaatggctcaagccaatagaggagagacagattctatcctctttcacttgcagttgtgaagctgtctttaaataaatattaagcacatatttttctatatgtgtttgaagcaatacaaagttgtcccattaaggcatctgtctgtcttggcccagccttgtttatcagtgtcattttacttatcaaagggaatggaccactccttgaacagtcacagaaaccacagtggaactcaggaaacttaaccagtcttgcatcctatcattcacatcccattgctaaataacaattcattccatttgtttattaatgacaattatctgcattgctcaaatgacttcctcatccaaattaaata

SEQ ID NO: 55054 - DNA, 1329 bp, Bovine  19866881370248
tctgcttctgtacttatctgattatgaggagataacagatgactttgttctaaagtgctgagaaaactccctggtcttacaggccggggcatggggctataggcaccgtgcgggtcccagaccacctcttcatctctgcctggcatgacagcaagggcacatgggcaatagagtgaccacaagccaggggcctggcccatgagtgcaacaagagcctgggagacagactattcctggggagacgcgtcgtctcaatgtggtgtccaagaacccagctttcaggttccagctccctcttgagtctcccagcctccagcctccctccagctcaccctcctttcccagtccctgcaacactttctggaacatgcattttttccccctcctcctaatatttttatgtgtgtcacattttcctttcatatccctcaaggtacctgctgcaaagcaggtcacacagcaatcccttcatattcatttgctcaaaatccttttactcaccataaaagtcaaactcaaaatgcctcctagctttgcagtgtcccagtatgcttatctaagctctattttctttgaaatgtcaatatgcttatctaagctctattttcttcttttaaatatcctcaaagaaaaaggaaacatataaataattagaatgcttgctcaatatcaattaactagatctttagatatacatatgtatatgtatttagttcagttcagttcagtcgctcagttgtgtccgactctttgcgaccccatgaactgcagcacgccaggccgccctgtccattaccaactcccagagtccacccaaacccatgtccattgagtcagtattaattaagcccatatattttcagagtatatatgcatatctttatacacatgttcacctgtgaagttagatgaaataggaatgtaaaactgcatagtgtcttgcctgacaaaaatagagttgggacacaaattcaagttaactatcatttgcctagaaatttctctcaacatattcttctatccctttcctgattttccttatagaaaacagagtaagacacacagagggctgccagtggaacctttcacagcacctatcttgccagggaggtgctctaccatcctttaatccatttccttcttagagtgtggtggccagaactgatggcttgatccttgtctctgtgttctgagcaatgctaagggcagccagtttctacttggtggaaaccctcaaaccactgtctaagatagtgtcagtgatttatcacttatggagtaactgtgataacacagtgatgctctgacagctttaccaatccagtctaa

SEQ ID NO: 55055 - DNA, 930 bp, Bovine  19866881905247
actgagcttatagtctatgtgagactctccagagaacacaagatgtgtgacacacaatttctgtctttttggactcacagtttatttggggagaaaaaaattcacctgcaaaaaaagctataatccaaggcagtataagatggctttgtacacctttttttattaactctgtctcaagtaagaaaaactacttctgctgctatatcagaagagcaatatagaagagaagacagttaagcttgggcttaagggacagttaaatttcattaagcagagaaatgagggagggcagttcaagcaagtgatggcaggagccaaggtgcagaggctgaaacatggtgctatttgtgtgactggacagatggtttctgtgggcaggctaggagacaagactacagacctgtttctaccatggcatgtaggggcaattttttatttcaatcgctacactgaatgaatgaaaagggcttcccgggtggctcagcggtaaagaatctgcctgcagtgcaggagcctcaggagatgagggttcaatctctgggtcaggaagatcccctgggggagggcatggcaacccactccagtattcttgcctggagaatcccctagacagatgagcctggcatgctacagtccatagcatgtagcatggactgtaaaaagagtcggacacaacctgaagtgacttagcacacatgcatgaatgaaataaggaagattggtaaaaagaaccccagaatggaaatcaggagaccagacatcagctttgtcaccaattacctggactccctcaaacaagtcactgtgggagctgaactgtcctcagctgtcaaacagaggtattctgactcatctctacatgctcctacgagttacaaggacaaaatgaacaatcagagggaaaactctcgaaaaaggaaactgctgtgc

SEQ ID NO: 55056 - DNA, 1179 bp, Bovine  19866880424854
acttcacctttgtggtcttccttccaaacgcataccctagtctaagcatgagaaaaatatcagccaagaccagagcacggggctgtacaaaataacctgccctcaaaaccatcaaggtcacacacaacaaggagagtctgaagaagcagcagagatcagaagaggccgaggaggtgtgaccgttaaatgtaaggaggtttcctggaggggaccctgggacagaaaaagaacttggggcaggggggaaaccccaataacccatagaatctcactgatagtggtggacggatgccgctgacttcattgagacaaatgactacagctttgtcagctgccaacaagaaggggacaggtgtgggggggtggatgctctctgcacccttgcgattgctctgcatatgcacagctcttctgagcaaaaagcttatattcacagtaaataaagatgcagagatgcctggcaatcctaacagaagctgggcttcgctcaccacccattcgatggatttggggatttggctggaccactccagctcaagtaaaccagggtctccgagcctggggcctgaaacttggacgtccacaaggtcccgatgagtgtcccatgccgtttgggggtaaaaccactcaccagggtgagacaggaatcaagtccgaagggctgccgtggaggcacatggaattctaaacaagtactggcatcctcgacgaacgagaaaggaccgcactgaatgcgtttcctccccggcccgccagacctctaaaggtctcattgttgcatctcctccggcagctacacccccagcccagggagtgctgtacggctgtggaaatcaggtggtgggaggggttcaaatttctgctcagtgtgaaaatgcaaagtgacctgggctagcgaggaaaagagcaggtgtcctctttcgtccagctgggggtcactgtcccctaaggggccccctggccggcccttcctgccacaccgaggtctcggacttgactggcttgagctcccagagggggacctcaggagcactaacactgcagcaggccccgggaagacctgagctccgagccccgagtttctcggcgaagaggggagccatttccgactggggagggctggccccaagccagcaagtccccagatgccttgcaatgcacacctgagcggggtaagag

SEQ ID NO: 55057 - DNA, 3977 bp, Bovine  19866880426614
tcatatttttggatcctaagatccgccaaaagcagaatctgagcactctccaaagcaccgtgcctttggattgagaacaaaaccgcagacaacactttttcattttttccctcttgaaaagtcccaaagcccagattacaagaaaaccttggctttccaagcccgtgcctctcggggtagcagacacaccccgctgtcctcaggcaggactggatctggacatcccgacgcccatggcccactttctgcacacactggccggagtggctctgggcaatgctgagtggatggctggccaggatgggttcttttcaaagacagaaaacacctggagagaagagagaagtgggctccagggaggcgagccctggggagccactgccaccccccaggatgttctggggccgctccattttaattccctcccatctgaaggcagcctctgcacagaagtgcttggtgcattctacatgtgaccgctgggcactctcctgcctctgctcagagcgcttctctggtgggaggggcaggattcggcaggtcctggctccaaggcagggatgagaactggctagagtgagccaaggttctcacctggaccctgcagagcccgacagggctgccttggctccccgacaggtttcctttctggcttagggctttcttcctggatgattttctatctgctgtgtcggaaggagggggatgtttcaggtggggcacctccacgcgcccggatgcccacgtttggaggtgacgcaggccagcaggtgtgtgtgcaggaaggcgcgtgcagctgctgcgcccacatcaaaggcgtgaggcccagtgtgggagtccactggagcgggcgctattcttggcccaggcactgactggctgtgatacgatgcctgccgctatcttgctgcaccatctgcaaaacggggcaagatcaaactttcctggttccacaaaactcatgggcaaaccacctcactggtcaggaacctggcctgtctactgggccctggggccagaccctcctattgcctccctgaggttttctgagcatccatctggcactgtcttcatgccatctcttgctgttgcactaagtcatgtctgaccctttgcactgcaacatgccaggcttccctgtccttcactctctcctggagtttgctccagttcatgtcctctgagccagtgatgccatccaaccatctcatcctctgcttcccccttctcctcctaccctatctttcccagcatcagggtcttttccagtgagtcagctcttcgcatcaggtggccaagtattggagcttcagcttcaatctgtcctcccaatgaatattcagggttgattttctttaggattgactggtttgatctccttgcagtccaaggaactctcaagagtcttttccaacaccacagttcgaaagcatcagttcttcagcactcagccttctttatggaccaagtctcacatccctacatgacgattagaaaaaccatagctttgactatgtagagaggaggtgatcccactaggagaagtgctcctggtttctagtgaaagcaaacctgtggctctcacagctcctgtctggcctcccaggtgcccttcccaacccccagttgggtcttgccagtgtcctgctcgactcctactaagaaccgatgggcagagacatccaggtctccttctgtcccactcactctgacttgatgtatacttgccagccgcatgtggcagctccgagttcctcggtcaggccaggtctttttcaagtcccagggcctttgcaaatgctgtttcctcatctgtcctttccctccaaccagctcagcaaacttctcttcatccttcagaacccagtgctgagatcattctcatcggggagccttccctgatccctgtactcccccatcctcaggctccacatcagggggtgtggggcaccccaaggcctgctcctcatcatctctcagggcagactggctggagtgcatctctacttgggagagcaggagtgaaagtgcctcatccaactttactcccaggctcccccctctcagagggaggtctggagtccctgtcccaggaaacccggggtagaaaggttggaagcaggaaggacagctgtcaggaggctggaggcgggtggagatgacttcagatttacatcagtttggggcttgagaggaaggatcacggggagttcaacacaagccagtcagactgtggttcagctgttccctgctctctgtgtatgctccctgctctgtgtgtgctccctgctctgtgtgtgtgctccctgctctgtgtgtgtgctccctgctctgtgtgtgctccctgctctgtgtgtgtgctccctgctctctgtgtgtgctccttgctttgtgtgtgctccctgttctgtgtaagtgctccctgctctgtgtgtgtgctccctgctctctgtgtgtgctccctgctctctgtgtgctccctgctctctgtgtgtgctccctgctctgtgtgagtgctccctgctctctgtgtgtgctccctgctctgtgtgtgtgctcagcccctgctggtgtctccaggagcccagggagtgttctctgaaggtgaggagggtgctggcggcggggggcggggtgcctgcagggccctcactaaacttcaagcacaagcctgcccagtgggggcttagctggagaagcaggagtgaagggaagggcctgcctgtgacctcacgccagggcgcctatgcctgcattgagctgctgccttcaggaagccgaggaggccgtgagaaaggagaggccctcttgaacagcagataaagacggggagggaggcgctggcagcccatccgattcctgcccggggctgatgactggtgacattcagatagctccctgggtctggtttttcctgttcctgaagtttccgcagtatgcagggctaggtcagaagtggctgctggggagtgttgctcatgtgcatgggtgtgtgtatatgtgtgtgtgtgtgcatgtatacgtgcatgtgtgtgtgcgcgtgtgtgtacatgtgtgtgagtatgcgcgtgctgtctctgtttagggaaacaggaaattcaggattcatatcagcaccacatcccaggctgccttgcttcctagaaaggaagggcagataacacggggcctgaccagaaggaaggggctcgtggcctggctttgtcccagggcagcgtctggcccctgggtgtccgctttcttttcttctagaggaggctcaagtacttgcctggaagaagccaagtagggagcagccttggctcaagaaagctctgagtcttgccggggctgcacgttatggtcacctctctcccgggccatcagtgagagggccaggagggtggctctgaagggagcagatgacagaggacgcggaggggctgggaaggtggagccctccagcgtggagggtcaggaccttggagctggagtctcagggtccagagttcaaggcagggggagctgggagccagtggtgggggcaggggcctgctattgccttcacagcccaggaaagaggcctcaggccttgactggctggtccagcatccatggcgctcacctgctgaactccccagcttcccagctggtgaccttccttcaaggagtcccagataccctgccctggatctgggcctgggcacctgaggaggctggcactctgcccactcacctgggccaccccttagagcagggccccattgtaagcacgcctggacctggtgtgggctccttggagcttcaccccggagctcagccttcaggtctccctgcaggcccgccctgcctccagggtccctctgatccctgacctcggtgccccggggaaggggcctgggcacaggctagaacagctcacactgcagagtctctgtgcattgatcccctccccccaccctagcttgttacatttttaaaaatagctaatgaggaaa

SEQ ID NO: 55058 - DNA, 3259 bp, Bovine  19866880435643
ttgtaaagcaattatattcccataagaaaaaaaatgtttaaggtatctaattcaaggtcatagggttgctaacttgaaattcgcctagtgtatctttttaaccccatggactcagcactctagtcttccttgtcctgcactatctctcacaatttgctcagactcatgtccattgagtcagtgatgccatcccaccatctcgtcttctgtcatgccctactcctcctgccttcaatctttcccagcatctgggtcctttccggtgagtaggctcttcacattgggtggccaaaatattggagcttcagcttcagcatcagtccttccaatgagtattcagatttgacttcttttaggattaacttgtttgatctccttgcagtccaagggactctcaagagttgtctccagcaacacagtttgaaagcatcaattcttcaacactcagccttctttatggtccaactctcacatccatatatcatgactggaaaaatcatagctttgactatatggacctttgctggcaaagtgatgatgtctctgctttttaatatgctgtctaggtttgtcataggttttcttccagggagcaagagccttttagtttcatgactgcttcactttaccaggcctcacagcgacagaaagacaacatccctctcagagtctctttaaaatgctcccaactaacaatccagccattctctcagacttgcttctggtttgtactaattaacacatttctgtgcctttaataaaggacttaagttgtgagatcctgcatttattgaaacatggtttcatgtgtgccgcggtccctctctttctgaaatcttcccaaatgctttgcaaaaatcacagccaagcccaggcactccactcaccaggaaggtgaagacagagtgagtgatcttctgttattttgattcacaggtgccttaagctcagtccctgggtttaaagtgaaagttgctcagttgtgtccaactctttgcgaccccatggactatacagtccatggaattccccaggccagaatactggagtgggtagcctttcccttctccagaggatcttcccaacccagggatcgaacccaggtctcccacattgcagacagattctttaccagctgagccaccagggaagcacaagaatactggagtgggtagcctaaccctgctccagtggatcttcctgacccaggaattgaactggagtctcctgcattgcaggcagattctttaccaactgagctaacagggaatctccctggattaagcaccaattaactcctgtgacatgaattcagccccttcctgccccgaacctctgtttcctttactcttaaaatggagagaacagcagtgtgtgttttagaccacgggctgggaggattctgtgaaatcttgtattcacagcacctaacacaggtcttggggcatcacagcacctcgcggttgatttcctcctccatcctgtctcacctgattaggaaaacaaggtttcacatgatccaggggcctacctgctgcctgtaacttacacagaattatcatatcttcccatacataaatatacataagacgagtggtgtaacattattagcataatgaatattctaattatgtctctaacattaaaactgccaccaaacattaatccctggggaataccaattgccaaggaggtagttaccaacccttttggggtgtgctgtgaggattgaacttgtgaaatcaaggagccatcccactttccgaaacacaggaggaaatctgctacaacagaataccagcaacatacacagggcccctttgctaacacagcgtggccataccatttctcttctcatagaatattactgtggggacagaagaaatgagtgcggagaatttaatccagaccatggatggaggatttacatgggctggaggctggcttatgcatttccccacgtttctcaaatagttcaatgaaggtgtttagtagcacactcccattctgtgcttgggggtctgaggtgcagcgaagttaagtcatggttagtgcatgctcagccactaagtcatgtctgactcttgtgactccatggactgtagccccccaagctcctctgtccatgggattctccaggtaagaatactggagtgggttgccatttccttctctaggggatcctcccaacccaggatcgaacccgagtctcctaaactggaaagtcgattctttagcactaagccatcagttcagttcagtcactcagttgtgtctgactcttttcgaccccatggactgcagcacgccaggttccctgtccaaagccaattcccggagtttactcaaactcatgcccattgagtcggtgatgccatccaaccatctcatcctctgtcaccccccttctcttcctgccctcaatctcttccagcatcaggatcttttccagtgagccagttcttcgcatcaggtggccaaagtattggagtttgagcttcagcatcagtccttccaattcaggactgatttcctttaggactgatttccacacagaagaaccatcagggaagcctctaaactataatgaaaacaagagctgccacttctgagtgtttcctctgggctacatttccagagccatttgcacaagttatcatcactgttactatgccggcatgcacatcagcactgctgctgctgctgctgctgtgtcgcttcagtcatgtccgactctgtgcaaccccatagacggcagcccaccaggctcccccgtccctgggattctccgtgcaagaacactggagtgggttgccatttccttctctaatgcatgaaaatgaaaagtgaaagtgaagtcgctcagtcgtgtccaattcttagcaaccccatggactgtagcccaccaggctcctccatccatgggatttttctggcgagagtactggagtggggtgccttctctagtactcagcaaatgtcctacaagagaacagcagtggaaccggaacctcccccaggtcatcactccctcagggcagacagaaatgccaagaaacactcccccattgtccaggctcccacagctccctatcaggaagctgtgattcaaaacccatttgagcaaactctgagagatagatagtggaggacagaggaacctggtacactccagtccatggggtcgcaaagagtcggacatgacttagcaactgaacaaccaccgtcagctaccacacaccagctacctacacactgt

SEQ ID NO: 55059 - DNA, 7744 bp, Bovine  19866880459099
ctggagagggctgagtggtgatagaatccggatcgtggtgagagcctatcaagaggatgagctgaagggaggcactgaggtctggaggagcagcgggtgccaccagattagagtgaaaccttcccacaccacctgtggtcagatctctgctcacagccactgcacaccaggtgaccagaccctacggctccctcttcaggggccagctcactctccagttcacttgagagcaagaggatggcttttgtccttccctagggaaaagtgcttagtatgaaacatgtgcatccagacacgatcttccgtaggaagtagaggatgttttctagactgagaatagctatagaagtttgggttggtgggtctgattagctctgttctctccaccttctctctttgcttctctaattggtgaatggtgtggtcagggaggaaaggggcctgggagtgccctcccacccctggaaatgtgactgaactgagcctgaagcctctggtgttcttctctaagaagaacttggttgtcattgcagagctgaggtgtggactccaggcccggactgtagaagtaaaaggtggagcctgtcctgggaaatgcaggcaggcaagtcacacatttgagtaacagaggctctctgctcattctgattctccaaacatcttgtccaacccagcagaagaccatgaggagctcaactcctgaatgtagagccttgtgggccctgtgtcttctccgtgtgggttctttgtgtgcatttcgcatgccctgggtgagttgttcaggaggctctattcccgaaatagctgctgctgctgtggtgtgggtaggacaagggcgtggggaaggctgaccccctagtgtcagcagcctgggggagagtgtgggcaggaaggccaccacggtgagtggctgggagtggccctacagacctggctctaccacttgccaatcacaggaccagggcacagaagttagcaggcagcaaatgagcagatttaggatggatgagaagtcaggattctggggaccagacctgattagatctgcagtgcggagagttactctccgagttcagatacagcaacaaagagaggggaatggtccttgctccctgccttgctgactgtaaaaagccagtagcggaaagcctaccacagtgttttgaaatctgcaaagttcttcccaaggacaaccttcagattctccctaaataggccagaaatagaaggctctgggcctctcctactgcttcagtggacggagcctgtgttccagctgctcctgcaggcgatcgttaatgcagatggactcctccaggtgctggcgcaggttacagatttcaccaagatgctcctctagcaggtcagcccctgtagccacctagcaggacaggaggaggtggggatggagcactctggtcactaatggggcccacattgggggtggggctcggccagccaaatccctaactatcaccatcctctctcccacagatatccagaagtttacctgagcttgcctgaagagcatactggcttcaaacacaggaccggtgatgctaagcaagccccagtggcctcctcccatacaggggtctgtgtcagggagttggaatacatgtacagtgacctgggcaactggtaggtgtaaggggttccccattgtctagaaaaataactgaagcttgtggaactcggtgtagaccctagacaggtgtgacctttgcctgagttgacttgagggtactagggaggagctcaattaaccttaacacctctccttgcactgacccttgactgaacattgcttagcaaggaacactgcccttcctccacccttagagagaaggcccaaagtaaaagtgggtatctcatggacttccctggtgacccagtgattaagaacatgcctgccaatgcaggggacaggagtttgatacccagaccaggaagattccacaggctgcagggcaacaaagcccgtgcgttcaccacagctagagacgctcgtgtgctctagggtcctggctccgtaacaaaagggggccccacaatgagaagcctgcgcacggtaaccagaggggaacctccacgtgctgcaactagagaaagttcctgcacagcagtgaagacccagcacagccaaaaataagaaataaatacattttaaaaagttagtacctcatgtcaactcatcctgtgtggttcatgattggtactcaacaattccctcaaatcacttttattatggaaggaagaaagctcactcaacttttccaaagagatctgtgatgtggtctttgtttaagaggagcaaaaatgattgtactcatgtctgctgtttaatgtttcaactaaccatcccttgcctcatcaaggccattgcctttggttgctaaagttttgaatagtttccatctccagtccttccagcaggtaatccaggtgaatctgcttttccaaaggagattggcctagtctatgtcctgttatttgcaaacagaccttaaaatgcctcttcttagctcttcttcccccaacatcctaacttaccctgatttggaaatgccagttcagtctcagtcacagttacctactactccataaatggctgcccctgggtttgcataaaaacatctctagtgtgacattatctttgtctgtatggcactgaagtaggaatccgacagctgattagagagttggaaaaagcaccccaaagaaaaggaaaaaagatgcaggaaagagcagtgggtggggtgctgatgaccgactccgtcaaatgcctcattttgcctggacacagccttctgagaatcccagttctctcctgttggaactgggctgcatcccagcattcacctgtgtggctgcacctctccaccaggtggagaccagggagctaggagtgtgagttgggtttgtactcagggcacatttaaagggtgaggatctgtgtagcgacaaccccactttctgtaattactctggatgatggaagaatgttctgcaaatgttggcacctggcattcgggaaggctctgagagtgggctgtgaggggaccagggagcagggactgagaaggatgtgactatgagagcacagaggcagtcactgactctcacagccctgctccgccccgaggcccagggtggggaggatgaggcgtgcactcggaaggacttggcactgccgggggcttcgctttacctcactctgtgagcaggggctagaggagaaatggaagaggaggccctggtagaaaagaggggggtcctaaatgagacttcatttcacaggctgacctactcggctttgtgtttacctgtgggtttggagtgaagctggcacatggaggagcctgaggataggtctccagttatgctcacttcctgaggtctcatcacataccactggccactgctgcccagttctgtcctggaagagagtggggctgggcagggttgggcaccatactgcaaaggagacatttcccttgagaagccaccttgacaagggacttgctttacttaagtggagtcatgcttgttgctgctaggatttcaaggtcttcattctaggccctttgtttaatgttggggctttttccttcatgaaaatctccctggaatttttgtcttaaatgcagtttcttgagtcttatccccaagtttataacaggccctgttgtgtctctggtgtagattttctatactgtgcagccagcacccagggattggggcctgtctccggtatgatatcacagtcaatcatccaaggttagtactatttctctattttacacgctacattcttctccactatacacgagatccatgtgctcaaagagggcaatgaaatcaccatggaaagcagacttggtattttggtggagttgaaatgtgcaccttggacttctgtcaccagggctgtgctttcattgttttcacatggacacagggtaggatcgatggagacagggtaaggagtagaagacttcagtaagagccagtgattcctggtaaccagtgttgatctgcttgacaagtacttactgaatgttccctgtggcaggctttgaagaggctctggggaggagggctgactaaggcacagagggtgcctggctctcaggaatatggcctctagcacaggagccagatattttacagagaatcacatctaatttttaaataaagactgtgatgtatttaatattcatgcatttcttggtcccattgtgtccaccaagggggaaaacagagtataaatataggattattggaaagagattgggcttccctggtgactcagatggtaaagaatccacctgcaatgcaggagacctgaattcagtccctgggtcaggaagatatgctggagaagggaatgccgagtctaaatataggactattgacagagataaaatttggggcgggggagatgtctgtcaagtgttttttattttaggaagggaaataagaagtaagtttgatcaaatgtcccctgaaatttagccgtgggttcctggtgcttttggatacaaacgcttgtagtcaaggtttgtgtggcagctctgctgcataagggcgtgggaatttcggcgaaatctccatgtctctctgggcctcagtttcctcatctgtaagataaggttattcaaaatctccaaattcctttcctgctgactttttcctgagtgcaggagagactgagatgcatggtaagtgtgcactgggatctgcagccaagacctcaccttggttccttctctgtgtgtctcccataggagcctcaactgggcccacacactggaaacacagaaaggagagaggggatggaagaaaggaaatcagcaggttcggaggatgagaaaacccaaagaaaagcgaggtaatggtcgaggagctgtttgccaagggaggtgaggacaaggacaagtggagcttggaaagttcagtaggaattgaggaacgcacagcatcatctaagttctcaaggagcaacctgagctgagcaggaaggaccaggagagtaatttagtccccagcgaacttgtgcacctgccgaggagatccacacgatggatccagttggtttatactgctgggagcaccaatcccaggaggaggatgaggtttatactgctgggagcaccgatcccagcaggaagatgatgggaccttgaggctctgcacgagacccccagcttgaaacttggacgtgcccacatgtggatgtcctccaagtaagggtgtatgtaataaggtggataaatggtgtttggagaaacattagagatcttcattcttatcaggggccaggataatgggactcatttctgaagcagagatggtaataatattcttctccatttacaattttgaggctttacacacatcctctcttaactatgtgttgagtgcttaatgtgcagacaaggaagagcatgtacactgttccattttataaatttgttaaaaagacaaattcatgtaaactggctgcttggggctaagtgctgagggagtgatgtgctgcagaggggaacaaggagagttgtgaccaatggaaacaccctgcgtcgtgatggtagctgtggtttccatagtgtatacatctatcaaacgcatgtagttctatagttttaaatagtgccgtcaagaggagtcatataaaaatctaccacatttctccataccagcaggattagggaatgaaattcaataaaacataatagagataaacatccatgatcatttaatgctcaagaatacagactaatgactcctgaaaactactgctgagagaattaaagaagacctaaataaatagaaatatatgttatattcgtagattggaagacaatatttttagaatgtcaaatccttgttattctcaatagtattgcacctggcatggggggggggtgtatattttgcagggtaattataacatgtaaatggaaatcaaagtatctcaattagccaagacacactgaaggagaattaagttggaggatttactctactagatttcaaaactcaggttaaaacacagtgattaagacaatatactggtttaagtaagcagaacacaaattgatgaatgaaagaggagagagtgagtaagtgaccatatccagttttttaataaagtcaccaatatgcatcacggggtaatgatagacttttctgcaaaatattctgttgtgaaaaacagtatcaagtgagaaattattactacatttgggaagtttttggtagaaatgcagtataggtgaaggaaacagctactgggaggaatctgacacaagagtgaactggaaaatgtgggatggggtttcgcaggagaagggatgctacccaggggtggctccagcccttacagcaagggggtcttggcctgttagagaccctctctgtgcctccgtttcttcacctgcaaagcagcagagagttatgtttttggcaccagtccattttgaacactagaagtaccataaaggaaataatcatcccctcgaatcatgagggaggccaaagaaatcagtaggtaacaataagtgcacacctgaggacctttaacaaatagattccaggtcccatctgaactcactgaatcacagttgctacagtgaggactgtgcacttgtttgggtactaactctcccaggtgattcttacagtgatcagcttggggacagaacaactgagctgcataccttttaccccaaacacagaaggaggacagagcagaagcacaagggtgtttccaatcccatgactaaagcagagaactattggaagactctagcattgaaggactaggcccatctgaccccattttactcttgtccagtgtacagcagagacacaagtccttggggacacatgcctgtggcacccgactatccaccttgaggaaagtgagagccccaattttaaattcagtctggtttgagtgaaagctaaatttcacccttgtttgctcattgatgggaccaatcttctccaagctgccactttctaaaaaataaatcgtattgctataaatacaaacttcagcaaagatgtttgttagaaaattttattaacactcaagccacctaacaagaaaccagaaagttagcaagagcattcagtttcaggagagtttggcccaatagagcacagtcactgagagacaagatccttgagttgaagggaagtgatcctttctgtcctgggtcgtcctgctaacttcagtgggctgggcaagcagctgcccattctaacagatgggattctcagggggcgctagcggtaaagaacccgcctgctaatgtaggccatgcaagggacagggttttgatccctggctcaggaagattccctggaggaagaaatggcaacccactccagtattcttgcctgggaaatcccatgaacagaggaggctggagggctacagtccataggatcacaaagagtgggacatgactgaagcaacttagcacagctcgcattctaacagatgggctgctcttgcctccagatggcgactggtgtcctgaaacacataagcactcaggaagcctttagaagggcccagccatcacttctgctattgctcagtgcacaaaaatggtttagttgagaaaaggtagggctctaggaataaagtcaggtcacaaagaagtatgaaatgggacaaaggcaggataaaaacaataggtttctcctacctacaaaatgcaaagca

SEQ ID NO: 55060 - DNA, 973 bp, Bovine  19866880598974
ctttacgaccccatagactgtagcccaccagcctcctctgtcccggaattctccaggcaagagtactggagtgggttgccattcccttctccaggggatcaccacaggcctcctctatgtcaggaagattctctattgtctgagaatctgagtcaccagggaagccctacagtagttcaaacatggaaacgagagcccgaaaccaaacagagcaccctacaccataggaaattcaaactggagaaaataagaattctgctttcaaaagcatttactaaaagaaaaggaaagggtggagaaaagtgtgttcaaaagttgcaaggaggctaattagaaatacactactcagtgcacaaaagagcagggagtttggatgtgaaaattaaagatttgaatgtgaaagtttcaagtaaacaaaagattaattactatatgcattggcttttgccttttaaagagacaactaccatgcctgcaggcttctctgtgattccctgtataaaggataactcaaaagtatgcattttccttaatgagatttttttcatataaggaaatgcaattggtaaaaatttaacttacgacacctttctaggcagcacactagccattgctgaaactcagtaaaattgtgtttgaatctaagttcacatttggtgcatttatgctttgtatgtttaacacactttataaataatgattcatgctcactaaattgatataaaatactcttccatccactatatcaataagagacctagatgcattagagaaggaatctgtcagagcagggtctggaaatcttaaattctcagaagccattcccaaacccatgaggccacctaccctgtactttgaagacaaagtagacccatctaattctgtgataccagaactgtaatggtgcctggcatggagctggcactcaataaatatatactcaaggaagggatggcagacaggagggtgggtg

SEQ ID NO: 55061 - DNA, 1206 bp, Bovine  19866880603877
tgtctattcttacattttgaagagtcttaaaagtattgtacattgaaatgccaaaattacaaacctctactgaataaataatttcaggaaaaaattgatctctacctgatctctaatggtatatttaatctttttgacaaatctgaatccttcaataggttttttaatataaatgtgcataatatgcttactgtactataaaataaactataagcctgcagaggtaatgatatttttattttacatattaaaacattttagaaaaactgatttttaagtactgttttcaaatatttaaatattttcaaatatcaaagccttaattaccatattttagtttttcatgttaaagttagaaacacacaactttgaaacatttaaaattctttctctgttctacattcgtataaaatactgaaaacagcattatgagtttaaatgagaaaatattttaaaaatcaattttatcctattgaaagcaaaagaaaagttattaaaaaagctaccaaggaaaaaattacagccacttagtgtacataaaaatggtctaaaggctcagatgtaccagctgtttaagtgccaaataccacaactgatttttcttaagctttccatacaaaacctgctgcagttagcagacacaatcaaaactgaataaagcattgatttggggttttacataagttggttagaagtctgccttttttaaatggaattaagataaattccattctctcaaaaaatgtctgctataacattcccattgatacccaataaatgattctaaatattcatttgaaaatgaataaattatatctggaaataaaaataaaattagttcacttctgtctttctaatatttcagaccagttgtctagctctgtagtcacagacagcctgctggcttccagaaataggaagctgtagctccagtagctacagctgtgtggtcttaggtaactcccactccctgcctcccagagttacgggtattaaacgaaataatctaggtaaatccatatattgagggctcaagtaatagcactagctagtgcttttattagcatgtgcccagcatgtaataaactctataaatatttaatgaatgaacacaatcaaaacgttcagcataacaaaaacagagtccagctaagtcaaaaggcctttctaacaataccgacaacagccagtaaacagaaacagaag

SEQ ID NO: 55062 - DNA, 1289 bp, Bovine  19866880624940
gtcgcacagagttggacatgactgaagtgacgcagcagcacagggacttccttagggcccactgtttaagattctgccttccagtgcgtggggaatgggtttgatccctggtcggggggctaaggtcccaaattctgtagggtacagccaaaaattaaaaaaaaaaaaaaaaaaacttactacaaagctgccacagaacactgtggcactgaccataaggagagacataatggaatagaattgagagtccagacgtaaaaataagttctcacatctacagccagttaagctgtagaaaggttgccaagtccattcattgaggggaagaatagtctacaagaaatgatattggaacagctagatttccacatgtgaaagaatgaagttggacccttatttcacaccatgtgcaaaaattaacaggaatgggtcaatgtactttttcccaaggttttttccaatcagaaaggataattaaagtgaaaattattttaaaagaatagagttctttgggagcaatacttttttgtgtgtagttttttcactctgcagattatttattaagcaaaagtgatatgatggctctatgtgctaagcattcgaaatatacaaccaaacttgtctttagctttaatggagtttatcttctagcagggtagataagcattaataaaattatttcactcttgaataacaacatgctgattgtgatatgtatatgcaaggaagcatatgtggtttgagctttgtagtagaggaatacagtgtagtttcacggaggactccctgaagagggggagctgagtggagagacagaggatgagtaggaattaacctggttaagaccaggaaggggagagtgtggccagctcctgacgtgttctaggggttttgattgtctccagatagtaacgggcttaattttatcattttattttttgtttctgaccctttggctacagtgctgagtggcggttttctgtctctttgtttcatctgtgttccaggatgcccatggtgctcgctctgtgcacagagagaatttagcaaatgtgcactcactgatcaaagtaataaaattctgaggcagtgaagagttttccgtttttaaatttttaaagaaaatgtatcttaatttttaacctcttatgattaaataatgacattatcaagcagctacttttagacaaaatatggtaaataacaccttgatatgatgatcttagacctatttatattttgatttaaaatagaatttttttccatgtaatttaaaaccttattttgaa

SEQ ID NO: 55063 - DNA, 1185 bp, Bovine  19866880754917
tgcagagctagagcttgtccaaaaatatccccgaggagccagtggccagagcgtcaccctgctctggctgtctgtggatggacccctgggtctgctttggggtgcaaagatgtttggtcccctctcactgggcctcttggcctggcgtcccccccgggctgtgggaggatgttactggacgctaactgcaggcccccactctcaggtctgctagcctccccgtctctctcttccacacttccagcacctacaggctctccctgtgagtggaggatattgaacgtggtgcccagcatggagactgaagtcagaccttgaattagggctctgtccttcataagctcacgacccagcgcaaggtgggctaattcctcgagcctcagtttacccatctgtaagatgggggtgtgatccgacccatctcctaggatgtctgtgagcattaagctggataatgtatggaaagatctgtgtgctgcctggccattgatccctctgtcatgatgtatttgagagggtctgtcccctgaattggccgagaagctttgagagtgtttgcaagtgttgagtctgcacactgtatgcagagcggtgcttctttgcttcttgtgctcagtggggccctttactcccgggagtgggttgttttgcaggagggaccctggataagaaatgcgcgtgggccttcgcagccttgactttgacagggtagcccaaggccggctgttatttcatcactgaccctgccagccaggaccgttgcccttgctgctgctgaaggcagagcctggaactcccagtcaggggtttttctctgcttcctcctccttcctggccacttcttcccctccctccggggccgcgggccctcccggtctggccgcccgtgcgcctcccgtggtcgtgaccccacagctgtgtcccacagtgttatcgggggcccgcagtcctccgtggcccccggggtgccccgtgagcaggcgtggggctgtggcctgacggctcgacttcctgtcgcagggtctctctgctgtggctctgtggagccctacagtttatctgtggtcagtgctcgcacccatttcctgccagctgctactggtttttcagtcagctctgccagctccgggaactggggaaggaccgggctgcgtattcactggccccgggcctgcggggatgctg

SEQ ID NO: 55064 - DNA, 1092 bp, Bovine  19866880845543
aaaaaccaacggggagggggaaggggggaatcacaaactgtatccggctacagagagttcagagtgacgtgggggaggaatcaaactttcccaatctacctagctccctgctcgacaaatgacaatgccaggagtgaaattaaaagggaaggaacacaatgcccttttcatttcacttcaagggcaacttctttgggtttgtggtagcatttgccaacccctcacctaggattctccccagggacataggagactttgcaagcctctcaaaagagcttacaaaacggctttagaaatggggctaacctttttcaaggtgagaagtctggcttcgttttttatctcagggagaaaagggagccgcaggaagcaagactagaaatacaccacaaagaacaccaacaccaaactgagttagtaattctgaacacccaggaatacgtctgtgcttcgttcattcaaccagccttggttagactattacctaccagacgctggggggtatttgctgggatgtaaatatgagtaaatccggatctgtgtccttgaggagctcacaggggaaagacagaccctaagcaaacaattatgttaccagcagtacaccagggataagagccatggtattggaaccagctggtccactctggggtttgaggacaaggggattttgctggagggagaaggatggagactggataagaagaagcgattgaaagttcagaaatgggaactccagccacatctaaaggcacacccctgccctccttagtgccgtcttagaacctgcctcctgtcactgcagaacagtgcaaaggttaatgagaaaacgtgagatgccatcttgagaacttctaggaaagatcttagagtcctgacatttgagagctcttttgtattagacagatttttgctcctaatcaacaggattccatctggcaccatttttattgctgatcaagatcaactgttgtattttttttaagtatacctatctcctaaaagatcttcaaatacatctccgtgttttaatcaattaaggagtatttactgaacactccattgtgccatatcctgttgccatctataaat

SEQ ID NO: 55065 - DNA, 1922 bp, Bovine  19866880891847
tatcatatggtatcacttatatgtggactctaagaaaaactggtacaaatgaacctatttatagaacaaaaatagagtcacagatgtaagaaaaaaagcttattgttactagggaggaaaagaggggagggatgaattgggagactgggattcacatatacacactactatatataaaatagataactaatgaggtcctaggcttccctggtggctcagatggtaaagaatctgcctgcaacacaggaaacctgagttccatccctgggttgggaagatcttctggaaaagggaatggcgaaccacttcagtattcttgcctggagaattccatgaaccaaggagcctggtaggctacagtccatgtggtcacaaagagtcaggcatgactgagcaactttcataataaggacctactatatagcacaggaaactcaatataatgtagtgacctatatgggaaaagaatctaaaaaaagagtggagatacatatatatatatatttatatatatatgtatatggctgattcactttgctgtacagcagaaactaacacaacattgcaaatcaactatactccaataaaaattttttaaaaaaaagttaagcacattagccttttcatctgtatttccatatctctatcagtttaagagaggttgaaagaagttcaagcacacacatgcacacacatacacacacacacacacagagtctctgatttcccaagacttgatttttcatcacaatccctggttcataagtgctaaagatgttccacttggtatgttggaacccattatttcccagtgagacttgctgtctgttttgataggagcaatttatcaccctggtggaatcaggctgccgtttggaaggcagggctgggatttatgaatctcttttcactgggatgaatttaattccccagagtggaagtggtattaaaagatttggccctgctgcacctgtggcatttgagacggtggcttccggagtgagtggcagcttggccaggaaacccctgccctctcacacccacatcaacactgcactagaaacgtcttcacccttccaagcacagagaaagccccatctagggcatgaaatccaattatgctggatataaaacaatagttttaattaacaatgatggacatcccaggtggctcagggataaagaaacctgcctgccaatgcaggagtggtaagagatgcagatttgatccctgggtcggggaagatcccctggaggagaaaatggcaatccactccagtatgtttactgggataatcccatggacagaggagcctggtggactacagtccatggggacgcaaagagtcagacatgactgagcatgcatgcaagagttaacaatgaatttaaaacattaaaattgatttagagtgtgttttcattctatttttggtgtgcctaagtgttaaaattattattcactgaagatactttttcaaagtatccacttttaagctctgaaccaagttcttgctctactggggccaggttctacttccagtttatggtccagtgtccccatatgtgttgtggtccaggtaagacatgatgctgcccactggaaccagcggggaagctttaaacgctgtggatgccggactccgccctcaggaagtatgagacaatgtctggggcacagcctgaaaaccaagagtttttaaccttcccaggtgattctaaggtataattaagctatatataattattattaagtatataatataatgagctttatattttggaaacaagcataacagaatttcaaattagacatcctccttatgattggtcatctattttatatgaaccaactttgacttccaaaatcatttcatggatcaacttggtaactgacagatatgccttagtgttcacggaca

SEQ ID NO: 55066 - DNA, 1439 bp, Bovine  19866880893009
gcagccctttcagacacagcccagggtcccgtgtggctctgacagcagtgtcgggggccggatggctctggccccagctgcccgtgatgcttgagagctgtggccaccccagaggaagtgacttgcctgctgagctcaggggaagtcctgtgctcagtccttaatcagggggagagggagggactgaagggcgggcacaactgaggaccccagacggcaactgaagccttcctggagggcagtggctcagggctgctccctcagtttctgcagaggcagaaactcacgcccagagaggggaagtgacccatctgaggtcacacagcaaggcagagacacagcttagcagactccccagggccactgtggtgtgaccctggagtctgtgcctaggggctgcccttccagcctccctggagcctgtgttctctacggggtcgtctcaactttcgtcttcctccccttcttcatcctgcctgcagcccctgcagtgtggtctccgtgctccccctggacagagctgagacaacccggggccccagggtcctgtgcaatccatcctcctcaaacctttggatgtgtgtgatgcatgtctacacagatgtgtgcccgtgtgtgcctgtgtgtgtgtgtgtgtgcctcgcaggcacatacaatgtagatgtgtgtgcaggcgtgtcatgagcgtgcacatgtgtgatgcatgtacagtgtctgtgtgcatgtttaagcggacacaatggtgactgggccccaggagtgtgtgaaccgtccaggagcaggggtggccagcaggtgcccagtctcccctgagccagtccttcccctagcagagcctggaactccggaataggaaaccactgttttcctgccggctgtttgcccttattaattcaggtagcaattacccactctgaatatttggcgactaattagttttccccgtggagatggcagaacgaggaatgctttactctgacctgatccactttctggggttcctgagggaggaggcacgggaggatgaggggatgggcagagggtgagagaagcctgcctcgcgtctggatgtttctggagctgcctggatctttgctacaagcctacagggtgacaaaaaataacccatccagttttgggttttgttcttgctttcgtgtcgcctggcccgttccgctgtaggtgcagctccctggcgttggcctgatggtgctggtggcagtgtcacaacgaaaggccggggctgctcacctagctggcgtcacctcatttgggcgctatgccctctgtatccacaaggtgaccaggggctctgcgtgcagggacagcgtgctgggccagaggacggcgctcctgtcggggccaggaggcacacagttcagggtggtgggtcggagaaggggccaggggcccatagtccgcgctggctctgtgcggga

SEQ ID NO: 55067 - DNA, 885 bp, Bovine  19866880998411
aagtagcattgtaacacagcactttcttttatccatctctaaactaaggcataaaagggcaattttaggatacaaatagtaagaaacctatttccacctgagctttcccatctcagcagagaactcatctttgatagcctaaatacaaaatgcgtcgctgtccacagagcccatctcccatgcccttgagtgagcaggtaaaagtgcaggtcaccttcttgatggttgcacagtactgaggcagcatgctctggtccagcccttcaatttgtttcagtttctcacaaaccgcatccacgttcatcgaattcagtggtattgtgcctgaggctgggcctgatccctaggtaagtcgtgggaaaacacatgtataaacagcatttaatgtcagatatatgcagtcatgtgacagagaaacacttatgaagttacactataaagtacttcaattaaagatacattttcaaacttaagtaaaaacagtgaatgtgtgcagcatgggacatgccattagagaacagatttagctactgtttaccttaaagagtatcttttattagagcagatatagcctgatcaaaaccacttttctaagaagacataagttccatgagccaacccaaggccaacttcaagaaagcctaacctcaaacctcaagagagaaaggtgtagcccttaataacagaaagacaggggcttaaaaaaagaaaaggaatagggggaattactgatgcctataacatacaaaaaaatataaaaggtaaacctatgagataattttaaaagtgctaacactcagcagctttaaatgtcttcacagattaccttaatagtctacaacagctcaagttttcagatctgatcatattttatatccaagagat

SEQ ID NO: 55068 - DNA, 745 bp, Bovine  19866881846775
ggaagaggtaaaattaagtcaagttctatagatgtaacgctgaaaactgcaaaagaaagttcctttgcaatgaagttattctcactctgctactcaatcctaccacctacctgtctgtgatgtatccacaacaaagccaatgaaacatgagacctcatgtttctatcctgacagtgatgcccaaggggtaatggcttaccctgaataagccattcattcagttaatgggaatattgggggagcttttccaacagatttttgatgtgtgtgaatggaattgttggttcatttcaaacggactccaagaattgagcagatctttccctgctggatgtcatgacggcagaaagtcacctaaaaagaatcctcaacatgcaaattcattttaaattgagcagcgtagttttacattttgaagataatcagattaaccaaaaggaactgagagagaaaaccaatatcaggcttggagtggaaaaaaagctcgaaaaataaaaccatgagaaagctgagtcattttttacctaatttcaaggccctggtgggaagtccccagcataagcatggggtgggctgggggcatcgcacagttctctttttctcagagccaaccactcgcatccagccctgtagtgacgggcttccctgagctgagctgatggccctgtgactcgaaatggaagacatggcctttcttttgatgtctgtggcatgcagtatgggagctgcattaaactgaccaaaa

SEQ ID NO: 55069 - DNA, 2682 bp, Bovine  19866880432850
atattatatgtcttttttaaagaataatcatcacatttaccattgctgatggtgttgtttaaaatagatagtattatgaaggatgccctgatattcagtatggaataatctttaaaatattggttagaagtatacatgtgaattatataggctcagtgtgtataagaaatgaataggttggggaaggataccaatcattagaaataaagtctccaaaaattactattagtatatattatgttcattaatgacaatattaacatgaataataaaccgtctattgggaaatagtcagagaattggggtataggaaatttgcttaaaaaatgatttatccactattcaaaatggccattgtgagaaagtctaccaataataaatgctagagagggtgtggagaaaaagaaactctcttatacagttggtgggaatgcagtatggaggttccttaaaaactaaaaatacaactatcatatgacctagcaatcccactattggttatacattcagggaaaactataattcaaaaagatatatgcaccccaatgttcatagcagcactatttgcaatagtcaaaacatggaagcagcctaaatgtccactgacagataaatggataaagaagctgtggtacatattatacaatggaatgttgctgctgctgctaagtcacttcagttgtgtccaactctgtgtgaccccatagatggcagcccactaggctcctccatccctgggcttctccaggcaagaacactggagtgggttgccatttccttctccaatgcagaaaagtgaaaagtgaaagtgaagtcgctcagtcatgtccaactcttagcggaccccatggattgcagcctaccaggctcctccatccatggtatttcccagacgagagtactggagtggggttccattgccttctccaaagtggaatgttattcagccatattaaaaaaaaagaatgaaacaatgcaatctgcagcaacatggatggacataaagattatcatactaaacaaagtcagacagagaaagacaaatatgatgtcatttatatgtggaatctaaaaagaaaaatagatacaaattaacttctttacaaaacagaaacaggaccacagacataaaaaacaaacttatggttaccaaaaaggaaagtaggtgtacatttcgctgtacacataaaactaacacaacattctaaatcaactattacttcaataaaaaaaataaaaattaaaaaattttaaactatatacctctaaaatataaggaaaaggtaaaataaagatagcagccaatgtccccttttctaattattcatattatttttatgacacctaactacctagtatttaatatttttccttcataaagtttttttttttctttataaattgtatcagaaatgcagccatgtaactctgactatccctgaggaatgctctagcaaaaaataagaacatattactgtgactatacagtattaaatgttgcaatttgatttcatcaaattgaagttgtacttgaaattgtaattgaaattacagttatgattatgtaactgtaaaataaacttacaaaacagacttgctttaacaatttgaaaataacttttatatacataatataggttattatggattcttgaaaaactaaaatggttgaagaaggaatcactattttgaagtaaaaaatcatattgacaacctgaaaatataaatatcaaccaaaatttgactaaattggatcaaactgtgattactggaattgaaagcattttattctattagaaatttacatacaatattctgttttacagggcttcccttgtggctcagctggtaaatattccacctgcaatacaggagacctgggttcgatccctgggttgggaagatctcctggagaagggataggctacccactccagtattctgacctggagaagtccatggactgcatagtccatggggtcacaaagagtcagacacaactgtagtgacttgcactttcacttttctgttctacaagtagattcaaaaaatagttaaagcatgtgtatgagtaggcaattaccttaatttttctaaattatagtaaaaatggcttatcctgtttacttttataattattagagagaaatgtaattttgaactctggtgacaacaatctatcatcttgtatcttctagtctggtacccagataatgatttttgtatttttctcttatttttggtgcattttcagggtaaaaagttgaattaataatattctgtttttgttctataatctaaaattaaaacaatttaataagacaatttgataggtgtcaagttccaatttatttacctgaacggtctttattcacccagttttctcataaagaaatgcaaaaacaaaatccccaagtagtgttttataaagagtaattaatttattactttcttctataaaatttattagacagtcttattcgccatcctgtgattttttgctaatgctaacaccactatttaagaattgttgagtagaaagcagataattagttcccatttcatctattaaaaaggacttgaatttaacttctaagttatcacattactgtcacatttacttttaattaagcattttatgctaattctgatttcatagcttgttgttattagcatacaaat

SEQ ID NO: 55070 - DNA, 1066 bp, Bovine  19866880810344
tttgagaaaatgtgagaatagaaataggaaaagatgccagtatgaataactgcatgagatgggcagtgtatgaacagtggaatataattagtttgaattttgaagtgagtcagatattcatgtgggaatgataaagtcttataaaaatttaaaaaatcataactgacaagtgaaatatttataatgcagtattgtaatatgtaaaattaaatacatgaatagaatatgattcctgggtagagatgttgatcttttttaaaataaacacaatagaagtgtttagattatgtaatttccctatttttttgatactaaagtaaatactgttctaacaaatcagtgaattaaaaaaataagtaaggcagaaacaggtcaataatcatacatttagaaatgaaacttaagtgtattatgtttccctgagttcttagaaaatttctaaactatttcagaaggaactaaaagtggattatgtaattttctaacatgaggtgaagcgatgatcagccaacactttctctaggcttctaggagtcaccattgcaattagtttgtcccagtgccctgaaatctttctcaagatgctactactgtgtccaaatatgtgcactcaaaggaaaaaagtcttgcttctccagacttacttttaactttgttgataagtcattttcagaacccatacctagtatactcctttgactaccagcagtgtgtaccagtacagaggaggttctagctcttagtaggaaggtagggacatctctgcaatgcctgagaattcacagggctctgcagagccaacacttttaggaacattcttctctatgacctgagtgcatatttttttttaattttattttatttttaaactttacataattgtattagtttagccaaatatcaaaatgaatctgccacaggtatacatgtgttccccatcctgaaccctcctccctcctccctccccataccatccttctgggtcgtcccagtgcactagccccaagcatccagtatcgtgtatcgaacctggactggcaactcgtttcttacatgatattttaca

SEQ ID NO: 55071 - DNA, 1359 bp, Bovine  19866881182056
ttgttggcaagcggtctctgcttttaggtttcttctttttaggtctctgctgtctaggtttgtcttagcttttttccaggagtaagagtcttttaattttgtgcctgcagtcaccatctacagtgattttggaacccaaaagaataaaactgtcactttttctccatctatttgccataaagtgatgggattggatgccatgatcttagttttttgaaccagctttttcactctcctctttcactttcctcaagaggctctttagttcctcttcactttctgccattagagtgatgtcatctagatatctgaggttgttgatatttctcccagcaatcttgatttccagtttgtgattcatccagcctggcatttcgcatgatatactctgcttataagttaaacaatagaaataacaccatccaataattacatgataagcaagtaggatatgtctgagtgtacagaaaactttaaacagtatttgatagaaatgtacaaatcagtaaaatcagtagttttaaaatatacaatggaaatgaactttcctgggatattaataggatgaagattgtagaaaacattctcacactttatattttttaaaatcttaaaatgtgcacatggtaacaaagtaaagctgggaagtacatatataaatatccaatataacaatgctttttaagtgttactgtaaaaagacattgggtcaaagctgttgaaaatgtaaaattaaaaaatatagatataaataaaacttctatttgaataattaccttgacattcttaattaatatgaaatatgtattggcaggataaattgtatatcctttatgttgctaataagaaataacatatgttataatcatattctcattatttgtgtccagcaaaattctttctctaagcttttctaatgtagagctcttatcattctgaccttcagttttgtttttggtcagtcatgatggtttatgcactcttacagcattttagttattcataccctcctaagaatgatcacacagggatgagatggagattatgatcatttcagtccttttcaggagagcatagttcacgaccaaacaaatggttaggtcaggtcatggccatggccttcctatctgcctcaggaacacttcaggttactttcatttcaggcagttacttattcatttattcattacttcattcaaaatttatccaatccctactggtgacagtgcagaataatataaagtgattattctttagaattcaggcaaacttgactaaactcttgcctctggtgccaactggctatctggttttgtaaaagccacagaaatgttcttatctttgtttcccattctatag

SEQ ID NO: 55072 - DNA, 1043 bp, Bovine  19866881410739
ataatatcctgtatgtagcaggtggttaaggagcaaatgaattactgacagatttctaattataatacacttttagtctttcatgataaacaacagatgtgtgtttatgaaaatacattattgtagaatcaggtcaatggagtttaaatgaaaaagccttaatttatctgtactcccatgtgaattcaaggggctggcctatttaaaagagccacgatttaatgtaacatgagttcaaaggagatttatttaaatagaccaatgaatacctttttcactaattgtccagatagaaggaagataatttcagagtgcaaacagacatgggagaaagtaacaaatcacaacaaaacagagaagatacaaaaaagggtattataaaatgatgaaaagctaaatcaaaccaatctagttcctaaatattgatagtatattgaagcctttcactaattttctttctaggatttatttagtatgttaaatatattttgtatcatcaattatatgaatttcaatcttttgataaagaaggaaaatagcatttgagtgcaaatcaagtacctgaaataatttgaacattgaagtatttcttgtatgtaagtttgaaaaattaaaagggtgaatttggagttcagagagtggtagcagatccattttaccattaagtagctgtgaaacacagcagtttcaaaaactatctacatatactttcaaacccaataatgagccatggaaaggaagcaatatttaaaatcatcacatgccttatttctttcttctatattctttatattattatatgtgtgtgtgtatatatatatacaaaacacacacacatatcattgtcatcatcattcagttgctctgtcgtgtctgactctttacaaccccatggtctgtagcccaccaggctcctctgtccatgagattttccagacaagcatactggtgtgggctgccatttccttctccaggatatatacataaaatatgtgtatataatatgtatatgtaatatatgcatataatatgtataatatatg

SEQ ID NO: 55073 - DNA, 2137 bp, Bovine  19866880223372
acctttgttggcaagtatgtctctgcttttgaattgctatctaggttggtctaacttttcttccaggagtaagcgtcttttaatttcatggctgcagttaccatctgcagtgattttggagcccaaagaaataaagtctgacactgtttccactgtttccccatctatttcccatgaagtgatgggaccagatgccatgatcttcgttttctgaatgttgagctttaagccaactttttcactctcctctttcactttcatcaagaggcttcttagttcctcttcactttctgccataagggtggtgtcatctgcatatctgaggtgattgatatttctcccggcaatcttgattccagctcgtgcttcttccagcccagcgtttctcatgatgtactctgcatataagttaaataagcagggtgacaatatacagccttgatgggatagactaaaatggtatagacataaaagggagaaaaaagtcaaaagagagggtagaaaatgaattcaagaataaggccaacacccacattctataatgatagtttactttctaagggtgaagagtttttttctctaagcgttcttgctacatatgaaaataagaccaggtttttttctgcagttcatgtaggtcatatgatgatacagaagaatgtcaatagttcatggtacaagatgaggcagccattaagcctggaagtgttttttaaagagaatgcagtgtgggatggtgaatgatgtcctggggaaatagtatcagtttttacatagggcagcctctcaggctagatacatagcgtcatgcatcaaagcggtttagtaacagtgactgcctgtgcactccaggtgcccaactcctggcttagctggcttggtgtaaatatagatttcacaatactgggaagaatgacataactaatgatctttcaagaaattatccctatcacatgtcaacaaattgaagactatcctctccaacagctacaggatgggcagctgctctcagctgcttattaaatgcagaccccataaactttggcaagaagttgagcagaggaagtgttggcctcctcccgggaaaactgagatgcccgacaatgagtcaggcctcggctcttgcttgggggagggtgtgcatgtgtctgtctgtgttccatagtcctctgtagaaaattagtttgaatccactagaaaatgcaaactttaatgaaagatcaaggccctaacatacataaaccttattaaatggacacaatagttttagtcttgaaaatattcagagctagcaaactctgttaatcaaataatcaatcaaataatctcataaagtattccaaacttgaggctgaacaatgccgtttcccaagaattgttagtgaagtgaattatttatttaaagagattattgtttgtaaaccacttaggttaagaattgtctgcgaaaactataacttgaatttttgaatagttggttctgctttcaagcaatgcatagctataacgcatagtcatttgggccacagacaatctgagatactatgtctcatcaactgcacagaggaggatgcatgtgtttacactatttacactctttataccaggcaattacatgtccatctttcctgggactgcataagataatggataagtaagtttggaagtgtatttttcagtgctagattgtattgttctaaaattttaataacagtgatacacttagtagtaaaaatccaaacaatactaaaaaatgtagaaaaagcctctcccttatttgctttgcttttgcaactctccaagggtaatcacttttcaaagattctaattttgattttcctggttgtgacctcaatgctctcaataacatgttcaaagctctatttcttgacctgtttattctcaacagtgtctcttggctccccctacttaaaaaaacaatagaaaattcaaattaattacatcagattttactcaaccaaagctttatttatattatatataattatagtagctctctgttagctcttttagcttaccttatgatgtaaaaatatgcccaaactgaaacatatactttaccatatgtaaaatagataactagtgggaagttgttacataacagggagcccacccc

SEQ ID NO: 55074 - DNA, 1596 bp, Bovine  19866880357227
cagtcatacagcatggaatctataacgcatgtcagagtctataatgcacttttgattataaaaattaaaggtcatattttatatctcaggataagaggtaaaactgacttcggcaaaaataaccaattgaagacaagggctccatggctgggtggctgagcctggcaagatccgtattgtacttgagaggaaggattgagatgaataacaatgcagattattctcagctcaaaggagaaggtaagtcagggatacagattggaaagaccagggtaacaactgcaagaacagaaaaatgtcatcatttcaaaaccatcaagaaagcaaaaattgcctgtgcaggaaaaatataaataaaaagagaagcaataggaaggtatggaaaaaagaagctataaaataagatggctgaagtaagtccaagttacatcagtaatcacaaaaaagcaaaccgattaacttacttattaaaagatagataccatcaggttaaaaaatttttaaatccatccatatgctgttacaagcgacagaactgaaataaaattatgcagaaaattaagggatagaaaaaatacacatatcaggcatatgtaaacctcaataatgatggtgaagcaatattaatcacagatacaatagaatttaggcaaatggcatttgggggtaatgggaattcactatcctaaaataattgtctgcaattatgagctggatgttcttgaatagcatagccctggagtatcaaaaccaatattgtatcaatatgcataaggcaaaagcgaacagaatgataaaaaattgcaaagctataaccataatgtaagattttaattcacttctatataaacagataagaaaattagtagacagagaatccaaacactatcccccttcataatctgataaataaatataccaccttggaatcattgttggggcagttctctgaaaactctggtggacagccaggctggcacttctttctgatggagatggctttcttggtaacagaagacaaaaatcactgtccttcaaaacctaagaagtaatggcactgacatgaagtaactagaaacctgtctgggtggcaggctaagtgtcatgttctgggttagtgctctgagcctcaggattcccatctggaaaatgggcatgggaaccgtgtgtggtctgctaactgggagtacacactggcaagaggaggggaggaaaggaataggctttgagcccattaagctccatgcatatgcctgtgtcctgatgctgtgagatgttcttgtggattcagaccagaatgctactgtgttcacagaaggtacgagacaaatcatggctggattagttagacagggagcagaataaatcagccataccaagagtttgaaattggtcttttgggaggaaagcctggtttgaacagggagctattattgtcctggaaatgagggaattggggagtgtccaggtcatcagagcccagctaattaaggctggacttagtcaccctaacaggaagtctgggagcctgatagctggaggccagcggacttgatgctaccatcccctgaggtcctgccaggccacagaggcttg

SEQ ID NO: 55075 - DNA, 1031 bp, Bovine  19866880375565
ttttaagatcgtttgatgtttgaggattttaatttttgcatttgaggaacaaggacaatggtggtattatgatggctctttaaaaacacttcaagcagattccggccatctctgggaggcaaactttgaacatctctgcagtccccagggagaacaatcttctgtaactttgaagccaaataggatttctgaaaaggaagttacagtccattgaaaactctcagtggagtgtgaagagcagagggttccctgtggtggagctgcagctgggcctgcccgggctagacgtgcccttctcagctggagggagaccgcacagacagcacggtgggcaggctggagacgggatgagtcctggatctgaccatgtgctccgagaccagcttagaagatgaaatatcctttcctcaaccttgttgtgaatgtggccagctcaaatgaattaaggtaactaagacagagaagacagaataaaaacaaacagagattgccttatctgttcctcggcagagatactctggaatggggcactcagtggtcaagaatccacccgccaaagcagaagacgcgtgttcgatcccttggtcaggaagatcccctggaaaaggaaatggcaacccaatccagtattctggcctgggaaatcccatggacagaggagtctagctggctacaggccatggtgttgcaaaagagtcaaatacgatttagcttaaacaaaaacaatacattgggatatatcagaaacaaagaactgagatttctgatggttgggtgaacgtctacgggggaaggtagacgtttgcccaatcttcctgataagagctcctcatgccaccctttcctgctcggccacatggaaggaaatgcaggggtgctgagagatttcgctgccttcctggcttcctgccactctcatgggatcttctaccacccacaccctcgtctgcctgttcaggggctggtgctctggaccattcccggagtaccctggggtctgccctgcctcaccgcaaatattccctttcctc

SEQ ID NO: 55076 - DNA, 925 bp, Bovine  19866880423445
catgcccagcgggacacagggcctgtcactaagagcccgtccaccttgcctccccgcccgcaggccagcactacttacacccacacttctgccacgctcatcccttcatagtggtacttgagggtggggacccccatgtcatccttgtagaggatggagatggggctcagtttggtgggcacacagcaggccttgcccaccttcatggggaacttgagatgcaccagggtcttcacaatggcatgtttcgttggggtcacatcgtcggccagggggaagaagcagccacctttacattcaaaggcatcatactccttgggcgcaatgatccagctgtcccagccgatgtcctcgaagttcacccgcagggaggtcttctgacagtggttgttggccccagtactcctcttccgtctgaccaaagacgattccgtgggcgtgtggcttcgcacatcctcctcctcctcgtctttgttctcacctgcctccaccacggtgttcttggacaacttcctgagcacactctcctgctcgtggccgatcatctctctgagctccagcctggtctccttagtcccattgctgcggtcattggagaagacgacaaagaagggcaggtttttggatcccggggggacactgatatccagcttgtcacagcccttcctgtgactctccaccgtcacttccagtttatttttgctcttggtggagtctgcccggatccaccgcttcacggcactggacacctcaaaggtctcccagccctcgtcccggatgtcctgagacaccaggaaggtcttggttcccgcaggagcgtcccagacctcagctccatccagaacgtcataaatgaccatgtttcctttcagctcgtgaggggagtccatgtgactctgacaggagaggtagagtctgagctcgg

SEQ ID NO: 55077 - DNA, 1406 bp, Bovine  19866880442349
ggaattttttaacctaataaaaggcatctacagaaattctgatgaaaacattatacttaataactgaatacttttcctcctaagattagaaacaagataaggatgttcattcttacaacttcttttcaacactgcattggagactctagccaatgcaataaggaaagaaataaaaggtatccagaaaagaaactcaaaaagaagtaaacctgcttttattcacagatgacatactatacatagacatttctaaggaatccacaccaaagaaaatctattgaaactaataaatgatttagcaaagttacaagaaacaagatctatataaagcactaggggtagaaaacctgcttcatttccgtgttttcccacccttgatttaagaaaccacttttctatgctgcaatgaatggttccatgtctatctcttaaaaaaaaaaaaaaggaataatttgaattttagaaattcaagttttccaaaattgccatctgaaaaataaatacttccccattctcatgtgtgcagagcctctgcagagataagaacaattttcaaaatcattgctaacaactggtccgtggcatgattcaaggcaggtggtgacttaaacaacatctttcccccaccttcaagtataggcttcataaggatcccaacatccctttccaagtcttaccactctgtatatagtgttcgctggtagcaggacatccccaaaagttgtgccttcaggtgctctatccacaatatttggaattaatggagacatcagttcttcaaaaaatggaggctttggaccactgctcaaattggctacagtatcctagaacagagagtatttgcttaaggggcgtacaatacagaatggagacctttttccctgaccactgctactgctaagtcgcttcagtcgtatctgcctcttagcgaccccatggactgcagcctaccaggctcctccatccatgggattttccaggcaagagtactggagtggggtgccattgccttctccacaccctccccaaaatgtcttcactggaacacacacacacacacatacattcactttcactttttctctctcttcccaagagctaacaaatgtaacaaaatatgaggggaactttgctgaaattggagcctagatgtccataattttaacttttgtgacagaagaacatttcggtcacaggaaacactttcactcccctcgtcagtataatctgagtgtaagctaggaatcacgctacgtgagtttagattctgggacaaccattctttacgtgtatgactctcaataggaacacatggtcagcctctgtgacatgacattgtaattattcttttaaatgtttaaaaagtgttaagtctctcttaaccaaagtcactaccaagtattttc

SEQ ID NO: 55078 - DNA, 2552 bp, Bovine  19866880451403
accctgaggcctgttccttgtactgacttttcctggcttgagagatccaagctgagaacaagccatcattgtattccaggctgctgaaaaggaagggtgggtaccagaattggcaggccccggttgctgggatcagctgtcatttgtctgtttcttggttgtttcccaacttctttctaactcagggtcccttcagagaggataggtcagcactgggtcaggcttagaacagacacagctcctctcagaattgttatgctctaattttccatgtgatttttctcttacaaaacaatccatcccacctgaggacagaaaagaaaaaaaaaaaccaaaacagaccacaatattaaaagtttattgttggagtgataattttactgctcacctctggattaaccttggtctaacacatttccaacttcattgtattcactctgtattgtcagcgcttaaagtattttctgtgccacgaagcgttaattaaatgagcggttgcataaaagacagaagaggcagagtggtgagtttattccaactttaaatgtagttgaaagcctgttctttgtgtgacctgccggggagagcagcaacagccaccctggagtgtgatagcagtgtctccttgctgagcaagatcccagcacagggactgcttcggtctgttaccccatctgaagctcaaaggaacccccgaaagagaggttaattggtctttgttggagaggcggactctaagtcacatggaattatacccagagccggccccacggttctccgtccctctgcactccctgagctcttcactggggctcagggttccctgcttttctgcttggatttggagctgacaatgagcctccttttggacagaaacacagccaccctgacacttcctgtgtgggctgattttccacttggcagcagcactggcccccagagcccacagtgcccagggcacctattgtttgaactcaggtggcttctgtgtgactggaagccccacgttctcacccctctgggctgctcagcccgctccctggtaaaggctgacctggaatgacaggcagtttctacagttagctttgagagggtgggatgtgctctatcaaagaaggaaggtgggaggccgttggatcagtgtttgcctggatcctttataaccacctcgaaacggtttcctgccactaaggcagtcccacctttgtcatccccccaccacagggcacccactcacccctgccagcagtcacaatgtgtgcccatctaggagagtctgttacctctaatgatattactctgctcaaagcctggcctggctcccctccatgtaaccagaaagctccaaaccggctgggtaggccaactgtgaagccttctccactggcacagccttctgcttcctggggaaggaaactggccgacagcagccctcacatctaggtctggaaatggggtgctggcaaaccaagtctgctctgaggtcgccaggtcagcctccaggacaaacaggccctgcttacccggggcccaggcaccgagaggggggcaaagctgcaagggccccaggccaggaacagctgcccacggggccttcagctcaggaggccatcgctcaagccaaagaagcgccatgaaccaaggccaggcttggactctcagggtgactggaatagccagtagtttcccaggcttggagacagtcccagtgtgcggagagccctgagcccacaggggccgctcaggctgaagggtctccaatagtttcccaggcctggagacagtcccagtgtgcggagagccctgagcccacaggggccgctcaggctgaagggtctccatggagggcgtacctgctgagcagggtgcagtgcagtaccctgggcccagcctcccctctcgggctctctcgtggagctgagcacgctgctggcactcagcagttcataaatcaccgtcctgcaaggccttcagctgggataactgcacagctggaggaattttcttttttccccccaaacttaacacatcataaaacacagccgtttagggaatgagaacaaccaggaggtgtttttgcctcagaggctctgttctaggaaagcttgaaaggtgaggtttggagcctgatacatctccactcccagtcagccttaccagagcatgagaacggccatttccacgggtccccaggcaccttctgaactggcaggctggctgcttggccagggccagccagacctggggcagaaagaggccagggctctctctccagggccatcttgggttcgtgacaggtgggtttactgtaagcgagtataaattcgtcccaaaatttggtcccgagtctcctcatcccattcagagtctgtcggcacatgaccctaggttctgccagccaaagacaaggcctagtccagaggagagctcggaggggcctggctacagtctggttaaggagggagtctccgccaggccacagcttctatttcgtatcagatcaagattctccaacatgggtattaaagactttactttcattcattaattca

SEQ ID NO: 55079 - DNA, 1465 bp, Bovine  19866880459960
tgatggtcactgagccagaggaagaggctagttaagcagcatctggcaggagcatttccaggcaaaggaaggacagtctgggcaccaacctggatgatccctaaggcactggaggtggggccctgcatggcccccagaatgcaagcgtgatactggggtcttgagaggaccatggagctgacacactcactgtccggcagagacttcattcacacatgcccaccactctctgtgcccctccattccacctcccctcagggaaagaagggcctggagggaggaatgggcagggtgtggggctaggggaccaccaggcccaggtctcacacataagaaaggccacatattagacatctgactttatttccaagtgaaattttgatgcaggcacagaaacaccctacagggactaaaagatgtctgtcatccatccttatgattgagcaacactgtcataccacgaattagtattttctgtaactccagtaattaaacaataatgttttattgtgttttggtattaaagctgttcattggttccatgtaaacatttaacacaagccattaaaaaaataatctgggaacttcaaccaatcggaacgacctaggtctctccaggccttctttgggatctgctctggctggtgatcagaagggccgtggagtggaatcttcgccacttccagaatcttcctactcgacccccttccatgtgtgactctgagagtcagaggtcctctcttgcggtcagtggggatgaagtctggtcccaaggcccaagcccaggaccgggactggatgcacattactcaaaacagtcagtgcatgcagccagagtcaaatgtggccaataaagacctgagttcatcaatggcgggagccctcacccaggaagactggatgttgtcacctgagtactggagtaaaaacaaggatattgcaaataccaaagcaagaatgcatttatttcaacaaattcaaatccaggtctcatcatccatggagtccttgtgggacgggagcccatgggtgtgtgatggtggtgagctggtcatgctaagtaactgcagagacacaggccatgggctgcccatccctcagggtaaactcagtgcacccccgccaaccatcttgcagtctgagtccacggcagcgagtggccctgtatgaaccactggtcacacagtctctgtgccagtgggtcaaagttcctctggccacagcgtacactgcagcctgagggcgttcgtcctgcatttgctccatcctgcagctggtttaagggatagttctgtgactcaggggtatcttaaaaagcacttggacactgaatcgacacaggcacagagcagtcagaatgtaccctagatgcgacaagtagcccagtcatcctgctgggcactggtcggacttagtccagtttgtcccccagtctccatttcccaaagtcaatgtttcagtacca

SEQ ID NO: 55080 - DNA, 1497 bp, Bovine  19866880463401
ctaatatttctgctttattgactatgccaaagcctttgactgtgtggatcacaataaactgtggaaaaccctcaaagagatgggaataccagagcacctgacctgcatcttgagaaacctatatgcaggtcaggaagcaacagttagaactggacatggaacaacagactggttccaaataggaaaaggagtatgtcaaggctgtatattgtcaccctgcttatttaacttctatgcagaatacatcatgagaaacactgggctggaagaagcacaagctggaatcaagactgccgggagaaatatcaataacctcagatatgcagatgacaccacccttatggcagagagtgaagaggaactaaaaagcctcttgatgaaggtgaaagtggagagtgaaaaagttaacttgaagctcaacattcagaaaaaataaaagatacccactagtgagaggcataaagaggtttattcttcagaggccccaccaaaagagggttgggaatatttgtcactattggccatacatagcacagtaggatacagaagagtcagtacagggttatctgcccatgataagaagtgatttcgacagaaacacatctacaactatcacaaaaatctcacaaaataaaaaaggaacttacgtgaactccccagggatggcagtgatggccaagaacccgagagtaacaatctgaacgtcaacgatatctgggtgccagggatgaggatttaacagctaggaaccaaagcatgaaaactgtgttaggaatattactctctttgctcgagaccaatgctgctcacagaatttcctttgttaatggatattcaatgtttccagttgtttgagtgtcttatcctacagtcacaggtgtttttctaagtcatgtagtattaaatattctatctagaattaatatgtgaatttcaaataccagtgtcccattaacctggaattatgttctcatcaatgaactttttggtggctttatctttatggaatcacaatgtgtaacagataaccaaggttctcctatattaccatggtgactatccttatacaagacaaacaaggaattaccatcatttgaaataacttaattatttctctttttactctaaataacactttaaatcttcagttgctaagtcttgccttacttttcttctccaagagagtatatcctttaccatgttcagattagcacagaatgtttccctctattccttctatttcttcattgcctctccttcttgaagaacttctaagtaaatgttagaaaaaaaaaaactatatttaaaaattgtttctacatcaaaaattcatggtattatgaacactggcatgaatatgaaaatccatgttccaaagggtatttaaagaatattgctttagttaataatgttgcctgagttctggaaaataacctgagatgtctttctctgtgaggaattctgtgctcatacatcttaatcttattcttccttttc

SEQ ID NO: 55081 - DNA, 1674 bp, Bovine  19866880541008
tgtctttgtggtctgttctctacgttaacctagggacagtgattggggggaacagtaatgaatacaaatcgctccctggccacctcggaggctgtcgttagcatctcggcctcccagggctgatcgtcctcgtaccgcctgagcagctgctgtcagagcgcgggagcacgggcctgatgaagacagatgacgcctcctctgccgggccttcgcctggggtaatggtgtgcaaaaacggggccaagcatttattcagaactctgctctctgccccgagccgagtaattggaggcaggtgctaactgcaatttaaataaaatgttgagttaatcaggtcagtctgacaaggatgttacgagtcccctttcaagtttccaacagaaattttaaggcaacttggaggcctaaggtagtgtgatcatttcttaagtttctgtgcaaagataagggaattcttttttaaaagcctatttattttcacttttgtgatataaaaatgagatgattagaagaccagcaaatatatctgtctgatccatcatgtaattagtgtgaagtactcagcatggggctgtcacgctcaccttttgagggagcaccccaagcgaacatagtcaaatccaatagacccagatgcctggccttggacagcaaaatcagtgcccatgggttcccaaacttagaagccagaatgccacccttccccccaccacagtgtctggacaagagcaagaggaacgatataaagtccagacctgtcctgtccgcacaacttaggctcagagggttaaaaaaaataaatgtccgaagtcccaagactcctggcgtacaggggccctgctggggtgcaagccagaggcattgtctcatgcagccactgtggcctctgcccaggtcactctcagctcccgacctgcacaacccacccagtggccaagccctgatcatgctgctctagtacgaccacaagccgccacaggctcgctttctccacgctttggtctcaggccctccaggaatccgatcccccactcagctcctcctgtggctgttgcccgtgagtgaggctgcccatcttgaagctaactggtaccttccaagcccatccctcctttcatcattccaaacatgattaaaaattccattttcatttctggaacctacctggtagtccagaaatttgactgtgtttcctgagaagtccagagttaggtcaagaggctgccctggacctgaaaagacttgttagggaggccgtggctgggagctgagtgaggagggacatgagacagtcccagccttatctgggtggtggccggttcctaaggttctacagtaagtggtgtgactccttgtgaggcagtgtgggctggaggaaaggcatggcctattcagtccagagaagctgggggactgagtcccagatccacctgttactattggtgtcactttggagagacatctactctcttcaagctgtttctctgcagacctgagtcagcttcagcagaagttgaatttattggaagagatcaggccagggccaaagaagcctggtgcatgggcttggagaacaggtaggaatcaaggcaggtggcgctgccaaggtcagctacatgaccttggcatgtgggttgggagggtgtgggcccaggccactgctgccgccacgcg

SEQ ID NO: 55082 - DNA, 1735 bp, Bovine  19866880581207
atgtcaattttaagacaggttctcaggacccatctgtctccagagtgtgaataggaggcatttgctgagccagagctggtcctgggaactcagtgagaagaatcagaaggactgggtttgattttcagccccacctgcttctaacacacaaccttacacaatgtattagcctctttgactggttttcctcttcagcagattgaggaagacaggacttgcagagttcgtgtggagattaaaggcagtgtggccccaggctgtgccagcacagagtgggccatcagtcactgagcaccatggtccccttctgggcacctgcttggcacccacagcaggcctcagtcccaccacaggaccccacagccaggctttcctacctggtctaaatagcaactcaatcactttgattttgcagcaggaaaaaaatctctgcctagcttttagcatccttgtggcatttgtcttgtaattaagtatattttcaaaaataagaaagaagccagtaacaaaaggtgttttaatccatttatgcgacaatctgcaaattgcctgcagatttatgtgacaatctgcaaaaggaaaaatgacagggacaaaaatgtaaaccaatagttgctgaggctgggtaggggtcagggattcttcaggatgttgggattgttctatatcccccgtgtgatgatggttttaagaacctatctacatacatttatgtacgtagaactgtaagaattatacacccaaaagagttaattttactgtgtgcaaatcttagtatttatatgatagggaaaaaataaactcatatacaataaaaaataaaaattaaaaaaaaaatagttttgaccacaaagctacataaaccagtccacataatctgaataaaagtacttttaaatgacagaagcatgattggaaagcttgctgagatgaactgcacttcataaaaaacaaaattcatgactcaacccaactcggagggtggggactgaggaaggggtagaaatcagggcccagggagaaagaaaatctctccttcttcaagggaaccctggtcaggacaaagagcccattagaggcaggggtgtcggggagcggttgtcacagaggtgagggctgacaggcttggcctgggacagtctcaggggagccccaaaatcctggccacaggaagcatcagggaatatgacatatgatagcaggctttgcagatggcttactgaggaactggggaattgtgactatgggggaagcagacattgggggccaagaaaattctctttataatgctgaattcaagagcaaggggagtccataaaacacacaggggcctctgatttccgactgctgtgtgttcaaatgtgaaatagagcggtgttttgtgcaaggcagagaaaacaatgcattcagccagcacttctcagttcacaagtcatctctgacgatcacaggtcaatggataccttgggctctcatcttgaaagtgtgtttaaatgagatgtatcgccagattcccaagctgtgtcgtctagctccctctttaggcatgtgtccgtgtgtggcactctgttaagtaactctgctgtagttgcattatcacatgggcctttgggagggtatcacggctcatcgttcaaatgaagaagtcaagtttacaagagagaggaccttcactgtgatcgctcagctagtaaggggccttggagctgagctgctacttacacgtgcctagctc

SEQ ID NO: 55083 - DNA, 1638 bp, Bovine  19866880664724
ccagcagcagcatctttcaggagatatggcaggggtgccctgaatgtgcaagctgcaatgatgaggctgaagggcaggtctccactcagccaggagaccctgtcttgggcccataagaaatgcaccataggtcaaacccacagtgggtagaagcagaagtggggtttgaacctaagactatctggtttcaaaaatgcacttatgaaccactttggttcacagccagatggtgctctcccgggcatctgtctggcaggcatgggtacagaggctgtgctgggctggcatgttttcatcctgcccacctacaatggaccgttgatgttcatgtcacagctctaaaatattatcactggaggccatgagatttcagaaagaacttcctttccagagccacgttgctgtctataattagcacaagtttccataagcatcaagaagaggtgggaacagctgccccacgagctaggtttgttaatgtaaggcattcctggggcttctgtgcagtccaggctgtgctcttccatccctccctgcttccctggcccctgccctcagcagccactaggccctcattaaaggattagcaacatcggctgtgcaatgccttggccgtggacacaagaaatgctgggctttctgctctggcccttctgccccttatcagtaatccctgagccatgtttgtgctggagaaatcatagcagggcttgggcggaaattatggacaattggtgtcacacactaattaagcactccagggtcaagcatcacggaggggaccggacttcaatctcagtccctctgctaatgggatgttgaaaagcacagctggggcttcagactaagaaagcccactttgccaagtgagagagagaaaaaggtgatgcagcctgctgtgcctcaggaaagatgacaggtcttccttaaccaagtccagaagaggggctctcctacctggaccccatgcctgggtcacaaaggatgccactgccagagcctagccacatgctgcgaacaccacccaccgtcagcggccctctcctctcagtgcaaggagactggaggggccctgcgggatattctcacgttgatcacaacacacttatgacctaataggatacttggcggagaaggcaatggcaaccactccagtgttcttgcctggagaatcccagggatgggggagcctggtgggctgccgtctatggggttgcacagagtcggacacgactgaagcgacttagcagcagcaacagcaggatacttgggataattctgagggtctatatcgctgtcattaaaaacaaaacagattaaaattcaaggacaattctgaataatgggaactagccaaacatacaggggagaaataaaaatgtaatcctaaatggcttctcttgttggttatttcccagactctcagccccctagatcatgagcaactccatcaatatgatcttcctctgttcctatacccaagaagggcaggtgaaaggtgaaagcctggggccaagtcagttgctgagcacaaatccttgcacaaggggtgaataatacacccaggtatcagtcatatctccttttgcctcccaaactcactcagtccttcttggaccgggggccctgctcgagcct

SEQ ID NO: 55084 - DNA, 1670 bp, Bovine  19866880707645
ccctatgacccctttgtcctccacccccagcacggaagcacgctgtagggaagtgactgtcaaacctaagcgtgcatcaaaagcaactgtaaaggcctgttagagcacaacgctggggccgctcctgttcacggtttttgatgagtgagtctggatagtatctgaaaatctgcatttccaacttcaaatcttcttagtgatgatgctggtggccacatttatagcagcactgccccagggcttcagcgaacactcagaaaggactcagaaaatgtcaactgagtaaatgagttgcacacacgctgaccaactcaagtttttcagcctatcacgaggactctattgatcaggtcttacacgtataagtaatctggggtggaatttctgaataagttaaaagagacaaactacatcatgccctctccacattctggagggctcatctgagtttctatgattggagccttgctgtgtgcctggaggagtcaatatctttcccaggcacagggatgggaactggagggtctaggcctgggatctgtgactgcttcccattacaccatttggaattctttatagactggagagcttacaacagcatcatcaaaacacgtttttgtgattttccaacagccctgattcttgctaccgtgtcctgttcccatttccagcccactgccaagcttggaggacaaaagccagcaagcctcagagctctcaaatgcccacagcagtcccttctcatggagggagtctggaaaacaggatgtgaaagacccagaaaatgccagagaaggttctttagtgagccagcctgtaaccacacaagcaggaattgtgcagacaccatgcctgccagagtcacgatcagtttaaagaagacctcaatgtccagaatagccatgccagccaggcaggtccccttgcttcactcatcatatgccctcagtcccaagctggtccactttgattttgaaacggtaaacctaactggagggacatctgttatcacattcctcagtttaccttgactccaggtgctgccaaccaccctgggacttcacagagggtgtgcgggtgtggctgctgtatccatggctgcgtgtcccctgggcaccacgcagcagtcactgtgggaaccctttccctggcctgagatttagtgctgaaccctgggcaaagggcgcttcccaggtggagcagtggtaaaaacatctgcctgccaatgcagaagaaatgagagacaagttcagtccttgggtcgggaagatgccaatgcagaagaaacaagagacacaagttcaatccttgggtcgggaagatcccctggagtaggaaagggcaatcccctccagtattcttgcttggagaatccccatggacagaggagcctggggggctcaaagagggggtcgcaaagagtcagacatgactgagtgactgagaacatgagactgagcacttgggcaagggaagccctccccagggaactgtctccgttctctctccctcctccaggtaactccagatgactctaccacagaaggatgtgttgcccttgtgctccctgatttttctcccgtaatacttgggagttcactttgcctcaggatggcacctggatcacacaccagtgtgtcggaacatcgtcaggaggggagaagaaggcg

SEQ ID NO: 55085 - DNA, 2844 bp, Bovine  19866880800915
gtctgggatcttctctaggaagccggttcaggtaggggtgacttgatggtttggaggctgggatcgccagatgacctttggactcagctcctgcacgtggtctctgcgtgtcactgggcttcgtaacaagatggaggcctcaggatgttcagactccagcaccagtttccagtggaagaggttgtattgtcgtttttttctgttctatttttttcacaggcccactagattcaggaggaggaggagataggagccctgacctgtgaaggtggcagagtcagcctgtagaagaccacgtagcatggacggtattactgcacacttctctgcaaatgcagtcggccacaaaaggaatagcagagaaattgaaatatacacactcaactgaatttttcttctctttctctctagagaatccacttcccccaacccctttatccctatctccaaaatcaggttttcagtacagtgaggtaagcaagcaccaacagtgttatgcagttgaactcaggcatggctctagaaatatgctaaaagaaaacttctttgcaagcacatatccttgtgcatattcaaagtatgacacatcagacactgtaacaaagaaagtgttccttccatctttcctacagggtagtttccagaatcagactggtttttgatctgagtctgaaaactgaaagatgaacattaggtcctaatttccatcaacaaactccttccagccaagaactcccaggttccactttgttcatttctgtaggaatttggacaagctaaaagagacactgtttttcaactcaagatctcccatcccatccaagtggaattaacgtcaggtttaaaagggagtggtggtggtggtggtaatttctttaaaggcatgtaatatgaaggaaggagcagagaacacctcagaataaacagaatgctgggtgttgaaatgcgtctttgcttattgaacgatttttaaaaattaaaaatgccactggacctatttctttaattaaaatgagaccaggagattggggatgtcaaggttagctgaaaacagggatgaactgacctcagtctaaacagaaggaaaaatagtgtaagcaccaataaaaaaagcgtttgattatttttctctaaatgtaaataatatttttggccagtagagagttgaggacaggctaaaactgctttgctgcctttagcaaataaaactcggttcaagacacagggttgacttactaccaatttaatctgttttcaaagttgtatgactttatttgagtcttccatgtcatttggaaggaagatgggacctttgggtaacatctggaaggcatgtatgtcaacaaataccaaaaataacttttaaataccaatcctctagaataagtgatggagagggagactttcttcagaaacgatggaaagagcaaactcattttattggagagcagcctaacctctaatgcatcttgtgatgctaatgtaatgtgatcaagaggtacctttctctagcttccctccacattgctccatcactgtcaacaagtgggtttgtggaagagatgaagttatctttcatttaggagagtgcctgtggtggtcgagtgggtctttggtttttctgggatttcttgagagacaacactaccatttagctcagccaatggagcacaacagaaggaaggcttgagaaggactctaggaagaaaagctgttgaagcacatggcatactttgctcttggtgcaccttattccagcagcctccataatccatccttcagattgcacttggatattcactaagatggggaactcactgccacttaaaatctcctattccattaggggtctttattgggcagctctccataatactaagcagccccgtccaagcagtcactggataaaaggaaagaaagaaaccaagctgaactccttctcacttatacccactggtgatgctgtgctcccttatagaaggagaccaagacagtaaagcagacggatgggcattgcctgtgggtcattctccacatgcgtgtttctctgctgaggcatcagagattacaggaccagcagacagggacagtcttaagcaagacaagatccagggtgctgtgagcgtgagatgtgaaatctggaggcagttagccagtaccttgctcactgtagtacaggagaaccatgtgagccctcaggacatggaaaggtttccccacacactgatgctttgctgaagaacaatgaagtgaaggaaattagggatgacaactaggtttttttcaatgcttgagaatgctttccctgttcagatcttgcaggaccttggaggactctgtgtggatacagctcttgctctgtagacatggaagccatggcagagtcttggctgaagagcaacaaaacccagaacatggtgagattactctgagagttgttgcatattcaaaacacactttcagcacaaaaccatggaatgtcattgctttattcattcatttaattggtcattcattcaacaaatatttttggaagacctaccacactttgggtcttaattgtcattagggttggggacagggcagggaacaaatcaggtgtgtatttatcatcttgaggctcagtatctatctgggggatgcagcagtaaacaaaaggcgacgtgttttataaagatgcacagagcaagctgcggggaaaggagggagcgtgggaaaatctctttagagaggacattcagctgggaatcatgggagaagagcatctcagcaagtcccttcagaggaatgggaagtgccaaaagtcttgtggcagcaacatgctgggctgcaaatgactagaag

SEQ ID NO: 55086 - DNA, 1320 bp, Bovine  19866880846515
tgcctaaaaagagtgccttaacctaaaaagaactgcctaaaaaaggttaacatttaaccaagaccttcttatatgaatacattttttaaagcatcaggaagataaacggtaataatatagtctttggtctagaattagttaactgaacagaggggaatctgactcaatatcagtctctttataccttcattggatgaatcaaatttaaactttttaaagatgtagcctcagatctcttaggcaaccctagttcaaaggaaatacttcatatcactgaacattgccttaaaaaaccataaaaaagatttaggggtacctgtctgtttttattatccatattctcttgacccttcaataattagtataactaatacctgtgatatttatgctatcttttttatgacatgccaatgactgatactttagttgcaaataaatgtcctaaaattgccattcataaatttatggaaaataatttagatatgttacttaaataacatggtattatggactaagcatgtgtttgggcattaggagacttcagtttcagatttggctcctacacttgctctctgataaaacaaacttcattgctctgaacttgaggtaggtcatcagtaatgtcagagcataacttatgtttacctcaaacagtgagaattcaatgaaattgtgtaggtaaaagagctttacaaattgtaacatgctatacaatgtatgttacaatgtaatattcatctttatatcattattgttcttatgagaatttatgtggcatgacttacctttgtttggaccattccatgacgctgttctctcatttggctcactatattcatgatgtcgaactgtaacaggatgacagtaattttgtattatccagagagggggaaaacacaaaacccacagatgcctaaggagtatgccatacttctttccagtaaaagatatctcaagatttaactggcaagttctcgttttcagtcataagagcatgtactatgtttaacctagtctagtggataaggaagacttgttcaaatgggtttccaggaaaaagcaggaagcaatcatttataataagaaatgttctccaaaagaaataacaacaaatttgcccctgtgtatacttttctgttctccaaagggagaacttaaagcagcattgtgattctgcaagagtctgaagcatagaaaaccttttctggccacaacagtaacacagctgtttctcatataaagagccctctcaactcaaatggagaccctgagcagcagctggcccaaccccagattctgcacctgtgcgggagaacagca

SEQ ID NO: 55087 - DNA, 1567 bp, Bovine  19866880895265
ttgttctcaatcttagggtaggaaaagtatcaatgaatatggaagatattggtaatgatgataaataaggttgtttttaaaaaaaaaagatggtaaaattatagttgaaaggacaaaggaaccctttgaagaaatcacagtcaccaagctgagcataaaaacaaaaataataatgaggcttacttgaaacaaattgattttgtggaagaccacgaaattcataacaatactcaaaagaggaaagttaacataaatgtatgcataaaagaatccatgcattagaatttgtttaatttttattgctttttaataagtagaaagtgttttttcctgtgatgttttcaaagtacagagttatatttctcattgcctctgtagataagaaagaataaacacagggaactataaataaactaaaataattccccaaacatgggttctgcattatgtaacaagcagatggaggaaaaatgaagcaattgattgctttcgtggtcctacacagcaagcaattaagcagagaatcccacagagtgctccaagatgattaattagccaaatgctgcatgcaccccatctctcatctctgagtgtatggaaccttgagatggccctactaattataatccaatattgataaggcatgcataagcttccaattaatatttatagaccaggtcaatttatcataatgacgggacaatagtgtaagtattgccaaccataagaaactttcagaaatacatcatttctgggaatgacaccaagtttcagaaaattaaatctttggatttagattttaaaaggcaggggcttaagtctggatataacaaatagaacttcattatcaaaaggaactcagccagtgatttggtttagatcactgtagactgtacaaacttgtccttggtcagaatctgtgacctcttctctcctgaaatgctgtgcatacatggaggttagggtctcctgagattattagtactcaatagaatttgataaaatttgatagagtattaatataaaaataaaaccttggaaataatataagcaaaggtaaaaatttcttttaaatccagggaattcataattacatgaccacttttatatattaatcattgtcttaaaaagactactagtggggtatcctaggctatgttgtgattataagtaatctcaaaatcctaacaatccgatgcatgtctcatttctctgtaattgttcctttcctgctaagtaattaacacaacacacttagtctggtgtatcatcaaatcataatttgaaatgatcctgttaaattagaaaatggtctgaagatgaagtaaagcacgtacacggagaacctttaaccagtggacagggccatttagtctcctttacttattactttcagaacatgtttcacggctagtagaagaactagaaatctctctcctcccctaagtgtaaatggtcacctcatggtaagcacacttgaccgtcttgcagaatgtggtgtgtatgccgtatatctcaacttcttcatgttaaaatgaatggagtgaggttaagtcaacctcacact

SEQ ID NO: 55088 - DNA, 903 bp, Bovine  19866881398740
tttcaaagagcactgaagccattatatacatttctaatgttccctctgaggccacagatacatctctttaactgttaaatgaagaatatctgatatgaaatttttgaggaccaaagtgactctgaatagtgaaatgaagttaaacttggtttctggagttgccatcttggtcctttacaaaaaccaaagacttctccctctgagagaaaaagccaacctcattgtgtctataaacatagcatatctggggctacacagaatccactggttttataaacaaattcctgctgaagaatccaaactagcctgatattataggtgtagaaaccaaggtgctaccggttccagtgatcttgaagcttggtcctctggatttctgtcttttcaccaagccaggctatggtgattgcacaagggaagtatttcttcaaaggagaatcaaacaacattccccaggttccgtgtcgacagccccggactggagaggaaagcagggctcctcacagaagttcagtttacagcagagctctcccttggccccaagacagctttgatcaccgtgaagtttccacaaacacagaatgaatgaggaagaagatggttatgcttttaacctgatcgacactgatgagaaatgaggcatatacagtcttttctgtagtgccctgcttcaaacagctgtcacccttccctttaatgtatgggcttaaaatagttgtacattttgttttctttttaacacttctcatcacataattaaggtatgatagtgaaaggcacttatgacttactgatatggttcagtagagtacaaggccagaaagtaaccagcctaccttaaaagcccaactcccgcttctaattttcgaatgtgggcttgggcaaatacttaaccactctgca

SEQ ID NO: 55089 - DNA, 1173 bp, Bovine  19866881607081
ctctttacaaaagaatttaggtgtgcagatcttttattatgcgtgtgagttgcttcttgtagcacaggtgtggaacataatcagatgtggattagaaacccagaggattgccattgttattttatggtaagaatgtagttttcagaaatactttgaagtgccgtttggggcattttaggggaaaattttatctgccctcccgctgatgagacattgagagattcttttgtcctacatgtagtctaccattgctcttagtcatttttccagtttccatccttgtgactggtgctttatgtctttgcaaattaaatccatattttcccctgctcctcgttctcttttatactgaaataacttgtgacatttgaaagttaaattctttgatctcacattttacatctttagatcatttgacaggattctgaaatgcttttaatgagctatgtcaccttttcaggttatgataacacagtgttctcattgtatgtaaaactgacattttgtcaaatggtttaggtattaatgcatatagaatttggaaagaaagatgagactacatgatctgaacattaagaaacgcaactcagaacagtgatccttgtagttctattttagcggccagggcctaatgaggagcgagtaattagggacttgccatctccatgcatttgctcagatgtgcctgtgttactattccagccagtgtctcaacagctgatgcaaattaatgggaacagcgcatccaaaaagaatctgggagtctcacctacagaaacagttgggaaacatctgtaaggtcttatatttaggctctttcccactgtgacacttaaaaatctgattaaacatactaccgaggagggttttggtaactttgaaaagtgtgagggcttagttttaggtagaaaatagctgtgtatataatttgggggaaaaaaaacaagtatttttactgaattcattatcgtataaatatgaaattataaatgtttgaatacttttggtttttgtgttatggcattgactctgcattgtcttttaatttgctcataaaagaataaaaattaaggaacctctctgagccttctgtttaggcataacaactggatagtgattccttttctatgtttaaggaattaagttcctgccaacagggaccaatgttatttt

SEQ ID NO: 55090 - DNA, 1102 bp, Bovine  19866881907357
tttatttacattcacagtgaatttacgcactgacttcctctcttggaggggaaggcatgacctggaactcagaggaagagctaagtaggaggaaagcgtgtgctctgtgccgaggttgacatttctggcagccatcccacgacagtgcaggctgtggggagatggatggacagagccatggcccagcccagagggaaggtgagcatctgaaaacccaggtcagtgcaatggagcaaacagtcccacgtgtgtcctgcagacttgcgaacaatgagagctagttgccacgtgagcctctgccctgagaggggaggggagggtggggacaggggagtcacactgggaagccacttaggccagcaccgttagttacagacaccatgccctgaaatccaaacctgatttctagaagagccttggcaaagaaggggtttaagagaccggatctgtgtgcgggcgtggggtgggggtgggggggcgcgtgggggaacggccagtgtccacgcaatctctgtgattttgctgtgtggaaacacatgcctaaaaggatggatctcctgctctgcaaaagcagaaaggttctgatttaaaattcaaacgctatgaaggcaacactttcaaaaggacagccagacagcatccatctgtgggctgtatccacccaacaggctgccatttgggcatctctgtctagctactccctggcttgaatggatgggaggtgttatcatctctgtttacagacagggaacagagtcaggaggcagaaggacttgcctgcaagggcacagctggagtgacagtgagcagagcacagcagggtgaccctgacgccccctaccttgggcatcgggaactcacaggctcccgagcagtagtaggcgtcgaaggacttgggtgagatgatccattcattccaccctatgtccgcgaagtccaccttcagatacctccgggaacagacccgtggctcatcccattgcttcttccgggctttctgcatcgtcttctcatcgaagtccagcacctgtgaggaggccatgaacacatcctggcccttcttcctgcggtccttgcggcccggccgtggcttcagcgcacg

SEQ ID NO: 55091 - DNA, 1354 bp, Bovine  19866881932020
taaatctgtttatctctttgactaatagaaaagatggcatagaaatttctagcaatagacaattagagtaaggtttagaaaaaaatcggtttctactaaaaagagaagaatgccatcagtatccagacatcttgagagatttgtgttacatatggcacaagtaggaataggccaagggaggtatctcctagcctataactaaacacagcaaaggaggagccctctgaaggagcaagtgaatgaagggcgttctcctacaaatccagagaacctgaaagctcagagcagcagtggccagaaaggaacaaatgtttttggaaaaaaaaaaaaaaaagactgggatagtttatacaaattctaggattattagaattctatcgactgcctgcacacagagtggccatcttttgtgtccatcctcagctttcaccggtgaagcagcatgctcatgaaagcagaagtactgtggcaaaaggatgctacaaaggggacttgctcaaagtatggacgactattaacaaatttgagaggggaaaagccaattacgtggctcagtggcccgggaactctctcttcactctacatggacatctggagctctggttccaccactgctcctacagagagaataaaaagaggatcttttcctgccatgcaggggtctcaccagtagcccctccctggtactcaagtcaggaagcccgctcatctaccaaacacactgtgacgagatctctgaacagggcttacaccagttctgacagaacctttctcaaattcaaaaatagcagacataaatctctccttgtaaatatgaagagacaaaacaatcactagatatataaagatacctagtactccacaaaaggataccattctgagaaatcacagcaaatatcttcctttctataagagaagaatactttaaaaactcttatttgtattttaaataaaatctcagcaaacattattttattatttaaaggatgatatacatatatatgtctgtttattgatataaatttgttacattattaaattacaaaggaggtaaaagagcattaaagtgagatctttcatcatatatatgtatatatacatatatatcatatataagagcttctctggtagctcagaagtaaagaatctgcctgccaatgcaggagatgtgggttcagttcctgggtggggaagattccctgcagaaggaaatgacaacccactccagtattcttgcctgaaaaatcccatggacagagaagaccggcaggctgctggaagtccatggggtcacaaagagtccgacacgactgagcacaacacagcacagcatttatccaaatgctagtaggga

SEQ ID NO: 55092 - DNA, 827 bp, Bovine  19866882110625
aacaggggcagagcgccttcacagaggtgcgtcagctcaagaagaggcttgggggtgggcaggcccaggacaggaagcacagtggccctgtaggccagcctggcccccagcagctgacccctgatatccgcagggacctaactggcagcacccgcgtctctgtgtggcccagtggagcccgcagggagcagagaagtgccttcagcaagccagccaggggtccagcagggagactgggaccagcctgtgtctttcaggccggtgaacctgcagatgccctgggagagctgctgggactcatcagcacggttgatgtcacttgctggggtcgactttccaactccaagcttttggtgggtgatttctggaacctgcaaacagggccaccacatgctcctctctgcggcactttcctgggcgcccccgcgctgtggctcaagcacgccacggtccagatccccacgcccccatcgtcgtcctccaccagctcttgggccctgctgccccctacgctcacctccctgggcctgtccacccagaactggtgcgccaactgcaacctgtccttccgcctgacgtccgacctggtcttccacatgagatcccaccacaaaaaggagcatgcggggcccagcctgcattccaagaggctgagagcagaggccctcacgtgccccatctgccacgagtgcttccgtgagcgccaccacctctcccggcacatgacttcacacagttaacgggcggtctggagcaagcgctggccgtgaggccaagatggctcacagggccttcctctgaaaaggcggtcacggttgtctgcaggg

SEQ ID NO: 55093 - DNA, 1180 bp, Bovine  19866880768774
atattaaaaagcagagatattactttgccaacaaaagcccatctagtcaaagctatggcttttccagtaattatgtatggatgtgagagttggactgtgaagaaagctgagcaccgaaggattgatgcttttgaactgtggtgttggagaaaactcttgagagtccctcagactgcaaggagatccaactggtccatcctaaaggaaatcagtcctgaatattcactggaaggactgatgttgtagctgaaactccaaaactttggccacctgatgcaaagaactgactcatttgaaaagaccctgatgctgggaaagattgaaggcatgaggagaaggggatgacagaggatgagatggctcgatagaaccactgactcaatggacatgagtttgagtaagttccaggagctggtgatggacagggaggcctggcgtgctgcagtccatggggtcgcaaagagtcagacatcactgagtgactgaactgaactgaactgatttcttgtcctgcgttttgacacctcttctcactcccttcacattttcatggagaaattgaagcagaccagggaaagggagaggtttttttcctcctctcttctttccctcccctcaaaactctactcctagttctaagaattatgctactagttaaagtgaagatgttttctttcttgttttcctatcttcattcccccttcttatttttagaactacagaagctcaggattgttttcagggacatcatgaccagaggcagacaatctcaagggcctgactcacattgttgaaaacatatatcaagataaaagatgtcacaagactaattcggcgtagtcgcagtcacgtagctcattcctttaggagcagaacctagaggaatgacagagaggatggcaattaaagtgagaatgggatggtactaaaactcagctgtcagttccctgcaaaaataggtccctaaatcacttgatgagataatgggttgagttttgtgcatctagccattctcagaggcaaagcagaagttggtagttgactgactgggtcaagaagtttgagactggtaggtctgaatcaagcaggataaatgaatggcatttagttactttctatctctttgccatttatactcaaggacatcatttgtatggctttctgcaaagcaacagctaaa

SEQ ID NO: 55094 - DNA, 1717 bp, Bovine  19866881036724
ggatcttctggacccaggggatcaaacccatgtctcttgtgccccctgcattgggtggtggattctttaccactagcaccatctggggagcccaaatctgttttactctcacagagaagtttggccaacaaatggccaaaatagcaaaaatgtaaacagcaagcacttctaaatagcaagcctctttaaacacagagttaatatttgttcaagtaatcagatatggagacaatctaaaggcatgagccagattgttcagctttctttaggcaaaaggagcaaaagaaggaaacattgttctagccctgttcaagaaatctgcagtctgttgggggaaaatatgacagacatatactaggaaaattggttattaaaatattaatttatccattaaacaatgtctattttgcacccactctatttttattagggaaggaaatggcagcccactccggtattcttgcctggagaatcccatggacaaaggagcctggtgggttacagtccacagggtcgcaaagagtcagacacgactgagacacacacacacacacacacacacacacacacacattccaaatagatttctggagtctggggaaacaatactgaataagataaaatatagaacttacattcctctgaggcaggaaacagaaaataaaaatagccacacagaggggtacaggctatggaataaatgcaaagaagggaatgggttagacagctactggtagagagtaaagtgtagactttttttataagctgccataatttggcaagttgtatcaggaaatggcttttgagcagagacctgattgatgagaaatagccagtaactgatgttccaggcagaagaaactgcaagtttaaagaccctgaggtgagaacaaagttcaggaattacaacaaatggaggaaatgaaaggaaatgtatagctggagctagctcctgtgtgtatgggaggggagaaggtggggaagtggtgagatatgtaccatcagaaatcattttgagattattttggctaccatggtttccctgtcagttgagctactatgtcatgtacactcaaatgcctcagctttatggcttgaggtattaggataataacattgtatatctcttataaaaccattccttttctattgatttttgttcatagagatcatcacagtgttattatgatttccatttagcacttacttgccctccttagtttgttgaacaatcaatactctttgtccagaaagcagaggccatctttatttctcttatctctttttggtaagcatgagggaaggctgcttcttgtttcttgggtacatcctagtaaactacattgtttgtacggaaagaatcacttctgctctcagtcaaagcttagtcaaaacatctaggcatttcaaattgcaccccacagcctggctgccttcattcaggcaaagctgagacctgaggcaatactgcatttagaacagagagcagcccttaaatctagtgaaccaatctctgacttgcctctttaggattgaattttgctctaaaatacccattttaaaagcaaaaacatttacctaaatatatttccatgacacaaatgtctaacaactttcataaccctgcattatcattgttagcgtgtattatagaacttgtagacatgtactgtgtggttaaaaacgaatcatgtcacctcacgttcacagatgtgtt

SEQ ID NO: 55095 - DNA, 1128 bp, Bovine  19866881459270
atttaagataatgctaatttatttctctttcttctctgctatcccagggaaaaagttgccatgtaaaagtaatcttttcccaaatagaaagcactctatattaggaaaatattctctgctcctcaactggacacggtggtggtttagtcactaagtcatgtcctattattgctaccccatggacgggagcccaccaggctcctctgtccatgagattatccaggcaagaatactggagtaggttgccatttccttcttcacaactatacatagaagccacaaaaagtaggagaaaaagcaagtcagcatttttaagcttttagaacttcatgatgttcaattgactaactggttcttatactttagttactgcctcattaactataaaggagaaattatcttgggttcaaagagaaagataaaccatagcttttattccataaggaaaaatctaattatagcttaaagaatcaatgagaataatattgatataaaatatagaagagaactattaaattggctcaataaagttttagtaatagatgggtttcttctaggtcagtaactttttccctgtcttcctggagcattaattatttattcattacgttccttcagtaactgtgaaattattaccttttagtttaatcagtacattttctatattctttatttctgactcatgtctagaaagttttctaaaacaaaaaatttccctctactgcttgagtatatttatgggtttgagattaaaacttagatgctacatacctatacctgagaactcaacatctaaattatggcttgcaagaaaacttgttagcattttcaacaattttcccaagtgtaaattcaggaaaaatcaatttactttctcttttttaatttcaggtataagttataattctgcagtacccaatatctctctgaagcccatggtctattctttttcttttctgtatatttcaaactgatcctttggagttatcttgaaagaaaattaataggctccttattaagtattgtagtgtttcaggtagcaaatgcaggacagctacctaaccaatccctgagtagccaaccagtgagtgggcattaatatttggagaaagttaactaagtacatct

SEQ ID NO: 55096 - DNA, 1948 bp, Bovine  19866881693446
gtaaagaacccacctgcactgcaggagacccaggttctatccctacattaggaagatatcctgaagaaggagctagctactcactccaagattctggcctgaagaattccatggacagaggagcctggttggctacagtccgtgggttgcagagagttggacacaactcagcgattaacactgtacacaggcaaagtctttagcagtcaatgaagcagaagcagatgttttctctgaaattcccttgctttttctataatccagtggatgttggctatttgatctcttgttaaactgttaaattaagtgactgtgagtctgagtgaactccgggagttggtgatggacagggaggcctggtgtgctgcgattcatggggtcgcaaagagtcggacatgctgagtgactgaattgaactgaactgagatctaaattcagagaggctaccacagaatgaagtggttacttactttagaaagtgattcatcccataacagaaggctcaaacccaaccccttttttcttcacctgctgtgctgcaaaaaacagaagccactgtgctgagagctgatccttggagccacaagcaggccagggtagcattttctctggccagtgcattctcagggcatagaaaaatttcacctctacccctcttgagttcttgtgactggacaaattgaatacaagacagattaaaaggaaaaaagacaagtttaatttatgcgcacagtggtctcataaaatggaactaagaagtggccaaggtaggtagcttttatactttttagacaagcaataaatttgagaggaactgacaggaaaaagtaactatgtttgggtgcttaattaataaggaatttaagcaaagtttggacttgagcagtatattagtaaaggattagcaaggtttacacagatgtctcagccctgaattccttgcctctgttgataaggacgtctttttatctcctttttacagggagggcatttcttacatgggacatttatgttctgtttccagggagacagagaggagggtcaaactgtcccctttgtattggccatttcttaagtaagtttacttcaaaataaccaatgtgaaaaaatgttttctggtcctaagcaatttctggatttcagggggatcttttaaataagttagaaggggatcagatttttagcatatacaatgagtctgtgagcttgacagataagttctgtttttttgtatttttaactgctaaatttagtgttatataactaactatcttcaacgtttgaaagctgaagattggatatacgtcatgttagcattgcttaatacttacaactttttgagttaaactggaaatgcctttttccacttggatacattttcttcaatggattttctgttcaaatgttctagaaatattcatccatatattgaaatatatgccataactttatatcgagaagaagaaaagcccaagtaaatgacaagagaatgaaagttgaagtctgcttattaaagttaggcatgttttgagtatactgtgattacatcaactctttcaatgctatagttaatagaatattagacgcagcaaaactgaaaacttgcaatttagcaaacatttattgaataacttatgtctatattttgtgtattactctgctgaaactatggtgtaatgtaagcacgggatgtttcctgctctgaaaagcgattttatatagcacatacacaaataatcctggaggaggaaatggcaacccacttcggtattcttggctggagaatcccatggacagaagagcctggcatgctacagttatgatgttgcaaagagttgaacacaactgtgggactgagtatgcacacacacatgtacacacatacatgaagtgataaaaaaatgatatacatagaaggagcgggagctgaggggagggagaggccggt

SEQ ID NO: 55097 - DNA, 1859 bp, Bovine  19866880243935
ttcttctgtgtattcttgccatctcttcttaatatcttttgcttctgttaggtccataccatttctgtcctttatcgagctcatctttgcatgaaatgttcctttggtatctctgattttcttgaagagatccctagtgtttcccattctgttgttctcctctatttctttgcattgatcactgaagaaggctttcttatctcttcttgctattctttggaactctgcattcagatgtttatatctttccttttctcctttgcttttcgcttctcttcttttcacagctaaactcagtaaatataggctgttctgattattgttatcattattacagttagtttgaatacttaagcatgaaatttctgcagcttctcccatagattttatgagatgaatatttggtgcagactcaaaaaacatggagtgaaactatagaaactgaagctcaaaatttcccatctacttgcaaatgtacttttaagccatacaagaagctagtgtcctatgaaatggtctgtgctttatggattagctctttagtcatggctttcctgcaaacactggagcaagttgttatcagctgatatactcctctaagttacagtgagtaaagtcaccaaataaaattgtttaatttttgatcattaggaaaacattctttttagatgactccagaaaggcacaatttgtggaactagtttctgaaccataaaactgttgagccaggattttacaaaataaaataattttatggtcatacaaagagtcagctctgtcctcaaagtatattcttttatgtgagttaaaatttagagatgggtttagtttgaaataaaagaagtatattacaaagcttcagaggattatttttagaaatgcttacatactaactttggaatcaagctctatcaatcaaacatagatggtttggggtggaaatagttaataggatggtcattatacccataattgtgaaagatttctgcactctgaaaaccattttcttaattattttaggttaacacttgtgtccatggcagggggagggaaggggcatgtgtaatctgaaacctcagatatggtgcctggtctgaattgagataacattaaagattttattgctgatacattataaattatttctattactggggtcctgcgggtattgcattgtcagtgcactttgcctattacctcatttaatgttattaacacactttggggtataaaattacagttttatcatggaaaccttaaacacttacatccaaagtactgaagcaagttattatctttactgaccagacccgttttattgtcattttatcactcataaaatctgagattcaatttgatttaaccattaagtaaagcttggtctccatgagtttaagtccagctgtaatattaatatattaatatataagatgacttcattttattaaaggtgaggtaagttagaaaacctcttttaatgtccttctgtgatcaagaaatttaacctgacctgtctccacttctgtttcaccaacatcaacaaaaatttaagaggatcttcttagagggtgctgagcaccttctctaacctgcttctggcctttattaaaagcccaggacacattaatcagccacaaaatggtatcactcatcacagtgtcaagaggcaatgtccaatttaaaaacaagaaagcactaagaatccatcatgttaaagaaacatgggctacacttaaaaaaaacttaaagcagaaacttaagcacatcatttcaatagctcctaagttaagaaaaggggaatgggcttcccaaatcaatccatcactcagaaaatagaacactacagataagagcacaga

SEQ ID NO: 55098 - DNA, 1414 bp, Bovine  19866880347301
acccttcatgccataactaagacctgacaccaccctaataaataaataaaatttaaatattttaaaaaatgaaaacagtttccctcctaaaaaaatgaaggtgttgggcccttactctccaccagtagttagcagaagagaggactgcccagattttcaagcaacatgttcccttcagggacctggagaccaagcatcccagtgcactttggaacttcgattgatcccacagcctcttggtgcccacaggactccagggcagctcaggagatgccctttctgtccactgctcagttgctgggtccacgtggagtgacttcagatgcgataccagtgcctgggcacagctactaatttaggtatcctatgcatcctccttatcatttaatacattatcaaaattaggaagggcaaaaaatattcttcagagcagccttatacccatggggtattagttctacaatctgctcagctgttaggttaaaatctcccaaatgttttggctctggtactgaggtctatttcagggcaattgtgtcttgttccaccaagttctagtcaaaggagccaatgggaaatgagctgaacaacttctgggaccctttcaatccacattatggacagtttttagagctggagactgggggagaaaaactgaaagtataggaagaataaaatcagattttaattgaattgctgcaatgtactagtaaggctagttaagcatataattaattgttgtaactatagcaacaggattagctggaactgttagagtggcaccaggggttcatgagagactcttaaaaagacaagtggtggagactgcagaaaataattcattctcctccagtagctctcaagagggcctcacactatttagcaaaccccaaataaatctatttaataatatttcgttagattcatgcagcttttcatatcccaaagggccccgaggttcttcttaagccatgaaagcaaatatagatttggaataatgtatcaggccagattttcccagtgcttaaacaactccctggtggtttgttctgcacctctggaagccccattaccttgaggatacacagaagcagtaatttgctaagtggcatccccacaggactggggcctgaagcaccaacagaatgtaaactcaggtgggggcataaaaggctccagagatagtacttttatttatttataccctacctcattccaaaaacgcctcgagaaggcttgcaaattacccaggatataccaggataaaataaacacaggagaaaacccaaagcaggggcagaaaatagtaggaaaggaaaattagatgtttgggaaatgttagcacaagaagtgcacacagcaatctccaatctcctggtctgtgtgtgctaagtcacttcaatcatgtctgact

SEQ ID NO: 55099 - DNA, 1490 bp, Bovine  19866880424302
agtagttgaatgtttgttgaagacccaggagcctctttaaatatcaagaaggactgaatatacacatttgatgtaaggaaatcaagtgcatcattccagcaatttgtttgaagccaagatcattaatgagtctcacgtcaagggctatatcctagcatccttgtgtgtcactattttgtaacttcctaatctttactagaagcagcaaagactggaaatgctccattaagggaaatatgtttgagactttactaaacttttgatgtcaaatcctttcagtttcttttttcacagtgagttcaaaatgtcttcattggaacagaaccttccaaagttacaagattgtttttggcgccccagggaacacacgggcaaggctgtaatcgagggagacaatgctgtcagtacaagtgctgggagaatctgaaagcccaagagtggagcattcatcaccatgattccacccgacacttgactgaaagcatttttcactaatttgctttgtgcctgtccagacaatctaaaaagaaaggatgagggggcaataggtgtctattaaacagaataaacagcccctggcaaatgaatgtatttcacacacttgtggcttttggagggacaggggcggtaaggatgaggggaaaggaaacagaggaggaggagtgaaggattagcctttcctccactggtggggaagggctggctcaggtcacagggatccatccacatggcccacacctccccagcctggagattcacaggtgcgggtagaagaaggctacacccgagggctggcttctcgatgtgcacttttattctgatcgggtttaaaacctacctgaaaatgactttcaaatctctgatgaaatagattcgagtctctttccctggattgtatttttaaacttaacctctacatacatataactgctgtaggctggttttaagcctctgctagtgggtcaattaaaaacaaaaaaaaagcctcaagcttgttgtcacagttgtctgactttgctgagagcatgcaagaaagattagggtaaaggtgaggggagcgaaagaactcactctgggacccctaattggctcctgttttgaactgtggaggggagggaaaaaggcgaaggagcgagaagatggtctaacaagaaacacatggtcttttgaaagtaaacacagctgggacccaaaccgtgctctcctcattgtcctagccttcagccttttcaggatcgcattatcgttgcggtactgatgattatctgtttggattatcattaagaaatgtggcaacattctagagagaatagatataaatctaatttctagggctgtggttaatcagaaaactcaatcatattttgccaagactaaaacaatggactttattaataattctcagtttctttagagtttctaagtcagtggatattttctaagctgcttgcagtttgatctttactcattgactctctaagtaaataaca

SEQ ID NO: 55100 - DNA, 1084 bp, Bovine  19866880473190
taccaagtgtttatacttttttatattttgtatatgaggcagtccaatccgtagtttgtgtggtatgggtgtttttctcaccattcctcagttgatgagccttttatgtcatctccagttttcattgttgaaaacagtgctacaatgagtatctttttgtgcttgtaccaacacctgtgtagggtgcattcctagaaggggaatttctgggtccttccatttatatttattgagtaactattttgtgtcaagtgctcgagaggctacaaagtaatagaattcaatctttgacagtaaagcagtgtttcctgctttcatgaagcctgtagtttaagtatcaagaaatttacagaaatagcaatttcaaatagaaaatcatgagtgctctttacaaaatgcaggagaacttccatgagaggataaaaacaccttgacttcctaacccagcctgtgcaaagtaataattacttgggagtctcagaggaaggcattgaaaatttccaaatagagttcctggcacctgttaatatgaatgagttgaaacacgggcatgccgaaggtgacttgtttattcaaagaggtccagagagcataattggttttgaacttttagaaaatatctctacttgtgaagggagggttggtatagttcactagagaatcgaagagtggaagaacttttgtttcaaagatcttttctcaatgtttgatacaaacaaacatttttattttggctcaaggctaattcattttagttttcagctttatatatgtgtgggctcagctacataaccttttttgaatctagaccattttgataaagctcatatttgtctttagcatagcagaggttaagaatgagtgtttcattttttattttttttcaattacgatcccaaaactgttttattagggaagcttctcttcaaattcagcatcctttagtcaaagcaacaatccctttcagaatcttacaatagtatgcaggcttgtgagttttaaaaatgtatccaagcagaaaaatattcatgtagagatgaaggttataagccatggctccaacatcgtatctttcaggcgagaa

SEQ ID NO: 55101 - DNA, 1271 bp, Bovine  19866880557548
tacaagtatccattttctcccaaaactccccctccacccaggctgccacataacattgagcagagttccacgtgctagacagtaagtccttgttggttatccattttaaatacagcagtgtgcatatttctatcccaaactccctaactttccccttcaccccatccttctttaaagggaaaatgccttttacacccaataagctttgcgctgtcactccctaccccccaaaaaaatgaaagacgaagaagagtaaaagacaacataaggcataactagtggcttctgtttgctttgtgctccaggacgcggtcaggacaagtcatcgggtctcagagtgaattttctagttaccgtggatgatgcattgggtcgactgtggtgacggattgttggtattagtagacctgagtgtgattaataaggctgctctgtatctgacagagtgggaatggcaccactaaaattgaatggaggcaatcctactaaaatctgttagggatgctccttggggaaaaaaaaaaaaagtacaggggaagtaccaggagtagaagcatcagttcaccagctgtagccacatagatcaaagcaagatggcaaggtctcactaaacagaagaaccttctgcttctcacttggtcttcttaacaatgaacaagctagattccttcccttcttccacagaggcatacatttatttatagcaggactgtgtatgtaccagtgtatatatttgtgtgaactgttacctgtgtggatgggagaagaaaatcaaaccaataatacatttgagtacatttttgtttttaaaaggtgtcaagtgacagatttaaagtagagagagagagggcaagagagagggagagaaggagtcaatctttagtctattagcagatgtgtttaacatttagatactagagccagggtttcatatgacgcaagatgaaaatatattttcttatgacaatatatctttcatcaccattaaaatacaataaaactgtatggcggaaaagaggaaatatttgaaaagttgagtgaagctgtgtcatatatttagagttagtatctgagagttatgtttctgattaaggctgtatcaggagacttaaaaggagtaaaatatacctttggacatctctctgagcttcagaaaatggaatgtgtgcttctaaaatcaaaggcaactgtttttattgatagtctatctggaaggactatcagcacagagcctgctactttgcggagggcagagtagtggggccttaaaa

SEQ ID NO: 55102 - DNA, 1932 bp, Bovine  19866880558273
actggagtgagtagctgttcccttctccaggggactttcccaaccaaggtctctggcattgcaggtggattctttaccatctgagccaccagagaagaactgactcattagaaaagacccctgatgctgagaaagcttcaaggcaggaggataagggaacgacagaggatgagatggttggatggcatcactgactcaatggacatgagtttgaacaacctccaagagatagaagaacagggtggcctggtgtgctacagtccatggggttgcaaagagtggtacacggcttagcaactaaactacaatggttgattggtgtcgcttactatgggctggctcctttttgacctccaaggagctttctaactgggaaggtttccttgattttgagaatgagaaatatttggtctcttatcttttatctgggcagggcccagcctcctctatggactgtcctgctattgatatgttggagtttctctctatagggaatgaactcaaattgctcactttggggaggcccatctacctcttacctcaatgtaagtttttggcagctgataggagatgaagatgtagacatagaaaaaaatatgaaaaaaaaattagtttaaaaaaataccagatttgcatgttttatgttatgaattccagttggttggttttattatagaaaatgtataagtggatggtatcaggtaaatatgagtggcctgctgattctccagtacaatttgaaggctgctgtaaatttctatttttttcagaagtagtcttgcttattaatgaattcaatttctctccatgcattccctgaactaaacattattgtctgacctgacaaagcaaatccatccttttaaaattataaacattattattgaatcgatttggatagaaacaaattattagatatttggcaggaagcagcactagccacatcaggaaaattttcatccaaactgataaagaagttgattaggagggaggcaccgaggaacagattgtcatttgagatgatgtgtggtacaaataaataaataagaaatcttatttgctttctgctgtcaaaatttctgtgaaagagttgagcttccaaattcatagaaaaagagatcaaattttgttgttaccagaagcaaggagttgggggaagggaaattggaagaaggtggtcagaaggtacaaactttcagttacaagatgaataaataccagggatgtaatgtacaatatgatgactgtagttaacactgatgtatgatatgtatgaaggttaagagaataaatcctgagttcttatgacatgcaaagatactgtttttctttctgtggtatttatatgagatatgaatgttagctaaatttattgtcattattcttggatatatgtaagtcagtctgtatactgtgtgccttaaacttattcagtgctgtatgtcaattctatcccaataaaactggacaaaaagttgggtgttgtggacaagagtcaagaaagaaataaagtaagcatcatgaataggtcaggaaaggttttctacaaggctaggagaagcctgggaaacaggacagacaaggtgatcaggaagggtgttcgagagactgaagacagttattctgaagccaggagttggtgaaagaaactggtacatttctattgcatttctccaagtctatagtgcccttctgagcactgcatggtacattacccccaggccattgcaacaaataattcattcacacttcagtgcaagtaggaaaaaaatggcagcgttttgacttccaactggtactcccacgttttcaagggaaatgagtacttcttacctctacaaacatcttcccattgcaagtaaggaagtaagcaaatttatgtacctggcttgcaaacagcgtatctttctttctttttttttttttttaatt

SEQ ID NO: 55103 - DNA, 1221 bp, Bovine  19866880826650
aatttctaaaagaaagactgaaaaaattgtttcactattagtattgcccatttaagtcatggatgaaatgtttagaaactttattttgacacacatgaaatatccattttctgtctttgtcatgaagccaaatatagaattaaataagatagtgaagggatttacacagtaagctttgcactatcattttatgagttctagtaaactttactctgcttatagttccttgcaactgatggagactttaagactatagaaagaccttaaaagtgtaagaaaattcaaagttccacaaagaaaccttggatcttacttaagaagtatcttgaagtccttgggtgaaactgcatggctgtgaattttatgtgagggggtgtcagtccagaaaaattcctagaggaaattatggagggcaaaatataggagaaaggggaaagagtagagtgaaaccttgacaaaactttgactataacaatagaatgcaaaaaaaaaaaaaaaagaaacaaacaaaaaataatttttgatagctagaattatttgtttaaaatattattttgtaagaagcaacaaatcattttgagctatgctcagttcttctttagttagcactcaattaactgctgaatctcagaaagtgaattcattatttttctgatttgcttttaaaaaatgagaaaaaaaatgtcttggaatacataaggaatgaagaaaatatccaaataaaaagaattttacactctgagtattagaaactatggctcaagtttcctcaactagtctagtagagttttttacactgtatttcacatcttccaatgggtgttggaccattaaaattgtattttgcatagaggggaaaatgtagaaaaatcaacaacttagggaggaaacacattttaggcttgtgtttgctaggttttttctcattaatcaagtaagttagtaatgtttcaaaaagacagtactctgactatggcattcagaagtcacagagaaattcttctgagaagttggaatctttttatttgtcactacatcaaagagtgtttcaaagattagggggctgtgttctttgcttttctccaagtttgcaagataatgaagattattttgtttttgcagatgtttaaaaacatgatgttaaagacaaatttttcaactaaaaccctcaagaaatgtcacttctgtgtcttgcaaagagagccagcattttctctacgt

SEQ ID NO: 55104 - DNA, 977 bp, Bovine  19866880869417
ggatcaaactcaggtctcctgcattgcaggcagattctttaccatatgagccactagggaagcccataaaataagtgtgtattttatacatacacatatgtgtctgtatatatatatatatttagagagagagagacaaagacagaaaccatttttctctgtacagagagagctactttttgtgtatagcaattttctgaaaaattagcgtaatgtaatataaagagaggaaaatactcaataaaagctttcctttcttgtacttatggttggaaacattgctagttagattttttattaaaaaaaaaaattgtgttttttttttttttagaaataagtagaaacttggccagatccttaggtttgaaggctccgcatggcccctcctccaccccctcactattgttagtcatcctgtgcctgacttcacgttatcaccttcaagagaacagctgggtcactgtgaaagggtgttaatctcccagtgtcttccctaacaccttattgacagcttgagttagggcggcctacttaggctttggtgaatccgacttgacaaaattccctctcaactttatattcatttaaaaaatgtggtctctgcaatttcctgagcaagatctgcaatgatccccattctgaatgacctagtagagctgtgcagtgactttcccatccctgggaggctttctgtactgctgcaaatttctacctgcataaatctgcaaagcctggcagatttaagcagcaagaaacaaacatacatctaatgggttatagacagccctctacattgtgctgaaaaattgagcgcactgccatggaagatttcagtgtcatttactgagttttttagatggaatggaatgagcgcagttagctccagattctccattgttctccttcctggcctttagccttaccctgggattaggcctgccctgggatcagaaccatcagatgcatcagcaaatctg

SEQ ID NO: 55105 - DNA, 2037 bp, Bovine  19866880930538
catgagactttaaagtctttttctgtccctatttgccctccaccacttcccaccatggtgtgaggagtaccccctgcagcacagaaaagggtcagtcatgctgcaggtccagggacacatgccaaattccacttaatcacagagcaagcccatcagaacagttaccaactctgaaatactgtatttgatcacttcctacaatccagcctatttataaatatacaaacttcatagtgtatttaaattaagtctacttaagcaacccaatccagggttcttgcctggagaaccccaaggacgagggagcctggtgggctgccatctctggggtggcacagagtcggacacgactgaagtgacttagcagcagcagaaacaaacatagcaaataacttttccaagaacctacattcagcttaaggtagggtttcagagtattttttttttttcggtgattagatattcctggatcttcctgcagtgcaggagacctgggttcgatcctgggtcaggaagatcccctggagaaggaaatggcaacccactccagtgttcttgcctgggaaatctcatggacagaacagcttggcaggctatagtccatggggtcgcaagagtaggacatgacttagtgactaagccaccatattcctggatctaacattgagtgattaattacctcaagtcatcttcatacaggtattgttggtgcaaatcaatgtgtagaagcaattttgagttcttttaaggagagaaatgtcaatgacctaaaagaattcaggccagaagtatgaataatcactgccatttatttttctgttccatcttgatttgattttcatgagcatcctgtttcaagggaattctgagtgtactagttgtagatcaatgcaaaaaagagaagaatggtaagccacaaggggagggaggtggtatggtagcaatttgagcaggaaaaggtctttctgattatgttcgttgtctttgcttttatttgccatttttctatctttatgaaagatgaaaattttattgtctcagaggaaaaaaaacaggaattatataacacaacatatttaattgcgttcacatacatttagcaatatgatggcaattttagcaattaaaactatttgtccctttctggagtatgagaacttcacatgggtgtgatggtggagcatatgcttactgcccctctctaaagaatgttcaaagtttgccagtgaggaaagaagtaagaattcataaatttcacacaaaacagtggaaattttatcaatggaaaagaatttgactgacctaatgctttttaatagcctatattttccctgaagagctaaaacatttgcatgaatcatctcattggattccacaaggtttctctggaattttagccacatatatgtttctctgtggaatgttcccactgaaaagtgagacagtcaaacaagtagggaagcagatttacaaaagtgggaatgtcatacattaggcttataatttaggtagaaacttcgaacactatttattattaggaccctgctcatattaggatgctaattacatttaggatgctattcattttaggttattttggatgatgaactggcacaaagtgagaaaaagaagattgtagaggattgttgaggaactgtcctgaaagtctctgcgtagctacacactcaactaaggaaacaagtacttaaaggaaattagtacaaggaaagttccaagcattatctcaacatgtatatttaatttccgaaagtcagactgaattgtatttatttcacacagttaattctattctcatttttcacacatgaaaaaatactgttttcacaaaagaataagtgctttcaagcagatcagaataaatgaagaaagtcatgactttcaaatacattgtctgacagatgctgaaggcctatttcaaaggaaggatatagcaggcaagcctgcacacctgtgctctgcccacttcaggagatgtcagtaaaaaacccataaggaataaatagggtcttccaaggg

SEQ ID NO: 55106 - DNA, 1448 bp, Bovine  19866880951352
aaaatagatctaaaattgaattctttgatttttcctgtatctcagggtatgagaaattatgtctttgattctgtataataattaaggcaaagttttctgagtgaccaaaggtatgtttgcagtcaatattttaaaggatgtatattcagtgatgccaaatttccattttgttttctatttatgaatataatcaaatactatttagtggggagaaatatacttttcatattttataagagtgaagtccatggtttataaggaaagtccataggagaattaaacagtcatatcatcaaaggaataatgactcatcccagagaatacagtgttcagatattttagtccacagatacgttgacatttttcttactatacaagaacatcatgacatgtaataaagaatacttaccaacttctttaggcgctgcatctaggggagacacgcacagatgtctttattgggctccagtctgagtagcttccctggaggggaccctggggatgagcattagtgggctgatggctgatatgtacttattactgagctcattagtggtgggtgacctcacaaggagggacatggtattgcgatttctctgattcttagatatgtgttgacttcagggggaaggatgcaggcttccagatgcacactctcagaatgagctgatcatgagaacatttccactaaacatgcccttaaaccagcagtttccatatcatgagaaaagtcatgagtcattcccagccagaataagttgaagtccagagaattggttcattctgatttaattacttcactgggtaaaattgttgtgccaataacacagaatttttccaagttgtgaatttcagtcgtgtgttcattttggaaaaaacaatgaagctatgaaattttttattactacaattttacttgtgaaaagtgcttgtctgcttttagctctggctgtttcaagtataattttaaatatgtgctgtatgaagtggtggaaattgacaagttgatttgctttatcctttgccataagtagtttgatttctgtgaagctgatcataatggtagagattctataaaaatgtaaagtgagtatatgtgtgtgtgtgtgtgtgtgtgtgtatacacacacgtttgcagtagttctgaatcttaccttgagtgtcatcatttcagtttctcaatgaaaagcaaatgttacacaattaaatgtttattgtttaattttaaatttcatatcaaatgagagaggagcactttcattcaagtgttttgttatataagcacttaaaactagattagaacatgaactagagttcactattattttatctcttttgtgttggtaacgagcacaaacagagaaaaaaaaggaacacctaattgttggactttgaatctagactgtttcaccatttcccctacattcattgggaaataaaaagagaaa

SEQ ID NO: 55107 - DNA, 993 bp, Bovine  19866880966833
tttttatgtccctctgtcacctcctagtcagagtcaaacgttcacttgtttttactttaatctgttggtttcatgagctgagagtatttctggatgctgagtggaaggggaggtagggatccgcatgacagagattttggaccagcccagtactttggttttctccatgtcctaagggttcgctctagaaaccctggtgcttcccatgccaaatactgtacttcactcaactgaatgattagcttttctttcaatcagtatactcagttagaaaagtcctaaggttaaattttgtatgtaaaaattagatggacatttgatcagggatatttatacaaacattaggtaaatgtacacttttaatcctctgggcatacctctctcctctgtaatcacgtaagcatcgtaagccgttcttccgttgtaagcctctgttgaaaatcacagtgcaaactgttctcccaataattgcggtactgaaattgtcatgaatcgttactccttcctttggttttttggtgatcttttattttgctttgtttttgtgtgtaagaagctatgtgttgtctgaacagttttatttgtactttaaaaaaaaagatcagctatttcttgacctctgaattacagtttacatgttttgtcaagacattgtccatctccatgataccaaaacacagtgaaagaaacaacaaaattgtacggaggaagagcaagtttaattatctgactgcaggtagaaaggcagctgcttactagggtcttcacttggattgtcttgccaccttttttaaagaaatcataaagtgcacccatcaaagtaaaacagagctgattttctagcacttaacaagaatagctaaaaggtatgatttgccttattgaattgatattggtatatctgaccttaagcagtaggttgaaactgcatacctttttataatcaagaagttatttgatgaatgtagaagattctacattggaatagagaat

SEQ ID NO: 55108 - DNA, 727 bp, Bovine  19866881030086
ttaacatgcaatcctctaaaatctcccaaatattaatatccttacaggaatgggtcttgccttttcaaatgcccttttatctccaacctccaatacataaaaaagcgtgctttaatgatgaagttagtaacaatatttatcatctctgcagcctgttttttttaggattgttataagaccctccagcagcagtcaaccctgtcagcacacaaccgaatcaatatgcttgcacataaatgttaggattactataagcactgagatatcaaactcaaatctccaactggaaaaggatcactacattaaatggaattatctcttattagaaatgaatatataaagattacaggataatcaaacattctccattcctaatatatctgatcagatttcccatgcataatttatctgaagaggtttaatatcttaatgtaggattattttttatatatttggataggagaaattttaatcaatatgattaagaaaaattctagttttcagtataatcttagtagatttttaatacacataaaatataatttagcatctaaaacctttaacaaccttattttgcagcaaacttttgaagtgtttcaatctattatcaactgaaaattattttatttatttatttatttatttgctcaacaacaacaaatttattttggtgcaaacactaaagttctattctcttaataaatttcaatcatacaatgcagcatta

SEQ ID NO: 55109 - DNA, 2015 bp, Bovine  19866881031518
ctgcagttatattcagaaaagtctatttatctagagcctaaaatttatcaaatgcttgatttgatcaagtaattctacttttaggaaatcaatgggaacaagtcaaagtgaaaataaagcaagaggtacaaagaaataaacctcatcatcattcacaaaagtgaaaaaactataaattacataaaatccaatactaaaaaactatggttaagtaaattatggcaaatccataaagtgtaatactgtgaaaaccttaaaatgatgcatatcaagaatttttagtaaggaaaaacatgtatattattattgtatatggagaaaacgagatgcaaattttgatatattgtgtgattttagctaaataacaaagttacatgcatagaaaaagcctaggaggaaatacataattcagttaactctctttatctacaactgtaagggttatgggtggctagtttaccgtgactaaaacaattgttttcctgtgtaatttacttgtctttttccattttgaattataaatagaacaaatgatacaatttatagttcagttaaaggacatttaattcaaggggtttaggttgtcacaattgtcttccacacacagaaatttcctgtgaaaggaaaatataaaaatataccaaagagacccatgtacattgtcagaagtgttccaagtctcaaatcactgagaaatacctacctcacacaagttgccataaacacctgattcctaagcataaatcttggtgttgaaaattgcatcccacacacatttcatatggagttgaaagaacagtatgcggtatccaccttccgtcatatacactagtagtcacttcctaaacctcattaggggtggtaataatgcttcccctacaggaactaattttatgctaatcagtgactcctgtatgtcagtgactctcacagctgcttcacctaagcaagggttttgcaaattagctgctttctcatttggggaagatgtaggatggacagaagcaaaggcatcattggaactcatataatgtttttacacttgttaatgagcctagcagtctaattttatcatttcatcagaagatggtttggggcagaagcagttctgagtttatcaattctgactcagctgattaacactgggcttgtaagataattggaaagatcaaaaaacagtgtctagtctttctcctaaagctaaaattattggcaggaaaatgtccaagagacactcccgcctttgtggaaaggggtttcggaatcaggcagacctgaatttgaatcctgggtgcttgctttctctctgcctggcctggggggaaaggtacatctttgtaaatctaagttcccttctctgttcatctcagttcagtctctcagtcatgtctgactcattgcaaccccatggactgcaccacaccaggctttcctgtccatcactaactcccagagcttgctcaaactcatgtccattgagtcagtgatgccatccaaccatctcatcctcggtcatccccttctcccgccttcagtctttcccagcatcagggtcttttccaatcagtcagttcttcacatcaggtggccaaagtattggagcctcagcttcagcatcagtccttccaaagaatattcaggactgatttcctttaggatgaactggttggatctccttgcagtccaagggactttcaagggtcttctccaataccgcagttaaaaagcatcaattctttggcgctcagctttctttatggtccaactataacggaaataaaaatgcctctctcatagggagggacaagacaagatacatgaaatgtaacccccaccacactgctgggtacagtaaaccttctttcaactctaactggaaaaccttgcctatttgggaggaccaagcttcaaagctctaaactgatgggataatttccaccccctggactgggctggttagatttcttttagcttgaaagtggaatatgatatagtcacagggggttaaatgtggg

SEQ ID NO: 55110 - DNA, 776 bp, Bovine  19866881040192
ttgctgctgctgctgctgctgctgctaggccgcttcagtcgtgtctgactctgcgaccccagagacggcagcccaccaggctccccagtccctaggattctccaggcaagaacactggagtgggttgccatttccttctccaatgcatgaaagtgaaaagtgaaagtgaagtcgctcagtcatgtctggcttttagctaccccatggactgcagcccattatttacctattataaacagcagttgggagatgtggatggtatttctggacgtgccattgggaattctgtgtcttggctaggctaaactctcaagtccctgcctagaataatgtttgctgatttttagtaataagaagagtgaggacagtcacagtggaagtagcaattatcatctgagcactttctatcttatatgtgctgctcttacatactctgtatgtgtgacttcatcatgaaagaacctcaaaacatcttaccttcgggctgttccggcagagtcagtgtcaaccagctcatatccataatgaactggctggcaacgctggagtttctgctgccaaaaccattgtatggaactgtgccaatcactaacggcaactcaagcatcaactttttagcaccaggaatgtgaatgtacacctaatacgccaaaaaccaaaacaacaacaagagagagagaggcaaaaatgtaagttaaaccttatagtgagtaacccaattattttttcataaaaaaagcttcttttgtctgctacattcccaacacgatcacaaa

SEQ ID NO: 55111 - DNA, 740 bp, Bovine  19866881102485
cccatgaactgtagcccaccaggctcctctgtccatggaattttgcaggcaagaatactggagtgggttgccatttcctatgacacagcatttcaggaatatcttttctctacaagtagtgtttcttaaactttattgagtatttgttaaaatgtgtatacctgaaaacatcattgctaacaaagcatttaaaaaggtttaaagtgaaagtcgctcagttgtgtccactctttgtgatcccatggactgtagcctgccaggttcatctgttcactgaattttccaggcatgaatcctcaagtgggtagctattgccttcttcaggggatcttcctgatccagggattgaacctgggtcttctgcactgcagacagattctttaccagctgagctaccagggaagcccaacaaagcatttacatgcctttaaacattctctgattatttcagttaaaatgcctcaagcactttctggaaattgatttgcatttggtagagatatgacctcactaggcataacaaagcttagttttgaaatgtcaagcaaactttctgggacctctggcttgcagtgaggtaaatatttatttaggaatcaaatatgcttgttctagtgaattcactgacaaactcttgatttctgagaaagtcatcattcatggagtcattttccagatcatgcagccgtagtcttaactctttcaacatccaggaaaaaatagtggtcacttcattaatg

SEQ ID NO: 55112 - DNA, 1557 bp, Bovine  19866881105464
acagaaagaggtgtggttatccctccccagcaaactccgtgatccacagagacaatgagtctttttcgtctctcaattgaggcaggatggctcagggtctgtcatggagatgccgggaactgctttctcttagaaagcttctctataagcaaaagtcctttccaaatctgaggttctgcctcgaccaaatggctggctctggtctctatcatcctgaaaccttctttgtctgctgcgcgcttccacagtctattggaaggtatttgtcaacaattacatgtctattaaggagtagtcaatcagttgggcccaaacagccaggcctccagggcccagctattgataggaaactgtcaatattccatgcctccttttctcaacaaaacacacagtcacctcacccaaatcattgtctgtgaaacatcacagacctggctttccttgtgcgtgtctgattctctactttctgaactaatattcagtttgaatgaataaaagctgtttaaaaaatctgaataaaggatactgattaaaatgctatttcagctgggtgggggatagatatttaatataattaagaacattatgggaggactgtgcacgtaggtggctgcaattactactgaaaattggaaaaccggaagaaaattaataagggatagtttatattagtttgatggtaattaatatctataaatactttccattccaccaacaccaagtttagagttatttacttaatgtaggacaaaaggttatgatatcagtcaatacatttattcaatttacaaatctttctggggactttgtaattatcatggaggatttgtctttttctgaaagaagaaagactgggagttccatgtgaatgctttaaactgaagcccccagccccttgccatcccaggcaaaaccaccatgtgggggtgggggaagggagaagaaaagaaagaaagaaaagaagccctaagtaaggctgtatcctttgaacaggcgaccctcctgcatcacagaatacactagtcgtcccagaacaaaagacggcatcaaacccgctccacaaagacctcagacacccaacaatatttaaagcagatgtaatatttagtgtggccgcactatggaagatgcacttttaagatttgttacagccaagtcttgttaaatttacaaaaacaaatattttcttccttccttccaatgtgtttctgtgattctttgattcctcaatcagatggagaaattaccatgaggcagacatgagagctcagggttcaggtaacaggcaaatgaattcagagataatgcatgattaaacttgcccctctaagtcgagccttctctcattctatcccacctattttcaccaaagccaaataattcagacagagcaaagaaaggtcaaaaagaaacacacatgtcaagtgaaagttttggggagggaatggagttaaagagacaaaaaaatttcaaagcgctgaaatgaacagagatgtttcaggtcttaggtagaaaggcatttcttttttttttttttctttttacagtcaaaacaga

SEQ ID NO: 55113 - DNA, 1965 bp, Bovine  19866881114554
atatgtaagaaaaaatatcatcttaccttattcgtttgagtctctgctgtagcagtcaaatacaatttctaactgatacagcaaacaagaccaacataccctgattatacagaggttagaggctcaacagctggatctaaagcaacataacaaacatgagataggagattatagaagccataagtccagggaaccagcgagatacaggaatatttctccagagaagtaaaacctaactaaccatgggctggacttagccacacagagaggggagaggagaatgttccaggagaagaagaagcacgtgtaaggacgcactgttgtgaaatttatcacaacattgaaagaggttgttgaaggcctttaagtaagaatgttcatcttagaaaaatccctccagttgctatgctgagaaactaaaaaggtaagtgtgaaaacaggaggccagttgggaggctagtgcaggagcctgggtgagacacccagggcagccggggggctggcagtaagaggggagaaagtgatacatctgagtgatgctcagcagatagactcagcaggatgtggacaggaaggggaagagtcaagaggggctcagtgtcctggttttgtttaccaagcaagaacttatgagggtgtctcagaagagacccccatccatgtcctctgcctgcctttggtctgtagaaaaactttagcctcctaggccttccccaagttccaaagaatacatttaatcagagaaatgagaaaatgcagaaagaaaagaaaacagccaagcaagacaaaataataatactttaaccattaaagtcaaggactttagttcttcctcaaggactatagataatattctgaaccatgtcttttaagctgttttgcagacactgaaacccccaccaagtagaagcagctaactgcgtgctgcccacaagcacatagaccccagacgggctgcaaccagaaggactatgatgttgactctagatgacctcaccaccaaccagtcagaagaatggccacgtgccaatcacacccctctccctgaacactaaaacactcctcataaccttctcaagagcgggacacagtcttaagggcattagctggctctggccccctttgcctggcaaggctgtttctttctacttcaccccaaactctgtctccaagatttaatctaatgctgatgaacagaggccaggttttgaccacagcttgaacaaatctggggacgtgagaatccgctcatggactatactgtgtctatcaccgctacagaaaaatcttatttcttagcaacaggctgttctcttgccttgttcatggctgtgtcaatgggtcagctccagcccagttacccatgactactgaaaagaagtaagaaaatccttttctcaggcactgaggcagcatgtgatttatgagcattttctaggaaaatgctggggaataaaaagaaatgtttccagggttttgtgtgaaagaaaaaaagtggtgagtagatatttacatagataagtccacagcagatatctgttaggaaaatgatcccaactgttcttagagtccaaattctatggttttcttcaagcagtgatgtcagtctcaattctcagggacgatttaggcaaaggttccgagatgcagtatgtgaaatatgctgaacatcgaaagaaggtcctggaaataaagagaaacccacttcactacaaggaacactgtctctcactgggtacctggcgcaggtctggcggccagtgttataattaatcagacagaaagaagttaagtcaggactaccgacatgcagtgcagttacagcagctgccagaggagggcagtctaacccgattcccataagaggatgctcaagactaaggtgtaaatcaaggcgcaaatccggcctcaaaaagaccaacactcacagtcccactccgtgggctcccttgttggggaaaataa

SEQ ID NO: 55114 - DNA, 1022 bp, Bovine  19866881138746
aatgtgtaaatactaaatgtgtatgtatatacacttgtataatatttaacaacattatcttcttaagtcatgcttttgaggttgacagagtaatgagtgaaaatttggtgatatctcagatgttgtgtgatgtcatcaggtcatgtgataattcacactaccatcctgaataaggacactattagccccacgttaaatttgaggaaagtgaccttccaagcctaagtgattaattcaaagctaatgaggattagagtgaagactcagacccatttttttctgactctaaattcagtggcattcaattacaggactctgccttttctggaagtaaagttatgggtacaaggagtctgcctgctttcttttcattcgctttctccctggaagcattaccgtgtagtgattaggagcacttccacttgctaacgctgtatactccttggatcaggtatttaacctctttaaacttcagtttccatatgtaaaaatgggaatgataacaatatctctatattgaaaatttcctaagaacaatataatgcaggaaaagtgcttagaatgtaatatggtctcaataaatatcatatcccacttctttggaggtttacacgttttgttgttgtttttttaactggagggtaattgctttacaatgttttggtttctgctatgcaacaatgtgaatcagtcataattatatatataccccttccctcttgagcctctctgtcctctcctatcccaccctacattatttttaatatgaaaaatttgttttttgtgtgctgtacagtgtctcctataactcattagctcttgattccaaaaaatgttcatctagccctttttgaaagttaagacctaaagtaggagatttcataattgtgattctggtatgctccatgagtacatttattcatgtaattagacaggaaaaaggactgtcagaagcccattataaatactgtgagataataaaatctttttttctatcctcctgttcctggagcccatatgca

SEQ ID NO: 55115 - DNA, 1259 bp, Bovine  19866881170472
caggatgggacagattcacctctgacagcccttccatgaatgttgactgaattaatgttagcatttcaagtggtatctaaatagcacttcattcagagtaaggaattgtcagactgcatcatacacaatgaataacaattcaagcctaaggcagggtggtcattcattaccaaagtagggtttaatgaatctgtttcagaacataagagtgttaacagaccagttgaaagagaaatgcagaggatttatcatgatggaactggaaatgggctgagaatctaaagattcgggtgggaccaaaacagatgagtagttgttctctggaggaaaaatgcagaggaaaattttggaggctaaggcaaaataaaataaaatgacgcttctatgaaccacggaggaaaatgtgtgcctttagtagtacatgtaatgtaaccatctacatctcagacagatggttgtgagatgcccaaagcagagaaggttgactggcaagaaatccaatccatcaacattcctaactaaattcagtgggagaatcctcataaatggttcagacgtgtcttaacgaggcagtcagcaggactgaagtggacagatctagaatcctcaccctttatgctcctttcccatgctctcttcaatcagaccaacacacttctcatttcacccccttcaaaattgatatgatacatcaggtttgcattgaggaaaaaaagactttataaaaaacataccatcaaaatgactggaagtgaataaagaagttgtacttctgctgcaatgatgataaggtttaaattctgagcttggtatttttaaaaatccaatgcttgcatctacctagagcaaaacatcaacaaccacaaaacctcttaggagagaggagtgagaaagctaattcaaatctctgggccggtgcttctttgggtaatgtgctacctgacacggggcattaatatttcagacgccagagaggaacttgcctgtcacacaacgagtcagcgacctgacgtctactagccgggtgctcagcaaagggcaaccagggaaaggggaaaggaagagacggccctaaggcaagctcaacatttaactggcttcaaacaaaagggaaggatcaatgtagatcaaagcaaaatgaagaagaaattttaaaagataaatgtaaaggaaatgtaaatattgcttttagaaatgcatcagcatgtttctctgaggaaagatatgtatgggtttcaacaaaaatgttgtgacttatt

SEQ ID NO: 55116 - DNA, 714 bp, Bovine  19866881196205
taattctctaaatctaggttaacgtactttttgaagtatattcagtggtacagccaggaaaacctccctttaaaaaaattatgatttatactgaaaattgttgatctaatatgaaacttaaataaaaatatattgtcttttttaggggaaggcatcctcttactacagcctggaaaacatgaatttccttttagttttcaacttccatctgagtaagtgaaactgtgtagctttgggggttttctttccctggaaggtgtctgtacattgtatggttactgagtagcttctaacactcaggtgtaaatatttatcataagtaacctctgatagatcccacccctgttacctctctttttttaaacaaaactgacacttaatttaaggggttttccccatgaatcggagaaggcaatggcaccccactccagtactcttgcctggaaaatcccatggatggaggagcctggcaggctgcagtccatgggtcgctaagagtcggacacgactgagcgacttccctttcactttccactttcatgcactggagaaggaaatggcaacccactccagtgtttttgcctggagaatcccagggacaggggagcctggtgggctgccgtctatgggttgcacagattcggacacgactgaaatgacttagcaacagcagccacatggattagtggtaaagaatctgcctgccaagcagaa

SEQ ID NO: 55117 - DNA, 1058 bp, Bovine  19866881417941
cccccccctacctaaatccaatgtggtaaaggtacagagtcacacacgcaaatgctggctcccaaatgaccctttgggtggagtgcgggaaccagtcagtcttacagaagtcagaggcagggcagaggaaacaagaaatgacctctgctagagacgtcagtcagagcaaggataatgtagggcctgggagatggagaggaggttaaaggaactgagggtatttagccacggggtcaagttgtgtgagggcatcatcggctctgaagtgagtagctggtggttctggtctcagccttcacacagctgggggacctgagaccgtagcttctctgaacctcaatttcctcatcttgagatatcagtaatgatctgtcccaggcagtgctcttgacaggattcaggagacagttcaggtaacccatcacgcgcgtgtcttgcacagctcactttcactaaataaaagcagttatttcatctagaaaagaaaaagcttggggagggagacgtgagaactgccttcacatttttaaaagcctgtcatatgcacgtgagtttcaactttttctgtgtactctggagcatagagattctgtcaagaagttacaaggcagtgagttttacctcaataaaagaagaaaaaaaaaaaaaaaaaaacagattgaaagcaaaaatggactggggagaactgagtaaatttctccaaagatttttcaagcaaatcttagctttctctttccctgggataatgcaaagaattcacaagtcatttgaaggttagcttcgaaggcattgtaaatgccttttacctctgagtgtctgtgcttctatcaaaaaggcagtgaagggcactccagtcccaaagccagagaggacgcctccatatttaggaggtggggcacaaccacatcagccatcatccacatgaaacctgttaagtaaagtctagcagctgcaattccattgcatgatgctgtttttaagtcacaaaaacaatgagttataatttacctgagagttaaagtctaccctctatctaaaaaaaaaaaaaaaaaaaaaca

SEQ ID NO: 55118 - DNA, 964 bp, Bovine  19866881733560
ttccatctctctctctctgcccttctctctttaatttctcctcttatattctcaagcaggggctgaatatcaagattaaggttcaatactagcccaattttattgttgatctctcaacccagagaaatatgggcttataatggaagtcctgacacagactgggctctaataaactacaagatggaccaataaaccacagaaagagcctattaccgagagccattactactcagagaacagggcaaaatttattttgttctgaatgttgttggagatctctaacataggatgggcagttttaaacttggctttgtgttggagagaagttatcccatgcttatctcagaggaaagccctgggctctcagggaatggaggcgcttcttatattatctcatgggtgtcacatcaaagtgggagtagactcttctttgaaagaaacttaaattgggacagtacagaaaaggtcaaaggtcatacctatgattgattttaaagagagccacttaacatggttttataacataagtgatgtcctggtgttctgtggtcttttcttcatcctggaaagtgacttggatgggtgatgttacacggggtgcaatggtcaccactcagctgtttaattttagcctcttctcatttcaagtttcatgttaccatcttgctcataatattctaatcacttagtaatgacaacatgttgatagcgatcacttcatgttcttcacagaaaggtgatgaatagtagttgaatctgccacttcccagggctgtgttctgacccttgaacatattcttattccatatactgggtgttggctgagtacagagtcgctgttattcacaatgcaatgttcatcacttctggtgctgaactcagagctcaccttttaaagatgggctttcagaaaggtggatgcaagcattctcggttcaaggacatgataccaggctgactactt

SEQ ID NO: 55119 - DNA, 684 bp, Bovine  19866881890689
aaacagcactaaaagtaaatgttttcacgtttctttttagtttttaggtttttttttttcttcaatctacaggattaccaagagcaaaatgtaaaagaaaaacatggtagaaattggctgttttgtgaaatataggaaaaaatataccatctgtgatttagcacagttttcaatattccatctgtggtctaactgccgttcttcacaaaggctgcatccattgtagttcagtatgattttttaaaaagtttttctaagaagactacttttgtaaaacattgttattcttgacatggagtttcttttgaatgaaatagtaaatatggcctttggactgcagcccaacaggctcctctgtccatgggatttttcagacatgaatactggagtgggttgtgattttctccttcaggggatcttcccagcctggggatcaagcccgcatctcctgtgtctccggaatagctgctgctgctaagtcgcttcagttgtgtccgactggcatagcaggtacattcttttaccttctgagtctggagcatcccatattggagaagcccaatatggccttaacaattgttttaagtatttgttgttgttgtacacaagggcttaaaattctgaaaatcactccacccttctcctgtcaccccatctccagcgaacttcattatataaaatgta

SEQ ID NO: 55120 - DNA, 1173 bp, Bovine  19866882161984
cagaggaaacccctactcaatactctatagtaatctaaatgggaaaataatctgaaaaagaatgaatatatgcatatgtataactgaatcactttgatatgcaccagaaactaacagaaaattgtagatcaattacactccaataaatttttttaaatgttcacatttgctgactgattttcttttttggtcatgctgcccaacctgtgggatcctagctcctgaccagggattgaacctgggattttggcagggagtgaaagtacagagtcttaaccactggactgccagggaatttcctactccaataaaattaaaaagaaaaaaaaaagaaatctgatcaatgagatgaaatgacagaaaatatgaagggtgagaaaacttgctagctgaatctttataaacttcaagaattcttagagaagatttttttaaaacactgtacaaatgtgaacctttaaaactactctcattagggaacacagagatcatgattccaaaatgtgatttgattcaatttcaaaggattcagttaaaggtagaattaattcataagtttaaactacatggtgcttcacttgacaataaaagattaggactaaaggtaatcatccgaatttctgccatattttaatgcagttttgccacttgccctaactctttttgctattgctagtactggctatactgaccttgacaccagagtgaccactgtctataggctgaatccatgagcctatccaagttaataggaaattcattttaatgtatccgttatacttgactgacaaaggatgctctctatgtatgttaagttctgaaaagaaaaatccgtctcaaacaataaaatggagtgccttacgatggaaaatgtaaggcaaataattataagaattacagtaataataataatgttattatgaccccatataaaattgaaaaaaggcaaaaagccaatctacaaaattgctctcgttctaagaatatctagcttctggtcatttcaaaaggcaccagatcctgttgcaaccacgtcaagctcaggtcaacccatccccacctcatccaatgcattaggaattctgcaaatgagtgttcttggttcacagggggtttgatcacagaaagctagttgttgatcttcggatgcctgcaggcctgcaatctgtgcta

SEQ ID NO: 55121 - DNA, 3375 bp, Bovine  19866880208667
ttcccatctctttcagaattttccacagtttattgtgatctacacagtcaaaggctttggcataatcaataaagcagaaataaatgttttcctggatccttcttgctatgtcaagtctatttctgttttgtaaataagtttatttgtatcattttcaaaaaggtaccacagcaaagtgatattatattttgtttgtctttgtctgacttacttcacttagtacaataatctcatagccaagacacggacgcctgatatctgtcaacaaatgaatgcatatcaccacttctttgatggctcagtggtaaagaatctgcctgcaattcaggagacccaggttagatccctgggttaggaagagaccctggagaagagagtggcaaccttctccagtattcttgcttggagagttccatggacagggaagcctggcagactacagtccacggggtcataaagaatgggacacgactgagtgactttcactttgatactattatttactatatgtagcattctatcagtgtttttagaaacaatcttgtaaaagtaagtcaggatgaaattaagtcaaggactttcctggtggtgcagtggatgagaatctggctgccaatgcagagaacacaggtttcatgccttagaagatcccacacgccacagaacaactaagtccaagtgcctagagctagtgctctgcaacaagagaagccaccgcaatgagtagcctgtgcactgcaaccagagggcagtcttcactttctggaaatagagaaaagcccatatatagcaaagaagactgagtgcagccaaaaataaaataaataattaaatactattttgtttaaaagaagtgaagtcaatattgcactatgacccttttaaaatggcatctcatgcccaaattctctaatgaaaagctggcatcctgagtcaagtaaaaaagccccccatcaaatgattaaaatagtttacaactactggcaatatgaaaagtgtcaattaacttttctgtacataatagtagcagaatcataaatttaggaatcaagtattcttatttgaaatccttgttttactgtgggaaaaaggacaacttgttgaggttttatgatgattaaattaggtagtacatatgagaagctgacaaataatggatacttttttaatgatgtttcagtaacttcacaccagaaaaaaattgtctatttcaggtcaccttgtttacttctttataccatcccctgtgatgacaacttccccacctgatgaaattggtgttaatgatggaaaagtgtgattagatctttctaaccatcattaaaattttgctaatgaagtctgaacttgttccatcaaaaatagattttattttatttagacatttaatttttaatttaatttttgaatatagttaatatacagtattgtgttagtttctcttgtacagcaaatgaatcagtaatacacatacatatattgactctttttaatattttttcccatatagatcattacagaatattgagtagggttctctgtgtgatacagtaagttcttattagttatctattttatatatagtagtgtgcatatgttaatcccaatatctcatttttatccttccatcattcccccttggtaaacctaagtttctttctatatctgtgattctatttctgttttataaataggtatattttaaataaccattttatttttcaagtggattaaaaaatgataaacaaaatgaaagctttatccataaaattatcctgaaaaatgacaagaatgatgctaaaattagtaaaggcatctttgtatgttaatatttttatgttctacaggattaatttgtacttaacttttattcagtgagtcattatacatgtaattatgtattaaaattaatttgcattattgcactctattatgtagttttgttttcatgatcaaggataaagtatgaaaatacagtctggttataaaagaaaactattatggcagtatgatatacaatgctgcctttgtatattaaaaccagaatgtttttctcaaaagatacattaactctgcaagtaatacttcactctgttgaaaagtaaaagcgaagagatttttgatgtaaattttcttaaagaagaggaaattacatttattatgcttctatatttagatcagtgttttgttttgatgtaatattatcctatccacttcttttttcctcaaatcaggctgcagataattttagttttactggtagtttgtctatttctcttatagctatgactttttaaattacatatttctaatagggaggtggggcaaggaggttccaatctaaccaataactacaattatagatttgatacatggtcttctaaatataggatataagcttagttaggtttttctctaataaaaatgacattttgtgcatttctgtaaaacactttaaaagctgaaagtcacacaagatgtattttattttttaaattgaagtatagttaatttaaactattatattaatttcaaatatacaacatagtaatccttttattttttatttttatagattctactccatctaaagttattataaaatattgactatactccctgtgtacaaaatctattttaaaatagctatcaaaagacaaggacccctgagagatggaaaacaaactgcataaatcctactgtgatgattcattttaatgtgtcaacttgtctgagccaagattcccagatatttggttaaacattattctggaagttttcatgaggatactttttgaataaaattgagatttaatctgctggacattgagtaaaagcagattattatccataatgtaggtgggccccatgcaataagttaagcaccttaacagaacacagactttcttgagcaagaaggaattctgttagcaggttgtctttagatagaaattacaagtgtgttctaggtctccagccctccagcttactctaaatattttggatttaccaaagcctccacagtgcataagccagtttcttaaaataaattcttgtctctggagaaccctagtgaatacagctatatcattatagatactgtcatgaaaacagtttataggcacatagcagaaggataacaatcagaatatggtggtcttcattaattgaaaagactgaggaaagtgtccaggaaagccaggttagttaaagttctcagggcaagatagagaagtaatagtagggacctgatttcctcttagaccaaaaatgatcaacaggtgaatgcaggaactggaacaatagatttcaaaacactgggcttcagaaaagaaaaggtagtaatcactaagataaggaaaagcgtaagtcttc

SEQ ID NO: 55122 - DNA, 1313 bp, Bovine  19866880957820
aattaaaaagtgatgtttagtatgtctgtatgagagagatttgagctagaccagaagtcttatctgcatggatagtaatagggtggtgtctcctagagtcatcatcaccactgacttcagaaatataaatttgatgaagctgaatattgttgctttatcattatttgacaagaaaatgtgagccatgattttgttaccaacataaatgaggctgccccaattaaaatgcatggtcatttcctgtttgtggcaaaattaatgtgacctattactgaaatgtgttacttgaaaagcaccaacatatgtattctgtgattatttgccttctgcatcttggtatccaagcaccagtcactttgcattttattcttttagtgctctttctgatccaagacttagatttatggtaaagtattcatcaatcaaattggcattgcttttagtcacatttagggtgaaagaatgtttgaatttaatcaacaaatgcacatgtttcactcctggatatgtaactgtaggcctcattgcagttttaatagcttagtttggaggctttttagaaaactatcattatttatacaaatgcatttgaatgttgttgtctattaggaattgaatgaaaagaaggctatgcaaatttcttccagaagcttagtatgccaacactgatacagcttcaacttagaactgtcttcaaatggactacttgactgccactgccagttggatttacttaactattatttccctttagccaaaggcacaggatgtaggaaatctatatctattgctttggcagaagcttagctatttatcatttgtgtgaggatcaagcaggccaggtgtactgtttactttaatgaagccagtatagaaaagggagttcagaataatgatataaagcattgttcatttacttgaccctttgcttgcatttgcaagaatgcttgtagtttcctagaccacaaaatagcctgaattttaattcattttcacaaatactcagaaaaaaagccacttctgtttagacaccatttacactatgctgtgctttttgtttacttgaaaaaaatgaagatttctttaagaaaaaagaaaaagctgacccacataacgcctaaaactgaaagacagaaaattgagggaaaaaaatgatgatttgaagttagggtggagtctaaattgtatatttatggaatcacaagtgatttggaaggtaatttcaaagtcccctaccttcttttcaagtagatagtgtttggcctgattccaattcttctaggtatttctaagttctagtgttggggagtgag

SEQ ID NO: 55123 - DNA, 1224 bp, Bovine  19866881299057
ttttttttctggttaaaattaatggcattgatttatttaccatcagggaaatgatctgtattgaaataaatctatagtaatggaactatatgaggtacatttttaattattcaaaaagaataatttataaataatctccagatgcttttgctgagtataattcctcccttgggaatttgctcattcctgcctttgcctggctgtacagagtttttctattatatgctgttctctatttctttggctcctactcagattctccctctttgcctaccactttcaatttatgacttattcaggtttatcctttttaatttggctgctccccaagtaattgccttctggggcacatacttctcaacctgctcaacagttcttaaaaaattatgctttactttctcatctagctctgactagatagaaaactcaatttttctacttcctcaaaacatgagtcactctggttccttggggaataatgtatttaaattatgcatttatttaatatggttaattggaatgagaggcagttctggttagcagactcttttattattggactcacattgaaccatctgggtgtgaatcctccctttccattaactaattaactgtgtaacatcagatttaaagttttttatctgacaaaaactatgataaaaatagtacttaaccaataagattgtgttgattaaatgagaaaaaaatattaaagcttagtacagtgccctatgtctttagacatatactcataaatgtgcataaagacacatatgtgtagacataagtatagatacaatgtgagttattttagaaaaatatatctggggatatttagagaggaaaagtattagaaagatatttacatgattttttttcagtttctttacatcacatgataataatttaacctgcctggaacatgttcttgctcctttccacccaaatcttcattccagttcaataaaccattttagtaattgtaattcccactaatatctacctattccaaaataacataatagtactaattatattatttggtctcttatgaatgggtatagaaagaaagaaaatgaagttgctcagttgtgtccgactctttgcaacccccatggactgtagcctaccagactcctccctcagggtcttttccaatgtgttagttctttgcgtcaggtggccaaagtattagaatttcagcttcagcatcagtccttccaa

SEQ ID NO: 55124 - DNA, 1400 bp, Bovine  19866880244433
tttcactttcatcaagaggctttttagtgcctcttcactttctgccataagggtggtgtcatctgcatatctgaggttatcgatatttctcccggcaatcttgatcccagcttgtgcctcttccagtccagcatttctcatgatgtactctgcatagaagttaaataaacagggtgacaatatacagccttgacgtactctttttcctatttagaaccagtctgttgttccatgtccagttctgactgttgcttcctgacctgcatataggtttctcaagaagcaggtcaggtggtctggtattcccatctctttcagaattttccacagtttattgtgattcacagagtcaaaggctttagcctagtcaataaacagaaataaatgtttttctggaactcttttgctttttcgatgatccagcggatgttggcaatttgatctctggttcctctgccttttctaaaaccagcttgaacatctggaagttcacggttcacatatgtttagaaaaaatgtttagagtagagcaaattaaaggttttagaaatcaccaacaatgaactccccccccaccttgatttttcatttcattgtaggcatcatgttatagatgttaccaactgggagtagtcacgtggatgaaggtgggctttttatttttcacctttaaaaatgtagtaatgattgaaatcttgcctgatgctatgaatttttcatactagccaggtagctattcagcccagcgatctaaatctgtacacctcagctgcagtccaagcagaatgaaatggaaatatgtgacggtatttcactaaactctatcatgcatgggcatgccacttcctttattttttacgcatattattcattcacgcagtaaagcaaatcggtttacacacacagacttaaatttgcttttcatttataagtggtaaaatcctttcttaatttattgttctgcatttttatatactaactactgtattttatactttgaattcctcattcaatatggttgagagtatcatgcaattatacaatctgtatactttcaattttaaaaagcaacacaatgacccaactttattacatgtatctgtatatttatatgggcttctctgatagctcagttggtaacgaatacatatacatattcatatatatatatacacatatgtatatgtgtatatatatatatatatatatacacacacacgcatgctaagtcgcttcagtcatgtcctactctttgagaccccatggactatagcccacaaggcttctctgtccatggaattctccaggcaagagtactggagtgcgctgtatatatgtccttctccatatatacatacacatatacaggtacacacacacatacacacacacacaccaca

SEQ ID NO: 55125 - DNA, 1525 bp, Bovine  19866880423715
atttttcagtttatccctatgtgaaactggcacaggtcaagctgaactacttcttttctaaaggagaaaaaataaattctcattataaatttaagtgaaatggtttacatctatatacacatattggctaataaattaagtaaatactattataacactcatcctggataggaaggagagtatataacacacacacacacacacacacacacacacatacacacacaatggatcaactttctgatatacgtatgagaattgattctgttttccttgtcatttactaaatcttttaaaaactgttttctcacattcatttgggatgttttcagaagaccagtctgtgaataaagtaaaaatcacagctgaaaatgaattagcaccatctctaaaggagcagacctcaccacctaggtgccaaatgaagggcacgatgaccctcataaacaccttgtgtgagttaatgagagtgaaggctcatttccataatgactccatatttgcatctgctgcataccactcacagagccctgtaatagaggttttcctggtacaggctggccaaagtcagctgtgaatcaggctgtgattctgcagtaagaaaatgaccatgcagtctttctgtctggcccagagcccaagtgaaaactgttgcattggctccacaactacaaagcctctgaaacacaccatctgctgggtgtctttgttgctacttactcttccttgtgagagttggactataaagaaagctgagcgccaaagaattgatgcttttgaattgtggtgttggagaagactcttgagagtcccttggactgcaaggggatccaaccagtccatcctaaaggaaatcagtcctgaatgttcattggaagaactgatgcttaagctgaaactctaatacttaggccacctgatgcgaagagctgactcatttgaaaagaccctgatgctgggaaagattgaaggcaggaggagaaggggacgacagaggatgagatggctggatggcattgctgactcaatggacgtgagtctcagtgaactcggggagttggtgatagacagggaggcctggcgtgcggcagtccatggggtcgcaaagagtcggacaagactgagtgattgaactgaactgaactcttccttgtagctacataaacattcatttaccatcaagtatctacttccagggtcttctctgctggctcagtggtaaagaatctgcctccaatgcaggagacccaggtttaagccctgggtcaggaagatcttctggatgagggcatggcaacccactctagtactcttgcctagagaatcccatgaacagaggatctggaaggctgcggtccttacggtcacacagagtcggacacaactgaagcgactaagcggcggcagcagcagcagcagcatttacttccagaaagcacgtctatgacaaagtgaaaagacagattctctcactgttttgctacttctgtcaccaatatcttcttacttgtaaaaggagtaagag

SEQ ID NO: 55126 - DNA, 1188 bp, Bovine  19866880455119
acagctaaagactccttctaatgtttaagtagatcatatgcaataagatttgtctaaatgatctagtttagtaaatgccatccaaacacatcagcctaactggccctcattaagaatacaatctgccttcttatctttgttaagaagaagaaatgtttgcgataaaatatttttctaagtcgcttagttcaaaatcttataaataggcatgtggaaaattagaaactcaaatactggtgattctttttacactaacttttaagcatccaatgtatactcagcgtttagcaaaatcaagatgtaattgtttaccttggtccagttaaactaacctttatctgaatgtatgctggcaacaatacgtgcattaattacaaatgccaagcatcacaacacagcaggatctttcattcagaaagtataggtcttcaaccagttaaagaattaaacatcagaaaaatgttatgtgtttcaaggacttaggaaatatagtagaaactcaagtgcttttaaaatcttattttacctgcaggataaccttggacaagacacctaatactagttaatttcccaagctgcatttttggaacataattgtaaaattgaatagtttgtttaactatatgttgtacagaagaagcaaatgtcaagtctcacctaactattagaaatgaaagctgagaatatccaaaataaaacaaccatatgattttcatcaataacagaaatatcactattttttcaaaagaatccaaatttgtgaaaattatgcctaataataagagacagagaaaatgagggaaattgaagccatgttgactattcagcacacataacatagaaataaatgggtcccatttcatttaacttcatttaacaagtatattactatattgtgtacttaagaattcccttgtttaagtactgcaaaatgtatataatataaaatctctttcttcaaagaggatcagagcatccagcaggaactacatgtatccagctatagcctggcaatcaggaaatagttatggaatttttttccttctctttcagaaatatcactattttgtaaacaaaaagacataatgaaacgaatcgccagtccaagtttgatgcatgatactggttgcttggggctggtgcactgggatgacccagaggaatggtacggggagggagaagggaggg

SEQ ID NO: 55127 - DNA, 1648 bp, Bovine  19866880486345
aatcactgtgttgtacatggaaactacagaatgttgtaaatcaactacacttcaacaaaaataaatttcataaataaaggatggcttggttgttagtgagacgtctcctcagaacaaattaaatagaaatcattttaacttctcccccaaataataagaatcctggagattttaagtgcctaagtctgctgcagggcccagggggcgagggccagtatttctgatcctttccatcagagcttcaggatgactggctcagctctgaaaccaaggcaagatagatgaaggtgtttaaaaatagtcattgcttgacttggttgctccatgttatctgtattgttccttttcagttcgaaagctaactgtataaaacatttatgcaaagtgaatgtgtagtttttaatagaagttttattagatagctgcttgcacatggatgcattgtttctttaatataattatgtaaaacaagctctcatttataggttagatagctaagttattgctttcatttagtgtctaagttttgatttttccaatcctgcagacaatgtgtcgtaaacattcctttctagggataagagtgtaattagtgtgagaacaatttgtcttaatgagaaactgacatcagttcagatgaaaaatttgagagacatctcagaaaaatttatgtctcttttggttaaaaacatcagtcctgacacacactcaatcttggctcactcaccattcttcccattaattaatttactgcatttatgaagagctttctccgcagctaacttgatttcatttccttcagttttgtggttgtcatagttcatattcgtccacctgaaggtatcaagcctggtcaggtttgatttggttagaacatcatttcctgttttttctattacacaaatattgataactggaatttaatgaagggttaatgtacttccatgcagctctgaactcatcgtcaaagacccttacattctaactgattaattgttccccaaagcaaagtggatttggatcatagacttatagcttttagacttctggttcgcattttcttcttttcttttctattaaatctgcttataatagcaaacgtcacaggctgcacatacatgttaacaaaaatcttgcaaggcagaatgcagggcatgctaaaaggggattgatttcctctgtagttaaaagcaattatgctttatattctttaaagagaaggaacgctatttgatttagtgacctacctagatgaaccggaggacccattccaggcatttcacgactgacttgaagagggcaaggattctagaagtttccagttaacagagtgaggctaaggagttttgagtcagtgagaaaaggcaaagcccaagtggaaatgatcaggcagggacatactagactttatcaatcagaaacaaaagtctgggctttaacagcagatgccagcgcaccactcttgaaggccagacagcccagagcatcagatgttaggggttaagttcacataggccaccctgcagtggagcccacatgggatcctgcccatcatcgtggatttctggcttccatggaaggggatgcttgtgaacatctcagagtttatataagcgtggtttcgtccttcagtgaatgatggctgtgt

SEQ ID NO: 55128 - DNA, 1750 bp, Bovine  19866880775357
gtgctatctttataattatatattattatctttgttattgccatagtctaatgaaaaataagcttgcatgtgatatttcacctctcagtgaaagaagtgtgaaagacatattttcaggtgaccatgtgggttgggagatatgatatgaaaaattgttctttcccaagatagtcaagccacacgatcttctgacagtgttgtctttcacattctttctgttgagaggttagctttatatcctatgcagttgagacagaaaagactgctgagccttttgactagtcaaatgagacccaagtgctgtttgatgacacccaagactatgtcatagaggagatgcaacctccacattgctcactgacaccctgcctctggaatcctgacctgtaacatgaatagttccattgtcatgaggtccccatgctgtcaggaagaccagaaaaagatgtcataggaaagctatgagactatatgaggagagagatggatgaccagcctccagctgcctccttttcacctacaatctgcctgcaatttcgtgggagactctgagtctcacctgcctaaccaatttctttatggattcctaacagataaaatggagaaggaaatgtcaacccactccagtgttcctgcctggagaatcccatggacggagaagcctggtaggctgcagtccatggggtcgcacagagtcggacacgactgaagcgacttagcagcagcaacagcagcaacagataaaaatcatgagaaataacactattattactgttttatgacaccaagttttgcagagatttgttttgcagtgttagtacctgatataattatgtttccatcttttctcaaatttattgcttaaaaggttttctcaataaatggaaagaatacatttgttgttacattacacttattgtcttcagaatgagatatttaatttttcaagttgacattatttttcacctcatagaaacttaatttctttgatctgtgagggttatggaactcactttccccctttcttccttatttctatctcttttgggagaaatgaatctgaatttcataaatgagagtgacagcaagagaaggatgcactttctggatcagttactagagtcaacaataccttcactcaacaaaagattatttaaagttatgtttacaccatgcaggatgtattttaaaagtatttcaatacttctatcacttggagatgatcagtaaaccccattattttgatctaattttgatttgacctcacgctatatggttgtgtcttcacatattttgcagtgtgatttctctgcattatagtatagccagtggatgtttcacttatgctaatagaactcttgtttgcaaacttaccttatctggccaaacttcttaaagcacctagtctctacggttccttattgagccaaattatgatgatgatgggtgatgttgatgagtgtgataattacgtgaattcttctccttttcttatttttcttgttctatttgaaaattttcaattccttgctttccagttctgcttaggagttacctgtaattaaaatatctttattctctttgtatattataaaatccatagtctaaattagccttaggaaatgtgtatcattaggaatgaaagaagctttttctagttactcaggtgtcccctgcttctgtatcaaaaatgggtgcagggatgaatttatgaaaaggggttttggcattcccagggcataatccctta

SEQ ID NO: 55129 - DNA, 1566 bp, Bovine  19866880893294
ttctacgatggttttgaactgaacccagagtcagacaatcagagatgtgaatgccgttcaaatgtttatggttattggtttttgctagtgttattggccctagatcactcagaagtaaacttaacaaattggcagtgcagctccctgggccagcctcctagagagccgtgccaggggcttcctgagcctctaggatggaggatgaagcctggggggaatggactgcatagttttccatctgaacacccctcctacactcctcattcaataattcatagactggggttgacaagcaaagttgtctgaagaatgcagtcagatagtcacagaggatctgtcaaggtaatgcctcccttagggtttctggaaaaagaatctttccaacctgacatttaaaaacactacaggtttcagcctgtctaccaccctcaccccttgctgttgcagaagccaggatccaaatgctatgccatatgctaacatcccacagataccaaagagaattgagatgcatctgacatggctggagacccttctcttcaaattgtcctggatgtcacaggcaggagaaaaaaaaagagctcgttttctgttaaatcaagtatcctcatcaacccagcttgacttacaccacatcagcatgtcaggagtgatggaactttctgcagtagtcagaagatatttaactacccaaagaaaactcactgcctgggtgttgtcctaccatttaaaatctttccattttattttatctttaaattaaaaaaaaatcttttgtctgcaccatggggcatgtggtatctcagtcccctgaccagggatcaaacccatgccccctgcattggcagcgtggagtattaaccactggaccatcagggaagttctagtttttccattttaaacatttcttgaatctggctatatttggatgctaccttatagttggaatatatattttaaaaatataccttttcccaagtaagagtattagttatccctggaaaagtaaataaatacataattcatataaaatgtgaagctataaatgaaatgtgtttcttggttttcattcacccttagtgtagctcaccattaggatagagtattttctttctctgtgctcactttatctcaaaaggaaaattctgaaattcagtatcataaagataggtatctcagagtctccaacatggtcctctccctttgcttgatttgtagagttatagcaccatccttgctgagatttcccaaacccattttcccatcttgactagcagtctttattccccagtagtagatcttgtaaattttgtaactttccctgaatgttataacatacacttcttttttatgtgactttgttcaagtttccgtgaaatcatgattggattactcagctgtgatttttaaaatttttattgagatatagttgatttacaatgctgtgttagtatcaggtatacagcaatgtgatttagtttatatgtgtgtgtgtgtgtgtgtgtgtgtgtgtgtgtgtgtgtagtcttttttacagtctcttcctttagaagttattacaagata

SEQ ID NO: 55130 - DNA, 960 bp, Bovine  19866881472935
atttttggtaataggacttggcataaaatttttgtgttatcagatctgtgcaattgtatgaatggtttggagatgttatagaaaatgtttttttgaattgtcaaatagggagaaatgaaaaactatttttcttgattattttattgaagcatagttgatttatgaaagtgaaacttcttgaaatcttttcagtattctttaacctctacaagtgtcaatcaactgatatttctgagaacagaacaataaatcaacttgatccaagaaacacaaaattaaattcagttagtatactttgatctttctgcaatgatttatcattcctttctattttcaatataggaatatgtatgaagcatggaaaagaaattagacgtttaaaaatctcatattcaaatctatatagatctataatatatattacaatgttcacatctagtaatttattatagatatatttattttttattgattaactactatactattccactaacatactctcagcaaaactttcatgaaatagacattttaaatatccttctgactcactcatttgtgcttaaaaaacccccaaatcgtaaacacattaatttagttcatttcatcatcattgtgtcatcttttcttgagtaaaacctggtttatatattcttctgttttggtcttgtcgaatgtctgcctgagttggtgctgggatttcctgattaggctcatgaccagtgtcaccaactcaaaaatcctggtggatgttggaactttcctcacagtctagtggttgggagtccatcttccagtgcaggggacataggtttgatccctggtccaggaactagggctctaggatcccatacaccacagggtagctggcccaagttctacaactagagatcccaagtgctgaactcgagaagccctcattctgcagctactgagcctgtttgctctagagctagtgct

SEQ ID NO: 55131 - DNA, 2015 bp, Bovine  19866880157512
atgccatcatctttgttttctgaatgttgagctttaagccaattttttcactctcctctttcactttcatcaagaggctttttagttcctcttcactttctgccataagggggtgtgagcatatttctttgtatgaatgtgtgaatgtgacgtgtgagtgatttgagtgtgcataagtaggagcacatgtttcagtgaatatgcaaatatgtccgtgtgtgagcacgttcaggctttgcaggtggtgctagtagtgaagaacctgcctgccaatgcaggagaggtaagagatgcgggtttgaaccctggatagtgaagatgccctggaggagggcacagcaatccactccagtattcttgcctgggagaatcccatggacagaggagcctggcaggctacattcagtagcgtcatacagagtcagacacaactgaagtgacttagccacacatgcatgtgagcatgttcatgtgtgagtgaacctgagtgtaagagtctctttgtgtgggaatgtaccagcgtgttcatgtgtaaaaaaacgtgagcatgtccacatgtgtcaacatgttgatgcaaaaatgtaagactatgagtaagtatgttcaagagtgaatgtgtcagcatgtatctgagtaagtgaatgtatgacaattcttatgtgtgttatagatttaatgggaaagtgtgactgaatgtgtgagcatgggtttgagtgtgtttcttccccctgggtttttttcaggactgcatgtccacatggtgaaatgtaaggcactgtgcacaaataagcttttcttctctattggctcaaaactgtctataaccagctgtacagctaggacacattattctctgtaaataacatcccacccctcctatagaaacatgtgtgactctcatgattcaccctgctggcttcactgcaggctaactgccctgaagctgacctgcaaagagagaaataagttatcccaagtcgaacgctttagaaagcaaagtgctattgggaataattgtttgaataacagctgagaagtaaatggggctctgtgttaggtcaaatcccagacactagcatttagggttaccatgatcaagccccagcaaagtgcttacaggagttgctataaacacagccctttattccaaccattcagaccccaccccccacaaacatgccattagagaatggaagctatgtatgtcagttaagaaaatctagcaggcccagggagccagggaccccaccgaccccaaggtcatacttctcattctagaccatttagtgccactcagacagccatccctttgggtgggatccagaagaccctaaaggcccagcacagggcctggtcgagagactcccagcgataagagcaaatgggagctgaaatacagtccacattctcctcatcaagctgcgtgccctggctctgagatgcagcccaaaagacgggagacatgttgtactttatcttcccagagaggacgccttatgtgctagaagggatctgcatgagaacgtagtggaagtatccatacatctcaaaaaggcaaattaaaagtgttacggactgcgtgttggtgtactccaaatacaaatatgtacagcctggggggagtgccactggtaaggtgcagctggtttgctgcatttcagctcttttcaacctaacacaaaactctttttttttttttaattttattttattttttaactttacaatattgtattggttttgccatatatcgaaatgaatctgccacaggtatggtatggggagggaggagggaggagggttcaggatggggaacccatgtatacctaacacaaaattcgtaagtgtcatgacttccctggtggtgcgctggctaagactgcactcccaacgcagggggcccaggtttgatccctggtcagggaactaaatcccacatgccacaattaaatagtatgccacaactaaaggttccacatgctgcaaataaagatcccacgtgccacaactaacga

SEQ ID NO: 55132 - DNA, 1143 bp, Bovine  19866880245166
tctgtctacaatgtgggagacccaggtttgatccctgggttgggaagatctcctggagaaggaaatggcaatccactccaggactattgcctggaaaatcccatggacagaggagcctggtaggctacagtccatggggtcaaaaaatgtcagacacgactgagcgacttcactaagactcactaatgtaattactaatgtaaagtaattccaattgaaataaataaaattttttaaaaagatataggcaggttgagatttgtgtgatatggaggcagagactggagggatgcagccacaagccaagggatgccagcagccaagagaatctgaaagaagcaagagattgggtctcccctagagcctctggataggttatgaccctgccaacactttgatttcagctcactgaaactgatttcaaaaactatgttgttttgagccacaagtgtatggtgatttgttatagcagccacagaaagctgatacaggaagtgttcataggagatgggtttttgtttcttctgctaagtgcagacttacaatggtttgactcatgattttttgacactacaatggtgcaaaggcaatatgcattcagtagaaaccatacttcgaatttttatcttttcctgaactagcaattctagactcttttgctgctgggcagtacagcaagccacagctcctactcagccatgcagtcatgaaggtaaacaaccaatacacttagaatcattctgtacccatacaatcattctgtttttcactttcagtactatatttaataagttacatgagacattcaacattttattataaaataggtcttgtgttatttgattttacctaactatgccaaagcctttgattgtgtggatcacaataaactgtggaaaattttgaaagagatgggaataccacaccacctgatctccctcttgagaaatttgtatgcaggtcaggaagcaacagttagaactggacatggaacaacagactggttccaaataggaaaaggagttcgtcaaggctgtatattgtcaccctgtttatttaacttatatgcagagtacatcatgagaaacgctggactggaagaaacacaagcggaatcaagattgccgggagaaatatcaataa

SEQ ID NO: 55133 - DNA, 1137 bp, Bovine  19866880282641
tcagtcgtgtctgactctgtgcgaccccatagatggcagcccaccaggctcccccgtccctgggattctccaggaaagaacactggagtgggttgccatttccttctccaatgcatgcaagtgaaaagtgaaagtgaagtcgctcagtcgtgtcggactctttgtgaccccatggactgcagcctaccaggctcccctgtccatgggactttccaggcaagagtcctggagtgggttgccattgccttctccgataccatgcatatatgaagtttaaaaacattcaaaaattcttacactgattataggtacatatatatgtagtaaaaggtatacatcagagtgatgcatacatatggagcatgcagaacggtgtctatgagaacaataaacttatttaggacagcagttaaatcttacagaagaggaagaattcaactggggagaggtatactgggttccagttttatttataatcttatgttttttaagatggacaatggttgcatgggtgtagtattctctgtacctttgtctaggtctgaaatatgtcctaatttaaagaaaaataaaagaggaaatgggcctaatatctggaacttactgaaggaaaaaagtaaagtacttaagctgagtagaggatcagaaaaggggaggaccaggggtttgagggtaaaaggccttatttctacatttagttaacgccacttgaatgctcactagttagcaatgccttgttctattttttgtgctcgttcatcccatatcctcgagtatattagcattatttatttttgtgtgtatctccccacctcctaaagtgtgagcttctgaatagttgggaatataaaggctttatttatttgtctctcctaaagccctgtgttttcttcatagggatttgatgaaggtctgttaagtgaagttagtacaaggtattcacaacccttttccctgtcactggttttgacatttaaacatgtattatcacatactaacagagtattctttatggctagaacaaagaagaaaaggcacaaggccttttgtcaccattgtttagtgaaagaagagtccaagtaaaatttatccatgtagtgtcacttaaaggcttcaaattggttgttaggttcatgc

SEQ ID NO: 55134 - DNA, 1147 bp, Bovine  19866880577237
ctgatttccaactacagagaagggctcgtaagtgggtcttttgtgggctctttcctggactattatgctgctgacatcacttaccccttgaggaaagccatccaggaaggagatctgcagatggatttccccaaggtgaattattctgacctggaagattctgaggaggagacctctgcagctttaaagaggcactgcaagagaatcctccctgaccggatgagggctgcttgggactgagccaaccagaagctggtggacttcatcatgaaaagaaagggggctgacccacatcttctggacatcgtcaaaggcaggaaagaatccaggtggcttgaatcatttctgaattcacagaggtacatgatccccattgaaacatacctggaggatgacgatcagctggatgtggtggtaagccacttacgagaaatctacaaacacgtagacaagaaaagtgctggctctgatgagagatgacccagtgagcttccttctggacgttcttctgccagaagcaatcatttgttcaattactgcactggatggattggagtacaaggaggcagaagcaaagtacctgcaagggccacctgtgcattcccgggaaaaagaactgtttgataagaaaatactgaagaaaataagaaagagatcagctgagaggtacaaggctaaactctccccctgtgcccaacagggcatcgggggagacgtctcagccacaccattagcaacaatccccgtctgtatgaactgcatgatctttccactccacatggcatgaaaacaccttctggaaatctgaggcctctggaacactcttgaattcactctggatccatctccagcgcctgcgagtggcagagtcatcctgagtttcttcttctgaatactctcacacaactaagtggttaaaatattgtaaacagctgccacttccctctacttgcccagatgtgtagttttccagatattttcactatgtggcttttgactctacttaatattttaaaggtggacatgcattttttttattagatgaaaaagccttatatcagatacaaagcagcaatcgtgtttaagatctaaggcatgtttcttacagaaaagccacatgggcttcccattcctactgggcacatcg

SEQ ID NO: 55135 - DNA, 3626 bp, Bovine  19866880848327
caatcacatccttgctcaggaaccaggagctccctcaccctccaaatactgcaaatccctcttcccacagacccttctgcttcactctgttccagaatgcatctcccatatgtcctacatgggcctgcggtgtccacctttcctgggctgcacaagaagtgagtcactgtgtctctaaactatccccgtaaccacccagaaggtctggaccactcatgattagacgagataaaaatccaaagctgtaaatttgcactgctaggaatgtgaaatattctgacgggatttgtacagagagaaaagaccaaaaaaaaaaaaaaaatccatgcaactgaagtggcagcacatagcagaagatggtttcagtctgtacccctctggcttgggggcccagcaatcttctgctgtgccactctgttacatttgtccctgatttagtaaaagtcctgatcatcctggatacagggaaaaatgaccatagcacttttgtgacacagtggtgaaatgaattcaaccccaactcaagccagagactttaaaatttattaagcaaccattgtcatagaggagacccctagtgctaatgaaactgatttgaagctctctgaaggaaaaaaaaaatgcataaatgtgagcaggtagagaggacacctaccccatcacacacagaaagtatatccagtgacaaacaagcaaaaaggatcagagagaaacaaatcagaaaacttgaatacagagggaggaatgaatttaaattgatgcaaaggcccacagtttaatctggttggaaatctagaatttgctaaaagaatttataccccagtaagacctttgtccttggcagacaactgtcttctcactgtgtcctcacatggccttttctttgtttagcgtaaggggagagagagagctctgtggtatctgttcctcttcttataaggatgcccccctattggattagagctccatgcctatgacatccatgtcacccaacacagtcaaataggggttaatgcttcagcatatacattttgagagaataggattcagtccataacatcttgatgtatattttgtgtgcctgtgaggccagtgattcccagagttctttacctcaactgggacaacttttaggcaatggcccaagagtttataataatgtacagatgggcccatttgccagccagggcatccaggactaaaatgaggatgggccaattgtgctgacgcattggtcctgtcctttatcatgggtattgccactatccatcagtattactgctttccatccctccaggtgatgatggtgacaataccatatgtagtgcacaaacattcaatattttccacacaatggattccaaggggctccccaggtagccaagaggtctggaagagggatggcttcttctaccactatctcatctgccctcttgcaagaaacatatgccagaaactctcttgtatcagggaggcctcagtaaccatgctgaggttttggggtgctggttccttgatccaaggaatgctgggcaactgagtacagggtgtcactggctcagggactctgagaacctctattttgacgattgctcattatgtggctgatacttgccactctaatggtttgtagtacaaagccaagaagggcagtttcttgcatcagtagcctgtggacaacttatagcaatcatgggtagtccagagatgccagggggcatgaacaaaggttactaaagcctcagcaatgaagaggcttcattggagacactactgggagtgtccattgttttagccttggacagattctagagtcttttgttggaagaagcttttatcattttgttaatataaattcttttagtaaattctgggtttctagttggattaaattgtaactttagacagaagcagccatacaacaagtttatatattgattcacaaggagcataggaacctaaccctgtatacccgctgggagcaatggtttagtggtcactaattcattacttgtagtgactttataggatataaagtgaacacacactcacacgttgcaggaactgatgttccttgatcagcatgtgaaaatatgttaggatcacagttatgctcagggcctgttcctattcccatgcccttgggaaggaaacctacctgccaaaagtctcaggtatcttggttgacacatcagaaagctttagaaaggccagatacctatagggctcaggctgggtacttgagtatactcatccaagacacctccaggctggaagcacatgattaatgagagaaatgccagttcccagaatgaatgtctttgagaagacagccttaaagcctaagaatctgaaatgaattttttgggtaaagccagaaggttctctctttgtgtcaagccacattcccagttctaaaaacaggtatacaagagaaaggttaacatggttgtgacaacaaaatgtcattcccagctcagataatgtgactttgtgcaggagaatgtaggcttgttagctcagctcaggagggcactgagggtggaagattacttttcctggcgcagtcagctgcccctggatggatccccaccaacatggagagctgtgtccatgctgactccaagatggggctctttagggggttgaagtaattctttttttctgtcggctgccctctgcctgcttcctctcctctccacttgcccaaatgcctgcactctatcccagcctctcatcctgcctggtgacattgacccagtctttgtgccccatcctctggagaaaagctggagaggagaagaggaagaggctgcctcagtgcgtgcttctggctcactcaccatatgaagagaagggagcaggggaaagaatgtgcatacataggactatatgcgtctgtatgtgtgccggagaaggcacggccctcaaaaggtgacagctggggtacttctctgctgtttgttctctgggaaactatgtgatatttaccgataaccagtgacttctctgtttcagcaaaagccttgcaaatgaagctggtttagatttttgacagggtgctgacaggatatcgtgtccgtcttaatccacataaaagaagaaacctgcttctaggcacttgaggggtttttttgtttttgttttgttttgttttgtttttgaagtatagttgattttcaatgttgtattaacttcaggtgcacagcagagtgactcagttttacatatatagacattcttttttacattagttttcattgtggtttatcacaggatatttaatataattccctgtgctatactgtacgaccttgttgtttacccattctatgtataatagtttccatctgctagacccaaactcccaatccattcctcccctacaacctccccccaccccaggctaggcaaccacaagtctgttctctatgtctgctagtccgtttctgtttcatagataagttcatttgtagacagttgagggtatttttaatgacttttaaattgtaattttcaaagaatacatttgaatcagttctaatgaggtggatgaaactggagcctattatacagagtgaagtaagccagaaagagaagcaccaatacagtatactaacgcatat

SEQ ID NO: 55136 - DNA, 697 bp, Bovine  19866881089484
ccctaataatacacacttgtcgaaatgtaggcacaacttcctttgaccctggcaaaaacctgattttctagtttgccttcatctgacatccagatacttaatgctctgtgggtcattttaaagtgaccagcaactcaaatacaacctgtcttgtattttggcagaccaaaaggtggtttgtaacagaaactggaacatgagtctgtgtctctaatagggaaccatactgcttaacccttctttacttccttgctaatcccttgtgtaaaaagcttgctttctctataagaaatgcctctaccatggcaagtattgtctccaatatttccttcattagattgggatggcataagtgactaagatcaagtataacactatgattctgagaatgtgctttcatttcctggtttccttgaaaagctaacatgaacaagagcattttgatgacattctggtttctatgacaactggaatatgccattttatcccgcaggcaggaacaattaacaaggatggtacaggctggatggactagcagcaaaaatctgcagcctagtatgtgattactatcactgtgagatagtgtatgtgtgtgcatgcttgtgtacatgtctttggaaaggtgaggtgtttagttggggattagggactttaagctctcttgttttattgaagaaattggaaattcccactaaag

SEQ ID NO: 55137 - DNA, 1824 bp, Bovine  19866880098611
ttggatggcatcactgactcgctggacctgagtttgagtgaactccaggagttggtgatggacagggacgcctggcatgctgcaatttatggggttgcataaagtcagacatgactgagtgactgaagtgaactgaactgaatccagaattgatgcttttgaactgtggtgttgaagaagactctcgagagtcccttagactgcttggagatcccaccagtccatcctaaagatcagtcctgaatattcattggaaggactgatgctgaagcggaagctccaatactttggccacctgatgtgaagaattgactcattggaaaagaccctgatgctgggaaagattgaaggtgggaagagaaggggatgacaaaggatgggatggttggatggcatcaccaacatgatgtacgtgagtttgagtaaacttcgggagttggtgatggacagggaagcctggtgtgctgcagtccatggggttgcaaagagtcggacacaactgagcgactgaactgaactgaactgaactaaactaatccagtatgacttcctcttaacttgaatacatctgcaaagactctatttctaaataaggtcacatatagaggtactagggttagaaattgaacatatacttttagtagacacaaacttgaacatatatttggggggataccctctataaaaattattgactgcatcaactcaataagtggtcattctttatctctttgtatccatccaatgattaagcatttactatcttataacctttaggagacctagaatatattactaaaactcttggtacttgttatagtttttacagcacttttagcctggaagattcttaaattctagcttacaattttcttttgaactttaatctggtgaaagcagtgatttttctgaaagccttgggcagaaggctgttctctaccactgacctctgttccaaaggagccacagggaacagctgggaggctcccaccccacagcacagttttgtgtgtgtcccagtgagagagacccagaattatcccagtgaaattctcaagattagcgtccctatagaatgagcactcttccttcaaagcccccttccctggcacacacccaagctcaccagcatgcttggccctcgcctccccccaccagtttccttcatccctcataacctcagccttgtgacctgaatagagtttctttttttttttttttgcctttcttcacaatggggaagatggggaggccagagtgagtcctggagagtacagtgagactgtgtgtgtgtgtgtgtgtgtgtgtgcatgtacgtatatgctgcttgtgactgaaaaggatctgttgggtttaattgatgcattcgattactgtgatgacttcctccccagagttttccaaaatagccagatgtacccaagtggaccacctccaggttttgcctttggttcaaactgagggcggggggcagagaatggtgaggattacagagcctggcacaatggaagaaaaacctaggcctgtttctgtagagctcagccaccatccctttccaccaggacaccaattagaccatctctggcttgcagagccctggggctagacgtgaaaaggcagaattggaggaagccgatggcgctgctacttctgggggcccctgccccagccatcccacccacccgctgccctgtttcactgccagatgatcaagaaaaataaaatgagagcgctcatttaaagctattgtaaaaggaggagataatcctttctccaccagctccctctgcccctcccagctcacgtcgggtggcttcctggaca

SEQ ID NO: 55138 - DNA, 1268 bp, Bovine  19866880359058
tcactttctgccataagggtgatgtcatctgcatatctgaggttattgatatttctcccagcaatcttgattccagcttgtgcttctcccagtccagcgtttctcatgatggactctgcatatacgttaaataagcagggtgacaatatacagccttgatgtactccttttcctatttggaaccagtctgtagccctagactaacatctagtggccatgacataatggtgggcatcaggacagagactgaagcttcaccaacaatttagtctttaaatattttcaccctggagccaggtggacagaatagataccctgtatctctcagaacctgcccctcagggacacatctcacatcctttatagaacaaaggtgattgacgtttcccgagtccaatgaatagctttgtcatttcggtccagtgtataagcccctcctccttcaggggggcctttggcccaaaggtgtctcttccctgcatcctaaggctacagtctgaacatctaaaattacttgaaacataaacaatgacagataaccattagaggagagtcattcttttacactgtaaaaatagagctgggaattgtcacttttaagaggtaagagagagacatatgggcagaataccaagagacgctcatttgcctcttaacattaaatctaaatcataaaaccgcagacaggagactcttacatttggatcctctttttgttttcctttctttgtactaaagggtataatgtgtgcaaaaaaaaatacacactcagaagaatgtatcctttctgcactgtgattcctcggtggtaaaaatagactcacctctaagtctgtaactactaactagtcttgatccagtgagatttcttggggtgacagttggacagtttccatcatgacactggcttctgtgtgtgtgtgaagctctgctcttccacctacttggccttgacggaagaaatttaggaagttactaacacacgctactggagaaggcagtggcaccccactcctgtactcttgcctggaaaatcccatggacggagctacaacaggaacaaaccttgaaaacacaatactaagtaaaaaaaaaaagccagccacagaaaccctcctgttgcttgcttcatttgatgtaaaatgtccagaatggcaaatccatagagacagagagctgactggtgcttccctggggctggtaaaggtgcaggggcgggcaaaatgggagagtgactgccagtgggtacaggctttcttttgaaaggt

SEQ ID NO: 55139 - DNA, 3336 bp, Bovine  19866880442250
cagatccagtaatgtccatgtgcacacattcctgtgtgagggcacagaaggtacctcttccggtatttctcctccccttgcatgacattcacggacctccccaggagacctagcttcatcatttgctttgccctggagcccagaactgaccagcctttctcccgttgggctccagctgcggcggttcatcaggaaatagcacgtggtgatcaagatggccagcaggatccccgaggtgaccagtgcaatcaaggtcttccgggaatagctctggtggctgctgacagcttcttcagagatgtcctcgatgcccatcttaaagagaagccatagaaaagtgagccttccacttgtggaaggtgggttctagaagaggagcccagcccatgctagacgcctctgtgtgactcaacactgaatacacccaagaagacatagacctcggggattttctaaacaggacttaagactggtatctcttcattaagccgaactgtaaaattttgtttcaaagatagaagggcaaagaccgttggagaagggtggggaggtaggaagggtaggtaggtactttctcccctgagacccctcatctctgcaaacttacctctctcaggtcagaccggtgctcttccagaagtttgatcttgctggaactttctagaatgagaaatggagtttgctgcatccagaagctggaacagctcatcctgcgctgttctagaagaggctctgacagtgagggtagatctcaggagggtctttcccagcctcagcatggccctgctccccggcacctgtgccctctgagctgcaatgcctggtttctacccagcatcctctaaccccagcccgtctccccctctagacctcagcacagacctgtcccttacctgtcctgttggtcaggaccagcagcaggcactgaggcctcacctcagactgggccaggagcaaggagcacacctcggcctgtttcttctgacacaggaatccggtcagtttctcttcattgttcttcttaaactcctcctgggacaacagagaaaagtggtgagcaggacatgaggtcgctggtatcctctgcactgtatccggagtctcaggcaatgattcagattaaagtcccactgttaccctcaaaacaaaaagaatcctttttttccccccctaaaattccaagtgaaaaaaaaatcttgcaaacttcatatgtgcaaaaacacaataagaaaaaaaaaaaaacaaaactccaaaattttccaagatcaaaaggtggtcttagctggcactctatgatgtcagagaacaaatttaggaaccattaccttattgaaggattgcccatgtaaacctacactatccaaattaagttcaaaagaaatcaccaataacacaaaatattaacagtgcaatacaaatgaagataaaaccctctgtttcaaggctataagaggcccagatattgaaggaaaagccaagggagatgaggagtagagaagaaatttatgactatagatgcaacgggatcctcatcccttccctcttagtctccaaggggtctcacagacagcatggctcaaattcaagtggggctcctgtctagttttccattccctgtccccactagagacacggaatccagtttcacatgaggtggacaggtcgctccaggttgctgactgactggtccgtgagagtcagacgctcagactcagaagacagactctgacaattcttcaacagtatagcctcaggaaagggatgaattagaagccgtggctgttccccctcctcggtcttctaggatttattccagcagcctccgaagggagtggcctgctctacccagaaaaggaatcaaaaccaagacactctcctctgtccggatggcagatggcgggggaggaaatgcctgagcagctctgacagctttcctgtgaggggaaaactgctggggcgtgtgaggggcatcagagctgagcctccgtggaggagagagcttcctgtttgcagagcggtgctgctccgagggcaaggccacagggccctcccagcttggcaagcagcctgggtattttcctattgctgtggcccaaggcagtaaaacccaggctcctttgctcctgcacaaggcaaggtcaagattggcctcacgtcccagctttcttctgccagctggaattcgaggctttggggaggccagacagcagggcgagctaacctccggatcacagaagagaggaatccagcgggaaccttagaagggccccaagagccaaggttacagagagatgagtcctcaggccatggctccttcttccttgggagaaggacagatgaggcaggtctccagggaagtcccaggataagagctcctcacaatagcatttgctgtggggagtctgggcaccacactgggtgtggtcagcagtctccttcttctctgggctcgtgtcccctcggacttgccttgctgccccgtgagcagcttctggaggaggaggagggaagtccctgcctggatgactctgggcttgtaaggtatctctggctgacatgtgtctcgttcccgagagaggcagggggacggggcacaatcgaaacaagccgaacaaggaggcacctcctccgtgtgctgagtcctaagaagctccgcctcgatcagactcagctgttctgatggtgatcagaactgcgtgaatccctctgtgcgtgtgtcgtgtgtggtgtgtgtatgtggagcggggctagcaatgaattccacgtggtcggagctgttggtatgtccacatggccatgaagacagacacaacttcctgtgtctcaggcactggtcctaagtgctttctgcacattgactcacttaggtttcacacaactctatgagatggacactgttactctccccattttatagatgaagaaactgaggcacaaagagacttcagagttgatagagtcacatggtaagaaccctaagagaggcacaatggtaccgtgggcatgtacaggagagcaagcacacgcctgcttcggggttatcagaaacatctcgaaataggcctcacagaatggacagaatgtatgcaggagaagctggggaagggcctcgggagtgcgggtgccaccctgaggaagcccaggcatgcatgagcctgcagccttcacagaatgggttgcccctgggaatgaagcacatggcctttccccttggaatttcatccttcaaggcttgattccacctcccctcctccaagaaaccagtccctatcttccagcagactgggtatccgtcctgctctgcatttactagattcttgcaagtcatacagctca

SEQ ID NO: 55140 - DNA, 1378 bp, Bovine  19866880450250
ttaattacgctgtgccaacttcagcctccttgcaagtaatgcaaaaaaagaaaacaaaacccataacctttcttctgcctgggcaggctcctggggaggtggcctgtctgtccctacctggacaggtgttctccgcttcctgtcctcaggccagaggccactgcttcctcagaagacagggctttgcttctccctccaggcccagagtgactacacggctggtggaagccttggcccaggaggctgggggcttgtggcgggagtccgtcaggcggcctgggccaggtccgctggatcccagccctgcctcctgtggcctttgggcccaccatggccgcctgagaaagctcgcaggtgtgagctgggcaaactcggccggccccggctcccgcctcccgttccggcagtctcccagccagctcggtttgcagacagctgctcaggtcattgtctcagcctctccaagctgtgaatgccgagtctatagagaccgccacgcaaacagtgcccacagtgcctctggggagggaagggagagctgggctttgccagggccattgactctgcaaataccaaggcctgctgtggatgggggaaagcttgttggagtctttaatgggggggagcggtttctccacacactgccctgtgccatggagaagcacgggggtgcccgagggctggcagactggcagggcaggggagaggtccggcctcagggacacctgctcaaacccaagaaagagagtcagagacgtggcggggcacagggtcgaggcatgagaggctggaaagagaaattcccacacaggcaggtggagacggtgtgctgggcttggctggggcagacggacctcctcactctctccacagctcgactcgccgggctgggtgacaacccactcccccaggttgggctcagcttctgcatctattgtgtggactggggaaaagttgcgatcaaacactcagagacgtttctcaagtgttctacatttaacacctattctcctgcagtgcaaacggttttcttcataacattctggaaaagaaaccccaggcaccttgtcaccctcgctttccacctctggctcttgggcagtgctgcggaaggcacggggctccctctgcttgcatccgccctcccgtgctgtttccaacaaggggccaggctctgcgctgaagaggggagggctgggtcagggggagcttcttgggctagtagaagacagcttctcccccgacatcctgctacgttctgcccagggatcagctctgcccagggatctagttcctgagccccagggtctagcttgggccctgggccctagtgtctgcaagtgcttttcatgctgtgtccatcccattcatatccatg

SEQ ID NO: 55141 - DNA, 1249 bp, Bovine  19866880480502
cctccgcccacgtgccttccccacgtctgccacactcacagccctcgttctaggttctccaggcctcttgctgtctcctcagctgttctcagtccaccatccagattccacctcctcagtgaagccctccctgattttcccactcagtcagttaagttcttactattggtgacagcacttagcaaagccagtttcctgcttgagttatttaacgttcctgtctccaaggcagtatgcacagtgaccagtgtcacagagtttggggtgggactgtctggattcaaaacttggtctgtttgctagtgtgtctttggccaagtacttaagctccctatgtcttacgtttctcatcagcaatatgcgtgaacagtggtacctgtctcagtggggctgttgtgggcaagtaatcattgccatgggtaaagcatgcagaaaggggcctgtttcctcttatttttatttcctatgtgattgctgtctgctcttcttgcctggttgtgaattcctggaggccaggaagcacacaggattcatctttgtatccttccaaagagattccacttctcctgtggtctagaaagaaacacaaaaggctcaagctagaaaggaccagagaggtcatttggagtgaatgctggttttcctgattggtaaactgaggtccaggtgagctgaaggacctgctcgaatcacacagccacaggagcctcacagtcagggtgtgagatctaggtctcgtcagccttgcccgagccaacgcaaatgctatttctgtgtgctcttcggagaacagacggtcagcgctgtctcagccttctctcggcgtaccagtgaccacgctttagatggccgctcaaccccggaccccgcctgctaatggatgtccactgtcctcagccctttggcctttcctactgaggcaggttttccaaccttccagtcggggtgctgcatgtgctttacgaagggagtggcgatccagatcggggcttgaccctaacagagactccagggtggagggcgggtacaggggaagggaaccaaccgagtccagaagacacggtccggcccaatccccactccctcccggcacctccctgccaggcacccaggacgcgttcagactcctcccttcaccatggacttgatacaatctggaaaacgcattaaacgttacagagagtagttgacgcgtaattaataaagtacggattttggctggaagcctcaacttaaaatagcacggcgg

SEQ ID NO: 55142 - DNA, 597 bp, Bovine  19866880489748
aggagaggaaacaaaggattacgccttgcagagtctgtcctggttcccactgcccagagggggccttgtcaggaggaaactgctgattcctgcctgcttctgagccagaggaaggaggaagagcccacaccctcacgggactcccctgtctgcagagacaagcctgggctagtaagcaaagggctgcaaaggcgggggacagcaagtgggctatagggctcggagagaagagccccgcactcaccacgcccacccagagcatcagactctgctgaggccacctggatagcaggggtggggtggggggctacaggaagggccccttaccgtccttatagtcccagacctgggcacccagaggcatttcggtggcctcagaggggcttaaggatgagtgagagaagcagaggtcccagggcttaattttaacatgctctctggactcacaggaaactctaagataaaagattttgagctctgttcccagaaaagaaataaggaagggaaccctcactcacttaatagcagctctgtcctaaaggctgtgctggccagcttaagggttatctcacttgatccttagtatgaccctataaa

SEQ ID NO: 55143 - DNA, 732 bp, Bovine  19866880608228
ctgacaccggggtcttctgcggacctggatctgcgcacacccatgaactgtgttcctccgcccagccccgctccaccaatatgggtctccctttcctacatggaatgtgacggcacaggactctcaggaggctgaacatctcctcatttgagacatccgagatgctttcaaattcactattactggtacaggaaagaccctttgacataagaacgtgataaattgctttgtagtttctgcagccacctcatcccaggacctgtgactcacctgtgtgcttttgacgagcttcaaagtcaaattaatgctcacttctcttaatgcaataatatataaaagttacaattaataattaatgtagtagtgtgtgtagcaagcattggcaaagttttcaagtgcattaggagcaggtggacacatgctagaaagctggctgggtccaagtacagctgctcagagcacagacttcagagtggacttggttcctggctgtgccaccaactctttttggtctcagcagttacttaacctcttgctgacgtcaatcccctcaacaggaaaataggaaaagaatgtggacatcacagagttgttacgagaattaaatgagtcttgtaaaccgcagtgtctggctcgagaaaacctgctacttacaggccagttgctccgtgtcagcccctgtctgtcactaactggcagtgtggccttggggggaagtcaggcagccttgtt

SEQ ID NO: 55144 - DNA, 672 bp, Bovine  19866880692944
agctgtgcctccccacctgacagcccccctggtgccagaggcgggccccacctggccgctcgcctccaaggaggctgcactggggtgctattctggggtgattcatcaggccccaggcttccttggaaagaggaaggcgcagcggtatgaggcctgggctgacctcaggagctctgacacagcccttccggccccatgcgctcacccgcaaagcctccccgacggacggagctttcggtttgaaaatcagaggttatttttagctatgtcctggggccggtagccggacatgaattcctcaagaggagctgcggaaaggaaataacagaatcctcatattctccatctgggtagggagctgcaggaggcagggctgtgtgcgccccttctctgggcaggagagctctattgcctacaggtggagggcagtgtgtccccctccgcctcccgccgttaggattatagttgccatcatgatgtacttggggtttggccttttgggcagggctctctgagacactctggcattgagtacacgggcagagacccctgcctgccccacaacatacatgcacagacatgcttagcccatggggggggcggggacggtcccaggagcagaggtgatgccagaggacaccaagtgaggttaagatgaactgtctcaccgcc

SEQ ID NO: 55145 - DNA, 1849 bp, Bovine  19866880723042
tgtttctctgtccttagatcttctctttctttgaaaccctcttgctcttttgccttacaaacttccttgggtaaaaggtttgagggggtggtcacatctaggggagcagaacaggtggtttcaaaggactctgaactttgcaggtgcactggctttatcagctataggaatgagagatgagttcatgtgtaagattgcctttttttttttttccccaaactggggacaatctcatagattagctgacacatatgttctatttttcataactcagaactatctctggagctgccaagagtcaattccagctctctgtttggataagatggaggtttcaaagcaaagttttccttggcaaaatttatgccttagctggaacagtcccatgatgaaaatacccaagaccaaaggcgaggtagggctgcttccaattactgaagttgagctctttggggagaggcctcgtgacaggccttggatcgggagcagacagtgtttcgaatggcaagccaggggaaaaagaaagagatcatgtctctgctatttggtggacttcccaatgatggaaaggtaattcaagtctttggtgattttggaagcctttccactggaaaattccccttgagttttggtatttgacttcttctggagcattgagagtgggctggagggagcagagtctaagttgtccaggggcttgagatgaattgacgggcaagtaaggcagaaaggttgcctgggacttgccctgatgcctctgaagcaggctctggcttttcacgggaattgaacttattacaaaccaaagaagagcaacctgggctgctggcacagagcgagtcagaaatcccttcatggctaaaaactgaaagaagctgaagtcaaggcaatagaaaaggaactcacaggtggggaggctgggggagaagcagtgtttctcctcttctgagctggaaggtgggacaggaggaatgattattttgagctgctgcctggcattttacaggatgacaacactgcttactccgagtctggtcacgtaaataagcttaggagtcctgacccaagttcccacttggcttttcctgggtcgccttttgaaataactgctcagagttgagctcatgagaagttagtgatctccaccccaaccatcttgtaagtaacaggtgctcactacactgctctgtattttctgcccacctgcctgtgacctttgatctgtgattgacctgggaagcagggataaaggactgtccctgcctcagctcactttgtgcatcctccccacttatgggatctgtgagaagcaaattttgtcactttcttgcctttgtgtgcacttattgaaactgtgtgctgtgcacgctaagtcgctcagtcatgtccgattctttgtgaccctatggactctagcccaccaggctcctctctccatgggattctccaggcaagaatactggagtgggtgaccatgccctcctccaggggatctccctgacccagggctcgaacccgcatctcttatgtctcctgcattgacaggcgggttctctatcactagcaccacctggggagccctctaccaattaaaaggacctcaaagttttcaaccccttgaaatgggagctctgatgctgaggaagttagctgctgatcacatgtaggtggcttgtacctccaccttccgtaggtcatatgtgcccttacttaatttcattattggggtaacactggtttataacattctatcagtttcttgagcacagcattatactttggcttctgtataccctacagtctacttaccatgaaaagtaagcttccatctgtcaccacacagttgacc

SEQ ID NO: 55146 - DNA, 1922 bp, Bovine  19866880794085
agatgtttatcgctctttgaacagcgttgaaattctgacagtgaccagcagagggcaccaccagcagagacagtgccgatgcactgctagggagacgggcatatgtgccttggatccactaatcaaaaaaacataaataaagaaactaaactggcttcacataaataataagctggcattatgtttttcctctctcctctttctccttacccctttttgctgaattttacatttcccccgattctcctcctcgttacagagaccccttgctgtgtgaaatggatcttctattttggggttgcctttgatcagaacagccccaaagccctggcattacaggagaataatgtaccagcctgcaccaccagtcagttctcagctcctccccagagccccagcagaagaccagacgactctcctggtaccctgggcgtggggaggaccaagacacggatagatcaggtttgtccagttttgctctggccgctggaaattctgctccttatctcgtctgccattgcttcaccacactgccaaaattacctcgataatatattttttttaatttaagaattcattttcacttcaagaaagaagaacactgcagccagataagaaactccatctgtcatcaagaaaaaagggtcgtggatttgggtgtcacaaatcctgtaatgtcttaaattaaggtgccacttctgcaggctttcttcgtgtttgtgaaatgattattctacagaggtgcatttaatatggttaaaataatgattatgcatgtttaatacatcaatttaagttattatctcccatgctataaaatgcagaataatttcataaataattataaagcatttacaaatggcgacttgatgcaaagcattcttgctaatcctttatctttcacaaacacagaaataacaattagattcctggaatgggaaagggaggttatgttctagaaagtgtcactcccttactgaatgcaaataaggaggcaagggaaaaaaataaaagccctgggtagaaccagtgtactttcccccgctcctgacagatggaagatgtctgtccaggttatcattagtctaggtacccacctttctctctgcaggcattggggagtggggggtgtggcctcagggaagggaggtgtctttgaatcccttagagaaagaataattctgcctccttctaattttttaagaaatagagaagttgcggtactgagacctgaccacagggttagaataagaagcaaccttccccacccaatcacacgcacacgtaggcaggacatcctttgactgctggaagtttgatccagatcttcaattatgccgaaggatgaactgagtcaccagggaccatgtatggcaaaaagcttcagcctccgcccttcagcctgtcaatcaacgacacagacttggagaggcaggagatcccctcagagggcttctgctcttgatggggagcctgaatgttcactttgaaactattcagtaacacagacagcatagagctgaggttaaatcagccacggtaaaatttagttgacataaataaagtaagtccagggagactttttcgaagaaatgagatggagccaggtcacagatcagtggaatcaagtaaaccaaagacgccatagatgctgagagagacgatgcacggtgcatttaaggcacctgccacacacacagtaaggacctgctgtgactcaagccaggacgccaagggctcggaggtatcttgggataatgccctttgcaccccgccaagtcagcctgtctctcaaaggctggacagtggcagagacaaggacgggaaggaggtcctaagtatgcctccagccgatccaaaccccagctctgcagaaagggatgtgggggagaaagagaaggggcaagacctcgagggccccg

SEQ ID NO: 55147 - DNA, 1337 bp, Bovine  19866880819214
cccagcttagatgtcttctcccacagctctccttggctgcttcagcattcagggcggtagcagcaaatcctcctgaagggcaggaactccccagcacaagctggtcttaactggaaccaagtctccgaagatagggccgtggcatcacatgatctctgtctttattgcttcgtcttccgcttgctcgctgcctgactttgggcaaggcctttggccactgtgactctcgggtcctcctctgtgaaacagggatattgctcgtgccccctggcgtgcacgcggccgccccgtgaaagcagatgcagagagcacagggctggatcagtgtcggctcttccggttctgtcttgcctcccagctctgttctttgtgggggccttgggaacatgtacccactgaccatccacgccccaggtagccatgacccccgccatgccaaggagtggactgagcgatgacccctgaactctgccccctcatcctgctcgtagccttcgggcaaggaggtggccacttagcccttctggacctagcccctctcccccctccctgaagcagaggcgtttcctccgctgacagtctgaagacaggtcatttttcttctcttcccatataatggcctttactcccctacccaccaccccctctttccaagccttaatgactttaacatacacatagttctgaaaaaaaaaaaatacaagccccctgtgagctgcccagaccccttgtagtggaggagaaataacccgagcacatgtccacaagtcaccgccggcgatgacaggggtccgcgcgccgatttcctcctgtgtttgaagctggagcaggggggcggggtggcagggaggagacggagggcctgggcattcggtggttccctttgatcctcctagaaacgctgtagcatttagggaaatatttcaccctgagaaatctaaagcgtaagaaagacaggctgggcgggtgtcggggacgatgatggagggagattgctaccagatgaccttttctctccttgagagtctgaatctctgctgtcttgcttctctgggctggggagggaggagacagtctctaaggggagacactagctcagagtatttatggatctgctgaggcctgctaccccgaccaacatgcgtggcttctacctccagcttctctgtggtttgcctgacagagagagagacacggaggcccacagagcccagggccctcatcttcccagtgtagacagcatccagggccaccctgtccgcctgccaccctaagggctgtgccccggcctccagggctgacacctttgtctgtgaatgaacatccagggggacggt

SEQ ID NO: 55148 - DNA, 1932 bp, Bovine  19866880850225
ctcacctcccagttcccgtcctgctcctattctcaccttcaggaacttgtgcaggaggaaggcaaaccaattggtcagcatcttctctgccacagactctgtcctggggaggcagaagggatgagaggcagcccttcatggagggctcccaagagggtgcctggctttttaggtggactctcgcccaagagaacccagggctgggagccaggacactgcgtcctgtcccgacttcacccccagtagcaagacgcgagaccttgggccagaggcttttgccttgtgagcctcaatttcctgggaaaatggagtggcactctgggtctacaggcgcaggtgccaaggacaccatcttccagccctcttctggcctcagggggataaatacagtttctctgtccctctgaggtttcctgcctggtctgaatacttataggcatatctagaaggcccctgatacctgcccctccaaacactcagaatcagactgagttcaaatctcgactgccacggactggctgtgtgatctcgagtaagtcgcttccctttctctggattcagttggggaattaatcataataataacaaccacaattaataatggtaaccaccaccaccgtcgtcaccgtgtatcccacagggctgctgtcaaggttgaatgagtcaatgtacaaaaagggctaggaagagtgcgaagacccggaagctgtcgccccgctgacgtgtggggtctggacccggcccctcacatagagagctgcgtgcataagcgttcatgagacccggaagctgtcgcaccgctgacaggtggggtctggacccggcccctcacatacagagctgcgtgcataagcgttcatgagacccggaagctgtcgcaccgctgacaggtggggtctggacccggcccctcacatacagagctgcgtgcataagcgttcatgagacccggaagctgtcccccgctgacgtgtggggtctggacccggcccctcatgtagagagctgtgtgcataagcgttcatgagacccagaagctgtcgccccgctgacgtgtggggtctggacccggcccctcacgtacagcgctgcgtgcataagcgctcagctaacgggggatctgcttctgcaagccttgcccctttgccttgccgcccccaccccccacgcccaccccaggccgcagctctggggacctgggaaggaacaacgcagccctgacagatccctcagggatgaggacgctggaggagtgctttaactccctgcacatggtgcaaattacaccctccgatcgcagtaaatcccaggcatttgccagggcggctcagcaaccccgggcctgggagagagtgacaaaggcagaagaaattgtagctttctccgtgggcccctcccagcaccctctccctgcattatgcctgagattagctctaatttaaatacaacagttcttaatgagagtttctaacgctcagattggcagaatgggggctctgtattcataacacaaagccattcttcctccctcttcaccccatgtggggtctggaagcctgagaccttgctaggagaagggtacggaggaggcggcgatgtggaggtggttccaaagctgtgctggatccctggggcctccagacacggtgggcttgggggatgcatgtcaaggtctctgaccctcttccctgctgggaaaatggcaactggggagaggctggtggtaggtgctggtgattcagatcctggaagctgggcattgaaggcacaggcagcaccaaatccttagctgggtgctgaagggagaactcctccagggatgggaacagcttctgcctgcgtttccaacgtgggggccacttgtggggaccgagccctcaggatgggctagtgcaatggagggactgagtctcacattttatctcattttaa

SEQ ID NO: 55149 - DNA, 3140 bp, Bovine  19866880854813
aaaaacacaacaatataaactttaatgaacttaataacaaagccattccaattttagaaataaaaataataagaataaatacacagcattgatgaagctcaaataactgtactcagtgaaagaagccaagcaaaaaagtacacaccgtatcctcctatttatgtaaaattccagaaaatgcacactcacatatagtgacaggaaggagatagaggatgaaggtagaaggagggtggatgttaagatcacaaagagacttctggaaacaatggaaatgtttacgatttttattgtaacgatgttttatttgtaaggacatttgtcaaaaccgaatgaattgcataagtttatatatgtgtggcttcctgtacttgaattttatctcaatgaagttcgagaaaagtgaatgcttaaacatcatgcattaatacctccaactccaatccaatactacaagattcttcccttccttttcccattttttatttgtatctcatccctccacaatgattctcgccaacagattctcaacgtcccttgttctcaacatcaatatatttgctcattgctgtgacacatgcaaataatcttgaaagtactgtatttataccactactaaaacaatactgttagaaaaggttcaaaatttctttgcatttacttttagaatgtgtctaactgaggagttatagacatagacatccaagtactatgatcaaaagttagttgtattaatttttccttctgtatagttatcttaccaatttaatactcagatatgcttattcctatttacattcagctctaaggtcttttcccacgtgtttgatgagttagctttattttttgtatggtaaaatgtttacatgggtcaaaaaaatcaaaactatgcaaacagtatacttagagacatttctgactctttgttagcttttcttccttattttaacttattcccttcagataaccatattcactcacttctgattcatccttcttatgcttcttttgcaaaaatggatatatattcttatttcaccctcttttttacaaaatgtagcatactatctgtgtcttctatttaaaaatactatggaaatcatttcagtttacagagatatttctcatttttatagctgcatattatgccattgaatggatatattgagcaccgaagaattgatgcttttgagctgtggtgttggagaagactcttgagagtcccttggactgcaaggagatccaaccagttcattttaaaggaagtcagtcctgactattcattagaaggactgatgttgaagctgaaactccaatactttggccacctgatgtgaagaattaaatagtttgaaaagaccctgatgctgggaaagattgaaggtgggaggagaaggggatgacagaggatgagatgcttggatggcatcaccgactccagtggacataagtttgagtaaactctgggagttggtgatggacagggaggcctggtgtgctgcagtccatggggttgcagacacagagtcggacacaattgagtgactgaactgaactgtgtggatatacaatgacttattctaccaatctgctctgcatatatgcatgtagattgttcttgatattttgttactatgaataatactacagtgaataaccgtgtgcatattttgttttatatttttgaagatggatcttcaaagtaaattaatataaataggattattgagtgaaagtagaaggaaatggcaaccgactccagtgttgttgcctggagaataccagggacagtggagcctggtgggctgctgtctatggggtcgcacagagttggacatgactgaaacgacttagcagcagcagcagcagcactgagtgaaagttcacacgcatatgcaattgtgtgagatcctgccaatccctcttataggcgggattagccttctacattctacattcccactgggattgatttcaagtgactacttcctcatatccttgtcaacagaatgctttatgaagctttcaaaattctgcatattttgtagtttcaaaatggtatcagtatagtttcagttggcatttctctcattctatttattttttaaatatcttttctctcttttttttcctgttagttttgtgatttttctgttagtctcttgattttgtaagctttttatatataaaagatatgagtcctttttctgtgatagtcattgcaaatattttcccaatatatttaatataatgtgcatatgattttgtttatgctaattttagccatgcaaaaagttgttttatttggtcgaattatttttattgattttagattttgagtcatactgagaaagtcttttaccaatcccaaattatcagataaatcacctgttttcctctaatacagtgtgggttccttgatgtatcttacatatcttagggacttgcagtttattcctgggtagggtgagagggctgattacaattttatctttttccgaatggctattcagttatctcagcatcatttatttaaaattctatcttttcttcagtgatttgagatgttgcctttatcgtataaaagttttcattatgcacctgggcctatttctgtacctactaatttattttaattgtctcctactagagcagcaataccacactgttttaattttagagtgagcctcagtgttttaattggtaagctaaatcccctcatgtactgtaatagtactaactaaggagttatttctgccatattatttaatatttttcatttactctacattccctttgttttttattttgtctcattttcattgcatagataaatcatcttacgctatttaaaagttttcttttctatttttattattattgttgtcgtctttaaacctattcatacatttatttgcttgacagtgtctaaaatcttagttttgagagttataaatatgtttttcttttaaaatcttttgtttgatccttactttttcagacaacaacaagctttattaaagtatttgatcattcttccatcgaatttctcttgcagcactttcctggatttatttctctttatatttgagtgctcttccaagagttatcaaaaggggattttgtattagtaaacctca

SEQ ID NO: 55150 - DNA, 1087 bp, Bovine  19866880865600
ccctgggcctcctgagctctgggagatggatacttgtaaggaggaaaaggaaagggtggcctccatggccctgcaggaagagtgtcaggaggaaggaggtaccactgagcaaatctgagccggcgccctcccctgatagcctggaacgagcatcactggcccgccctcccctccttcagccacctggatgccaggaacctactgaaaaccctgacagaaccgtgatgattggcttgctctctttcctccacttttatttttaaaaatacattctcttgctcacggcggttaattacaacctttcagaaacactgtgaaatgaaatctttctggaaagcctaaaaatattttggtcttgcaggtagcacgtggggatggtattatggctattccgtgatgttggcaggtccacggggcagtgtcctcctgctgcgaattcaccacagtgatcttcaagggtctgaggcagaggcctggtcacttggggactgtcacaaatggacatttgtgagcacagagctgctcagaagcataagccagcttatgctgtttagagatgggagacttgacaacattattagcaagcataatcgtcttgcatgaagacacatcaaagagatggatagttaggggtgtggagacccaagtctgagcccttctaacccaggtaagagctgctggaatccagactgggatcatcctcacgggttaggggcaagtggctggggagtgctgggtccctgtgggtcttccccacacagtacacactatatcctgtgcctccagcacccggggaggtggtgaaggagtttgagggtcagaacactcagcagccactgtgccctggggcttacatggggtgtagcttcccttttcttgcttaagacaaaactgatgaacaaaaatctggatttccaaaacacagatgaggtggtgagaacttgatttgcaagaggattcccaaggccgccattacggatgctttccaaatctatattgttggctcagacctctctcccgagctccatatccatatatccaatcgctactggacacctcgacttccacatgcatgtccctcaggcat

SEQ ID NO: 55151 - DNA, 844 bp, Bovine  19866880885608
agcagacagccttcccttcctggcttccaggtgaggccatgctgggacagaaaccaggcctgtgtgctcatctctcacccttacctgcccagcgggtgttaacattaaggccaggcaaagggtcagaagattgaagtcttgcattcggtatgtcctaggtatctgttgatggctgagcccgcaggcagctgggctgcaaaaacatttgctaggctgggaatgggatctcatgtgtcagggcagagaggttccccacctactggacgtgtgaagtcaagcgggaacactacctgtggtccagcagcctagtgttccgcctctggcggagagatgaagggtctgatggaaacgccttcacagcatcctccagagaggctcgggatggagtctaacaaggctcacccagcaaccatttatcagatgtcactgcgtcaaggctccagtgctgtgtgctagagaaactgcagtgaatcggacacagatctgtccccctgcagagcacgcagccctcggggctcggtaattacaaactgggacccactctacattgtggtgaacatccatcgcaggcgatgggtatatgccctgggggccttggtagattaaaggaggggccacccagcacaatctgtctggaaaacggaccagcagccaagtgtgggagagtcagggtaagagtgggctctgcagatgcctggaagggccttcctagctgagagattaccacgagcaaaagtaatcatggctgttggtgcatgcgaactcagtcctgtccgactctttctcaaccccgtggactgtagcccgtcaggctccgctgtccatggacttttccaggccagaa

SEQ ID NO: 55152 - DNA, 542 bp, Bovine  19866880900200
tatctctaccatttgtctgacccacatggtaccactctgtctgggttctagtgagggcatttctggcaaaaacttttctgaggggccccttacctctgaatctaagcagggaacccaggatgtgtgggcgccaatccagtccggattttgcatctgtgaggcgcctgcttcgctccctccctgcatagcccttccaacacctgctgcggaggctggaagccaagagcgattgtgcaggaccctgaactctggccctccgcctccgcccccaccctaaaccggcacttctcgtgggggtgctctgctggctggcaaggagccctggagtttcctaggccgctggggagcagaattcctagccagccgcctccccctctgcctttggagtttcttccctctgctctccctctggggctcttggagttaggaagtttaagtgcgattttgcatttctattgggctggtattcagtggcagggggtgtatctgaatagggatgcgaggccagttggagtaggatgtaggcttcttggaaccaggga

SEQ ID NO: 55153 - DNA, 2977 bp, Bovine  19866880909938
gcgggatggtgggcggccgcctcccagaggccaggtcgtgagccagagggaatctcggacacgctgccccttcgtgacctagtcaaagccaattagctagaaagcaggaagagtaggtctttgaaaacttttcttgaaagcaaaataaaaacccagagctgggcctgagtgatccaccttcaaaaatcagagaaaacgaaggggaatctcaggtgggaggaaaagcagactcactgaagacagaacccaagggtatgtcttgtttggcccgtggtaaaagggggagcaccagacggatggagtgaggggtctgctgagcctttagaaagggggtctcccttccatccacgcatttcatattacgagtttcaacaaattactcaatcttgtaggcctttgttactttgtagggcttcccttgtggctcagctggtaaagaatccacctgcaatgcgggagacctggcttcaatccctgggttgggaagatcccctagagaagggaaaggctatccactccagtattctggcctggagaatacagggacagtccatgaggtctcaaagagtaggacacgactgagccacttttaagggaaagggaaaacacaccataaaaccttaattgtgcagagacaggggactgggccaaatgacctgtcgaggtctttgcaaggtgtaaggactacaacagtatacaagagcagacacgtgcagcggcagggaacactgaggagaaatagcttacacccagctgtatcatatcctggccaagtagccttgggcatcaaatcatgacttctctgtcccttaattccttaacttgcaaagcacagaccataggaaggttgctgtaaggactgaatgagttaacataagtaaactgcttagaacagagcctgcttattgctccataaatattagatgtgttttttctgaaaaccactctcctatataccaattactcaattattttggctccaaagaattcaaatacaagatccttaggctaccaggatgatctggactcatcttgtctgttttcctgcttccatggaaactttgtctaaactatcccagagagatgggagcttgtgccacagaatagaatttggggaagtgccctgaggtgtctggtttccatggctaccagctggcgagctggatatgaccaggaagtctcccctctgactaggaaatctggtgggtaccacagccaccataaatgaggccagcctcacaaaatcaggcatttgggcaaaagatcacagtgaagagtagctgtctgagagcataaagccacttaaagagccagctcaagctctcatcccctggtcagtgtttcaggggctcgtgaaacagaatagtctcatcccaatcttgttttacttagtaaggccaaagattcattaattaaccatcagtctcattaaaaagaagagacacaacttcacaaagcaccggggacccacagttctcagagccaggagcagagactgtcgggaaagggaggccgagaatggtgactctgtgacccggcttggggagcaaagcgtccccagaagtcttcctttctttagcacgatgttgaatgctgctctaaaatatgaataataaatggcatgtgggtgagtccattctctaacaactcagagagcgtccgaagcagctgtcatcttatccactccagaagaaaggagcggaactgcaaatgcctttccttatttaacagaaaactgaggtccaccgaagaagaactgacccaagtctgcaaagcagtgagagatttgaaattgaactccgttgtttgacacccagctactcaggcagcctcatacctgatagtttaagcaagggagaataagataccttcccacagaatctccagttactcgccttgcatgacccaaaaaagcagtaatgtttggaaagaatagggaaaccatctcccaatggtctcagtgcctctggttccttcccctgcaatgcaatactgttcccagagtgattttctaaaacttaagtctgcttatgttactctcctggttaaatccttaaatgactccccattgactttaggataaaacccaaaggccttgtaatgagaccaattcatgaattggctcctgcttctcttaccaacgtcatcccttcctctaccccaacacacacacacacacacacacacacacacacacaacagtccatccatcagaagtgctccaatagctatgctttctcttttctccaagatacagtaaggatctcacactgtctgtccagcctttccgacttcagttcctccatagccagataccacctcctccaggatgccttccctgaccatcaggctgaatgaggttcccctgtccgtgctcttgcaaggtacggaggagttcccttagctagcgtatgtcaccacctttcgagtcagtgacccctttccatatgagctgccctagggcagaggctgggaatatccatgtcagtctccccattccctaaaacagtgtctggcacatggtagatgcctaatagatagttaacaattgcctctctctcacctaaagtctgcccctttagttttaatacttttacatatatttatttgcaagcccattttatctcaaccaaggaaaaaacaagggagcagaatcgatagttaattactctgaaaatgattgtcaccagctttatcgacaaaaaatggtatcaatagctcaaatcaacagatgccctagaagtcacttctagctaatgtgtttgcctctgtggtatagatgtacatttgtgcacacacacatacatgtgtgaagagcaatgtggcatgtgcaattacctgtgaggtttgcttttataatttaactgattttgctgattgcgtacatgttagagaatggaggggagaaaatagcaagaagtggaagaaatgagcctgatactacaaattacccaaaggcatacaatccaccagaggg

SEQ ID NO: 55154 - DNA, 861 bp, Bovine  19866880927232
cctgctgtcagcgtcacctgaaagagtggttccgctcagccctccagccagccatcttcgggcaccactgataacagcagggcagggcgggctgccctctctgctccctcgctgtcctcagcaaatcatattaggatggggcagattggcttgcagagcagctaaatggaaatgacatgtagagcgctgtgcaatggagacgcggctgaggagcgtcaaggtgggaagtgatggagagtgggaagggcccctctgcccaggactgcgagtctggcaaggggattccacctggcccttctctttgacaggatgtaaggaccagggtcactcatagcctggtgccggacggggggactggttggccttgcagccctaggctaaatgaagagtaaatggtggtgtcccatcacccccaaagaaatgatgcaattacaaggttggtggccctgctctcatagctgccctgaacacccacccctgtccccagagcaccagggaacattcaccccctccagcctctagaccatcagagccgcaggcatgtcggatgcaaaagttctccagctgttgtagtggagtctgagcttaacatgaggttccagagacaccccttgaagaacagctacttctctaccaggctcctttcccacttccagatccttctggcgattctgttcatctttatttcatgggcacattacaaggaaacacacgagcaggaggggaggccagtgacacagttaaatatacacggcggcagctggcagcagcctcaacttgccagttcaggtgccatgaaatatttatggcgctggagttgtcactgttgggggggggtttctagtctctgtcctgcctcct

SEQ ID NO: 55155 - DNA, 1440 bp, Bovine  19866880974919
ggtgtcgttgttctgctctgttaccaggggacgttctaggtggattctccctaatgtcaagaaactgaatcaggtgatgccatgaagcttcaggatgatctgcgctctgatatttcttctttgtttccctatagcttctatggaattcacacagacacccatggcagctactactgccacagtgtcagccagcccagaaatatcttcacctgtccctacaactacattcgactggagaagcatgaactcaagtacttttagaagcaccagcctctacgatgtctctcaggacagcaatgggaccacagcagtcaccttaggtaaagatttctcatctcaccccagaaggatgctgctggcccttgggtaaagcattaggatatttgcaaaccacctctgtcctccatgttcccccacagatggaaacatacaagctccttttaataatggcttgagtatcatgcttagggaaccctgaagtatgttctagacaattcttcctgtagtgacagctttctccagtcaatgtctgggctgctcgttctgatcagtaactctccttgtactcctgagtccagcttagtgagaaaagaagaatctatgatcttttctaagtaaagcaaaccatgtacaaattgggggtcttttggtgtctctaaggtaccagtttcagcgttcagtttcagcgtcttggagggcatttctaacacattctagattatagctctggtttcaacagctggctggaaatgagttgccaagggttaggacatgaagcaacttttaactccccagattcccttttctgggttgaagtccgagcctatgtgaatgaactgagatgtgtgtgtgtgtgtgtgtgtctgtgtctgtgtctgtgtgtttatgccattgtgcacgtgttcacacttgtgtattggtcagttccagcgtctacagacagtttcacgtctacctctgagaccctcccagcctctggggccgtgaactcttctgtccagtcacagacctctttagccaccacggtgtcttctaccctcatcagctttgcgacttcagaggcgactctgcagcccagcacttttcctggaaatatttcggattccctgtacaatagtaccagccctgtgactttttccattattacctctccatcattttctcctacccaaagtatcctcaaggtgggtgaattgggctaaaaatgacagattacctacccccttacttcatatgtatgcaagctctctcccttccccttaacctctgcttatccaaaccaatgaattttgatcatataggagttcacatgagaattatgcagcttaaatattgctgaaaggggaggaaaagggtagggtttggtggcaagaccgatctgtgccatgggtataatgtttctagagagtagagagtgaagaggattctcagaaatccatc

SEQ ID NO: 55156 - DNA, 1268 bp, Bovine  19866880985457
ctcaggctgcaggagttctccttctaacactgctgtaccatgggcttgccaaataccccattcctttattccccctacccagagcagcactaacagggctgcaaggccagtgtgaactgactgaagatttaagatcatgcaggaagattacagcacaacccagaagagacagcagctaatcttgaaataccaggcattcccatgctaaacagccgggccacaccatcaggagttttcccagccaggtcttttccaccctccactcactaccgtttccctattgctccaagcgcttccctcctctctctatgctttcctgggctcggagtccttcagccttttgtctcttggttcatcaaacacaaagtttcactttattttatcatgctcagcacttcaacttcctgtctgccactgcccagcaacggtttgtgccagggtccaggttttctcaaccaaagactcgttaaggcattttcttaaacaatggagcgggctacctagagatggtgctctccaggaaggtagcaggggtggattctttgtgggttttttccctcttaaatcaggagcagacttccgaatgaagccagaggccttttcctttatgtccaaagggaagtgattcattctagcaggctccagggtgtatgtcctgggacacatgccctggtatatatccctcctcatttctaccacattctcccaagatgcatgcacctttctccttagcaaagtcgagggcccttgagactaaaaagtgtagacactgtgtttttatttcttagctgaggaaggaagagagtgttctcattaggaaagtcaaagcccagaaaaatacggaaattctgccctggcaactctgagcattttcttttggagggtggcgttttattccttttccataccttcagattttcagttcgccacacttggggccatttagtgacatccagcaaagtcattgggagagggagacccaggcaccctcagggtggagctgggtgaccaccccgccatgagcgcaggcctgcgccctcctgcccaaggagctacaggaaatcgggcagcaaggtggtaagaagtggaattgttgctccttttgatttactttcgtaagaacgctaggcctgagtttatttgctgcagtgtggtccttctggccctgagctttggaagacaaagactcttccaaaggagatgagaactagtgagcacagaggcccaggaggtggagccaaagggatgagaaaaagttgcccaggctc

SEQ ID NO: 55157 - DNA, 1206 bp, Bovine  19866881013712
atggcaccggggaccctgactgcctcacatttgagggcagttatggtggccacggatgaggtcaataaaggacatggttgcttccaaggcactgcaaggctttttgggcccaatgtccacaagaacacaaaaatattctccagggttcctcgagaatcccaagctcaagatatgtcactccgtgggtctgtagctattcctgagctctcttcacagggcgctgacagtgacggaagcctgtgggcattgaagggaggcgaggccaggacgggagaggggtgctctggccacgccgtgctcctaccttcagaatgataggggatcctggcttctgatccaagactcctgtagggctgagaagttcaaaggtcgggttggggtagtagatgaacttggtgtcattgtaaatcagcaaggactggacgttgttaaagacaaatccaaactcgtctggccgctccacggtgtccaggccaggccgatagtccgtggtcagcgagggtgccaggcaggtcagggtggtggtgttcacaactttgcacacctaaggggaccagagcgcagcattccaacacccagccggcaacactgcggggtcacactcccattgtcccaccttctgctttgttagccggtctccagtgagctacttacttcgggaaaagagctgtgaaattgtatttttctgttgttggttttgtgtgtgcgtgaaggaggaggggtgtgttttaacttcacttcttcactcgcccacactgactgagcacctacaggcgctgtgcccaggagctgggccatcagtgaaaaggccccagtccagggtggagacaaggatccaaccagcatcacagggtggtcccagcagagggcctgtggcccaggaggggccgtggcactgctaaaggcacagatggagtgagaaacgcccggacgggcagtccctggcactctaggggtgcctgtgtgtgtgcaccagcctgtgtgcgtgtgtgtgtgcgcgcgcgtggcctgggcagggtgagggtgactcatgggagctttcctttggaaacaatgaatgaaatttaacctggagaatgtgtaggactttcccagacagcagggatggtaaaggatcaagttccaggcagagaaaaacagtagcaaaggcctgggaatgagggagcctgaacaaatgaggaaaagataagaacagaagccgtgtcc

SEQ ID NO: 55158 - DNA, 1833 bp, Bovine  19866881041253
cacacacacacacacacacacactttcacaaggaagcggatagggtgtggtactcaaagtcaagtgcgtgtggaggaccctggggggtcttcctgcccgagataaacatctgcacagctccctgcagcacctcataccaccagggtcttcaactctagaactgcatgtgtattttcaggcactaacattaatatcagtatttttaaacattcttttaagattaaaaatacaaataataactcaccctcccccaaaaaacttactctaagattgctgctggtttcccacttgcacatgagcatagacggggtgagggagtaaataacacagatctcctgcctgacctcctgctggctgccccagagaaagaggggttcggaggctgagtttgaggagggacccaggaaagatctgacgacccttctgcctggcctgcaagcaactggacaaggatctaaacaatggattctctccacctctttttagagaaacagcttacaaaagcaagaagaaaattcaggatcatattccaacctcctcatggtacagaagggaagacagaggtccgggaaggaattcagtgttgtctaagctcagggatccagtgtctcccgactccagtcttctttcctcctcacccactccatctctttaggcctggagggggcggtagagaaggaggggggagggaagagccccccttggggaagatgcagagagccacagaagaacattacataaagcacagaaactccttctccggctgaagtttcctccacaacccagacctccctcccaaaaagtccaaggtgccccccgcctgccccagcccctctgctgatctacttaacccagcgacactggtgctcctgcgctttgatcctgcaggcgtcaggagctttttgttctattattcactgcagggtggatgctgggttgtctctcctcattacaggctatggctggactgcccaccacctccccaaggccaccggaagatgtccatcaataagtcagtaacagcgactggatgtgagaagccttctggggcaagagttggcaccatttcagaatcagagttttcaacaagcctcttttttaggaggagagctggagaggaaagcaataagcataaaaactatagaagtgcaggtagagatgccatgagacacgtctctgcccagctgatcgggcagcttcggaaggcgggtcttgctcgtagggctatgtgtgtcccccagagcagccgacacacagtgagacaccaccggtgtttatgtaacaagtgagtgtgtgagcgggcttctcctcccaaccctcaagaccatcttctccaagaaggagcacagagcttctcggcacttctaactgcacaccgtgatgggacaggtctggctgtctatccacgatccacacatacacaccagagggtataaggtctaggcagtcattcccttctgttcacagctgcatccttagcacccagcaccatgcccagctcatagcaggccctcaaccaatgtgtacaataaattcataaattgggtgtcagacccgagacctatttccaggtcagctgccagcttgctgagtaacccgggccagtcacttcccctctctgggtctcagtttgtccctctctgtactgagggctgtgtgccagaagatctccagtgaggtcatccagtctagacatttcttaggaagatgaaaaacgggcgtgaccatacacagtcatgcggtgactcttccaaaactcatgttctgtcccttgcatcgttatgggagcttccatcaccaggcctctgataacctatggggaagcaggtgatg

SEQ ID NO: 55159 - DNA, 811 bp, Bovine  19866881122312
gctgaaaattccttatgcccagaggcaggactttacagtccaggaaacaaataaagagccccgtccaggctggtaagaatcttgtgaggttgcctctagactgaatcctcactgtctaaacagaaagaacccccaccaatggcaggggccacagggagtttcaatgacaaggacataagttccagcaatcagttttgcagattgccgctggtgatctctgggtggcagcgggtgcaggaggaagaaaactgctgggtcctctctctggattcgctggagccagcgtaggttcacggggcgggtgtgtgggtctgcgcgggcagcacatgttagtccccacgcctgcacttctccgaggcccagtgtcccggactggtggccgcagtggctgggctggtgtggggtgactcggccctgcctccgctgacactcaccccaggtccctccccttctctccagccggtgcccatcgatgacaacttctgtggactggacatcaaccagccactcggaggctcggtcccagtggagggcctgaccctgtacgccaccagccgggaccgcatgacctcagtggcctcctacgtttacaacggctacagcgtggtgttcgtggggacaaaaagcggcaagctgaaaaaggtaagggtctgagcctggatgtcccgatgctgtaactagaggcaacttggttttcttgggggtggggttagttaaaatggggacagcactagggggtaatccgtggtttatcttccagctagttcctctagctgttgggcaatgagtgtcttgggaatatacacatatt

SEQ ID NO: 55160 - DNA, 1094 bp, Bovine  19866881169381
catggggttgcaaaaagttggacacaactgagtgactgaacaacagcatcccgttaatgcactgctcatgcaagcctatgaaggagagaggagcatcagcataaccacttcacagacataggcaggcttgaggtgaaatattttggagaaagcactgatttggaagtgggccttggacgtgatcctggagttacatccctctctctgcggctctgctgccgggagtgagaggtgccaccaagtgatgccagcaaggacagaaccccgactctggaggtcagtctccctgcaccaggcaggctccggccacacccagcatacactgtcaccacttccggaatgggggtgcagtgtaaggagctcaagtcagacttgcattcttggggacaccctgtgagaaaggaagaggcctggctaggagccctccacccaatgccccttggctcctgtccagccctggggagaggctgaggactggagatggctcacgggcaggtgtggcaggtaagaagaatccagaaacagggctttgcaggcagagaggctggggtgccaaagtcccctccccacctgacctgctcttatctgtggggaagaaaacctatacttgccacctccccttctaagacccttgcttccatggtcccagcagctggcccgagatcgcaggcagaccctacctgcctctgactgctctgtcttctccagctctctaccccggctccgcgggctctgagtcccagccctggcagatcactgattaattcagggctgtttaataacccttctatttcgatgaaacaagctgtctcgttttctttatttttaacaccgactttcgtttctttgctaagcatcttactgtcatttaaatttctctgtctccaaccaagctgataatagactggagtgagcagctgcttccatcctgtttatgacagtgattagaagttagagctgtgcaggcagagagctgaccatgcacgcggctctgcccctgcttgtagacagagggctcacttggacacgattaggacaattctggctccaggagaggccagggcttatcccagtcctccagccttcctggcacc

SEQ ID NO: 55161 - DNA, 1774 bp, Bovine  19866881191524
tatccaaacacgggagctttgagaggattggttggggtgggacttgggagattcctctcaggatgtcctaacctgggagagctagcacagcagtcgtctgaagaccccagagtgaagctggaggactggaactggagaaagaatggcaaggccctggagtgttctcagctcttctctccaaaactctgtgtccaaacatatgactttagtcatttgccagctaatctgactcactgtgtgtgtgtttgcttcacaactagaacatagtcttctccaaggaggtcttgagtctgccacacagcttgtcagtaactcccctgttcctgcatttctcacttggaacacgagtagcttctagtctggtctcctgataaccatttttttgttgttggtggtggtggtggtggtgtttcttcttctctttattcagacatcaggcagagatactgtatgaagaattaaaacggaggcatttcattctcttgttgaaaactcttcagtgattgtcctttgctctaaaataagatccaaactcctcactgtgatctggagacctggctgggctggactcttacttgtctctcagtctcctctcttgatctcacctccttgccctgtctccccaccattctggccgtttggggttcctaaaacctcccaaggtcttttcccaccttaactcttgacgcaagctgtttctttgtctgactgctcctctttctgtaacccggctcatcgtcccatcctccctgaccaccccatggaaataagcacccccacccccagtcacttttctctctcacagcccaccccaccttgaaacatgcattcatgctgcatatcacagtctacaaccacacacttacttgttggctccttgtctttctcttctgactgtaagcgacacagtagcagacatcatgtgtctgctgtgcctgggaacagtgcagatgggtaacagaccctctcaatatttactgggtgaatgaatgcactacctctttattttcctttgaggagtctccacttgcccagacatcagtaaaagaaaacgttttaatgctagggacaaacataggattatcacatgctattatcgttgtttcagaaaaacaaggtcatttttacaacctcaaggtgaggggagcctaaactcaaaagaaagccctttctacagaggcacagttggtgatcttatcctaatttcttcagtttcctgtgaaaaatgtcacagataagcccacgtcttctgactgcgtttggaaaccttagccccatctcacagttcctacaacccatgacagcgcccaacgtcggttaggtgttcagactctgaacatccgggtggacccaagtgaatccttgcccctccgtggggcccagtcctggcatctgccgtgtgatagggctcagagagatggttgccaaggtgactccggctccaaccgtacccacccaccggcttccctctaagaggcaggctgagccatgcctgctgccgaggggactaagcggggtgggcggctggtgtctgagccgtaagctactgccagacgcgggagggggggggggtcgtctccttgtgtgccgggcagccaagggcgagaggggaagcagccagagtgggtggccagttcctgtctctgacccttgggggcagtgcctgcagctcctgccaggctcccacaccttggctaagaatagctcagctccttcctgccggcctgcaggccgccggagcccagaggaaagagagcggactatataacctcag

SEQ ID NO: 55162 - DNA, 1775 bp, Bovine  19866881267134
ggttagttttccagcacacaaggctggaaacccctcaaccccgacacactgggtcttgctcctccccttctgcactgcggccacttccggaggagccattttcatgccgttgtccacaggaacagagctgctgagtcccggccatgctcagcccgagcacagtgttctgcctctctacttccttcacgttatccatcctgagcctctgtggctccattcagccttgctgtgtgtgctcagaaatggaaaatgcttctgctgaggcgaaaagagctccctgcctccttgcgggcacacctgcccctatcctccccctcagacggcatacaggaggctgccatgttttgaaggaaagggaagtttctcgctgttatggaagaaagaacaactctgctcaaaggtctgacaccagcacagccgaggagagtgttctggctctcagaggtctgattctcacagcctgagacctctggtgattcccagctgggaagtctgcaaaatttgtaccctaaagggtggggccatcttggatgaagatggtgaactaggaggagtccgaaaaattcataggaattggggctgtccttgacccattcccccgacccgccgcctctgaggtggtctcttttaggcgtagccctaactcagaagataagcagtaggagaggggtgaagggagaaatgttcccagagccaggccccaaccaaccaccttattttatgtgatggttttaagaaagaaaagacctccatggaaagtgcaacaatcaatagtttgggacagatgtttcctttccagccaccttttcctgccccaagctaaaaataaccaccctctgtgctttggcttccatcaaatgtgtgtcattaaagttgtccgtttgggtttccagagacaaagactgatggattcctggatttcccagcctgttgggccatgtgctacatgcagtattgggtgcaagatgactctagccccccgaggtgattcttgggtcccagacatcacttccctgctcctacctttaggtagcaccacagagtttccaagtgaggaagtgcagtttgccaagtagctccacttctgttactccaaataaatccttcacgttggcattttcttgaatccattacactccagcccccagggtagccttgacccttcctgtactctggctttactggaaatacaaatgttatctggtcgcactcaagagggatgctgagataggcctgccctggcaggaagatttattggaaacctagaagagacacaagggacataagcagagccaacagcagaggtagagacacactcacattcacagggcacggatttctgccccattctcagagggctgcttcccgcggcttagaaatgttttctccaagtgccctcattgctgacatatatattcgctcttaagccaagctgttttctgttatcacgtggctgctccttcagacaacctaggtcctaacaaatcttaagaggactacagtaaaaatcagcacatttattttccttttcacgatgcaaatagctttatttgtcattttttgtttgtgaaagtaacacatcattattgtaaaaaataaaataaaaaagggccatgctgtacacagaagtgaagaaggcagcatttgcccctaactctgccagccagagataaccatgtgacagcttatagcctttcatacactgaccttttctcccttcccaccgcaaaatatcaccacaccgcgatgtgcttgttcccacatgcgtgtcttat

SEQ ID NO: 55163 - DNA, 1313 bp, Bovine  19866881396391
tgtgaggggagcgcggcggcagcaggcagggaaggcccctcgcctggggctgccccgagggctggccgtcaggatcagctttcttccttctggacacgggggccggcccctgtactgacgcttgccctccgaccactgctggctgacggggagtcagctggtggatctggagccagacgatacaagggctgatgtgagagggtgaggcggggggaaggctgatggggctgaggatgccctgcgggatgtcttaaaagcctgccaggaccagagcagtggaaaccactctgaatgggtcccacaccctctaccctgagccacaagccctcagccagccccgcctggaggtcgaggtggcaggggcttcctgtcctggccttgctagtcatttgcagtgagacctcggcaaagcggcttaacctctttaagcctccctcatttttaaaacggagcccaccatacccatctcacttcatcctgcctgctcatcagggagcagagcccttctgagctcctattttcagctccggcctttccaacaaatcaacttcccagtaattaacgtgaagaagtcattattgtttgttcccagggttaggtccagttctttaaaaaccaatagtgatgtgtgagagccctttaaatcctcataaagtaaacgccaatccagccccctgaccatcctctgagctgcgaaagtcacgtgaccaatagcatcaagaaggaggcgtgaacctcccaggaagccagctggagttcctggaccctgtgatcgccaccaaagcaacatgcaaccttctgaccagaagctgaccctggggctgtctcccaagaactcctgactatctggacacccgagggcggagtgaagctcaaagagaaaaatctatttttaatgacttgggggagaagagtggagtggctgagtagttcggagtaattaaagctatctatcattctgagaatgggagccaaagttcgtcgaacttttcaatgatatatatttttttccccttctcattcataaaacccagcagagggtcatgtgggagtcaaaggggaaaggatgatggggaaagcaatttctggccccaaacagtggaattcatgctattgatgaacacttgggtaatgatggcccctcttgaatccttttggtagaggccctatttactttgtcctggttaagaagtggggctttgaaggagacagtcctcagtttcaaatccagctgctatggtgatcaatgaataaagggtcctcattgacctcctcgtgcctcagtttcctcctctgtaacatgctgacaataa

SEQ ID NO: 55164 - DNA, 1410 bp, Bovine  19866881408315
atgatctgaatgagtacagtgggagtgtgggtgaagtttatttcttacttattctgtttcccatgggtgctgagtcactcagtcgtgtccgactctttgtgaccccatgaacagtagcccaccaggctcctctgtccatgggattctccaggcaagaatactggaaatgggttgaaattacatgggttgccatttccttctccagtgtttcccattccagccaccagcttttacaaatgtaatgactgtaatttaaaaagtactgtactcttgagcttctcttccacaatcactcttgtgggcagacaaagaactctctcaccctcttgtctcagcagaccctcttctttccagccctaactcaactatcctccactggcgaccctttcactcccctgcgtttgcccggttaggaagtagaggggccctcacacggtatgcattgttgtggccaccccacccacaggacccagcacccagggagaaggagcagtgattccccaggctttggcattggcacagtctgcctgggttcatgtatgatgctggctaacgatcgtgggaagctctccactgagccaagtatgctgcaagagtgaaggttctgtcgtggccaccactgtctctccaaagcagattcaacaaatattgaatgaatgaagaatgaatgaacacttctttctgtgaaatgggatgaagtactcccgtttgacagagtgttgtgagaaccgaatgcagtgatgtgagcacacgggcccctcgtagatgccggatgaacactggtacccatgccgcagccggctgacccccgacgggggccttggtctccctgctctcctatggtagacagctttgctgaagctatgcatggcttagccttgtctctctgagttttccccgatggtctgaaacacgtggctttcctcttcttgtttttcttttggtttcctccgaatcgattctgccactagtgaagggcagtaaattaataactagctttccccccacgacaccaagcccaacaactaattggctcgatatctccccgttgctgtgtcactttgggattttctgggtgagatataaataagccgattctattaataagccatttggccaagggaagaaaatactcttccgagatccccaggggcctggggaagccgcccggtggcccgtggagcgaaaaacttgattacaggaatgaagcatgccgcctccgtgcccgcctccctgcaaagctgtcctcccagcagagtcctctcgggtcctgggggggcaggggagggaaagctttgttaagtttaaaaattataatttagataaatctgcacattcattggtctgagcgagtctctggaaaataatagttagcagggtagaacctgccgcatttcagggctttattgt

SEQ ID NO: 55165 - DNA, 818 bp, Bovine  19866881787089
ataattcctgctggttgctaagatgatcagctgaacatttccttcactctcctgggcagagccatgtaatttaatatttttttccccactgtggatttttgtgatgttaaaaaaagttctctatcgtcagagcagaatgtctgctatgttgttataaattttttagtttgttctactggctccatctttctcttttcagtcaatatgctctgaaacattattgtattcataattatagtccaggagatgctattatggccatcatttttcacatgagttactattattacttctttgaccttctggagattgacgaggctgagatggagatggaaaaggtggtgttgcatcgaccctctttttcctgacgcattcccagcatgcttggggcttccctgggaaacagaaatacacaaaatgacggacttgccggaaggctagatctggaaaggtctcggagatcatctggtccaaacttctcctcgtgtagcttagaaaatagggccagaagggagtaatgacttgcccccagacatgaaggcggcaggtggtagggccaagctcagtcccacacatctgactcttcgtagctagactatgtgagatgctggtgggcttgacattccatcgtgccagaagtgtgggatgccagtctgttacctccagtgcccatcgtggtaacagctctgtaggctagacgagcacatggctctgtgtcccagtgaagagcttgatatctgagcaaaagagactgtgtcccctctccactttcaggctgaggccacagcccacctccacctgtctgctgtctctaggaa

SEQ ID NO: 55166 - DNA, 2105 bp, Bovine  19866880124144
aatcgcagcacgccggcctccctgtcctcaccaactcccggagttcactcagactcacgtccatcgaatcagtgatgccatccagccatctcatcctctgtcgttcccttctcctcctgcccccaatccctcccagcatcagagtcttttccaatgagtcaattcttcgcatgaggtggccaaagtcctggagtttcagctttagcatcattccttccaaagaacacccagggctgatctccttcagaatggactggttggatctccttgcagtccaagggactctcaagagtcttctccaacaccacagttcaaaagcatcaattcttcagtgctcagctttcttcacagtccaactctctcatccatacacaatcactgaaaaaccatagccttgactagacatcaccaaatgtccactgggggcaaaatctccacggtggagaaccactggtctaagcaaatgatttttaatatgtgtaaataaagatatgtgtgtgtgtgtgcatgcgcatgagcacacacatacatatatgtcctagttctattgagaggagctggaagcaataacactgtcatagctatgagtacatttatcacccaggtcttgggttctaactaccattcttgactaaaaaggaagcagagttccttggggaaatggcttctctataaaatccaatactgggccctggaaaatataagatgatcctggaacttcttgttatgtcatgaagtaaggaaaagctcaagaaatgctgggaaatatcaaaatgacataagggtttgcctgaaggtactccctctgaccaaatatggggcaaaagattcagaaaatttcagcagcaacgtaaatagaattgaataaaataagaatatatagtcaatactaaataaataagttttttttttttacagtagaatatcaatcagtgaacctagaaatgatgatgattctatcattagaagataacataggctggttaataattgattcaggcaagaataactaataggtgctaaaaccagggggtgagagtggatgaataacagtatgtttacatcataaaatttttggaaagtcaatgtcttgattgaagggcatattattcttgtataaatgcctttattgaaagaaatctaaattatggtacattccatattcaaatgagcatatataattatactaatcagcatcaatgcctggaaaaataaatatttgttgaatgaatgatgcatcctcactaagcatgataaacggctgttgctttggtctaagaatcagaaatgtgccattgtgacacacgaggatagcagtcagctgcaactgccttagcctaaacagatgtttactacatcatgaaagaagttttaaatgttaggcttcagctatgcatatgatttagtgttttgatgctgaaagaaacattcctatggaataagtaagacaagactgaattgttcttttatattcattatcttttatttttttcatatttgaaaattcactgttttctgtatattctttatggagttcatatgatagtatgttggagtgtcttaatttacttttcctgttttttaaaaaatttttattggagtatagttgctttacaatgttatatttctactgcacagcaaaatgaattggccatacatagacataacccctcccttttggatttccttcccattcaggtcaccacagtgcattaagtagagttcctctgcagccaaaggggcaaggtaaaatcccacaagaccagataaatgaagctattaatgtcttgtctttgaatatgaagtccactggagtaaattgataggataccagcaggtgaatttaaggaaggcaaatgtaaaatgtccaagggacactaggtcactaagcagcatgtatacatttaaaaaatgtaatgttagaatcatgtaggtctgtacttgtacatcaataaagtttcttcccatggggatactttcacaaagctgagacgatctgacttgtaaaccagtgacatacagaagacaaacttgaagatagacctgcttaagggttttccactcctccatggccttccccgtcattgacagtgtctccttacttc

SEQ ID NO: 55167 - DNA, 2313 bp, Bovine  19866880254798
ttctttgggattggaatgaaaactgaccttttccagtcctgtggccactgctgagttttccaaatttgctggcatattgagtgcagcactttcacagcatcatcttttaggatttgaaatagctcaactggaattccatcacctcctctagctttgttcatagtggtgcttcctaaggcccacttgacttcacattccaggatgtctggctctaggtgagtgatcacatcatcgtggttatctgggtcatgaagatcttttttgtatggttttctgtgtattattgccacctcttcttaatatcttctgcttctattaggtccatactgtattaacactagtcaaaagaaagcaggagtgaacttccctgatggtccagtggttaagaatccacgtaccaatgcagaggacacaggttcaatccctggtctaggaagatcccacattgccatggaacaactaagtctgtgcacaactactgaagcccacgtgcctagagcccatgcaccacaagagaagcccccacagtgagcagcctgtgcaccacaactagagagcagcccctgcttgaagcagctagagagaagccttcaagcagcagtgaagacccagagcagccaaaaataaaaaaaaaaaaagcaggagcctgctatattaatttcggacagaggagccttcagagtaagaaaaattatcagagataaggaaggatattacattatattacatataacatgaataaatctctctgaagagtgaagtctcaagaaagcaattatactatcttttctttaaagataaagagaaaatcatcctaattttttaaatgtacttcaaacatttcccctgcagttagcaattctatatcaccgaattcatgccctgacacttggccatatctgtaggaatgttaaacattatatgcctaatagcaacccccaaacttcaaatgagctatttttatcatgttattaaaaagttgaacatttaataaattattgctgttccccagtaaactgagtaatttcttttaaatacatccccccaaagagctggcagccccaattttggtggtgcttaaaattccaaaccatacccattctcgaaggtcactatgtagttaactgctatgaaataaataagcattaaaaattgatgttaatgattgttttcaacctttccataagaaatttgctatcaagcagagattacttgtttcttcagtctctaattataattctttttataattttgctggtagtcattcatttagataggatcttaaaatacaaaactgggtagatgagatttcttaaagacagctggggttttttttttaatattttaaatttttaaaaattatctagtgataaggtaagacttgttttcacattgaatggctattacaatccatctcccactttcccaaataaacagattgataaatgacactagcctaacaaaaagtgaaaaaagaaagaaaatagagcaagagaaacaaagagatagtgcaaagagaagaagattaaaagactttgtaagatgggcttcctggtggcacagtggataagaacctgccagccaacgcatggattccatccctggtctgggaaaatcccacatgccttggagtaaataaccccatgtaccacagctactgagcctgtgctctagagccagcaagccaccaactaccgaaccccgtgcaccctagagcccaagctcagaaacaaaagagaagccaccaggatgagaagcccacccacctcaatgaagagtagcccccgcctgctgcaactagagaaagcccacacaacgcaacgaagacccagtgcagccaaaaataaaagtaaattaattaaaaaaaaaagactttgtaagaggctgaaactcaatatcactttttgaaaccatcacgatttaggaactaaatctaacatagcagagtccatctagctgattcatctcttaaaaggtagacttgtaaactcagggtgctattcagtgctccctattgaaacaaaagaaaaagttagtaactcattactaaaaagataagatgcactgataacctatctacttcaagaaaaggaatccaaatggaggatcacagaccttcctcacttattcgcaggcagggaccacgcacagaggaaggctgtctggaggtcactagattaaatactatggcagcaccaagccagggtccatgaatgcatgggggttttgaagcaagacttcaaaacttcctttaggctaataaagcaatgtctcatctccacccaacattagctgtgtgctttatgtggctca

SEQ ID NO: 55168 - DNA, 1376 bp, Bovine  19866880449482
cgaggaagagatggctggatggcatcactgacttgatggacatgagtttgagtgaactccgggagttggtgatggacagggaggcctggtgtgccgcagttcatggggtcacaaagagtcggacacgactgagtgactgaactgaactgaactgagctgtttgggtattttaattggaaattaatcccttgtcaatcatatggtttgcaaatattttcttacagtctgtaggttctagattttgttaacgtggggttaattaactatgactgttttgcagcctaagaggtcaagatgtttatttctatctttattttcacttaaaaaaaaaatctctcctccaattaaaaataaataaatttttataaagtaaattaaaaaattctctaaaaggtacatcactttttttttttaactggttagtccagcatttatacctcacctcccatatgtttgcagtacacatttgctatgatttgtgacaatgacatttgttgtaacacagcatttaacagttgtccctaagtacaaaatatgttcagcaccaagaggctctttctttggaggactttttattgttgttggagccagtaggatcaagctatgtagtaacaagaaaactagaatgaaatctcctttttagttaccctgttttcctagaccccagggtttatgcaaacaaatcatcttatatgttctctaggagacgaaaatgaaatctgtgatcagttaatgaaatcacatttttatatgaaataagggagggataaattgcttgagtacagtaggattcaactcatcttaaattgggcaatttcacttttgtgatatatttgcttcgtcctgctctgaaaaacaaagttctgttgctctacctacaatgacaaatattattcaaacttgccaatattattaagcactgattacacgcccacatgctaacacaacaaatctgctagtttctctgcatgtgcctccgtcttaacacagacaagatagaaagagggccattattttttggccataccacgtggcatgtgcatgcatgctaagtcgcttcagtcatgtctgactctttgtgaccgcatggactgtagcctgccaggctcctctgtccatgggattctccaggcaagtcattaccggatcctaattccccgaccagggatcgaacctgtgcccactgctggtggaagtgcagagtctaaccactggacctcagggaattcccaatgagagggccttttatcaaagatatttaatcctagaatcttgctttacatagtctatacataagaggccctttagatgagatgcattaaaacattaaataaacatcagttttgaatacagcctccttagtggcaagctgacag

SEQ ID NO: 55169 - DNA, 4656 bp, Bovine  19866880472632
gtggacaggggtttgggtgaactccgggaagttggtgatggacagggtaggcctggcgtgctgcaattcatggggttgcaaatagtcggacacgactgaacaattgaactgaactgaactgaatatttcatcatccatttttaagtgtacagttgggtagcattaagaacttttatagggttgtacaactgtcaccatcatctaaccacaaaactgtatcatcatcttaaactgaaactctgtacccattgaacactaactccccatccttccttccctgaccatcttactttctgtctctatgagttcgatgactcttaagtacctcacataagtggaatcatagtgtttggcttgttttgcttagcataatgtcttcaaggttcatccatgttgcagcatgtgtcagaatttccttgctttaatattacttaataatattccatcaatctattcaccacattttgtttattcattcatccatcaacagacacttgggttgcttctacctgttaactattgtgaataacactgctataacactgtgtacaaatatctgtttgagtccctgctttcaattcttttgagtatatacttgaaagtagaaatcttactttaacagaagtacttaacttttctatttcatttcttagcaatcaagctaccagcaactttggggaccaatataataaaaacaaactgtcattatttttcctccaaaaagatactctattgatcatttaaggtaagttttagggacacccaataatgtagtatttcaggaactattattgctatggctgaaaacagaaaaatacttctatcgtttggtgaaaagcatagtaataaatctgagtataattttactgctctagtgattgcaaaacagtaatgtaattaaaacttgatacagtaacattgagactaaattggattgccacgattaagacatccaggaaaataattctacaagcagttagagattacagaaagactgttgacaggagtgtcagtctatgaactggttaaggaaagaaataatgtcatcactaaggaagacaggatgacaattcaaatgtaccagttagtaaagagtcctaattctaaggagggatgtaaatgctgctttgagctgaagggagagtgtttctttcaatttaaaaagtgttggggcagaagagatgttcttacacagatgtaagctgacactgataaatcggagtcattaaagcctgtgtgaaagtcttttgatagattttttcataaagtgcttcacattctgacttaactcgaggaagagaaaaacgcaactaaagacagtcttaaataattcttttagtgctggttttcttctaatcccccttgttggatgctctgtgtctacactcacttctagcctttcagaaggtctcaaggaagacctccctcccgtccatgtgtgagtcttcagttgtttagaacacaggtgtcaagccctagctaagcctcccttctcctggtgacacgtcctccttcgtctggtccttgtatgtcaagatttataggtgctccactaccttgataactcatctctaaagtgggtccaatttgttattttttctttgacaacagagtacctggatccaaactcaacctttcaaatatgtgctgacaagagtggaatacagaatggctattgctttctgttctgtagaaaatcatcttggggtgaagtctaaaaagctttggaattattgtttggcttgtagtcaccctttcggcttctggtaagcttcctttggacaacttttatttatttattattttttaaacttattatatactccaataagcttattggagtatagctgattaacaatgtcctgatagtttcaggtagacagcaaagggactcagccatacatatatgtgagtcccccaaactcccttctcatccaggctgccacataacattgaatagagttccatgttctatacagtaggaccttgttggttatccattttaaatgaagcaatgtgtacatgccttcggacagcttttagatcttcacctcaaaggatgttaagttgttaatgatttttgatcgttttcttcctgtgaaattgacaccaaggtttatcccatcaaccccatacaatgtatgcaatatatgcgctctgttccttctttttttttggtcgcactgggtcctcattgctgtgagtgggctttctctagttgcagcgagtggaggctgctcttggttgcggtgagcagcttctcattgtgatggcttctcttgctgtggagcacagggtccaggctgcgtgggttttagaagttgcggcacacgagctcagttgttgtagatcgagggcttagttgttccacagcaagtggaatcttcccagaacagggatcaaatccacattggcgggtggattcccatccactgtgctgccaggcaagtccacgtcagctattcttgctggttgtgtcatcagcagatatgatagcagaagcaagtgtaataaaacccaagtcagtgagtgttacgaagttctgtgctttaccttcaatgtcttattcagttagcacaccaatattatgaatcaatctaacagttatgaagcattattattcctattttatagatgaggaaactgaggctgatgagtttgtaaacttagaattggaagcttggcctctctaatttctgtcatcttaactaccctgtggcttccccataagcgtgccacgtattttcttaccccatcacctgtaaaatgattgactaggatcgggcaaatccattgtctttggagttggctcagtccattaacagcacagtctttgtcaggctctttatcgtgtatctctgtgacccagcccatgcttctctgatgtcagttttttcctgcaagcctattgggatctactgtgtaaatgttttgaatgcagttccattcctctgatatgtctcaaccagttcagagaggaaaaatataggcagtcctatatgttcctttttagtcagtctatgctggctccttcttttctaaatcatcataaaccatctatttaaaaatccattctgaagttgccccagggatttacattagatcaactatctggaacttttagaatcctttctttagaaaactgagataatatttacttcttttctggcactttccctatggtttctaaaatattaccagtattgattctacaattacatctgcattcctttagatggaaattaaattttcttggctttttgtatttgcttcttatttgtggcagttacctagttttggttctaagttgggcttaggtaggtggccatattctttttgtatgaccaattcaactaagttttagctcagaaagctattacgtattgggcaagtatattgtaaccaaatgtaaaacatggttcctagacatttagggctgcttcttacctatgcagtactcctgtacagactaggaaaaagatgcccctttctcaaataaaaaagtgcttagataattatattatgatgtaacatgactaatttatggtagatcccatcctggacttggctctttggctttagctatacaatacaaatgctcacattttgacccaatctcacataagacagaaccatttcagatcaatgactgctgtgactggaggcacggtttccacacctcactcagactggtaagaatgatgattccgatacaccatgataagttataattcctaaaactaccactaaaaagctatacaagaagatacactaaaaaacactaccgatatatcaaaatggaattctaaacaatattcaagtttcccctaacaaatcaggaaaaaacccagggaaacaaaaaagtaaaaactaaccagaaaatcagaaaattaagaaaatcaaatggaagccttaaatcctaaaatagtaattaaattaaatgtaactagttgaatgcacggattaaaagagttgcaggcaggattaaagaacatgacccaactataagctgtctaatgatgaacctagacagcatattaaaaagcagagacatcactttgctgacaaaggttcctatagtcaaagctatggtttatccagtagtcatgtatggatgtgagagttagaccataaagaaagctgagcactgaagaactgatgcttttgaactgtggtgttggagaagactcttgcgagtcccttggacagcaaggagatcaaaccagtcaatcctaaaggaaatcaaccctgagtattcattggaaggattaatattgaagctgaagctccaataatttggccacctgatgtgaagagctgactcattggaaaagaccctgatgctgggaaagattgagggcaggagggaaagggagcaacagaagatgaaatggttggatggtatgcatcactgactcggtggatgtgagtgtgaaactctaggagacagtgaaggacagggaagcttggtgtgcctgcagtccctggggtcgcaaagagtcggacacaaatgagcgactgaacaacaataaaaagaaggaacatacttcaaatataaagatataaactgaaaacgaaaagagaaaaagttgtaccatgcaaacagtaatcaaaggaaaacaatagtgactattaatatcagataaagaaatttta

SEQ ID NO: 55170 - DNA, 1299 bp, Bovine  19866880562812
catgatttcctaggaatgaatggctcaaaaattttctctgaacgtgagacaggttagcatagttgccagacaagctggtaccttgatagaaagagggtgttcctgtccagaggttttcagtggatgctatgaagtccaaattcaacagaaaaactgctcacacagaaataccgaaagttaagagagatactgcttttcttggaacaaaatacaattagtctgttgtcagctagaacggcttgacgtcctgttctcagagaattgctgaaggaactaggtcttttgaagacagaacaaagaagactcagggacaaacaatagttttcatcaaacatttgagagactgccttgtagaagaaaattttgatttatttcacacaactctatatttaaattaaagagaggtgggcttggattcacaatagagaagaatcttctccaaagggcgtcaagaatggaaactgcttctagagtgaaagttcaggaatcctttctaggggtcatttggtaatgtgcaagaatcttatcccattggcccagcaagcccaggaatttctactgaacaaataactggatgtttcttgaggtatttgtaacagtgaaagatttgggtaggttattaagtaaataaaggaaaagaaaaaagaaatatggggtaaaaaacaaagcaaaatgggggcaatggaacagaaactactattctaagcacagggctggaaaggagcgtgagatattattaggaaagcaccagtcaaaatagggttgaatgcagaccactgaggcagtggcccaatttttttgttaattagatgagagaattgtgattgctaaaataaaacttagattgagaatctctagtgaagtgaggtcaacaaaaatagctaatagatgggaaattactttagtcatttgcaagtgaagaaatctattactaatggatgttaaatggtttgtaatgtagagaaaggaaacagattcctgtacaggttattagtcactacaatgctgcattaatagagggcttcaggatgtagtatactaggcaaatgctgggtttggaagtgtgcattctgtgttagacaatagtccaaatgtttgtgatctaaatggcaaacaagtctctgcagaattatttaaaatcagaatatttaaattatttgaagatactaagatttacttgaatgtcttttttttttttttactgaagaagagtgcataatgtttgggaatacaaaccagaaaaaaatttgcacattttcttgaaaaagacttttatgacattattcataaggtgaaaaa

SEQ ID NO: 55171 - DNA, 1169 bp, Bovine  19866880574322
gaaaaatggacctttgttggcaaagtaatgtctctgctttttaatatgctgtctggtccagggcaggatgtgcgtatttggaggtgtgtgtatgcaaaggaaaacaagatctttcatctatatttcatttatggtatgggaatgggagcagatggatttgaataatagcctctggcctttcttatccccacttggtggaaccatctccttctttccttgtaacacagagaccctccaggacacacttaatgtttaagggaggaaatgatgacattaaaatgtgcttgtagggagttccctagcagtccagtggataggactcgttgctttcactgccagggccctgggttctatcgctggtaggggaacttagatcctgcaagccatgctgagcagcaagggaaaaaaaaagtgcttgtgaatgacacctgccatttcagcaggtttctgaacacacagattgaacacaagtgtggaaggaaagcttgagtgcccatgatgggacctgttccctatttctagaaaccaatgcctgcttttgtttcttcaccaaaattacctctattcctatacagttctgagtttttaacatctcccttgcttcacatgttaaagcttcacaggttaaagcctcaaactggcaggaacaagcctgtgggaaagaagcattgttctctctttaaacactgtgtcaactgctacaaaagacctcttttgattgtgactacttaaataggtaaacatttgggcttgcagcaatttgggcctttttgactaagcaggatgttaaaaacaaaaagccaaaattgaggcagcatcttctgacagcctcttcaaggaccagagacttggcaagacctttggtagtcagaaaccagcacctgccaacccagaggctttggatcaatccaactgctctcagcttccctggaggacggcacagacgagcacccaccctccctattatactcaacaatctcttttctttgccaagttaacaatactatggcctagccaaatagttccttcaggtacacctgagttctaaaggtgtggcattcatgcactgcacatttcaaaagcctggaaactggcataattctttatatgcctcatacattttttcttccttccttctctttttcattttttccttcctgcccatcctc

SEQ ID NO: 55172 - DNA, 1382 bp, Bovine  19866880638508
agtgcgatttggtgaagagcttctggaccgagtggaccaggtggcggatgcagccggggccgtcgctgcggtgctccacggccgtgcgcttgtactgcaaagtgtggtagccatcccggctgagaggtagctgcctctcaaactggtccaggaggttggcggggatgcggttggccttggtggccagggtgcggggcaccagggcacactcgtccttcagctcctgctgcgaggtgtagtgccaccgcgggaaggtgctgctggccagcgggtcgctgaaggggcccacacactcggcctggaaggaggtccgctgagtgtagtaggggtggtcggccggatggtgctccaccaggctcagcaggtatggcttgcggtccgcgtggcgcgacagcgagtcacaggctgaatcgcaggtgactccgtggtgatggctgcggctgcccgataaccctttcatcgctgacggggcaaagccacgggggtcatggacacctgggggtgtggttccagacccgtctcccgcaaggacctttgatgatcaattttccatttttcttgcttccaacgcaggaaaagatccaaactttacagcttttgttttttaacccgatgtgccttttggtgtgtgatgctcaactgttctcttcagatgaaccagacatctgattcttcatctgcaggcttcccttgtggctcagtggtaaagaatctgcctgccagtgcaggacatgcgggttcaacccctggtcaggaagatcaccacattggacttatggagtaacaggcaaacaacacattatcttggataggactccagaaaagcagggattgtggtcagaggaggaacctgtaacttgtcttagtgagacaagcagtgtctggtctgcagcaaccccatgaatctgaaattgaactggatgcttgctgatcctttggagaaagtgtccccagaacaggtgtgagtggttctcacaaaaagtgctcaagagcaccattcacctgctgacctgtttcttataatggctataactcaggaacagccaggtaagagagatgctcaagaccagacacccagggaaaaggcgagaagcttccatctctctctgacatcattgctcttctagcacctccctgtgctcactatcccggaagttctctggaggctgcccgaatgggtttttatggaggcttccttaggtgggaatgattaacataccatttcagttcagttcagtctctcagtcgtgtccaactctttgcgaccccatgaatcgcagcacgccaggcctccctgtccatcacaaacccccggagttcactcagactcacgtccatcgagtcagtggccaacaatctccagcccctctctcctcccagga

SEQ ID NO: 55173 - DNA, 1795 bp, Bovine  19866880660668
ttgctctctccctgacatgtttagctagcctcttgttacacatttttaataacaagaagctctttttcaccttgcttgggatctgatgcttttgttgggaaaaaaatcttttcagtctaacagctgcctcctcaggtgtatgagctggggatacagtgtttgcgtttcggtgtgataaagccattcattattccctggggttatcttctgacctgctcctcctctgctcttctcacgcccgtggacttttcggtctcccagggaggccccaactgcctctcagtgggagtgcagaatggtgctaccacccacagaatccaggtgaacccatcctgctggctgactgctgaagctcaggatgatgtgtgaatgtgagaatgttcttcccccagtggtactcactgtcctccccaagtggtactcgctgtctgtccagatttcttctccggggcctgggcagccccaccatctctggggccagaagcctggttcttgggctcagcctggttgtggtctgaggcctcccatgcaccttctggggcacctgaccctgctcttcctcattctcacaccattgcttgtcctgagatgctgcccagagagttaaattgcttgggcttggcctccaggctggactgtatcctctgttttggggaaacttgagtatttctgaaaaaattccatatcacctagtcaactagagactcaatcatggcctccatttacttcttctcaccagttggtggtcattgccccatctgtgggagaaggcaatggcaccccactccagtactgttgcccggaaaatcccatggatggaggagcctggtaggctgcagtccatggggtcgctaagagtcagacacgactgagcgacttcactttcactttccactttcatgcattggagaaggaaatggcaaccctctccagtgttcttgcctggagaatcccatggatggagaagcctggtaggctgcagtccatggggtcgcacagagtcggacacgactgaagcgacttagcagcagcagcagcagcagcagccccatctgtttgttcctgtcccatgcttgtctttccctttcccactttagtctagtcatctctcccagagttcagtgtgggtcaaacagttgctaaataaatcttggttgaatgaaagatgttgagaatggttgtccttgtattgtttaacatttaaatatagaacatttaacatgatctgctcgcaatcaagactacaaaaagggaccgtagattatgatagctgggtgaaatcatcgctggttgaatctaagaaatataatgtttacaaatatcaatgagaattaaattggcatgatttaattttagtgaattctttcatttcttagttacttacatgtccctgtgaagtgaataacatttccttcttatgcatggggatatttgataaaatactgaaccaagagaaagcgggagctgttgaaacattaagactgtatctataaatttaaatgaacttcatctgggcttaaataaagggagtgggcatgaaatcagggcttgttaaaacaatgaattctctgtgatgagacacacgtacatgaggaagagtccaaaatgagttgagaagcaagatcctaaagactccgtgactcccatgttcatcactgagcgtggcactttttatcctgatggagttcagaagctggaccatcctgtcttgttatctgctattggaatttagtttaaactctgctgatattccctaatagtactatttgtcagatatattaatatgtaccccctg

SEQ ID NO: 55174 - DNA, 889 bp, Bovine  19866880710484
ttagaggagggagctgtaattgctctaacataagcataagttccctgggtcctcatctccgcctcttcttctcttgtatcttaaacccttcactctccatcagtatctttccatcagcatttaatcatggttaagaagctctttcatcttaaaaggaaaagctacatcttgcctcaatctcataccactttcaagctattgatctctatcttttattttgtgcagcaaaatttctagtacatgtccatcttgttttctttatagtcccttcagccagcctgtcatttgtttcttggcagtccgttgactaacatttgatgaatacaatggctgaacgcacatcttaaaacctgaaaacacacacagttaaaaaaatgtatatcatgtattatctctttagagaaaaccatcacggacattttaaatagttagcatcttcatatttatattcctggacttcaaaagacaaataatagtcttattcagttttagaaagagcacagtaatgtcttcagaatgatttagaactgctattcagttatttgtgcaaatgttatccagaaaaagtagagataattgaaatttaaaggaaataccttttcttacaccattaaatcatcatactggatcaaacctctattggaacatctaataagtgatatcaaggaaaggaggttttaatttttaaaatttttattgatttttttggatgtggatcattttttaagtttttattgaatttgttacaatattgcttctgttttatgttatgggttttttttggccacaagacacgtgagattttagctccctgagcacgaatcgaaccctcaccccctgcattggaagccacagtcttaatcactggaccatacgggaagtcctagaa

SEQ ID NO: 55175 - DNA, 1628 bp, Bovine  19866880716543
tgaattaatattgaagtctttgagaaaagatttaaaaaaagagtaaacaaaggtctgtctagtcgaggctactggtttttccagtggtcactgtatggactgtgagagttggactataaagaaagctgagtgccgaagaatgaatgcttttgaactgtggtgttggagaaggctcttgagagtcccttggactgcaaggagatccaaccagtccatcctaaaggagatcattcctgggtgttcattggtaggactgatgttgaagctgaaactccagtactttggccacctgatgtgaagagttgactcatttgaaaagatcctgatgctgggaaaggttgagggcaggaggagaaggggataacagaggattagatggtttgatggcatcagcaactcgatggacatggatttgggtggactcatggagttggtgatggacagggaggcctggtgtgctgcggttcacggggtcacaaagagttggacacgactgaacgactgaactgaactgaactaagcagttcagcggatctcagtatattcaaaaatgagaagaagctggaaatttctagctgttgatcaagagatcaccatgactgtcagttaaaaaccccaaacggaaaaatctacttctttgtacaatggcccgtggagtgtttttccagtagtgggttgtttgttttcagcccctgcgtggcattgtcttagaagccagtcctgcatgaaggaattgaaaaggaagacttcatgattatagcttttgattttggtggctggggacatattttactttatatcatgctttttgcttccttttcattctcttcaaatgatcaagaggtttgagatcctaagccgtcacatttattaaaattacttttaaactcttagctcattactgtgttcttgcccacgatttagaatcctttaaccaaagagaaatagctattttcttatagcaagttctttttaccttctatagctttgcataaagaatactcctcatcaaagagggaagaggttacctaaattattgttcacacatacaatgggatactttgcagttgttaagaatttttaaagaaaagttaatctacgtgcatttatgtaaaatgatgtttaagaattttaattgaaaacaaattgtagaataccatgcataaagaatgtagatgtgtgtgtaagatatgcatagaacatttctgtaaggatacacaagaaatggttacaattcttgtctctaatgaggggtaaaacagggattggagaggggaggaagacttttacatactattcaagcacactttggtgctgttaggatttttacaagtatttttaaaaaaatatttatttattcatttggctgcactgggtctacactgtgatgtgagggatctttgaccttcattgtggcatgcaggatcttgagttgccacatgtggaatctagttccctgaccagggatcaaacccgggccccctgcattgggagagtggagtcttagcccctggactgccagggaagtcccaagtgttctttctataatactgtaataaagaaggaagcctttccatcattcctaagcagaaaggagaggtgtgtaggcatggcgtttgttgtggtgt

SEQ ID NO: 55176 - DNA, 1219 bp, Bovine  19866880740304
acattattaatgattatttcagggttatatttatagttctaaagcattggttgccccttgtcacagaggcctactcgctgcctccctgcatgctgtggaaggtaaaattacttgaaaaattacactagaatctgaaaattaggtgaaaaattgacttgagaattgtcatgtacattttaaggttcagtaatgaggtgtgaatccatgggcagtttcacacataaaacaatctcactttcttaatagttatcagggctataaaaaaacctgtttcatgaatcacagtaacattctaatccatcctaaggactgtaagtagaggaaactacagcctgctgatgaccctgccactatcagcaagttgaaatatttaatacaggcagccatagtgtaggcctggagaaggcaatggcaacccactccagtcctcttgcctggagaatcccagggacggaggagcctagtgggctgccgtctatggggtcgcatagagtcggacacgactgaagcgacttagcagcagcagcatagtgtaggccagctcagttcagtaaacatttaccaagcacttcagtgttccagacactgagctaggttttgaggatgggtaacaaatggtgtcagcccttgagcagctcccctccatttgtggaaaggcagtcaatgcctacttgccatgaaagtttctaaacagtccctggaaaatgcaggaaactcagagtaaacacaaaatgcacaaagaggttaaatgaatctcttgcaaaacatactgccttctccccttaactggtttgtcttcattctctcatgttctgcaaaggaatgacttgacttatggggatccttggaatagaattggccacgccagaagctgcctaacaaacctgcttgacaatggggtggggggattctcccctgagattgatcctaaagcaaaggaggctcggaatttgggtgtaggccagaattcatcatcagtttacaaagctggttggcaaaatattcaaaagcaaggagaaaaaagaaaaaccctccttacattagaactagatacaagatcactaagtattctgaatgtctttattttggtgtgtgtgtatttcctcagcactgaatttacctctgatgttcaaaattcatacaataccaatacttttttctgctcatttaaaatgcaggcataattaatgacactggacagctacagaacaaatatcaa

SEQ ID NO: 55177 - DNA, 816 bp, Bovine  19866880799358
ccaaatccgatccttctcttgtcatttgatttatactgagatacaatggctggaaaatttgaaactatgatttataaatcatttgataggtttgttgtgattgctttcggcctgtgctcattaaaacgcttatgtctcgttgatgagaaaaaatgaattactgatgtttgtttctgttgtgcccagttgccgtgaccccttacggttatgcgtccaggtttgagatccactttgatgacaagtttgaagtgtctttcgggagagaaggcgagacgatgagtctgggctgcagtgtagttatcacccctgaaattaaacatttccagccggagatccagtggtaccgaaatggtgagccttaatgatgaattctcactgaggctcatattcgcagaaggtcacagaccagacttggtcctaaagcatgaatgtctgtagattgcagttctgtttactagacctggcagaaactagatagtggaggacataacatactgggtgttacaaaagtttttacacatgttttagagtagcagaacttttataacatgtttgtggagatcataatttcttatcacagtataatacagggaaaggattacaaaacatgtattttccttttacaagttggatatatattcattttgtaagttaattttattcggtaagataaagtgaaatccagggaagtcctgttggttcccaggcggtaccagtggtaccactgtgggtggtagtcagcgtgctcaccacgcagctggcctaaacttcagtgtaccgtgtgggcaccgggcaggctgggccatcgtgaagcga

SEQ ID NO: 55178 - DNA, 1724 bp, Bovine  19866880840652
cagatgctacatttcccaaatgcactgcttttccagcaagactcattttcaagttctcctcacatttgctgtggcttttaacacagctgcttttaaaagacaccgaatattggggaccagctgtgctctttctagcgttccctcatgcccgggactgggtttgtacaatcctgtctaatcggcttaagcttggggctggtgcactgggacgacccagagggaggggatggggagggaggagggttcaggatggggaacacagggtatacctgtggcggattcatttccatatttggcaaaactaatacaatattgtaaagtttaaaaataaaataaaatttaaaaaaaaaagaaaaatctttcaaagctgtcatagagaactactagttttaaaggtctgtggcctgtttttccataactgaaaaacaaatgactaaaccctaatctatcccaaaggatgtgtgagtgctacctttgggttttcccagcaacatctgtcccagaaatggacgtgaactgtgaatgttgaatccgttgtcactgaaattggatggacagtgtccttaaggattttcacaacagaactgagatctgtattttagaatcagattagccagtgggatgtgattgatttggaaagaggtgatctcttggtgatgaagacaaaacccttagcctgaaaccattagcaactagcacatgtcaagtgagtaggtggctttgaggcagcacaaacgctttttaaagggtgtgtaagtggtaatttcctgttgttctcagctcaactgacttatttcaggaagattcctgtgacccagaacctggtgaggtaaaactttattatctcctctcatctaaaatagtgttttctgtggagcagatgatcaatttttatgtctttccagccctggaaatttaattcatttttttcatcaatggcataaaatgtgaaacacccttagaatgaagcacctgacttacattctttcactaaccgcttttcagtatcttgaacacggactcagatacctttataacctgtaattaaatagatattcttttccctgtggttgtaaagaaagaaaatctcatctgatagagtaagacagccaagtagaaacttgtagagagaacagaaatagtcttgttccaattacattttgaaaactattggtacagtgttgacagttatatgggatatttcagtacactcacagcgagtaaggtaagtataatatggagataaataggaaataatggtgtagaaatactgtcaatggacatgagtctgagcgaactctgggagatggtgaaggacagggaagcctggcgtgctgcagtccatggggacacaaagagtcagacacaacttagggactgaacagcaagaagaaacattgtaaatagaagttggagttaaaaactggtttctaagagtcaacatacttcaaaatctaagaagagaatattaaatgaccctgtagctagttactaaaaaaataataggtttatgttacctcacgtacatatttctatgatcatgccaaaaatgccttgagtagagatagactcttaaaaaaaatggattctagagttactagagacacgtactgttccttcttgtgtatttcatctcaaatatatcaaggctatttctatctgatgacttatgcttctaatgcttcttcaagccactgttctttatttaagtgctaattaagatt

SEQ ID NO: 55179 - DNA, 3679 bp, Bovine  19866880843778
ggtgttcccagtccagcactgaaacccagcacttctccatttcgctgccattttgagaaagtggcaatgacatatacaccttaatgtgtaaaatagtgagttaggggtaagccgctgtatcacacagggagctcagctcgatgctctgtgatgacctagacgaaatggaataggactatggggagattcacactgttgtacagcagaaactaacataatattttaaagcgattatactccaatttagagaaattttggaaaataaaagtattagaatgcaaaaaagtttttaaaataaacctaagtgttttactcctttgcaattattttttttaaaaggcaaaataaaatgcctgatttttgtactgcttttacagtagtagaattttctaggatctggtgcaaatagacatgttctctgcaggctgaaaagaggctgaaaaccctggtgtaatctgtctccctgaattattataggattttagatggttgacaggtgcaataactttgaactcctcaggcatctcgatggaaattcagttccggcttgaaagtgctaactgtacagcttacattcaaacggagcttctcagatcagaggagctggttcaatactgcccttgatttatccatgtacaaggaaggattccgaaaatgcatcctttggagtcgaggatttctaaaggagcgtcttctagtgactggctggaggctgactggaccagcacagagtgaaggaaggaatacagtaggggttgactgtattcagacaggtgaagtcttgtgggtgtatgagatcagcagacagataccagatctcagcttactaattcatcaggcttttagcaactggtttctccatttcagtcctacagagctaacccacaacatcatccgtaatgcctggtgatattcatttctccctttctgaactcgactcttctcttaaatttcatatcaaaatccatttttcccctccaagccccaagctcaaagtttccaacatcatctactagatccttatgaatacttctctatcaagttctcattgggaaactttctcccaggatatatgactctagtgctccgttgctcccaactttcttacttccttgtccctggtaagttcacatcctccgaggatgggagtacaaggctctgtctgatttgaatcacatcattttgtcagctcgcctttctctctgcattcagatgataatgccgctcaggtgaccaggtgagcgcttacccagtcatgtccaactccgttgtgaccccatggagtgtaactctccaggttcctctgtccaggcgatttcccagggaagaatactggagtgggttgcctttacctcctccaggggatcttcccaacccagggatcgaacgtgtgtctcttgtgtctcctacactgcaggcggattctttactgcttgagccactgaggaagccctcagccaatcaccaatgtcacagatacatgtctgcagtgggccttatcttcaatgatcagaatcaacatttacatcttcagagtacaattatgtcctcatgcctgctagtactttgagcaagagaatctgtatcatgtttcccattatctgtccttgccctgaagctgttgctgtgtgaactctgcagggaggaccaagggaagggacccagccaatgtccactgagccaccagtctttacctgagtgtagagatggaacatcccgcctctgctcagcacccacctgctatgggactgatattaaatgtacgggcaaaactgagtccctttggagagtgaaaaggataccattaataattacactgagatatacacttgctccttgaaaggaaatctatgacaaatctagacagagtattaaaaagcagagacatcactttgctgacaaaggtccatgtagtcaaagctatgggttttttagtagtcatatgtggatgtgagagtagaaccataaagaaggctgagcactaaagaactgatacttttgaattgtggtgttggagaagactcttgagagtcccttggactgcaaggagttcacaccagtcaatcctaaaggaaatcaaccctaatatgcattggaaggactgatgctaaagctgaagccccagtactttggccacctgatacaaagaactgactcattggagaagatcctgatgcttggaaagactgagaagaggacagcagaggatgaaatggttagataacatcactgacttggtggacatgaatctgagcaaactccaggagatagtggacaggggagccctggtgtgctgcagtccatggatttacaaacagcagacacaactaagcgactcaacaataaactgaaatgacatttttgagtctggaactgtgtctaagcccagggccctagatgaagctgtgtcctaatgctcttttgctgatggtttgggtagagcagcttcgtataaagaatgtcactgtgatcactgaagagtgatccatctgagaggcaaacacagatctttcattccagctgcaatatttatacaagtacaacactgactgactaggaggtgaataaagcacaacaaagctgcatttccactccccccgctgaagtttcctgagaagtagtctgagaagtttaaaatattttttccaaaaaacaagccaaaataactccttttattttgggttcctttcagatagccttgcagatggtttgctgaaatcgtcagaccaacaaaatctgtttggctcaaaaaattaaaataaccctaccaaattatgtgtttatttgtaataaaaaaaacactgaatttctaaaacaaaaactaaatttcttatttctatctattaaacttaccctcactctgcattttgtgaaccaaactacagaaataattccttaaagatccacacattttcccctgtagtgccgaattctagaaccccaaaatagagtggtataaatgctgagttcttctctgtttgcttttctatcaatacatattcatgtcttttctcttgacacaagcctcctatcaaaacatccaaaagacagtaaatactaatacatccaggaggtgctctttcttcctctaattgcctgcatcaagccagtttccatgacatcagctcaggaacaaacacagaaaactcaagttaaaaatacttcctctgggaaaaataagtatgacccaatgggccagttggtgggacagctaaagggaagagggcttccctagcagctcaggggtagaggacccacctgttaatgtaggagacactagtttgatccctgggtggagaagattccctgaagaagaaaatggcaacccattccagtattcttgcccgggaaatcccatggacagaggagcctggagggctacagtccatggagtggcaataaagttagacatgacttagcaactaaacaaaagacggcaagagtcccatgttctcacagaggttttagttcaaagttgttttgagaagatttgaagaaataatcgcctcctcccacccatggtctcagcgcaaagccaactgtgccagcccttggggtccctggtgcccagcacacagcccctcgggtaggctgggcacaacttcccctcatcaacaggatgtgaggagatgctgcgaggtgactcagcttccaagatcctaaccgctgccactgcagt

SEQ ID NO: 55180 - DNA, 1200 bp, Bovine  19866880889736
acttttttctttttctatcaacttgtagaaagctctgttttaatgaagtgacagttacaacttatcgtgcagttactgtgtctggtgctgggctgagcccaccactgccgaatacacagcagatattttcccaggcggtttgcattttaaaatactttcctaatgaagccattgctcctatttctcgaggcagcttttggagtggtctgttttagaagtctgcattagttcatttttggcatttagcatcatgagtgggggacagaggctcagagtttgtgtaggctgcccttgagactgtgcagctctgagtccattcttcatcagaaaggccccaccctgctggggtgtccacagggtcgctactccagatgctctggcctgggactctgggtggtaacctcagagtgtggtccccagaactcagtggggatccctctgttccccctgctccctctctgcaccaattcctaagaggcagagccatgagagtaggtgtgatgaggtgacaatgacaccattgtccagggacactaaaacatggggtcagaacagcctggagagctcgtggacattgatcccagcacctgtaggaaaccagccagtgtcacgaccaaggaagaacaccagtgacccactggctctcaaagcatcctgaaacaggcacatccctcttgtgcactggggcactgcttatctgttgtcattgttacgtggaagctggtctaaaatggtcctaacgtagcttctcccggtggctcagacagtaaagaatctgcttgcaatgcaggaggcctgggttcgatccctgggtcagaaagatcccccagagaaggaaatggcaacccatttcagtattcttgcctggagaatcccatggacagaggagcatggagggctacagtccagggggtcagaaaagagtaggatacaattgagtgactaatactttcactttcaaggtagcttctgagtagggcctaagtaccgtctccaccgttttctctattctctgccccttctcttccctaagaaggccagagggacatagcatccttctgggtgcagaggctgtgcccacctgaaggggaatagtccttctgagtgttccccactccccctgtctgcttggtggcaaatacaccctcacctgtgctcccttcagcctcgaccagcttctgccggtcatcctcacttccc

SEQ ID NO: 55181 - DNA, 1452 bp, Bovine  19866880912131
cagggaagccggttgagtccaaagatctggaccctcagatatggagggaccaccccagagggagagctgactataaattgtatgcaaattttcttcttcgtggagggttggtgcccccaacccccccatgtgtccaagggtcaactgtatgttttataaagtagaatggccacatgctgaatactatttgtaatatatacacacatatatatgcatatatttttgagtttgaatatctgtgagaaatatgagaaggaaaatgttaaaacgatagcagtggtggtgctcttcaggaagtggtggtgggagactgggaaacaggggctgacttttcactctgtaccattctgcactgtttgtatttttccagcatgaacctgtattagtcttattaaaatatgaattctgtgggaaaacctccaaacccacttttctttaaaaaataaaatctgtggaaagaccacaaatttataagcatacaagtttgttttttagaatttctgtcatctttacatgatctcaatctgtaggttctattccatcactggcaaagataatctaaggaacacaatttaactggaaattgatgaaagttgagtaggagaatcataaattagaatcttttaagaactattattaaagacattttgctttcctattttttcagcttgggttagaattttatatttaaagttaggaaaatgcacatataatcatatgcgaagacccgtatgttctgtatcagtctgtgccacttattttcaatgagataaaacagcttacttaaagttgaatttccccattgagtttagacgaatcagctgtttatccagcagcactttgcttaaaaatagatgggatgacatttgtgggtgcttttaaaaaatatcctttggagaaagaagcagaactctaatgccacttttaccatttccattacataagaaaggcactttttttttttgttacgaggacttcctgtaacttattcttctttctcacacatatacttttggaacaagtaacaatcattggatgtataagggcatctcacctgaattttacattttagtgaccgaaattaattcaatggaaaccttaaatatggctagaaagagttttttctgattgcatatggagatttctttttttcatccttctaattatgtgctctcccatcattcttttatcagctagttattgagtgcctgctatgtgacaggcactgtggttacaaaaatgaacataaagatgattttgagtgcatttcacttgatcttacagaccaatttaataattgtctgtaccaacctgccaacaataagaagtggttgatgttaccttaaacctgctgtcatatgattccacggagtctaggataagcattaaaacagggctgagctgaaaatatactgtcacccaaatttcaaaccaagtagatacacaggagaa

SEQ ID NO: 55182 - DNA, 3154 bp, Bovine  19866881012078
atctatatagagtatatttttgcatatgacaggtttaagaggttgtgaaattatgggcaaaatcatgataaatgctcagtttattcatatttggcttgttcagttaaattataactccttttgtgaataactcagagtattctgaaggtcaagattctcttctccaggcatgagtaaaaagaaacatcagttacggtcatgtggtgtcagacctggttcataccaggttgcaagagccaactgttacattttggggaattttgtaaatccattattaaacacacccatgattacaaacttgcaattataattatgttaaaacaaaggtgataagtaccttaaaatctttacttcctgactgtttgactactttttactatccatgctcttggggttctttacatctgctatccttgtgtggtgaaatatttactacatgatggttttactatcattcatctctttccaaagccatgtcctgtgacagcaaagctggaagcttgaaataggccacagtgggagtgttttcatagtgttgacaccgaaagagttttaacttaatcaaaatactttctataaaacttgaacagtttaatagttcaagagatcacataaaagatacaatgataatgaatttactgggaaaagaacaaattgggatgcaattcagagcattatttttgtcaaatcatgattgatttgctggctgtgaatcccacggtttggtccaaatcaacaaaagtcttctgtgagaatctgttggctgcatggaccctgcaataaataagactgtatattttattattatgtgtagattgtgtactacccatcacttatattggtaaaacccataatatacacacataatacaggcatatttttccccttgttaaacattgaccagacatgactggttccaccagaaagatgaaattcaactggtaacttaaaagaaagttgttttttgtttttttcagaaagttataaaagagagcaagtttgtctctttgtgaatagaatctgttaaaaatcagcgggtggtcatgctgataaccagtttggtttaccagtattgaaaagcattttgtttccatttttcatttgagactcctcccatttgaaagagaaccagactttccacctagcgaaactgcagactttttgttttttttccagcctaaggtatcatggctatcacacagagtttgggaaatattgtttatacttatgacttacaaggaagaaaatgaactttcaaaatcaaattattggaccaggtctaatttattttagtttagtattttgacctttcagttcacaaaaaagtcacgtggatatccagtcaagggtagtgtctgtttgcttcatgaataatttgacaagctcagcccctccactgatctgcaaggaatgggaacactgaacacaggagaccagaaatggcctctggtccaaccacccccgagaaggaagttgccagatcacaccatggtttctaaccacttgttacgtatttcagcagaaaccctgtcccaacacctatcagatgatctccaggtgcagcttaagtaggaaatactaggccttgatgtccttctgagtgaagttttatcaatccttcatccagtatgacctatctacagaaatagccagccagactattgagacttggcctttgtttcatcgagaaacatggccgatcctttatttagtgaaaaatgctcccaagggattctagtgggagaagaagacattcatgaagcttaatcaaggactgaaaattacttcgtttttgacattgatgtttgtttacttaaattctcaaaaagccagcaacaacagcaacaatccagatttgaagcatgtgtgtaatgtgcgaagcctggcaaagtaatttgggtccattctataactgcgactttttgtttttattcaaggtgtcataaaactgagttctgcagttgaaggtacgtttttacaaccacaaaatcagtaacgttttgcttcaagattgcaccgcgtggctttgtagctagaccgcttctgtggccgtggtgtctgaagccatgttctaatcgccagctactgcctttccatctgtgtttctccttgtcctggttctcttatgccacacgtccctcagctccccagtgagtggcctcaacactgaccccgagacagcattgacgagagcaagcaggtgtggttctgccccctgacggggcggcctcaggaccactggctccttagagagcatccttatcctctacggcatccttatctgaggctggaccttgagtcttgtcaggaacccttggcccacccccaccccactccctctttcgataggaccttttctagagggatttggttcctcatcctaatatagcagacatgtttgcccaggaaatatgcagacatggagtgattaaaacttcttgatggctagtctcaagtcacgaggtgccacccaggaggtattgcaagaaccagcttccttgagtgtcatccatgtcactcacaccaggtggttccttggaattgtgcttctaagacgctgagaagaaaaggaagagagatttaaagaaagaggagggttggtgggggagagaccacacagccgtgtttcactgagtaactcccaagaatgttaaaaacacctcatttttttgaaatgactcattggttattggtataaaattgaccaccttgccctaagaggagcacacatcttgtaagtagggaatatgtcatgctctctctttgtgagtgtctgtgtttgttgtggggcgtgtgtgtgtgtgtgttctcgtttattgggagtttgtcagtcatgctttggacggttcttcatccccattttatcaggggaggctccttggaagaggtggtgggctttaaggtgaattttcaaatgtaaggagagatgcagcttcgtgaatgggcaatgcatggaggtgcgagccggaaaatgcgaggaggaggggctctggtggtgagaccacctgcttggctcaagcaaaaggactgggtgggctggagtttgcaggctgggagaggggagagggactcggaaatgtccccacagggctggcccatccggagagggggactctgctcctttagggatttagtgccatcacattttgaaaag

SEQ ID NO: 55183 - DNA, 1653 bp, Bovine  19866881013767
ttttgggaaaagaagaaatgagaacaaaaaccgagacagaacaagaaccatttggatttgcaggacccaagtaaatataagaacaagcacttctcagacatttcttgagatataagttgcattattcaacagaatggggggtggggggagtgcacaagagacaaacaaagatcttgattatgtaacaattagagttatgtaccttattgatatagtaatggtctgtacctcccaatctcaaagaaacatgttcactatgtccttataatacgaacatattatagggaatgttaaaaagtaatacaggggaattccctggagatccaatggttaaaactctgtgcttccactgcagggggcactggttccaaccctggttggggaattaagatcccacatgccttgtgacaaaaaaaaaaaaaagtaatacgagatgctaactgaagacaactggtattaaataatctttctatttacatatttgctgctgctgctgctaagtcacttcagtcgtgtccgaatctgtgtgaccccatagacggcagcccaccaggctgccccatccctgggattctccaggcaagaacactggagtgggtactgtgatatagtagcaaaacatatctgctactgtatcacagatttcatttttattgcttgaactacctgggttccttccccaccttaagattgggaggcacatcattatacatacatataattactttattactggttttattctgttggttactttgccagcagagatgaaacatatgattaagcaaccacacatgtcttacacgaattttagcagagtttatagaaggcaggttaatgtgctgttactgaaaacaagccaagctctgctgcagatggaatggcttttaggtatgagatgatctggttatgggtgatacaccacctcatgggattggatggccctctgtattcccaggaggagcaccaagttaaaatggagtttcacacaatgggaatgaatatctgaggacacttgggctgatgaagatggaaaggctatacagaagcacagaatctggataagtgatggagatctgtaaaagaacagctgtggaagattagaggtcgcctggagtcagagacaatgaccatctgaggatgggatcattgagccatcttagaaacttgacacagtctctggaggggatgttatctttcgttgtaacttagaaaaaaatcattcccgccccctccacccgtaaagctgtgcatgaagaacttaccaatagcagcttttacttcaattgcttctgaattctgtgaatattcactaagtccagctgcgttaactgctctgacccggaaaatataactctgaccggtcttcaatccatgacaagtaaatctgaaagggaagaaaaattttttaaagtttcccaggaggaaaattagggaactaaactaaattctgttagtttaacagaatgatctggctttatgaaaaccattcattttttcaaaaggaagaaaaggatgtagagagatccaggtaacatacgtaccttaaacaagaaggcatctcaggcaattttctaaactcactctgtcaaacagtgaggagtcctggttttcccctgaataaacaccctatcctttttgaacctgtgtgta

SEQ ID NO: 55184 - DNA, 1038 bp, Bovine  19866881124637
ttggggcaaatgcaagcggagcagcacttcccgtgctttgctgagcggcagaaacagaaaacgcagtcggggttggctacttgacagtaacactaaaacaaaaaccttctttgtttgcatgtttgttcgtttctctcaaccacagacaaagctgccatcgccgagaaaagtaagtaaacccctttgagtttattcctagtgtggcttcaaaatacaactttatttttctattattactgcagacggaggagagtgaaagcatttttttttccttttctttcatttctatgtatatttttaaaaccttaggtgttccgcatgtgttgtcctttagtctcttgagtaagactgtctggaaaagaaggtctcaggttacactgtaagaatggctcccagcctcaacatgaaaaatctctgggctgcaaatcacacagtaggttgttcatcgcttgcagcaggcggcctatgtcagaaaagtgtatatattgagttggccaaaacaattcctttgggatttttccataagatgtagtggaaaaatctgaacaagctttttggccatgccaatatgttaaggaaaagaaaaaatattaatgaaacttgtagattgatatgtaaatcactatagctggtcccccaacaagtggtcccatttttctgaaagaccaagtaaggctgagtgaccctgaccccagcggtcaagcctgtgtctgcacaagtgtgctctctcccgacccctctcaactgtgcttcacacacagaggagtctatagaatcctgggatctacaggatctacaggatctacggataaaccatcgtgatgattcaggctctttctcagggtgggagcagaatttgaaaaccattgaaggttgtggttgtagagtcagtcctgaactcagggacgggaaccaggaggaggaggagtgagactgtctgctgactgtctatcccctctcttgaattctcctgtggacaagaagcctgaccctccctctgctccatgagctccttcctgaggtctctggaccacagta

SEQ ID NO: 55185 - DNA, 1331 bp, Bovine  19866881317640
ttacccttttttggtagttatgatagataatagtgtgaaagtgaaagttttagtcactaaatcgtgtctgactctttgtgaccccgtggaccataacccaccaggctcctctgtccatgagttctccaggcaagaatactggagtggattgccatttgcttctccaagggatcttccccaatccagggactgaaccctggatttcctgtattgcaggcggatgagccagctctttactgtctgagccaccagggaagccttagttatgataataacgagcttacaattttgtgttctgcttttttccacttaagcattgatttgtagccgtccatttttccatgtgcttatgtaggctttatagttctccttggtaatggctacattatatgacaaaagtaatcccagcataatagtgaggggattaccaagccagccctggaaggattacacctgatacacagcgctgagtgccagaggagcctgccaacatgtgataactttgaaaacctctttaactcaaagcccaaattttcccatttgccaaataaccctaatcatagttgtttgtcatcttcagagaaacagtgtgtacaagtagaaattacttttagtatcttataggtttgaaatatgtttatagactagaaataactcactctccttcgtctccccctttgaaggcagagcagactaataagctaccttcccaaagcagtaagcactgaaaaaagtgaggaggccaggcagaagcattttggctccgtggttgttttgcggtcacctatttgtaaatgaaatcattttggagtcaccttttggtaaatgaaatcattgaaaaacttcttgagcccatttgctttgctttatacaacatgtgcatggcttaaaagtaatttacaaatgaaaattgtactaatcacccatcctgtccattaacttagcttatttttgaggttcactcaacaggtttggtctttgctcagtgagaacctcatgctctcaggtgtgatggcagattgcccaaatgctgagactttcttattagaatcaaggactgttagagtctgaggagtctctattaccatccagcacatttagtccaaacatttgctcacatttctctagattaagggtacacacaccactgatggggcttgttgggcttccctggtggttcggtggtaaagaatccacctgccaatgcaggagatgcatgttctattcctgggtcagcaagatccctggagaaggaaatggcaacccattccagtattcttgcctggagaatcccatggacagaggagcctggccagctacaatctatagca

SEQ ID NO: 55186 - DNA, 1515 bp, Bovine  19866881355327
attaaagaaggaaactttccccagaagaaagcagtaagtggattaaagagaaaatgaaaaagttggaagacaggctaagaacatcagagctataatagagtcccccaagaagaaactgacagcaaggagataaatatcaaaaagtacaagaaatttttacggaaattaaaaaaaaaaaaagatatactggaagggtaccacatctacttgagaaagtcaacttggaatggccaacactgaggcgtgttttaataaaagtttttgactttagaaggaaaaacatctcttgtgcttccaggcaaaatgactaagtcacatataaaggaaagaaaatcagattattatcagactttttgacagaaatgttttgtgccagaagaaaatggaacaatacatttatgaaacacaagtaaaagcactttgttcatagcagcagacttttaagcatgaagaatgcggacaaatgactagcaacatgcaagaaattagaaaatactgttttcctgggttcttcctgaagaatctactcaagaatgggctttttaaaaataaaataaagaacaaatcaatcaatgtgattagagcaccatcaacataagggctgatgacataaaacacatatttacttgtatagaaaaagcataattttaaatggctatatggtctggcaatgcagattcagtacaactatttaaaatgcagagatacaggacttgaatctatgagaaaattttactgtttcagtcatcaaattagggagctaagactgatgtcattactgttaccctgatactgttaaatacagaaaatggaggtggaaaacacatgaatgattacatgattttctaattctctcgtactcttgtctcctttcaaactaggatcttggtgaagaaaggcaacacagatgtaagacagtaaagtgaagtaaaaacctgtaaccctgagtatttgaatcagagtgttattatgaattctagagctattttattctgacttcatatgaaatagctgaaattggtaaggcaagaataagcagtgtttgattggaatcagaggtaccagaatgaaatgatagattagagaggcagagagagaggtgtgaagggtgatggaggaataaatatagatgtgtgtgtaagcaagagttatacacacatgtatttccaagcactgtctactaagaagacctagaagaaattacagtcaacagtgaacacatctaacacccagatcttggtttctaagtacccttcttccataaagggagctaggcctccttagagaattagttgacttcacagctgcagcagaaaagaatacaagatgaaaccagagcaactgtggatccagtgatctaggattttaacaaagaaattacattgggttaaaaaaaaaaagtaaatgcagttgagggggaacctacagactgggaaagacttgtgtatccttaaaaaacacacatgtatacctgtggcagattcattttgatatttggcaaaactaatacaatta

SEQ ID NO: 55187 - DNA, 1054 bp, Bovine  19866881401434
cccatgcagatcacttccataaacttctttaggtgttctcatttgaaaaatatgtttaattgaaatatatacacattaagtacttcccagctggttctcttagcaacaattgtagcctgtttctagtataagaccaagtttctactataaactaattttgggaaaaaaactacctaaagaaaaatttgccatgttttgtttcataagcaatatgagctaatgaggtgtcattggtctctaacatatttcagggagccatgcttacaagctgtgcatcagtgctgagaaactgcaagtgtcggctgcatcctctatgaccctcagctgtaccaacttaatttataaaatgtaattactgagccaacaatgaggtactgaatatgatcgtatctctgcagtgactcacctgccaaaagaaggaaaacaagactgttctcaacgtttataatttccctaagaagcctccctgttgccatggtgatgttgatgctttttagctcaaaaaagcaagaactctacattgttactaccataattgataaatggcaaatggatcaggcatgatggatgatgaaggtgtcatgggactatagttgttcagttctgtaggtaccatgagatcagagacagaaaggcagcgtcagatacggtcttggcgagacataggagctgtcgggctggaacgcttcccctttgtagctgagattttgggcaagttacctaacctcattttcctcatttgtaaaatggggataatagtcgtaatacccttagttgtgtggatcaaatgagttaacacttctaaagcatttagaatagagcctgcacacaggacgcatgacttgagtttgttaaaagaagctgcataacaaagcttaaccaaacttcgctggtagttctcatcattagaacctacaaatcactgttttcaggtccaggaatggtagcatgtcttcagtctgatgtttctagatattgcaagctttcaaaacagttaaatgtacgagttaaggaggaaagaacggtgcctttttcccagtggaatgtctattct

SEQ ID NO: 55188 - DNA, 736 bp, Bovine  19866881931413
atcttaaaaagttcttcacatgtttctcaaagacaattctgagactttccatttacttaaacacagtgcttgtggaactagagagataagtcaaataacatttttgctttaaaatcattaagtgtgactggcattttctattgtgaaatagttttcttactttacttattaaaacattgttcaacttgcattgaagtacgttcactgcttgatcatcctgttaatcatcttcatgtcagttaaaataaaatctgttcacaccacttaacatcaaatatcatgttttgacagtttgatatcagaggcttctgaacagggattgtgccctgtggggccctgaacggcatcacataaacatgactgtaatttatgatgagaaaggaaatgtttttaagataatattttttgggggaagagagcttaattctaaaatatgtttgacctttcagttctcttcggtttttatcttttcaacatttgaccatttccttccttttacagtaaaatacgcatgcattcgcaaatgataaaccactgcctataaccttcatacactgagaaaatatatatatatatatatatttacctaatgttgagggcaagagatgaagtgtcttctcaaaataataatggtgaaagagttttctgtcttcagtacagtctgacagagatagagataaaagggcccaagcaaaaagtcttggatgaaagaatttcatctaagccatagagtcca

SEQ ID NO: 55189 - DNA, 2394 bp, Bovine  19866880413426
ttctctaaagaagacatacaaatggccaataggcacatgaaaagatgcttaaacatcactaattattttagaaatgcaaatctaaactgcattgaggtatcacctcacaccagtcataattgccatcatcaaaaagccgacaaataataaagaatggaaagggtgtagagaaaagggagctctcttgtactgttgtttgggaatgtaagttggtacagtgactatggagaacataatacagagaacacagtatggaggctccttaaaaagctaaaaacagaattatcatgatgcaacaatcccattcttgggcatagagcttgaaaagacaaaactacatgcaccccaatgtacttaacagcacaattcacaacagcaaagacatggaagcaacctaagtgtccataaaccgatgaatggataaagaagatgtggtacatatatgcaatggaatattacctggccattaaaaagaatgagggcatgacatttgtggcaatatgaatagacctaaagattatcacactaagtgaagtaaatcatacagaggaagacaaatatcatatgatataaacttatttgtggaatctgaaaaaaaaaataatacaaatgactttatttacaaaacagaaatagactcacagacatggaaaacaaatttatggttaccaaagaggaaagagggtgacaagggactaattaggagtttggggctaacagatacacactactatagagaaaataaacaagaaggatctactctgtagcacaggaaactatattcagtatattttaataacttataatggaaaataatctgaaaaagaatacatattatatatacatataatattatatattatgtataataatcactttgcagtatacctgaaatcacacaacattgtaaattaagtatacttcaaataaaaaatttctgattttaatcagtaaattttcaaaataaaaggaatgagaatagtttctttttaaaagctgtaatagctaaaggaagcaattaaataatagatatcttcagattcatcatgataattaattgggaccatttgaacagggagaaatctcaaaatatccttcattttgattcaaccttaatattttgcttttatcagataccaactttgaaataaaccttttagaagttggtccattgcttataacaaacctagagtagttttaaacaatttcccctttatctgatggagtgaagattgtcagagatgagccccagctggggcccaaattagagtaattaagaagcaaaaagtcaaagtacttttctataacttgtttattttattagaagattaaacagtattgctagtgcagaatttgtcatacttacagaaacagaaagagagggcattgtttaaatgctatgtgtaacagatatggaagtgatagcctcagaaaacaagattggatcatcaaacagtaagagacatgcttaaaaagacatgtaattttactttatgataacaatgtagccattgccaaataaggaagtgtctcattaaaactatcacaaatcattcatctgtggtcaaagagagacctgtatactaacttatctgatgtttttgaaaaactcttataaaccctaactatacttgggcaataaaagagaaacttacatacaacaacaggaactaaaatgttttaaggccttaaggtagttactcttcttttctggagacactattcatgcttataaaagtcaatcaaaaattaaaattaaaaaaatcctataacaatactgttatatcagtatcttctgactcaatatgcaggctatattatataaagaaacatttaggtactaaattttaggtactaaaattgcctctttggattcatttcaaatgcttttcataaatgcaatgaattgtcaatgtcttgtgagcctcaatgatagttttccctgtcctttaggcatttctcataatttctgcagtcccttaaaaagagtagaaatcctataaaaaaatttgctgttgttgcttagttgcttcagtcatgtctgactctgtgtaaccccatagatggaagcctaccaggctcccccatccctgggattctccaggcaagaacactggagtgggttgccattgccttctccaatgcatgcaagtgaaaagtgaaagtgaagttgctcagttgtgtctgagtcttcgcgaccccatggactgcagcctaccaggctcctccacccatgggattttccaagcaagagtattggagtgggttgccattgccttctccataaaaatagtagaaatcttattttaaaaaaaaattgctaataacttctaaataaactctcttctctgcaccaatggtgaatgtaattgatgacattgcttttagtagatt

SEQ ID NO: 55190 - DNA, 1396 bp, Bovine  19866880477795
aacataatgttgaagaaaagaagtcagactgtgaagagtaatactgtgcagttcattttatgtaaagacaaaaataagcaaaactaacccatgctgttagaaatcaggagggaggttacaatggatcagggagaggttggaagggagagtcccggggagctggaaaaggactgtttcttgatctttggttacacattgattcagttcttaaatacatgaagctattcacttgagatatactcacttttttgcatgtggatcacaattcaaaaaaagctaatacaccagacacacacacacaccaaaacaaaacaaagcaaaacaatcaaaatatctactagtatttactatttgtaaactttagaatgtaaatgtagtgaccagtgcaaataagaaattctgtgagaatttgccacataaatcagtttgtcccaactgtcaaatcagtataatagagcaaaatgtcaagtagcagaaaggttagtcccctgctttattgtccttttaagtgtctcataccagcagaggtacctcgcatcacacacacttcgggatgggactcatgagagtttaccacccatgaaatgagggagggactgtgtgctaaatgatgcctttctcctaagctttcccagggacaagaagatacatttcttaccatgtctctttcttcatcctttagatcccattccaaagataaactgtaatcgcaggagacatctcatcaatagaaaactcatttttcctagacccatgacaaatgggtcatgaaacctataaatcattgcttaagccttagccaaagttgatcaaaaaatgttttttccctaaaaggaaagctttcttctcttaaaacagcagcatcctctggttaacagtgtaactcttaactaaaccttggtgtcagaatatgttttggtagagacagcttaatggagttgctgaaagatctatcattcattcctctgataaggacttccagaaccagggaatcacatgcattattccaaatttatatgagtaaaagctccaaaaaaatttaaatgtacctttcaagatcaaaatgtttacttttaacatattaaatggaaatacctttatattatttcataatcaatattcagttgcaaatactacctggatacagatattaaggaactttttgagttcaaaacatggctgttagagtcagactgggaaggacggttagggaaacaccttaaagttctttcatatttgagctcttaaacaaaataatgaaaatcttgtataccatccaatggccatattagtgaacactgtcttcctgcattgcctagttaactgtaaaaagaaacagctataaaggaattcaagagactgtcaactccaatttcctgttttctaaggaaaggag

SEQ ID NO: 55191 - DNA, 1261 bp, Bovine  19866880613079
atcccacctgccttgcagcggaagcaatatgcaacaaattcaggaaatctttaaaaatggtccacattaaaaacaaaacaaaacagaacaggtaggaataaggtggcattcatgactcctagaatgtgtggcttggggcagattataagggctgttgcgaccctggcagacagcttgagtctggggccggcatggcatctatacagctggtgtgtgcggatcctttgatggcagcaacgctcagactttagtggaattgaagaccctgaggcatttgttccaaactcagattgttggctgcatcccaaccaagggtttctgatggaacctgatgttctgcatttctatcaagttcccaggggatgcctaggctggttcagggtcacacctggaaaaacactgcttcaaagagcagttcaggtgggcatcatctttgtccatcctctgcagttaccccagagaagagatttccaagtgcaagggagtagatggcaggttgtgacacaattaccactctcttttccagaatgctttgcttcttctctcctttcaaatgaacatgaacctctgtttaatatccaccccttttctccccaaaggggaagaccatagaatcaccttattaagttgctcaccacaggttcccagacgcccaagtccttgtggggcaatgggctgtggcagcccggtttgcaggcaggggctgctttcaacagaccctgtatccccatccttttctcattgtggggctccctgaaaatgcactccttcttcccagacatttatctaagagtaacagcgcatagaggccagtagcactgctgatctccaaccaggaagcattcagaccgtcaggaaacacgggcgagcaaatgtttactgaccgtgtaattaatatgatgctctaccctgtctctcggcccttagcaccgtatttcctgttcagggcagtggaaagctaaaatatttgtcgctgtttgaccaaaggagcaagtgtcttccaaacgaacacatgatctattagcagtcctgccgagtcttcccatgggaacaggcattttactttgttttacagctaatttctttcttacagcaggttcccagacacatcaaatgccttacatgtgagtctgaagtcaagatttatagtccaggcccatgtaattcaatgtcaagcaactctgataacataagggcttggaagtcaaccattttctcatgagttctcataaaaaagtcattttagccaaattaagtttga

SEQ ID NO: 55192 - DNA, 1045 bp, Bovine  19866880753187
tctgtgatttctggaaaatgcttatgtaagcataatcctaaatctccaaggctatatacacgcatatccacatacattagcacgtatataatcacctgtcacaatactcatggtcagcactcttggttctccgctcttactccctttaactggcgggtgtgtccattcatcaactgctgtgggtattttacaactgtccccttatttggataattgcccttggccaaatcagatctactttgcctggaaatttatactccctgctcctggaagccatggagagatagccaatggctgactgacaatgagtgttttaaaaattaagataaaggccagtttccttgccccaaggtaggaccaaccatggtacaattcatgcttcggggccctccgagggatgaggctgcagctcagctctagatgagaccacccacatgctacatgccttcgctgacccaccgatcccctcactccctttctcctaagaccccttctttcttaagccccaggcactgtatccctgtctcaggctctgcttctagggaaccccacatgaaataactcctcatcactgatactgaaattttcagcaactaggaccctaacatgggtgttttcttggtctaatttcacttttaattttctaagttattcaccaccacataatttcagtttgaccatatgcttgacaagatatcctctcctctccccacctcagtctctgtcattcacgtaggcaacagactgcgttccttaggttggaattgcctgacacgttcctatagaaactcaaagctcatttgctttctttacaacaatgtatagattggattacctcctactccttgcaggttagggggtgtcggggggcgtggggtgaggggaagagaggaaactttcaaaaataatgctttggaaacagtaatctctcttgaacttgaaacccacagacaatggtcacgggattggctggtcctggaaaacttcccataagaagaccattctgtgaaaccagtgaagctgacccagtctcgataagctatct

SEQ ID NO: 55193 - DNA, 1006 bp, Bovine  19866880953169
atacttacaccatcagtcaattcaccgtatctattttggaatattccaagcctacaactaaaggacatggcttcctgctaagattaacttttcccaccttggtttgtgaaattggatatacacaatgcttcttcttaaaggtcaccctcatacagcaacactgtctgagtactctctccataccacagacttgagctgtacatggaaaagtacttgaaaataataatttattatgctttttcactttaagaaaatctatcttctgaaggtataagtagaacctgtgcctaaaaagcactgctgctgctgctactgctaagtcacttcagtcgtgtctgattttgtgcaaccccatagatggaagcccatgaggctcccccgtccctgggattctccaggcaagaacactggagtgggttgccatttccttctccaattaaatttgtttttaatttaatctcaaaatgacagaaatgcttttgaatttgggattacagtatgacaactccttcctcatatggttataaagacttgacttgaaatgagacacttagacctattgaagcttctcaatttagtctatgaaagggatcaaaagttgtgcatataaggctgagacaggacgctgagtgtctcttaaaggagagaaaaaagaggctagatgtcaattattctagaattcaatggtttcagtttcaaacagaataccaattgaacattttaaaaaatcaacaattatcatttgattccaacacaggattaggtaggatggtcctgaatttgaaggtaaagagacatggatatatatttaaggaaacaacactaaactggccatgttttattcttgtacttctttactgtcaagaagaaactcactctattttgtgactcagactttcttcagccaaactaggcttagagattcaacagggacatttcaaccagaaaattcgatgacagttattctttgtgtctgtaactaggttgaaaaaagtgtgaacagatg

SEQ ID NO: 55194 - DNA, 762 bp, Bovine  19866881022660
ttcttcctgtgttggctttgtcttgcaggtgtctcatcttatggtagtttttggagcttcaagtttctgaactgcataccacaccacccttaagaaaagaaaacaatcaatgtatgagaagtttaagctctacggggctagaacaaacttaggtcacatgtccacctttgatcaatcactatggctataagaaaatcatatgctaattggcttaggttgggctgcctccatgcctaaaagacacattgaaaacaggcttatactgactggtttaaatgatcatgaatcaccccgtgaaccatggtcaaggccattcacatccaaaacccttagctcccgtgcaaatggcagaaggaacagatactgatattacccaccttgactagtaagtggtagggaaagcattttgaacccctttttactccaagtccaaccccatgttcttccctgaatgcctaccctgtctttaggcaggaagtaagacttgaactaactgggccttcagggttggacctagggaggtgatctgcttttgaggtctgggaatgaaaagcatgattgtgtgtgaactcagaattaacagtatgggctgtgcctccctccattggtagggttattagaagactagcagtcgtttgttctactatcctgacaatttagggaattttcataagcagcgatttttgtaaagggaggggttaaaatgacttcttagacattgaggatccatctataataatgcatgttggcaaaagggagaca

SEQ ID NO: 55195 - DNA, 2237 bp, Bovine  19866881034123
aattccttgaagtcttctacatctttccgaattagatgtttgatatgagacacactcgaaaaggtcagaaggatggaacttaaccaagagaagctggtcatctattcaaaagtctcctcaactcattctgagttgagcccatctaacaagttttcacttgttcctttgaccctgggaatctacatgtaataattttgacttgaaaggtagaagttacattttcaacaataggagaaatttcttaaagcagcaaaaataaaattggtctttgccttggcctgccaccactacttcattgctatgacatatgacatcatagttagtcctcagagtccagggtgtttctaatgagctggagttggaagggtcccagtggaatgcagtgaaccaaaagaaccactgttctttcaaattccaacacaatattagaagggaaaacaaagagctcttcaagagccagaggtcaatctgttaagtaagttgtgcattaaaaagtggcagtaatgaataggaatggccagtgtcagagcatggcaacaggtaattgttacctatctatgctatattatcactgctactttaccaataatggtaatggatatgctactttcaacatattctgatacattcatatgtcatcacctgacttgagatccttatcacaagattgcctcaaacaaaatattattacagttttcagtgtgtatatgttattaaaaatatatttaaactttttatttattttaaactatatatagaaaaaatatatatataaatatatatatcaaaaatagatggggaaatggtggaaacagtgacagattttattttcttaggctccaaaatcactgcagatggtgactgcagccatgaaattaaaagacacttgctccttggaagaaaagctatgacaaacctagataacctattataaagcagatttattactttctgacaagggtccgtatagtcaaagctatggtttttttcagtagtcatataaggggtgagagtcagacatagagaaggctgagtgacgaagaattgaggattttgaactatggtgttgggtgagactcttgagaatcccttgaacagcaaggagatcaaaccagtcaatcctaaagggaatcaatcctgaatattcattggaaggactgatgctgaagctgaagctccaatactttgggcacctgatgcatagagctgattcattagaaaagaccctgatactgggaaagattgaaggtaggagaagaagggggcaatcgaggatgagatggttggatggcataatcgactcaatggacaagagattgagcaagctctgggaaatggtgaaggacagggatgcctggaatgctgctgtccatgaggtctcaaacaattggacatgactgagtgactgaagaacaacaaaatagaaaataaataaaaaggagttaaatattacccagaatatgagttaggctcctttttgctcctgggcacacaggacccactgaggggcatccacctttcatagcatccatgtaagccataaactacttattccctctggaaatgtatataattatttagccaattacatcaagacagcccagtggctacccccaacttcagcatacccaagggcacaggaattaacaggatctccttccataagcttacttggtatctcagatggtaaagaatctgcctgcaatgcaggagacctgggtttgatcactgggttgcaaagatcccctggagaaggaaatggcaacccactccagtattcttttctggagaatcccatggagagaggaacctggcggtctatatccattgcatcacaaagagtcagacaccactgagcaactcatactttcactttcttttccttctataagctaaaatcatagaaatggacatgggtatcttattcctaatcccaccacacagacccctaatcttcagtcaggggaagctggacaagcttattgtcttcaacatctccaaacaaaaatgactaataacatgcaatttccagatacacccacaaatctcaggacaaacctgttcaacacacacccttccaggagaagtctgggacaaggggcaccagggctggatgttacttacctctaggcttcacaaaaatgctccagaaatgtgtctgcccatgatgagaccacaattagagcgaaagagtttggtacaactatattaaaaaagacagaacaaattagaaacaa

SEQ ID NO: 55196 - DNA, 4179 bp, Bovine  19866881037665
ctttatgtagctctaaagttcctaacctaattttataactcttctctcctgctcagtgttacaggttttctgctaccaaagaaacactggtctcccatctcttctgaatcacaaaagatgccctcccttcctgacaaaaataattttttattcttagttgaatatgtgttttttcaagattttgattttgatatcctaagctgtcaaaggaatgaatgctaattccaggcactgtacacatactctctcttcccctaaatgtaattgtttgtaaaccattaagccttatgttaaagctcacaggttcagattaagaacacttagatggagctttccaggtggttcagtgggtaaagaacctgcctgctaatacaggagatatgggttcgatttctgggtcaggaagatcccctggagaagggcacagcaacctactccagtattgttgccaggagaatcccatggaaagagggattcccctggtgagctacagaccatggggtcacaaacagtcagatacgactgagcacaacacaaattatttttagactatctatatcatttaggcattagtgctttacaaactaccccaaatttagtgacttgaaacaatactcacttacgtggctcacagttctgctggtcagcaatttaggctaagttcagctggttggttctcttgttttcatctgggctctcgaatgtgtccacatcagctgttggtgtgatgaaggctgctgacctaggatggcttcagctgggatcagctctgtcccaggtggtccttcattgtccaggagcctacactgaactttttctcataatggcagtgggggtctattgagcagcactccacaggcctgcaagccttgtaggtgcccagtctcaagacccaagaaagagcccagagacagtgacagagacatccacggtttactgaacaaagggtctgagagcagcctcttgctgtgtgtggcagactgtgagcaggacaaggcagaagtcttagctccttgggggtaggatgctactctgtatagaggaattgacatcaggtgggctcttcatttatcaggggactaagccctataattaagaggactagagagtcatgtgagtacagcagggactgctcaagcagggagtatacagagagcaagagaacagccaccttgaagggcctgaccatacagcattcaagagagacacatatgcatacaaggcatttggaggtttaatcagaagacaggcaccatgtcacttctgccgcattctgttgatccattcaaggcacatgtctgtacaggttcaaggatcaggaaataaagcaacctcttggtgttcagagcagcagagacacattgcataggtgtatgaccatttttcggagaaggcaatggcaccccactccagtactcttgcctggaaaatcccatgggtggaggagcctggtaggctgcagtccatggggtcgcaaagagtcggacacgactgagtgacttgactttcacttttcactttcatgcattggaaaagaaaatggcaacccactccagtgttcttgcctggagaatcccagggacgggggagcctggttggctgctgtctatggggtcacacacagtcggacacgactgaagcaacttagcagcagcagcagcatgaccatttttgcagttaacttatcacaacctctgtccctttctgtattgtaattcctcaaagactcggtcacatttctcgtactctcagtgtttattggtgtacatcccacacaggacacttcccatacaacctcaccccaagtccccacagggcaaggtgctggtgattgtcttagtccattcaggctgctataacagaataccatagactaagtgtctaataaacaacctaaatttattgcttatacttctggatactggaaagtccaagatcaaggtgggagcagattcagtgtctggtgagagcttggtttatggaggctatcatctctctctgatctcatatggtagaaggggaggaggaactcttgggatctgtttcataagggcactaactctattcatgtgggttctgcactcctgacttaatcaactaccaaatgccccacagccccatcatctcagggactgagatttcaatttcaattttgagaggacacaaacattcagtctatagtagttactttgaccatcgtatccttttatgacaaatctggtcagccagaagatctactggctcatgtaggaatagaaccacagccactgcaaacagtaggttaattggttacaaagtaatatttatatcagtcattacacaaccctggctgcacaagagaatcaaatgtggtattttaaaaataatggatgcccatcagggacaattcaataagaatatctgaggttgaagaatgtacagatgtcagagctccacaggttactctactacacagctgtggttgagaatgactgattgaactatcaacccccctatccatctaacagaactgtggttctcaatattgagggcacatcagaatcacctagagagctgtgaaatagactgctgggctccacaatccaagtttctgagttatcagatctgtccggaatggggcccaggtgatgctgaaaaagaactgttccagggaccacaccttgagaaccactgttataaaggaatgtggtctattggcctattaaaagtacaacatctcagagacatatttgtccccaatactgccaagaaggcagaagagtctattttatagacctgtagtaattccaggagaggaaaggatggtttcccctacaactatcaatgagtgggttccacattcagtgattctgattaaactgggacctgagcgttgcagagattagaatttgtcccaagtgattccaatgtgctaccaggatgaaaagctaccagcctcctcatttcctataccttgtcccgggatcagcatcatcaacctcacctgaaaacatgctaaaaatgcaaactttcgggctctaccccagacctactgaatcagaaacctggggggtggggcccaggaatctgttataacaagcccttcaggtgattctggtaaatgctaatgtttgagagcccgtgtattagtgtatagtaacaaagaaaggaaatggttagtgccaagtgagtgacatgcggcttctaagccccatccgtataggagttcactggatttgggccactagggagaggtaagatccgagtgagcaggaagaagatgggcctccaattccccttgccaaaagaagtatgtgaccatgtgtgcttgggggtggagggtcggaatccccaggcggtcccgggacaatacgccgaccacactgcaggtgcaggcagtttagatggtgaagtagcgcagtgagtgcttcccagcctttttggcaccagggatcagtgttgtggaaggcaatttttcaatgagccgggagcagggggactggtttggggatgattcaagcatattactttaattgtgcactttatttctattattattatacagctctacatcagatctccaggcatttagatcccagaggtcagggacccctgaagaagtagagggaaataatcccacattggatcacagcccgtttcataatttcaagaagagatggaaagctgcatgatacggttgttccaatatccaagccaaagcaacaaatgaccttcagaatcccaggtaccttcaggaagttggaaacaatatcagtggcagagaggtgaattctcctgctatggaagaaaggaggaaggaatggctcattgtgaaaacatgatcctgccccctttcagagaaaatagataatgccaggggccctgtttcctttcctcattcaacaagcttcacagagtgcttcccatatgccagggatcatgttagtcattgggaatacatctggaaacaaaacgcaatccctgtctaggcagagaggaagagtcaaaggaacccacaaaatgcatattacttcaaggtgtttcttcattcccaggaaaccacactttgctagcagggtctttaaaaaggcactctgttcagatttaggtacctaaaccctacccctcatccatcttcccctctgagatgcccccaaggagctaaacacaaggaacaaggtataaaacaggaaaaaagag

SEQ ID NO: 55197 - DNA, 2461 bp, Bovine  19866880264344
ccatgtccattgagttggtgatgctatccaaccatctcatcctctgtcatcctcttctcctgccttcaatctttcccagcatcagggtctttacaaatgagtcagctcttcacatcaggtggtcaaagtttagcagtttcagttttgacatcagtctttccaatgaggatccaggactgatttcctttaggatggactggttggatctcacagaagagaaaccttacatattcagtgaatatggaaaaggcttcagtgagacgtcttattgcacgccattgaactcatacacgagaaaccctttatatgcagtgaatgtgggaaaggttcaccttgaagaacagtctgagcacacatcagcaaactcacagagaagagaaactatatatgtgcagtcaatgtgggaaaggcttttcaacgaagcactgcctcatcatacatcagcaaactcatacaggagagaaaccctatgtgtgtagtgtctgtggaaaaggcttcactatgaagggtgatcttgtacatcagtgcactcatactactgagaaaccatttacatgcagtgattgtgggaaaggctttactgtgaagagccaactgattgtacatgagtgaactcatacaggggagaaatcctacgtatgcagtgaatgcagaaatgcttctccagccaaggcccacctcatcagacatcaatgaactcacactggagaggaaccctatatatgcagtgattgtggaaaaggctttgttcagaaaggcagtctcattgtgcacgaacgaactcactgtagagaaacccaatatatgcagtaaatgtgtggcaaaggcttattctcaaaaaggaagcttaatgcacacctgcgaactcacactggagagaaaccatatatatgtaatgaacatggcaagggcttagatttccctggtggctcaggaagtaaagcgtctgcctacaacgcaggagacccgggttcaattcctgggttgggaagatctcctggagaaggaaatggcaacccactccaatattcttgcctggacaatcccatggacggaggagcctggtaggctacagtccatggggtcacaaagagtcggacacgactgagcgacttcactttctgtaaggagtactctagataagtatcagcagatttgcactggacagaaactatacaaatgcagcgagtgtggtaaagcattttggaagaagacatgccggatagaacatcagagattttactcaggaaatgcttctttgcacgtactgaatgtggaaaattctctttacacaaaaatgatctcatcacctgttagagaattcacatgggaaagaggccatatgaatgctgtgaatatgggaaagtctttaccacaaagtcaggactcaaggtttatcaatgaaacataccagagaggggccctgtggatgcagcaaatgtgggaaggctttttgcccacttgttaatccatgttaaacataaaatgaaataacaggtagtctcctttgggggaagtgtgtaacaagttgcagaccctcaagaaatagtatgcagagaagaattgcaatgcaaagaatgtggtattatctttagtgattacagcatattttatattgatggaaaaatgtacaaaacaactcaggtaaaaccagccttcttcagcgttactggttggggcatagacttggattaccatgatagtgaatggcttgccttggaaacgaacagagatcattctgtcttttttgagattgcatccaaatactgcatttcagactcttttgttgaccatgatggccactccatttcttctaagggattcctgctcacagtagtagatataatggtcatctgagttaaattcacccattccagtccatcttagttcgttgattcctagaatgttgacgttcactcttgccatctcctgtttgaccacttccaatttgccttgattcatggacctaacattccaggttcctatgcaatattgctctttacagcatcagaccttgcttctatcaccagtcgcatccacattgtggatattgggtattgtttttgctttggctccatccctgcattctttctggagtagcatacctactcatcaccagtagcatattgggcacctactgacctggggagtgcatctttcagtgtcctatctttttgccttttcttactgttcatggggttctcaaagcaagaatactgaagtggtttgccattcccttctccagtggaccacattctgtcagacctctccaccatgacccgtccgtcttgggtggcccaaaacagcatggcttagtttcattgagttagacaaggctgtggtccgtgtgatcagattagctagttttctgtgattgtggtttcggtctgtctgccctctgatgccctctttcagtgcctaccgtcttacttgggtttctcttatcttggatgtgggatat

SEQ ID NO: 55198 - DNA, 787 bp, Bovine  19866880403644
cccaaccctccgctgcgtcctcccccgtcccatcatgcactccttcccaaccccaccacaggctcctgcgaagttaatgtggtcccttcagccaatggcaaatgggtggtaggtgggacttcgtttgtttggacaaatgaaatgaaacgcaggctcaggacagcgtagcatggccaatcactgtggaggagtccctattaaggggctcaggccggctgcagtctgagaggaacaaagatggcggcggctgacggcgataactcgctcgaccccatgtcgatcctcatagacgagctccagaatgaggacattcagcttcgcatcaacagcatcaataagctgtccaccatcgcgttggcccttggagtcgaaaagacccgcagtgagcttctgcccctcattatagacattatgtacgacgaggacgaggtcctcttggccctagcggagcagctgggcaccttcacccctctggtcggaggtcctgagtatgttcaccacctgcttccacccctagagttgctggctgtggaggaggaggccatagtgcgggagaaggcggtgcagtccctgagggccatctcgcatgagcactcaccctcccatctcgaggaccactttgtgccacttgtgaagcggctggtgggcggcgacttggtcaactcccgcatctcagcctgcagccttttctccgtctgctaccctggcgtgtccattgccatcaaggcagaacttctacagtgcttccgggatctgtgctcagatgacaacctcttggtgcggtgtg

SEQ ID NO: 55199 - DNA, 3648 bp, Bovine  19866880737510
taaggatcacaaactggtttggtagcttgatagcctgtttatgggaaatgacaaagacttggatgcttacaattggacttggtgggggatgtctaggaagagcacaaaaggaacagacacactatcaccttggcagattaaagagctaatgaagatgaacgcacattaagttctgatgggaacagaaggactgaaaattgattgtctataaactcaactccagtatcttgaggctctttggacgttagagcaactaaaaaaggaaaggctattggctgtgttctgaatgacacagggcaattatcgttaactagtgtcataggttactagaattctccagtaacacatcctgatgttggctcttctaagcagaacctagtggctaccactcttcccaggtaaagaaatagaagtgaagttgctcagtcatgtccagctctttacgaccccgtggactgtagcctaccaggctcctctgtccatggaattttccaggcaagagtactggagtgggttgccatttccttctccaggggatattcccgacccaaggatcaaacctaggtctccctcattgtaggcagacgctttaccatctaagccaaaagggaagtccccctcccaggtaagtccatagaaatattctcaaacgacactagtccttattaattatcacagattcttcttccaatgtatggtgatcattctgagtgtgtgtgtatgtgtgctcaattgtatctgactctttgtgatcccatggactatagcctgccaggctcctctgtgcatggaatttttccaggcaagaatactggagtgggttgccatttcctcctccaggggatcttcccaacctaggaattaaacccatgtctctcgggcctcctgtgttggcaggtgaattctcccccactgtaccacctgggaagccggtaatgatcattaccaataagcaaaagacctacaggtacgtgttctggctgttttcaccataagttaccacggctcgctctttctgggtaacagttttcattagttactatgaaaagaagtaaaatgcccttataccgattttgcaattgaacacttaattatcaactagtctagtaaatcacaagttcctgaaaagcatattcactatatcttacaagtaaaatatccctaaaacagggatataagatgtctctataaaccatttcagacaactatttaaaaggtgaagaagaactaagtgctaacatataaacacagcaaaaatctgccctcaaggagcttttggacacttttcaacagatagaacaaataacagaatcagatatgaaatgactactttttcaagaattatcagcacaagattattaatatgaatgtttaatataaaggtttactgtattgagaaataggaaatctaaaatatgtagaagggatattattaaaatgaccatttagatgtacataaaccagcagaaaaatttaaaaataaagttcagttagttctcattattcatggatttactgtgaattcacctgactgttaaaatttctttttaaccccaaatcaataatcatagcactttcacgaacattctgcagacatctgcatagaataatttgagcaacaaataatttgagttgcccaatgtgtatgatcccggctgagtctgaacaaaatgatgttgtcttatttcagttctcctattgcaaacaagcacccttttcatggtctacttagtgtcatgtttttcatatttttatactttttcttggtaattctgctgattaaaatggtcccaagcacagtgttcaagtaccgtctaatgtcttcaagtgcaagaaggcagtgatgtaccttatggagcaagtgtatgtgttagataagctttgttcaagcaagaggtataatacagggcttcccctgtgggtcagtagtggagaatctgcctgccagtgcgagggacacgggttcaatccctgatctgggaggatcccacatgtcacagaacaactaagcctgtgtgctacaactactgagcctgagctctagagctcgtggcctgcaactactgatcccatgtgccctagagcccatgctctgcaaaaagaagtcactgcaatgagaagcctgggtacaactagagaaagcccacacgcagcaacaaagacccagctcagccaaaaataaacaaaaattttaaaaagagatactgcgcaattggccatgtgtgtgtcagttgttcagttgtgtccgactccttgcgaccccatgggctagagaccactaggctcctctgcccatgagattcaccaggcacgaatactagagagggtgccattcccttttccaagggatcttcccgacacaggactgaaccaggtctcccacactgcaggtccatctttaccctgtgagccaccagggagcaatgtgtccctttcttcacgtggacagaatcccacagaagattataatttccataatccacttggcacagcctgcttggccatatataacatttataagaactattttaacatcattttctactaattctatcacccatgtcatttctgggtctctcattacttttttcctctttttagatttattgttttccacattgttattgtttttaagaaatattttttcattttttatttttctgggtctctttcccacagactttccttcacatttatgggtcctattttcctgtttcttggcatacatgcgtaggttctgattggatgtctgacttcatgaaattaacattactggttgatccatgcctgctgagtcatgtcctactctttgcgaccctgtggactatagcccgccaggatcctctgcctgtggaattttatatgtggatatattaatctattcaatttcagaatagatacaaacgtatgtttggtagtatttccagcagcaaaaatctcatgttccattaggagagagttcttttccatagctgacaatttgattcttatgtttcaagagcattccacggtgttcacatctaagaattagtacaagattctctgattaaagaaaaaaaatgttaatgtacttagatcataattactttagataactgcttcactgggaacatgctgttccaaatttatttaaggggtaggcaggaatttactgaagtgcaaactctctgaaatctaatgcttttgtggtaggcaatatcatgacaaatcccaaagatgttcatgtcccaattcccagaatctggaaatctgttacattatacggtgaaggggaattaaggcagaagatggcattaagtcattttagggccaaataaattgtttctagagttttaaggttcacagagaaaaatggtgccccagggaagattacacccagaggcttaccaatactagctttagaaggtgagatttggcactcccgagtggatccgttttaggtgagattttggactctgagttggtcctgtgacaggctgagacactcggagatggtgggatagggtgactccattttacatgtgggatggccacgaatcattgggtgccaaagggtggccttcggtagggagcataatggcctcccaaagatgtctacatccttatgtccaggacttgtgaatatgctatattataaggcaaagggga

SEQ ID NO: 55200 - DNA, 1639 bp, Bovine  19866880995773
tttcagttatttctacatttacatgtgtgtccatgagttcatgaatctagaagtccacggttttcataaaaaaatcatgattttataactgtgtactgtattatagttaaaagtataaatatattccatgaccttgcattttttctacactctcttgttcatggttcaaatagtagtaagattactaacatgttatgtgtatgtgtttgtgtgcccatatctgtaatgatcgtttattgccttctgtgttgttcactttgaacttatttcaagtagtctcagggaaccctctgtcagtgtgcttctaatgctattcttttttttttagccttaatgctcttctgttacttcagtttttgcttctttatcttcagtttaagactgcattctctttaattgaggttcttggtatatcatttcttagcttcttaaactaagttgagtttctccaaatgtctctgatacttgtctctgtagaacagcatgtgtctttctctactgagctatgatgttgattaaaaaattccatagccgtaaagcatttagaatattgcatagcatctttaaaggatttgaacacttttagtcattgctgttgttcttatgataataatttaagattttgacctttttttatggcactgttgactttgtcatttctgatgccaccacccatagtgtagctcatctagatattgaatagcagtcagtgtgtaaaacatagtctaacacttctggaggaacatcacattgttgaatcttacttacatgtatttcatgtattgtccacaaaaatgaaaaatccatgttgattacaggttatcataatctttgtataaaagcaaaaggaattaaaattaagagacccataatttcctccaaatagctttacttggatctgtcggaaaacatacttcaacttgatcctttcccttctcttctccttttgtgtgaaaataagaactctcctcatggccccttggtgaaatgtgttttcatttcaggcacagttgaccttcaaggatgtggccatagagttcactcaggaggagtgggaatgcctggaccctgctcagagggccttgtacagggacgtgatggtggagaccctcaggaacctagtctccttgggtgaggatcacttccctttgaagttgggatctgccctggggtatctctgcatttcccactgcgtgcctcttgggagccccggttttacttgactgatctgaaatccctgttgattcagacatgaagagcttcaggacgcagcctcaggagtttaaatctaccttttcctctgacgatctgcccacttcatgatacatcaggaattgttccagagcttttgtagtgataaagttcaatggaaaacttttaagacacgccttttcctgtttcctacctatgtgcttttgatttagaagtcttaggaaaagaggtatgtttctgtgcattatactgttcccttcgtattcagaaggagataacagcctgtaaattttggaaatatttttctgttcctctctgtattcccatcagtcctcagttgagcaagggactaggattctggcaaagccacagcaagtcatgtgtctttcctcttatgtggaggtatttgtttcttatctgaatattt

SEQ ID NO: 55201 - DNA, 3413 bp, Bovine  19866881042601
tgagtcttatccttctttccaataaatcctcatttcttctatgtctcattacttcctttgcttcttcaaaccattgtcatgtttgaactgcctactttattccttatcttgctttttctgtttcctttccaccgcagaatatggcttcaatttaagtaaagaatttttttgtgtttctccaataccagcaccatgtctggtttgtggattagccatttaataaggatgtgttgaatgaatgtctttcaccattttgaaactgggtgtccctccagtctctgtgaggtgatgctaacagtgacggtatttaactgtccccagggccttatttataaagcaaacaaatctatatttattcattgtgaatttactgtattttacactgatggctgacatcttttgggttgtttggtgttttatattatcgtgtttttaaccatttccaagagattggagttagtgcttaatggatgcagagtttttcagttggagaagatggaaaaaaaaccccaaaaaactagcaatataaggtgctggtggttgtacaacattgtgattatacttaatatcacagaactgtacatttaaaaatggttaagggacttccctggtggtcgagtagtaggactctgctcccactgcaggggagcatgggttcaatccctcgtcagggaactaagatcttgcatggcccagccctgccaaaaccattaaaacagtaaaatttattttatatatatttaactataattttgaaaagttttttaaagataaggtaattttatgcttggaatttctttgatatcttgggtttttcattaaagagccagcttaccccaaggtatttttgaaatagttttattccatctgatgctcataaagtgttcattgttatctttcctagacattaaggaagtggatgatcatgtgcagttgcactggcaaaaccaaaatatgccgaagtgtcatgaacagaatgcatttgggaatattattcatcagagcagaagttgttttcctttaaggccaaattatgatgtatttgatttacacaggaaaactctgaaatcatatctagatgtaactaaccagaaaaaaagctgcaacaaaaaggagcctgctgagtttaattgggatgggagattcttgctccatgctcatcatgaacaaactcatactgaaattgaacatcaggaaatacacaaaacagagaacacccatgaatgtactgaatatgggaaagccttcctcaagaagtctctcagctcaatgaacataaaataattctcacacaggaaagaaaccccatggatgtagtccgtgtgggaagaccttcttcaagaagttcaagctcactgaacatcagcgaacttacaaaggagagaaaccccatgagtgttttgagtgtggaagagccttcctcagggaattttagcttactgaacatcagaagatgcatacgggaaataaaccccatgtatgcagtatatgtggaaaagcattctacagaaagttcaagctaactgagcaccagagaactcatacaggagagaaagcctacaaatgtactgaatgtggaaaagccttctttaggaaggcagagctcactatacaccaacaaaacaaaacaggagaaaaaccccatgtatgcagtgagtgtggaaaagctttctccagaaaatcacagctctttctggatcagaaaattcagacaggagggaaatcttatatatgcagggagtgtgggaaaggtttcacacagaagggcaatctcctcatacatcaactaactcacactggagagaaaccctatggatgcactgaatgtggtaaggccttcagtcagaaggcatgcctcatagcacatcagcgattccatacgggaaagacttcctttgtatgtactgaccatggaaaatcttgtttgcagaaatcaggactcattaaacctcagagaattcatacaagagagaaaccttatgtgtgcagcgaccgtaggaaagccttcaccacaaagacaatgctcactgtccatcaaagaactcacacgggagagaggctctatggatgcaacgagtgtgggagaactttctcccacatgtctggttaaacacaagaggacacacacgagagagaaacaagtagattctgtgaaggtggaatactctttcacaaagggtcacagcttcttagatactagtgaactcttgcaggggaaaaaccctgttaatatagtgactgcgcagatgccttctgtgacccctcagacatcattactcatcagtggactcctagcaggtaggaatgtagtcctgatggaacagccagctgccagatgtgcaccctcaggagataacagagagtttgtacaggagagaaaggtttatgaatgctatgaatgtggttatgccttcagtggtcaattacatcttattttatgtcatgaaaaatacataggaaaaaaactggtacattctatatggaaaagccttgggccataatgtatagctgcttgcatggttatatgtaaacaggaagcctgtgaatgcagaagttagaaaagctgtgttttggaagaaagaccctgtcatcagtgattaccattggtcataggtgagcttatagtgggtaaaaaatatgagagtggtaaaacccttgcccccaataggtattacatatgcgagagaaactgttggaaggcagtgaatgtggcaaggttttcagtggtacattctgcctcatccgtcagctggtgaaatcatacacaaagcactgtgaacatactacttgacaagtatcttaattagttcttgtgatgcaaagcctgtgaaaatgaggggtatttgagagctttatgtaccatttcccactttaatgcattacataatatacctgatacatatttttggacaggaaacctggaaccatattcttaggtactatgcttaaaagtgaaaatgttagttactcagtcatgtctgactctttgtgaccccatggactgtacctgccaagctcctctgtccatggagttctcaagacaagaatactggagtaggttgccattccatttgccaggggtttgacccagggatcgaactagggtctcctgtattgctggcagattctttcctgtctgagcaaccagggaagcctggttactatgcttatgtttccataattttaaggagataatctacctcacatcactggttatattcatttcttatacattcatttctcccaactgaaaaaaaattatcttcaacgcccacccagtatatgataactagctgctacatttctttgactctaaatttatttaaatattatttcagaaaattgaattttctaataagaaaaataaatattaaggtcataaatgcaacttaatgtcctgaagagcttaactt

SEQ ID NO: 55202 - DNA, 975 bp, Bovine  19866881566422
actgagtgactgaactgaactgaaactcctacaaagtaaaagttctctgataccgggagagaaatgcagggaggaactgttcacccatcctccaaccccctcacagctgtggctcttctctgacaaggtcatttccacagcctgtccccctgctggtctctcactcacctgaacgggtttgacagtgggtttcatcatccatcatccatggttctccttgatccaatttggagactacctctggtgtgcttgcttgaaaacctgttcatgggaaatgacagaatatttaggcccagtgagtttgccttggggtctgtgaagacagcagaatgctacatgtgaggccaaaacaatttcacaacctacagagtcaaggcttttctcacaggagaagagagaatacacccacttctcttgggccagagaggacaccgagcatcacagatgctccagagttctcagaagctgagaaaggaaaggccactgactggggacctggtcagtgacccaagggagccatcctcaccggcagacaccaggttgctatagttctccagcatcacatccctgtacagggccttctgagcaggggccaggagctgccactcctcccacgtgaagtccacggccacatcgtcaaatgtgagggtttcctgtaagaagagaggtgtgtgatgatgatgtcatcttgatgatatggaagaaatgttaagggtgttctgctcatttccactttacaggctgcactgaaatatccagtagggtttttattttaatgtatcattaaagaagcaaatgctgaatacaatattctctaatatatgtgtatgtatatacacacacatatatatatgacatgaaaagatacacaaatttatactttatggaataatgaaagtgattttttacaggcctctaaaaatccattagggaacaaaggaaagaataaaacaaatcaaaagtcacctgggcctg

SEQ ID NO: 55203 - DNA, 1095 bp, Bovine  19866880545284
tcccaaatgacgggacgtgaactccgcctactcatctggcattcgagaaggcctgacgtcctgccaggacaagcattaaattgcattgttacaaaggagaagggccctcgctctttaattctccccaatgctgaggccaaaggaagaaaatatcagcttgggtgctggtgtctttaaatcctaacacttgccaacctccttaaaaaaaaaacaaaaaaaaacaggtagtctttagattgagagccttgatagcagcatctagctagagttttactttttatgatgggtttgattttatttttcaaatgacttggaatttcaagtcaaatgacatgattttccattgatgatgataaagactcatttaaatgtatttaagtttataaaaagcaaacaacataaaagagaatataaagtcaaaaacagtccagtgatagacaagccaaacaaaacaggaaggctggttaagatggtaaattttaggttatgtgttttgtactacaaattttaaaaaagagcccttaaaaggatgacaacagtcatataataaacctttctgagtcagttactcgccaagcatttaatgcatgcattttctcatttaatcctcaccaaaagtctataaagtaggtgctactatttcccccattaacagattagaaaatgaaggtttagcgagagtttatatataacttgcccagtggcatcctgttcattgggtaaaaggactttgtaaactgtccagttgccagtggcgtcttggcagtaagcaaacgtaccacctaagctacataaagaaaaagtcttcaccatccccaaaaataaattcattgacattactgagttatttgcatatagccaaatcacccagggcaactttaaagagttgggaaataaggtgctttacagttgtatggcctatttgagattgaagagcagatttcttatatcacctgacttaatcatccactaagtcgaaggcagctcttactatgtgcatttgacagatgaggagactgaggctcagagttcagtgacctcaatgagtagaagagccaaccccacaatccaagtttatccaggttgcccttcagg

SEQ ID NO: 55204 - DNA, 920 bp, Bovine  19866880640555
tatgtttgcgacaaaaagacccttatccgaatataccagatctagtccttcaagaaaacatgacagcggaagcatagctagaacactgtcctccaggtgggtaattggagcttagagtgggagagacgccgacagctgttaaggttgtggagtcttagctgaggcctcttcctcatcctccattttgcatttcactgcaaagaaaagaaggagaaagtcagggctgatttatcaacacacacctagacagaagtggcacctggacaccgcaaactttgatacacggaagtcagttgctttgaatcccactgagctcctgcaatggttctgagcccacagatccaccggggaagaacacagggccattgtcctcccctggcagcacctgaggtttcaaagaaactgcacaaaatgttcacagctgttctgagttcagttcagaagaaggtcaaaagtatgcttggcaggtcaggggcactaagggaagtttcactaaagatgatgacagattcgaagctctcgattcaaccgaatctatcaccactcaccctgttccccccaccacccaaaattaaaaactcaggacaacactggggtcaatgcacggccagaagagaaccttttcttgtctttcatggaccggacgagaatgtgatccgggtgatttcctgagttggccaaacaggaaagttaggtgaacacacaacggggactgttttgtaagggaaattgtcccgatagataaaaagccctcctccaagatgcacggaaatccaatctcctggcgggtggggatccatttggaaagaccctctctttttaataaatctttgcttctagtgtccaagtgcttgcccccaatgttaaggcctaaagggttattcagagcaaggccacaggctctggtcatgtgtggagag

SEQ ID NO: 55205 - DNA, 1012 bp, Bovine  19866880688047
gcacgacacggttgatgcaggacacgacgaaaggcagtaaaagcaccgccccagggttactgtggttcgccaggaactgcaggggatggagggagagaatcaagttgctgaccgtacactggacccctctctgcctgactcagaagatcccccaaggtgggaaaaccccagaagtagctcctctgattagctattaaaggaccacttaccaaagcacttgcccttggccaagaattactcacatgatgctttaattcccactatagcccaataggtgggtgttcatagacttaactgatggacaacctgaggctcagagaggcaaagatgcttacccagggttccccagctaggaattggcagatttgaacccaggtctatcagactcagggacctatggcccaacagccattctgtgactttactttcctcaccaagagatttggaaacatgagaatgtgctccaggctgctggaagaaaagcttgagttaccaaagctacaactcaagggaatttctcctccgctctcctgcgtgcccttgttcatttcaccaagctttgcctgtccttgggtgctgaattaggggcaagggagcctctgctagcccatgctgctcttttctatgagggtcagaggggtgcccctgcctttgtggggacaccaccctggcatttgtctggagtgaagcctatgccgcccctcttggagtaagagattctaatggatttatctgatgtctgaaagttccctcatttcccaccctgaagcctgactctgcctctatttacctctggatagctttgaaaacaccacttgcactttcacagtatctttggagccagatcggagagggcaatggcaccccactccagtacttttgcctagaaaatcccatggatggaggagcctggtaggctgcagtccatgggggtcgatagagtcggacatgactgagcgacttcactctcacttttcacttttcacttttcactttcatgcattggaaaaag

SEQ ID NO: 55206 - DNA, 2626 bp, Bovine  19866880727922
ctaagtcgcttcagtcgtgtccgactctgtgcgaccccatagtacggcagcccaccaggctcccccctccctgggattctccaggcaagaacactggagtgggttgccatttccttctccaatgcatcaaagtgaaaagtgaaagtgaattcccttagtcgtgtccaactcttagcgaccccatggactgcagcctaccaggctcctctgtccatgggattttccaggcaagagtactgaagtggggtgccattgccttctccgtagaatgtgtgaggagctgttaaaaaccactgcaggtgggaatgtggtggaggggaggggtggagtgcactgctatgcaatggaaataccatgtgagccccattcaaagagctaaaacaaaaacgtgtaattttaaaatatacttcatttaatctaattcatctaaatatcatttctatatgtaaacatgtaaacttaaaaatcagtgagatatttcatggtctcttatttgcattaagcctctgaaattcaacatttttttttttttactcacagcatatctcagtttggactggccaatctctagtgcacaagagcctcatgggaccaagtggccagcataatggatggtgcaggtccagcacttagagccaggctctcacttgctggtggcaggactgtgccaagttcctggctctttcccactgggtgggcccccctaaaatgagatgcagtgattccaaagagcttttctagccctaaaggtctgtagagttctgtcttgctttctgagaaatgtgcatattaactagttttaacaatacagatgatggaaggaaggaaaagacagaaacagaaagagaagagagaaaaaagagacaatgaaagaaacagcaaaagagaaagagacacagagagagaaagacaaaaaaagaaaacccaaaagacaagacaagacagattaacagacaaaaagaaaagtcaaattacagggtctgtccgatgccatctcttcatcctccagggaagcaggagcaggaggaggtgggatgaaagtgaagacagcctgttgttctaacttgaacagatgagcgcacttcctcccagcagtgctaggaactcagaaggaggagtaagagagaatggatgctgttgctgcgagttccatattagcctcactgtcatctttcatttatgtgacaaaataaatttgtgatctcattgtcccattataacctcctgagagttcaaattgagcagcaataaatttaatgcaaacatcacttgggcatatactgtagatgcaaagcatctgttattattgatttatttgatattgttctttaatataaaattagctctataaagcaatttgcttcttaggaaagatatacaggaaaaatattaaaatgtcaagcaccagagaaatttaagttggtataaaagttcagttgaatctaatcataggaccttttcattcttgcagattcaaattacttgctcaaatccctagctggctgttggaaaaatctgcttttcaaagactgagatgatcagtaagagtgtttctttaactttcaacacacaaaaaatttcaggtctcaataaatcctaacttgatataaaccttctaaccctgacttcagggcagaatgaaacccgctggaacagctatgacgttacctggtaagacactgcggttatccacacacatggaaaagatgcgctcgtacaccagcttccctggggagaaaaggacatatggtgtcagcatcatgcccttcaggtgcaaacactaaattaacatttcttaattagggacagagaaggagacagcgccaggatgagcttcaacttgtgagagtatgctgccacctagtggaccaaatttttaagccatgattcttttgaacttaacactttctgtgaagaggcagaaaagtgatccttcacttatgccaggcaaagtaagtcagacagagaaagacaaatactgtctttcgcttatatgatttcacttatatgtgaaatctaaaaagaaattaaaaaagtaacagagtaatagatacaaagaacaaacgtggttgccagggaggaggggaaggaatgaaacagtgagagagataaatgactcatgggttatgaaatgtagttatggggaatatagtcaataactacgtattatctttatatcatgacaaatactaatgacttattgtggtgatcattttgaaatcactgtgttatgtaacaggaactaacacaggtcagttatacttcaaaaagaaacaagcagagcctgggatctacaggctctatggtggggtcaatggcgacctccaagagggcttacgccaaggggcaccttccaggactgcagcggccagtacccatccccaaggtgagccacctcctccgaggtctccacaggagactctccaacactagcaggcatatctaataggctgaaagtgagagtgttagccacttagttgtccaactctttgtaagcccatggactgcagcctaccaggctcctctgttgatggaattcttcagataagaatactggagtgggttgccatttccttctccaggggatcttcccaacccagggatagaacccaggtctcccgatctt

SEQ ID NO: 55207 - DNA, 927 bp, Bovine  19866880753905
aatttacagcttgtgctttccccagatttatttaccaagcgggcagttgcatgttatcaaacaggcagggagcagaaatgtcaaagagtacaggctttgcagtacattcctactgtgccatttgagcagggaaccacagaacgtgcctctctgtagggtggcatgtggcaggtgagctgggtctttgcctgtgtgatcagaggggacacaccattaattgtcacgtacgcttttgtcgtgtgggacctgcagctttactgggctggactgggctgatgagagtcaggaaaaccaactcgccatatggtaccatccgactggctccttctatggcagtgccagaaagacccccactgaagagtgaattaggttatttctttgtccaagaagcatgtgttgaatacctactatgtgcagggttcttccaggcctcctaggggatgcccagctcggtagtgtggggcatgtagtccagagtctggtgctgctggattccactggggttctgccattcagtggtgcagatccattctccttccctcccgccacctgaccagggctccgtttccctgtctgtaaaaggggtaggggtggttcataacaactaactcctggattgtttcaagcctgaaatgatggttcagatagagcatttagcacagtgcctggcacatagtaggtgctcagtagctgctgccacctttgatcctaataaagcagatgccaacattaagatttgtagcctgttatgggaggggcgacaagtcatgcactcaggtgactgtgacacaagataagtcagataaaagccaccagagatgtgtattcattcattcactgaaaaaataaatcagagcaccccacacgtgccaggtgccgtgctaggagggcagtggtgaacgaaaaagacactgcctctgcccgcat

SEQ ID NO: 55208 - DNA, 1504 bp, Bovine  19866880797457
taaaatttgtgtccccaaatagcattttttgccctgtttttctttaggatgaagatataacgcttcagatcacagaaagtgaagataatgaggaagatgacatggttgatgttatctggcgtcagttaatatcaagttgcccatggctttcagaacttgatgaaagtgcaacagaaggagtcattaaagtgtggaggaaagttgtggacagaatcttcagcctgtataaactgtcctgcagcgcatattttactttccttaaactcaatgctgggcaggtaggtagcacagtattcttttatgaaagtttatttgaaatttcttttctagtagatgaaaacagcatttggaattgtttaattgtatcctcttgtctctcatccttagattcctttagatgaagatgaccctcggctccatttaagccacagagtggagcagagcacggatgacatgattgtgatggccacgctgcggttgctcaggttgctcgtgaagcacgctggggagcttcggcagtatctggaacatggcttggaaacaacacctactgcgccttggagaggtggtggtctaaataaaatgtttcagggaaaagtacttctgggtagaatgtagtaagacagttgaaacataatagttccttggatttccctggcaggccagtggttgaaactatactttcactgcagggggtgtgggttcgattcctggttggggaactgagatcctacgtgcttaacggtgtggccaaaaaaaaagttcctatatgtttactgtttgaatgtgttatgaaatagctaaattagttcagacgacactgtggactgcttgttataccactttccctcccacctttcagagaaatggaaggctgagaggcaaaaagcttttaatatagaaaaggaattttggagagagtgataagaatgtttcaaaaaatttcatatccctttgaaaaaattgtctatatctgccttcttttacaggcattcacagacaatatatttctgtgtaacgtttgaatcaagattttgattacagctgtgtacccttactaaacctgcaaatcaagagctattatgtatatagttctttgttatcccagggagaaatttgaggctcctagaactaatggctgacatatatcaagttttatccttttgcctccaccatgttaactgtttttctttaataactttaaagtatttttcttcttatcctaaaggaattattccgcagcttttctcacgcttaaaccaccctgaagtgtatgtgcgccagagtatttgtaacctcctctgccgcgtggctcaggattccccgcatctcatactgtatcctgcaatagtgggcaccatatcgcttagtagtgagtcacaggcttcaggtaaggaaggttaaaatactgctactttaaattagtttgcaaacactgtttattaggtaaaattttttgagctttatgttccagagttataagagtttgtactttttttttccc

SEQ ID NO: 55209 - DNA, 1581 bp, Bovine  19866880802997
ttttccccacacctaaactgacccaatttctacgttctttcaaggaaacagccctgaattttggtttttctttcctgtgagtcccctgttaccaccactctccccgctccctggtttcaccctactctgtgcccatttactgacctcagtaaagaccaacttaccagtgaaatggagttcagacactgagcacagcagttgagctccaggatacgacgggacttcttacttttctctttgtcaaccattttcctgtggcaaagggcagaagaaagtgagacaccaatgtggtaatgcattcatccccttgacatttcttgagtgcctgccacgtgccaggcacagtcccaggtggtgagacacagatgtccccagctcatgaagctggcaccttagtggggagagaaagaaaataaataagaaatgtaatcataacataggtaaacaatataagataatagaaggtgagtggtactatgggaaagagaagggggaaacagagcagagtaaggaggcgggaaatgctgggatgaagaccctgttatgatttgaatagctccttatttgcacaaagtctggaaggagaagagggggttagtctgtggataagggactatccaagcacaggaaacagccaactcgaagccccaaggaggctgagatgggcagaaatgagcaggggaagggtggagagtgtgagtgataaccgtgagtaggtggctggggtcttataagtcagtggttctcaaccaggaagattttttggcctcaacagatatttgggtatgtctgcagacttttttggttgtcagattgggggttgggagtggcactgacatctagagaccagggatgctgctgtataccctagagtgaacaggacagccccccaaacatagaataatcccaactcaaatgtcagattgaaaatcctgctgtgaagtcttttggatcaccacaaggccctcactgtgtgacagacagagccaagcagagtttgaaatgtaagggtattttcaaaaagatccagctgcagttgttctctttacttttccatgaactcattacatcttctttgctctgggctcttttctttggcccagccaaaggcccacccccacaacaccatctttcaaagctcagttcacagacgtcctctactttgcccaagtggaccgttatctctagtcctgttatctcctagtcctccccctgcaatctccttctcccttgatttggcctgatattctttctatcatttataagttacttgttgaccaatctactttccctgccagactctggacctcagaacaattgcatcatttatttacatatatacaattatttattagcaattgcatctactctactaccagctccttgtgctcgtgttcagccatgtccaatctttgtgactccattgactgtagcccgccaggctcctctatccatgaaattttcgaggcaagaatactggagtgggttgccatttccttctccaaaggatcttcccgatccagggaatgaaactttttctcttttgtctcctgcactggcaggcgaattctttactacttg

SEQ ID NO: 55210 - DNA, 1978 bp, Bovine  19866880858024
ttagttcctctttgctttctgccataagggtggtgtcatctacatatctgaggttattgatatgtaatcaataattatgtaatatctgtgatgaaagatcataatataaacttatcacgattagtttgaaatgcatagaaatattgaatcactatgtaataggaactaaaatagtgttgtagatcaattatgcttcaaaaaccaacttatagaaaaagagatcagatttgtggttaccataggtggaggtgggggagggggaattggatgaaggatgttcaaactccagttataagattaaataagcactggggatgtcatgtacaacatgataaatatgattaacactgctgtatattctgtatgcagagaaggcaacggcaccccactccagtactcttgcctggaaaatcccatggacggaggagcctggaaggctgtaggccatgggattgctgagggtcggacatgactgagcgacttcactttcaccgttcactttcatgcattggagaaggaaatggcaacccactccagggacgggggagcctggtgggctgctgtctatgggatcacacagagccggacacgactgaagcgacttagcagcagcaccagcagcctccagaactgtaaaaagataaatctgtgctgctttaagccaccaaggttgtggtaattgactaaacagtcataggaaactaatactccaactcctaaatgtcagagctcagactggaacccagaggtgtctgccatgctgcctcacgcaggctccccgagcttgtccccaaagagccacacagaaacgacaggaaaaaggagaggaagcagactgtgtgccccagggaaagggccacccccacgacacacctccagtgagagggaggcactcagcatgtcctgaattcaggaagcagctctctttccttcctgtttgaagacaaaagttaacataaagagcaaaaaaaaaaaaaaaaaatgattatcaggatactctggcctttggaattactgagacagaaatcttctataagacaaaatgaatctaaaggattttttcctttcaacagggcatgacaacaaattttctgccaggctaccatctaactatgatctttagtgcagaatgcatgccatttcctgtgccgttctgaaggcatgagcgttttgggtctcacaaaccgcttaagctcagcacagaccatcctacaaatgctggtgtttgtcctcaaacggcacagtgagtcttctgttttcatctcgggttttggtcataagatacctttcaccaatctgaaagtattgaggatttttcttttcttttatccaacggtagaacttagctgaaaagagatttcgcccaaagcaaacttttcttttctcttctataacataatctttgtttcattgaaggtctcagttttaatgatgtttttcatgagccttttccccagggacaccgggccagagaggcagcagcgtgctttttgttccttgtatttatttagtgattgatctgtgcaagcaaactggactaatactttttggtcaaaataaaaagctaaatgtttcctgttcttagtatgatagcaaacaatttcactgtttcttatgggctggttaaatcaggactccattcagtaaaagaggacagcactggattcacaaacaggagccaggaaaagaggagaaatgatgtaatctgctgctgctgaaaggtggggatgaagacccccctcctcaggctgattggaacatgcgcagattgtttcatttctcccaactatcactcctttctctataagagaatcctgcatccctgctcttccattcgcctgcagtttctcctgaagcaagtggtgtcaattccctataacactgatattgagctttctcacgggccctgtactgaacagtgaagtgtgagcagaagtaatattggcctgggttgctcgttgcccttctccctctgccg

SEQ ID NO: 55211 - DNA, 773 bp, Bovine  19866880908299
ccttgtgacaccagcccatgtttcatagggcttgaaggtagcagaagaagagagtctctcccagagtttctctcatcaaactggctcaggtcaatgacctagtttggaatcagcccttggaactaggaggattcagtgggatattaggcaaatggaaggagacttatccaaggcacacagctttagagttgagaagggtggaccccagtaggaactcggggcactgttagacaaagaaggcagaagggatagggggcagctatcttagctatggttcattatgttgaaactagcgggaaagtggcttaaataataaaggggatttattggcttaggaaattagaagttagaagtttctgagatgaaagaaggcttcgggattgggttgattcaggtgctcgatgatgcagtcgaacacttggttctcttcttggttctcttctctgtctctctgcttgatctcttagagagtcagttttatccataagttggcttctctgaaaatagtagcacagcaatggccactggcttaggttttgcctcagccagaaggagagaatgctcaaaatatttcagaaaagcaaacaaaatggcttcccaggagccccaacacatctcttatcatgatggaattgattacatgcccatcctgagtcagtgaatccctttggacagggtaaatgtggacctcgttggtttaggtgtaggtggcaggtgaggtgggattacctgtactgctttatcagggttcgtaccggagcggagaggggttc

SEQ ID NO: 55212 - DNA, 2046 bp, Bovine  19866880930256
gcaggtgcgcgcggagagacccgagcgtccctttaccctaaacctgctcgacttgcgccctgggcgcaacaggtctggcgcggggcggcccagcagcgccacccagcgtcgcgcccagcgtcctgcgcgtctctgcccgctggaagctccgcgccagcgagcgtgcgcccccgggcgtgtccacccgccagcctgcctgcccacgtggctggggcgccctgggcctggaggcttcccccaaaccggtcctcccaccccaaagccacagagctggggccgactctccactgcggtatctgaggtggaacactgccctctgcaagttctctttttaaaatgtccagacatctttagttgccagtttaccaaccatttaaccttccagcgactctatcttttcatcaataaaaacagcataaaatttctgccctgcctatcttccaggactgtttttgtgggagtaaatgaggaaatgaacgcggaagttatgaacaaaaggtgtaataacatatgtgtaaatatttcctgtaaatatctagcatacatatacatttctaagtatgataatatttcatttgtagcacatggcatgtaacatatgtcgagtgcttataatttcgcaggcatctcgctcaagcatttcgtcttgtcctcccctgccttgctcattcctgtatgtctggcagagtgctggtgtgtgtggatgctcaatcaagtcctctgtccatgggattttccaggcaagaatactggagtgggctgccattccctcctccaagggatcttcctgacccaggggttgaaccaggtctcttgtgtctcctgcactggcaggtggatcctttaccactgaacccacctaggaagcccagcagggtgcttgactcctcttacctttctgaggggggcactgcagctctccccagtttacagatggggaaattgagatgcacagagggaaagtcactaccaaagcaggacaggtggcagctgacggcactggcatttgaacccacgtggtctgcactcctaaaacttggtgcgtatccacgatgtttcttttgcagtgatgggaagtgatgcttggtggggagagggcttcacagaggaggggttccctcctgggatgggtgctcccccggggtacttaagggaagtggaggagttccccaggtgttcctgtgaggaatggctaagcgttttgagactgtgccagtctcaaaccttttaaccttttaaaacctttcacaataaattcaatcttttaattctctgataggcttgaggtgggtactgttactgttccactcttttagatgagaagaaaaaaaaaaaggagtcacaaagcagtgaagttgcccaggagctgtacatacagcatcaaggagctagaattcaaatcaaggagctggaattcaagcctagactccctaaacctagcctttgccggatattggggagaggggggtgaaatccttagggttagtttcgtactttaatctgtaaaaatttaaagctgtctcagaatatcaaacacccctctgccaatgaagaagattacttgaaatggggataagagaacataccccctggaattacatcaataaaacactttgatgtatgtcaagcacctggcaggcaatggatacgtaataaatgcttgttgaatagatacatcgatggtattattagctaatgtgggtgcctccgacatatgtgccttcacatatgttcttgtataatcctcaccagagccctaccaagtgggtactgtcatcacccattttacaagtgaagaagttgaagttcctggaggagaagggagtcatccaaagtaaacagggagaaagtgacagagacaggagaaaagtgcagatctggttgactggaaaggtccaactctttagggctgcaccgtcctgcttccagtgaaagaaggaacaaagaaatgggtcctgcgtcgttcagcaggggactgtcagaagccacttcagggtccccagctctgctagcctctccctgccctagagaggacccacagtccag

SEQ ID NO: 55213 - DNA, 1105 bp, Bovine  19866880938097
tttaaaagcctttttaatggagtaagtcaagctgcattcccttcatagaaagaatctttaccaccaaagggtgcactaaatgccaagggaacaatgaatcttttgtagggagagagggagagacactgccatcctacaattgctggattgtttaaattattagatggcaattcatgctaaatacatatttgcattgttgtacaagtattttcttattttggtgaaagatagcttttcaaagggaatcctactcttgcagtgcaaacttagaagaccccattacatggtcgagtgcatttaattttattactgtggccagcagtgtttcaattttttaataaaagtctatcagcagtgaaggaaaagactgcagacaatctccagcaactcaggcacctctatattttatttactaacagctgtagtaaaactttcagtgaaaaatcttaagtggcactttcctttgtggtgagaatcaattgcacaacaatcttttaaaccttatttaagcctataaagctaatttggctacttcaaagtaaaggggtggggggagaaaaacagaagaaaaatatttctcctaataaataaaatattagaagaagaaaatgaagaggaattgtccagaatttattagcaatgcctacttaataagtgtcagaattcttgtacaggagttttttcttgctttttttgcttgagttgcatggggaatgcattcattcacttactcaccagtcattgatcacctgctctgtgccagatactcagttaagcactgggaagatagagaagacacatgtcctgtgctcagagagtttatagtttggtagaggggttggacatgtgggctagcagttatattacagttatacctgaggtgctataacagaggggcacgtagaaccagtgctggccgggagaggagagcttactctaaattgaatagggtaagaatgctcagaaaggcttccaggaggcatcttgaaagacaaatggagttagccaatgagagaagaaaggaattagttaagaaattagttaaaactctttctgttggaagctataaacaaaacaaattggctgagtaagaaagggggaatat

SEQ ID NO: 55214 - DNA, 1429 bp, Bovine  19866880966732
ctggcaggcagcctgtggtgccagccgtcttgacttctcttgctcttgtggttcaagatggttatggaggttccggcctttgtatctgcattcttgccagcgggaaggaagaagaaatgaagatcacgccccttcccttggagctgattccttgcgctcctgtgtatgtcctgggacctgaacttggtcacatggccacactgagctgcaaggatggctgtttgcccagcagaaaatgagagtcttattattaaagaagaagagagcagatagtaggggaaagtagcatttttgtcagaaggtgactcaagtcttcaagtggtatggcagcctaactctgatttctcacctcagggtcttgacttaccatacacgtcaggtccatgtgatggaccatcgcatttcatgttacagttgcagattcctcaagcatctggaattcttagcagtatctctgtagttactggtgggtacaccaagagcctctggattaaattaagggcagtggctaagaatataggctgtggagccagactgcctgagttgaattctagctcttacgtctacttgcagcgtgccctgggcaagtccctaaacttggcagtgcctcactctctgtgtctgtgaaagaggaccgtatgagtacatgacttggagggcttttgtggggaccgagtgagctgatgtctgtaaagcgctctgagtggcgcctggcccttagaaagcctctgtgtgtccgctctcatcgtcactggttgtttcctaataatgatatttgtaaggaaagccatggaaggactgggcgccccacccttctgctgcactgtaactgttttttgtcccaggactcagagcagctgtaacagatcccaagaattaggaaggctgatgggtattatttttgttttacagatcacttctctccagagaatgtaaatgacacagccaaagaaacatgcttaaattggtttttcaagattgcttccatcagggaactcattccaagattgtatcctttttttctgtctgatgattttaaagataggctgcaagagttgcactgttaatagaggcggtgtgaggggctgccctgagattcctgttgaaaatgggatcctgtcagggttgctctcctggaagcacagcaccagccacaatgtccaagaagcccttggatctggctctctccagttctctggagagagagactttgactgtggtgctgtgtaccaggcttttgtttccctgaagaacattcccacattaattttcttaattaaaatgctttggggttttttttggggtatgttttctctggtcccaagaccttgaaaaaagcagggtccagcttctctgcacaaacaccagtgttgaagaacagacagtccagcttatacacaaaaggaatcttagttctctaagtttcatc

SEQ ID NO: 55215 - DNA, 1000 bp, Bovine  19866880981796
tacggtgctttgaggagaaaaaggctgagtgacccacaatctgaacccatcagagcagccctccaaggccaggcaacacagaccctgatgcctgccatcaccaggagtgcctctccctgccagacagccctcaccaactcgcactctgagccagctctttaatacagagaccacaaatctgataaaacaatcaaattcaaagacaaagggaaagcacattttgagtcaatgagaagttaacctatcacccgaaaggccttgggagcctccttcccagcaagaagggagaaacaattagttctgaaacccagttcatttgtgagatgatgaccctaattagagttacgggtaagtgggtctacttagaaattaattttaaacagaaatcctacagccctgctttctgtggacaagctgtgctctaaaattagcagctaatgaagtccttcgtccagtgactcgtgaggtggcggggagggagaagcacaaacgctggaggaggcaggatgtggtggtctcaccctgcataggtaggccctggcatacactgacaccagtgggtccccgatgccccggaccatgcacgtcagccgcggcagacactctgaaatccccctgcgagagatgaaaagacagcagcatttacacccaaaagtctacgtttcgacttcctaaaggtaggggggcaaaatcaggtttcagaaacaaaccaaggtcaaagttgatgttttctaaggccatgtaccaagtctttctctcttgccattattcatttttttgaatggtttctttcatctctaccatcttttcagtgctggagtctaatctttacttttttcctgtttgaggtcacttttactaatttaactatttttgtcccatccccagttatcgtccattgacaggtcactaggtcactcctcacccttctcaatatttcggctgttatctatatccctttggcatggatttactgccccgtgctccaccccattcttaa

SEQ ID NO: 55216 - DNA, 707 bp, Bovine  19866880997298
ctgaagaatccccatggaaataggagcctggtgggctacagtacatggggtcagacagagtcggatacgttgagcgactaagtgcaatgcagcacagcatgactaatgtattgaaaggcttttgtagatatattcctgcttacttataaaagtatttctataggataaattcctagaaatggagttgctgagtcaaaggataaaatatattaagtttagacagtgatcaccgtactgtcatccaaaaacactacaacaatttatgcttaatgcataaccaagtcactttggaacttttgatgggtgatgtaatctttgtatttcattttccccacttgtaaaatgagaatgattatgcctcaggaataattctaaatgaggtcattgctttgatatcaccatgggtctttaagaagaaatacactgttgggaaatctaaggtgtcattttcattttaattttttctctcatatctcctcaaaccttagttccttttctattttaaccagcagaagaaataaaaatttgattaaaagaagtctagtgacttcatgccttgagattactttcatcagttctatttttaagactcaccagtgggtgaggatattaggatgacatcaactttcatacatatcttttcatttaaaatttgcaaaagtctgcacaacccggacatgcctttgcttaaaatgcttgatgttccc

SEQ ID NO: 55217 - DNA, 805 bp, Bovine  19866881064531
tcattgctacaaggtccatggatttcattggcatgattaaggagtgcgacgagtccggtttccccaaggtaggctcttgacttaatccttggtggagaatagataggcagcgtttgcctaacagctctccagggagagggaatctggtgtcgggggcagctcgggccaagaggaaaccaggtgaagtctgtgtttctgaagagtgcagaggaagacgagtgagcgacgggttgagagacgcatgtaattgctgagagtcagggttctgtgagtcctaaatctacccagttagctcactatgaagtatttaggaaaaactttggtcttacgcctttaaaactgtatcttcatccattaattatgcaaaagtttgtccaggagaatagtatcgcccacaggttggaccagtatacagagccagctctttgttctgaccttctcagtctaacttgcataagtttgtgatagaacttcagaaaatggtcgttggaagattaaccttgagataggccgactgtgacagccttttcctttattttcttaagttactctgatttttaatttctgagatcataatgtttgctatatttcttagcatctcctttttcgctccctggggttaaacttggccttggctgatcctcctgagagtgatcgacttcagattctcaatgaagcttggaaagttatcactaaattgaaaaatccacaggtgggtgacaatttagaccttgttttgactgctttgtgcccaagttatgtagtatgctctttctttaaaaagtttctctgtcaactaatcatc

SEQ ID NO: 55218 - DNA, 1126 bp, Bovine  19866881066494
aaatatcccaggcattctgaatgaacttggggtataaacagttctcatccaggttcagactggcagaagctctgtatattgaatgctgtctttaagtgaaatggaaacagatcccccagtttatttttacacagctcctctgtaagtataacaagttaataactaactgagaaactatttcagtctgtacttaggcaccgtgacagtattcacttattatctggtggtcagtctggaaccctgggctgacacagctctagacaagaatcatccaggactaggaagacagttttatcaaaccttaaaagaaggagatgggaagtagcattccaagagtttcagcacagagttctaaaaggaagctctctggtgtactgaaaataaaaaatcaaatattctcaacctctgaccttggagagaaacatactgactcctaaacaaagctactttttagaaaggatctttcatatcacctatgtcatttttaccctctaaacgtctcctaaacccatccacttctgtcgaattccactgccaccaggtcatccgatccagcccccacctccagccatgctcatccttctataaagcccatctgatgatgccaatgcccagctaaagccctttaaatgctgcctgctgcccctaggatcaaggccaaagtccttaaccaggcccctgaggccactgctctctcccagctccccatcacctcacacctgctttcatcacttaagccttctttcagtcccccttccaggctcaaggtctttgcctccatcctttcctcatctgaaagccctcactgccactcatgtctagttaattactaggggaacctattcaaacctcctgttaaagtctctcaaagcatccatctgatgcctcagaacttctttagagcgctggtcacagtctgtaatcaaggatgcacgtgattactggaacagcatctagcttccccaactggcttaagtttccaggagagcaagatgttcacttctgttcgccactgaacctccagcgtcaggcaggcccagtcctgtacccagagcaggcgctcagtcaattggaagcccccaggcctttctctctcagcctccctccagactatcaaaaggacaca

SEQ ID NO: 55219 - DNA, 1580 bp, Bovine  19866881306661
aaaagaatcacatagtaatttccctaagcattctcacacccagtttttttctttttgttttcatgttaaatcttaagaggagcagagcaggtgttcctttattcataaacagacccccccaaaaaggacaagatattaaataactcctagaaaaattcaagagcagagttgggatgacgcagaacactgagccgtgctgcagtcttcgccttcccaccgaacacccggcccctcccaagcctagccgcccgcatgctgagttgagttggtatttccccctctagtcttccgaagaaccccacttacaagacaatgagggtgaggatgaagaagaagtgcacgctcccgatgaggttcttgtagatccaaacaacccacaggtagctgggcgtttgattcagggtgttgatccacctgtagatggactcaatgaagaaggacagacctcgaaacggaccacagtcagctgaaggtttcaatctgataaaacaagggacagggaaacatctctagcgccagactcaggtatagtttttctagactagcccagtcctttctgggctcttaacctggaaccagtgatccttgcctgctccatccatatccccttccaaaggaaaccctttcactcacaggcccagctggtgtgttttgtactcatgacctgtattctgaggaccagcttttggacagcaggatcacttgatccaactgatctaatccaacttggatccaacttgatccaatccaaagaccaggttgtgaccttagctgtgtcctggcacaaagaaatgaactggggcgataggactctcttccttaggaacttgaactaggaaatacaaagaggggaggctgtaatctagggaagctagagctgtaataatggccacatgaagtcagttgtgaacaagcagaaactagaaggcaccaagaactgaataggaagagagaaaagagccaacgcggtgagacaactgagaacatcttgcaactgaggagcctgccctgaagctgccaagttccagttctgcaagtattctaaaaagtcaacttccttgtgcattcatttgctcattcatttgctcattcatttgacaaaggcccactgaacttgtaactgaggcaggagatagatgggctccagaccagacatttacaactagcctcctgtttatatttcttgaggcaagacatagatgggctccaggtgagacatttacactcagccttctgtttacacatccaggtagaaataaccacaggaacagggtaaatagctggactttgtctccagtggacacttgagagaacagtaatggtaagggctggaaaagaaaatggcaacccaactccagtactctcacctggagaatccccatggacaggagaagccctggcgggctacagtccgtgggatcccaaaagagtcagacacgactgaagtgacagcacacccgcaatggcagagggagagaggagctgagtcttgcccagataaaagataaagagaccacattttctcattcttgaggtcaagaagacctccccaactacacatctgtagaaggctccttggg

SEQ ID NO: 55220 - DNA, 2912 bp, Bovine  19866881311364
tctttttccatcaggaggtacataatgtcttactgacttgtgttgtcagcagctgctgttgatgccagtggccagttctggcaatttactagcagttgtaaaatatcagtattttaagtctgtcatatattcttcatgtatagctagattaggggcttccctgttagctcagctggtaaagaatctgcctgcaatgcaggagacccccgttcgattcctgtgtcgggaagataccctggagaatggatagactacccactccaagtattcatgggcttccctggtggcgcctgcaatgtggaagacctgggttcaatccctggattgtgaagatcccctggaggagggcatggcagcccacttcagtattcttgcctggagaatccccatggacagaggagcctggcaggctacatacagtccacagggtcgtaaagagtcagacacggctgagcaactaagcacattagctaggtagaattcttctgtagaaaggcactctcatctatgatttagctcctcagtagcaaataaatgcttaattttgccctttgttcaccagtttccaaaacaaagagttggttcctcaacaatggccaacatagcatatatttaaaattttacagtaagggtggcgcctactgagatatagtgtcattgagatgaatagtgtaatggggctttcagacatttgaatcggcgtttcccaaacttccttaaccgcagacctttaaaatgtgtgatacgttttccagagcagcatagagcacagactaaagaattctactgcatcccattgctttgtcttcatccctttccccactgctctcttttctcttctctcagccagtttccccaaccccacacctttttttagccattttctctaaaaaggatcaaaaactaaccagcccatcttgacatggtcatggtttcatcctaattgcattctgattatctctagccataatttaaatccatatccgattaaaagttactctttgtgacattgttaaaatttgaccctgaaattgtaatgttctcattttaaagataggattgcaattcttttaggattgtggaggaagtgttcttgtctatattgtatatttacgtctttacatctcacacattattttctcaaaggatgtatgatagagtatttagtagacatgggggcagcataccacccgtgacctcctcgttcagaatgagtacattggctaaatctaaagagtaaatgagaggtattagagttaagatgtgatgatggctttctttccccaaatttcttttcagatgagacaaacagatcagaatgtagtaacggctttaattcatagaccctggagccttagccacacaggagatgggaaaccacgctttgaatctttctggaaacagtccatgtttgtggccttggacattttgctcgattggagtatgcataatatcttgtggtacctgtgtggagtttcagctttcctcgcacaaaaggactttatatccccgtaagttggaagattttatcttctcctgacacatttcctgaatgttcttcttggaggattaacagtggacacctgcattggttcccacccacagagcaagccatgcctttattaatttggaatgctaatagctgcttaggtggaaagagttcaggcctatttcactgtctccaaaagatactgatcaattattcttgttttttagcgcattttaaagaagtagtgtcaaactctgacaacagaaacagagaaattgtatttccttgtgattggctgcctttaaaaaccaacacaggatccagggaagacgtcttgtgggcgcctgcctcatctcctagctttcctacaggctccacttcattgcttctgagaaacttgccattccctaaactgtcagcattctctgaatctgttttggcaattttatggctgtgtatttcaggtggttatagtttttaagttttatattatttcaggcatgcatgcattcagttcagtagatatttggtgtatgcctatggtattacaaggtcctgtattaagaagctgatgatggctgtggtgaaaaaaaggaagccatggcctgccctcatggagtttatagtcaagaggaaaagagagatgctaatcaaaaagcgacccaataaatattaaattacggctaagataaatgctatataggagaaacgagtacatgtatactgttcaatttctcctaggaaaggagtcagggaaaacatccctacggaagtaacagctaaacaactaagctaagatctgaagggaattgaggagggtaggggtcgagatccaagtcagaggaaaacacatgccaaagtgttgtgacaggaaagagcctgttgtttgcaaggaattgtatgaaaaatcagttcacacacagaaaagaaagagggaatgtggcgtaagatgaggccaaagaaacaggtggggctaggccactgcttacagcctctagtaggggcgcgtggccgcaaggaattgtttttaggaggtcgctgaagtgtttaaagctgcggcagtgttggggaggcgctcatgctgggcttggaacagtctggctgcagaggccggttaagaggctcctgggtgctgttagtcctccgtgaacatcatacttagagaccattagagatttctgagacagttggcattattctaatggttgatttttcctctttctccagggactatgtgaagaagtggtcagctaaaggcattcaggttgttgcttggactgttaatacttttgatgaaaaaagttactacgaatctcatcttggttccagctatatcactgacagcatgttggaagactgcacacctgaattctagacttcccccgcaggggaggaaacacagttacagaaactgtctgtgggc

SEQ ID NO: 55221 - DNA, 1579 bp, Bovine  19866881321456
gggaagcatgacatgaataatttctttcttatttttttattgcatttcattgcttatatttggttataggttaaatgtgattttccaaaacttaggggtatttcaacaattacgatgtaacaacattacagtccacttaacatctggacacctctgttgttagctgctacggttgttccatggccagatctcttaattcaataaaggttacacaatgccagtattttacttgtgtgatttcttgtcatttagtagctggactgctacaaaaagaaacttctgctcatcctgggaagagttggaagacttccagctctccccagtttctccctgtcccattgcttctccctccatgctggtgatgggtgacatttcctctcagacgtttcctctctctgtggactgagaaaatctatcctttctagttcccagattggttgactcctgcttcagccaggaaaggcagagagtgatagagttgtaggaataaaaggacctttcctagtggctaaactgggatataaggaaaagacttttaaaattttgcttgcagcctccactggcctgtagtctgccatagttttccaaagtatgacagaaggaggtgagcctctcaacaaaatagtaaagcagcagtaccccagctgcttacttatctgctggtatgagtttaaaatgcatcctagtggataatgcaacctaccaatactcctttgaacatccccatatattagtaaacttctgatgtagttaatagagttgtacttaataatacagtagctactggctgggactacattgtaatagattttaaatacatgaatctctctgttttacaggctactgatgctctaaaaaaagtatatatggaatttcctaaactatacaataatagtatcgtctgctctttcttgccagaagttatctataaggtaaaattctgggtttttgttgtatgttatattttgttagttggtggtgataatagcagtggactaaataagtataagatagatgcctattaaagtgaactgaatcaattaaagaaacccctcttttaaagtaacaaaaatttgggaaggggagggtacttggaccccattttaaggtaccttgattcctttttagctcctccttttatgtttatatgggagaaggaaatggcaacccactccagtattcatgcctggaaaatcccatagaccgaggagcctggtgggctacaatccatggggtcgcaaagagtcagacaccaaactgacgacttctggtcctgtgtgtgtttatttttgcttttatttccagaattctgggaggtgggtcatagaggatcctgctgtgatttatgtcaaagagtgttttgcctatgttctcctccaggagttttatagtttctggtcttacgttgagatcttttatccattttgactttattttggtgtatggtgttagaaagtgttctagattctttcttttacaggtggttgaccagttttcccagcaccacttgttaaagagattgtctttaatccattgtatattcttgcttcctttgtcaaagataaggtgtccataggtg

SEQ ID NO: 55222 - DNA, 785 bp, Bovine  19866881338319
cccacaccatcatccattctccatatttttgtttttgttttccttcttggcaggagggcaaagacaaaatgttcctgatagataagttgatcaagctgcaaggtatggaaaagagagcaaaccccaccttatttacgctggaaagaagagatttggaggtgaggctgcaggctgccttgggatccctgtgacacggatgtgccctcctgtgaaaagtgcatcaggagctagaatcacatctgggcccttcactttctgtgttttaacatttctttacttttatttaaaaatacagtatgcattcaccatattctatgcctggccatgttctaggtaatgtaatatcatggtaatatcgtggcaacacagtaaggcccttccctcctggagcttgcatacatcttcctattacccagccatacagaagtgtgtcccactgggatgaaaaatgccttgaaacttcaccccactaggttattgcttcagtgtatagtcttccagatctttcccccaggcatctgcatgcatccatacatctactaacattcttgtttatttatttattacaaaaatgggctatattttatacataacttcccctctccctgcttaaaactgtatctcaaacattctttcagtttgtatatacttggacatttgggttgctcccagttttttttttaatactaaagacaatgtgtaatgaaacttttttgttatagtttttgtacgtgagtgttttatctgcctcaggcatatgcatgataatgttaatagatattgcc

SEQ ID NO: 55223 - DNA, 1108 bp, Bovine  19866881341722
tataaaaataattgagttagatggattcccgtggtagatttttcaaaagattttcttgattaaagtgcattcctgttgatatagttctggttaaaaggtttgggttcataattatcaccttaaccctaatctcattggtgaagtagcagggtcaaaacagtgtgatctaaatgttttgcagggactaggcaggaagagataagagactgggaaggatgttattcaagcaagaagttatgaaagattatcagttaagagcatgaagcctcaggctgagaatccaaggcccaggtgagttatacaggtaagcgtgaaagtttcaccataaatccaggtcatggaaatcatcatcatatgtgtccttatcccaattaagttaaacattaattgacttaatgatctaacccttcatctcccatccccactggaaggagattccagcacttactgcctggccatttccgggtcctctgaagagccataatcatgaccattctcagcacctgggtaatcaggctctccccaaaagtttggagagttccgatggtcttcagcacccagatagtctggttctccaaaaaagtgtggatggttagattgactctcagcacctggataatcaggctctcccagagagtctgtgtatgccttgactctggggctagcatgctccggattccttctggagcctggatggtttgaactggccctggggccagaagagttcaagttttcctgagctccagggtagtctggttctcccaaggagtcgagataatctggatttattctggagcctgtgtagtttccactgcctttggaaccaggaaaatcaggatttcgttgaaactgagagtagtctgggtctccagatgagcctggttggtatggattcctccgagatccaacatactctggttctgccaaaggtttgggatagtctgtccctgcagagtatggatggctcctggtgccagggtagtctggattactctgagatccaggataatctggttctgctagagacccaagatagtctggacttgttctggactctgctgggtatgggttgctcctggtgctgggttcatctgagttgttcagagga

SEQ ID NO: 55224 - DNA, 1292 bp, Bovine  19866881352791
aatcttgaatgtagtagtgcttaggaatgaatgcattattaaatctatttctgtaaaatagaataacatgttgcatgcagttacattttctatttagtctgtttatttcttcatactctgcttttttttttagcatgcttgatttaggagaggaataaagggctatctaatatgataaattcagattttcaaatgggatgataatactctagttgaaaggctgcattacatgagacacttatatttaaggtttttcatcactaacatattcatttaaaatataaaccaaaaaaggttaccaagggaacatgactttataaaaagaatgttcgttgttaatttatcaagctatttccaaaagggctttgtgcttctcacgtaaaattgggaacatttatgtgtgcatttaatctttctgacttgaatattaaaaagatactggtattttgaaaatgcagactgtatgtattcttagtattctcttaaggattttgagataaggatggttttcttcgattttccactccttttaaaatttaacttttccatccaactgtagacaaaaattgtaatctactctgggtgtaaacttgattttctttattgaaatgtatcatttatttaaggagtgaatcagaaaattagaaatagaacacagtcaaaaacgtctgaattaccaatttatatttttgggcaaagtatatcaaaatgatcttaatatgataaattgtgctttatcattctgaaaactcaggatacagattacttattatcattgtgggtctttccagtatgaaagatagatgctaaatgttttgtgtacagtaatgcagattggctataacaaatagtgtgtttcagagaaagttaaaactagttttggattgaggatgcagaacttgagttttttttttaagggtaaagcttgcatgttttacgaattttttaatgttcacagctttttctcataaaagtgccagacattgttttgtgcttttaatgtgctttttatttatatatattatttttattatttttactttgagtggaatgtccattaatgtaaattatatttatttttatactttaattttcactagttttgcttctaggcaaaaggcaaaataaatttttcattgtaaaataaatttggtgtgatttttttttttttttattaccaaagaaaggacttttgaaaagtatgtgaccaagacattaatactttaatacgatgattttttacaagacccatgaaaaatatatcgcactgtttaatatgtaacctgtaacag

SEQ ID NO: 55225 - DNA, 1088 bp, Bovine  19866881374938
ggttatctcagtgcaccagctctgagcaccctatctcatgcatcgaacctggactggcaatctgtttcacatatggtaatatacatgtttcagtgctattcagtagtgttttttgaggtccatttttgttgtaccagagagtagcatgttattcatttttttgttgttgaataattttttattgcatggattttgtttcactgtttttacatttttggctattacgaataaagctgctatgaacgtgtgcatacaaatctttgtgtagacatatgttttcatttctctttgataggtacctaggagtggaggaaactgagttttaaaccttatcttattacatttgattgcatgtcatgacattttattaaatgttcagacagcggatctccatttcacattttgaatttagaacctaaataggatatttggctccaagttaagggctgtttcataatgacctattgttaccaaacagtgcccatctatgtgattaatcaatagtgattgatggcaattactgatagtgtgcatgagtgtgctcgtgtgtgcatgtgtgtgctcagtcgtgtctctttgtgaccccatggattatagcccaacaggttactctgtccatgggatttcccaagcaagaatactggagtgggttgccatttctttctccaggggatcttccaagccagggaccaaacccgagtctgtctccaacattggcaggtgtagtcttcaccactgagccacctaggaaacccccaatcactgatagaatatttcttaaatgccagacattactttacattgagatctcacttaatcattacagtaacactttgagcagatgcttttattgttccattttgttgctgaggaaacttgagactgagaagctcatatgactcctaaaaggaagagcccgaatttgaacaaggagttgggcttcggagcttggcacccagttctactatgtcaataaggctgctggttctgaaaagacttcccgttgcaactcttggaattgctgtcagatccagtttgtaaaccatgcaagaaaatcttatagctttatagtcatgcttcttttcttt

SEQ ID NO: 55226 - DNA, 1031 bp, Bovine  19866881384798
gatcccccaagctgataccaaaccaagggtacacaatcctttatagaaattggggtagtatttgaacataactcttcatacaccgtcctgtatattgaaatcatctccagattacttatagtatctactataatgtaaacactatgtcagtagttgcagatacacgacaaattcaggttttggaaactttctggagcttttttccccctgaatatttctgagccgtggttggttgaatctgagggtgctgaacctatagttatggacagctgtttgtcctttgtagggcccggcacctttctagaaggggagatgggggccgtttgctgtccaggccctgaggctgcactgagaccgcctgtgcctggccagcgggcgtgcgccacttgccgggacagccggtgcccgctgggcctgttgggggccgccctgccccaccccgcacctcaccatggtcctggtgtccacacagccgtgcctctgtgccaggtgccacaggttgacggacagctggttgagcctgttgttgcgcaggtcgccgtgggccaagatgctgttaaagaaggaaaggcccaacgagctctggcgctttaaggcctgaaatagaaaaaagaggttactaccgggcactgggctcagactcatcccagtgttgacgctgcctggggtgccacggccagctctgccatggatcttctggagggcaagctgcttaacctcccagcttcatctgtaggagaattaaggtaataccagctcacagggtaaatgagactaaaacgagatgctgtgtgtgaagcccacctgggcattactcatgggctggaagcagaaggcagggctgcatgagactcagtgctcagtggggttagaggaatgacataggccaccagagaccagccttcttgctttaatgccagtacaggaggtaaaatatgtctctcacagatgtgtcctcaagccacccaaagtttctgtcattattcctaccctctggctgccaggaataaagacaaaagacctcagcttcc

SEQ ID NO: 55227 - DNA, 1045 bp, Bovine  19866881417893
cagatgcacagtgggtgtaattttctttccctgcttgtaagttgacatgaaaactgcctccctgggtgtctgcctgacccccaccccctgcattaaatcaggacagaatgtagttgacttataatggcaattatgtctagagatggccttaggcaaggacatcatttaccagggaaaaaaaagcacacaagttggtgaagaataggcagagtgggtggaaaggctcagccttccctctgtctacaggagctggtgtctacactggctggagaaggggaggagcagggtgcggaggggtgtctttggggcttaactctcagccactccctttaggatcccaagttacagagatccaggaagggtgtccattggcttggtgccaaagatcccattatgtgtctgctttcagattttattctgcctcattttgttggggctggagaagcagaggagagacatcctgtggatgattcatgggtggggttctcttccatccttgttcagggtcacgttgactttctcagtggcccctttggtacagaggggccaagatgcttaagaaatgcgtggacaaccacgtgataaaatgagggtccctagcctcattacaagaaaagtgaaactgaaagtcactcagtcatgtccaactctttgtgaccccatggactatagagtccatggaattctccaggccaggatacagggagtgggtagcctttcccttctcccagggatcttcccaacccagggattgaacccaggtctcctgcattacaggcagattctttatcagctgagctacaagggaagcccaagaattgtccctaaaaggccaaagtgtccctaaggcgtttgaagatggggcaggtcattctccagtgatctggagtgtgactgagtatgacttggaaaagaattcatggaagggataatgcaaggggccagagttcagttgtggctcttctccgtactaatcattaggcttgggcttcccaggtggctcagtggtgaagaattcacctgccagtgcaggagccacaggaga

SEQ ID NO: 55228 - DNA, 1000 bp, Bovine  19866881450010
acttataacattctagaactaatagaattttgagacagaagggaataaatcatacagactatctagtcggctggttttcagctatggctgtataaatatcacctagtaaacttacacaaaccctcctatgcccaacacatacataaacattccattcagaatatgtggggtagtgcttagacatgagcatattttaaaaagcttctaagctagtgataagaagctaatatctgataagagcagtgaaaagagaaatctattttacataaaaagaacttcacctttttttaacagaaccctaaggaaatgacttgatttctcaaatcacattcttcttagaaaaatattttaattcactttcatcttatcgaagtttcatctgaaatatttaatcaggtatatgctatttagaacactatttcccccaaaatactgtatcaggtttttcttgcctgaatccccgctgggcgacacacagcctgaccaagaataccatatattctctctttttcttcttcggttatggtgtctgggagcagattctgaacttcagatttttctctaggcaacagacgaacaccttctccctgactataaaaataaaacaaatcatcagtatttcagctaccaaagctttgccatgtcagtagacattttaaatctctattttgcaatgcattaaataaattacacattttaacatacatacctggcattgtcaaccacctttctgccccacctgtaagcccaactagccaatgcggcccaagatttggctacttcaggtgcctgtactgaagacagatgatacagctgtcccaagatgaagtcaggttccccaactccaatatgtactgccatgatgggaaaaaaaaaaaataacaatgtcacattcataaatttctaacagcattttcatttacattttaggaatttgctatcggtcagtaagtcctataacattataatggtacataattgataaagcacacatttgtat

SEQ ID NO: 55229 - DNA, 962 bp, Bovine  19866881450953
tccctcgggcaccccaccccaggggaggggccgcggggagggcggcccggggcgcgccagccgcccggcccgccagctgtcgttgccttggtgacggctctggctaattggccggcggagcgagccggcggcagctgttccggccgggagggacaaggacatcgtctctcccgggcactgggtgctgaggggtgggggacaccccggaggcgcactggtggtgttggggggcagccgattactttgggccattgccttgggagttgtggaccccccttcccttcatcttggggacaccccgcaagaatccttaggctgaaataatttccaggctccttttcttgaggagggcatgcttgactaagagacttgtctcctcagtacgaggggggaagcggcgacgggtcagcgccaaggtcatgcggtcagacccgctgagctgcttgttctggcactgggtcctttgcccctggcagtgataccgacgggctcctacattctgcctgcccagaggcagacgggtgcctctgggctcgcttctgccctcgcccaccactggaggggctcctgatacctcctcccactttggctcacacacgcacctcctcctgtccttagtcttttccacctgccggggaactctgccctgccatccgctcatagccgccccatccctctcctgccttagattcgctccattgacttccctttcatgaaatccttaggtcatcttttcaagttcaatgaaggtcacatttactgttcacctactgtggggatgttgttggggggagtggccactgaacacgttcagcaaacacttgggtgacatgtaatatgtgtgggcaccgggaacacagctgaggaagcggcgtggtccctgcccatcaaggaccacgcactgagacctgaaccacgttagaacggactgctagggctcttaagactgtcttctgcaccga

SEQ ID NO: 55230 - DNA, 1428 bp, Bovine  19866881496438
aaaaaaaagatcgcagtaaaaagcacctctagagactgacacagggttttgtgcatattcagagcttgataaatattcaattggctggaagaatggaagatgggtggatggatgtgtgaatgggtgcacagatcaatggatggatagtaaataagaaagtaatcaaatccatttaaacagaagaaatggagggagccttcagtgcactaataaaactaaacattaagtaacaatactgatccaagctgcaaatatacatccacatctcctatgaaaagcactgttccaggacctagggacacagtggtaaagaaaacccactccaggctccccatctaccactgaaagcagagtggaggagaaacctcttatgcctagaagataagaactcaagtttatactgactttatcacttatcacagccccacagggaaagcactgctattatacccaatttacagatgaagagatgaagacacagaaaggtcaaagcaagtgacccaaggtcataaagctaagaaagagtggagccaatatcagaagccaggcaactggactccagcattcttgaggtcaggggctatcctgctgctctgtaggcctcttgcccatgcaagcatgccaagctcaaaaaaaaaaagcaactgactctattttcaaacacaggctttatgaatttcaaaatacttacttgtttcctagcttcttacatctctccatcatctctgttagcagagcctaattaaaaaaaaataataaaaaccatcaagttgggggatctaaagtaacacttctcatgagcagatttgcaaagtaatactctaaaataaaggtagtcatttacatacccatttctataattctcagtgtttggtagcatggggaggatggaggagaaaacaagttcactcttgtggcatttagcataatgggtaagagctagggccctgggctcatgcaccgctgggttcaaatccagtctcaccaactactttttcttcatctgtaggcagatgatacaggtggtaccatgccacctgcagattcctacaggacaatgagagtggtaccgcctgtgctctagggtaccagtaagaatgaaatttgctttactccccacctctcctaagatcccctggagaagggaacagcttacccactccagtattctggcctggagaattccatggactgtatagtccatggggttgcacagagtcagacacaactgagcgactttcatttttactttccacctcttctagacccccagtgttcctcccctttcacgaggtgcctgtggaactctaagtaaaatgaataacactgggccagtcacagggagaagcacttgacagtcatgctgccacttctcacaacccctatgaggcaggcttcaattctcccatttcacagatgagaaaccaa

SEQ ID NO: 55231 - DNA, 1580 bp, Bovine  19866881685175
ctgcaggtttccgctgcagggtgtcggccgccttcttgctgagagccatgctgggcctggccaccgtgggagaggggcgactgaaggaagggggcagatttttaaagccacccatgagtttgagaaatttcagtttctgttcctcattttcaaaaccagcagtatcccattggccaaactgggttccctgtggtaagagaaaacaggtggttactctcctggcttccaaagcctggtctttccccagtccccagccagggaggatccagatgatcaaaggcttactggaactacttcttaattccaaccagagccctgtgaggagtgctgttggttcccactccactgatgaggaaatggaggtctgcagctggaggggactcaggcctactcagtaatcctgctggaactgcgtcttgggtctggccctcaccaaagccacctttcacactgagctgcctgtctgcttaactccttctcccccggttcatggcagtcagtacgacacacctcaccagctagctactcatccgtcagcctaaggtggaagtggagagcgcaagcaggagtctgaaatgcatttatcttcgcagaagcactgcattttctagcaggaaaggcatggaggcttggagaagtaaagggtcacaggagtcggaggcagagtcagcccaggaacctggggttccaattcctctccagaacactctaccacccatgcactaatcacccatgttcgagaaaatgcaaaacagcaccttggagacgtggcccgacagaagactccctttccaaagaaactctcttcccaaagaaaccccatgaagactgactttgaagactcaggatcaaaccccacctgtgttaccacggtcaagttacttaacctctctgaaccttaatgtcttcatctataaagtgggggtgtaacactccccccatccctgacaaggcttcagtgaggctcagatcagacttgataccaacaacccagagcaggattcctggttggttttaaatcctcaagaattggctgttctaccccacctcctaccacccaccccaccaggactgctgacctccgtgccacccgggaactttccgcttgtaagccaaacgctagcggagctcttaattctaggtcggctttgagagaataacaggaaccagtcatcactacagctgccctgagtgaactggtgacaagttcccccagcttcacagtggccccaatacaggaccaaagacagcttcccaggccttcagtttctagaataaggccacatctgaccacctcacgctcggtctgaggagagagctgccagaggctgaccagtcctgggagccagctcctggaggggacccggtctcacatgcccaccgtgtgcctcagcaggcaagtggccctgggccctggggcagtgccactaaagcatgtgcggaggaccccagcccccgagcagccccctgtggtcaggcccaccagtggagccgctgggctgcggctcggggtggcgccggcctgcttctgaccttcctcattcaatcatggaatcgtatcagctctgcccagctcaagt

SEQ ID NO: 55232 - DNA, 1288 bp, Bovine  19866881695708
gaagttacttgctaagtctatagctacagaaagtggccgagctcagaacggatctcgggtctttagattcaaatcaactgtccttttctgtgttacgctatgaaagcttcaaacagcacaagcagacacgccttcctgtcatctggatcctcttcccccagatccacgtctgttaacaagttcttttccctcccctctgccccctcctaggcctcaggcctgcacactgagccttctacaccagctccctgcttccccacacacataccctccagcagtgcccaccacaccctcccatcccccgcttcagccagatcacgtgccccatgctatacactctcctgtcccatctcctcagccctggtttggaaatttcctattccaactggaccagaggcctgccacacacacccccacctctgccccctccatctgtgtcagcagccttctgagggcaccgcccactgctgggaagggctcgccatcatgtgccccaagaaactggtgcccaggacatcctgcccatccagaggaggagacaaaggtccaggcagcttatctcaagcagccagctctccaggagggaggcaagcgcctcttgcagaaggaaggaaatgagctgaggacgagctctgtggagagggagccagatggcgggatggggctgcccctgggccagatggactcggcctcctgtccctccactccacaaggtgagaaggaggtgggtgggacgctggagcacccctcaaagagcccagtggcgaacttactgtccacttcttggtgtcataagcttccgttttaccagactcacgatcaatctcttcttgcaaggcttttcgcctcacctgagcaagagaaagggaagagagcaatgagacagacagtttcctctgagcttcaaagccaggacagagatgcggtgggagtcggggggagactgaagggatcttcacctgagggatctggtggtatctcaggcagctttgttctgctgcagactgtggaaggtatggcagctccaagccccccctgccctgtgaatctcattcttcggctgcccctgagttatatccctttagaataaaccagtgatctatcgagtaaagtgcctctgtgagttctgagttgctctggcacattaattgaacccgaggaggaagtctttggaacctctgatctgtagctggttggtctgaggcacagctgacaacctggcttaagactgacatctgaatgtggggggtgggggtggggagcagtctggtgggactgagcccttcag

SEQ ID NO: 55233 - DNA, 1159 bp, Bovine  19866881749548
tttcaccattaatgatgaagctgttctttgttataatccctgcacccccagtgtctgccccagtaacgcttgggtattttggtttctgcctttcctagtatggccaggtatttccggaacaacttcattaacccccacatttactccagagggatcgccaagctcattttttgctgggacttcactgtcactcatgaaagtgcagtaaagctgaaacagaagaatctgagcactgaaataagggtaagcagagctagctttaaaccccttcccatggccagtcctctttcctccttcaacatgcctgtaacttttcttaaagtaataacgttttattttttattctccacgatattggcaaaaaagaaaaaaaaaacaccctaaaactattttaaatgcccagtgctggtgatggtgtagggaaatgaacattttcacacaatgtggtgactttgttattgacataagcttgctaaagggcagtttaacaatttatgacaagatgttaaatacttattgacctcacagttctaggtttaaaatgttatccagtggtttttgactcgaggcagatttgccccagagacacagaccaatgtctggaggcttttttgattgttgctgcagaggagtgtgtattaccagcatctagtgggtagaggctcaacatcccacggtgcacaggacaagccctcaacacagatttatcaactctgaatgacaatagagctaaggttgacaaaccatgatctatagaaaagtatttaagagaaaaaaagagcaagcagaatttataaactaatgggctttgacaagagggttgcagagggatcctcagccttattcttcaagaaggccctatggcctcagtgtattctctcaagatcatggtcccaatctctttccctctgagatggaaaaggtattcaatgaagcgatggggggttcttgcccattagagattttcctagtggtctcctaatccaagctcatggtgctttttcccactctctcgcctgtgggtttgtgtctctttgagagcaccaaagcctagggtggtcatctttgctgacagtgtaggggttctgcgagtgaacttgacttccttgtgtttacaggagaacttgtcagaaatccttcagggagaacgtcaagttaa

SEQ ID NO: 55234 - DNA, 594 bp, Bovine  19866881768772
gcatcccacactcgtgaccccctcactaacatgacaaagggaatcaaaatgatggtgggtgaaacctccacaaaaaatggggcagagaacaaactggtagatttaaaaatccaaaatcagctaccgctgacaaaatgagaaagaaccaggaacgctgtctataattttatggaataggaatgtcacagggggacccttgacaaaacttaccgttattggtttcagtgggtgatagtccccaaactccagcggtacagcctccaatcggcatgacgcaaactcagccttgtagttcctattcctggaatgcctggtaaacagcaaaacccagaaaccaatttagttggagatgcatacatattaaaaactttttgctaaaaaaaaaaaaaaattgtttttgatgagacaattgacagtggaacagtatttctaccaagaccagtaagtaatggtaaattttttttaattttttaatggtttgaaggtataaagagctgccaaggcaaacaaaacccatgaggccagacaccagaacaaagggaagctcagtgaggtgaagccaacttcttgctggctatctctggctgggcactg

SEQ ID NO: 55235 - DNA, 702 bp, Bovine  19866881816785
tgcctggtacatagtgagcgtcattaaatggtatcttatagaaaaaccgacactgagaaataatattagttttgctctgtttccaggagtatatgcaggaaaaatccaaagaaagcggccaaatgttgcgacaatttaagaagacaacattcattaggataaaaacggggggcaaggttaggattcatattatttttcctgctcatgattttttatttaactctggcctctgtttacacaggcaaagtgatgtcaaagggctgagaaatcatctggatattttggtctctttctaaccacctccccccaccccccccaccccacctcaaattttcctcttagtatcagttttttgttgttgttcaggcacaaagttgcgtctggctccttgagaccctgtggaatataccccccaggcttccctgtccttcactgtctcctggagtttgctcaaattcatgtccattgagtcagtgatgccatccaaccatcttaccctttgtctcctcctcctgccctcagtcttttcccacatcagggtcttttccaatgagtctgctcttcagttttgggtgaagacaaattagtgcttagtaactgactcatttttgtccttaacctgtaaaagtttattttattactcaggtgtctgttgagaacctttttgtaaactcaaaggacatttgggtttatttctataaa

SEQ ID NO: 55236 - DNA, 1633 bp, Bovine  19866880374323
gaaggactgatgttgaagctaaaactccatactttggccacctgatgcgaagagctgactcattggaaaagacactgatgctgggaaagattgagggcaggagaagggaatgacataggatgaggtggttggatggcatcaccaactcaatgtacatgagtttgagtaaactctgggagttgttgatggacagggaggcctggtgagctgcagtctgtggggtggcaaagagtcagacatgactgagcgactgaactgaactgaactgaactgaagcttttgaggaaaaatatagtttgaagtacacttacagtaattttatagaactaaatgtaaactttctttgtgaaactattctaaatttatcagatttcatattttagtctttaaaaatttttttgttgttgttaattgaaacaagtttttcaactttgttgtatgaaggcaatggcgacccactccagtactcttgcctggaaaatcctatggatagaggagcctggtaggctgcagtccatggggtcgctaggagtcggacacgactgagcgccttcactttcacttttcactttcatgcactggagaaggagatggcaacccactcctgtactcctgcctagagatcccagggacgggggagcctggtgggctgcagtccgtggcgtcgctaggagtcgggcacgactgagccacttcactttcacttttcactttcatgcattggagaaggaaatggcaacccactccagtgttcttgcctggagaatcccagggacgggggagcctggtgggctgccgactatggggttgcagagagtcggacacgactgaagcgacttagcagcagcagcagcccttaaagagggggaaaaatcatctttatttttaccctaatggctgaaaaggcagcctgtggttagagatgttacctatcctttgataggtaacattaatctttgttttctggatgcttgtgaaagaaatccataccatcctaaaatatggaagcagatttcaataatttcagaaatagatacagtatctatatttaatctatttagtttctttccttacatcactcattcatgctcctcaggaaattcatgttagaattcttgagtctcagaaaatggctttgagggcttaacaccctcagaactttaaccagaaaagacttggaaggatgagaggagtggtgatccttggctggcacaggttttcatcctgaaggaacctctgtctgccttttagttctttctctcccttctgctgcttacttttagggcttatttatcactctgtcagaggctgcaatgggaagatgaaaaaaaatgaaaatcatatttattaatttttcatagtagcccttggttcaaaagaagggggaagggaaagagactgaagctgctggatgagggaagatttggaaattatttattagtacattcctgccctcttgaccagtaatagaccagcaaaaaatcctacaggattaaaataatccatattggacaaccttttggataattctacccacagtattatgaactctttgaatattgtgtatccctcatattatcatcatggtagtgaacatttattgagcatttatcaggtcagccaccacactatc

SEQ ID NO: 55237 - DNA, 896 bp, Bovine  19866880476885
ctaaaaatagaaaaataaggagagttccctcaatgaatttaactttagtgaaaatttcaaaatctttctttttaatcacaggtaagtattttgaaacgattcatatatttagctaaggtttctgccaatttcagattccatgattctaagtttctggtgtctccctcaagtggtaggaggtccggctgccttccaagttctatagctccatgggcttcactgctccgtggtagggaacctccacccccctgatgaccactctcctcttcatggcccttcttcactgtgctcatgatctttctctcctctgcagggtgattctggagggcctctggcatgtcatattgatggtatatggatcctgataggattgtcaagctggggaagaggatgtggtatttctttccctggaatctacaccaatgtgacctattaccaaaaatggattatgtccgttatctcaagagctgaggtcttgggtgccaataacctgaacttatctgacttcttattctctattgtaccgctttctctggctctactgggaccctcctgtgtgtttggatctaacattttaccaggagagtagaaagtgtagctgatgctgctgaccaaggacatggctaggaaggaaggtgtggagaataagcactcggggcagggaactcacacagtcattgggaactctggatgactttattaaaataattagaaatgattctgatttcgaggtccttgattctggaagtaggttttactggctggaatgcctacagctgagaaaaaagaatgccagtttgtgtatggcattcttgtccttgacaatgcaacttacaaggcaggaaggatgccttctataagaagtatgggacacaaataatagtccacagaagcca

SEQ ID NO: 55238 - DNA, 694 bp, Bovine  19866880479065
cttcagcccccatccccctgttccttgtctcctcggaagcacattctgctggttctgcgcaagaaagtgtcaacccagacaaactgagaaaactgtctagaaaaggcagtaacttccacctcccagacagaagggctccaggcagcaaaacaatctagctcatctcttccaaaacagaaaagtaaaggctgaaaggaaaataaaaggagggtaaataaaaagaagagaatattcacagttttatcccaaaaacaaactctcctgaactgtgtcctgagtcataacttcccttccactggggctctccttacccggaatggggtgttgattcggctcgtgagtgtatccaagatgtggacattctcgtgctggtgcaacaggataaagcggaggaaggtctcgagcagtgctggctcggagatgctgcgcagaaaaaggtccaggtaggcggtggtggtcatgacctcctccacagtcacctgggcccaacgacagagggaacgcaggtgagcctcccccgatgctgcgatccgtgcctctccaacggcccccagcctcaccgtggtgaccccatcaaggcaagaacacacctgccgcctcccccgatgctgcgatccgtgcctctccaacggcccccagcctcgccgtggtgaccccatcaaggcaagaacacgcctgccacgagagcacactt

SEQ ID NO: 55239 - DNA, 1828 bp, Bovine  19866880554452
ttaggttgtctgagattgtttcctgaggtctactgctatgaactttcctcttagaactgcttttgctgcatagattaatagtaatatctttgtcttctgcattcttctactaaagttctctttttcttctttgatctgttgcccctttgcccttttgctttaagattttaatttgtgaggtgaagacagcgggcatgattttctcctgcattgcaggtggattctttaccaactgagctatcaaggaagccctttattatagataattgcctcgaacgctggctagtgtggacttgacctttcaaaatgcaaggccaaagatcacatttttacttgtgtgggattttttgttgctttgatctcagaggaatcgatggatgcaggtgtggagaagactaagggagatgaggggcaggtgcttggtcaggagctctggggccatgttcagtctctcagctcatggtagtgtcttacatttcttggaagaagcagaatagattcaaatacctgaggctaggagcagagcaggcctccatacttccccaaagttcaagttccttttaactctgaatgtctcctgagatcattcttttaaaaaacactactgtattttttttcataaggatgaaaccccagcactctaaattcatgctccctactgtgggacctagtattatagaatctatttgcctctaaataaagaaagtaagtttcgacagcatgtcagtcagctgtcccagacaccactcagaagttgatgggtgttttgaggttgtatattcacctgtctggagagttgaggactctggacatatttcgagttaggaaataaatacctatgtgattacatggcttattgtttattgtaaaacatatcaccttatgttagagtccagtgactcatgatctgacttcagaatacttttacttcaataatttaaaaaaccccttttcctgccatttggcttttaacatgtgttcaggccatacttttcttttggtacctttctaattgagatgaaatttgcataacacaaatgctgtgaatattttttgtcaagagaatttaagaaaggttaatgactcagcacttggtttatttatttgaattcagtcgctgataggccaggatgatatataaagccaggtccgtgccttgaaggagaccagggcctccacgggggataaacatataaatagataaaatagagacacgtacagtgtgccccgtgactgcccaggatgttgcctgcacgttcctttctgagcccacctctgaaaacggtgggtcttttcctcttgctcaatatttttgtagtgacttctctcacttctttgtcttactgttttcagttagaggtttcatatgaaagttagaatttgtcagctacttcatgcttctcaacatttcttgcttctctgattcgaagacaaaaatgagagtggtaatgcttgatgttagtctgtttgttagaattataaaacatgcagttgatataaaattggatataaaaatgtatttttgaatgttggagtaggaatttggcattctaccaagtgtgtttttcctgtaagtgtgtggcaagactgttggccaataaaatccaggactgtttgcttgcttaagcctgaactatattgcgtatattttaatttttattgtatgtttcaccctcattgccttaaaaaacccaagctgaaaaagtatacttcctgttttctttgctttgaaatatcctgaaacttcatatcttttctctcttttttttttttgtcacttaaatctcttatgtgttgaaaatgataatagcagtgcctttttctctta

SEQ ID NO: 55240 - DNA, 1738 bp, Bovine  19866880575883
cacgcaggagtggaattaaataaaaagtgcaacgggaacctgaattctctagttgctgctatttttcccctctgactgccagctttttagcaagttccactgcctggtagggaagaaataattaaactgcatttattcatcttttaagagcgataacgggtttggttaaggtgggagatgtagcagtaagcaactgaaaaatgagatgctttattttttctggctttctgatctttctggcccaggtagctcacataatctggagttagtgttgccaaatattacacgggacatgcttatactaaaaaagtgttcgtttttatctacacagttgattcatattatcacagtttcacagagcatctgtattttagttggcaaccattcccagagtttaatttttacagattaagacttgctgtcttagcacagaaaacaaggtggcctaatgcagtggttctcaaagtgtgttccccaggccactagcatcagtgtctcctaggaacgtgtcagaaatacagattctcaggcaccaccccagacctgcagagttagaaacacttcaggtggggtcagaagatctgtgttttgaccgccctgccaggtgattctgatacagcttaagcttgaacagggctggccaggaagccaggaacatagactgtggagccaggtcacccgagttcacctcctaacgttgatgcttactggctctgcggcttcggcccgtgggtccttagtctctccatgtcctgtgctttgttcctggggctctcctgagaactaaacggtgcgaagcgccgagagcagcgtctggggacgctgcgtcagtggtcatcctctgttcttcgccgagtctcacctgccctctctttagtgtgcgtgcatctgaaaggagtccttcccgcccactcagaaggtggtgagggagcgctggcaacatccatcagtgttttagtgctccgtgcttcctattagtggagcgtgagtgtcactgcattttctggctcgagaaacaagggaagttttttcagggagggcatctgacatgatcggttagctcagagagcaggaacaaaaccaggctcacggcgctggcagctgctgtcggctgcgctgagacgcgatggcagggtgcttagccagcactcccagtaagagggtctgtcaggagcccagtaagcagatgcagggctgagctaatgagctaagtggaaacagcacactcttttctcagaggctgcagacagagagatgactgttagtccccagaatggtactccgcagggaagagtgaggatctgtgtgctttactgcttcattattgggggcgtggggacgggggactcagagaagtcaggagaggccaggctagattatggccacagcgcatagactaatctttcggctcgttttcctttttttgttgttgtcgtattgtgtttttaagtacgcttgtagttttaggacattaaaaggagtgatcaactggttcccagctttgacttacagactagtgactctggcccccatttgcctgcaggcgggctaccagattacccagcagaggctgccgatcgctgtgaacgggagcttggcatacagcgtctatgtgggggaggaagccaagtcagatggtcaccaggaccgtgagggtgaagcagatccagctggagcaggacagtggcaaaagcctgcacgacgacctgcggtcccagacgctcattgacctgaacag

SEQ ID NO: 55241 - DNA, 2384 bp, Bovine  19866880592947
ctgagatgtagattaaaagctcaggccctctttctgggtgatccttggcttttgggcagccatgccctcagccacatggagaaaactgaaccagagagaagtaggaagaagtagggaaaagacactgagactctcagtggtataggagtttctagctttggcttccaatacctccttcacttctctcatacctttgaccatgtgagtcaataaattccctttccatatagttgaaatttctaataacttacaaccaaaggaatcctaataaaatccccaccacagtgacctctacatttctggtttcttatgcttactttcagagaaggcaatgcaccccactccagtgctcttgcctggaaaatcccatggacagaggagcctggtgggctccagtccatggggtcgctaagagtcaggcacgactgagcgacttcactttcacttttcactttcatgcactggagaaggaaatggcaacccactccagtattcttgcctggagaatcccagggacggtggagcctggtgggctgccatctatggggtcacacagagtcagacacagctgaagtgacttagcagcagcagcaacatgcttactttctgtacaaataacacttaatcacaagctgtcctaattttttgtgtgtcaaatacatgtctgtcaacattttttgtggccttgtagacatattaactcataacttttgaaagaatcccactaacaatccctagaagactgccaacagagatttagtacataaataacaattaccatgtactgattattacttccatggtaagcatttcagatgtgttatcttatttaaccctcaaggaaaattcctgctgtggggggtgcattataaacttgggcttccccgatggcccaagtggtaaagaatccacctgccaatacaggagacacaggagatgtaggtttaatccctgggtcagaagatcccctgaaggatgaatggcaacccactgcagtattcttgcctagagaatcccaagaacagaggagcctggtggctacagtccatgggggatgtggagtcagatatgactgagcataaaaacataaagaagctaaggttcatcccaggaaagtaacaggttcagacacaattattaaatagcaaagcagaggtctgagccagatttgtgtccaaactgcaccttctctccaccatgcccacgttgcctcccacaacaataaatacttgctaattaccttaccagagagtataattcaccaaagacctccatttaacccctgactctccactgacctcaaagtacatgcccttcgtcatcaagcatacttaatatatggatgcataaataaatgagctatatgaaaataagtaccttgaaaaagtcataatacaatttctccaaaattactactggcagcctgaagatgaaatgctggcattcctcttaaggaagaggtaaaaggatgaatatttaagacccctctgcctgaacaagatgtatacaactcccctggcggtgatatttcaaaacagcaaaaggagatttgtgagagcctgtcgctgtgagacacgccttcagctctgcaattgctcagaggaacattcctgtgtcatcattagacactaatagttattgagcactcccatggcttggaggcaagaacagaagccctttaggaagaaaatggctccatcttcttagctcagtgacgacaggccagaaggacaggaacagcaatttactgacagagaacccaaaaatcaccagttcccatctctacacgatctgcatccttcaggccaaggttttcgattccatgcttctgtgtccaattgctgctggaactactctattaaactaacttcgaggcaacaactgttttcagcatctacccaaggactttccagtgagaagtgtcccatacacgtgctggtgttgtctgtctctttttcttttcccttcctcactttttccactctacttgggggcttataccatacatacactcttctgaggaagacagtgattgttcctaagaaggccagagctgctatcaaagaggcacgctccttagttataagctggcaagagcagagccaaggggagagtgtgcccagcacacactggagaatggcgtaccccttgatgccacaggactttgctaacctgcatgctctggtgaaagacgagccctaaagcactcagcaccgccaccgacacaaaacgacttcagatgagactgtatgtgcgacagtgctcttcaagccacaaacagccaggagactctaaatcagtcctgctatagatgcggctgcaaggaaggcagcaacctgcgggacaggtgggtatgtgggtttggagcctgactcggtctggag

SEQ ID NO: 55242 - DNA, 726 bp, Bovine  19866880660597
ccaccccaccacgctagctggtcgcagagtgccaggctgggctccctgtgtcacacagcagcttcccgtcagtcatccgtgttcactggtgttgcgttcccttagttcctgatggcaggcctgccctgggaggctatttttactccttgtattgggtcactggcaggcccttctgatttggagactcgtgtcctgcagctctgagagattcatctgtgtcatctgtttgacaattttctcttgtctgcttcctctcttttggaactcctattaatcagaggttggaggtcctggattgattttctcaatttcctattttttcccccctactgtccaattcatcgtatgtgttattctttctgaaagatttgattttatattctgactcttctggacttttttttttccatcctaattttaaagcttctgttctgattgtttattttaacaaggtggtagcatattcctgtttcaaagatacagccaccttctcttatctttctgaggatatttataaaagcttttaatttttaaagtatttttaccctatgcgttatctgttgcctctgatttcgttcagttttccttttattttgggccctgtctgctatgttggagaatttcttcaaatgtctggtgatctggggctgtcaatttctatcttaaagtaaggtaccaaacgcgattaaaaggccttgcgactggcggccctcacactagggctct

SEQ ID NO: 55243 - DNA, 1261 bp, Bovine  19866880692700
gagaaggggaagtaagaggatgtactcctggtcaagtatattgcaaagtgatagacaaatcacttgagggccaactgctgctcttctaaaaatatctggggaacattcacgtcctgtaattgctttcatgaaaagcaaggttttaaccagctacctattctaggaaagcaagaagagaaatttgcttttcttcctacctaaaaaggtttcctccctatgtttctggaagcctagttacttgtcacacaggtagggacccatggatcagcccaatagaaacccctaagatgacctaaccagcagagagggtgaaacgcacacattacctgagcccagtggtttttaaatacaatcatgcatgtttctgggtcaactccctgcaggctcaccgccctctggattttgctctctgtcgcaacggatgacatcataagccttcataaatcaaatgctcctaagtcatatttaattttcatgaaaatttggtaggcagccactaattttcaagtatcacagtagaaatgtaacttcttcacgtttcgttgtcaccttctgaaatctgtaatgacaataacaaaaaaaaacacacattccattaaattcatatattaaataggatatgattaaattaaaatcaaagcatagacattctcaaagtccagcactgagcaaaatatctacaaaatagacatttaagctcaatccaaagcctttcttatatttttctctcactttgctactaaaaatataaaatgatgctaccaaagctacatgaataaattaaaaaattattgagtttattctactaccaccaaccacaaccccctagattattattctaaaccattcaaatctagtttcaagcaataaagtacgattatcaatgttgggtggtgtttaaaaacaccaagaaacagaaaaatctttagttaatagtgactaaaataaatagcttgacataactcaggggagtaatagcacagcacccagactgccgggtccaataataacaattttttaaaatcagtgactgtcataatggaatttaaaacattctcagtcatttcgtggctaccaactaagttaaggtttctaacttccctgaaaaataaatataaaaatagaattccaagtaaccttgacaaatcagatagaaacgatccatcaaaaacaagatagtgcttacttagtgtaagtaaagcacagcacacttatcaatgaaaggtagcagtgttatttatcaatgaaaaatgaattatgt

SEQ ID NO: 55244 - DNA, 1343 bp, Bovine  19866880913041
tttattctatagggattgctctgtgctgggtgtacttgatcagcacatatctgatcctgatttgaaaccacatgttgaaaccttgaatcatttctgatgtcacccacttattcccttaccctgactgtgtttctgagtttgtaggttaattggcctaatgcttaattctaagactgcatgtggtgtcagggctgatttgccttaaacatcatctgttctaaatactgcagaagtaaagatcaggtgcctcaggtgctgaccgaaggatggatgtgtggtcatcttaagaaaccgacatgcctctgctgtgtctctgttcctggagacactttattctagatcttgtcttcaaagtttggcaataaagcttcgatgattacaatggtagaaagaggtttggagggaggtatgacattcattcactcattattattttattgaaatatagttgatgtacaatattatgtcagtttcagctgtactacacagtgatttgacatttgcatacattaggaaatgatcactgtaaatctagtaaccatatgtccctatacaaagttactatgatattattaatattatctgtattccttatgctgtaataaatccctgtggctcatttattttatcataaagttttattatctcttaatccccttcacttatttttccatcttattccccttcctctctgtcaaccacccttttgttctgtgtatctatgagtctgttttcatttgtttaagattccacatataagagggatcatatggtatttatctttctctgacttttcttatttagcataataccttctaaatccatgcatgttgtcataagtgggaaaattttatttttattatgactaatattccactgcatgtatacatcacatttttatccattcatctgttgatgggcttgttatggttgtttccatgtcttggctttaacagtgctgcagtgaacatgggagtaaagatatctttttgaatgttgaaacattaaaaggatgcacagccttgtttaaatgaattgtgtcatttgaaatttctgggctgggtattgctcagagcagagcctaggatgaattggagaacattacctctgcttgttactggtatcttacattgataaggaacaggaagacctctggagtttttttttttttttttttaatcttgtacattgagccaggaaaatcacatttaggacaataatgatattaaaaataatatcttatctttgcattgtactcagaggttacaaagcactgttatacacatgagtgcctctaaataacctgaactgggttttcattatttactactgtgtattcaaaa

SEQ ID NO: 55245 - DNA, 1646 bp, Bovine  19866880936824
ccccggtcccgcccctctcccctgttctcatttgctctccagcccagtactttcacgctggttgtgtggatcattctagacaaactgaagattcgaagcttgtttgatttgatgttttgagagcaccacttcccccccagaacacccaggcagttaaaaccctgtcgttcctgcagtcggggctgtgcctgacagatgtcctgataactcagagcagaactccgtgctgaagtattagagtcattagtgctggttttgacaggtcctcgcgtctgtgaagaataagattgaacagttcgcctctgtggagagagacttccctggcctcctcatacaggcccagcaatacctgctcttccgcgtggacctctccgatccgagccccgagacacccaccaaaggtcagcgggtcctcccctgtccctccctgtcagcggctcctgttcccccagcttcccgacttggggtcctgggtgctgcagcagctcctggatgctaaaagcatctcaaaagaaaaaaaaatctcagaaaatatttcccttttcaccctgagtgtccttacaccaaaaggaaggtctgctccacccatacgcagcctggtcccactttggaggctctagcaaggcatttgttttcctaatgtagggtagttcagggcaggactgatgtgggagctgtttctagaatgaatgacttggcacctgtgggccagaaagaagccttatgtgcatattgtttggttggtgctaccccaaggagggcatccattttatttattgtgttttcagagacttttgagccccaaataaatgtgcttcagggctccagaaggtgaaagccgttcatctgggctccagaaggtgaaagccgttcatctggagcaagagaagtaaagtttatgtgcaccttaaaccttccaagatgcctttccatgggctctggagggctggccgatcaggtggcacaggaacccgaggactggccacggggcctggggaaagggctgcccagccttgattaagctctggtcacacagatttgacaacagctgtctctcttactgagctggcttatgttcatctcccttgagacaagtcaggcttctctgtggctggtggacagcagagagcagggctgttggtccgggctaaagcaagtgatgggaaacaagatgtggagtgagaagcaggaatgtaatttagagcagtgttacaccactgagggaagctgggaaggcccggccctctgacggcacgccctggccaccgtgtagctgtctgttcttggttacttgtcttcacgggacttaggcctcgactctcaagtgaaggtttgtctctctgtctctcgaggtctttctgactgcagaattcagggtgtgaaaggtgattagaacactgcaagacagactctgagagaaagggagccctgtgcccctggtgaagtgagggggaggcttcaagcacaggccgtggagaagagcaggtggccagtcttggatggaggggagccccccgtctgtgggaaagtgggctgcaggttccctgcgccctctgctagcctcgtgccagtcagcctgttggcttgtccctcctggtggggggcatgctgccgtgactcaccctgcgggagtggtgtgccagtta

SEQ ID NO: 55246 - DNA, 860 bp, Bovine  19866880978131
cgtaactcactgaaaattcggttggcccgctcctctggcacattcaaagactctgaggtgacgccttacgaaaagcccaagcggcaattattctatgaaattaatgttacatgtgacaaacctgatggatgattaagatatagcaccgtaaatgctttaatttatagagagaaagtaattaagatttactaagtaaaaataaggcactaaaacgggtctttattttactgctaaccataaatttgtctcaaagcacgaactctctctgattcatattcaaagcaaaagttcccacacagataaattttcattacggtagagaaagctgctccccactgcctcacccccacattctttctcaccactgagctcttctgtcatcacccaaaacaaacacttcaaggtctgatgactaagcgtgctgaaactgctaagaaatttttttttaaaaagtggacttttaccatcaaaagataccagctttgggaattcctttgtagtctagtggttaggactcatcgctctcagtgccaagggcctgggttcaacatctggttgggaaactaaaacccccgaagccacacaggatggccaaaaataaaagaaaagagttaccagctttatgcagatactaaatatttatctaaatacacccacataaacatatatgttctttacacctaaggggtgttgcctcgggaaaaggagaaagaatgctacaatttctcttttatttaaatccctccctcacaaaagaggaagaaaaacaatcaaacacccatcccaggaaacaattcttgttcaaagaggaggggtgggtcgacaggtcagccccgagctccaaggcgcctctctattct

SEQ ID NO: 55247 - DNA, 1154 bp, Bovine  19866880979102
ttcgtcaggaaaggctgaagcacttttggggggccatccaaaaagttcttgccgcttcctgtcctggaggtgtcctgaacgggatctgaaaccagaaggcaggcagccgtggtgaggagcctctgggagcccttctgtctgcccttaagtgacgtgtgcgtgctggaagggggggagggggtgcggatgttcagttcccactctgactgcagtctaaagagcccccctctacttccctctgagacactcagatccacccagcagatcagctccagcatcaggcatgtaatgagagttttatcccaattcctatatgaggctctacaagaagaaactgtggcaagaatataggttcatcaggaaccctctgcgcctggggcgagacgaaggggaaagggaaaaggcgtctcctcccgccgagtcagccaagtgaagacgcaggacaacagggacaccgaccctccatgcctcctggggtcggggtgaccaccctccctttgccagctgagccctgaccacctcgcagggctgtgcaaggcggcctgagtcacacacaccacgctgcccacggcctgggcacagggctccggcctccagggcttcctgccccgatcccagccccttctgggtgggacctccagcctttgggaggaacagaatggatgaagccttttcgaggctagaatgatggagaggaagctgaatgctcctaagaccagactgggagctctccaccaccacgggcatctcagagcagcaggtggcttggacgttccattcaagcaaggtttccaggagtttcaatctcagtttcaataatgttcatccaagatgatatgaaccaaattttgtatatccaagtgatttgcattttcatatcgcatcagtttaccaattaaaatggttcagcttacctatttaattcctgaagatctccagccttcctatcgataggaattatttatgtcttcctccgcgcccctctccaacagactcattactccttataaatcattatattcaagctcttcattattttggctgctttttagaattcagccccatttctcaacattcttctcagagtgttgcttaactatggtactaaaaattcctgacatttatagtattttccacattctcactactatcgt

SEQ ID NO: 55248 - DNA, 1673 bp, Bovine  19866881001436
taaaagaaggcctggattcgaaatgtttcaacctgcttttgagtcctgactctgctgagtagccttggaagatgtacataatcttattggttttcatttgtaaaatgggcatggccatatccacctccattgtttagaaatgacgtgatacacatgaaaactctttacatctgtgaactgctcttcaaatgttattattagtgtacaaatagcagccacatttcatcttgcctaaataatgtcaactatcaacggactgctttgtattaatttcattctggagtgctttttttctgatttgggctagaaattaaaccttttttcatatagtatgtaacataaaaacattgaatcagtaggttgtatacctgcaactaatgtaatattataattcaactatccttcagtaaagaaaaaagaaaaaaacaaataatatacaaggaagcttgtaaaataaaataaacttctaattctgacaccaacatcttgaagaattaaaagttttcacatgatccctagggtttcagtaaacagactaggaagtcaggggaggaactcttttctctttattcccataactgttctcaagaaatcacaaacgtacaaaggtaaaatttatacaggtattttatatttctctcagagtctaaatgacatcaatatgcatattcttgatagaaatacagagtcacttgctcaaagttaattttcgtaacagaacctctaagttgctgacagaaagaaccaccataccactcatgaatgtcttttctacccactcaacgacagggaagtgacataaatgactgacatcttgatgtcctttcaagtggccccactaaactgaaagcatggtccaagccagaacaagaatcattttaagaagtgttctaagcacaatattcctttcagaaaatatgctagccccaagccctcagcacagacaccttctataaggcagactgccttaacccctagaatctcagtactgactgaatcatgacacaacacatttgcaaaatcaaagtaaattaaacacccacatagccagctctcttttctacactattagacaaaaaacaagtggaataagtgaggcattgacctctggcttgaacacaaatggaattatcctgccacacattacttaaaaatgcaaagcacagtctcaagttaatttgtcacttggagatatcgctgggcttttatgatgagaaaccatttgtgagaagctcttagcaccattttccccttaaccttttccatttatcttacatttactactcttccacagcaaacttttatgtgcaattttaaggctgtataatgtaagttacaagggcactagtctttgaaacccaaagaacaatctaatgaaaatgaggtgatgctaacaaactgacaatgacttgccctctcttgatccaacatgctgaaaaatatgatcgggtaggattctctgtgatactcatggaggagaaaagaagaggagctgggatcagcatttatttgactgtgaggtggggagattatatccataaaatctcgtttcaaaactgctaaaatgaggaacagccaaaaacaaaatccagttttaacatgatccattccctttggagaggaatgataatgttgggtgcaaggtgaacaatcggccctttatccataatgaa

SEQ ID NO: 55249 - DNA, 1832 bp, Bovine  19866881154130
aaattgtttccatgtttgtcttgaaataaagtttggggtcccatttgtcatttgtcctgtagatttaggaataggatttaactgtgtggggcagatggaaaagacaagagaaactgcctatcactgaactagattcagagagagatttagagtggtttcacaatctaggcacaactacccagctagcttcctaccttcccctaaatagagacagtacggttgtatcactttatataaaagaaaagatatttatttggctgagctgggtcttagttccagcacgtgggatcttcaatcttcattatggcatgcaaaatctttagttgtggcatgtgggatctagttctgtaaccaggcatccacctggggccccttgctttgggagtgtggagtcagcccctggacaaccaggggagcccaggctgtatcacttttaatgtaggcctttgaagaccagaaatgagaggactgtgtcgataatacactgctggacagttcttcgtgataacttctcgaaattggttcaaaacactttctctgcagagttcttttctgccagaataggaagtcaatagattatgtctgcaggtcagaaagcagatgtacaaataatgttgaaatatagaggtacatattagcagaagcctgaggtgtgactttggaaattatgttcttgtttcacttttcgaaagagaattttataagaaagctccctctctctgcaaatataaaacagagctgctttctctgatgcctgcctagatgccccgatgttctgtgcacatttgtctcattgggtgatacataggcccttggaagagtcggcctctcagattttgaccgtggaacatgatttacttcatcccttacttctcacacttccgtgaagcgtgaacacctttacttcactcttactcttgatgacgtctgcctcttagtttttagcctacataggagaacagtgctcaagtggccaagtagcttcaggaacttcatttatagggatctcttagtgaagacaataacagaaagtaactttttttgtgggtcttgagatggctgacttaaccaaaaaggcagctcttgccatcgcttcttggatatttggctaagatcagatgtagtatgggggcttccctggtggcacagtgttagagaatccacctgccagtacaggaaatgcaagagatgcagattccatccctgggtcggggaagatcccctgcagaaggaaatggcaacctactccagtattcttgcctgaaaaatcccgtggacagaggagcctggcgggctacagtccctggggttgcgaagagtcggaacatgactgagggaccgagcacacaccatatttgtgctttgtgtttcaaccattttgaagttcgtgctattatgttcagattatacaggaggaaaacagatgagattcagagaaaataagaaacttttaggtgcatattttgttcctgtatgtgttgaactcagacccaagtgcagtgtttctgatttagaggctaggcttttaattttttctctgctacattttgtgcggtgtttggatgcaaaatggggtattatttctccttaaccaaaatgcgtgctcgtgggggactacagaaacacgtacttacacgtgtgtgtacatgcatgtcatctttatatcctttgcatcttaacagtgtagctgcaccccacgaggtggggtaggtaaaagaataccctcctagttgccataaggaactttgactaggatctacagttgaaaaaatcagaaaataaaatttaagtgtggggtttacaaatatggaattaattactagaagaaacat

SEQ ID NO: 55250 - DNA, 793 bp, Bovine  19866881164033
cacgctgggctggaagaccatgttggtgttgagcaggaaggagcgcaggaggggctgcgggtagctggccagctgtgtgatgatgccaatgagcagcaagttcacgtgcagcgagttctccagcatgttctccagcttggataagacgacgctgatgaacgggcctgtggaaggacacgaggctcagggccggctgggcacaggggcagtctctcctgaaaaccaaggagtcagggggaccaccgcggggccactgggggcaaatcaagttcagacaagtgcggctgaggtgaccaggtcgcctggtacctcaaaagcaaaccacaagacataccaaccgccacaaaaacaaagcagaaacccgtgctttgggagctagtattttgactctgtgagcagttttaatactttgaaaattatcatggaccttagaaaaaatgaccagtgatttaatttttaaaaccaaaatgtacttttcatactatttctgtatctcttggggctgccagtgctttaaaacatggcactcttcattccctaatggtgcaggctatagccaacagtgccaagactgtagcccgccaggctcctctgtccatggaattctccaggcaagaactggagtgggttgccattccctttgcagcggatcttccccacccagggatccaacccatttctcctgtgtctcctgcactgcaggcagattcttcacccactgagccatcagagaacccctcatgctatataggctgtcatgcaaacattcagtcagttcagttcagttcagtcg

SEQ ID NO: 55251 - DNA, 1106 bp, Bovine  19866881251133
aggcacttctaaaaatgactagcagctaggctctggcctcttattctgtagcaggatttctccattttaacgctgttgacgttttcggtgagattattctttgttgtagtggttagtagcgtccctggtctctacccgccagatgccagtagctccctcctcctgagctgtgacaaccacagaccgtttcctggcattgccaggtgtccccctggggaggaggagcaaaatcgcccctggttgagaaccactgccctgtagcccgtgagacctaatttcctgtgaaacatggaaacccaacttctgaagagttctgggtgatagagagttaaggaggaggctgtgctggtctcagtgtatttgcagatgtagctgactgctcatttctttcccctccccatcctgttagatgcttttgccaaccatgattcatggaatgatttttttgagctgagtaatttgtggcttttcagtttccttactttctttccttagctaaacttgttttggttttagcaaagtgtttaaaacagcaaagatctttgaaaatgaaataatacgtgtaatgatatattttctaagtagatgatttttaacaaactgtaaaaactttatatgcctgtccttctttgtatctttcataactcctctgtcagacaaattctctcaactctgaaggagagccttatgtaggggaagacacagcaacctttgaacagccctttgtgaaatctgatggtatggcagctggtatttaagaacttcttttctaagactcctaaagagcattttaaaatgtgactttcttctttctttacagatcgaaacgaacgaaataaaccagagcatcgttcttcaaggtatgaatttatagttatttaataactctttataaagcttctcttttaggaaatattatttggaagaagtgcaagtgtccctttttgaaacactgtatacttggaatcttccgtggccctcaggcttcacaagggaaatactgttcattctcagaacattctttataaaattattaactacctggaagacatgttttattttgagaatttgtatcagtgacaggtatatttttacagaaaattatt

SEQ ID NO: 55252 - DNA, 2587 bp, Bovine  19866881267637
tgtgcatacctgctggttccttgctggctcccagtttccacctgccctctcacggtgtgaggctcacagtgctgaaagcaattcttccaactgaggatacgcatttctgtttatacagcctgagcccgaatgcctcccgcttgttggatgctcagctatgtctccaacttaatgaggaaagtaggttgatttctaatgagtgccttgctaaaggggtgttcaagaggaattttgagtctttgtatgtctttctttatataccgacattagagcttaatcgacagataagttctattccagtagtacagaatcagtttatcaatttttgataaccctgccaggcatagagtgggaatgaattattatgtgtatatgttaatagtatatatagcattattcttgccaaaacaaaaaaagtggccaaattcttcttttgcttccataccctcttctcagtgtctttgattttaagtggctaattagctcttatgcaggatgcttttcgggggaacgtgggaactctgtctaccactgtcttggtcccaggtttctactggaagcgccaactctagggagaaatagtgccaaatgcaaagtttatctgaagcaaaactcaatttaaaacactgtcttcaatttctcttctcttgcttttgctttctctttctttcccctctgtacacaagacatggatacgcacgtattaactgagcagagaagagttttaattaaagaagtatggatatcctgaaaccattccaatctgtgccagtcactctagaggcaagtggagataaattgaagcagaatatgggagagttgtgatctacccagtggaggcttataggtgaatcagtgcccttcctccccatgaagaccgcctctctgcattctgctcggggggctggcagccatccagtcactataagccaccctcgttgtgacagaggaactgcttaatataagttgttaccgtttttacttttatttcttggaagggcattacaataagatgaaatgctgtaccccaagcagaaattagagccttcattaccctttgttaattgcaaatgacacatgacttttctattgtggagtctctgaaaaaacagcaactaattattagcatttaatctttgtgcagagctagacgtttatgtgcgcgcgtgtatagacgtgtgcctctcgatccacgagagggagaaagagtaggtacccgtcacggaggtagagcagtgctccactcaggggtaaccagtctcttaccaggttctgtctcagcactccacagagtgatgcttgtggcaaaatgaggcttcagaacagtgcgatctgctgtcaatgagttgttgttattgtttaatggctaagtcatgtccagttctttgcgattccctggactgtagcctgccaggtgcctctgtccatgggatttcccaggtgagaatattgaagtggattgccattttcttctccaggggatcttccagatccaggaattgagccagcatctcctgcattggcgggtggattatttaccaatgagacccgtggaagccatgctgtcaatgagcaccatactttaaaaagaggaagtttaagaagcttacttgtaggtgtataataatttttggttttcaaggaaaatgatagtttgaaaggttttgtacaagtagaaaaaaatgctacaaaaaggccaaataattgtaaaaagttgttgtgaatgggggtgacactgctccagtagagctatagcaaattgcagtgctgaggtttttttgaatgagagaaaacttgatagtgagctatatttactttgactgattttgttttttctcagaaagaggttctcaaaaagtatcgaaaaccttatttatgcttctctaacatgtcattttcatccatatgtattccatcggcgttaacaacgtacatgctatgaatcaagttcgtcttcctttgtgtgttttctgttaaaacttttcagacattttgtggtcactgtaattgattccaatggcatattacattaatgtactcttttattgctactcatacgcaccaggctatatataatcactgtgtaggccttgccctttcccagagagacggagacttcaagtccgctgtgactgctacactcaagctgaacttatgtgcttcccttttcgttttccatgttcttttgcttttgttaattaaatatgttttcgaaaagtagtacataatcatggtaccaaagtccaaaagtaaagaagggtgcacggtgaagagcaggtctccctgcctctctgtccccagcccccagtgccccccgctgaggaagccgcctcagggtcttcgtgtgtcttcacagagatgggctatgcctttgcgagcatttagagcaacacatgcctttttctcttacacaaatggtgacataatatacctgctgctctgtgtatatcctggcagcctttccggtatcagttcatttagaactgcaacctttttaaaaattttaaagcaatttttaattgaattatgtatgttataggtatacaacatagtgattcacagttttaaagggtacatatcccattta

SEQ ID NO: 55253 - DNA, 1643 bp, Bovine  19866881267724
aaaagtcttgaggctctggcttccctttttgatttgtgcattaatgctgcggagttgacagcctgcttgagagaggctgaagagacgcgtgttctgcacatctgaaatttattcctttcactctggaagatgggacaccacataacggccatggagaagtaatttttaccctgcaacgatcttggcaccagttccagaaagacatatggacataatctttgggacatttgtagaaccttcccttgaggactgtctttgcaggcttgggttcacttcaagacctatggcactcactttagcttgggtctgtttctacttaagagataaaaagctaaattgtattccattggaagaactaaaaatattaatgtaagagcaagtcatcattatgacacatatcaatttctcacttctgaggtggtgcacagaagcagggccctggataataacccagccatgattaggagaaaagaggtctggtggatcttagcacacactgtgaaaatatgagttttcaccatgctgggagccagtatcttcggctataaactcacagagaggtgacaaaaatgtcttcttaggaatgaaaatgtgcttaaatgttattctgtaacaagctattctgaatctaagaccctacatatcaggtatatttaaggtatatttattcatatattatattaatatattaatttctcactggaacagatttcaatctatatacatttttattttaaaatagatgagatagcataataaatccagctaagtttcccctaagtttctgtgtgggtttagaaagtagccacttactcaatttaaacttcatttatggccttcatttaatactagtcctttttttccttgataagtctaatgtggtgatagaaaaaactcagaaaacatcaaagctcagccctatggaaaatgaccacgcctgccccaaaagtcaccccttaagactagctcccagaagaatgccagttaagaggtctgctgggagacaatttttattcatttactagtgttttgtgaatcccctttgagaaaattcttcggagttgtactactgggaaaaggagaaggagacaaactgcagagacagacattccctggggtatgaggtctcctttgctccatggttttcccccaaggaaacactcagaatcaccttgctaaaaaaaattgacttggctaatggccagctttaaaggacaggtttttgctgtttttttttttttttttgtctcagtggtcactacactatcaagatctaagtaaatgactgttctatgaaccttggctgagaaaaatgagtgaccacaaactctcctgtattccttctcatcatggttatatgtgaagtcagtcttatagaatctgatgatagatccagagacttatagatcttaaaaagtctcaagaagtcacctggtccagcctcctgatgctcaaggttagtgaagagcacactgcagggatgctgggacaccagctggctatcaggacttcagatgatgtttgggaatgcacgaacaaaatccccccacccacatctgagaaagactggagggatatgtgttcaacatgtctatagctttctttttgggcggaaacaagacggccaagggtccttagtttta

SEQ ID NO: 55254 - DNA, 1112 bp, Bovine  19866881339221
tggttgctgtgttgaattaccctaatttaaaagtcttttccttgctattaatgcagattatataattttaaacccatttccctttttccagttcattgtacatcaagcaggtcaaaagctactatgacaaatatctacatccaacaggattttggattttaagccagttctccacacatgctgtcctttgtgcaggttccgtggaccaggtaccgttccttcttgtactcccctggctgcccccactgcagacgtgcagaggtgaccaggggcctcctggaggaagatgggtgaatgctcctcaagtgcttgggtgtgtttaggtagcataatgggtaggttcttgtaccctcacatcctggagcttggtaaggattctagctcctgaatcaggtcagagaggcaactggtggtcatggctttcctagacagggtggggagagagagagagtgtgagtgtgtgtgtgtgtgtctgcgcttgtgtgcagtggggtaggggatgcttgctgagcaggcggagagggcagggtggccatcagcctcctcccttccttcccttttcagctcaggggtgtgattggcatgtgtgatgtgtcgtgagtggaggtttccttctaggacagaacccacccaccttgccttggtattagaaagcatctgttagtgctccacctcagtgacgtttctctgggtgactgcaacactgctgacggtcagatgataactgtggccctgacgggctggggagagaccagtccaagcccctcactgtaggcctggagagcatataagagggaaccagggtctggagtgcacagaaaggctgtttttcgtggcatataggatgcatttcctttagctcactggagcacacactgtgacttccaattatgtaggcgtctagaaaaattagtattgaaaatccctaaagtatgcccatagacctgtttaccaatctagctgtaattatttattgatcgtgtgccatgtgattagacctgtccagcccctgctcagatagaacagtaaaatttggtccagggatttcagactcattctgtttgtgatttaggtttttagggaaagcccatttaccctaaatcgagacagaa

SEQ ID NO: 55255 - DNA, 1405 bp, Bovine  19866881460214
ccccccccccgcccccaccgtgttcgtgacacttccagtttaggcaccactgggttgcttaatgccctgaatgccacttctgaatactctggttggggtttttccttcacaggtgctggtcctttgtcgggtttatgaactgcatcaccttttgtgttcaggtagaaactattttgctcaaagagaagctgtctgttcacttcaggaacattcccatcttctgtgagcattaggtttctggaggagaggggaaaagaagccaacttagggtacggtgaataggagaaatacggccaaaacatctttgaaaaacaaaggagctttttgaaattcactcacgttgcttttaagatttttgcccgttggtgcacactgagattgctgttgcctcctaagaagcatcttgcttgctccatcatacctgactgctttgtttgtttttattgtcagtgtagcagcaggcactgtgtatgctctgttattgattggttgtcactgaattgtttcagaagtgatgatgatttattttaacgagtgatatccaataacatagaacatggatccagggttgcagagggctagggagataatgaaaaaagcgaggacaatgtaggaaatagttttttttcctgctgtattgggatggctttgagtaacctgagcctctaaagccatttgttagtttccgattatgtaatatttactgcttcctgaacttaaataaaatcccaccccaggcaaataccgtcgaaatgaaaagatagtttgatgccagtcatctgcacgaagtttcctcggtgattctcctgctgtcatcagccacttaatcccgacgggcgacgtttggggaacatctgactcctttctgtttctagtttctgtctgtaactgagggcaggtggtggttagtgtgtggtcccccacgcttcgctctgggatagtcctgcattatagaagcacagtagtagaagtcctgctttaaatgcaggggtgttattcatttgggttgactctccaatttctaattgtatagaaccctctccttcaaccactgggggatccctttatttgatttactcagaagaaaattcttagtttctatggaaagtgtgtatttgcaaagttgcaaattccaaatcactatttattctaatataatgccaagctacccaccggtgatatttgataaatagctctattacgtttgatccactgttccattttttttttttttttttttttacttcttcaaataaagagtagaaatctatgtatatcaacttaagtcatgaaatatgcttggtttgagctgtaagtagtcatcaagttcctggagtatataaaagcatcaaagcaggttgtttcttaaataattaatgatgagaataaggatacaatataaatt

SEQ ID NO: 55256 - DNA, 607 bp, Bovine  19866881539308
acctataattctctttaattcatcagagaatctccatttccttctagcattcccaaaagtatgtcaactgaaaacagtctctttaaaataaggcgatctgctttaaaatactctaaaatgaaatcaagtgggcttttttcaaagtgtacaaaaatttttcaaaataactataaagtaaaagatatgcaggtaatccaactattacttcagtaaaaacataattttaaaagctatgcagggtcaaaattaccatcacaataaccaacacagtgatcttatatgaatccaattcatattgattctttacagaatctgtacaccatctgggctgagaatccaagtatatagatcattaaggtcaattacatagggggaaaaggttgtactccacgatgctgaccacgatttttcctaggtggctggatttcgggtgatatgcttttcttctgtgtggtatacatgcgtgtttcccaagtcttctgctctacaaaaagagccatgactttcattatcagatgaagaatgttctctgtattttacactcctgtacctaactacaattagaggatcagggtacattttctaaaaggccgggtccctcaaggag

SEQ ID NO: 55257 - DNA, 703 bp, Bovine  19866881630560
cccgcattgcgagagtgtatgtactgcctgtcctatctgggacaagatcaaaattcagaattccatgtaccatttctactgaatgcatgtatggctttcaccccatcataaggtataaaaatctgaagttgaacaattctaagtgggaaaatatctgtattcatttttcaaggtctcatatgggcttaagattttcatgttatggtttgactctggttatccagccaggaaatgcgtgaaagaatttccttctatttcttgaacttcaaagaattttttttttcttgtttggttccgattaatctagacagtggcattctgtacaaagtaaatcagctttattcatgtcatgaaaagagaatttttgcatggctatctaatttttcaggctgattgaaaaactcagtggggatacaaaacacattgatttgttctttttcttccaaatcttacactatttgtcctcttgttccatattgtaagacaagttaacattctcctccttttccagttgttccacaatttcaagttttcattgagtacactgtatgtttacttctagactttgtcattttaattatttggagcatttgatcacatacagtcgccctgatgttcagcagcacggcctggctccgtttgtgtggcctgctgacagaatgacaggcagcgggagccccgtgttgtgctctgtagcctctcg

SEQ ID NO: 55258 - DNA, 1039 bp, Bovine  19866881826064
cccttgtcaggcttgaagctcaggagtgagcccagggggctggagtgaaggtgcagaagggatgagccccctgatcacgggaatggacctgcagacactgaacgcggccctttttgtcttccaggtatctgatcccttgcaatcacatgatgctgagtcagaggtgggctgtgaaggagagagactgttactctgtgtctgcggccaagctgctcgccctgacccccgtctgttgctccagcgggatcaccctgacacttgggaaccaggagagggattatattctctggtcacagtgcaggcgtgacagcccaggtagggtgttgccaacctgcatccctgaccctttagcgatagaaagtgacaagaggccagaggaggaattcagcagggctttccgggcctcttgttgcagcccaagaacaagaaacagatgcccttgcttgctccccaagccgggggccaagctggtcccttaaacggggtgagggtggggtgacccgatagttaggtcagagggtggcttatgtgggctgccgacgcccctggtggtgctgtgccccagtaccatgctcagtgccctgcttttgcttctggcgccgggagagtggcagttcagttcaggcctttttgtgtggtgtttttcataatttgccccatctgtgcatgcatgaagttatttttagttccttatagcgtctttgtattctgttgctggaggggaggaggagatgcatgtccaggtgtaagcactgaagcatggggtcccgggtcccagcctgccaggcagccctctctagtgataatctttataaaccaaaggataccagattccatctcgccctggatgtgtgtctctctcggtagacagggagtgcggcagcgagtcccgtttcttttatgactgactagctaggggtccttttctgcttcttacagctgtaataagtattcactgacgtgcccagctctcaccccgtcagtgtccccagacctcagttttcactaggctttctagcagcatcctcagtgtacaagt

SEQ ID NO: 55259 - DNA, 1442 bp, Bovine  19866880552674
tcttgcctggaaaatcccatggacgaaggagcttggtaggctgcagtccatgaggtcgcgaagagtcagacatgactgagcgacatcactttcacttttcactttcctgcattggaaaaggaaatggtaacccactccaggtgttcttgcctggagaatcccagggacaggggagcctggtgggctgctgtctatggggtcgcacagagttggacacgactgaaacgacttagcagaagcagcagcagcagctagaaaaacactggagctgcatcataaatgtagataactcatataaattcaaccattcctttttaccatcctttttaggtctcacaaatatttcctttgactttcaatctagagggagaaagcagactcttcaaaaggcctcattcccaacactatgaaacctctctttcagtgcttttgctattgagatagttttactttaatctgtgagattatttgattaatgtctactccctatgctatgttatcaagcaggggcccagtcttttttcaatttacttttgtgttcagagtgccttgcaaagtgcttgtctcatagtgactatttagtatttattggtgggtggataaacaaatatataaaacaggggtacagaggtagaaccctggcgcagaaatcatggtgacctagactagagaagtgacattggaactgtgggaacatggatggatttaagagattggaaggtaatgcagaacttggttattgattaaatgtatgcagtgaaggagaaaaaggcgacaaggacgacaggcagatatctggtctgagtaattggtagatggtagtgcccttcctcgagacagacggataaatcatatcccagtgcactaaaggacttgcagatgtaatcaaagaacaactgtcagtaactggtgagaaatgaaagaaaatgagaaccgcactgaaacacagggatcagatatgttttgaagagcctctgggagaattattaagaaactctgcagcttgatttagttagacatttaataaatccacttgtattaatttcctagggctgccataacaaatgaccacaaacttagtagcttaaaacaacagaaacttattctcccacagttccagaggctagaagtctgaaatcaaggtgttggcagaatcgttgtcactctgcaggctttagggagaacctttccgtgccttttcctgctctggagccttgtggcagtgtgactccaatctcaggctctacatgcatctcctttctctaagtgtcttcttagaaagacaccagtcattggatttggtctggacaaagacaccagtcattggattagagctctaagctctgatactttggccacctgatgtgaagagctgactcacccgaaaaggccctgatgctgggaaagattgagggcaaaagagaagggggcagggaggatag

SEQ ID NO: 55260 - DNA, 966 bp, Bovine  19866880605690
cagagtaaatctatgtctactttcccctggaaatgagtatcaacacttctattctgatgtctttttgcacagtattagacattaaacacttgacattaaattcttgcaatccaattgaaataatctgccttaaatcaaggcacctgcacattctgctagtctcaagtatctaccagataaaatgcccagaaagattttttttgagagaaaacaaaggtccagtgatgaatttactaaatgattagatttcataaatatttgaaaatatgaaataggagccatctctgccttcactgaacttatatcatggtaagagaaacagatgatagattcatatacatacaaacatatgcatgtatgatatattaaacacagtatacttatgtgatggtagcttccctggtgcctcagtggtaaagaatctgcctgccaatgcaagagatgcaggttcagtccctggattgggaagatcccctggaggaggaaatggcaactcactccagtattcttgcttggagaatccaatggacagaggagcctggcgggctacagtccatggggtcacaaagagctgactctgacttagtgactgaaaagcaacaaaatttacattatatacaaaacatagttttgttccatagaaaatgaatgcaaaaataatgtgatgtttagatttcccaccccaccctgccaaaacaaaaatcttagctttaaactttttggatacattattaaatttctgagtctcagtgttctgaaatgttacatagaaacagtgataactaccttgaaaactttctgtgaaggttcaaatagacaatatgtaaaaagtttttgccatttaatatgtggtacctagtacctgcttggagaaggaaatggcaacccactccagtgttcttgcctggagaatcccagggatgggggagcctggtgggctgctgtctatggggtcacacagagtcg

SEQ ID NO: 55261 - DNA, 1257 bp, Bovine  19866880642644
actgcaaggagatccaaaccagtccatcctaaaggagatctgtgcctgggtgttcattgttaggactgatgttgaagctgaaactcccaatactttggccacctgatgtgaagaactgactcatttgaaaagaccctgatgctgagagggattgagggcaggaggagaaggggatgacagaggatgagatggttggatggcatcacagactcaatggacacgggtttgggtagactctgacagctggtgatggacagggaggactggtgtcctgcggttcatgggatcacaaagagtcggacacaactgagtgactgaactgaattgaactgaatgacatggtaatagctgcatgatatgccaaataactggaagtaatattattgttagttttctatttagtttagtaatccgtttcctattaacagacttataggctattttctttgtttttaaaaataatgaagcaaacatccatgcacattattttttgtatatgcatgcatttatttgtagaatggattttcagaagctgaattgctgggtcaaatggtgggtataataaaattttaataaatattctccaattgacctccagagaggatgaaccaatttatataaccactaactatgtgtttgtaattatttccccacacacttaccgacattgtgataacttgcttttgtgcaaagagtaatttttttattgacattattcacaatttatcctctattactctcaccgccccccccgccccagtggaaatgacttgattcaacaaatatttaatcttgtaaaactttgttctgttgaagtatagtatcagatattttcagaagtcacaattcattagataccgtttctgcccctggccagatgctaatactattgagagaggcagactcactgtggcttcagattatttttcccaccttatctatttgtaataacttttgtgaccatcgtgggactgaaataagcaagtttcatgaatattttaagtgagtactagaagtttcatgaatatgttaagtaggtgtgagaatttccatgaatatattaagtagaagaataatgaacatggatagggcatcatagctcactaacctccatctcctacatgttcttttaataccatctgcatctttttttcacggctacaagctagtacaagggaggtgtgactgggaatttatgatttcatgcctctttcacagatcttcctgggcagctgacttacaatctcacctgccaat

SEQ ID NO: 55262 - DNA, 899 bp, Bovine  19866880719069
ccagaatttattcaggtggtcatgtacaacccaacagatttcagtattatatggccaaatgctaacaaagcattgtgcctggtttgccatgataacacaacagataagtacttaacataactcaggagggcttctagagatgaagacattttggcagagttttgaaggatgagtatcataattatttgttcacatgactgtattccctacgtgagcaaaaccctttatttcagccccattcatcttctttagactcccagccaagtctaaaaccgaataaaatatcagtaaacatttgtgttgaatgaatgattaaagtaatgaatgaatagatttattagccacgttgcctaatggatgctggtaggtcaaatggatcattgtttattttctctgaacagctcacttcactgacaagtttaatcaatcaagaaaagagaaaaggaagctattcaaattaaatccatgttgtgccgtttattgtccgccttgttgttcagtttagcgcacagcccactttcacacttaccctggaggaataatctacatacccgcccacactgtgatgtgggagaagccttgagatgaagggaatttgacatcacccagatgggtagttttaaggcagcgtcatactgtaaaagggtagatattcccaggtggcgcttgtggtaaagaacctgcctaccagtgcaggagacaaaagagacatgggttcagacactgggttcagaagattggctggaggagggcatggcaacccaccccagcattcttgcctggagaatcccatggacagaggagcctggcaagctacagtccacaggatgacaaagaataggacataactgaggtgatttagcatgcatgcaatgctatgaaaggatttcagattcaga

SEQ ID NO: 55263 - DNA, 1188 bp, Bovine  19866880888982
tggcacatttaaaacagtgcaccatcagatattactagtcgggtgacattggcacacaaacctctgcccatcatgaacccatggcttgaactggcagggcgggtgctcagagggaaggctgacctgtttttattactcagaagaaatgaactgttaccttttacagacacatgttttaacgggctcaacggagtggcagacctacgcactgaagtggaggcagcactccacaaccccaataaaggatacagctatatgtacccgcatttatcttctgacttcgctttcttcaaagactgaggatcctcaacattataaattacattaatatttctgaacaaacataagattgatcggtgtgtgggatttacacatattttcttatgacctaaaggggttgaatgctccatgttaaatacaaactactaaagtatgagagatgtatccaaacaatacatgtctaatgaagactatccatcacatttcagatcaaaattaatgtctgtgcaaccaatctgcaagcctgtaatattttagaatccctttcaatgctaagccctacttcactctaggatttgttcttatttactatagtcttaataagcagtacttcattcttcgtgtttcaaataatcactaatggaaaaagaaaaaaaaaacccataacagtttactctgtaactcaaggataggcaagggacagtgtctttcttcctctgaagaggtgtttcatgctaatatccaaagattactcagcaatcccacggaccttccaagcactaagagcaaatgttcatgtactcgatactcatattcagtgtgacacttgaattaagctaatttattcagcacaaacatgaccttgaattatagcataatattttaatgttgtgcttaggaacttaaatccttgggaagaattttaattaggggataagaaaaggcacttagtttggttcattgacttgttgctgttcaggaaataattggcactgtttgcacactgtgtggagggtttcacattaaagaatcatttggacaaatttatcaagctatattttagagtgggagtaagtgagtctgagattcttagttctcttgctcatccatgaatgaaattaaacaatgcccgaaggtttaaaaaaccctcttttgaaagcatatctttggtagagatccaatattttg

SEQ ID NO: 55264 - DNA, 3121 bp, Bovine  19866881139556
cactggagtgggttgccgtttccttctccaatgcatgaaagtgaaaagtgaaagtgaagtcgcttagttgtctctgactcttagcgaccccatggactgcagcctaccaggctcctccgtccatgggattttccaggcaacagtaccggagtgggttgccattaccttctctgggaaacccagaaatatgttttatgtttggatatagtacttgagaaaattctcacgcagcaggatacatagtaacctggtcagaatagcacacatcttgttggattaaattctccccaccgtttctaatatgatccagttagatcccaagagacttcccaggtggcgcagtggtaaacagtctgcctgccagtgcaggagatgcaagagatgcgggttcaatccctggattggaagatcccctgaagaaggaaatgaacccactccagtatccttgcctggagaattccatggacagaggagcctcgtgagctacagttcatggggtcacaaagagtcagacatgactgagtgactgaggacacacagttaggtcccaagcagtgattgaattatcctacttactattagaaattaccattcaagcatttgtgtatacattttcatcataacaaatgggtgaaaaatatctcatttaaggaatatactttctgctagcatagtgatatctcaactcctgttaccatcatttgactcttgcccatctctcccttacctctatgtagcctgtaacgaaatttgaagttttgtcatagatggcttggttatcattgaagtgaccttccaacttattttctaatttaaagcatcagctccctaaagtgtttgtgaagtgtggccataccgatccttgtaaaatggaaattcattaccagccctcagcttctgagtttcgtggatccctttgccatgttccacagttccatctccacatgcctttggctccagctaccctgtgctgcttacagatctctgaatatagtctcctgcctgtgtttccttaaaggaaaacagccatctcttgcccagtgatgtcacctggaaaattcctactcatctttcaagtcttaactttcaacaccactccctctgagaaggcttcttccactcagctctgacagaatgaggtccttgtgttttcacatttgcatagcagactctgtattccttggtcatagcactttttgccttgaattacaattattattactaattgcacttattaaacttcaaacattggaggaagtattttatatatttatatactttggcttacttcagataacaacccaatgagagttgttcttttagtataaagaaggctcaagaagagcaaagggaatgtcccaaaattaaattattagttgatcaagccagaaataaatgggagtcagtgtacttaaggttatgttttgaattattgtgtgattttgttcccctaccagactttgagttcttaagaatagggacagtataatatttataatcaatctctagcctagcagagtgcctaccatgtaaatgcatgcttaatgaatatttgtggactaaatgaagaaagagtttatgaaagaaatgaagaaagtcctgctaaataatgttgtattaggatagtaactgggcaaccaagaaactcacttaattagaataagttttatgataaatgtcacctatcacttagatttattttattctttgctttacttaagaattctgctaagagagctgcattctgaacactgtagtttttatatgcaaggcttgttaaggcaaagtgttaggtgattatttattctgacagatttaacaaactgaggggatcctgtgtcaacttgctactctaagctttgcacttgcacgatctcacttatgagtggtatcaacaatgcttgagtagaggttttgaatttcttttgatgctgttttgtgaaactgatggtctagaatcagtaagccaaaaaccaagtgactctcaagtgctgttttcacatcttgatttttaaaagattccttacaactggcgttatgtaagaatcaattttataggcaggcattcaaacagtcttcacctcaaggtgctgttcaactactgactaatagcaaatgcattcagacatttatttattgtgcaaaacatgatgtcgaggtcagaattgctaagggaacactgaggagagagtgatgaattctgatgaaggagaagattttctgttagtgggaggcatctaggtgctgaaaatgtaagattttgtaggtggatgacaggtggggaggaaactccatatataatggcagaaaagcaagaaaagttcagggtaaatttggaacatggagaggaataaggtgtgattagagagtaggtgagatgtgaagaaatttgatagaaagaagataggcttttaaactaatgaagttgtggggagaggaggaagagtggcagataatttcttatgtgctcagaaaatgcagatattttaaaattttataattgcatattatatatatgtagttttagttatcaagaggcaatatatgtggcatacaaaatgtactgacttacaggatagaataattaaacatacatactgcttcttatgaaacttgaatactctgcatgagatttctcagtatcatcatttacgcacagcagtgatcagtgcattggggtggccaaaaagttcgttcaggtttttctggtaagatcttaacagcaacccaaatgaacgttttggccaacccaataccactgtaaaacatatgctgcgttgttcaaaactttttttaaagctagtttttaaagacttctcaccatccttcttattcttgaagactcatgatattatactcgtcatggttacatccctgaacaagagcccttatcttagctttagtttacatgtgtatgaaggcaatataaaattactttcttgtagacttattactggttgttgttaacgtgaaactaaagtgtgggttgttgttcaatcactaagtcatgtccaactctttgcaaccccacggactgcagcacgccaggcttcccctgtccttcaccagggctcaaactcaggtccattgagttggtgatgccatccaaccatctcatctt

SEQ ID NO: 55265 - DNA, 1564 bp, Bovine  19866881255482
accacagcacaacacaggagcaacagagagtaaaggatagacgagatcactcatagatttatgaaccaggaactattagaaactaaggaagggagagactgactaccccaggaaaactgggaaggcgtctaatattggatgcagtgttgtatgtacaaatacaatttgatgcgcaaataaattagctatttaggcaaagaaagcaattccatttaaagaactccagtggaagaagacaggtcatactgtaagcagctcactttcagataaaaactaaaacacagtattatgggtacttttgaaaagaaaaaaaatatttatagtctgacaacctcaaaacaaaagtgattctcaacttacacttctcaagcctatattggaagactagctctgtgagtgctctcttctaggtgctggtatgtaaagatataatccacgtaatccccacttgctcagtctagagatagggagttgagaatatcacaataagaatattgtctattcacagccaagttgcgtttttagggggaagtctctttttgagtaataaccacctgtagttgttctttataagtcttcttggatagatagaaaatacgcaggataacagctgggccagtatagctgagatctgtctactttatcattcagatgcatgtgcacatgtcatcatgttatttatctcatttcttctgagcaaactctcagcactgtaggaaccacctcctccactgatgataccactgctggtattctagaattgattaaagtaggccaggaaagtctcccaggggaagcagatgaagctgtgtaaatgcagcctgcttgttagagttgtagcccatcagtggaatcagccctggcattgatggatgactgctttgttacagactggctggtcaggcccctgaagaagcccaccctttgttcattgccttgtaataaagccccactcttcaatggcaccagccgaggctgtcacctgccagatcagtttgcttctcctaattctcatttagacgggtctacaataacttagcagctgtcttgtgtacttgggcttaactacatgatttcaggggctacacttgctattctttgggactgaggatacaggaaaaataatagcattttatttattcagaattgagttggacaattcttcagagatagtttaggttaattagtcttctgatttcacagatgagggtcagaaaggagagctgactttcctgaggtcacccagcctggctgtgaactgagctggcactagtcagatgatttctttgctagtcagatgatttcttcaaggccagcacattcccactacattttaactgataataatctagtaacattttataattttttttaaatgttaggggatgcaataacttttttgaaacttcaatcagaaacattggtttgggacttttgaaacaggaaggagagaaattaggctgagagacccgaggatggaaatatgaggtgggcatcatgacagcaaaagggaaagattctttcattggtttcgatctgtctactaatatccatggacagagaa

SEQ ID NO: 55266 - DNA, 1151 bp, Bovine  19866881342450
actcagggattgaacctgggtcttttaggtctactgcattggcaggtgagttctttaccactagcgccacaggatatattaatgaaagtgggggtgggtagtgagccttagtcgctcagttgtgtcctactctttctgaccccatggactccaaggcatcttcccagtccagggactgaacctgattctcctgcattgcaggtagactctttaccatctgagccaccagggaagccccatattaatcaagagactcccccaaactgtggtttgtacaagagagtcatttatatctgcatagtagcccagaggcaggaaggtggtccagagtgaactggtgggttttgttccatgaggtcatctaccaggatccatctattttgactctctgctctctcctgggatgtggttgactaggctccctgacactgtatcaggcttctgttttagggaaaagggaaagagagaatagagaggacagcacttgaagaaaaaagatgcaaagtttgcacattttgctactgggcacttgatcagctgtggcacgttttacgaccagtgctcatagtcccttagtgagaactaggtcattgggccacacctagtgggaagcttagtagtgaatctctgggtgaccaggtgccctgtacaaattcaggagctgtgggcaatctgacctaaaacagtgggtacccatggaacatatagtagaacacccagcccacagaaagcaccccaccaatacacatatgagtatgaatcttatgcgtatgagtatctgcaggtagcacagtgttgaagaatcaggcagtgacgagcacaaaggcaagttctaccatctgtacagaacatgaccttggaaagatgatttcttctttgagattcactcaccccattttctcagacagaaactacaatcccttacctcactgtgctttttacgataatggagggttgcccaatttaggctacctgcaaccccaagtcagattgcattttgattcttttaatcacaatgaaacaggagatattcaaaattagaatgtttcacatgtcattaattccttatcaaattcaactccaagcaacatgctgcaattactgtacaacttttggctctcagcctggagacaggaatcttaatcctaggg

SEQ ID NO: 55267 - DNA, 1872 bp, Bovine  19866881393224
ctcctcccaccttcaatatttcccagcatcagggtcttttccaatgagtcagttctttgaataaggtggccaaagtattggagtttcagcttcagaatcagtccttccagtgaattttccaggttggtttcctttagtattggccagtttgatctccttgcagtccaagggactctcaagagtcttctccaacaccacagttcaaaagcatcaattcttcagtgctcagctttcttcacagtccaactctcacatccatatatgaccactggaaaaaccatagttttcactatactgacctttgtcaaacaactgatgtcttttctttttaatactgagatgattgggtagcatcactgactcaatggtcatgaacttgagcaaactctgggagacagtgtaggacagggaggtctggtatgctgcaggtccatggagtcgcagagtcggacatgacttagcaactgaacaacaatcaaaaattttaaacaatattagttggctctgtgatagcctatattctcagatttttctttacctctgtatatctttcctatctcctttaagggtcatctcattgatgcaatgaatgtatatgatgtataacctttcaattttctttgttttcgagataagtgtacagaaggatggcactgaggcagtggagtagtcgctaccgcttccaaacaagggagcatgagatttagtatcagacacttccaatttcagagtctagctctgcagtttctgagttctgaccttaattattctctcagcccattttcccgatctgaactctaatatgcttgcagtgacagtagtggatagcactgctatccacctcttaagggatgttttgaagcttaaatgcttcctaggtggtgctagtggtaaagaaaccacctgcaaatgcaggagacatgagattcgggtttgatccctgggtgggggaagaccacctggagggggaaaaggaaacccactccagtgttcttgcctggagaagcccagggacagaggagcttgccagggtgcagtctgtagggtcacaatgagtcagacacaactgtagcaacttagccagcacacacggagattaaatgagacagtatacatacagtaaataggtgggcgtttggtaactagcaaaagatctataaatgtttattaagtaaagataaaagtaaactcttctaggactcgaaggataatctttttggtatatactgatgtattctcagattgataacagagtatatcacttaaagtaatatataatgcggaaaatctccaggttgtactctttgtctgaaatagattctcttgttctttctctcaaagcagttttctgttttctttgaaatttagagactgaatctttagtgagggcttcccagatatcctacttttctgagacagatagtcaaagctctgaaaacaaaagaaaacaaaagctctcctttcctcctctgtctggaggaaaggagctgtggcgcttgctgcctgagggaaatcttccccttttcctggcattttacggctaacaatgcctatgagtctcatttcagattctgagtctcctgagtagatacaatgcttccctgagtctttcaggattgaaattaggctgtccggatccatgattctgtggtttataacagaagacataatcagacatggaacaatttgggtcttcttttttaaaaattttgttgagttttgtctgcactgggtcttcgtggcagtgggtggctacctagttgcggtgcgtgggcttctcattgcgatggcttctctccttggggagcacaggctctagaacacgggctcagtacttgtggtgcttagttgctctgtggcatgcggaatctt

SEQ ID NO: 55268 - DNA, 1464 bp, Bovine  19866881433003
ctctggttttagttttataaccttttttccctaatacatgactatttaaaaattgtcagggacttctccggtggtccagtggttgggaatccaccttccagtgcagatgaagggtttgatccctggtcggctaactaaagccccatatgcggtgtggcaactaagcccctgccaccgctgctgagcctgcccactgcagagccaggtgccacaactaaagagacatctgtatgccacagcaaagagcctgtgctccacaacagagaccctgcatgccacacctaagaccacaaaaatccaaacacataataaataaaagattttttaaaaaattgtcctatgggcatcctttgacacattaatttttcaaatttccaacatttaaatttttttttctttttttttctttttttttttttttaaatttattcctttatttctcatgtgttccccatcctgaaccctcctccctcctccctccccataccatccctctatccatgggaaacagatttttaagaactgaagtaatgattttttaataatcagttgacccattcactgaataatttcagtacctcagtgactgattagaaagttagctcaatgatgtttctctttcccgttatgaatgctgtgtttatgttctactcacacacacacacacataatcctagaaacctttacaaatccaacataatgggttaagtttgctaacacttgttttctggtgcaaattctaatacatacatgcacatataaatatgtagaatatatataatatgctgggttagaaaatgtctgatttactgattctaacacctctatcttaactgcacacaatatttacaatagttatcgtgttgttcctttctccttttaaaactaaaatgcattttgtaaccataagtctaagtcatgagacttaccgtgaattctctcagggagaatttctgcctggccatatagcagttcagaggaatgccttgctcatgagagggaatgaaattcccgtgctcaactgtgagtgtgattggatttacagattaacaaaatgagaaagatcaaagccctgttatcaagcagacctacaagtctagagcttgctcttcgaagaaaaattgctctgtacccttaatctttctaatcttgacctcacagtggggttttatacttaagacactgccatcaggatgcaaaattcaacctcaggccacattccactttctcttaacgtgggtgtacatgccctcagtgacttaattggcaactgtatggaaacttcaggcttcaaacagaatttctaattccatctaattccattaaactgatgttcagcagagcacactgatatttgcagttactaaagaaataactaggcacacatgcttacttttaattaatcacagtctcttttttccccaaatggtatggactttgatgttctcatctacactacatctt

SEQ ID NO: 55269 - DNA, 555 bp, Bovine  19866881643531
gtgtagcctagatagtttcaacttcaattcggaaccatgatcatgctaatagggacttaaaaaaaaaaaataactggagagaggcaccctggagtttcctggcttcatggtacaccttcaagtctagctttcctctcttgtaaatctgcagctctagtgctagaatgaagagtcaagtttatcacccagagcctgaggcactattagatgctaagtgctaaatgggaattcaattacgttctggccatcctatttactaaagcagaaaattgggattatttagtcttcaagcagcgtttctcccttgtgggtagggagtgggcagagactcttcccctggaggacgcatcatattctgcagaagtgtgtatgaaaacaatgtatttaatattacattataaattttaaaactgagacaccacccagagtcattatttttgtgatgtaaactccatcaggaaggtggaaggaaaggtcttttatataagaaaataaactttcctctgtctctcaggatttcattaggaagacaagagcaaggcccctggatgcatg

SEQ ID NO: 55270 - DNA, 1829 bp, Bovine  19866880703352
cattattaaaagatgtaatatcctagtgtttttttttttttttaattaagagtcaatgcttacatatatacgtaaggactgtccctccagataggtaacttaagagacgatataagagacttcacctcaaaccatttttattgtctcctattacctttgtaagtggcagagagggtaacatgagaggttttcctgctggagaaagtccctcatgctctttccacccaggcaaggttcattgcctctgcaaactgatccatttcacccatgcccgactgaaacacaatgcatcttgttctgctgaccaaaaagtacttcttccacttgaagttaaaagatgtaacttttttcattgtaaaaagggatatatatcaaagtggaagtttgaatgagatgtagcataagggcctattttctctagtttcatggcttgtagctctggccatgtgtgtcttggtacatgatgcgctggctttagaggtggaaggcacaaagcacgttcttcttgggggtggggggtgacacaagcttaatcaagaaaaaaattgtcctgagtctcccctattcaaatcacttgggtggaacgtttgcctataatacaatataatggccaaagtgttcaatgcatagtttatgcctagcaatataccttgaaaagcttctgagctagaatgtagaaaatccagttagctttattaatatttgaacatatatatttccctatgaaatatatacttgcagcgtaaacagattttaggccatatttgaatatgcgtcactttgcagtttgaatatttccattgtgtcatgaatatggcatatttcaatattttgaataacagaggacagaaaacagaatatttgatttgtgtgagcctgctatgcgtgtatattgctttctcagatgaagtatgcctattctggtgacccaattagaaatatgctgaaataatcaacagtaatttggagagtcagtgaaccaagggatctgtaagtaatagcaaagctgattcaatactggtgtttgcctcaagattgccccatgtcctacacaagtgctgttcaaaattttaaactacctcaggctaaaacctgttaaatccattgtcagttcatttgcaaattcttccctctccctaacctgaaaatgtttgagtttgttaatccatttagtcagcagttgactggaatttttgcttaccttaggcaaactggaaattgcctactctttccaaatcccatccgttgactcacacaccggtcattttgcattttgttcccagtaatgttttgtgtggggaggggaggagtggccacctgctctgtctctgtggtaaagtcagacttgcatttagaacatgccctgatttaataacaataagcattctatccaaatctgctgtgagactctgatgaaattctggttcaaattagtcagtgaaccaactattcagaggttgtcagagtgctgaggctgtgactaaagtcatttcttcttcaagctccttggaggcagcataatgaagtctcctggttggaggagggtagaaaatctattttgaggtgtttagaaaagataatgttgcaggtgccagcatgcacaaatggaattccaatcatattgtgtctgaataggcaaaaaaaaaaatgaagaagtagattgtattaaaacaattcccttgctcacaatcatctgttgcacctgccaagttaatgtggtccattagcatccccaaatcattagtattttaatgaagacccaatccctggtatagttaacactaacttagttggtaaatgctgttatttttactccaccatcatcagcc

SEQ ID NO: 55271 - DNA, 1496 bp, Bovine  19866880896422
tatttgtttatggcgatgggattaagcatagtgggacagattcttggattgcctaactttgataagggaggaaaaggaaaaagaagctctgacaagtcaatgagcatggaaaggggaaaacagaaaatttgcaaatacatttaccacaggatttcctgatgttcactgaggaatttaagtttctgtcatcaagaaacttaaaaatattttaaaggacaaagcatgggcaaaatacaactcaaataattatgcaggttcggggcttcccaggtggctcagtgataaagaacctgtctactaatgaaggagacatgtgttcaatccctggttgggaaagatcccctggagaaggaaatggcaaccactccagtactctcgcctgggaaatcccatggacagaggagcctggtaggttacagtccatggggtcgcaaagggtcagacacaacttagagactacacaacaacaatgagggtaacggttcactctcaaagttagtggatcagagaatacacgggaattcaaagcactggaggtatctttgtggactgatttctcctcatcagtggaggcccaaatgtagaaccaaaaagactgtcctgcaccaacatccttctcccattcttattgttatgtaaaactgtggtaacatttcaaaatctcagatattcttattctgcttattcttgttgttcagtgactaagtaatgtctaactctttgagacctcatagactgtagtatgccaatctttactgtccttcactatatcctggaatttgctcaaactcatgtccattaagtcagtgacgccatccaatcatctcattctctgtcgcctccttttcctcctgccctcaatctttcccagcatcagggtcttttccaatgaattggcttttcacatcaggtggccaaagtgttggagcatcagctttagcatcagtccttccaatgaatattcagggttgatttcctttaggactgaagtagtttgatctccttgctgtccaagggactctcaggtcatctctagtgccacaatttgctatttttctgcttaatagggtagaataactcatgccagaaacataactgtgtcacccaatgggtgggaatatgttatagaattttaggtctctaagacagacagaaagaatgagttactctgtttaagactgacagcagcagcagaaactgacttagctggcagtcctaaattcaagccactcttatttctgcaggttttgtttgtgtttaataaaaatgatcacttctcacatgtttatattcaaatagggactcaaaagtcaataaatgcatctattcattcagttgagaaaaccaattttcccagtgtgtgcacatgtgtttgtggtttgctaactttttttttttttttttgtctttttaagaaatacatatgctgtagcttcaagggtggaaaattttatacacttctatagtgaggaagttaaatggtaacccttttgcat

SEQ ID NO: 55272 - DNA, 1066 bp, Bovine  19866881224364
taggcagatgctttaccgtctgagcccatcagcaaaagttatctatgtttgtgaataatcaatcaaatgtaatcacagtgagtgatggattcattgtagagaatgagaaaggaagatgttatatttttaatgtgaatgggaatggttatgagtggtatggccatatttcaaaatggagatgaaaaaacaaagaaaagtattgacaaagaatattatcagcacaattttaaattgactggactttagccatcatttaacccaacttgctgtctttattgattaagaaatctctgaagtctgtaaatatcaagtaatccatagacttagcagaagagccaatcttagaacccagacttactaaaccttaagtccctaggtaacgtttctcagagatgaaataactaggctcttgatgagatggttcaaatggtaaatgaagactgtagaataattgtaggactaaggggaaagacgacagactggagaggcatttgcccagttttcagtgaggatgaagagctaacctagaacttaaaaagcagaaggcagatgttgatgaggtggtgaagtatgtggttatatatgatgaaactcaagttaaatgcttttataatatgaaataggtttgccgtagaaatggcactggatagtacatagagccattcgtatagagtagtactagtcatcaattccttgttgtttcgtcgctaagtcatgtctgactctttgcaaccctgtggactgtagcctgccaggctcttctgtccgtgggatttcccaggcaagaatactggagtgggctgccatttccttccccaggagaccttcccacccaggggtcgaatactgaaggtggattctttacctctgagccactacatactcaactaccagcaatcaaaatctacccggcactgctagcatgtccaaagctgatagtcactacttcaggccatacaaagataagcaatagtgaatgtgaatttggacataatgcagaaaaagaaaagattgagggcaaacactgaagccaacactcgttactaatggaattttttcctactgc

SEQ ID NO: 55273 - DNA, 1795 bp, Bovine  19866880818574
tatgagctctctgagcagtttgggggtctgtgtttcaggcataagttttctgagcacttttgagggtactcatctcagaatataaggtctctaagtttattgtagaatgtttaatgctgtttgctgcttgggatttgtgcttaggagtgagatctctggactctttggtggtatgtgcttcaatgtatcagtgtgaagtatttcaaagtttgtgttcagggtgtgaagtatctaaactctttaaaggtctgtgtaccaagtttgaatctatggtatttggggttctgtattccagtgtgtgaggtctctgaactcattaagggtgtgtgtttcaaagtttgagtctgaagcatttccagtctgtgtttaagggtatgaggcctctgaaattgttgaagatgtttgtcccaaggtttgagtcgaatgtattcggggtttgagttcaggatctgagattttaaacacttgaatgatctctattgtaaggtctaagtttgaggtaatgggggatatttgttcaggatgtatggtctctgaaatatctgagtgtctgtttcttggggtttgaatatagcatacctgggggtctcttagagcatgaggtccctgaactatcagagttttggtgacaaggtttgaattggaggtatttgcagtctgtgttcaggctgtgaagtctctgaacttttagggggtctttgtcccaagattttagtgtacattatttgaggccactgtttaggatatgaggtccttgaatttttggagggttaagtctgatttgagttgtgtctagggtgtgcaatatttgaatttttagagtgtctgtgttccaagtttgggttggaggtatttgggatttgacttcagagtgtaagactcttgctttttaagggtctttattccaagttttcaaggtctgtattttgaagtacttagaagtttgtgttcagagtgctaggtttctgaacgcattaatatagactctgaacttcgtctatattccaatgtttcagtttgaggtcttttggggtctatgactggagtatgaaatctttgactttgtgatccaaggtttgagtctgagacatttgggcatttctattcagggtataaaatatctgacccctttgaggatgtgtgtcccaactgttttgtctaagtttttggaggtttgtgttcagaatatgaggtctttacatgctctgaaggtctgagtatcaaggtttggatttgaggtatttaacagtcaatatttaatggtgtgatgtctctgaaaacattgacagtctgttttaaggtttgagtgttgtatctggtggtcaggtgtgcggtttctaaacttttaaggggtcaccaaagttttatgagtcagttatttggtggcatttttcagagtgtgaggtgaatttgtaggtttctgtgccccagtatgtgggtctgaggtatttaggggtctgtagtcaaggtgtgagatctctgaacttttagagggtcattgtatcaagttttcactgtgagttatttgggttctgtgttcaggattagaggtctctgttctatttgaaggtctttgtttcaatttttgagtctgaggtatttgggagtccttttcaaggtgtgttgtgtttgaacccattgagcattgtatccaaaagccttaatctgaggtattcaggttcagtgttcagggtgagacatctctgagtttttagagattcttttgtttcaaggtttttagtataattacttaacgttgaggttagtatttttttcgaggatctccgtcccaagt

SEQ ID NO: 55274 - DNA, 784 bp, Bovine  19866881319325
ctgtattaacactcttagcacctaccaaaacatacacacggtatggcctccggcctgttggaacataggcataatatcctccactttttaatgtatgtcttgtcactaggtggtcagtgaatatttttcttcccctcatacacacagggtattttgtttttaagcattggagagcaacaatagaagcagtgtgtctgaatgcaggaacagtctgggaattcaggtgctgtgaattttatgatgtctttgctatttccctaaagcacgattctagaccatttaatttctttattccagtgtttcttcatctggataacagaaatgatgagaaggccagaattgaaagtattataactatcttaaccctatcagtctactagccatagtacatgaatcctcataatcctcataatcattctcataattttctttgaggaatggtctgtataaaatattttttgctccttctcactaagaaaaccagttcatgccctaggctcaggaggcttcagcctgcctatagcttcatctcatctcccatgtacatcacaatttgcttttataaattccattcccttagcctagaatgctttcctgccattactcaaatccccttgttcctggtgacaaatcagtatcaagactgagcgcttctcctcatggtcttcatcaactgcccccatcaagccatctcaaatacatgtcatataatattcttcaacatgggcagttcagattttctcagtcttatgtataaagtgagaataaaacaatctttaataaa

SEQ ID NO: 55275 - DNA, 2164 bp, Bovine  19866880364523
tcagttcagtcgctcagtcatgtccaactctttgcgaccccatgaacccagcacgccaggcctccctgtccatcaccaattcccagagtctacccaaactcctgtccatccagtcggtgatgccatccaaccatctcatcctctgtcatccccttctcctcctgccctcaatctttcccaacatcagggtcttattcaaatgagccagctcttagcatcaggtggccaaaatattggagtttcagcttcaatatcagtcctaccaatgaacacctaggattgatctcctttagaatggattggttggatctccttggagtccaagggactctcaagagtcttctccaacatcacagttcaaaagcatcaattcttcggcactcagctttcttcacagtccaactctcacatccatacatgaccactggaaaaaccatagccttgactagaaggacctttgttgacaaagtaatgtctctgctttttaatatgctgtctagtttggtcataactttcctaccaaggagtaagcgtcttttaatttcatggctgcattttattatagttctgctctaatagttgtcagctcctagtcttgcatactattgggttggccaaaaagtttcaggtttttccttaatagcttagggaacaaactttttgggcaacccaatataattttccttatttactcttagttctataggtaaatatatatttaatgctcatcattgattccttatgtctttctaatcttgccattttggtgtgcaagtgtttatttctgcattgtctcttctagtccattggtctatacgtctgcttttataccatcctactctgttttgcttattggagctttgtattatgttttagaatcatgaagtgtgagactactgaaaggttgttcctgaaccatgaaagacgccgggattcttggcctctggaggagaagaattcaatccggggccagagacaaggcttgatcactcagagcttttgtgtaataaagttttattaaagtataaaagagagaaagcttctgacatagacatcagaagggggacagagagtgcctcctcaccagtgtcagcaatgaagttatatacttttaattagttattacagtgaatcaaaagaatgtctggaggttgtaaagaccttactagatccactcccataatttacattttaagataacaggattagccagaaggttttttccagaaactgtcctcaagcaggatagattattggtatataatcctaaggaatgtagagggaaaaaaagtgtcctttcctcctccttgagaattccaaacccctctctccttggggatccccggacttcttatcaacctgcctaggaattgactctcttactgggagcttactgtgctgaacacgttgtctgagaaggaggctttctttagaggccacacaggataatagtttaggtgcctaatgtttagagtaacctgatcagcatcctaatataagttctgacttttactggtagatgaatcccctgattttcagtgtcttggtctgttcaatgaagatcagtatgctttccttttaagattgttgtaaggataaaatgatataggttaggtagagtccttaccataatgtaagctgtagggaaaatgttcacaaagagtgattttcatttattataaaatctcaaaagcaaaattgttataggagatataagacagggcaaattctgaggtgaaaattactttttccagactaatgactttgaaagatactttaactcttacatctgtgataagtggtggatggagcaaccagttttaagtgactactgaatcgcattttcctgcttctaaaaaacattttaagttgccccataggcaattctcagttctcagaaagctcttagattctgtttcgatgagacacttcctcttcatcctcaaaatgtggatgaagaagctttcccagcacagaggaacatgagtcaactccaaataggaaggcgctgtttatggagcatatttcttttggaagaatcgttgtcacatatctgactcaacacttatttctagaagaacaagttgttcaggaaggaaatctatttccatatctaaaagaaagtttatttaagaagtgcaatggaataatcacgcaacagaaa

SEQ ID NO: 55276 - DNA, 1278 bp, Bovine  19866880392922
tgcatctgggttccacaggggtgggatcccaaatggatttcttcaattatttttcttcctccaacacccagaaatcctacatcaatctcatgtaaaattcacataatttatagattagaatgtatcttcctataccttctatagtcatataggatgataatagaacatgtgatactaaaataaaacaatctttccgaaggtagctttgagagactattttggaattgaggaaaatttgcacagtaatagaagtaatttacatgtgatgaggatcctgcacagttactgaaatagaactgatatctaggccatgccaggcaccttttcctctagtgattatcaaccattaaaaaaaaatcagccagatctgcttgtcaactgctgtgtgaaaaatagtcaatctattggtagtattcattcctatttttcttatacttttattgatccgttaggatagattcacttcttcatctctttttagctaaactttgcctagctctctggctcagtaatactaaatacagtctagcaaacacaagataaattctcccagttggcactcaaaaccagtctctgctgcaggtatttttgtctgcatttgttacatgaggagttggctgagagagaccaactaacctgtcaaggtcactcagctcctaactgttgaaccctccaggattcgatttccacatgaaatagctactactaaaatttctctccaagatttaccattttaatagccaccttttcaaggtggcccaaatgactcacatgacacctgggaaaatcaaatactgcctaagtcctgagccatgaggaaagagggtgactgctggcacatgcattttataaactaggggtgggcatagattaaagtcattgatcaacatcatggagtaactccgctgcttgcctttgcaatgagggaagagaaatttgcatttcttatttccaggacaataattgtcctgctgtcaggatgctgtcgcatgcccggtgctgatttataaagctgaagcatcatggctctcaggtggcctctctgcacagcagaagggagcccgcagtgcatccacctttggaggagagttcattctaccaagttagctgtgatttatggtcctgagtcctgctgtgttcctgacaaaccgcatgttgggaacagcaggaagaagcactgaaaaagttgggtgttgagtgagggaatatagactcttgcacttggattgtgtaatctgtgcccctagaaaggacggaacagagcagttagggagagtt

SEQ ID NO: 55277 - DNA, 2415 bp, Bovine  19866880425657
aaaagacccgatgctgggaaagattgaaggcaggaggagaaggggatgacagaggatgagatggttagatggcatcactgacttaatgcacatgagtttgagcaagctccaggagatggtgaaggacagggaagcctggcgtgctgcagtccatggggtggcaaagagtcagacatgactgagcaactgaacaccaccaccacccagtcataaagtaccagatgatgatgaagtcagggcttcccattatggcctgagaactatctgatccaccaaggtataaaatcaggcatccccagcagcacaccaccatcaagcagaatcggaatgaatagcactaaacccaaacacgtcacaagcaggttccaggagcaagtctcccacgctacccgatagccttccccttctgttctgctcctctgcccttgaccacacacattcatggcctcacgagtcctctgttcctagttccctgggaagtgggaaatgagaaacaggctatcaagtgtctctaaccagcatgttggcacagccaaaattgaagttctatagcgttactgctccactcaagggttcaaggccctatctatatttcttcctttactctgatccaaccacatggggctttttgctgtccttcaagcacccccagccccacaagtttgtatccatctcagcatgtcacactccctgttcattcatttcaccacaaatagtcttggggttgtatacagcagactcttggtcggctaaaccaacactcattcctaagtcctttctcccttgcctgcctccactacagaaactggaaaactatcaccgcaccccccccaccccaccccagagtaccttagagcaagaagtattggccatgaaagaaaggcaataagtcataagcagagacttctgggatcatttttgccttcctgattatttaaaaagacataaattacaggcactaggactagctgcaaggcagaatcacagagggttctgctctcagaagggcccgcccatgccttcccactcagtgtaatattctgctattgccctttttaaattattaataaatttgtctctgagtttatgttcaaagtgaagtcctaggagacagtagagtatgatcacgagcaacagagattctccagggatgaactcagcagacaaagcatagagtgcaggcacttaatcaattgacctgggtgctgagtactcttgccttgggcaactagaataccatggggccccagagtggtgggccgggacctgggcccagaataacagcaggcttaggggctgtgcaccgtgatgcaggaggaggacagtttgccatcctctctggagctctttatcgcagcctctgcataagtattaactctgccctcagtacaagaacagaaatgtcagcaaatttttacagaataatagagtatgcatggacattgcaataaagcatatcagagttatttggattctacaaagaatttagaatcaacagtttggaaaactacagaaacattgcaaagcacatagaaatgaaatttaaagatgtgacattccgcagaacagaacacttttcaaatgaagctgcagatcaaccaattattaatgaggaaggcaattttaaaattaatgctttatttttaattgaaaatacaatgacagactgcataaacaggcattttgaattataggcaaatcatgaagccattttccatatcttattcaacctctatacactacagaaaatgtcagaggagacattaaaatgccatggtacaaatttacacttaaaataaaattcagacttatgaaaaacttattttagaaaaattgtttcatgagaagcaactttagatgtcctaaaatttttattttgaaataatttatcagaaaaattttttcatgttgccacagtctataaaatacacttagcagctcccacgacaattgttgtctcagcagaaagatacttctcaagattaaaatattataaaaaatgatttgcagccttgcatttgccaagagtgactggtgttgctttcaattacattgattgaaaatgaacctactttgagtataaattttgatgacctaataaatgaaattgcagaaaagcaagctataaaaagatgatttaagatatcatgttactcagtagtatttattgttttgcataaatctatggcaccaaattttttttgcaataaaatgaaaagctttattttgtgttagtcctttttttaagttcttctaattttgatattctactttctttaactttactattttttaacaaataatttattattttttggttgcactggatctccattgctgttgcttaggctttctcaagttgtggtgagtgaggcctattcttcatggtggtacacaggcttcttactgcagcag

SEQ ID NO: 55278 - DNA, 726 bp, Bovine  19866880469946
aattacatcatccacatttggaaggccctctgccattgactaagagggaagagaatttattccaatgtccctatcactctttttttcttgttttgtttgtttgttcattcatttgtttgattgtttatcatgccacatagcttgggaatcaggctggaagaagacaagcctgaggtgccttctcccaggcaggcatggatcaacccaggcccaatacgagctctttacttacggctacatactttgtgtaatagacttcggagtttcctgtaaaatacatatttttgttcaatgtcctcatatcctatgaacctacttcttgcctcatagaaaagcaaatcccaaagataaagaatgggaagaaaaggcagttgtccattccaattatacaggccaaatccattttctaggtagcactgctactaaaaacatcatggagtttttaaaatcccacatctacccagagaaagactcttgagtcattaagccagcacaaaaaccaagtgggctgtaacagaaaccagcaggcctggcccagggactcactaggagcctggttctaatttggggaagtgaaaacagattttaaaaaaatatattccagacgctacaaaggcctcccttgaaaactcaagaaaagtgacaagacatgcccttagaaagtcagcaagagctaatcaaaagctgacaggcttctgaaaccatcactatgtgtttatctcaaaa

SEQ ID NO: 55279 - DNA, 1401 bp, Bovine  19866880507109
aatctagacagcaggtaccgatgaaccgatttgcagagcagccatagagacacagacacagagacttacggacacagagggtgggggaaagagggtgggatgcattgttacaataacatggaaacatatacatttccatatgtaaattagagagccaatgggaatttgctgtatgactcagagaactcaaactgggactctgtaacaacctagagggctggggtagggagggaggtaggagggaagtccaagagggagaagacatttgtacacctatggctgactcatgttaatgtttggcagaaaccaacacaatattgtaaagcaattatccttcaattaaatttaattaaagaaagaaactggtaagtgaagaaaatatactttgtgtaccgtatgtgtacattacttcttcaaaaaataattttaaaacgtataaattaagctgataaatgaaattaatcagagcccttacatttgctgcttgctttggctggaatgctctatgcctacacttgtgcctggttccagcccttctcatgcctctgtgaccttgcttgcaaactttgtctaaaagcctaaagggcccttcctgcagctgaccctggccacacagcagacatccaagtgtctttcaagaccctgtcttctgggaccccacccagcagactcaggcctaccctccaccgtgggcctggcagacctctctgcattccctgtcctgctgtatcatcacatggtaacccaagaggctgttctttagaccagaaactccttgaggccagggatggggtctcaccctctccatacaacctgtacctaaagcacagcctggcacatagcacacacctgaatacagtttcatcaagatgcggaatcaaacagaccaggggctgtgtccaggctctgctatagtttccaaaggcaatttactctgcgtgggacctgtttgtgatctggaaaatggtgcttgcaatgcctgccttatgatatagctgtgatgattaaatagcaaagaaatgcaggggtggatttattattgcttctgcatcccctgaaaaacctgggtgctcagtagaatccctcagcactcactcagtgctctgcttaccagcttctgggccctgctctccttatcagcccattttcagcttctgctaggagtccagccctccgcctggctgttagggcactgagacctggaattttccttctgtctcttttaataaatgcaggtgtagcttcctttaatgggctgtcagtgagcactaagaatcttgactgtacaattaaataaaacaaatgcttggccatcactgctaacagctgtgaagctccagaaacccttatgtcctgggaaagcagacttcagagtctgtatgttaagggcacagcacactg

SEQ ID NO: 55280 - DNA, 1195 bp, Bovine  19866880544746
cctgggatttctttggaaggaatgatgctaaagctgaaactccagtactttggccacctcatgcgaagagttgactcattggaaaagactctgatgctgggagggattgggggcaggaggagaaggggacaacagaggatgagatggctggatggcgtcactgactcgatggacgtgagtctgagtgaactccgggagttggtgatggacagggaggcctggcgtgctgcaattcatggggtcacaaagagtcggacacgactgagcaactgaactgaacggagaaatgtcaggaaccctaagaaagatgctgtgagctgttggcatcttcctgatagaaagaaagatgttctgtgccctactgtaagcttttctcttcaaacaaatgctcatcactggagacatttggaaacataaagaacttaaaacaaagctgctacctacttccatttcccttctgtgatatcaatatcccaagtgatgccagccagcttgtacagaatgagacccataatctttggtgcttatctaaacagataaagggaagagaatattaaggcaattacaatatgtaaacaacttagagaatcagagcacattgctgtggtaagtgtattcgatgctaaaatcgagacctgggagaacctgggtccctgtctcacctctgccacttacaggctgagctgagagcctgcaggtaaactgttccctgtctctggagcatctttcttctgtagtaagagggttggattagacaagagcttcttaggctaagatggctggacagataccattacttagtgctaccctcacaaggaggcaaaatacccagtagccctcatcaacttttctaaattttattattctcctagaaaaaaacaaaatagcaaccactggacaatgtggcctcttgtcacattcagaagctgacactccctcaatggttttgagtcaacgctggataaagtactctttaaaggtgggtatcttactcgtgagaggttcctgggcaagagattgggggccaggagccttgtgctcacccaggacagaactgatggggacctttctcctgcccttgaatatatgttcaccaatggctcacctcaaatgctttcccaggctttcactcccttcccgatccttccgctgaaccctcggctggctccctcccgggacactcagagtcagcccg

SEQ ID NO: 55281 - DNA, 724 bp, Bovine  19866880553149
tccaaaataaacgatgttgttaatggaaattgcagctattcagattcctcaacagaaccaaagttgtgcctttaaaagcaatgtactttccttactgtgagcctatttgcttaaaatcttaatcacagttctttacagtggacagcaaatggcacatgtgacctgttgactgatattaaccttgtgttttatgtcatcaccataaaatactctgctgaatactgctggcaaatgaaaggcagacacaatgtttatcagccactacatatgaatcatgactaaaaacaacaagtatgaatataatagaaattatctatagaattaaattgtgggaaaagagttcatcttcctttgacaattttatactgcccgccagcatatggtcccttaactaccctatatgtttggggaacaataacttgaagtgtcattaaaaaaactgatgtcttaagtgatgaataactccaaaaatatattaaaaaggtaaagggagaagaacagaagaaagttaatgatccttgtaatttgacagtcgggcacaatgttggcttctgactttccactgaaagctttgttcctctgatagaaatttggctgttttgaaaatgatggacaatgagaagcatgagtcagtgtcaacaagcatgaccctcggtgccacatagtcaagagtggggaaaggacacaaaaaaaaggaaagagagaaaactaaaacagacatggg

SEQ ID NO: 55282 - DNA, 1688 bp, Bovine  19866880595481
tttccattgtttccccatctatttcccatgaagtgatgggactggatgccatgatcttcgttttctgaatgttgagctttaagccaactttttcactctcctctttcgttattgttatttagtcgataagtcatgtccaactctttgcaactgcattgactgcagcatgccaggctcccctgtacgtcactgtcgcctgaagtttgctcaaattcatgtccattgagtcagtgatgctatctaaccatctcatcctctgtcgcccccatctcctcctgccctcagtctttcccagcatcagggtcttttccattgagtcagctcttcgcatcaggtggccaaagtattggagcttcagctttagcatcagtccttccaaagaaatcccagggctgatctccttcagaatggactggttggatctccttgcagtccaagggactctcaagtcttttccagcaccacagttcgaaagcatcaattctttggtgctcagccttctttatggtccaactctcacatccttacacgactactggaaaaaccgtaactttgactatatggacctttgtaagcaaagtgatatctctgctttttaatatgtgccatctaggtttgtcatagcttttcatccaaggagcaatggtcttttaatttcatggctgcagtcactgtcagcagtgatctttcagtttggttcagtcgctcagtcatgtccaactctttgcgaccccatgaactgcagcatgccaggcctccctattcatcaccaactgctggagtctacccaaacctatgtccattgagtcagtgatgccatccaaccatctcttcttctgttgtccccttttcctcctgccctcaatctttcccagcatcagggtcttggagcccccaaaataaaatgtttcaattttcccccatctatctgccatgaaatgatgggaggtctttgagtctccctattgttttcctgtcccttttctctgttgtttagattagaaaatttctcttaatctgtcttcaggttcactgactcttttcttctggtatttccgtttttatattgagccattatgaggaattttaaaatttatattatggttctcaaagttgactcttttttatagctattaattctttgttgagaagttttatctttccattctatccaagagtacttgtccttacatcttgcaatatggttatggaagcttctttaaagtctgcctcacattctaacatttatgagatttcatactttgcatctgatgaatgttaggttttgcttgttctttttgtgatgaataattttgaattatgtcctggacatttttaataatatgctatgagatcctgtgtcctttaaaaatctggagaatgttgatttttgttttactttagcagattgtcagtatagagtagagtgtcctgagccctatcctaccaggatcggaggagtgggaggggtacctgaggtaaactgatgcctgggattggttcgtgagggaagccaggacagccccattcataatattaataactctccaagagctgagctgttctctcactgtgctgactgaattgattcagaaagagaagacctgactagagaagctagagttagggtcccatagtctgggcatgcatccccagaagttggaaacccctagtccacagtgtcctat

SEQ ID NO: 55283 - DNA, 912 bp, Bovine  19866880645164
agaatcgggagcctctcctttatgttggtttttataactgtttctgtgatcttgataagctacattctctttgggtctcattttcctcatctctgaaacaggatacttagatccactcattccttcatctctaagagtctgagtctatgaaatagttggattcaaaggtaactgaacaaatcctggcagaagagattggtcttaggcccagctgatacagagaatgatgagatacagagtccagcagtttttctatatttggatgctgagatgttctttgttgtttgcatcttggaagctaggagttgtcaacttttcctgattcaagtaagcagatgctcctctggctgtcttcagttttctgcaccctgaaaccagcgggagcaaagattttaatcagatccaaatgagtagttggtgccactggacattatatgattaagtctctaaataacactccagccgaattcaaatcagagagcccggattgcagttgtcatgcatccaccggctatctatgtgctgaataaatattgcacttcctgtgacacaaacttgccaaaatactcctatttttttttttttttttctcctagcaagagggctcccaaccaagaaccatgtcctgggagattgtggcaggctctgttacacaccatttcacacacctgtttttgtctccataaatttgcaatgacttttcctccaggcttagactgattagagcattcttctttctcctccagttgttgcaaaggcagcactaatacgaatcagctcaaatgccagaacaggtcaaagctttagcttttagcctcctctatgagcctagtttaagtttaaaaaggagcctttaagccttgctgtataatgctgggtttggcctctgagcaagaagccaggagagttagt

SEQ ID NO: 55284 - DNA, 2255 bp, Bovine  19866880660571
ctggtaaattcatactaggaactagattgctctcataaagctttctgctaataataataaagaaatggagaacccttccctaaacattttatgaaagcagaacaacagtaaaacactatgcctaaagctgacaaaggatttctggaaattttaaattatagaccagagttagtcatgaacatagattcaaaagttccagatcaaaaattaacaaatgaaatccagacttacatataaataatatggtggtatattcatacaattaaatgctactaagcagtaaaatgagtgaacacatacatataaaagcaaacatgaatgaataccaaaaacagtatgcaaaataaatgagacatagagtacttataatatctgatttttattaaatattagaatccataaaactaatgtttaaaattaatctatagctaatgtatacatagtttatacatacatgtataaaactacttcatagctttggaaatcattgattttctgaagcagcaataagggatgatttaatgcaaaagccataagagaacattctgaggtaatggaaatattcaacatcttgaatgggactgtggttaatgggtgcctaagtttatcagttcccaaatgtcaacttgaaatgactggccttttatataaattatacttcaataaagttgattaaaattgtatattaaataaaatctaagattttatttaacatacattatttggtggctcaggcagtaaagaatccacatgcaatgcaggagacccaggttcaatccctgggttgggaagatgccccaaagaaggatatggctacccactccagtattcttgcctgggaaatcccatggacagaggagcctggtgggctacagtccatgtggtcgcaaagagtgggacaggactgggtgactagcactacaattcagaacaatgtgttctttctggtctaaattgtgatacctcacattatataatagatgatagacagatatagatagatgtgagtgatgtcaaagaaacagtgaaaaacaatatgacatgatattaacaatgatacaaaagagatttcaggcaagttttatctttgaattataactgacaaatgtaatttacaaatttgctgaaaatgagcatgcattaacttttccttaagttaaagaaaggttatgaaaggtaaaagatatatatataatgcatgttatgtggtagatcttcaggatatgttttacaacttcctttcagctctttgttttcctttttatactcttttaccagctcattctatttctagtctcttgtgcatttccttctgtttttccttattcacattgtattacacattcatgcctctaaatccagatccgatgatgtttgatgaaagatttttcctcaatttaattcaagtcagtaccagaaatcttcaaggaactaattatcaagtttgcacaatattgaagtgaacacagccgtacacaaaaacaagatgataggaaaataggatgtgtctccactgtaattgcattttttcatttcttctgaccttaattcagcctggaccacagtttctcacatgcctcctgggatatcaaagcctgccagcactaagagaaactctggctatgaagcacaatggtaaacttataagccagggaccctctcagaggcagccttaaagaaagcactgttttacgaaaacttgtagtaattggccaaatcctgctgctgttctcttttggaggcgagctgagaagcctccccttttctcagctgccctctatgaaagaaaacccttgtagtcctacctttggtaattcaggaagtcactccatccaatctggtggacacggtgctcccagagaggaaaaagacaaaaaagcacatattgactgattgtagtcagtgctggttcaaattgagagaagactagaaaggaaaaacagcaaaaatacttattctcactttataaggtgtttcctcacttaatttttataaccctcccttcaggaatgagttactagaagaaaacagaaataaagtgcacagatacaaagatgtctttatttgctgactgcttgatggtttaggtttaaaatcctaagaaaggaatctgtcaaaaaggaataaattctactattagaattactattattaatgaaagttaaattgtgaatatagtaagatgaattgtatttctatatgttcttggtattgctcagttcctaagttatgtatgactctttgtgaccccatgg

SEQ ID NO: 55285 - DNA, 1606 bp, Bovine  19866880866863
aataattgctgctgctgctgctgctaagtcccttcggtcgtgtccgactctgtgcgaccccacagacggcagcccagcaggctcccccgtccctgggattctccaggcaagaggactggagtgggttgccatttccttctccaatgcatgaaagtggaaagtgaaagtgaagtcactcagtcgtgtccgactctgtgcgaccccacagacggcagccccccaggctcccccgtccctgggattctccaggcaagagcactggagtgggctgccatcgcctgctccgagaatactcactatacgtggggaaatacccaagctcttgtccttagaatcgttcccaggacatgctcgcctgctgtccctctggccagacaccttgctttgcatgcattttacatgccagtgactcacaagtggaacttttggtttgagcctctttctttagagcagattgataactgcctactctgaacagtcagttgaatgccttgttgttgttcagtcgctaagcatgtctgactctttgtgaccccatggaatgcaatatgccaagcttccctgtccttcactgtctcccagagtttgctcaaactcatgcgcattggatcggtggtgccaagaaaccatctcatcctttgtcacccccttctcctccttgaatgccttacgagtgttctgtggccacactggagctctggatccctggtcctcctctaaactgatcctcccctgctgttttctcatctcagtaaatggcaccactttgaccagagccctcttagtccctcaccttttaatttcatctattagcaaattctgtcttttctactttaaaaatgtatcttaaagccatctcccctggagattaggggactggtggggagataattaacttagaacacccatatttgcattttacaacttgttacatgcctagcttttgtaatttgagatctaataaagtaaaaagtaaaagaagagaaaaaaaatcactttgacattgaatcatgaaaagtgcttctcattgccttttgaagccacatttctgagaaagctttctgactggaataataaattgtgcatgaaaaacatataaactgaggagagggcaaggtcaccattgaaatggaaaactaagcgactcatggcttgaaaactctccgagtcgctggcgttcccctgatcgttgactggaacaaataactccccaaacaaaatatacgtcaagatttctttgagaatgccacaagtacggtttctttcctttctccctttcctccttttccgtcccccttctctctctctcataattggagagaatttgtatcagcctatcaggtaagtggttttcaaaaatgcaacaatgttttcaatattgtactacgaaatatgactgtaatattatatgccataaagttttataacattggttcgctagtgtataggctagacaaccatgaagcagttgtattgctgctgcttatcattgcttctaattgctgttatcaatgcgtgaatacctacaataaatatgagtttctttttctcgtcatcttttaatttttgatgtcccagtgttagtaagtatgtataacatccatag

SEQ ID NO: 55286 - DNA, 1436 bp, Bovine  19866880919718
catcaccaactcccagagtccacccataactgacttatacacttgaaactatggaacattgcaaattaactacacttcaattacaaaaatgtttgaaaaaagtgttgaaccatcaaataaaacttattatactttaaaacttgctatactttcccttgtggctcagctggtaaagaatctgcctgcagtgtggcagacttgggttccctaggttgggaagattccctggaaaagggaaaggctactgactccaatattctggcctggagaattccatggactgtatagtccatggggtcacaaagagtccgacacggctgagggactttcacactatactttaaaaggggacttattaggtctccagaggaaaagacaaacgaattactggtatatttaatagtctatgaaactcaatgtaccctgtatccctggtctccatccaagcagagtccctcagggtgattcttacccaaaattctccaagcttcttgtcctgtggacctgttaacatagctgggatggcatgtatcagaaccaagaatgcactcagactcaagaggagtagcaatggctcagttttgaggagcagtttaaagagtcatttgacacaagaatgtctagtgagagtgctctgacaaaggatagtgaataacgtgtctcatcagattctctctcttggggaatcttgattccaaatgagagggtggagggagatggatgggagagagagaaaagaaggaaaacagcagaaactaatggagcagagttggagaaaaacagagtgacaaataaggtaacattatcagacatataggaacatcctttcaacagtatgctaaaataaatacgtagttcaataaaacctactgttaaattcctagaatttctgttgttgtgatagaatgccagctatatatttctgagttctttctgtgtgctgggcacagtgctttgctttggcagacgttatcaaatctgacaagtctctagtttttgatgagtgtccatggacactcacattgctctggtacctgaaaggtgataaatactgcctccattccattaaaacctgaccttgacattattgagactgatctctgtgctttctgacttcctagggcatcctgataagtctccatgatctgaaggaagcatattttcattcttaaagcctgaaatctcctaacatactggaaactgacaacaaaaaagaaaagtaagccaaagcatatgatgccgaattggttatcatcactgttccctacatgagtaatgaatcagttaaaatcttcactatctcaagaaatcaccatctgttctttagtctttaattgatgtaagagatgtttcaggaaatctccactgggaaacaattccagtgttcacaaaaacgggctggcagattagtgggtcagccaagcaggggtaccagg

SEQ ID NO: 55287 - DNA, 1601 bp, Bovine  19866880939534
tgtcatgcactttttataagccaacagcatgtgtggttagtaactcgcaacatccttaggtagggacatttctctgtaagttgccctagacaaggatggaagttgggtgtagaaacaccatgaaaaatgggattctgtggaaatgaacaactatgtcacctttctaagatttatctcacagcttgtcccagaggtttctgtcctcctgaaagaaatgctctgggcagtagtcataaaataaagctttttatctcactgctttcccagtccatttctagagacacataaacattcaggacagtagccacaggggttcgcacaggttggctttgtgccacattgccctggggaaatagagatccaaggttgcaattcagttgtttttaaaggaacattatcttctccaggcaagaggccacatattggtgaaactgttgtgtgtcttctctcctgattaaatcaaaatctcagcagaacaaatcaatcagcttttctccccttttaaaccatcactgcttcaacttcgattttactacctctcacctggatgacttgcaaatattatccttttagttctccctgccctggtctctctctgggcattgaatccttcacattgctgccaaaggatcttcctaaaatgcaaagatgatactgacagcctcttgcttaaattcattcaatggtgcactatttatatagcatataagtgtcctatcaaggcattgagaagccttcatgatccctgcccacattttcagcaccatttctagtcacttttcctcacgctccaaatatttcaaccttatttgccatcattcccaaacaatactgtcctgtatttcagaccctttgcagatggagttcatttagtctaaatgactagactagaatgactcatctttaacatcactgcctctgagatgctttcttgcattgtttaatcccaggtaaccctgagcattctcatgtatcactcaggttctcagaggcagacaacagaatctactcttaagcaggaatggattaattgaggacactgggaagcttcctgagttgttggaaaggctagagaaggggctccagactcgctttcttagaagcagttcctaggtacacgccatggtctggttctggtaaagaagctaatttgtgcccctggtcccagacctggctgcctctgctgccacctgtaccgctgaatgggtgcccggtaccctttcctattttcctatataactcacttccaaatctgggtcttgtgtagatgtgtccagttgataggaacgaagtcacaggcttatattctagcagcaaaggagagttggaatgttttcatttttgattttacattgagaaggcagaattcaaagctagaactagaaatatagcgagaactagaaaaatattgaaaaaatatttaaaagacgaggagggggcagaataaatgacagaattctagggagtctctcttataaacagttcttgcatttcactatcattgtctttatacatgtgcatccgtgctagatcaaccatgagcttgcattaaggggatgtcttacttatttctgtatccacaacctctggcacagtgcctg

SEQ ID NO: 55288 - DNA, 1491 bp, Bovine  19866880944976
ttggggcttccctggtggctcagaagataaagaatccgcctgcaatgtaggagactggcttcaatccctgggttgggaagatcccctggaggagggcatggcaacccactcaagtattcttgcctggagaatccccatggacagaggatcctggtaggttacagtccatggggtggcaaagagttggacacaactgagcggctaagcacaaaccacaaagcagctttgcctgttgtcccttctttgttttatttcaagaggtttgattctattttcatccagcacagaaactggcctttagtgtttgctgctcatcctgaaagggaagttctcgctgtctatttgccttgtaatagatacacaattgattcacaaagtcttcatgctgcttaacatgacagatgaaccatttgcttccaaaatcacagggatctttggggtcaggcaggctaggtaaacagagagagtctcctccagaaacacagagaaatgcagataagcagcgcctggctttgggagccatctgcataggagtggtcagtgccatcatcctcttacaaccctcaagggactggggaattagtgtgcccaagccagcatatggtgcatatcttattaacctaatcgcaggactccagcaagctgctttcaagataatttgggcccctgtgaatagtcatccctcttcccagcccctgctcagccctggaagggatgacgtgtgcacatctcctctgcccaatggactccaaagaaatcttgccagtgtttataatatctgcaaaatccctctgtaaataacacccaggccacacagcaggttgaagccaagaagctcagttctgactgacagctttcccccaagtcgttacttttgcagttggaagggaagaaagacccccccagacaaaagatacacagcagtcttaaggtagacattttatggtcgttttatggaaagtttttttttttttttaatatattttgaaggataaagtgaatgcagcttctctacctggaaacctacgctggtcagtgacaagtggaaaaaaaaaaaaaagaagaagaagaatggtaaaagtaggcctagtttacaaaacacacatgcaacttggtctctattcaggcaaggaccaccctcccaatctcaatccctgtctctccaaccctcccaatcatgaatactaatgtttgggggagactctttagctaacagtgtcctgggaaacatctggtctggaaaatcagaactgtatctttaagatacaaaagagaggtttccttcaaatttcagaagtatttgtgactgattcctaagtaaaaaggaagatctaaaaagaacattataatgctcataggtagaggagaaaagggaacataggggaataaaataatatttattatataactacttgtgaaagtaaagatcacccaaaagaaaagaagtaaaggctattaattcatagctcgttaaagcataggagtcagcta

SEQ ID NO: 55289 - DNA, 450 bp, Bovine  19866880969601
tttgttacctttatacttgaattgacaacagggctcaagatccgaatattaggtcacactttatttcccacagaatttcctcagaatttattttctgtctacttgaataagtgttaatttagaaagtctgaggcccaaactcgacacaatttgctttgtctgcctcaatgactacccacagaagccttcattttacttttaaatttgatattcttaagctataagttttaatttttctgtatcaaaatcttctgggagttgatgtgtccttttgctctgcaaaaaacaatgttattttagaagaaattttgagtttacatagttcattacatcttatattgtatttggacttttccaaggatatcaattacgtatgtattatatctcttttgccatccgtatctatgatcttttctgtaataaatgtttttgattgtactctaattcatg

SEQ ID NO: 55290 - DNA, 1252 bp, Bovine  19866880997862
tcggacatgactgagtgacttcactttccttttcactttctgcattggagaaggaaattgcaacccactccagtgttcttgcctggagaatcccagggacgggggagcctggtgggctgccgtctgtggggtcacacagagtcagacaggactgaagtgacttagcagcagcagcagcagctgccatacttacatgagagttggcaccatgattctagtaaagaaagatttgacaccaaaatgcaaactaaaatactgtatacttgtaggtaataaattgacacattgcatcaaacatgtttaacctatcacgtgaggagatcgtttgaagataagcatgccttggctccagggattctggataaaaagctaaatcatggattccctattgccttcattcttcttaacacaccatcatagtaacattcatgaattaatatgaactttccaaaatgtatctctattttaaaatgtttcactttatttcccttaagtgtaatatatatttcattcaagttttaaagctatgggttaggaagagtgcctactacttttactgttctgggactgggtgaactagttacaattaatttcatccatataattataattttataacttacatcatatggccttaccaattaaatgctgggccagtagtttctcattttcatccttgagtaccttcctaatatttgggtggatgctagttcacctcccctagtaatatttctatagtttctttattagttagatccagaataccctgaatgctacctctggtggactggtataattttttttttttttttaatgagggtgaaaatcttacatagtaaagatgagagtcattcatttaattcatgcttattcttttattatccttgagcagtttgttgttttttgtttgtttaaattacggtttaatgtgttctatattttttgctttcatctaataaaaaggttgtttaaatgacctgcagttttagagaaaaataatcaagtaatccagaaaatcctctctgaagaaatgacattaatttggagataggcatggagaaaacaaagggaaaaataggaagaaagactttccagtcagggaaccctgtgggaagagaccatagtctgggaaaattcagccaagttaccgagaagaattctagtagtgagttaagccccatgacagaagacagaagaggcatgaaatgaaatgagatgaaataaaatctaaaaggtagatgtcatcacttgt

SEQ ID NO: 55291 - DNA, 1112 bp, Bovine  19866881039764
tttgctatgggaagacccttagattaggaaaggtgcttttcaaacaagacttttacatagaggttatttctccttgaatggtcagcattgtgtgggatttttctttctttggaagaatgtttaaaggtgcctatcatgtgacctctaccagttaggctgctttgcagctggccatcctgtgtaaatttatccagacaactgagttcagctttcatctaagtttcatggatgagaatcacagcacgctccccattctcgtgcatttggtattccagaggagtagggccaagtcctgtaccttgttaatggaagaagcaaactgcagaaagaccttggatgtgaatcatggcattctccctcagattgttaaagccatgtctcttgtttggcctccaatactgtttgggtgctatctgtcaggaggatttttgactggtgaatgaacagtcagatattttgcagtttattgctctatgtggacataaccatttgtcagagagccaaccaatagccatctcagacaatgctctctcttagaagattaagcagaattattgatatggacaattatggcagtggaaaaaatatattttgatttctagtagactttacctgaaataccacaacagtacttagaaccaaaaaaacaaaagttttaaagtgccctttaaatgttcagtactacagacacctcaagtaaagtatgcattccaacacttaataaagcttatatccaaccagtccattctgaaggagatcagccctgggatttctttgaaaggaatgatgctaaagctgaaactccagttctttggccacctcatatgaagagctgactcattggaaaagactgatgctgggagggattgggggcaggaggagaaggggacgacagaggatgagatggctggatggcatcactgactcgatggacatgagtctcagtgaactccgggagttggtgatggacagggaggcctggcgtgctgcgattcatggggtcgcaaagagttggacacgactgagccactgatctgatctgatctgatctattcacacttcagtaacattcactcaatgagtccaactctggaccccaaggattacacagt

SEQ ID NO: 55292 - DNA, 852 bp, Bovine  19866881132596
ggatttccaggcaagaataccggagtgggttgttatgtccttctccaggggatcttcttgacccacagatcgaacttgcatctccagtattgacagatggattctttaccactgacccactagggaagcctaattcttccccataatacctcaaatcttttccatctggtttgttctctctcttctcactctactgctcccacactgtcgatttgcctctccaaatttctatgcgcattattccctcagaggtgtgtgtaaagggagactgtcacatggggcctgtgtatcagcatctctcatactgctctttccccgcaggaagtgaataagtgctgatgaagcagcctgtaagaactgtaaattctatttcagtgtgaaaagaataatctctcgagacagcagagactagatgggccacatttttgcttttcttctgctgtgtggctgtcaggaaggtcatttgggctgctctagctttcagtggaaaggaatctaccttacatgccatcagacagttgtcattgacttcactatccttaagtcataattttcagtatcttctttttacaaaagccaggaatttttgtgtttaaccatttcctaccaaacaaagccagacagtcatttataaaacactgaagtctcttagaggggcaaaacatagttcagaaaaacataaatcttgaattaatatttaaagcatggcatacatttcaaaagatattaactcaccatagactccttggaacaccctttttagccgtgaaaaaaaaaagagtaaaaaaaaatactatacactgaatcaacatttcatgtactccattatgaacagaaagaactccacagtaa

SEQ ID NO: 55293 - DNA, 853 bp, Bovine  19866881149978
attcttactcatcttttctaacccatctcaggaaactgccttctcagaaagcctttccggctcccaagtttgagcaaattcatccccctgtgctctgtagtccttgctcagcctccctttgtacaccatcacttatttgcagctatctcttccaccagattggaagcttcagacatgtctttatttttgcattcaagttgacagcaagcagccatggcctggatccctaaaggtctgggaatgtggaattgggccagggagctgggttgggttgagtggaaacctcctggattgtagggagggcaaggtctggagctttcacatttgtcgcatggtaagttccgcatgaagggcccctagggtacctttgaagctgcagggctcggtggcttaaatagctgcagaagaagtcagcatctttatttcaagacctttctctctgacatttctctctgtaaatgccacttctactgagccacgtggagacataggtccagggagacttgacctattcagagcctggttatcaatcagagggacgttgagttgatactagttctctgctgggggtctttggacagcagcagacatcagttgaggtccactgctatcctgccgggtctcactctgcctgtttgctggcggtctccctcctcaggctctgtctgtgcacagagacaaactattaattaagccaggaccttctttcactccgttcctccctccagctcctcctccccagcaggcatgtgaactggccctttgcggctcagtgaggatgctggcaatagcgctgtgacagcttaaggtcggaggcagccagggagggggatgatgtgctttactgcaggga

SEQ ID NO: 55294 - DNA, 1585 bp, Bovine  19866881281817
aaacagttgcaagagtgttccctttctcccaccctctccagcatttattgtttgtagatttttttgatgatggccattctgactggtgtgaagtaatatcttattgtagttttgatttgtatttctctaataatgagctatgtcttcactttccagattcttgtacatctttacaaagatgttccagcataataaaacatatatatatatatacacacacacagtacacatatatatgtgatatatacccccttctaaaaacactcgtaaaatacccccttctaaaaacatttcatggacgatgcctgtattcttggaagggatttggaggtctggtttcacttcatgtttttggcttatcatcacacagaccccattgctcactgtgaccctggcacatgagccttcttccagtccttaggacattctccttatctcacagagactttgctcgtgttatcccctgtttggaatgctccttcttcctcccctgcctcacgttaatctccttctgacagagtccttgatgcatccttagtaaggacttatttactaaagcttcaacctccctctcttctctcctccaccggatcctagttcaatttgcttgctgcagtcagcatggctttcttttggttcttcacgggcaccgatcaccttgtcatcatcggcctcggtatcagccgtttctgatcccaggatgctcttcctcttggtgatatcatggccggcatcactcagatctgcatttgaacttggtcccagaggctctccctcgccaccttgcctaaagcaggtacccggatgctcttcctcttggtgatatcatggccggcgtcactcagatctgcatttgaacttggtcacagaggctctccctcgccaccttgcctacagcagctacctggatgctcttcctcttggtgatatcatggccggcatcactcagatctgcatttgaacttgatcccagaggctctccctcgccaccttgcctaaagcagctacccggatgctcttcctcttggtgatatcatggccggcgtcactcagatctgcatttgaacttgatcccagaggcttccctcgccacctcgcctaaagcagctacccgctctgtctctctcctatgactcttagttctctgtggatatttttcttgattgactgatttgattgatctctcccactccaccccaaatataagctctgagagaggagaaaattgtctatcattttcatcctgtattcctagtgcctggagctcaaggtacctgatgtctgttaagcgaataaaggcattatgtatttgtgagcacagaagtgcaggatgaaagtggtgcttaaggaggactacagatcaataaaattcagggcaatcaaggacagcttagatgtagagccatcagagaaaggaaactagaggagagcacattcatggtgtttctgccagttacagcccctctgccaattcaatcagaatctgtgagggtggggcccccatatcagtatattttacaagctccccaggagtttcttgtatcagcagggctgagaacaactgaattaggtgacatataactgt

SEQ ID NO: 55295 - DNA, 920 bp, Bovine  19866881286556
atatgggaacctagaaaataatacacaagaattgaaaaaagcacatgccttagccaagccagcttggctttgtccatgacttaaaacatagaaccaatatcctgaatctctctgtgtctcagtttcattccatgagaaatacaccacatggagttttcatttcatctgccaaaatgacaaataaaagtagagagctggggccttcctggtggctccgtggtaaagaatctgcctgtcaagcaggatacacctgtccaacccctgctgtgaaggatcccacatggtgcagagcaactgaacccacgcaccacaactactgagctgtgctctagaacccggggaacgaccatcactgaagcctgcagaccctagagcctgtgctctgcaaaaagcaaagccatcacaatgagaagtccaagcaccacacctcgagagtagcccccactagccatggctagagaaaagcccacacagcaacaaagacccagtacaaccatacgtaatttttttttttgaaaaaagtaagagaactgtcaactgacatatcacagatatgtcataaattccagtgatcccactcccttccaatggcaggctcatttgtttgatgttttgttagcatctttatcaggcatctattctgtctgttgaaacaaacagaaagctctgatatttggctgaactgatgacatttaaaagcccccatcctcacaaccataactgtcacgggctgtgcaggccacactgcacgtcagaaggcaaaaagaatttgattttcatcctccttaagtgagataaaatgtgaagagtgaacaagataaatacggtcatttcccttgtaagtcttgcttatttagatctcattttgaatgcatgggaaactaatctctgctatgttgagattttttttccctcacaca

SEQ ID NO: 55296 - DNA, 2460 bp, Bovine  19866881319583
tgtgtgagtagaagccggtaaacatgtacagaaactatctgtatactgtgaggctgactacgtttgggccctgaggattgcctccatccttaggtttgtgtcagtctgtgtcttgccccaggagccacatgctggtctctgacatagagagggtttaagatccctgtatgttgtctcagggaatcagtagagacttgtctgggacagaaggtgttaagacacttaggataacccttcttagctacaagagtgttgaactaattattttatgtacattttctcaatgagtccttatgttgtaagctatatatttggacagtgattaaaagaagcattttatgctctaaaaatttgcgagtgccagagccatttcctattacatggatactgcctttttttccttttggcagagatattaagttggagataagaaatattcctttatgaaaagacatttcttcagctgccataatattccatatttttgatgtctgagtcactctctcggatcccgaatctcttttgatttgggatgctgagtctcagtcctctttctcagagattagcttttttttttcttttttttctgaaaattaagttttccttctgaggcaggactgttttgcttataaaatgttttggagaataaatattcatccattatggaaatgaagcctgagaaagattacagagaccagaggggcctgtgaacataccccaagtgtcagcaaagctagaaatctctgtctgactgacttacaaggaatggctgttaaataagatcaagtgaggaactccattaaaaccgtttttaacaatgatcagtgttgtcctgctggtcatggtgtttgcactggcatctcacagtctagaccagtctttcagggctggaaaatagtctcttcctttctaaaaggaaatctttcgtttaaaattggcctcacgtgtagatggaaacaaaaatagtcttaatagtgcattgtctccaattacctgaagttatttatcagagctcagttgtatgacatgagcagtgcaaatttcaggtttcactcattctgagttgaagtgccctttagaattcaaatggtcttacagcaaatgcaaaaatcaaagcagattcacatatggtaatttaccagctaagccttcttactgcatatttcctgtttgctctcccctcaacccattctttctggcaaatgaggttccttggaatggaacctataatggtaatatattcaacatcattatcaatcatttgtattattgtaatcattgcagttgttgtttatttcaaagattagtactgccaggaggtcactgtaaataataaccagtccaagcggcatgtggaaatgctatgaatgtgaagtgtgcaagtttgaggcatttcttctacagactgggtcttagcattgtcagcttaaccataaagatacatctaaaaatcttaagatatctgaaggcagagtacaatttgcagtgggcctataaagacctggattcttatcccagctcagcaataaaatttgtatgttctgtgagtcatcatcttcttctgcaggaggatagatgttatatggaggccttaaatttggactgaagtaagtttgtatcttgctctacccttgatgtaaacttttcaaatactcaaaaaatttttttttcctccatgaaatgtagataatgatagcattattgggagacttgaatgagacacacctgcaaaaacatgtatcaccctccttgatatattgaatgttgttgttgcttagtcactatgttatgtctgactctttgtggcttcatggacttggtagcccaccaggatcctctgtccatgggattttccaggcaagaatactggagtgggtggccattcccttctccaggggatctacccaactcagaatcaaacctgcatctcttgcacaggcaggtggattctttactactgtgccatttgggaagcccataattcatagaaaaagcttaatcaatcttagcccttttaaattttgtgtaatttatttatttacttttgcctgtgctgggtctttgctgctgcatgggctttctcttgttgtggcgagtgggacctgctctccagttgccagatgcgagcttgtcattgcagtggcttctcttattgcagagcacagtctctagggcgtaaggcccggtagttatgactcacaggctctagagcgcaggctcagtagttgtagggcatgggcttaattgtgccgtggcaagtgaaatcttcctggactaaggatcaaacctgggcagcctgcactggcaggcagatacttaaccactgagccactaggggaagtccaggccttggttttattgaactgacagagaatgaataaatgatctggaatattctgagaagatctgatttacattcttactggaaagtgttttggatgtatggacctcatatctaat

SEQ ID NO: 55297 - DNA, 1255 bp, Bovine  19866881401479
cagcaccaatccccagtcattcaaatcaccagcttggctccttaacagcactgacttaaactactaatgaacaattgcaaactgtatcactgcattttgcaaacactcccataaactctttcatttcactcttgccataacaaattggcactatttagtcctaattctaaataataggttgtgttactaccattttatagctaaagagactggatttcagaatgaggacgtgacttagcaaggtcatagcaccatgacccttccttcaaccccaagtcctgtgccttactttccccctacaacagagaagatcatgtccccagataatgtcataaatcataaaatcacaaaaggacacgtgaatgtcccttgcaaaaagagactggtgggttcctctggctgtcactcatttgtacctaggctgtaatacttactttgttgggctcatcagacagaccaaacagaaaaattgaatcacaccgaagtaagcttgagcatgaccttttgaatcagttatacctattcagttctagatggactgcttggccagcaacaaagttggtcaagtgggtgtaagcaaactacaacacttgttctctcacttattctgaatatagtctaggagaccagaccagcatacttttcaacaattagagaaaaaatatattactgtgtatgataaaaatctcaagttgtgtggcgttccatggacaagagctattggagtccaggaaaagttgagacacttaagacaatgatttattctgtcacctctatttcctataaaagcatgactttgataaaaccagtgggagaagaaaaggaaccatcttggaaacaccaagaataatgcttcactgtgaatgaccttcctcgtttattgagcttcaaactcagccaaatgacaggttttcctgagggaaagataaagaataaccccatccccacagccatgcagcaagcacaaactaaaaaatgaacagataggctcagacagacgagagagagagagagagaatgctaccctaagtagggtggcagcctgcttgagcagaatgagaagaaaaaaaacaggccaagggttagcagcagcaacagtcgaacaaatgcaaagtccagaggtcatggtgacctgaaatcacggcctcaaatttggggatattcttctctgtcttcacttcccttgaagttagcaggcgtgtgaccaattcaaccaagagagtatggcagaaggcatgttgtgagactttcaagg

SEQ ID NO: 55298 - DNA, 1577 bp, Bovine  19866881467405
tagatgcatatttattaccccaaaaataaatttccccaaagatttaggcagtatgtgattataatactggaaagatgctataatctttttctgagtccttttctcaacataggtttcaggcaaatgttttatagttcatagttcaattttgcttgttctttttttctgattaaattggcacatataacaataacaactatgcattacttgtgtaatagaggaagacaaaatatatttgaatattggattccttatcacccataatattagcaaagtttagggtcagtttagactggtcaagttaatgagactgtgagatgaattttggaaaagcaatttgtatggcagatgtttaatagggcttttgcttagagctggaatgcccacagggaagggagaaggcattagtgctgtgttactcaatgtgtggtccctggaatagcaggatgggcattacccaagagctggctagaaattcaggatttctgaactcagccctgccaatcagattctgcatttaaaaaggtctctctgttaatgtgttcataaacgcgcgatagtttgataatcactattctagactagaacacagacatgacttgaatcaaatcattgattgagtttgaggaggcaggtggaggaaagacatggggaaaaaagagtgtgtaacaaatagaactagggaaatataaatacaggcaaaggagactcgtgttatatttctaacctagcctaggttatataacttctttgtttgacaggcttctgatatgtaaaaaggtcagcagtttctatacaggcgtaccttgttttatggcacttagctttattgtaccttgcagatattgcattttttttcacaaatggaaggtttgcagcaacattaatttgatcaatcctgtcagctccatttttttccaacatcatctgctcactttttgtctctgtgtaacattttggtaattctcacagtatttcatacttttttcattattatatttgttacagggatgtgtgatcagtgattgtcaaggttactatttaaaaaaaaaatttaactccctgaaggctaagatgatggttagcatttgtgggcaatagtgtttttaaattaaggtgcatattttgtttttcagatataaagctattatacacttactagagtacagtttagtatgaacacaacttttatatgcactgggaaatgaaaaaatttgtgtgactctttactgtgatattccctttattgctgtagtctggaattgaactcccaaatattaatatttccaaggtatgcctgtatcttatgaatattttgagcattaaatgttgaacatgcagcagtgtacgtgatgtgtaggagaaaaaggcttattaataccatttctttttccttactgtgaaagtgtagggacatatttggtggctttatagtcctaaagcaaggagaagatattaaaatacaactaagaagacatgttgcttcaggctacaattcttattttcaagttttattaagtgtctctagtattcagtctaatacaaagtcttgtagaactaagctttggcaagaaggg

SEQ ID NO: 55299 - DNA, 1025 bp, Bovine  19866882066092
tggtcatttttcaaaacttttttaaagaataaattagagaagagtttgtttctgaatcaaatagtataagtaaattatgacaaatccagtataaaaaatttttttccttaagaaagtatttactacttttaattgttagctgtagggctcaggaatcccatgtttcccagtaccagtttctaattattgtctttgtgacatggctttttgcagaaatatcctatgcttcttcatgagtcttgccaatggaaaggtagctatagaggaaccatccccagatcagacacaggtgaagaagcaaaaatagtagaatggtcttaattgcagtgggaataactagctcatctaaaacaggtacttaattctttacagtgtataaaagggtatatgcctttccctagatctctatctgcatacagctcacaatataagattcttcttgcatggctcactatagctttgtccatgattaaaccaggcactggataaatccactggtcctgacacaaagtgctcagcacctgcagacagacaagagtgagggtagattgtctctttctacatattttaaaccccttgtaagtagtcattctttagcccactttatcagtaattatcccagtagaaagcagatgacagagtcaaattagatacttaaagagtgtctaataaagagcctgtgagcagatgtgaaatggagttttagagaaaacaaaagaaatggtgcaatatcccagggctcatgagagcagagacctactgtcatttcctaaacctgaggaggttcccttttctcagtgatatgagctaataattctgaaattaatttccatgtatactagaattggacacttgggtttctaaaggttgaaggaagggattatatggagatgagaagactagaattccgagtgtttgcatgctcagtcgctcagtggcgtccaactctttgtgactcttggactgcagcctgtggactgcaggcccctaggctccccgtcctgacattttccaggcaagactac

SEQ ID NO: 55300 - DNA, 1572 bp, Bovine  19866880438290
tggttagacagatcattcaacctgggaaatacatgtactaggaggtgaatagtattgaagaatgcatttattatctacagttcatgctgacttagtggtaaatttatctcacagttggatacacaaaattaagttatttaatgggtttgtagttcagttgattgaggtctgcaggtctctgcactttggaagccattttattctttctataattgtcagtcactgtcatttccacttggttgctgttctgtgactagtcagaatataaggtaatggtatcacagcaatgataaggtggtgtttaaagttatctttacacatatgcacatgcatgtacataataaagaagtcccttcagattattttaagtcaatattttttttcatcatagatttgagatgtgtctgcttatactaaatatacaacttcacattgccttctatttaatgcccaaagttgaacatcccagatgcaaaaaaatcataatagagactaatttcaatggtatcagaatttcaatgtagaaatcaaaagattgcaacagtgaagctaactctagcaagcaaatctgtttgctacttttatgtattgagtcatcttaaagttgttatggtcatttaaaaaaaaaatcacatttactttccattcttcaaaaatgcacctgcattttttttttttttttgacaaaccacatcattcgggaaagagatcaaatctaaggaaaacaaatttgactcaaaatgatttagtgttaatagttcagtgctgttaggagtttgcaagaatgcaaggatttgttcttcatttttcagtgccagcagttttgtgattcaaaaatcacaaacacagcattttttttttttgcactgactctatgaggacattagcaagtttcaaataaatagcagtactacattccaaaggagttctgaaaagcaagcggaattccagatggaactctcaagctggacactgaaatgacattttaacaaacaccgtggaagtgaagtgagaaaacttaccaactatcagttacgctcaagagcatcttctgtgggaaaagcctgagttaaaaatgaatatatattcatatttatgataagtattcatgtatatttacatataaaaccatatatatatgaatagaacaatgcttcttttaatgttttttgagttctttttttctcattttaatataaatgtatttattttaattggaagctaattactttacaatattgtattggttttgccatatatcaaaatgaatccaccatgggtgtcaccgtgttccccaccctgaacccctctcccacctccctccccataccatccctctggatcatcccagtgcaccagccccaagcttcctgtatcatgtatcaaacctggattggcggttcattttatatatgatattatatatgtttcaatgccattctcccaaatcatccgaccctcaccctctcccacagagtccaaaagactgttctatacatctgtgtctcttttgctgtctcgtatacagggttattggtaccatctttctaaattccatatatatgtgttagt

SEQ ID NO: 55301 - DNA, 2407 bp, Bovine  19866880521733
tatgtacctaagaggaaggaaagcccccccccatatgaagagctgtacataaacattgaaagcagcattatgcagtttagctaaaatatgggaaaagactaaatgtatatcgactgacaaatatatgtgtgtgtgtatgtgtgtgtgtgtgtgtggtttatacatccaatagcatatttgtctataaaatgccaataatgtataattctattaatataaaaataatgtatacttctattaatataatccaaaatagataaatctataaagatagaaatagcccctggatctgggggagtatggggtgaataggagtggctgctaatggatatagggtttctttctatagtgatggacatgttttcaattgtgtggttggctgcacaactttgtgcatatactaaaaaattaagttggatgtattttatggcatatcatgtaattctcactaaatctgctaaacaatttaattgaatttgttacattgatttttaacaatcgaatcatttttatcaatttccctatggaatgctcatccattagattcaatttcttatcactttacatgtttacatatcatctcagtttcattgttacaatcagattgaacatgaaataactctactggaaagcacttagatgaatcctacaaagaatactggaaaattgtaaaagtttataggttataacagttatacttacattgtatgaacattcctcttttaaaaattcattataaagcacaccaaaaattacccacggggcaaatttaacaaatgtttcccttttgagagaaataatttttctgtctctttatgagggaaatacagttggataaaagcctttattaatcatactagtttatgctattgtaatttttgtctcatagttttccatttatacatttgtgttttcatacagcaaacatgtgctgcaaagtataacctgaacttttaaaaagagagcatggtcttcccaggtggctcagtggtaaagaatatcctgccaatgcaggagacttgagtttgatccattggtcagaaagatcccctgaagaaggaaatggcagtccactccagtattcttgcctgggaaatcccacggacagaggagcttggtgggctacagtccatggtgtaacaaaaaagttggatgtggtttagcaactaaacagcaacaacaggattgaaatacaacctctggcacttccaagattttgcaagttatacaaccagtaaatctcagtactcttatttgttaaatgggtaaaacactgcatacactgaggtatgatggtgaggatgaaattacatggctagtgtttagtaaataagtctatgccagatatttggcatttttattaagtctgaactttgtgagtgggtctgattgtgtatagtgagtttatatatgtttagtgagtttatatgtgtatataaagtacctatatataaacatatttattgtactttcaattttatatctcaaatcttgagatacatactacctaaaattttactatggatttagatactattctgaattctgtttaattcttaaagtttaaatataaaagagtactgttatagtttttcttggttttgtttctttagcttttattacttattaaggtaaagtaaaagtatacctgttagaatttatcataaccctatgcttcatcaaataatcctatgtttctttacttttatcatcacaatttaattgaagataaaatagtttatgtatatttaaaatcattaattatctgatgccagcagtgattttaaagttaaaaaaattcatttggtttattgatagcaattcataatattttattttagtcatcatagttgataactaaaacattgataattttaacacaaaaattaatcatcacagattaaaaatgatttcaccttgacttctctaaaatgatttatattagttcaaagtaaatcttttgagaagtaagtgaagcaaatccacttcccaagagacagtacatcacacagtattggagcaaacaaacacacagaagtgacagagtatttacacctgcctcgggggaatgggaacttgtgaattttgtgacaaaatctttaagggaaatttgatctttctgacagttccaccaagttatcataccaaaaacagagagaattttaccactttcaggaagtcaaggaaacattattaggagataaaaaagcatgatatttgatacaatgtttctttgtttctaggattttaaagacattccattttggcagtattattccataataataatttaatatatcacttatgccattaggttactctctacgtcttttgatggagttataaaagaaaaaagagagaaggaatgaggagtaattaagagagagtaggaatactcattcacaat

SEQ ID NO: 55302 - DNA, 1556 bp, Bovine  19866880606201
tagaatggataaactgcacaccccaaaggttatatctgaaaggctgtattttcagccaagcaccaaggtattgctgcttataattcctgataggtacttggagtgcagctaaactcccttgcaggtcacattaaaggccatgtgatatttcttgtaactctctagccacctatgttccctttcattcttcttcataaaccctcttcctttgcctcagctctcaaaatttaaagtagtcctgggatttcatgctgcccatttctcttttcaaacatatgtgtgccatatacgaacaatataatccattttcatattttcagttttttatgctttgatgattcccaaatgtttacctcatgttctcattttcctcttgagctccagaccccaaactttcatttactgactggacacctgcctttgtacctctcagggttattttaaactccacacagctctaccattctgcagaagtctggttctgtggtttgcccacacataatcaatctctaaacttgtgtcattattttaaaacttactaaggttatacttttatactgaacagaattcttatagtacaccctcactgttttactgtgaaatcaaaatcattgattataagacaccatgtaaaacataggtctactttggctcctcacggaaacagtggctactagtctaattagttttgtttttgtgtggtttcagtttgattttattttgtttttaaaattggtttgagaagttataggacttctggtgatcctatagtctggtgcagatttgttttctcctctttcccaaataagttctttctgcactttcttctaatctctaatcaaaaataagtttatattttctaccaggcttttatactgagggcaactattttgatttaaaccagctttatgaaggttgaagttttgccagttattaagaactggttttacttatacccacgccctaatcagagtcatcgacctcttgacttagtctcctttgcaggccccaaattttggaatggacatcctgagcacactaatttgaattgtagagactatggaaataacgggcttccttggtggctcagacagtaaagaatctgcctgcaatgtgggagacccaggttcaatcactgggtcaggaagatcccctgcagatacccactccagtattcttgcctggagaattccatgaacagaggagcctggtgggctatagtccatggggtctaaaatagtcacatgcaactaatacacacacacacgaaaataaacgattcttcccttggtgtcaaaaccaggttatgtttctgcatcctttcctcttatctccttaattgaggccaatttttcttaaccttggatattcatcaacatctcttgagccttctgttactcacatgcaggcagatgcgaagggctaatatatacagctggggacaactgcttcttggaaacatatttgacctcttctcttagatatttctaatatttgctcaaaaaatcactttcacactgaggacaaaccacttcaccacattcagttcaattcct

SEQ ID NO: 55303 - DNA, 1172 bp, Bovine  19866880795732
ttctttttttaattattaaatctatttttttgcatttttcccccagaattttcagttatttgccgaaagagttgccattgaaaatgtcatttggtttttaaattgaagctcccaatatgtatatgtgtgcatttctgagtactattgtaagggatattttgatcaatattattaggtataaatgaaagcagtggacatttggcagggctgttactgcaatgttgcactttgggcagaaggttgcagtattagatcatactgaacatctccagagatcatatttatctccactgaattagcaactagccaaacattttaatattcttacttagtttaattatctcatatttgcttttttcccctttaaatcagaaattcttttgtcactgataaattctgacacacacaaaaaaacaatgagagcaataacttaggcagttcattgcagaggaaaacaactacaaaatcatttgttctaaatatgtattattcctataccaggattggtaaagttcttcatgctcagtggtacaattaaatatttcacatgtattattgtgaaatataaattacagaaagatcaattacgtgaaaggttagtggatccataagaatggatgataaacaagcactttgcacagtgggatgtggcatttattaattaatataatcacttctaaatcacactcatacttctttaaagggaaaacagttttaagtagaaatttcacattttggcattgaagctgtcagaataattttattatgctacaccaaagttttgtaaaaaatatgaaagaatggtaatgatgtcatatttatatagcactttcctcaacattaaagaaaaatcttgccctttttgcctcaatagacatgtgatcctcacaatttcaaaaattcagtgaattacagacttggaattcaggtctatttattttttcattttttttcagtatatttctttttaaaatgcaaactggtaaagttttgctagtctataaaaaatgtctaatatttatacagggcattcttatatcttatgtaaaagaaattttaggtgacttgatactgtataaactcctctaagtggaggtaaactaatttaggtagaaggcataataaaatctgtgctaaatgcattatcaggaaatctagtgttgtgtgtgtgt

SEQ ID NO: 55304 - DNA, 795 bp, Bovine  19866880828750
tcccgcctgaataagggctcaccttttgatggttgccattttctgcttttcgttctaataactgacttgacatttgtggtgctccaatgtgtctttcttaatgtgaaggaatcatctgtgcattaatgaactggcttgatatatctggcaaacctttcaaagaagcaattaagtctgtgtaagaacttgcaagaatgacacgatttattgtaatttaagaagaagaagtataaacaaaaagtaattaatttctaaaggtggcaatcaagcaatacagcatcagaacaccatcttgtgaaaaccatctatatagcacataataacaacatgctattatgtaaattttgcatcaactttcaaacattacttttggtaaaatgttcaactttattactgttcaaaacaattttaattaaaataatggggtatggtgtttatccatcacactagaaacttaaattagacacagaaagaacatgaatatgcagggttatgaaaggcatagtgaggtgaatactacttgacattgctaatgacagggtgagctgcaatcatgtttgctgataaattttcaatatgtgtgagaagcctaagaattccatatactatagttcctaaactactcttagtaaacatccataaatatagctttgatatttattaagtatatttttaaaatctaccatgaaagcaaaaatctgaaatatctaacaacacaggaatggtaaattaaactatattaatgtgctttgtattcagtcgctcagtcaagtccaactctttgcgaccccaatg

SEQ ID NO: 55305 - DNA, 1323 bp, Bovine  19866881034936
aaatataattatttgtactcattacatttctttgatttcttattttgtgatgtttaatacatgtgctattataatgagagatcatcaaatgtattagaatactgaaaattcaagttgatttattttaggccatgaaaactcaggcagaaattgcaaccactattattatgaagtacagaaattgatctgggatagtacagggagttgaaatcattatcacagtgctaacagactaacagcgataaggaaataaattgtggtggacgttttattaaaaatagattgtacttttgcattttagtagaaggcttatgttaataaagttgttttagttagaaaacttaaaaagaatttattcaaagagtaataaaatcagtagcggccaaggttattcttggctgaaaaatgtttatatcttaaattttaagtttttagtttaaaagttacatatagagggatagatggagatacacatatcagcagcaatatgattatagatatagatataggaagctacattaaaacatgtaatttataacaatctctagatttagaaaatgaattgatgatagaatgtgcaattgatttctttaaaacaaaaagtgtaagcaaatacaatatatgattacagccttctcatggtgaaggggcttgtgtaattcaatgaagttatgagacatgccatgcttggccacccaagatagatgtttcatagtgaaaagttctgactaaactgggtccactggcagaggaaatggcaaaccattccagtattattgctgcaagaataccatgaacagtatgaaaaagcaaaagatatgacagaagagcctggtgtgctacagtccatggggttgcagagagttggacatgacttagtgactgaacaagtacaacctattcaaggagtgagatttgctctctgttacattacttctgcttttaactatcccaagactgtttactgcacaaatattacgggcaaggtgatatttttttgttgttgcccttgcacaagcttttgaaagattgaagaataaagtgtaagtaagacagaggcaatgaaattcagctaactataccagcacaagcagctggaaataagaaaagcaatactaaaggcaggaagaatcagtgattgatatccttgttggaaagatggatgtgatcaggctgagagattccatctaaaatcgaatttcctgctactcaagcagcttaatttcatttattttttaaacaatatgaccttgcagaaggtgtttcaaaatattattttatctttttaagtttataattaaaatatgaaggatttttttcctg

SEQ ID NO: 55306 - DNA, 1874 bp, Bovine  19866881182412
aatgtataagtcaaattttagatattgatccagaaaatcatgtgcgttatatgtatgtagttacatttgtcatttaatttgaactaaaacattcacttatgtattctgaattacactaagtgtcttgtacatattttagttcaaaaaccaaggcaaagcttggactgaatatgtacaaagaaattaatacatgtgtattattggatatttattaaaattaaaaatagcaatatatgtgaaacaattatgtttgagtagttttcatgtttaactatataacatcggcttgagttactgattagactattctttttaagaaaatctttcaatatttatatgtctcacataggccaagttagcttcctagagcataaaacgtacagaatgctctcaatatatatttatgtctatacaatagacatgcaagatacatttttttttcttgctaatatcagtaaagtgttattgagcaaaaaaatttgaaagattatgaaaggtatcacatagggggctacatttgagctaagccttgaaagagatgacataaaccctgcaactatccagaactcaagtttctaagcagagtaaacaaccacagcaaaaagcttcagttgagcaatgcctgaagtctttgcagaaagtaaggagactggaaaaaacaaaagataataactaaagatgaaaccagagttaaagtgctgccagactgcttcttgtagggtgttggttagtttgaatttaggttgccttttatcactacaattaagggagtgagatgcaaagccactggagaactttgaacataagagtcaaaggatgtgacttcagaatttaaaagatcgctctgactgtaatgctgagaaagccctgtggggcaacatgactgattatatttctagtataatgatctgggggataagggtgcttgaattaggattctattggtataggtgtaggatgttgtcaaaatttagatatttttgaaggtaaatgtgagttgagagagaaaaggaggaatcagaaataattccacaagtttatgacctgagccactgcaataatggaattgctgtgtaccaggcatgtgaatacagaagaaggcaatggcaccccactccagtactcttgcctgaaaaatcccatggatggaggagcctggtgggctgcagtccatgaggtcactaagagtcgaacacgactgagcaacttcactttgacttttcactttcatgcattggagaaggaaatggcaacccactccagtattcttgcctggagaatcccaggaacaggggagcctggtgggctgccctctgtgaggtcacacagagtcagacatgactgaagcgacttagcagcagcagcagcagcaggcatgtgaatactgaggaattagtaatttcagagaagaaatgacataagttccattgtgagcatgtggatggaatccaggtttcctgaattgcaggtggattcttcaccatctgagccaccagggaagtcccataaataaggtaggtaatatatatttgactgatatactaagaaaagatccctagtttttcccattctattgctttcctcttttttttttttttttctcattgttaattgaagaaggccttcttatctctcagccaactcatcagaaaatattctgaggctgggaaagattgaaggctaaaggagaagagggcagcagaagatgagatagttggatagcatcaccgattcaatgggcatgtacttgggaaaattctgggagatagtgagggacagggaggcctggcttgctgcagtccatggggttgcaaagagtcggacataacttagcaactaacaaggacaacagcaaaagaattggggggcattcc

SEQ ID NO: 55307 - DNA, 770 bp, Bovine  19866881320166
ttgtgggaaaagtctgtgttatcaaagtcagtaatataatattttgttaatataatttgcctaaaatacagatatttatgatatgccttgaaaacttctctgagctaaattcaaaactagatgggaaaaatttttttttccaacaagaaaagctgtattacaatgtagcttattctttcaaagttaatagtgtaaagtccaatattcatttgagtctgtaagcttgatatggttataaaaataatccgtcatattataatcatatctaatacatttcactaattgtgtctttaaggcttaatagagttatttcttttccccccaaaagcattcaacttagacaacattaatgagatcagacttaatttgtaatagattcagtgaaatgaaaaattaggttagcttgatataatacagttggccaaaaggccaaactaaatccttttttaggcaaattcactgtctctatcctggcctcttgagacatgatacacttgtagtttgtttcaacaattgagtttttaattattatagttttgcaggcatctctgatgacattaactagttatgaccttggaccagctgtctcacttctctgtgcctcagtttcttgttttgtacaatggaaataatatttacttttgcattacttttgagaggattaaaataagtgatgccatcatgttgtttagcaaagtacctcctgtgacaaacacttaaataatattgacatatcattatgatcagttttatatttaattatttgctta

SEQ ID NO: 55308 - DNA, 1405 bp, Bovine  19866881347890
gctgtggtttttccagtggtcatgtatggatgtgagagttggactgtgaagaaagccgagtgccaaagaattgatgcttttgaactgtgatgttggagaagactcttaagagtcccttagactgctaggaaatccaaccagtccatcctaaaggagatgagtcctgagtgttcattggaaggactgatgttgaagctgaaactacaatactttgaccacctgatgcgaagaactgactccttggaaaatgccctgattctgggaaagatcaagggcaggaagagaaggggacaacagaggatgagatggttagatggcatcatcaacccgatggacatgcgtttgggtggactctgggagttggtgatggacagggagggctggcgtgctgcggttcatggggtcgcaaagagtcggacacgactgagcaactaaactgaactgaactgaatgaacactgcccaaacaggaaataatgtaaaattgaaaattaataagtgactttcacatactcgggaaatcacatacatatatactccattattttgctcatatcactccccaaagcagccatgttaaacatattcaatctctcttcccaagaaatatatttgtatttactcagatgacactattattaaggtattttcagcacagcttcaaaattatgagagtgaaatttatgtacatactgtaatttcattcttagccaatgatttatactaaattaacaaagtacagtaagttaaatgagtaagtctaattctatacaataattactttaagactcaaaatgctgaccccagttaaatattgccttacattataattatatatttcagaatattaaggacatgaattgaagctaaaacaaatttatttctacataaaacataaaattattttcattgcattgtcttatagaggtaagtgaaattatgtcatagtggcaaaattgacttataaaaaaaaaaaaaggatactcctggccatatgatatgaactattcattcccagtatattttttgtatgatttgactatctaaaatattagttcttattcatctttctatttaactactaaatagtcataatcaaatattaactgaacttgtggcaatgttaatacaccctactcaagacagagctatctacataacagtaaaatttatctctaaaaaggttctctttgaaaagtcaaatttacaaaaataaaggcagcccctatggttattcacaatacctaagaaaatatttttaaatgcctggtatatttgtgtgaaaatgtgagatgaagctatcacaccacaagatggcagattaaggccactaaaccgatgtttcttgcaaacgaaagggtttattttctcttttatttacatggtgaaatttttacaggattttt

SEQ ID NO: 55309 - DNA, 2121 bp, Bovine  19866880516054
ttatgatgttagctctggacttacttttatagatgcccttatcatgttaagtatagtcccttctatttctagtttgttgagtgtttttcttatgaaagcgtattgaattttgtcaaatactttttcttggtctattaatatgatctttttttttttttggttttggttttgttctgtattaacatggtatattacagtgagtttattaaaccaaacttgttttcctggaatccctcttgttcatggtatataatgcttccatattttgctgcattttgtttccttgaggattttggtatcactattcatgagtatattgatctgtagtttttgctccttgtctttgtcttgttttggagtcagtgttgtactgatctcatacaatgagttgggaagtgttctttaccttcctagtgtttagaagagttttttaagcattggcaacttttctttaagactaatggtaaattaaaaaaaagactaatggtattttaatttttgtttttatcttttaggattctccttttacaaatgcaggaatggggtccaatctaaatctcttgggtgaaattgaatgtgacgccagtataatggatggaaaatccttaaattttggagctgttggggcactgagtggtatgtaaacattaaagcacattatctctactcttaaaaaaacctgaatattaccatttcattcctcctaaagaacagcccagttgttttcatcattcttgcttgtattaatgttgaaaacaaacatttttttcttttattgaatttaaaacataatatcttacctatagatagttttaaagaaaacagtgaaacagcatatgtccaagtctttgcttagagtgtggtcattctccttcatccccgcaagagattacagacatttaaaattggaattggcatattccattaattttgcaattatttgaatatactaataatatatttttattgttaaaaaattcaaatgatataaataaaatttacctttgatcttccaaatctttccttccaaaactctccctggagggtttaaccagtaaaataaaattcatttatctgtatttatatgtaatagaaatacagttttgcacatattttaaaaaaataaatgtattttgaaactttaatggtaaattaaaaataatgatatcagttattatgaaactttcttgttttctttaaataggatgtcttagagattttttaaacatcactacatataaaatatacataacgtatggtagttcacttattgaagtgaaatatacatgaagggcacagattttaaatataaagcttcatgaattcctacatgtatatagccttgtaaaccaacacccaaaatcgagacgtaaaagatttccgtgtcaaaatagaaaacctttccaaactcccagacaagttctttatgcctctccttagtttatatcactggtattcccatccccctgctcctcctcctccccagattctgactttaggcactatagattaacttgcccttggctcaaattcatatgaatggaatcatatccctctgtgtctggtttcttttgcttactgttacacctgtgagaatgacgtatgatttgtatcacaatagtttttaaaattttgtggtagcagcattttgttgcgtgagtatataataacttatttgctctcctcagtggatatttgaataatttctagtttttgactcttatgaataataataaaaaaaccgcagtgcatatttttgtacaagttttttggtagacatatgcacttccttcctttgagtataaacctaggatttagaatggtaagtttagatacatatgtgtttggctgcagttgaaactgcccagttttcgaaagtagttgttacttttatactcccacgatttatgagcatttcagttacttgacatctttggcaatgtttggtattgtcactctttttaaaatgtagccatttgatatgtgtgtagtggtattactgttttaatatgagtttccctgatgactaatgagattgagaacattttcatatgtcatggccattgagatatccttgtgtactgtgtttttgttttttgtgtactttttatggatttttaa

SEQ ID NO: 55310 - DNA, 1804 bp, Bovine  19866880570131
taactatgggaagagaatctgtattccgatttgaaagaattctaggcaactgaattgctggggggagaatcagtaggttcatatatcagggaagatttggttcctaataataggaaaaccatttttgccaagagagttggttgcgatggaatgcatcgccttcgagatggcgagtatctcaggacaggtattcaagcagagtgagtgaagatgaatcacgtgagaggctcattttagtgatgaggagagacacaaacatacagcaatcaccccctctgataagtgttctgtaaaggataagtagaaagtcctctgggaaaacagaggcaggaaacggggcggtacctgctggatccaagggaggaatgttagaagagggagagcaggtggatgccttcagaataaggagacacggtgggcagacgcaaggaaccaggcaagagcgtgtgatttctgagaactgggatgtctagagtgacaagccagagggataagaatggcaggttatggagccatgtctaaggtgtttttgttaaggatttagcatgggcttcctacatgggctggtggctcagctggtaaagaatccgcccacaatgcaggagacctgggttcgatccctgggttgggaagataccctggagaagggaaaggctacccactccagtattctggcctggagaatcccctggacagaggctccatggggtcacaaaaagtcagacacgactgagcaactaacactttcacttcacttagcatggaaaatgaaagctctttcctactatagtccgaatagctgatatgagcaacatttccaatgggctccttgcctcttaatatcagaccttactgacaaaatgaactgagagttagaagatgaggtgaattgggagctggggagggttcctgggcccttcacctgctgggaacaccactagcttcccacccatcatccagacactgccatcctgtctggaaatttgctgaactataatttgcctctatccagatgtccctcattcactaagggccccaagccagccccagggtaaccttgggtaatcccttcatggaaagcagatcatgtgctcaagggccaactttgcccaccgcagggtagtctgtctgctccctcgcctgtagcaccagtgactgcaaacccctctcattgaaagccttgctccttggctgatccttggaaagagagccctttctccagcaacccactggggctctggggggccgtggctgagcaagccaacagccgtggacagaggagccaaggccctctggtggccgtgtgtgggaaggatgaagacgaggcccccgaggagctgggcagcttcctggccccattcaagcatccaccatgattagtctccaagtctttccaactttgtagctcagtggccaaggagtagatttccccaccctgagaccagggaccacagatccaagaataggtaccagaccagccacccttccagaagacacactttgttcctctgtgctgatcactctaccgcggagtcaagcaggttacatccgttttacagacaaggcacaaaaagcccaagaaggtcctctaacctgcccaagctcatgaggctgtgtacatggcaaagctggctgcagcccattctgtctgatcactaagtccatgttcttaaccgtatcccctactcaactctttttctaattcttcccaccacttaggattaggggctttgctccagctcactctgcctttgatcaggttgttcaaatctgccaaatgtccctccaccaaccttcaggatgt

SEQ ID NO: 55311 - DNA, 811 bp, Bovine  19866880716403
gagactgtgagattataaatgggtgttgtttgaaacctctgaagtttgagacttctctggcagttcagtggttaagactctgtactcccagtgcagggggcaaagcttcaatccctggttggggaaataagatctcacatgctgtgcagcccggccaaaagataaaaacaggaagccctgaaacttgtggtcatctattatgcagaaatagagaactaatacattttctctagcccagagcacagccacaaatccacctgcttaatcctccccagctgtggctggtggggtaactggttttctccccaacttctccagacaagagtggggctagggtacggcccccagtgtattggcgatttttggtgttcagttgaaaatgaacctgtgacaggaaaaacaaagatcaatgtgtaacagcaactccccttcaccctcaaagatcctacacctggaatcatgttcttctccagttggactgaaccgacagaattccatgtgtgttacatcacaatgccccatctccccatccacacaagaggaaacaaaagtgaagaggaaacttctgcaggactcctggtgtaaaaggatatcttgtttgtaggatgggaggaaggaagtggctacactatccttttgccccagtgccatggaaaagacaaacagattctctttacacttgtgccggggaaatcgtttacggcctcaaagcaagtgcagaatttactggtctgccataaacttctacccttggctaactcaaggggaaggaaatgaagggacagaacattatggaccagtttttgagcca

SEQ ID NO: 55312 - DNA, 1435 bp, Bovine  19866880735823
aatcaacatagagaaacttgttttaaaaacataatgaaagactccttgggttcctctggccatcacacggctcttgcaacaacccctggatgagttatgtgcaaatgaatcagaaacatgcgctccaagtaatcagcgcaagatgtactgggcagatgctcttctagctttgccctaactcgacatctgagaggcttgctgagatgctttgccaaattgcaccgggtcatgccaatccctgagacaaacagacccttccttttgtctcaggaatggaaaagtttgaattctactctcttcgacgttcaaaggaggttgccccgctcatggtggccttgtgtggtccagacacgaggtccagggtgtgctcttctaccccagtacacttgggccgtggcaggccgagagcatctcctctggtgtgggatgcctacgagggcaccattggcttgattccatgctaccaccatcaccccagtcttgtaagcatcccttgcatatttataaataattatggaacttttagtaatcccccaaaaggacaaaaagaagaattacatcattcatcttgtatcactgttgtttgctggagggatggctgttggagagggacagtgcccaggacccacatgcaaccctacaaggatgtagtggaaggcatgcacagctgggttgcagggacctgagccagcagagataccataatgcccagcctttgaagacacaacctttctcctatgcagtcccagcccccatgcctgcagacagaacaactgagccgcaacaattgtctgcaaggctattaagggtcttggaggcgcgaggctgccaaaagccaggcaagcctgcaattatggtaataagatcagtctctgggtaggagataagggggaacaggctggacagttttggtattccgtttgtatccaggctggagtcaaagggattgcctaaacaaaacgtgccctgcaatttctccaagctgggaatcaaaacaattccatgttttaagctattaccgtcaatatgattctttttccccccaaactgctgcttggatccaaacaaaacagatttgttgcctggccaggcaatgagtagcaaaatacaaatttactccaaaaactattatcgatgactaaatctcatcagcttagaggtttctttttcccctttcatttctagccactgctccaactgaattaaaaataacacaaacaaacaaacaaaaaaaaaaacccacacaaaaccaaaaccatgcaaaccttaggatccacccttccctgcagttaggaatgtggaaacctcggactgatatcaaaagaacaaatctaatcttgaacgtgaaatttcataggcatccaattaaaaagacttaatgagcatgattggacttctcgaaggaaggaggtagagggagatcagttttagcttc

SEQ ID NO: 55313 - DNA, 1440 bp, Bovine  19866880746164
ctgccagttatattatgacacatggctttgtcatcacttaacacatggctattactttgcaagtattgcattgggggtgttctcccaacaagaaatatttgcttccttgatagcaaggttgtgcttctttgccatttccatgcattcctatgtatgtaatcactttttgtttgaattctgtatcagattgtagtccttttgaagacattgaaaatggcagttaaactcaacacatggagttccaacatggaacgcaactcagcagaagggtcagcaggggttagcagatgggagcagctgacctccagaggcagagctggctgtgtcccagctgctgcctgcagcagagccatgggaagatgctgtcaactgcagtgtgcctcctgatttctgaaaatttaaaatgtgaaaaaagagcatgcccttcttttattctcagcgttttttgtgaaaataaacagtttgaagctttctttaagcagtggtgtaagctcctgagaacaggggctctgtgagtatatttgtgtttcctgagtgcctggcatagggctttgcacttagtaaatgcttcatagacagaattaaaaaatgtgtgtgtatgggcaacaatattataatcatcagccttgttaagagactggaacacaattattccagccattaaaaagaaaggatagttatgtaatgtggtggaggttctaattattgcatgatggcaatcatattacaggaaataaatatatgaaattaacatgttgtataccttaaatgtatacaatgttacatgtcaagtatatttcactgaaaaagagagaaatgtgtacgtgattcttccctctcataggattctaaggttatccaccatgaaatttccttaaacagcattttaaaatttgatttaatttgccagaatcggattcacacataatttttcagtaacacatcagatgtgtaatataagatacatctgtggtctttctctggctatggaagggaagagcagatcgaggattagaagatcagaaggagggaaaaagcaagagattaagtttatgctctggctgaccttaacattcgtcttctgttacttgtctgtgccgtctggtttttttcttaaagagaaatagcaagtccgggggttttgtggcagctgactagtgatcaggagacagcggctgcagtctcccttttctggtgttctgtcatgaagaacagtctgctaccctagaggaaacctggtgatttctgactttctgggttctttgattttcctggtcttagctgtttcagaaatcagagggtggtgagggtgtgcccctggcttcttaagagtaggttcaaagatggatgggataaaaaaatgcgaagaatgagaccaggctgctgctttgatattaatatttctgagccagtgattggagtctcctctgcaagggtggg

SEQ ID NO: 55314 - DNA, 1576 bp, Bovine  19866880777228
cgcttgatgcggtcgaagatgtcgctgtgctgtaggcccctcggtggggtaggagcaggggcagctaggcaggtcgttgatcaccttatgcatgtatttctttaggaactcgctcttgcaactcatccagcgctcacagctgtccgtgtctgaaaaaggccacagagaaacttctcatcacgtgcaaaactgggagcaggatgacttttaaagtcaacctctccattctgagtggcagcccctggtgtggtgaacacactcactgtctttgaacttgggaatttctttgtccacaaggttctctgcaccaccaattccttagtttatattatgaaaaaactttccgatacacaggagagaaaatatacttatatgactgcctagatgccatcacctagactcaatcatcattatattaccctccttaaaattttcttttggaaatatataacattattattcccaaaccagtcaatgctaaaggaaatcaaccctggaaggttgatttcaattcactggaaggactgatgctgaagctccaatactttggctacctggtacaaagagccaactcattggaaaagcccctgatgccgggaaagattgagggcaggaggagaagggggtggcagaggatgagatggtgagacaaaatcactgactcaatggaaattctaggagatggtagaggacagaggagcctggcctgctgtagaccatggggtcgcaagagctggacatggtttagtgactgaaaaacaagttttagtaggcatctacaaaaaaaaaaaaaaaaaaaaaaaaaccaaggtgtattttctatggtttcctgaataaccataagcccattatctattactcataaccaaatgaacaataattcagagatccattttgaatcttccctttaaataagcaacgagtgatagaaagtacctcaaagtaatacttgtaagactaagttttattctaccactcactgtcttgtttaaactaggcctaacctcttaaccttgggcaggaaacagtaataatcattatatgcaaatctccatgaaagatgccttaaagaagaggctggtggaccctggtttcagagaatttaacatttggcccaaggccactgacctgtaggcttatagccagaacttgtcatcagaggtgtatcgtgattggccgttacagtatttaaaaataatgaattaattgccaatatttaagaattagttgattctatttactcatgtagattccctgttccatttggaaaaacaaaagatatgccgatgctgggcctacattgttcccatgggaacaagtggtcctgtgaacaggggacaagtgaccacttcttggtcaaggcaggaggtcgccggcttgtcaccttccctgcctgatcctgtccctgtgggtgttcactctgggtccttcagtcgtcagagtctagggcttctgggttggtgaagtctgtgttttcccaaacgctgagacaaagatgcagtggagacagttctttgggaggtgattctgggaaacaccagcagggaaggaggcaggacagggaaggaggggggca

SEQ ID NO: 55315 - DNA, 1141 bp, Bovine  19866880953451
tccgtacaggagagagccaattctgtgcgcaaaagataagtagactttgacttggtctggacaaagtctttgagtctttagaaaggcaatctaaaaataatagtagtgagtcaagtgtgaactttcccattcctcctaatggggttgtcaactgtgaagtttaattatatcactggtagccatttgatggcagttataggactcagaggccagcaattagtggtgacttctagcccaaccaagtacctccagcttcttgattgttgtaatgattgttggccaagcagaaggtcagttaaagtctttttgatcccggtcagtcgccttagttactgagtcattagcttcctaataactggcaaatcctctgctcaactaggtctgtcttgggtgtgttggtcattcttaccagatgagccaaatgtattgtatttctgattgtgatttcataaagaaaaccatgaaatagaattaagaaatggccagtgagcaagttctgcttcttttgtgtgcctgccctttctctgcctctagggagatcctgtccagcgcatcaacatggtggaaactgaatgaagttgagttgtgattgactggggacctcgtaggacgacagagtgcctgggccactcattcctttatttcttcatctattcatgtcataaaatatgttttcagctatactgtgtgctggacactggtgtagggtaagcttgagtgaccagatcctttggaggttacagtatgaaagtgaaacttagtcgctcagttgtgttcgactctttgcaaccccatggattgtagccccaccaggctcctctgtccatagaattctccaggcaagaatactggagtgggtagacatttctttctccaggggatcgtcccgacccaggaactgaacctgggtctcctgcattgcaggcagattctttaccatctgagccaccagtgaagtccatagcttacagtatacaagttaacaatttagagtttacttgtataattgtactacacaagtagtttatgtctttaattaaagtatagctgaggtacaatgtttcaggtgtgcagtaaagtgattcagttatatatatatatatatatatatatatatatatatatatatatgtagctttat

SEQ ID NO: 55316 - DNA, 2574 bp, Bovine  19866881004722
ctgtacttaaaagctttgactcgccaaaactaatacacagttttgatgctgtataaaaattaacctggaatgtaatccttgattcagttttctttttattctgaaaaaattaaaagaataaaaaaaaaatcactgcttttcgttaattaagcagatactttgtgctaaagagcacacttaatgtctagggtcttagaaaaagaacagatgcacctaatgtgtgaacacaaacagtaagttacaagttgccccttattactaaaggcaagaatcagcatcaatactcaaaaacagtgttttagaaagagtgtaacttacttttactgtcccaggctaactgggctgtgtctggtgcttctttgtctgcacttggccacccacagcctgtcttctaattaactcaatgctctagcagcagaacaagcaaacaagctgcctcccatctgtgtacagctcttcaggacacatttgccttggtcagaaggtggaaattcttgggagaggtgattttctctgcctcttcacaagaagaacatggacacttggctggatgcaactccatgaagtgtaactgtgtgtgtacacctcaaaaaataaaacaaaaaatgcagagaaacataaagactctataagcagatggaatacacagaaatactgaagcacccctggaaatactgctaaacagacagcaaagtagagtctttgactgaaataatcaatgataaccaacttgaaaaaaataaaggtacaaacagcatctgaagtcaaaatccaaatttcatacaatgaaaacatttgaagtactacaaagcagaaaaggtaaaactccttgcttcacatacataaaaacaggatctcccccactccccattacagacaataaaatatatggtcaatggaagagaaaaatgagactttagggagttgtgggtctaaaattggactcctcagtcacacagttgagggcatttgttgtatctgtgagctagatgcacggagctatctctccggcgtgttcagccccataggggcgtgagggggagcgggaagcaaggagctactgaaatcctcagctcccttctgcttatgaaaagatcgtttcttaaaaacaaaaaatgtgcagaacagagatgctcacttattttaaataattgttgaactcacaaataaacattaatgacagtaatgcagctgcccctacgtttttgcaacaaagactaaacaccaaagtgggatagggagcaggtgtggttaagcttctaatcataaagaaaccctaaaagcaaatttgttacaggcttggcgagagaaaggcagttaaatcagaccttcccagtattccctctcatccaagatatgcccatgcgccagcagcaagccacaccgtcttcctgaccacgaagcagcccaaggactcacaggccttcggggctctctctcccttcgaagcacacccacaattccagctagaagaataaagccaaaggaaggatgtatggcctaatcctatagctgcgcagagccctgggctgtggtccaccaaccacagggaggacattctggagatccttgctttttagacatgcatgcagagctggctctacagctcaggatgtagaggtcagataaatgcataaaagcattatatatactcatataaatgtacaataacgcaaatatctcctttttttccctcgcaccccaaactttcagccgtctggataagaagttacttctataaaggatttaccaaggtttacaagcaagcaccacattggattatatagagatccaaagacaatggtccatttttagcagacagctgtgcacaatataatctgctctttaaatgctaaagcatctggacaatcaacaagcttccaccatgaagtaccatctcctctgaccataggaagatataaagaatgaatcaactcaacaaaagatggcaaggtccacttagaataatctaagttcagcaaaacatttttaacaaggaggcctgtacaatttacctttcaccatatgaaattcaaaggctatacttatcactattgttaatgcatagtattctgcttaccaatataatcagctttcaaaacatattaaccaaaatctctcaaaggatacacccagccaaccatccattagtttcctcacaagactacaagtaacctcgcatcagtttgccagtcatatttcacctattattccttatcagaactttttaatcctcatcttaatactttcaaaataaattttttgatgtgcaaagagtgcttcagtaagcattttatgagctcattttctatcagaatctatgaaacactctttacttaagcagaggtattatgacttacccagatctaaatccagttttctcacagaaaaaaattcatatcagaaagctgtacatgtgaaatgtacaaattatgtaccaactatggtctaaaatttaaaatccactgtcgttatccaaaccaaaactatttcaaaagcaggcatgaaagcaactgtcttccaaatgcacagcccagacatgaagatcaagttgctgcacaaatttatcttctc

SEQ ID NO: 55317 - DNA, 1439 bp, Bovine  19866881039987
ctcagaaaatctatcttttcatcctctaagctcattgtctcttgtccaagtctggtcagaattctcattaggaaaatggttgtcttgtaaacagtcaatttctataaatttttaaatagaagctacaaccttaaccagactcacaaagaacagactagtggcgagcagtggggagagtgaggaggggcgccatagggctgggatgttggtggggtgtacaaactctcgggtgtaagataagctacagaggtgtattatacagcatgtggaatatagccagtattttgttataactgtaaatggactataacacttggaaattgtgtaactagaaaatagaacaaaaaggacaagcttctctggaacgtagagccacaccccaagtgcacccacctgggcagctgggacggtcacacgtcctagattcggttgcagtacacgcgtagccacaagacctggtccgtttctggttgccattcccacaggtaacactgcaaacagaccagaggctccagtcgccctcaccgtctgtggaatctggaagggagcagggagatggtcaccagcctcgcccaaagaaccctcacagcccccgtccggctgcctgccaactgcccacttgcagcgtccccactgttggaggggaccaggtgccagccggaggcgaaaagttatggccccagagctcattgcagggattagcttcatgttagcagggcctctctctgaggttcggacccctagaagatgcctgtgtgcgtgcatgctaagtcaaatctgactctttgagaccctgtggactgtagcccgccaggttcctctgtccatgggaagaatactggagtgggttgccgcgccctcctccaagggatcttcctgacgcagggatcaaatccaagtctcctgtggcgcctgcattgcatgcagattctttaccactgagccactggggaagcccagaagatgtctgaaactgaaagtcgctcagtgtgactctttgccaccccagagactatacagtccatggaatactccaggccagaatactggggtgggtagactttcccttctccagggggtctttccaacccagggatcaaacccaggtctcccgcattgcaggtggattctttaccgttgagccacaagggaagcccagaagatgcctagtaagtgcttattgaaaatgtacacatccacagagcgtggggccatgctactgctaagtcgcttcagttgcggccgactctgtgcgaccccatagacgacagcccaccaggctcccccgtccctgggattctccaggcaagaacactggagtgggttgccatttccttctccaatgcatgaaagtgaaaagtgaaagggaagtcgctcagtcgtgtccgactcttagcaatcccatggactgcagccctccagacttctccatccatggg

SEQ ID NO: 55318 - DNA, 1751 bp, Bovine  19866881075550
ccggggtcactcttagtgaaatgctggaaacagaaaatatggtgcactttatggcttgtgtatccatctgcatcttccctggtgcatgttcctggggtctctccccctcctaggttatgacctttcaggattttgcagattgttcaaagctactcttcagtgacagtttaaggacaacaagaggtagccactaaaaataacagtgtgcacagcaattcatccctgccccatccctgagcagtgtcttcctccatgttgacctttcagctttaaatgtgaatataagtgagccatgtgaaaatagcatctgtatgcagtagggcctccccttgcagaagtaagaatgaggtaacgtgcttttagaaaactcctattcagcagaactccaggagcattcttgtctagttcttttaaatgtgtatttccaacgttaatgatgagacagatgttctattaaaaggggaaagtactagaaacaagaatctaacagcaagcttcatactttgaaacttgctgtttctgcccctggaaaaaatgtaaagatgcttaaaaggagagacacatgagttgaacatagatttagttaaccaaagagataagaaattattttgaagctgtcccgtgttcacctatcgtgcccttgaattattctgatattccaatgcggacaaacgttagtcctgatctaagtcaccaggcacactgatcacttcctgctttaagcacctgcctccttctgtctaagggttttctgtgcattcaggatcccccaaccacacaaagcaagagttgacgccccaagagcagccctcctcagtgggtgatgagagtcagcagatgagcaccttgattcctttcccatctggaggcatcatttgaaggcaagttctgcagtctctcagagtgccctcaacaggctagagctccagctgctcactgtggtaacctgctcatcagtgaacattttattggctgtcttcttgactacatctcccttccccatgctctcatctcccaaataaactccaactgttcaaatacttgtccctgagtctgccatcaggtgaacccaagcaagatacatcttccctttggcccacaaacatctaagtttgaggtctgtgatcttactgaagtcgcaagaacttgtcctgtctagcatgacgttattataaccttctccaagaaaccaaaaattgacatttccagaggaccgtcttgccacagatgttaccaattacacagaaagtgcccaggctaggtcaggtggatctcagctcactcacagagagaggaatgaaaaataaatgccagggagggaaagaggagtccttcaaaaaatgtctccaaacattttccaccacaaatacctactctccatgggtaaataagaattatttgaagttataatggcttagaactttcaaaaactaatgacaaaaaaaaaaaaaaaactaatgacaaacactaaatcatcacagatccaggaaggtcagagatgaagaataaatacaaagaaaacaaatgaaacccttttgcatatcatattcaaactgaagaaaaagacaaagagaaaatcttgaagaagctagagggggggaaataccttaccaagagaagaaccaggataagaattacagtggacttctcatcagagaccatgcaaagaaaaggaaggtgatatgaaatatttgaaatgtgaaagaaaacacaccaccaacctagaattctgtatccagtaaattatcctt

SEQ ID NO: 55319 - DNA, 1402 bp, Bovine  19866881087653
aggaaagcccagggccatacagaaactcaagtctgctgtgcgtatgcttattccaggtataaacaggctataacactaaggtgaaaggctccaaagaaggaactcttactaagatgtgaaatgaaatcaaaactactaagacaactcagatgaatgaaaacatgtaagacaaatatatggaaaaatatttccattaatattgcatctctcaagagggaggggacatatgtatacttgttgctgattcacattgttgtacagcagaaaccaacacaacactgaaaagcaattatcctccaattaggaagatgggttatgacaataacaggggtagagtgtaatgtttcttgcctatgatccttttttactttatataagactatgaagtcttctacagtagatattacataaaaaattacttacatattttgaactactattaatgcatattaaaactgtattcaaatacaaatcaatatgtatgcctgtgaaattaaatatgtaggctccaaccctttaataaaagctaatggttttggagagagaccagagccaaaaaaaaaaaaaagaatattatatctctatatcctaccaaatttacgctaacattcgaaagaaagcctaacaagtaaagcagagacacatctaaccttcaaggataaggaagaagtcagataaaagaaatttcagtaaatcttaaatcgttactgtcctgtgacataaattttactatctgtcttagtgacatggggcaaatattccgtatttccaggaacacaccatcacatcatcctagcagaatgttctatcatcaatattagtaaacagtgactattatgatagattacaacacatataatttaccaggaaattatgaagaaccaggaaagcactgtcacgtgaggctagaatatagagaaatagatgcagaaaacagtattacaaaacatacaacactgaatcccgagtagcaggaggtgcgctgatacaaagtgataacatccatggcaattaacatatctgtacgtctctcctccataaagaaagatgctccagtcctggtgggaacaggtagacacacccttccaacctgctccctccattatgattccaacccaagtctgatttccaagcccatgacatcccaaccaccttcagagcacaccttctcttccagtcaagagacctgaaatgccaatgaggaatgtaaaaaaaaaatctctaattcctttctgtctaactcagatttttaaaaatgattatccatgttttctactagccaatgcttgtaaaaaaaatttttcatcaaagccaaagacaaatacagtgaacaaatgtactctttcttgatacgaataaaaatattctgaaaattaaaatgtaagggatccttcagtcatga

SEQ ID NO: 55320 - DNA, 1153 bp, Bovine  19866881118987
gaggaagtcgagcagcttgtcagagcctttttgagccgccttcatatggttcgcagagacagagctgggttttcatttcttctttcattcaacaggagtccctttcatgtttgcaaattgaaaacgcgtgttttgcagtgtggggcgaggatgtgtgtgccctctggcacacctgtttctcatttcctgacttgaaagcgcaacccatcaaaaggagcagaaaaacaatttctttctgacacgctgctctgtgttccctactggaccgaaggccttcgcagctttgccatcttggttccctctgtagaaggttctcgttagaggcagagttcactcgatgccggcagcaccttttatagcacagggccgtttggggtatgattttgttatggtggtggtggtgttcttttgctgcacaggaaatttacttgaactaagattgattttaaaaaatacacagagaggtcttaaacatttttaaatattaaatttagctgggcagcatcttacgttggaagcatctatgtaagccgaccagtgaaccagttggccaggaaaagggcttggtggagcatacaaatgtttaaattccagagcactgtttaacataaatcaaatatttccaaagcattacttcagatttgtgtgtactttaaagtcttgccagcttaaatgactgtgaggcacaatatgttgactttgagtttgtaaattgataatttgttgctatgaaggttgtacatggtataactcatcactttctgaaggtacatagtatgtctgatgttgcaagctgttacgtttgaaaaaaaaacgatgctcaggaattcaggccttgagctctcagatgcttggaactttggttcctcttaaggtttccctggatattttcagagtgaggcacatggttctttagacccaaacttgctttaggttttctacttctgagagtcatttgggataataattttaatgatgtatcttcagaaacagtttctcaagatctttttttttaacactcattcttcccacagtttagcatgtatgaatcacctgttaaaatccagagtatgggacttccttggtggtccggggttaagaaccagggaaacgaggatcccacgtgccacgcagcagaccaaaaggaaaatgc

SEQ ID NO: 55321 - DNA, 1153 bp, Bovine  19866881320459
actgcggtgcaaaaatcccagtggttctctccagcccacggcacactggagtttatcttgtccttacctccacgttgggtcaatctctcctctcccttctgctgcgcccttacactggaacttttctttatatctttgtctttcttcaagacgcaatcccactgcctcagtggagcttcccgtgtctacttcccaagaagcacatcccctctttctcctctgccttctggtagcctcgctgcgtatattagtctgcatatcttgttacttcccctgccgttacttcttcctgtgcacaagctcatgtactacgctcaaggacaaaaataaaaagacacattctagatcattctttgtaccctcctgcatactaaaccactgctcgcatgacctggatacccaaacaaatgtctaggaggccatttttcctttacacatctggttttgaggttccctcgtggctcagatgtgaagaatctgcctgcaatgcaggagacccaggttcgatccctgggtcgggaagatgccttacacatctcaactccaaggaagctcctatttttgtataccttctatgttgttgagggagaggctgagaagaatggatagaaaaaacaaatagcttagtgatgcgcctggaaaatcagaccacgttcaagaatcaaatgtcctctgctgtaatgtgtggagatgggtccaccaacacagatttatttgccttctttttggatttccctccttcgttaaaggaccttgtggattatttacggactcactcccatagcgctgcttatggcacatccatgagccccccggtagcagagcaaatcatcagagtaatgaaactcatcatgggactagatgggaccacagaaggtaagagggtctgcagcaagcccagctccctttcattccttcctagacccctctctgcctcccttctgccccatcaacctctccccttctcaaatatactgctttgtcttaatgtaaccaatttgtagattaagccatgtgtgcattaatagtacgtaatgcatagtagtacggagtacataaatgtactggaacagccattagcacacagaaagggtgagcagggcaatgcttttttaaagcaatgaacactttctaacttacctcttcatgtgat

SEQ ID NO: 55322 - DNA, 1384 bp, Bovine  19866881336686
gatggaggcactcaggttccaagatctagataacttgccccagggaaggtaactgagataaagcagaactgggattcaaaccaggtggctctgcagggatagagacccaataaccaaagagtctgcccatgtgcccgcatccgatgaagtgaacgtggaaaatgcagaggcatccatttgaccttcctcatcaacccatttagggcttagtttctttatctgtaaaatagcgagatcgaagtctagagttccatgatctggggttcagaagtacaatagtattgttttgatgttctcatctgcattttccttatttttaaagtcgttctcttctagttttgtgtttctgggaagcccagtagtccattcatggtggtcgagaagttttaaaatcattcaaatatacactacagtcagggaaagtgaaaagtgttagtctctcagtcatgtccaactctttgcaacaccatggactgtagcctgccaggctcgtctgtccctggaattctccaggcaagaatactggagtggatatccattcccttctccagggggtcttctgacccagggatctcatctgggtctcctacactgtgggcagtttctttactgcctgagccaccaaggaaacattagaaatgggagatgggtccaaaataaccttggatataaaccagtatagctggagcctaaattttctaaataaaattaatcaagaaatactatctagtcatatccaaaactacatatataaacaaatgttggaatctcagcatgcccattgtctctaagaatataagccattctcttgacccaaataatgtaagtttaagaactgagaacttcagtagtaaagtctaacctctatccctatggtataaatgaataaagacaaaggaaaagaaaacagtagttacctgatttttaattaatttcagctcctttttttttttctcctctctttccacctttcttctcttggattatactctgggcccaccaaggagatttttccaccatgtaagttggcaaaccagtggcttaattcccagtcatgccagtgggtaatatggtttaaacacagaggagaaggtggtgagagggagatttaaaaaaggagtcttgtcacttagctaatacattatgtaacaaaaagatataaagagattattcattggcttactggtttaagaataatccaaatccctgcagagagatttcaattaacaagtgaaattatttttacctacagttgtattttagttttgttttgttttgtttttcccctctattgaaaccaaaagaaaacatgaccttccactcaagaagaaaatactgttcttaggtttgtttgtttgttttttcatcattttggcacagtatt

SEQ ID NO: 55323 - DNA, 1772 bp, Bovine  19866881430308
ctaattaatagcacagtgagctaagtatttacttgggaattagctttaacaactcaaagcacttaaaatccattgaatgtatattaatttccccccagtgaaacgaaaccagagcagccttacaagattgagagcacgtctcccaccaaataaaatttgcccggttatccctgtttggtatcagggcagaaagggagagtgacacagagcctccctggcgggtgctcactgctgacaagcatttgttcttttgccctagcatggaaggttccatcgtgcatctgcccgatatcgtggctctgaagaagaaatacaaggcttatctctacatggatgaagctcacagtattgggtccgtgggccccaccggccggggtgtggtggagttctttggactagaccccagagatattgatgtatatatgggcacattcaccaaaagctttggagccgcaggaggctacatagctggaaggaaggtaagagacagatcccttgcatctatttaaaacctgaatgccctgggaatgcagtcttgggggtcctctggtttccctgagggcttcagttcagtttagcacacctgactgattaaggcggcctgggcagcatgggttcacaggcatgggaggcccagaaggtcaaggagctcattctctgatagtgcagaggttcttgtgatgaataatcctgtgatcgtgaaacgacaactctggctgtgtacataggcaaagatagtgcaaaggagagaaagactcagaagtctcagaaagactgtcagtcttgtagcccaagggtgacgagggggtgtgtgggtcatatttcaaaaagagaatgctgtttaccaagccacagaagtgatgctgcagaactgtaagtagtttgggaaaaacctaaggtggctggtaggaacagcggcagaggtcagatgttgaagacactgaccctctgcgacaagatgtgggttttcagagttttaacaaaacagtggcaagattggagatcttttttatatattttattgaaatatagttgctttaccatgttgtgttagtttctgctgcaaggcaaagtgaatcagccatacggacacaaaataccccctctcttttggattcccatcccatttaggtcatcacagagcaccgagtagaattccctgtgctacccggtgtgttctcattggttatctacttaatacatattaatagtatcaagaatgtatatatgccaatcccaatcccccaattcattccacccacctttgcccgccttggcatccacatgtttgttctctcatctgtgtctctatttctgctttgcaaataagttcatctgtaccttttccctagattccacatataagagattatgcaatatttgtttttctctttctgacttctttcactctgtatgacagtctctaggtccataagagatttttctctgccaagtaattctctcccacagtcttggataggccatgagtctaatcttgtcatcctctcatatcttatttgtgtgactgaagattctgagctgatggaattagactaagtgttatccctgtcattccactgccaacatcacccaggaggtcaccaaaatgaaacaaatttttgaaaaggttttaaaagaagagggaagaagacgagaggaagaaaatgaaatattaaaacctgactttcagggctcaaaaagccagttctctgctccatcatacaacagtttcaccagagccctgatggttctctcctccagctgtacacctg

SEQ ID NO: 55324 - DNA, 744 bp, Bovine  19866881584958
gaaacggagtgacagaggctccccttagagtgctgagttgctctgcctgtctgagccacttttagtcaattattttatatttacagctcacagttgccctccaccccaccctctttgccatctccaggatcccttgttggagttttcaagggcccattccgttaacctttgtaatagaattcttcccctgggcatggaaatattgctggagcctctttcaataattttaacagggtgtagtacaaaaagataattatttcttgtgggggaaatgtccctttaatcgtggcttatattttcttcccattttgaaggaagcccactttggatttggtatgaggtagtgggcaatttaagggggggtaatacaggagagggcccaaggtgtcagttagagagcagctggggtgtccttgcccagccaggccacttttaccgtggttctgactggaaggaggagcagacagcgtgcagagagcctggcagccgggagcagtggtttggtcagtgtgtgtagaggccctggaccccacccgcccagcctcccctccaagtggggggctcacggtagggcagctatggtcccttttgctgaaagagccaatgccttggctcccacattttctggaaacttctgttattgaactctggaaacattaatcaggttaaatggctcctctgcttaagaccctttgctggcttcccatctttcttagcagaattcaaacctctatccaaggagga

SEQ ID NO: 55325 - DNA, 991 bp, Bovine  19866881876890
ggctccgtgctgtcctgatctcgtaatcctcccccctgccagtgctgtgcttggcatgtagtaggtgttcagttaacatccccctaagatttgaacaaacaggatctgtctgcccctgagttacccacgagcacagcctggagattctcagaagcaaagagaagccaagattctgttttctaccccttcgtcgcacgtggaggggaggaaacacagctggcgcctctaacggtcttcgtctcccctccgcagactcatatttccagactccctcctggcgcggtggccggacaatccgtggcgattgaaggaggcgtctgccgcctggagagcccggtgagctgagccttccagcggaacccggagcgtcgagggcatcaccgaacccgggctccacggggttctaacggaagttggatgtttaaccttcctcgttccataacttctgtcgcagcctcgtgcgtccctcgcgcatccctcgcgacactagtgctgctgtagttagtgcttggcaacacgcgggtctagggcgggggagcgggatgcggtgtgcgtgagtgtgtgtgtgtgtgtgcgtgtgctcgcttcttcaatgaattagaaactcctccttattatgtaacctcagaccacgaatgattaaatcatcttcccaaaatgcgtgctttaactgtttacaggtaaaacctaaagttgcaggaaatggttgatttcacaaagcagtaccgactgtgttgatgtaacatgtaatgtgtctgaaactgcagagtaaatctacttgttgcaatgatggacagtggccgtgctcctgataacagtgctagtaacaaagtatttttatttgttagccagtttaagtggatcctgtggtgacttaaactgttgttctcatccctcatatggggcatttttctttaacaaagaatgggtttcagtgaaacaatctagcagagaattaaggtcagaacctttttaaataatagtcttattg

SEQ ID NO: 55326 - DNA, 1450 bp, Bovine  19866880164116
tcttcggcgctcagccttcttcacagtccaattggacattcatacatgaccacaggaaaaaccatagccttgactagacgaacctttgttggcaaagtaatgtctctgcttttgaacatgctatgtaggttggtcataactttgcttccaaggagtaagcgtcttttaatttcatggctgcagtcaccatctgcagtgattttggagcccagaaaaataaagtctgacactgtttccactgtttccccatctgtttcccatgaagtggtgggaccggatgccatgatcttcgttttctgaatgttgagctttaagcccactttgtcactctccactttcactttcatcaagaagcttttgagttcctcttcactttctgccataagggtggtgtcatctgcatatctgaggtaattgatatttctcccggcaatcttgattccagcttgtgtttcttccagtccagcgtttctcatgatgtactctgcatataagttaaataagcagggtgacaatatacagccttgacgtacttcttttcctatttggaaccagtctgttgttccatgtccagttctaactgttgcttcctgaccatatttgagttaggaaagcaagattgctatcattgattcctagttggccttgtacaagggtatgcctttgtatttgtgtaataaacttgtaactaatatcttagtgtaactttagtaaagcctattaaggatcacattatttaagatcatggagatttgcatgtttcatagtattgtcctagcagttaaccaatattactttccaattttttaatggtccatgctattttaagaaagatatatttggacatattactgaacatgtaaatatatttatgattactcattacttcaaattaatactttttatcctgagttcttatttgtctctcagaagataattaatcataacatgtctttgttcaggtatgaggaagaagccattcatactgtggtctttgtcaatttagggtagtgggtcacaagcaactctgcagtagatgtatactcattaaaacaatctgggctaactgattcaggtttatggttgatattattttcccagtgttaaatgttcatgactggcaaggctcacttattcaaatgtagaagctcctatttctattaaatagtgaaatacttctattttactgaataatatttcttgttggtgagaactggataaatgagctaaaattggttgacatctgaaaagctcaaacggtattgagaaaacaattgggttattttattttggaaaataatttgcacttacactataaagacagatgtttgacataacaaatgaaagtcactcttgctaagaaggcgtgaagccccgccgcagcacggagaaagtgcaggtcccgttgtgtgtgtgctcagttcccgagtcatgtccagctctttgcgcc

SEQ ID NO: 55327 - DNA, 1324 bp, Bovine  19866880384052
attatataaaacaaaaatccagatatgttctctcaaaagtgatgttcataaatatttaaacaaattaaagacaatgttacaaattttctattaaatttcttgagtcctaaaaccagctggcaatgatattgtctcattaaatcttcataaaattgcatttttgcatgttatttaagagaatcaaaacatcccaaaatccttgacaattctcaaaaactataataagtaaaaatacaaaggtgagagatgccaagtaatttcaaacaaactaaagtgattattttgctatattattttttccttcatgcttgtatatattcactcaacaattctttcaagagactgtagaatccagacactatattgataggtcagatttaattagttaagacaaaatccctaggctaatgtgtattaagcatactgtcacagttcagtatgataagagccatggcaaataggctgactcagtgctggaagcacacaggacttgttatgcctgggggttgaaaccagagaagattttatacctggaaaaatactttgtgtgctaagatatgttcttttaaataggtgggagatatgcaaataaaacaaggaattcaacagctatagtctctcccatctcatcctcaaaacaccaatggtatttgccatcaggaaggggtgaaaaaaaaatctagagataccctgggagtagtaatggaaataaagaaaaacaggtttccgggattagtcagtaggtcgttttcctaaattctttatcatgatagtgtctcaggacaaatatttgtcgttttagttttaccaaaggtgagggcacggctgtccattgtagtaagatattgtttctcatgtgtttcccaggtaatgaattctaataaagcaaagcatatgaccactgatttatgaatgagttaatggaaggagcgaacaggaggagagggcatggccaaacatctgagcaaatgactgtcccctctaagtctcacacaccctttagttccactgtttctcagtgtcaacatcgttccccattgaactgcaattcctcagataatctagcccataatactctcacgcccactcccctggccacagtattccctagctccctctttttttttcgcctccggtccatccttccatattctttgctcattcatataataaatatcattcaatgcctctatgcatgaatcattacattgggttctatgaagataatacaacaccaagatgaatttggtgcaaccccttctatccactttctaaggaaataagaaaggcaatgacatgcatgcacacacaaaatacctagaat

SEQ ID NO: 55328 - DNA, 1623 bp, Bovine  19866880460080
ttctaaattctggacgggagaggaaggaaaggatgctgagcagcggaagggagcaatgctggagggtcagggtgaatgcactgggcactcgagcaggccacggcctttcagaatgactgcaaggcttcgaatctccagtgaggagagtctgaccagaacagcatcagtgttagggagtgggttccggcagtggcgagagctgtgtgcctactagagagggacagacacctgggagagaggacaaggggcccacgtggaggccaagacagaacaacgctggctggtgactccagctgagatctcctgggaccctcacctaagtcctgatcctcaagggctgccacacacatctcacctcaactgaacggatggaactggggaaacacttaactaccccaacaaccagagctggaagtgtgtccctgataacgacttgccgcaactctgggttgaaagtccagcttcaaacatgttaagtaaaccaccctcagcaacccatgatgaggaagaatgcatgggcggcatgaagtctgtagaagtccacagtcacaggtatccagagggatgttgggcagggctacggaaatggtgctaagggtcccagcaactgtgctcatcaaaaggctcctgacaacttcattttttgtgcgtgcaagcaacatttataatgttggatttcctgaaactcataaatatttcaaaaaattacaatgaaacctggccacattgctctctatttgcaccagagtgcttttaattttcaagtccaagtaagtaaacagacagctgagagatttaatcctttgtcttactcagatctgaccaattcagaaagtaaacactctcccaagcaaaagtttaaagtgacaacttaaccaaacagagttgagaatttttaagtggtcccattgagaaagacaaaacaaggcacagtctgtacttaatttttcaaagataaagatctctacaaaagctaacctatgtctagctctgataattagcaaatcaatcaccatctcacttgatcagaccaagttagcactaaaggactttcaagtcttccatacacaagtacagccaatgatgcagtaagccttaggacttaaacatttattagcacgaactgcaggaataacggctaatgcagctcctactgtggagctgaaacaatttgtagttggaagaaattcaaagggagttatggctccactgattttcaaaactcagaattacgcaggaattaaaatgctacgatcactctacattcactgaaacatacacctcaatgtcttcccttctttcgagccccataacagaactgcagtatgaatacaaaggcaacttttaaaaactttctgaacacaagaataaaatcctacagctgaaagaaacaatactaaaacaacaggcttaaaaaccggtcattgaaaggaggattcgcaagtgctgccttttcttttctttttttttaaagtggctgaagtttcggtttaggaaaagttcacaggtaacatgtgcaggagtgctaaatatttataccctgggcagaagagctgaaactttcgctgtcattaccaccgcgttatctgcggcagaagaacacattatttagagagcaagtta

SEQ ID NO: 55329 - DNA, 1502 bp, Bovine  19866880618877
ctttgacttacggacctttgttggcaaagtaatgtctctgctttttaataggctgtctaggtttgtcatagctttccttccaaagagcaagcgtcttttaatttcatggctgcagtcaccatctgcagtgattttggagcccaagaaaataaaatctgccactgcttttacttttttcccttctatttgccatgaagtgatgggaccagataccatgatcttaatttattaatgttgagttttgaaccagctttctcactttcctctttcttgacacgtttactccagaatgagttaattatctagcaggttgtgtctttgtcctttctactgactctcaaatcttatgaagtttgatggtaacttatagatcttgtccgttagagttgcaaataatttctgtctgatagaaaagatattcccaaaggttatggcttcttattgccttgcagaacattgatcagtttatatctaacctgccaatctattctaatatttcctttaaaatacttataagtgatccagtgcttcccagtgttctctgagtggactttatcattttgcagattccctcataaatgaataaataaatctttgacatgtgttgattctgtacgttataaaagtcatactctaagcattttgaaactcctgctttgacaaatgaattcaaataaattattcagttcaaataagttgtgggacttccaaggtggtccagtggttaagactcgtgggcttctactacagggggcacaggttcaattcctgcttggggaactaagatccctcatgccatgtggtagcagcaactacaacaacaataacaacaaaaaatgctcaacaaaaaggttgtgatgagctgtgcaaatcttggcagatattcttggctttttttttttttttgcctcttgaggctctgattctgccttgctgagctatacaacacacatctggtccattcactcaagattctttttcaactggtagaggacatctggtcacctacggtccctcccatcagatttgtcttaactgcacaactttaggccctttatcctgtgtcccctccagctgcccctactccaggaccgctctcatttgttactcactagtgcacttaagcatccatatctgaaagtccatatctgaaagtgaaggggaagaatatccccaggtgaaataaataatattttatacttatctacctataagcaacgtgattctgctgcagaatcacaaatagacgtcatctctccggactattctaaccaattgctatctatctacagggcaggctgaggttgaacccaggctcgccctaacgtgctgtgatcagtcggcagtggcttccaggtacccaggattagagtgcttggtgtgaaccacatccttcttgacccagttccaagaggtgatggttcaagacgtgaaataaaccacaaagcctgcggctgataactagcgcaggcgtggcactctgctgcctttcctgcagaaat

SEQ ID NO: 55330 - DNA, 1081 bp, Bovine  19866880662126
tgtattgttttatgatggtagatgacaggcatgaggtttgcacatttcaaagcaatttgctttccagatatgccaatttacatcccttctagctctgtggaataccagatttatcacatccttgtcagtattgaggattgttaattgaaaaaaaaaacggttgactatttcataggtgaaaaatggtgtcttggctaactcaaaatgcttgtttcttttttgcagtatgcaagagatagttctggggtgatcaatgtcatgctgaatggctcagagccagcaggagcctatcctgtaaaagggtaagaatgcgagccctagcatatatgacaaagatgccaagatgtctttttaattgttttgaatggaggcttaagaggatcgtccgcatatcccaatctagtgcttttgtaagttcagctggggcaaaaccattgaatgacctggacatcagagccatgtgcatgcctttataccactaacagctgaatgcacgaatgcaatagtaacctacaagttaaaactaaaaggtaatccccaaagggcttccctggcggctctgtggtaaaaaatccacctgccaatgaaggagactcggatttgatccttgagtcaggaagatcccctggagaaggaaatggcagtccattccagtattcttgcctggagaatcccatggagacaggagcctggtgggctacagtgtgcatgaggttgcaagacttagcaacagaatcgccaccaacaacccccaaaagtgttaaaagtaacgtgtaagtcagctaacaacggtatgggagcagtgtcatattgctctaggacttaacagaacgtgttttctcagtttttttgcagattttgaaattccctacctccagaaggataaaatcacacgaattgagatctgggtgatgcatgaaatcggaggacccaaggtgtaagttaccgtgctactggtgatggtcatggtacaaacatgcttttcttggatgtgacatgacccagtctgatttacatgtacagttctggggaagccactgtcttctctgttcatagtgtggtgggcagagaaaggcaaagg

SEQ ID NO: 55331 - DNA, 1171 bp, Bovine  19866880668852
caggcagggagagagacagccttgctgacggggcgtaagaagacaagtctagagagacgggtgcgccctgaataccagtctgagcagtttctactgaattcatcacgtcatggggagctgacttgcctttgaacttctgttggaaaatcaccaggatgcttcagttcagttcagttgctcagtcatgtctgactctttgtgaccccatggactgcagcacaccaggcctccctgtctatcaccaacctctggatcttgatcaaactcaagcccgtcaagtcgatgccatccaaccatctcatcctctatcgtccccttctcctcccggccttcaatctttcccagcatcagggtcttctccagtgagtcagctcttcgcatcaggtagcctaagtattgcagtttctgcttcagcaccagtccttccaatgaatattgaggactgatttcctttaggatggactggttggatcgccttgcagtccaagggactctcaagagtcttctccaacaccacagtttagaagcatcacttcttctgtgctcagctttctttagtccagctctcacatccacacatgaccactctcactctctctcaccaggatgcttcctagttgtattttcttcacagatcgatggaacgtttaagatcgatattcccccagtgctcctgggctacagtaaggagcgaagcatgatgatggaccggggttttgactctgtccgaagcctgagtgaaggctcttacatcaccctgtttattaccttggagcctcagctagttcctggggagtcggttcgagaaaaggtaactgtgtagtctccggaatcccatatgagatgcagatgaaacgtgagagaggcttgctaggctatgctttcgtaaaattagactgaacagataagcagaggtttcctttcttgagcatctattattacattcagaggggagcttccaaacggggagagagcagactacgactggggccgacaggccgaaaaccagagggccctttgcactgggcattcttcccaggcaactgacctcctactgcaggagttttaagagtcccgtggccttccttccttaaaatgagactatctaagctgtcagctgctgccttcagtggcttttcactgccccactgtggctgcaggtggcatttct

SEQ ID NO: 55332 - DNA, 3650 bp, Bovine  19866880675587
aaaagaagattaataatttgaatatcaaaaatacttttaaagcattcatcaccagtgtttttaagttccttaataacgattaagagaaaacattcccattttggtagaagtttcactttttaattaacgtaagagttcaccccaagtcagacagatttatttcattccatttcctgattacctagtatcttagatgctgataagaagataacagcttaaaaagtgaactgtattaactagcccttagcaggaatttagttctttgcttttattaaattcattcagactaagctcagaatacttagtaattaatgtgaatatcatcatgaaacctaatttttggcttatcttattcccctaagttcctttagtaatgctgttggctttgttagctagctaaaggagtcatccggttggttcttgtgttccagacctgaaatatttaccagatcggaagcagtctgggaagcaggggttttatgttacccaaagtcttgtattttactctctgtttctatttttttcttcttttgtaaaataaaaacagtttccttatgtccccaaagaccactggaggaatttgactatgtctgaccagattgatggtttgaacattttttgaagtttgtagagaactggcatttctgtaggattatattggtgaaagaagtaaatggcttgccagtatagcaccaccctataaataaaatatttatttcacagacattaacactgtaatataatttcatcatactctgactcaaaagaaaattattttggatacatactataatattattatttatatacactctactatttttatgttaaactttttttcagatattaaggaacgattcacaaattatgtgcttttgctaatagtatgtctgagaaacatggagcagttttcttggaatccaggtaaggaagtctttacaattatggtgcctttcaattttactcttgagtgaaaaatcattctcttccatggaataaaatgagtacgcaggaaagtgcaggaaactccagaaggctttagctggtccactcttcacatgtaggatgggttgactgtgctctctatgggggtggtaggagctagaccccccgcagtagtctttggcccagcatggaaccagtgataaagaacctgcctgccaatgcaggagacacaggttcaattcctgggtggggaagatccccggagtaggaaatggcagcccactccattgttcttgcctggagaatcccatggacagaggagcctggcgggccacagtccgtggggtcgcagagtcagacacggctaagcgcgcacagttcccacgggccatgcagcatggctggagccacgcacccagtggccctgctgagcattgcagcgtagacatttttctctctcgcagacgaggaaactggaacttgttaatagaccatttccagcgtcaggtagccagtcagtggcggagctaagtgtcgaaagaggtcgaggtgccctggctaaagctcagcaccacgtgagacaggcagagacctccttcccggtcagcaggcagagccccagccctgcgccctccacccgcagccagctgccccaggcccgggattgccgctggtccctgccagcatttctgatcttcctgctctgtgccctcgtatatcctccttcaaggcctaagcaggttatcctgatgtctgcatttgttaatcaggcacttggtactgagttcacgttttaataaacatggtaaagatgagcaaatttggcaggttacctctgtatgacggtgaaataaaggatggatcagtatcgttgaatcttagtgatgaaagagagaaaaacagttcagttgactttagcaccttgtcctcctggttacccactgtcacaccgaggcagcaccagaggcttagacggagcttcctcactcaccatcccacatcgtcctgtggctctcctggcttcagggagaagctgggctccgctaaccccggcacccgcctcaaggcttcctctgtacccagcacggagtaagcacttgttgaatgacttagccttcatcctgaaaagataggactcttcctgataattaattctatgctgcttctctctccattatcacttgttggaaatgctctagttttgccccatggagagtgcactttcttctggtagcctgtgataggatgttaggattctgttcaaattacgagatgtaatcgtctctcttctcccctactttatagatcatctctgggtgttatttccagatgtctgtatggtggtcgcatcagaaattgctgtggatattgtaaaacatgcttttatcacaaagttcaatgacatcacggcagatgtatgtattttaataggcaattcaatgtttggtgttgacttctgattaagtatcataaggttgtaggatagcaagttaaatttactgaatttatgaatacggtagaaaagaactacatttctaaagttagaattataattttaaatttctaaaaatgattttgctgccaaaagtacattttttcaatattaaatagttctgcttctgtacttttggatagaggtatagactgatcagtagttgaaatcagggtgtcactaaaaccattataaactgttaataccatcataacctgtcttgttaaacttttaaaagtcacattgttcctatttaaaacattagatacgaaaacttctatctttgactagattgtttagtattttatattttaaagttgattttcttttctcttgtgattattaataggtttttggtaagtcctagaagacaaacaccgtatatttttctactgaaaacatttgttggaactttgagcaatttgctttgtcacagccaggcattttgtagcgtttccaaaaatagaaatgtggctgtaggcttgatgtaaacaaaatgaggcctactcgctgagccatcccaccagtcgagttttcaagagcaatgctcattcctcccccaggcccaaaatgaatggtaattcaccaatatctcaatttggtttgggttgtgcatgcttattgtcatattttaaaaggcaaagacttaaaatgcaatgcagtgcagctgctacaatcgatgatgggattatggcatttctgaatgttttaatatccttgaataaaagatgatcacgcagtttctggcaaaggccggatacgacaatttcaccctttactctcttggcttccttttcatgggacattttctcagcagcgcaagtcaaaactaatagccttgattcaaatatttagtgttttgtagtggaaatgacagtttacaagtgctttcaggactactgtgttctccaactcagcttaatatcatacttagcattcactcttctaagaagacatcattatcattagacgtacagtaataatttttaaaactgttcatttaatttaaattttcagaattattttccgtgccttgcactacttaaaatagccactcttcctaaaagtctaaactctcaacaaccataatcattaaatatttatccttctttaaaggaaacctttaaaaggccttgaacctatcaaggggaattgaggctctttttcactcttattgtaggtgaacaaatagggaaaaactacccagaggtca

SEQ ID NO: 55333 - DNA, 2286 bp, Bovine  19866880728815
tgcatttggatattttcctggaagttgaaaggtctttcccagaactgactcactggaaaagaccctgatgctaagaaagattgaaggcaggaggagaagggaaccgacagaggatgagatggttggatggcatcaccaactcaatggacatgagtttgagtaaactccgggaattggtgatggacaaggaagcctggcgtgctgcagtccatggggtggcaaagagtcggacacgaccgagtgactgaactgactgactgaaagaaggtagcaactgcttgatcccatattctgacaactcaaatcggtgcatcctttgtttcaggaaggatcttcaaaatggacacacacacacacccctgaaggtttaacccatgatggcaaataggttaaaaagcatgaaatgtgttcactgtggaatgttctctgtgtaattggtgtcacagtgtgtgctgtttcttttgtttgacttgcagattatctactatgagatcgggattattatctgtgctgccctgggattgctgtttgttattctgatgcctctggtgggctttttcttttgtctgtgtcgttgctgtaacaagtgtggtggagaaatgcaccagcgacagaagaaaagtggtcccttcctcaagaaatactttacaatctccctcctggtgatctgtgtgttcataaggcaagtagaaccttggacaagagctgagtggctctgaggctgatgagcaatacttgtgtttaactgttaagcacatgagcttgaaacaagaagagaatacagaaacagaaaagtaaaaaaacgcaaaaaacagaaaagagagaaaaaagatgtttgtcccgtgcatcactataaacagaagttggcactgtcattgggctgctgtagtttaggtgataagccaacctcgtggtacttttttcattttgaagacatctgaataaattctgggcctgcagaaagcattcgccttccaggacagcacttccttcctcttaagtagctctctcaagacaggggccatgcgggacggcagagcaagcatttactagcttatctttatgtcccaagggatcttttttaaaaaagttagttttgtttttttttaaattgaagatcagttgatttacagtatgttactttcagatgtatagcacatgattcagttatatgtatatatatgtgtgtgtgtgtatatatatatatatatttatatatatatatacacatttgtgtttgttttagcggtggggaaactgaagtttcacataatccagtctaggggatctggaaccggaagccaaagctagagaatgcagtccatcacctgaagtgtttgtggctgtgacaacacagaagccacagtgtgctcttcctctaggtagcccaggctaactccctgacttgtggggaccctttgtcttttaatgggataaggctttttggccaagttctgctcatcccatcccccaactcattctgacttctaacttgatgagttcccttgaaattctggctgccacaaatcccttccttttccatcttccttttgtccccatcaccatcaacaaaaggctgactgcaagtttccatctgtggaacttatttacatataataaaatattgacttgtttggtaccatttgtatattatcaccatactaaggcctttgttcagagagagggttttaaatcgttaattgatgtgaatttgtgttatccaggcagacactgtttctaagattctttccattctaaattacaattaactggactctcaaaagtgctcaaattgtctagtcatattcccttagttttaaattttttcataaatagctttcttgaattcaaatgatcttcaaattctcttactttactatttcatatatctgtaggttttctctaaaccaggcatctgcaaatatcttcaagtcttttagagcaagaactttctgtaaggagaatacctaaaattgtgacaatataaaaactgccacaacctggagtaatacaccaaaaagaaaagttgtttcttttgtagatttattttcagatataatggatttgcataataaatttgcagtggtttgttggttcctttaaaaaaatagttgatattgtttcttaaaggatatgaatatgggaaaagtgattcactggcttacaaaatataataattaatgtttatacattacttcaaaagtattttatatacatacttcaatttaatctttaaaataaccctactagttaaacgttcttacttctttcttttttaaattaatt

SEQ ID NO: 55334 - DNA, 2713 bp, Bovine  19866880773236
aaacttttctacatgtaaaaatcacttcaattttgcattacaaatatatattgtgatgaaacccttattaatttacatttttaaggaatacccaaggagattctgatgtaggatgtcacaagatcatcttttataaaaccgtgatttaatctcatctgcccatcttaccatgccttacataatatagagtcatgtatgacttccccctgatagtccagtggtcaagaatccatgccttgtaactagcctccaattaaaatttaaaaaataaaatgaaaaaaaaaaaagaatccatgcctccaaggcaagaggcgtgggttcaatctctggtcagggaactaagatgccacatgcctcatggtgcagcagaaaaacatttaaaaacaaaaaaacctgagcttcgtcacttaacatctgtgaaactaagtaaactgtttaacctctcttagtctctgtttccttttctataatgtgtagcgatgatatctacgtacaaagattactatgagaactgaaatgaaaaaaggacaaaatcagcagtgtgtgcctacctatgggaaggcacactcgtgggtaaagttatttttcttcttaattaagcttagcaataagcaaaccaaatggagatcattgctactttttcttaatacccaagctagcgcaaatttatacctaccattttgctggaaactgcagagctgtaggctaacactaaagttttcacagaagtgccaacatacggtagaacattatgaattaagccgtggagtaaacgtttttccatttgtgcaatgctgatagcaatcgactcctctccagactcttctgaaaaatgaattcaaaagtctaagaacatgataaaccagttataatcaggctactcaaggaatcactatgtcactaaatatgaaatactttctgctctccttaaactcccttacatatgcaaagcaaatttaatggacaagttctcatcagccagcacttaacatttaacagtcttgatatcaactgaaaagagacaaacagggaaaagaagtttaaatgggaaggaagggataaagttttcacatgattcaaggttgaaggtaattttctaattttcttctcaagctaattaacagagggaagattaaaaataactccaatttcaggtaccgaaaaaattttggaaaaaatactttgactacttaaagaacagtgcaagttcttcaaaagaatataggaattgaagaggaaaatgaaccacagtaaaaataataaaaagtattttcattatctcacataaataaaagggacatggacctagaagagatttgaaacaagttaggttggccataatgagtcaaggaaggaaaaataccttagaatttttaaaaaattaaaaatgagcaaagcttttgctttttgcttaataacgtctataaagcttagatgtttaaaaaaggatgcaatactgtaacaagtaccaaaaccaaaaaataaaaaacccaatttgatacaaggaaaaaacacactacactaagaacaatgaattaataatcttatcctattactttcttgcttacctgaagatctaactcgaatgtctctaaacataaaacagttcaacagaagctaaggaagtctcatttaacacaaaactgagtgtagcagacaaaaggaatttaagtacaaagagtaattctgaattttgactaatgtttccatgttacagatattattctaaattcttcctttacccaaacataaatgtaaaatatagggataaaaataacttttagtgaaccctatttattctactataattttatttccaaataaaaatgacttttagtgaaccctatttattctactataattttatttccaaatgattcttttgtttctgtggctgtctctaaatatgtactgtttactgtgaaatcctaagaaaaagaaaacaaaacatcctatgaagagtaataacttctctgcaagactagtaaaaacagctaagctgaaaaagcactaacatagatggcagtttagtcttggatatactacacagctaaaaagatatattaccttagaaaggctccatcattataaccttaacccttccctttcaaagtcaaagaaaacaacagtctctttgtctatctttaagagctgagtaaacacattaagtttgataagatctttaaaactcaacacagatattatgaattgatttttttagaatgggtaaatcaagttttcctaatagttcagttggtaaagaatctgccggtaatgcaagagaccccggttcaactcctgagtcgggaagattccttggagaagggaatgaatacccactccagtattcttgggcttcccttgtggctcacctgataaagaacccgcctgcaatgcgggagacctgggcaagatccctggattaggaagatcccctggagaagggaacggatacccactccagtattctggcctggagaattccaaagactgtatagtccatgcggtcacaaagagtcagacacaactgaatgagtttcacttccctaaggtgacataagactaaagaccgtaactccttgaggctttgctcaaatttctcaagagaccttactacccactctatgggaaatggtaacttcttcctctcttcctgacacacttttccattatgtttctccacagcacttgatactacctaataaagtacgta

SEQ ID NO: 55335 - DNA, 1851 bp, Bovine  19866880813826
tactgggtggattgcctttccttcttcgggggatctttctgactcaggattgaacccaggtcccctgcattgtaggcagattctttaccaactgagctacaaggttttaaaaatacatttaaatatatattttatatatattatgtatatgaataatgttatttgcagtgctgtgtgctgagtcgctcagtcatgtctgactctttgtgacccccatggactgtagcccaccaggtttctctgtccatgggatttcccaggcaagaatactgagtaggttgccattttcttctccaggggacctttctgacccagggatcgaacctgagtctcctgtgtattttttggagtaggcgtttggtaacacactgatataattgactcatttatcagtctgttatattttcataacacctattaagggaacatgcataccagacatgaaccgtttactttttatttctctggaaaaaatgatttatggtacttttaataactattcaatgaagataatagcatctccctcattgccattatatttgactgtgttttctcttcaaatgaaatagtggatgtttcaagtatatccaaaactgttcaacattcaacatcattcccaagaagctcagtgccaagtttccttgggtgaaatctgcctgtcacctagagctttgtatttcctggtttttataggttgctaccagtggtgaatcctacatccctgatttcttccgactcgaacagctacaacaggaatttaactttgtttcggatgaggaattaaatagatctaaacgattcaggctgctgcttcttagaagccaggaggtgccagagttccgacattataagcaaattccactgtatgaccgagaaattatggaaaaagtatttcaggtaagagattgccttagaggggttaataaaataatgaaatatttactgttccattttgtatactattatatatatgtaggtgtccttgtggtgttctcagtagcaatattggtttcttctttattgcactttacatagccttttcattatttttcttgaatccaatgtttaaatcatctctttgtctcagtctaatgacatctaaactaggaaaaattagtgtcatagggctgaagaatctcttcagtgttagtgtggcaaacagtcctgcctggcttagtcaggaattcgatgcccttttttttcaaattaatttatttacttaaatggctgcatcggtctcgttgcggcccgcaggatcttcgttgcatcacgaggtatctttgcttgcactgcacagactctctagttgtggcttgcgggcttagtggctcacatgtgggatcttagtttcccgaccagggttcaaacccacgtcaccttcgttgcaaggccaattcttaaccactggaccaccagggaggtccctcaatgccattttaacccagtaagtatttactaagcacaaagcacagtggtaagcgctgcttggaagatagatgggtaggatctgaacagcctgggtgaaggggtaggaagtggggaacaggtctggtcaggatgctgcaggcagctggagacagaaagccttgggggaggttggagtggggcagggagcctttgaggagttacagggaacaggcctgtggggggggggggcgggccagggaaagctggacaagtttatgtttgatgaggtaaagaaatagccactagaaattaatatcagtatgacttcttttgtttgtttgttttcactgccattactctaggaggtggatcccaaaagatattgctgcaatttatatcaaagaatattctgctttacatttttctctaagagttttatagagt

SEQ ID NO: 55336 - DNA, 1042 bp, Bovine  19866880839713
atcccacatgtacagggcaactaaacccactcgccaaaactactgagcctataaccagagaagcccatgcacctcagttgaaagatcttatgtactgcaagctaggacccaatgtagccaaatgaataaatactttaaaaaaaaataatggtttcaaatcttatttttaatttctaatacagtaaatattaacagctatgactcacagaaacagaagttgttgggatgtctccataatcttgaagattgtgaagaggtcctgagatcagatattctgaccactgagcttgacagtcaagagagcagggtcaaagcccacccagagggatgtgacaaggactagataggcctggcggggctgcagcctgggctgggggcagcagtggggggtgggcagagggcttaggagggtcgcccaggccaccaaggaaagcccccattccctgcccaagacataatgaagggtgagccagctgacaaggcacttagagagcctactttctccaccctcagagcagtcaggaggggtgggcagtgaagaccgtttctgaatttctgacttgctgattccagtgacctaaggaattctcgaaaagcaagtttggatagaaggataagtctgggtttcagaaggtggaggctgaggcgtgtggtcttcttgtaaccacctacgatgtggaaaaatggtttcaagcccccaagccagtcggattaacaagaccatgcttaagaaagtagctcttaaaagttctcatcacaaagaaaaaattccgaactacgggtggtgatgtatgttaaccagacttattgcggtaatgattttgcaatagacacatatctactcattatgttatacacctgaaactaatatgattttctgtgtcaactatatttcactgaagaagagaagatgctttattagtagaaacttaccattctcttaaaaataaaggacaaggagttctctgctggtccagtggctaagactccgctctctgagtgcagggggtggagttcaatctctggtgcaggagctagatcc

SEQ ID NO: 55337 - DNA, 754 bp, Bovine  19866880858367
ggcgtcgggatgcgctggagacggtggagttctcacacgatgctccatttccgcctcattctgttcccacagttttcaaacttcatctgccaaagcattaaaaaaaaaaagataatgataattaaacttaagataaatgttcttaccaccagaatactcttcgaaaatgtatctgaattaatcagaataaaaagctaccttaaatgagacatgatggatagtagcattttatagagggaaagaaaaacaaacccttaagccagtttatttaaaaaatatgaatgaatgaaggtttgcatcacagaaaatgtttcctaatttttcagctttactcttcacagccaaacatgagctgtgtattgtgtaattgcagtggataaaataggaattccccgacagaaaggcacttttatactgagaaaagcagagcagtattcattttcaggtagagttaactgatttccctttcaaattgattgcttcttaagttgttaccattaaaaaggtttggtgttaaacaggctgaggaaccatcagaggacaaaattcaaagatatccacttaactgggtttttcaagtcccagttttaaagtcagccttgtgtgggtggggcatcatcttgctcgggctcctagaaagaactggtctgccccgtctgtctctctgtctctgtgcccacacctggcccggatctgtgctctggaggtgggcaggctgtgtggggaaaaggaaaggaggcgtttggggtgtgcg

SEQ ID NO: 55338 - DNA, 829 bp, Bovine  19866880934605
ttttggttttttttttttttgggccggataagcaccatgctagatagacgtctttatatctactctttgtatgcatccatggtcattattttagaatttatagactttttaaagtaagtgaagggaagtgacattttcagaaaaatcatgttttccatttgctaatcatgtgtaatgccaattagtgttaattggagttctttgcatgtcctgagtggggggtgtctcaaactttaatttaaaatctacaggatagaatactttaagtatcccattaagctgttagtattggggctcaattaaatagctgagtgaaattaaaccatgcaagttgccctgtgccctgagtgaaataggtaacaggtctcctcagctctgatctaataggattttttttttcttcacagagcctggatgctgacaatgatggatcatctattagcatcacatttggcatatagacggagtggtgggtagttaggctggggacagttgattttctaggctaatggccttagggctgtctgcctcttgggtgggggaagcatgcacgtgtttttggaatggtgtaaatgagttgtttttgcgtggttggacctgcgctttaatgagaaatctgtacaatgcttgatgtctatgcctggaatatacttgtccaaaggaaataatcatagcttgtgagaaaagcaattggatagagtttctttattttttgacagccacatcagaaaattaaccagcacactgtaccacttttatggcacccatggggaaattgcaacatcttggaatcacatccagaaatttgccagagcctaggaatgacaaa

SEQ ID NO: 55339 - DNA, 927 bp, Bovine  19866881189312
aatatcctttctcctccctccccaactctttgggtataatttctaagaactaagagactaggaagacaataactttgtttgtttgttttgggctgcagctagaggcaggtgagttttagttccctgaccagggatcaaacctgtgccccggcactggaagcgtgggatcttaaccactggactaccaggaagtccctaactttttctttttttttaacagaaaggaaactaaaacacaggagtgtgagaaaaaggaaatagaaaaaaatacaattgacctctttgctgatctttttcatttcttaactcttcgaaaaaattaagtcagactgaaggaaagagcactttttgcttgctgaaaaagatggaacatgatacagccacaggaaagaaaaatcaaataatcctgaacagaatagaatgttggaagaaaaagaaggcaaaacttgtctgattaataattttctaaaagagaaaatgtattcatatactcttaaaatatctgaaaggttttagacttagtattaacaatagttttggtaatacaattttttacattatattttaagtttcaaatatttcaagttaggtgctttaagaaaataatgctcagaagactttgctttctaaattgctcaaagaaaatatggactgcagcccatgttactgtcagccaagtactccattctgataaagtacacttaaggcgctgagacagggaggcagggtcttcatactctgtatgatctgcctatactcatggagtgcttagaaatgctgacgttctgttataccattttaactgtgcttcacggtatatacatatatataagtgacggcataaaatgtaatttttcagaggatccaaactgcagaagcagcaagacccctctgcccaggaaaactgcacggcggccttgcagcagg

SEQ ID NO: 55340 - DNA, 1096 bp, Bovine  19866881213214
cggaaagttaagggactgtatggggagaagtgtctgtggtgagtgaaagattgtttcagacacagtggagtaaaaagttactgttctcatttaagctcttccatggaatttaaactcttccacaggcgatataattctgcagctcatgaatgtcttcagaactggcatctgaagaagaatcttaattaccagacatttctgactcctgcattccccatcccccgatgaaaaccagagaggaaaccagttccagactgactctcactttatgttcttttctgttttagaatgtatatatctaagtctcttctttcaggatttaccataatgtattccattatgtaataaacttttctgagatcccgtttcccaggcatcgtgccaaatgccaaagctccagaaagaacaagacggctgtcctccagaactcgccgtctaagtggttggatcgtttccgcttttgtttgttctgtagtttgtttcatgggtttcttatcccatcaaatttgtatcaactagggaaattgcaaagataactacttatgtagggcatgatttagaaagcatagtcgtatttttccccattttaaacttcagagattttaataacattactgtaaatataaactggaaccagaattcagttttccccttgacatcacttaactgccagttttgcacgccatccttataatggttcaagcaaccaccctcaacgtggcttttaactcacacaacaagtccctgctgactatcatgatgtccaataacgtaagtatgagattctactttacatttttgaggttgtatgggtactttaacagcagtattctagatgggagaaaattgtttttttccttaattgttatttattcctctgggaagtttaatatatagcatgtcacttttttaaactgtggtaataataaagatgacttttgtggtttctctttcagtttgtcgaaattaaaggaagtgttttcaagaagttcgaaaagaacaatctttttcaaatgtcaaatagcggtatgtacaatcagcttctgcttgaagctttatgcagagttactgcgtaattcattttgaaactcttaat

SEQ ID NO: 55341 - DNA, 775 bp, Bovine  19866881306386
acgcccatctctgagcagtcatgtctgcttctcatcttccgaggcgtccatctccgagcagtcctgtctgcctctcaccttccgaggcgcccatctctgagcagttatgtctgtctctcagtataatcaatatctgtttgtactgatgtcaatttggccaagagaatagaaggaaaatcagggtttactcaccacgaggagtccctgtgacaccacattccactctacaaaggaagtgagagtgctcctcccttcggtctgatttacgagagagaaagagagagagaacgttgtaatgtcgctgcgctactgagcgcgccaaggtgaggaggaggaggggacggcacctgaggtgggaagaccctctgacgagaccctgctctctacgagcgagcacggaggccctgccagggaggggcaatgacggccggccctgattgccggagaagtgatgcgagcatgacaggggtagcacaaatcactcaggtcgaaattaaggcttctgtctaaaaagaggaaaaatctcatgtgtgtgcatgttcgtgtgtgaagttcacttcagggagaactaccttggaggaggtaaggcagggggaggaaacccaacgggttaagaaacgctcgagcatctgaaattcctaattcttcagatgagagagatttctgtagggtaaattaccactgcctcaaaaacagaaaggtacctgaagcttccaacaagagatatgcttaaagccagggggagaatcagtaaaatttactcgcacgcatttta

SEQ ID NO: 55342 - DNA, 865 bp, Bovine  19866881320530
catgtcacatttctatcataaagtcatgcaggtgcagttggtagaagtcaaatcaaaaccttttctatttctgcacagagcagaaacaccccccactcagactgacttttcaacatgtacttttctcaaataaataagtcatttcagtgaagcatctgggtaattttgacagctaccttttaatagccacatgacaatgtggaattctaaagtacccaaataacacaacaacaaaatcaatatgcttttcagaacatgcttcaatccatatcttttggggaaaaaaaatgacctgcctgaaattccaaataaggtgattgaaaacatacacctttctcattattggaacatattttgagatagactctatcaaaaaggcacggaaacatacggctgtaagtaaggaatagttgtgttgaaattagcatcatgctgatcctgctgcccgcttcattggttactaagtggatgttcagcatcctggccacgtcttaaaaagacaggttcccagtctccacaatagttaagtcctgcttgcccattccatgtctgaatttgacctttcctttggtggcacaagtctccttgtttaagtgtaaagctgaactctgtgtttcaaaagcctattaagtaagttcaagcaacgacaagttcttcagtgaagtttcattttcacaagttccactttgggtcacggaggaattttggaaagacttcaaaaaaaggaagaatagccttcagggctggctcagctctgctttggactgtcccatgtgggtagggccctgaattctcatctaggtgacactcttattcatcatatccccttagcaccgttgtaaacctcaattgtcattatctcatg

SEQ ID NO: 55343 - DNA, 1086 bp, Bovine  19866880366098
tcctccctcccttctgcgttgttaaaacacacccagaagcccgcctgtactctgtgtcatctgtgctcttctaatggcaccttctcccctcaaactgattacttataagattggagagggacttccctggtggtccagtggctaagactctgtgctcccagtgcagaggaaagggaaagtattagtcactcagtcatgtccaactctttgtgatcccatgcactgtagccctccaggctcctctgtccatggaattctccaggcaagactactggagtgggagccattcccttctccaggggatcttcctgacccaggaattgaacccgggtcacagggcagggggcccaggttcaattcctggtcagggaactagatcccacatgccgccacaaagatcaaagtttccagtgctacaactaagacctggggcagccaataaataaatgagaaggagttggagggttgtgtgtgttgagcctttgggtgctctgggtggggaggcttgtttttactacagatagggaagcatttctgcctgccttgtgtgcttgcttttagaattagcggttgaatagaaaggtgttcatttgacaatttgatgtctttgattttttaaaggatgaatattcactgagtttcctttgtctgaagactgagtacatgcatggcatttctttctaatggtttatagctcttctcccccttctgaacagtctctgttgagaataccttggcacgatcgactttgaatgacttgggttaaatagcaagcaggtctctgtgacgattctcatttccactcagagtgcagagaaccagggtggggacacatgctttcattctctctgatagcagcagttcccagcaaaacacagttgctttcgatgtacataattgatcactttattaactggaaaaaagaggccttattgaagtaataaagcataacttcattatatcctgcatgtagacagcagacgtgttggaacgtggctgatagcttcccatttcaaggctgattctgatcatgataatatttaagtcacatcgactgtcttctaattggatttttcttcctgcagg

SEQ ID NO: 55344 - DNA, 1900 bp, Bovine  19866880369937
tggatggctcccacgagatggtggccaggtctccagccatagtttgcccaggtaccgatctcttgtcttttgctctgagaatggcatcaggatttccctggtggcccaatggttaagaatctgcctgccaatacaggggacacaggcttaacccctggtcaggaaagatttccacataccgtggggcaactaagcctgtgtgccacaactgtggaaggccacaagcctagagaccatgccttggaacaagagaagcaaccgcagtaagaagtctgagcaccacaacaaagagtagcccccgctagctgcaacttgagaaagcctgagcagcaatgaagatccaacacagccaaaaaaaaaaaaaagacactttggggcagatagcttgcctcttcaggctggctggaggctgggccaaggccaggggtggggcggtgtatgcaaggagaccctacctcgggagtcagaggcctggcttctgtagaccctgagcaaggaacttcccctctctgggcctccagttccccagttgtgaaggagaggggtgattccatcaccgctccccagattctttgggtctggtgtcgcgtgttgatgtgcagggtggccaggcatctcagagtttactgagtgtcagagtcccccgaggatccaccctccctaaactccagttagcatcactgcttaacaggcacccagggtgctgatgggcggccctaacctctctgagaaccatggcagcaagcctcctgcagtggggccaaatccagatgcgcatcaggccccctccgacctggtgagaagcccaggcagcaaagggtaattaaaagtataagctttcagggtacaacacatagagtccccctccatccccccagctctagcgtgttggacaagcttccttccttttcccatctctaaagtggctaaaggaaatcaaccctgaacatttactgggaggactgatgctgaagctccaacactttgggcacctgatacaaagagccgactctttggaaaagaccctgatgctgggaaagattgaaggcaggaggagaagggggtgacagaggatgagacggttagatggcatcaactcaatggacatgagtttgagcaaactccaggagatagtgaaggacagggaagcctggcatactgcagttcatggggtcacaaacagctggacatgacttagccgctgaacaacaacaacaatagtttctaaacccgcttagcttcttcttaaccagtctgggcctcagttttcccatctctcaaatgggggaacatatatcagtggttccccctcatgggattgctgggaaaattaaatgtcttcatggtggaaagtgtttggagctcttcctgcacagggcatccttggaaatgtccaggctccatgacgctaaacaagattcgattctagattcagcagaactgagggaagaagcagccacccaccttctttgttttaagaagagccaaacgaaggcgctaagtttatacattcattttgctacagacgggaggatttaaatagcttcctaaaaggtatttttaaaaactgctcttcaatgctccattaaaagattctctgccttgccttggcgtctccagggctgccaaaaatactatgaaaattactaaaatgcagtctgcggtcggctctaaaagggtttgccaactggcttcaaataatctaaaacctgatcccatatgatctggaacacaagagctcacattgctcagagtgatgatctgggagcctcgtggaagcacctccttacttaagagacccacgtggaccccacgggcctccttcctgaaaggctctcttcttggcttatggaagccacagccgtccgtcctctccagctatctctcctcctccctctcc

SEQ ID NO: 55345 - DNA, 1390 bp, Bovine  19866880371089
acggcagcccaccaggctcccccgtccctgggattctccaggcaagaacactggagtgggttgccatttccttctccagtgcatgaaagtgaaaactgaaagtgaagtcgctcagtcgtgtcccactcctagtgaccccatggactgcagcctaccaggcttctccatccatgggattttccaggcaagagtgctggagtggggtgccattgccttctccgtcctaagcctttaagaggagccaatcatcataacagggcttgataaggttctcatgtagattcaagacagaaagacttatatagcctgtagccccatgcatggcatagataaacatttacctttattagcactggccaggcagggactcagccctaccccatgctatagactaggtgctcctgaattattcaggtggacttgaggctgcttcctaaaggcagtgcttgcccagcaaccaggcatttttccattgtggccatcagctctagtatcccttactgtcgtctcagctaaccctcgatctcatcagaccatgtggctgaaacatcatctgtctcttgcttctggaccctgtggacagaggctccctcttctatttccacacctatagtgcctggcacagagtaactcaaagtgttacctgagtggtaaataagaagatagcatctcagcccaagctgcttctccaacttgtactaagcctgagcagaccccacgccaagaggataatgttttaggagcaggcagccctcttctccctctcctcttgctctgtgcatggctccagacctgcaactctgcacctttggaagtgctgtcctactttctccatggctggggactctgcgcctgggaactggttgaatgcctttcatgtttccctcattttcaaggctttgactggaaatttggcttctcatggttgatcccagttggttccgatgatattttatagcgccttcctaatttactgcctttttatgactatagtaaaaggccacacgtcagggaacaccatcaaacaggaagaagcgtcccctctccttgtcagctcaagttgagcattgtaatttacagggaaaccttgtggcttagggtgtttacctcctgtggaaccagtttcctctcccattatgagaatgagataattaaaatacttccctgttcctttgatatggaattaggtttgctcagcccaattgcaagtgccagtttgaaagctgttatgttatttgggtttcaatttagagccatctatttcaaaggttttttttttttttttttttttaattttctctttgcctaccctggattagaaatcaggaagggaaatcgggatttattgaaatttggtttggatatttccatcttgagctgatgcaaatag

SEQ ID NO: 55346 - DNA, 1572 bp, Bovine  19866880419084
atcccttggagaagggaaagggctaccccctcccagtattctggcctggagaattccaatgaactgcatagtccattgggtcacaaagagtcagacaccgactgaatggctttcacattcactttctccagggaaaataaacaaaattgtttttcaaaaactatttctatgaaaaaataactttaaaaaacaaaaattaaaaattttgatgtgcactcagaggagaggcagaccacgtctggcttgcggccctgtcagaagcctctgatcagagcctgcagggtggtgggatcaggactcggagagcagcaaacgctctcggaacagaggacaagccaggtggaggtgctgctgggacagcgtggcactggcagggaataaactgcatttaactgtctccactcagtccaacgaaacggtcactctgtggtgatgacaacagctcaccgagctagagatgagagcgtctgaagattcgaaatcttgacgattccaagctgctggtccatccatccagcaaaacccactgtagcactgggagtggagacttccaaacgcttcacctcttctctgagagggaacaagctcctgtcatcttcagcatttcttgatttggaatcatagggccagagatgatcaggctggcaaaaaacctacagttcactgaatctgtggctggtgagtcagggagcctctaaaaatctggaagaaaagctctatacatactctttctccagaaaaagacatgtagggatggagttatgcaaacaattttcagatgccgctcaactccctgactcaaccctggggactcaaaagtgggagactgtccacagtcacaggttaagaatccagacaggaccccgagaggccctgcttccccaggtcccagatcgtgcacagaatattaggctcatccaaccccacccagccccactgatgacggggagcctggaggaggcaccaaagagaagatggctcctttttgggaccgacgcaaatgctgagttaccagaaataattccaggccgggaggccggggcctgtgctcacacagtgtcctgccgcattcaaacgggagcatatttcaacctgcagtcggtttggactttagttaccaaagggtgggtccccgcagccacccgctctgttgctgtggtgcttaatggggcaagctggctcggggagtggggatgagatcacatttctagagggcgttgggattcccggggaaaaggagcctgtctccagcttcttcacagttgactgcacctccaccctgcctcaggcctcctgggctatttatagcctcacacccaaaacacaaactgttgtttgcagcttttccaaggtctagcccaaggctctgcttcagttctgatttccatctgtgcagacacccagctgctgatggggttttaagagcaaggatggggccagaacaggagaccctggaatagagcatgggcctcaccttccccagtgcagacaatgccccgcaggctccagccccccagtacagcagtcccacagagcctgcaccaggggcgggctcccctcccatgtggaccg

SEQ ID NO: 55347 - DNA, 2966 bp, Bovine  19866880592053
tttcgagtgatttattctattacttccccgggtcatgttcctgggctcgaggtgttggcttaatttgcttctgagatcttgatactacccgttcattgctcctaggagctgctgggggcattctgttaacaaggagcagagtccattttctggaccaagtaaccgtttatcccaatgcattagaattttcagcccccctcccctcgtttctgcttttctaaaagtttcttttcctgaagggctggaatattcaaaggcagtttaatagacattgatttgcaatgatttttagccactgtgcttcaggagagttgagaagccaataattaatcctttcaacagctcgtcccttttgttttaaaatgatctaatagctgaattgctctagcaggctgggccagcgtgacccagttcggctccttgccttctgctgcttcattcaaatttgtccgctatgaattattcagcccttttgcaggggtgagtgggtctcctcgttgtaatatctaattagcaacccgggaggccagcgtcattctgcagacagctgctgctcacctcgggcagatgaatgggcattcttagaacaaggggtcaggttctgccttttcaaggaggatggtttgtcctctgaccccagagcaactacaccgatccttgggcttgtccaggctcccctgtgcttggtcctctgcccatgcccgtagaaagtgacctcgggttcctcctagttgagggactcttgggtgactcccatccctaccgcagtgatgttgtgttgcttccataactgaccaccacacacataatggcttaaactatacatgtctgttattgtacagtctgtaggtcagacgtgcaatacagctctcaccgggctaaaatcaaggtatcagcagggctgggtccccctggaggctctggggggaaagcatctccttgccgtttctgggctttccttgtggctcagatggtaaagaatctgcctgcagtgccggagacctgggtttgatccttgggttgggaagattgcctggaaagggaaatggcaacccactacagtatttgccatgggaaatcccatggacagaggagactgtggagtccatggggtcacaaagagtcggacatgactaagcaactaacacactgccttttccagttgctggaagcatcacagtccttggctcatggccccttcctccctcttaacagagagtgaagcctctacaccgctacagtgtagcatctttctgactctctctctgcctttggtctcctctcctcctctctcttccactttatttggctctgctgggtcttagttgtggcatgaaggatcttcaatctttgttgtgacacgggagatctttcattgctgcagatgggatctttagttgtggtatgtgggatccagttccttaaccaggaatcaaacctgggccccctgtgtagggagggtagagtctcagccattcaaccaccagggaagtccctcctcttctacttttaaagatgcttatgattacattgagcccaaccagatagtccaggatgctctccttgcattaaggtcagctgactagtagcctcaattccgtccaccaccttaattcccctttactgcgtgacctaatgcagttgtggattccagacattaggatgtaaatatctttggggggcattatgctgcatccaacacctaccattgccctggtttcactgttgctgagtttatggaactttctattgggaagagaagctctgagaacttccctgagcagcagcctcataattttaagtgtgggtgttacagacagacagacagacaggacgtgggtccgtcttagttctgccacctctgagctcagagacagcagatggccagcaggcaagttgctccatctctctgagccacagcgttttttcccctgtaagacaggcttataaatgcccatctcccagagctgtggcaaagagtcaatgagatgccgtgcagccgagccatccagaggcggtagtgcttcctgggatctattgcactggccaaagatctgtttgggtttttccataacatcttatggaaaaatctgaatgaatgctttggccaacccaatacatcatcatgtgtctgttttcagtctgagcgtgggggcacctctctctcgggaggaggggttagcgggtcttgttagcttgttccctgaaccctgtgcagggggtggcgccatgcaggggtgctgggagcatctgtctgattctggggcaggtgtgtttcctgcaggactgctggccccctctgcatcacccccccaactgttgtctcccacgtctggcttcattcaaacccattctcttacccttagggacaggaccgtatgccctgagaagcacggactgaccttgtcctctgtctgtctccagatggttgtagataatcttcctgacattcctcttggggtgggttctctcggcttctccaggggtcggggggcgggggttgtaccagctcgtgttttcctcatgagattggtggggatggagatgctcatccccatttcgggcaaaagataaagatgtgaccacctgctcagggttactggctgatgaggggcagagccgatccccaagcctggcccctccaatcaaggtcaagtgtccctttgggttccagttgttctcggaagctcagcagatactggctcctcttaagtagctctggggcccctccctctcccctgtgtatttctgtccccctttctggaagcacatcctgggggccagcagccccctggtcactctgtctctctcttttgttacttgctagattaccagtttattagacaaaggtggccagctggaagagatgcagagggcggggtacaggaagacagagtggagaatccgtgctctgagcacaccagtctctccgaatctctacgtgtcctccccccacccctgttcac

SEQ ID NO: 55348 - DNA, 1085 bp, Bovine  19866880659054
ttctctgactaatgtaaaatgacagttgtcgcaacattctatataaatacaagtctgtttgcgggagcctgttctatttttaatgtaaaccacacctaacttgctctgaaggatggtacccttggaatttggagtcctgtctgttatctcttcatggtcctgggttgttttaggagcagcctggaagaaaaactaaaggcaacccaaactttgtagtttaatgtgagaattattcacctaattttcccgcagctattgtgttccttaatttattgttgtgcggagctgcgagaggacgtggttaatgagtgacacagtgcacttggtgagctgatctataatttaggaggctgctgatggtcttagagctgtctgcagtctgagcaaagcaggcagtaaaaataaagaatatactcacagattatataaatatgcacagatccgtggatacatgcacacacaatatctattagcagcctgttgcccccttgacatcaagggacatgaacttaccctttcacggtgaatggggaaagctgatatagggttttgtaagtttacagtggactctgtggatggccctttggaggaccgtgagcttatggagaattgggggcagccaagagattccatcaaaggcagtaagcacagtgaccttaacaccttgccccctctcctttctcagccatttcttcctatgcccatttgaaatgccactggcaacaggatgccccttaatcacagcagtgggcaccctacagctaattagctctccagagctgaaccaataggagacttggggatggcacccttcacagttttcagacaggaatggcaaccatgtgtcagaacttgactctgaatgggatgatgagcttccccgatgagcctgggctctttggcagttaccaccgagccgtggaaattggcatcagtcgaatccacttgtccttcctgtcaatgaggaaaagaccatggggtgattacagaggtgcaccttcattcaaggtcacacctggaacaaaaagcatcctgagtgggtgcaaatagaacacacttttctttctgctctgaaattccctttt

SEQ ID NO: 55349 - DNA, 910 bp, Bovine  19866880665462
ctgttgtagctcttgaacaaacaacgaacagcttaaagccacagccagacgctcccaggaaaggaccccagacctgctctctccgctcacctgcctcactacacccatctcagtgccccagtacccaatgtcgtgaactgggaatgcagaagaaaaccccggcagactcgtggaattctcctaaactgatggccatgttactcctgagaattcagatactcctctgtaaagatgaggccctaacactctggcaggaggtaaactcacaaagcaatgaccttaacttcgtaaattaattccaaagcacaattgttttcgatctgcatttaaagtcagcctttgttaatctagatttaatgacataggaaatggaaattcccttaataaaataagttatgaatatttatcatcccattttacctgaaaaattgaataattcatcaattaactttactattaattatttaatgcaaaattaataaactgcgaaactctgccatacccctgcagaccctctggcactgggtaaggaaattaaacaccagagaaatggcatgactatgggtaattccagacataccccagtgggataatagggggctacgggtggaatttttctccaagaggaagaattctcaccttggaatgctgtaccacagccagaaaaaaaacctcaaagtttggcgattatttcaaaagagtggttctcttgtgcatccgcctgtcaccatcaccatcatcaatatttttttcacacatgtgtggatggactgtgatgtgaagcctatccagccacagatcccctcgctcttggaggtcctgtcctcccccgcggcctcagacaggaccccggtgtgaggaggatgggtggagaaggggaacacagtacaagggacagagggacaggtgg

SEQ ID NO: 55350 - DNA, 889 bp, Bovine  19866880689414
aacatagaaactttgaaagacacacagtggcatcaaggcagaaaaacagtgaatcccttggattccactattctttgctggcacttgaccagagctcccggcctccatccctccctttctcctttcattcataccgttcttccaccttagtacttcctgagcatattaagagttcagacttctggatatacttcagtgagttaaaaaatgaacacacaacaaacatgttctgttctcgtggacacagagcttacatttaggaggaaatgataatgcacatttaatgactccctactgtatgcctggcacacagcttcagagcaccagagacttgacccagatagactgaaatctgaatcctggttttgccaccatctgcatggccttggacaatgtccttaacttctcagaccctccagtgctgctggaaggaacctggggtccattggatggtaacattcgtgaggtcacagagctccctggagtgggcttggtctccataaatctcagaaatatgtgcacatccctagctgccggggaccgaccggtgcaccactccacatggaatcaatagacttaatatttaataataatctgctgaaaggcacttcggtcagctcatcgcatcaatgctgcactaataacaaatcacttcttaagttattaacctcagttcctttcatgaagctctggttcagtgtgtggtggggagggaggagaatgagcatgggcccctctgcagcccgggaggccaaggtggccctgcacgtgctgtgtgatgggtgcctgggtgtcagcagatggccacaggaggtgggggtgggggtgggggtgatggttggggactgggcattgctgctgagtccaccggcccaggagatccacctca

SEQ ID NO: 55351 - DNA, 3363 bp, Bovine  19866880697981
gtctcttaagctagatttatatctgattttgcattgaactgtgtcgttatgcggggctgagaaactcttacgaaattaagcataatgcaaaaacatgctgaaaagacagttctgtagaaatgtgaaacattattatgttatagaatattggagtgaagaaatatgcagaaaggcacaattaccatggacattttccttttaatggtccttgtacaatccttggcagaaaggtttgctgacgtctcctcgcagataaaggaaaattgagacaatattgatattctacatccagcttgattttcagagaagaccaggagagcgacccagtctgtttcatgttctaaacactgaggcctggactgtccagactgatgctcacagggaccttgggagcatctgtcgtttgcctttggggatttggccaaagcctacactccatggatggaccaagaggttgagatcacatgttaccttccggatgaggagctggaagcttctagaggctactagattggatgactctgagttgtttgttcctttatctgaagagtttttaggatttgaaagtgtctgtctaggatggtttaggggtggtcttagggattaagctttattgcttgcagctgggggcagggctgtgtttctcatggtgattgctctccactccacaggagaccatgcttagcctcatttcccctggaatccccctgcccagggatctggcttagggcagaaaggatatctgtcatgcatccctggggttttgtccttccttctgcccacccatcaagcccgaggctccagtctccaaaatggctccagagcaaatgcttctcttgctgcctcacctcgcccctcactggggcgcttctggccccttgatacagctgggcggtgggcagaatccttgtttcccatcttgttcctgcagaccttttggctgaagttgtgattccaggaaagggagcgctgtttccttgcttccggattcagtcccaggcctctgcctacccacgagaggtccagctagagcagggctggttggcagcactgtgctcacaggccttctagaaaacctcctccccttcccacccccctacagcctcccagcaggttctctggcagactgaagcttttccaacaacctcccagagcctgtgcccttaagcctggcattgagaggccaccagctgtggggggaggggaacagaggctgaggtgcaccctgggttggagctcgggcgcctttggcattggtgcggggagcatcatctgaggagcccatgctgggttctgctcagggtcaggtgacagccagctcagtcttcagccagcaacctggcggttgctcccatctctcactctctttgcttccgctcttcttggaagctcttaaaggaccacaaggcctttattacttagagttgcttgatattaagcaatttgctgctgctgctgctgctaagttgcttcagtcgtgtccaactctgtgcgaccccatagacggcagcccaccaggctcccccgtccctgggattctccaggcaagaatactggagtgggttgccatttccttctccaatgcatgaaagtgaaaagtgaaagtgaagtcgctcagtcgtgtccaactcttgcgaccccatggactgcagcctaccaggctcctccatccatgggattttccaggcaagagtactggagtggggtgccatcgccttctccggttaagcaatttaggtaattctactttggacctgcaatgtctggctcttgaccaccagaggtcactgtaataaggtagaaagcaggtgtttaagagcgtcttaagttgacagttggatcaaaaagaaaaaaaaaaaccaaaaacccagacagaatccccctaaattttctaaccggcccgggtgtgctatggggtgtgggcctgcagtccctgctcaccttctcacttgtggagggtccatcctgctgcagagcctggcaggacgagggcaggtgggtgcttggggaacatttgagtccgagaccctgtgcgggccctgtgcagcctgactctcctggttctgaagtggcccacacttagtgggaaggggttccgctccctgccctgagcttcatcctcacaacccatttcctgcagcagtcttgggggttagcttctcttaggagtgtgtgtgtgtgtgtgtacactcctctataacgtgggttcagtaatagtgttgtccacctagagctgtttggttaaaaaaggatgatgcacattgtgagcttaaaagctcagtgcttggcccatatctcatgcttgatgaatgtcagccagaataatgctgtccttagggggaggatcaaaggcaacattcacacccctagatggtggcttggactctttcttggggaatcaggaggctcccctccctgccctctttgggcatctttcctgtatgttgatgccattagtgcaaaaaagtcagaaatactggcctttactggcagcagttctgggatattttttccgggaagatgttcttgtccttggtgggtggctggtaggagaacttgagggctttgaggtgggagacaggtgggctgcatttagcaaacactggggttctcttgtctgagcctttgtgaggcttctcatgtgcgtgtttctctcccagttttaaatgcctgagtttcctgaacacagtggaatgagagatgcacacaaatctctgcgaggagccaggctgcatggggagaggcggtttgggaggcaggtgttcacattcctcacagggaatgtttggaggatatatgggtcttggggagggtggatgcctttcctgggccctctggggggccgctggggctgccagtggatgaggtcaggaacagtgatctataggatgccctgctgccatccgccttcaacgggaatttcccctggatgcctctgcaggggtggcacatggacacacacacacacacacacacacggaagatcaccagggctccagagcaggtgctcagtgccatgaccatggggctgcagctgttgggcctgtgaactcaagcccactgactggtcacagggtcctattctgaatggctgggaggtgggagaacggagagagacagaaagcagtattcttggggaacccctggcatctgcaatgtgtgttctggtttgatgggtggcatgaactgggaggggggcttcagcaggttcaaaaggctcaggctggaaaggcacaggcatgattagcacatgaggacgggcgtccagtgcacagatgtagcagatctgagagaggagccgtgcttcctgaccttgaagacgtggtatttagagcctgaatgagccccgggcaggaagatccc

SEQ ID NO: 55352 - DNA, 2331 bp, Bovine  19866880713782
tgcaaaaagttggacaaaactgaataactcatacgattcattacagagtattaagtagagttccccatgctatatggtaggtccttattagttacctattatatatatttaaaaaatgctccttggaaaaatagctaggtcaaacctagagagtgttttaaaaagcagagacatcattttgccaacaaaggtccttatagtcacagctatgatttttccagtagtcatgtatggatgtgagagttggaccataaagaagctgagcaccaaagaactgatgctttacaacttcggtgctggagaaaactcctgggagtccgttggactgcaagaagatcaaaccagtcaatcttaaaagaaatcaaccctgaatattcaccagaaggattgatgctgaagctgaagttccaatacttgggccccctaatggaagagccgaactcactgaaactaataaaacactgtgaatcaactatactctaaataaaaacttttttaaaaaaggctgactctgatgctgggaaagactgagggcaagaagagaagtgggtgacagaggatgagatggttggatggtatcactgactcaatcgacatgagtttgagcaaactcgggcagatagtgatggacagaaaagcctggcatgctgcagttcatggggtcgcaaagagtcagacatgacttagcaactaaacaacaacaacaacaattttatatatagtgtatatgtgtcttgcaaagcccaaggagctttagaatctgggaagggaaatgaatgaccccgggacttcacgctacagcaatggggcaacaagagtgaccacgagtggcactgctttaagccccttttttaagtgaggaaaaacaagttacagaatgaaagacaacttatttcaggacctaaaatgaattaatgacaaagctaagatgaagccagaagtggctgtttaatatccaggcttcttcaaatcaagaaagttcagtgtaacataacacctctcctttctggcccgttcttggctataacaccaggggggcctgagcgccttcctgaggtggcccccctcatatgaactgccctgggaatttttttttttttttttgaccaagccgctcaacatgtgggatcttagttacctgaccagggatcaaaccctcaccccctgggtaagaagcagggagtcttaagcactggaccgccaggcaagtctgagctgcccaggttttgctgtctttcttttggcagaagaaaggagaggtgcctgcagctgctgaagctctcatgcccagggaattggcacttccggctacttcccggcccgcctctcaggggagccctccttcctccagagaacacagggcacatcgtcccaaggaaccacacttggaccctgaggcccgagagcctcagaagatgagaagcaaggctggggaaaggaggggccaaggaaacgagcagggagccgcagaggttctcattaaccaagacagcctcacgctggcgtcagactttataagtctcaactgcacgatgctttttaaaatataggtgcaatttgggcctgtggttaatactgtttaattttattttgtaccatgtaatattttcccaagctgggcctggagtaaagtcttgagtttcaattcagacctgggtgtcttggcaagttcacccagtcagcagcccgtgtgcacgcccacggccaccccactgcctggcccacttaccgagtttcagtcaaggcccacagtgactgagaatgtggctgttcagatcctgcggtgctccccctcccagcccaccctccagaggaggagagacctggaggcctgagacggatggcccagaaatgtccactgctgcacatctatcctgttgactgaaccgagctcccattcctttgtttattccttcaacaactatttatgcctcctgactctgcgccaggcagtcttcatccaatttttggtctggaaaatatgatcactgtcatctcaatgaaaggaggtgatgctccaagagagaaattgcagcttctaaacccagttccagcacttccaagctgtgtgaccccaggcaaggcccccaaattctcagcatctcttgtctgtcttctgagggtctccgtgaggtctgggggaagggaagccggaaacaccctggcacagagcatggcacgaagctggggctcaataaatggcagccgctcctttgtggcaaatgaagtcagactttcccagttgcatttgggttaaggcccaaccataaaaatgtgacgtgaatcaggaagacacccataagccaccaggggcctcgcggggtcaaggag

SEQ ID NO: 55353 - DNA, 1819 bp, Bovine  19866880716968
cggcctaccggcggctgtgcatgctttaccaccccgacaagcacagagacccagggctcaaatcgcaggccgagcggctgtttaacctcattcaccaggcttatgaagtgttcagtgacccccagaccagggccatctatgacatctatggcaagagaggactggagatggaaggctgggaggttgtggaaaggaggagaacgccagctgagatcagagaagagtttgagcggctgcagcgcgagagggaggagagcaggctgcagcagcgcaccaaccccaaggggaccatcagtgttggcattgacgccactgacctttttgatcgctatgaggaggagtacgaggatgtgtccggaagtggctttccacagattgaaattaacaagatgcacatatcacagtccattgtggcaccccaacagcttcagacacagccatcctctctggaagcctctcaacccagaatgggaatggagggggttccattaactttgcgctcagacgagtcacttctgtgaagggctggggagagttagaatttggagctggggatctgcaggggcctttatttggcctgaagctgttccgtaatctcacaccaagatgctttgtgatgacacactgtgccctgcagttttcatcccacggcatccagccgggcctcaccactgtcctggcctggaacctggacaagaatacggtgggctacctgcagtggcgctggggcgtccagtcagccatgaacaccagcatcgtccgggacaccaagaccagccacttcactgtggccctgcagcttggaatccctcactccttcgcactcatcagctatcagcacaaattccaggatgacgaccagacccgagtgaaggggtccctgaaggccagcttcttcgggacggtgatggaagcagagaggaagatctccaggcacagtgtcctcggggcggctgtcagcgttggagtcccacaggccgtttccctcaaaatcaagttaaatagggccagtcagacctacttcttccctatctacctgacagaccagctgctgcccagcgccgtgttctacgccaccgtggggctgctcctgctgtacttcgctctgcaccgcctggtcatcagaccctacctcagggctcagaaggagaaggaactggagaagcaaagggaaagcacagccaccgacatcctgcagaagaaaccagaggcagaagctgccgtttggttgatgcaggaatctgtccgaagaataatcgaggtcgaagagtccagaatggggctcatcatcgtcaatgcctggtatggaaaatttgtcaatgacaagagcaagaagagcgagaaggtgaaggtgatcgatgtgaccgtgcccctgcagtgtctgatgaaggactccaagctcatcctcaccgaggcctccaaggctgggctgcccagcttctacgacccgtgtgtgggtgaagagaacctgaaagtgctttaccagttccgcggggtccttcatcaggtgatggcgctcgacagcgaggcactcaggataccaaagcagtctcacagaattgatactgatggataaactacttgagaagccagattcaaaaggggctgcaaaagaatttccccaggagtcaacaaattttggaaagaagcagggaaaaaaacccagaatcagatgtttattttgtatttgcatagaaagtggtactggctcaattatgtgaagggacacacagatgccccaaggcaaccccaccaggaccggaaccgcagctgggcccgagtctgtttccaaggatcatgtccccgcagggaaggcccg

SEQ ID NO: 55354 - DNA, 1948 bp, Bovine  19866880767238
gatcacccccacattgaaggtccctttcacaaggacagagggctgagcaattagagaggcaggtgttactatgccaacctccaagggggacagaccctgggaagctgaccctggtcaaggtgtcgaggaagttgtgtctgcaaattagcacctccttccttggacagcctcaggtgctacccattaatgaacgtattgaaccacagacagttatttttggggactaaagagaacagaggtgtttgaaggcaaggggcttgattcgtggaagtaaggcagatctcatgggcagaggctgggtctaggtgtggacgctgaggctgctctgtgcctagaagacatcttccaggctgccttccctggaactagctgcccttctgcactccatggcgtgtgcaactctcttgtctcagaacatgtgccatgagcagtggggggcttgctttcccatctgctggaccccttccaagtgcatcctccaggtcgaggagatccccaaaccgctgggacccagactaacttgaaccaaagtggatacagaaagtaagacctatggagggaaaggccagaggcagcaattcctgggcagaggcagtagcaagaagttgcagtgatgcagacaaggccccccaaggaatgggttctacagagagcagctgaaaatcacaggacagggtttggaaaggacccaggttcaggctgactgggtggatccctcagaccctcccactcacacagcaacaccttctactaggcaagatcatcaacacaatcaattggccagaggctgggtggcctcagggctgtgcatcagcaccatggacagaggatccaggagccaggcttcgattggagcttccagatggctcctccactcccctctccacattgctccacagcagacatcacagatcgattacagagccccttccccgagagccaggggctcctgctctgccaacagctgtcccaatcaatccgacagccaaaggtgtgactctggaagccaattttacacatgtgccgacgacaatgaacccacgtgagaaaacaaacatgtgattttaagccaaaaggcttttctcagtcaggggcacagtgcccagccttccctgtcctcatttgaaggaaactgaggtaccctggaagcacctggcgggactttatcctcacgaggcaggcaaggactctccccgccagtttctccttttcctggtacctgacattgcactgggccaattgcacagctggcctcagtgccacatgtcaacatcaaagctgaccagggcgcctgggcccgaggccgccgcacacaggagccccgcccgactcagccccctccgcagacccttccccagtaccagagacggaagaagaatccagtcccagccacctacctgaaggagccagtagcacctccggtggaaggtggggatgatggaggaatggacatagcagccgtacaagcactagggagagaggaaaaacgagaattcagttggaaagagggaaaggaggaacagagaacagagaaggagcaagaaagggccacgcacactgccaccaccccagggagaccgaggggtgggtgcctccacgtctggctctacgaccaaggctaaggtctggggtacacctaagaagcatagttggaacaccccagtgggcaaacaaggatggacagctggggtgctcacccttgtggggccatggggacacgtgagaacccagacaaggcaggggccaggagaatgcgcataggtgtacattatgcccatcactttagggcagttaccctgggagttaccctggtgctcatgcagagagtctgggttaagaccctttggtgttcggggagggactgaacagacacacattccagacctttcctggccaaggagagtcctccctggaggcccctggctgggaggagcttgaaggctggggg

SEQ ID NO: 55355 - DNA, 1210 bp, Bovine  19866880768753
aaaattaattactttgtcaaaaatgaagatcatgggacttcccttagtgctccagtggttttaagaatctgcatgccaatgcaagagtcacgggttcaaaccctggtccgggaacattccacatgccatagaacaactaaacccatgtgctgcagctactgagcccacgcttgctagagcctgtgctctgccacaaggcatgccatcacaagacgcccgtgcaccgcaacaaagagcaggccctacttgccacaactagagaaagcccacacatgactacagagacccaggagagccataaatacaaatgaggatcatggcagtacctgcccatgctgggtagggatgctgccaagtcactgaatgagatggtacttgccaagtgctagatacaggagcaggtattcactagatggtcactaaatgatgcacagcatccttgctgttgagtcatcggctggctatggtcaggaaggagggagcccaagaagagaagtagaaccagcaccctggtcaggcctccgtgagctggcagactgtgaacagaaagggtgctctggccacttcaaaatgtatctggtttatgttatttattagttaaaaatttaattatatgaattgggtagggacgtgccaccagggatgctaagtaattagaaattaaggaaagactatggatttgtgttcctgaattgattccaccaaaacacacccaggtaacaggaaattaagtttaatgtctgcacgtgccagcagaatgtggcacaaaaattcagaggattaaaaggcagaagagagccccgggaggctctcccagctgccatttgacagactagctcccagggcttccctgatggctcagtggtaaagaactcatctgccaaggcaggagacacgggttcaatccctggtctgggaagacccaacatgccgcgagacaactaagcccatgagctgcaactgctgaaaccgacatgccctacagcttgtgctctgcaacaggagaagccaccgcagcaactagagaaagcctgcgtgcagcagtgaagacccagcacggccacatggaaataaataaatcttcaaaaaaagggactggctccctgaactagagacagtcataagaccagataccttgatcacagctctcagaatcagataggaagcacagatgagactggtcacccaagacctgggttcgattctcata

SEQ ID NO: 55356 - DNA, 2230 bp, Bovine  19866880787874
atggcacacttagatgggtaagagggcacatttcacactaggcctattctggcacaattttaaacaaaattttaaagtgttctaaaatttattgtttagatggggaaaccatggaaacagtgacagattttattttcttgggctccaaaatcactgcagatggtgactgcagccttgaaattaaaagacgcttgctccttggaagaaaagctatgaccaacctagactgcatattaaaaagcagagacattactttgccagcacaggttcatctagtcaaagctatggtttttccagtagccatgtatggatatgagagttgtagcatcaagaaggctgagcatcaaagaattgatgcttttgaactgtggttttggagaagactcttgagaatcccttggactgcaagatcaaaccagtccatcctaaaggaaatcagtcctgaatattcattggaaggactgtttgctgaagctgaaactccaatactctggccacctgatgtgaagaactaactcatttgaaaagaccctgatgctgggaaagattgaaggcaagagaaggggacaacagaggctgagatggttggatgacatcaccgacttgatggacatgagtttgagcaagctccaggagttggtgatggacagggaagcctgccatgctgcagtccatggggtctcaaagcatcgacacgactgagcaactgaactgaactgaaaatgtattgtattgatggctgcacaacattataaataaatcaaaaccactgaattgtggatttaaattggatgaattgaatggtctttgagctatatctcaataaagttgtttttgaaaaaatagtgatagtcagatgagggtggattatttcagaacagtgggcagggaagaacaatctaagaaggcaaactttggtggaaattaccgtcttgcggaggttgatgccctgcccacagtggcaggtctaagatgcaaacccaggcctgccacctctagagctaggactgctctgtttgcccattctgagttctgtttgtttttctgcttttccaagcctttcataccaatcatctcactctgctctgttccaggcatcctcactttctgtcttttttccagcagacagagtgagaagcagatgctcagggcttgacccaagtcccactgtcagtgccaggaacccacgcaatacagtcctggaggtcagcagacttgttctgcaaagggccagtgaggcagtattttaggctttgtatgagctctgtggcaactcctcaactttgctgttatggcacaaaagcaaccatagaattgtaaacacacagaggtggctgtgttccaataaaactttatttacaaaaacaggcagaaggctggatttgacccaaggaccatagtttgccaactcttgctctagcttgtaatcttctcttctctggaaggactccctgttaaggaagatgcaattggagggagtctctcccccttaaacgtgtgtccaggagaaggcatgtgaagtgctccaaccagctggatttccccagggcaacaggatgaaggaggaatatacacacagaaatatctgcatagaggagaaggttaagggaaggcctaggaagtagccctttgtggatggttgctttcttccatagacagccaatgagatgtcatccatccatccatccatccacacatgtctccatcagtctgcactaccttattctcaaacattctcagctcctattctgcacctggctgtgaattagaccttcaggcttcagtggagaacaggacagagtccctgctctcaaggagctcccactacaaacaatcccatgcatagtctataaacccagggaatggatgataaagataaggcatggagtagccagaatggttcaccctgggatcccttccttctcagaccaaactgaggccgactcttgtcagcagtccctcgaattctttcaggactccagctcctcaaccctaaatggtctctgagggtagaagttttcccataggactgtaggccagcctgcccactgagctctggatctctgtcccaggcaggtagaggcctgccattcagtcatgcagggccctcaggagctctgtgatctggagtgggaagagaagtcggtccccaaggacacacaggtggtgctgaggagtgtcttggctgttgggagggaggtgggaccatgaagaagagaagcaatgtcac

SEQ ID NO: 55357 - DNA, 1625 bp, Bovine  19866880787875
accccatggactgtagcccaccaggctcctctgtccatgggattctccaggcaagaatactggagtgggttgccatttcctactccagtggatcttcccaactcaaggatcaaacctgcatctcttacttctcctgcattgacctttaccactagcacctcctgggaagccctgaaagtccttttacccccttgcaaaagaagggggccatgtagtggtcagaatacacacctggtttaaaggctgcagagaggacacaggcccttggcgtccatccctcacaggcatcgggcagccggctccaggccaggcctccaggaacagccgcatgcctgtggacttgccaacagtccgctcaatgatctgtcatagcctgtgtaagcaaccactcggagagtcaaatcctcagaaactgtgttcattatgaattggctgctgcttccgtggcttcaggaacataaaccaaacagaaatatggcctctgggccctgcccccgccatgcactctcttcccgaatgggccctgggagctatcactcggagcaagatgtgaaaggtggcttccgtttccttaggacacagagggatggatgagagaaggacctgctcgaggggctctgtggaccaagcccagcactgagcctggatggttcactctcagccacccttccgttctcaggacatgaaatgtggaaccatgatcattcaaggcttcccatggggggccttgccctggccatgtccacctcaattgcgctgctggtcacttttaaatagaactttctgcacctcttcagccttcccaagtagcttacataacaagccctgtgcctggcaattaaccatttctgggcttacatgctcgttctaaccaggttggttcccccatgccaggtgtccatgtcagagtcccaccaggcagccctgggctttgtggacagcccaggcctctggtgcgcacacatacatgtatacacactctctcctgtacacacacacacacgcactctcctgttccagccccaggctgccagctagcagagctgctcagtcccacttggggcttcatggcaggtcagctgcgctcaccctctccagtgacctgaaccaccccaagtaacccctcctgacatacatccaggttggcaacagccaggcagacgctgggagtgtctactccagacgaccaagccaggcctttgttgttgtgtgtccttgtgggacaatgaatgaagaaacatccccaggtgcccagaacagggctgctttttgggcgggaaagcctagttattggagtcagtgagtcagtggttacattttaattaatttgataaataattatgcctttgagatgcccaatctgccttacaggtgctcttttccatcgcagataaattaatcttatttaaccacatttcactcactacacaaacctatgtctgcctctaaaacaggaaggtggcagaggtctcgttttctgcattatctgtgaatacatctacctcccctgactggcagaattcctatgccccaaatccacctgccaggtttcccccctcccctgtcctggaggacacacatgtagtgcgagttgccatctctctgaatccaaacaccggcttctc

SEQ ID NO: 55358 - DNA, 696 bp, Bovine  19866880803882
gcatggtcctgccccccagaagcacccaagcacacctccagagatggtggtaaaatgtggactcggtcatgggaacaactgggtttccctaggtagggaaaagacaacgaggagggcctggcaggctgcaggggccgatagacccctggagacctaagggggacagtggtcccaccccatacctttatccagggcatcggaccggtgccaggccgcccagagcagctggagcccatgtgagaggatttctctctgctttgcagtgtggtgacacccctggccctgagctgcctggtatcatcatttattccttctctcataaatcctgcccttctttctgcgagctttgcactcctgttttatgggcgcctagcctcgttcgtaaagcacccaggtatggggaagcctctgcctgtgatgatcagagggctctcagaatctgctcagacgacaaatgcaaccacagaatggactcgcgaatgctgcagacttgctctctgcctcccgcctcctcccaggccggtggcgctcagtcccggcccccaccccctccccccagccctagtgggggaggtgtgtggccactattacatgctattatgactttctgggtaatgtatacattttcaccatcacacggcctctctccttcatttttcatgagaactggcacgagattaatgaccgagccactga

SEQ ID NO: 55359 - DNA, 822 bp, Bovine  19866880817299
atggaggtttttgttgtgctccctggaagctggagacagggcctctgggaggaactggcagggcccctgtgtgaccccaggcccttgctgccgctctctgggcctttccctccattgagaaaccttaaaggttcaattctacctccagaggctgctgggagagtaattaaggttacttctaagtatgtaaagtggtctttggagacaggcctagtgtaaataaggttggttttattattaatagtaaacatttcttaaacacccaccgagttccaggcagtgcacagaataccaaagagacccccgcccagctcctgccaaatttcctgctggccccgtctacctccctctcccgccatggttgagagcagggcctaagccacacacaggcgggcccaacttcagaaagatcttacagtcatggctctgcacacctggttaaactggtgtgacacccagacctcagtccagccaggatgcagagtcccccatgggagctccaggtccctgggctgtgtcgcacttagtaagtctcctgccgtctccgggcctcagccccctgatctccacaaggggaggaggtgggatgcccacacaggacctcccacagccagggagccctattctaggctagggagctggtgagaccagttcaagccccaaatctgtgtggttgatactgggagcacttcacatgctcggacattacccagacagatttcctaaggctcctcttgctcacacggtcctggtgccgggggatgttaaaatgggccttgtccccaaggacgttgcatgtgatggggaaaggctgaaaacatg

SEQ ID NO: 55360 - DNA, 1340 bp, Bovine  19866880820031
gatgagatggttggatggcatcactgactcaacagacatgaccttgagcaaactctgggagacagtggaggacagggaagcctggtgtgctgcagtccacggggtcagacacgacttagtgactgcacaacaccaccatgtttctcttacgtagaatccccagaaggatgaaaacatcatgtacggccataacaagcaagaactgacctctcacccaagaccctcgccgtgttcccaaacttgctgcatgttcagctgtgcttccttctagaactttcctccagccaagccttgagaccctgtctgtccctttacgtcccagaggctgcaggctcagtctaaacccagggcaggggtgctcatacttcagccaggaccctgagttcacagacctctgctctggaccccaaggcgctgtggccaccctacacccatcctgtgacagaggctggctggcccacctgacgtcacaggaaccctctagctccgatccccaccacactggtctgtggctctaactgccccttccgggaagctccagcttcgctctgtgaaaaaatatgaatgcaggcagccaggctccctgcctccctctgctctctgatcctttaatctgagactattaaaacttcatcccactcctattggtaaaccatcaatcaccgtcaccaagcagcctctggcttccagagcccagcaggggagggcagtagggggagcgggggaggccacagctggtcactgaaggcccggacgcaggacggaccccctgcaagtccctctcccctggatgcagcccaagctccagagctgctgtgaccttgagaaggactgagctgctgggcgatgggaggcaggcaggaggctcatgtctggggtggagaatggtcccatggccttccatattggtcactcagggccccttgcagtgggggtggttggcaatgcccatgtctggcctccgggggcaggctcccgggggcagacggtgccatcagcacttgcagcctcctctttcctgagctgcagacacatcgaaaaccttgacctttctttctgagcggcccccagcttctttccgggttcagatcccaggctcccgtgtccttcttcccagagtgatcctgacctcaggcaggagggacgggggttctgggctcagctcttaaaggttaacttccgaccaggcagccccagcccagtgcttacaggattatgggtctttttcttaattaaaaaaaatccaattaaattaagatatcagaactaaataacactcaagtcattactgtgacttttatcttaatgactacagctgctgaatccttttccagtcccga

SEQ ID NO: 55361 - DNA, 728 bp, Bovine  19866880880349
cctgtgagcccaactactgagcctgtgcattctagagcccatgctcaacaagagaaaccactgcaatgagaagcctgtacaccacaactagagagtaacctcccgcttgtaacaactagagaaagcctgcacagcaacgaagatccataaataaataagtacaaatttaaaaaagtaaagctaccaggctttttattgctgaagcctataaatttcaagctcaaacttccaggctatatctatattactgtatctcagcaacaaaacctccacaaactatgttcttttggattgtgggaagtctgcctaattactgcaattggagattcatgactgcccatatgctccacgacaatctgatcgaaataaactgcatcagctaataaaaggctgtaattttttatgatactttgtgctcacagaatttaaaggaaaaggcagatttcagagctaattaacagcaagacagcatgggtactttgtgctgagcgagagccgcttcacgaagagaaagggcgctagagtatgtggtgtcgttgagtagattctgatcacacagagagactagcttgtgtgaaggttcccacacagtatgcagcttcagaagaccagaaaactgccctccgcatggccctaccctcttctgatgccactttccctgctcagcacagtcttctactctttttagttacttatggggacatctttggaggctctggaaataagtt

SEQ ID NO: 55362 - DNA, 1156 bp, Bovine  19866880908076
atttttgtatattcccaagtatgggaattaattatactgaattacaagtttttaaaataggacttttgttagttgtaaaaaaaaacccaaaagagtcatgattagtaaatgtgaagatgtagaaacaaaaaacagcttttcagctggggaactggtaacaatttagactataattctgccacatagcagaatcaccaaacttccagttccattaaagatatggataaaggcttgacacatcttcctatgttgttttttttaggaagcagacccccatcagatgaaaactcctgaccccaagaacatagagccttgactgattgaaactagacaactgatgacactttaaacttcaccttgatgccagccaatctgagaattatgcatgagctgatcacatgctctgcagccccctccctcaaactgcctttaaaactccttccctgaaagctgtgagcggggttgggtcttttgagtatgaactgcccattcttcttgcatggtgccatgcaataaatgctgtaccttccttcaccacaccctggtgtcagtggattgactttactgcaaacagacaagcggacccaagtctggttgggtaacattctgaggagtagagaagatctcatgagcagagcttcagccctgcgcccaaatagtgtacagcctacccaaagttctctcctttccttcctgcaggaatgccccaaagctgaactgcttgaccgccagtccaatctccaagcctgctccttgcctagaagccagaagaaaaggggtggggtagagaggaggggagggctgggaccattcccatcagtaacctaaaaaccaattatgatgcctgttacctctgagcatgggtctgggggaagtggtgagacagacaatttttattacctatccttttgtactttagttttaccaggtgtgtgtgctttcataataaggtgtgtcttcatgttgaaataatcattaaatgagatttcatttcattgtctattaaagtgacatttttgcaagccttggcattataaaacttcagtagcaatgaatttaagggtacacatagaaaagatagtggatcacttctgtcaccaaagggattgcctgcagcttcccaataccactccatgaatatgaagtgttaagtaga

SEQ ID NO: 55363 - DNA, 1932 bp, Bovine  19866880928582
ctgcatatcagtaaaggagactctgaaggttgaatgacgtgttcaaggtcacccttgggggcctgagtggcctgaaagccctgctcttaaggactatgctcctcttcactgacaggcagccttaggaatgtgaccattgggctaagtcaggtttctggacaaccaaggctcacactacttgctcagcacaagcgggttcactgttgtaactatcagactttgaacctaaggcagcaaatggaaaactcattaaaggaaaccttcgtagactcaccttcacatccctcattaagactaatcacctgcccatcaggttagataaatacctcagggctttaggtacctacatgtgccctggcttaccacccttttacattcaatttctgtggatggccctgccaccttggttgggggttgggtgactgtcccccaaggtcaatcttggctgtgacgggtagaccttcctcatttgctctagccttttcgtctgcagtccaaactcagatttttcagccccaactctgtgactgtaacctgcagccagagtaacccagacaaccaaaaactgtggagaggatgagatgctctacaccagggaaggaatgaaaatgcagggactttgggaaaactttccatttaggtgatgattttgcacttccagtttcatggctactttggaaggaaggatgaagattccagaacactgacctccatatgtgggctacaagaaaagacatttctacttgagtttgttttttatttaatgactgttttttttttcttaacaaaagtatctacaacttgaaaaggagactggctcctttaaggctaaaattgattgggaccagagatcttacaacaggttataaacgttgctgactgacatacataaaaatgaaactctttcaactacaacactggttaaagtaggagttaaactcaattatttaggaataaattaggtttaaaatgtgtcaattataatgtcgataaaaagtatgtacatcaagaaaatttcactaattcttcaggaatcctttctccaaataaattttggaaaatcatctcagaaatctcagatcagagtttgggcctctgatggtgcatatggctacgtaaaccagagatgccaatccagtttcaatatgcctagttaatgataaattattccctcccctcaacgtgtggcaggcagataactactccactctgcagacagacaatgtaggaacactagagaaagggaattagtaaagatcatccaagttttatctagctgcctacttcactctctgcgatacaatttaaaggggatattttaaagtttaaaacatggcaagggagattcttacgcagatttcagacatttctgtattactccatttgttatcatcatgtatcatgcttataaatttaaaactttacttaattagagttccctggtttgggttcagcttgcttccatctgagattcttggcagaaagtcacgaacctcctgaacatgagacttctgaaagcgctctggggtgctggtgggaaagaggaccttgcctcctagttacacttcaatgccatcaagctgtagacctgacacatcaacagggttattaccttcttttgaccacacgtgtaagataaagattacttctattttcttctctaatcttcagctaaatcatggtctttcaacttcaggttgatttctaatttcaccaaaaaatcttagttaaaatcaagtccagagatcactttccgagcttcttttctaatggaaccctggaaaatcacaccacagaggatggtgttctatactgagtttgttagcagcagcaacacaaaatgatttaagccagaggacttgtttcacaggactttcacctacagccagaaatgtgggaggtgacttcactgttccgggagaagtgaaattt

SEQ ID NO: 55364 - DNA, 599 bp, Bovine  19866880933639
ccagctgcttcctgagcaatctgtcaatgccacatgctaacctgaggctgcggttgccagtgccagctgggaggccatctccctcgcaggggccaccagtcaggactccatccagttttctggactttgccaagctcagagcagtgagtcctccctgttcatcccatctgtgagagcgttctttatcacccccaggaaactgaggatgtccagtggtgagggaggaataagtcactgctctcagctaaatggaggagggcggatctgctgggcatggctcctttgtcatcagtgcaaataatgaagattccatgcgctgaggacaatgaaatgagcccctgaactattgatggggtatttgtacaactccgtgagttatgtttcaaaaccaggctctattaaagatgcagaacccttttcagaagcaaaaagactaatattgctctccaaataatttataagtttccccacaaggcagaaaagcgaagttgtctggaagcaggcgatcgttgtttggggtttcctgccgtctctgggctcctcgctcagctccgctgggctctgacagaatctggctgtaacactccccacccgtggtg

SEQ ID NO: 55365 - DNA, 1149 bp, Bovine  19866880937522
tggctgggtctcagcctctctcttacagggaagcagaatgcagacttttttaaaagctaaatgttcaaaaacattccctcagtgctctcctactccaaatgggtacggttttctgcttaactggagtagaactgacatacaatgagctgcgcacttaaggtacgcaagtgatgagctctgacacgtgtctacacctacaagtgcagagtgctccttcgcgcagtcctgttctggctctttgccacccctcaggctatagcccaccaggctcctctgtccatgggcttctctaggcaagaacactggaatggattgccacactctccttcacgggatcttcaccacgcagggattgaaccctcatctcttgcatttcctgcattggcaggctgattctttaccactagcaccacgtgggcagcctcctacgcctacaaaaccatcacctaatcaaaacagtgaacttatccatcttccccaaatttccctcctgctctggtcacccctccctcccgcctccactctcgctgttcaataggggctgggggtaattataataaaattaaaaagaaaataaatctgacaaagaagggaagagaaaggtggaaagagagagggacacacacacaggggaagcaaggaagccagagaacatgtgtttgatggccccatgacagcccagagacacagagcgagaaacagaacgatgaagtgtgcagggaacagagagggacaggcgtgcccatctgtgcgcttcccctccgggacgggagaggcacccaccacttccggtggcttgaggcaccggctcagcagggaccccgccatcacgccccatcgcactgccccatttttcactgtcaaggccctgcttgagcacaattcatcacggccacgttcggaaactaccccgtgtaaatgccgagctattccacctggcaagggcctgactgccctgaaggggggtttctcaaagcgtctccgacaccgttctctggtctgcatccgccatcacgaccccagcatcagggcgggtccacggactcgctcctgagacagagcacagacaagggttaggagcaggggctgaggaggccgcaacggcccacgcctctgcaggatgcaacagctcaggcctgagcctggaat

SEQ ID NO: 55366 - DNA, 2096 bp, Bovine  19866880940936
taaatgccagtgtgtaaaaagaagatgttcatgcctagcatgctggaacataagaaagagcctcagtctcaaggaaggccctgggacagccaggaggggtcccttgatggagagcaaagcccacagctaactggaacctaaggagcaagactgggctgaggttgtgtagccatgaattcttccgaatcccaataaactgccttttattttatttgtccagattatttataaatggatttttcaataaaagccagagctcaggagacatgatggattttccctggcactttgcagggacttgttcatccccatggcgtcagcccagcccagcagtagaagctgtcctcccttcaggccacagattggctttcagtaatttctcagaagccctgggtagtcactaaatttgaactcctgtcctaaaaactcaaactcaataaacacgtattgatatcctactgcatgcaagacctgaggctggccaggtgcggtgctgggtgggaaacttacagaagagagaagcaaagaggaccctaagcactttccgagttagaagagaaaatgcttgtgcaaaaaatcaggcacaacacaaggagccacaatgaggattagaatgtggaccatggtgacaagtggatacttttagttgcaaaaaacaaaaaaaaattctagaaatccaacctactgctccttggaagaaaagccatgacaaacctagacagcatattaaaaagcagagacatcactttgccaacaaaggtccatatagtcaaagcaatgttttttctagtagtcatgtacagatgtgagagttggaccataaggaaggctgagtgccaaataattgatgcttttgaattgtggtgctggagaagactcttgagagtcccttggacagcaagatcaaaccagttaatcttataggaaatcaaccctgaatattcactggaaggactgatgctaaagctgaagctccaatactttggccacctgatgtgaagagccaaatcaatggaaaagaccctgatgctgggaaagattaagggcaggaggagaaggggatgacaaggatgagatggttggatggcaacatcaactcaatggacatgagtttgagcacattcagggagatggtgaaggacagggaagcctggcgtgctgtagtccatggggttgaaaagagtcagacacaactgagcaactgaacaacaacctaaacatcaaacaagtgagcatctcagatcctaggaggcctggacgcagagttggcatcaatgacatcgttgggaacctgggcttctctttccgctgagccttcctctgacttcaggcttgacccacgaagccgcccagagatcacaacagcaccccctccccatcatcacatcttccaaaccctagaggacacaactcacagactgctttttaagaggcaggaatttctccaggagctcctacacatctcagtggcaataactgggtcacaggcaacccctaaaccaatcattggcatgaggggctgagactgatccaaatttactcccttggactggagaggggcctgttccccctaccaaagaatctggccactgatacccatgagcaagaaaggagaggggtttgctgttgggcaaacaatcaaaagttgcccggcctggagaactagatattctctgaagaggttctgcattaaactggctaaatattcacacaaggaaatcagggaactggtctatgttgttctttgcaaggcatatagtagacatccaaatgtttgctagaaggaaggaggaagggagcgagggaggaaggaagtggggaagaaacagagatggcattaagtcaaaagactgcctggaaataggctagagaattcaaacccctggtcgtgcccagggaatcagaatagcaaataccatcatgtagagaaaggaaggtgacgacaccctactccagtactcttgcctggaaaatcccatggatggaggagcctagttggctgcagtccatggggtatcgaagagtcggacacgactgagcgacttcactttcacttttcactttcatgcattggagaaggaaatggcaacccattc

SEQ ID NO: 55367 - DNA, 1697 bp, Bovine  19866880950554
catctcccaaagcttgctcagactcatgtccattgagttggtgatgccatccaaccatcttgtcctctgttgtccccttctcctcctgccctcttcttccaggccctaaatgtgtggcattctggccagaaggccattccataggctcttaggatggggtggcccccaggacacctgtcagcccagctccctcatttatggagaatgcttggtccaagcagaagtggctggcgctgagcacacccacaagcacataccacagccctgggatgggagctgggaaatgctggccctgtcagcccccagctgtctctataccctcattggagtcctgaatctgtcctgtggctcctaatgctgcatccagaagggctgagcagagcaggtggtgctgagatctttagaaatacaactgattgcttcccaagccacagaggcattctgcctgtccctgcccccaccggtcggtgcctctgtctggggatggctcatgggtctggctggggatggacccaggactccaagctgtgagccctggctgcaccttgtaggcatcaaggcctcccagcttcatacggtgtgaatgcctccctgactgtgggaccttgctcgccgtccccgccttactgtttcctggtccctgttgtctgtttgctattaacaggacacttgattttagttggacagcagcaagcaatatttccagaacaaataaagctgcatggacgtttgctctaggcgttttacatttcaacttgaatatgtttatttcagccttgctgtttgaatagcatctccgtgggggatgtctggggatgtttaaatttcctgctcacatgccagtacttgaagtgatgagaaccaggcaggctgggggagggtcctgaggggcaactatgcacccacaaatgggcagtgggagaagctgccacagaaggatatgcagcagaccccaggatatgggcagatgaggctacaccagcccctgggagatccccaccaggtgcttggccaggctatgacctggacatctgatgccatactcactcctcctgtgcggttggcactctcaaggcaactttggggtgtcttctctaccccttctgctcccccaaaagctcagctcaggctccaccctgccagccactccatccacatcctgcctcccggctccaagtgcttctgacggcctgattggaaacccgaggctcagctggtggttctgtaccatcctgtgcactttgggcatctttccatgtgcccagggggtgcatacaactccaggcacccctggcatcacaccacacctccctctttactgcgaggaaagtaaacaatttacagactacagatgaggaacatgtatacactcctgctcagttgtgtctgactctttgaaaccagctcctctgtccatggatttccaagacaagaatgctggaatgcgtttccatttcctccttcaggggatcttcccaacccagggatccaacctgcatctcctgcattgacaggcggtttctttactgctgagccacctgggaacccccagattaggaacagttgaagtaaaaactagtagtgatcaggcctattcactattctgtttatcttttttgttctcaggaaagggaaagaagagaaaggaaaatgcatttctcttttttctttttcactgcaacattatcttgctaccc

SEQ ID NO: 55368 - DNA, 2116 bp, Bovine  19866880962264
catgttcttccagctcctccttctggccttgattcggtgtcattctctccatgaggtcttccatgaacacatgctttaaaaatcacacccttcccatccagcaggaatttctttcctctgttcctgtgttctgtttctctagagtgcccttcactacctgagacatggtgtagtttccctgtttatttaattcacttattcaccacctgacctcctttccctccaaaagtacgacaaggagaaggatttccagtctggcttgttcaaggagtctctccagtgcctgcagcgctgctggacatatagtgggtgctccgtgaatatttgtgaaatgaatgagagtgagtctgaaggttgtggagggagagatctggttttatttcactttatttttgttttgtatagatttcctagtgctgtgctctggggcacttccgtgatgggcttttaagtctcttcagcagctctgccagacatgagatgcagaaagggtgtattatctgtctaagatggcacagccaaatgtgagagctagaatttgaacccaggattatcttacagcaaagcctacaatcttagctttgaggctacacttccgctgctgtggggtgtgaaggtggcccctcaaatggtcccactacttttttctacctcccgtctccattgattctgaaccacctgggagacccagccttcctctgctggtgagcttggctctgggttcctgtgctgacctctggagttgatctagcctctgagttgcaggcagtgtggaggagcacgtgctcccccacagggcagagagcagagcccagcagagcccaggcaggcgggctgcaaaatttagcaagcccaataatgtatttctcctctcctgggaaacatgcaacctttcttggaagtcggggacacatgaagctcaaaatggaattgaaaacacttccttcctagggatcttgtctgtatttgtttggaggctggaaaatgctattaattatctaattaattagatttatgtagatagcaccttaacactgaaacactaaaggtctaataatagaatttttctataatgaacactgaatgcttcttggtcaataagcaataaaagagctaagtagaaggaggggtccggagggaaaggagaagaaaagtgagacctgagtttcaagaagacccaagggactcagcgggagatccaccctcgtctctgggctctcaggaccccacaggtccattgcatattccaccctgggtctttcctatgctgatagtgagaccaagtcttgggtcttctgctcttttctccaaagttctccctcccaggactcttaagaactacagggtttgactactgaccctctgtggaccttccccaagcttgaactctctcctggacacctggctgtcatagtatcatctcaaactcatcatcttccttcttcctcctgccctcgctctggctctgtttctgctctctgatttcccttgctctcagaagagccacctcatcttaaaggctccagggcttaccacttgtcctcctccatggctttgtcttcctcccctggatggaattagtcactggttctgccagtgtttcagactataattcacatgcttactttcctctgtctctgtggcctggccctggccatctgcatcagtcttgggtaactgaacagctccaaccacatccctctccaggctggacttcctccccctggtttccctaagacactcctttccgcatcattgttcttgaaaacctatgggtggagtccagtgctgggttcagggtcctagcgcatttcctccacctccctttctcattcattttctctgactccccaccacaaagcacccactgcagttaggacgctgatactgctctccagacacaccttctgtgtcccctgctttggcttttactcggccactgatctcccctccaacaccccatgtccagccccatctgcccatcttttggcttttgaggtcttcctggagccccccaggcacaccagctctaggggagtctctttgctgtcagcttctgtagcccaggttctttgtcatcaatttttgacaactgagtgatcacaagtgtttaagc

SEQ ID NO: 55369 - DNA, 821 bp, Bovine  19866881013808
tggtgggacctttcctccacacaggcctggccccagctcacagcctatctggatggggaacccacatccccatggttacccacactgtaggatggtgataaataaatacggggaccccagttccagccaagagatgtgagactcaggtttgtttgtgaatttgaggatcagatagttcccacccttatggtctttccactgattaaggtaaatgtctctttaaaaaaaatatttattgtttgtttagctgcttcgggtcttcactgtggcatgcagggtcatttttttgttgttgttgttggggtgaatagacactttagtcatgatgcccaggctcagtagttgtggtgcgtgggtttagttgcttcaaagcatgtgggatcttagttccccgaccagggattgaacctacatcccctgcattggaaaatggtttcttaaccaccaggccaccagggaagtccttaaggcagctaccttgctaggaccatcttcctccaagtcccccaatgctagcagagatggagttgaggggagagggccctgggaggatggagttgggggagctgagggcagggaccaccatcggctatcctaagtggttctttcctgtgggagcttctagggactccccctactaggggctcctcctacctactaggggctcctccccaacttggaccaaaggccttggaccaaaaggcccgtaggttcttggcttttaaactgctaatggggaggccaaataaatatttcaagggtcacccaagggctcccttgggccttgtttattcacagcacctcggccacctcagtgtaga

SEQ ID NO: 55370 - DNA, 828 bp, Bovine  19866881022516
ctttaagcatcaaagagagatggagccgtgcgcactgtatcatgaccctcattaggcaggaaacagtatctgtgattgaggaaagagtctccagcaacactctcgggtgcccatcaaagctacctactcctcatttctcagctctccatgtcttctttgggcttttctgtactcctctatatcacgatgctgtttgcagttctgccacagtgagtcatttcttcttacctagtttaattctatcgtttgtctgtaagattccgtcctagggcatacggtgtccccagactgtgggcttaagatggcaaatccgcgctgtgatataaacataaaagtcattaccattctcctcgagtatatgttaatgacaccgcggaatggtgataattagatgaagcatcatttcacaccatcaccagtgtgctttacatttatttatcgccatttctttctccaaagtcagcaaaatggagactcgtacaatatcccaaagcatccgatgagaaaaatatcctgcgactgttaattactgtcttatgagcctgccgatcccaacattcacctccagcctctttctggggatctccttctgtccctcccatcccagaacccttggacatgtgccctcagctcagccaccaggaatggctgtgtttgtctgctgcatttgactgacaaagcaccacaacctgggcagcttaaacaaatgaaatctattttcttacagtcccggggactaaatccaaggtgtcctgaggcctctccccttggcttgttagatggccatctacatccttagtccatacatggccatccctctctgtgtgt

SEQ ID NO: 55371 - DNA, 1327 bp, Bovine  19866881041852
cagagttatcagctgcctctgtcaacactgggtaatgaggtgcgaaagctggcacctcgcagtaaactgtgagcctgcagacattctcaggcacctgcagctgtggggccctccagtgaaagggggtggtacctggcagcccctgtgaggccctcagggggtggggtctgttctggggactggattggcatgcatctttggaaatctatttatgggatccacggagcattcccttatttagaactggaggaaactgacatcttggattgacagaaacctcccccaaaagcaaaggagcatgtgtttccatttttgaagtggtgatgcttttcttggggtgcacctgagcaggacccaggagggtagctgggactggaacccaatcccaagcctccatcccatctccttcgacagggtcagctggtttcctggtcccctatccacctgcaatcttctcctctgccttcttcttttcccttcttgagacccaaggttggaccctcctgcaggcctactatctcctaagtgccccaggcagatgggatcagggtcccagctcaatagtcaagctcctggcatgagtctctccaaaccaggcctaaaccccagaaggtactcatgccacccccatctctctgtgtccttcatcaactcgccatcaagtctgtctgtcttatcttctgaacaactcaaatccaacactggtgcccacccactgctaacctccaccacagtccttctgatttaacacataggctttataattattccagtggggtggggccaacagatctagagatgactgccactgaaaagatggtttgtgactcacaggtccccaagccagaggggaggacacagcacagggaggtgccacagggaggcagaggaagggaggaaaggtgggcaggacatttattgtggtttccgtgggctttcctggtggcttagtgataaagaatctgcctgcaatacaggagacttgtgctcaatccctgggtcaggaagatcccttggagaaaggaatggcaacccactccagtattcttgcccaggaaattccatggacagaatgggatacagtccatggggtccccaaagggtcagacacgactgagtgactaacactttctctttattcccaagtggcactagtggtaaagaatccacctgcaatgcaggaaacctgggtttgatccctttgtcaggaagatcccctggagcaggaaatggcaacctattccagtatgcttgcaggagaatcccatggacagaggagcctggcgggctacagtcccaggggattgcagagtcagacacaactgag

SEQ ID NO: 55372 - DNA, 1032 bp, Bovine  19866881058046
tcagtgggtgctattgtggttctgactgtggatgtgatggtatctgcggatgcccactctctctgggtcataccatttatgatctggggacagttggcctgaagacactgcagagggtcattgaccatgtttaggaaggccaagaggacagaacaaatcacaaatcctgtcttagctcactagaagccgataggattaatgtcacatcttctccaacagatgatttttctgggatggagggtgtccctgaaacactctcgtgggtgtctttgtttttctttggaggggacaagacaagcagcacccatctatttgatgggatgtcttctttgcttagtccttgggaagtgggtgagtgcagctgttggacttcagggtccttctaatgggtcttttagggagctggctctctgaatatgagaacagggctgcagtggaaagggcttggcacagtggggcccggattccagctttcttgccattcagaaatgaaagagaactgtaaggttttcagtacagactggtaagagcaagacagatatcatcagctgacaggttgtgacaagcgtgccgagctgtttccagattgttttagtcggtgcagacttcagggaggaaaccaacactgacacaaaccaattgcacagtgatcggcaaacaatgaagtgctgggagtcactgctgaaagtctgtaatttccaatggagtcgatggttagtcatcacctggccgctgaacgataccacccggctgggtgggaactacaattagccgctgtcaccctagagtgatttttttcttccctacagacaatggaatagtaagagatcaatagtcagtggtctgtgcccaattgtgaaatggcccatagttcaaaagaaaagaaaagaatgggatggaggcttttgccctgggccccagggaagactggttgcctacttcctcacctctactgcagcacagaaacagcagccagcttgcatcaggaggaatctatgaaacagaaacagaatcctgggcacagagaacaga

SEQ ID NO: 55373 - DNA, 1186 bp, Bovine  19866881091010
tatttaagaaaacctgcttgcctaagactgcaagctgtcttgctgtgggccaccctgtttagagtttatcttacattaaatctccaagccagagaccctccagtcggtctgcataaagcggagttattggtccaagtgtttttaaaaatagatgcaactccagaccccaagaaactgaagggatattatgggaatacacaactttattattgtgttactctatgaaaaattgagttctcagctcctctgttcccctcctgctcctccctctcctggatcctcacctgagagtgcagctcctggcaccaaagacagtaaatattacaaaccagctccccatcagaacagtccagagcacactgcaggggaccaagctcccctgtgcaccataaaaggggggccaataagctccagaatgccattccagctcaaatttcaactaatggtgagcccacaaaaaaatcagtcacagggcgtccctggtggctcagtggtaaagaatctgcctgccaatgcaggagacacagttttggtccctggtccaggaggatcccacatgtcacggagcaactaagcccgggagctgcaactactgagcccatgtgctgaaagtactgaagcccacaagcctagagcccgagcttcacaacaaaagaagccgctgcaatgaggggcccactcatcacaactagagaggagcccccactcgccgcaactagagaaaagccctcacagcaaggtagaccagcacagccaaaaagaaataaatacaatcatttaaaatatatatatatatatatatatcagccacaccttcaagctggattcgtgaatcacatttcatcacaggcctcccaggcaagctggtcttgacaggggaagtccatctggactctgagatttggtgagaaagttccttccagggccagacgtcctgggtgtggcagcctctccaggccaggctccccgccagccacagcagaagtcagaagagaggagcctttattcccgaaaacggccccaggaacagccaatgcccacaagccatggccacagtcacagttcaggctgtgtctggacacaggaaataaagtgcacctgactgggcttccctctactctcagccccagctataaactcacacagtgaaatcataacccctaaggtgacgcgttaggtgatgggg

SEQ ID NO: 55374 - DNA, 889 bp, Bovine  19866881099948
tacttgaaaaccattttcaagcgacataaagtttaacataccggtacatctgcctacccactagattctacatggaatttaaaatttaattatattaaagctttgttacagtgtgcattgcaagcatgctaaccaagtggaactttcacaaaatctctgcagatagcttttttttttccttttaaactcagtttggtaaaagcaagggtttgacaaacagttgatgattctgtccaaagtgtttactgcttacataaccaaaccacttgggacctcagtgtttattctcctgggtataattcatgagttcatcttctctttgctaaagcaagaagcagccaaagaaatcaagtagtcagggagctgagattgaccctttgaatccatttatggtctggttttgtgtttttttgtttgtgtgttgttgacaggaaagattgggagagatttacttattctggagagggtcttttcactgctagttttacatgcaaataaaagaattaccttctcagggtgacaagttgtcatattaatctgttaaccacaggttgggtgctttctgcaattaataatgcaaccagttccaacaggaagaaacaattccttgcaaacttggttcccaacaaagaagagcaaggttaggcttgagaagttggcagcctagctttgatccttagctctgtcattaaccagctgtgcatttttgagcaagttacttcacctccctgagcctattttacaaaatgaaaataatcatcgtatctaattcacatagatggttggaaaattaaagaagacaatgtatataaagctttgaagcatagtgcccttacagcttaaacactcaagaaatggtaattgtatttcgactgtgttattgttgcta

SEQ ID NO: 55375 - DNA, 1233 bp, Bovine  19866881100887
ctggtgatgagcagagctgaaagcactcagctgttctgatgggcatctcggggactgtgggcgtcccaaggaactgacaggtggctgctgggtaaactgtgatttaacctacatgtttactttgataaatacgccgataggaacatgctgcctataaatttcaattctctgcacaagaaaagaaggcttctgtttccaaagacatgggttcccagccctcagctctgcagggcaaaccaggactgcactaagagtctgagatctaaatcacttccaacttactgagaactttcacagcaaaaaaatcaaaacggaaccccagaagggtggtctttggtctgacttgcccccacctccctgttggtggtctcttgtgtttcagacacttgatgtgcctttttgttcacagggctcaggtccagtcgaatcatggcaggtgcatctcaggcctggatttggcttgaaaaatggtttgtcctaaagggagctgtatgagcttcagcaagcagactcatcagtctaaactgtctgcagagtacaaaatccgagcttcctcctaagtcatgctatgacatgttctagttagaagcgagagtcctgaactccagatgccaggtgatgagaattactgatgcattgctttcaaagcagttggttttatggcttggcggggctggcttggaggttctgctgggcttcatttgcataccgaatgacagcagaggaaaaagccacgggaggcctcagacacgcttagcctcttctatctctgctgccagttataggtcattttaaactaacatctggtgagtgtacttttaaaccacctctgtagctttaattggggatctcctgggaatgtcaggggaggaaaaaaagagagacatccccaggggaagattaagacattggcagttccactgatgcaaagcctgggaaactgccttggcccgattttagtaaactgtatgatccactgtgataagggggccctttgtacaagaggatcttaatattagtgagatgctgggataagcagaaattctgtctccacatctgaaagaatctattgtgtccagaaagtaccttctgtgccccaagatccaagaagggtttcccttatatgttgtggtcattcagtagctcaattgtgtctaactcttgtgaccccagggtcggtagcccaccaggctccctgtccgtgggatttcccaagcaagaatacttgagtgg

SEQ ID NO: 55376 - DNA, 1337 bp, Bovine  19866881105188
tgctgagcagggcagtcgtcagagggccgttcgagttttggacagctcttaacatctgaatgtcttctgggggctatggggtgggctcccggtgtcctcccttctgaaaacaggggaccaaagcacgcaagaagagaagggcaaggacggctatccaggaatgcacacggaaaacttccagcaccatggatgcagcccccagccccctacagaggctcagtgaccctcccctctaattagtcaccacatagtctaaaaccggcaagatccagttatgatgtgtccgcctaaacagatcggtgggcaaggggaacaccagccagaccgagaattcctcgtaggcgttcattttcctcatcagagtctccactcggtgcaggtgggggcccgtgggcaatgcgggggctctgaaaccactggtggaaagcagcggggaggggatggagggacagagctggggaaggaggccgcgatcagtgcaaaccacgttccggatccgttccagccacctggctgggctccaagaaacaggtctcagcaatgcactttgatgagagagaggaaatttcactttatttatttattatttatgcccagtactcttaggaagtatttgggataaaaacagcccagacacagtgaaacaggctaaaagaacaggaacttcaaagtgggaaggtaaccagatcagagtatggagagagagagggagagagagagaggaggagagggagaaagagacagacaggcgttcctactgctgctggcagagtgtggggtgctgcccggcgcacccagtgggaaaaggtgaatgaacaccctcgtgggggtcctgggaaccaggtgccagaagggacttctgagacacagaaatgcctgggtgacgtgatttcccagagcagtttgacaaatgctggggacagggagaaggagaggagatcacagacccagctcagagtccccaggagatgggaaagggggcaggttagagtggccaaatacctggacagaccccagcagaggctctacccttggggtcacgtatgggaacagacgctggtagagaccacagagggttaagcccacggccccctcccacctgccctggtctccagctggagattcatgactcagatcaagtccttccctaaatccaaatttaccttattatcaatttttagccattattccattttatgcccactaatttattaatcctggaaacccccaaaaacaataaagctgaggctccaagggattttatttatatctttaaacatgatttttatgcctttttatctaaaaattcatttaatttttatcaccctcctcattca

SEQ ID NO: 55377 - DNA, 831 bp, Bovine  19866881137568
tcaccatgtagaggtgggcagcactgctgtctcgggtacaggagtggacagaaatctctcctcgggttgtattaccgatgcacacaaacgtggccttgaccagagatagagccgggggaaactgacctcacagcttaggcagacaaccacctccttctgctcaccacctgggcccaggaactgaccagcccccagcactggttctttgggactgggaattggggggatatgggggacctttagtcaaagaggcactgctctctaggaacccaggcactgcctgtctttgcaggcgcggctctcatttgctctggtcattatttttctaaccagaacaaaaagtgccacatgcttatttctgcccacaacactcgagggtcctgagattacagctccacccgacgctaataaccttcactgtaaatcctttatttatagacttggcccggaacaacctccgcctggcgtgacactaagtgctgacgaggcagaggtgggctgagcatccctggcggctgggagctggggtcccaacccccacactaggtctgcggattcagtgacaggctgtaaaccccatgctccttccccacggagtctggatcccagggggcacatagttggagattctcatgcaaaataaattgcagtgcgttttcattaaaaaaaaaaaaaacaactgcatctgactcagcactttttgggtataggtgggggaggcgctttgtagtaaaatctaaggacgaggaggaggctccgggccccacagttcaccccaatggttggggccccactgcccactgcctctggccttcactacagctctggttt

SEQ ID NO: 55378 - DNA, 1384 bp, Bovine  19866881149359
tcctgttcactcagttccactgcacaatctcccagccatccttcaagggggctgggcacaatcccatcagcaggacactgcacttgctgtacgctctcgagtggacgtccttccccagatgtgcacatggctcactcccccctcccaggctttacccaaacgctgggggtggcatgctgataacctgactcccatcctctctattccctgccccatcctttctattccctgcccgttccttacttgctctcatggcatggtcgccctctgagacatcatgaaatctagctatcatcccattgactgtccccaaccccctcctcccactagagtataagctccatgaaggcagggacctagactgttccaactactgcatccccagaattcaggatggtgcctggcatacactaagggcttaataagtgttttggggatgagtaaacactttgaaaagcatctcagcttcttggctcttagttgtttctttgtaaacaggagacaccaaaaaaagatggaatcgatcagaacgtgtagcatcattcatcacaattaccccaaatcaaggatccaagtgaaggtgggagagagggtgggctgtccacacaggtagggagtagtcttcctgaccaaagttttcagctttcagagacagaccaagcagtgtccctctgtattgttcgtattgaccccactgacctccagcttgggccaaaatcccagaatcaacaggcaatgagtgaccccccacactgaaacccactgagctcatggtccagccaacagctgacatttggggtcaagttaaccaacttgactttcaactatattcccctcgagtacattattgaggagctacttgtgaaaatgaagccgcacactgtacatttctgagtcggtctgggacttgggagatttggcctgtctgtaactttaattttcaactaattcctaaagctggaagagatttgcaatacaggttgatggatcatctccaagtctcagaagtcttatgaagagtttcaagtgcatctggggaaagtctcatcgcaaagctgagcttccaggggtcgttcccacctcagaagatgcagagaccattcaggcatcatgtctccacacgtgtgctgagccatctgcacaggcacaagccactagcccagtgacagatgaaaagaaggcaagggctcggttaggaatgctcaagatgcttctgaggaatgctggatttctggaagagctcaacaggatgacaactcatgggtgacatagagaaagcctctccaggcaaaggttgccaggagcagtgcccaccacatccccagctccctggcccttccagagcaatcagtagatccactcgtctctctagaagacacatttt

SEQ ID NO: 55379 - DNA, 1084 bp, Bovine  19866881172475
aggagatgactgctaaaatgcaaaaacaactatttgtaaacaagaatccaaacatgacctgtttgttttgacttaaagagccgaattctccacaaacacagaattaatgattccactgatgaactttccagtgagaaattatccgtgctggcaaacatggagatgttctcttctcacatctccccaccagttgtttttccacctgaacactgtttttagccccctgctggcagccaaaattatattaaagacattagttcagtttttaaaacacagactcgtaacttctaaatttataactaggcagaatattaatcttgcaaaccaattcaggaatctcttaaaaaaaatggccttctgggcttcaaggttgtagatatatatttaataaattgaagtgctttccagttaatgtgtcaaaggcctggtctgccacactgagaaaataaccattggagaaacaagagtaaaacctttttcctgggtaagtaaatgccctgaaaaactggactccattcccttgagtacaaatccctgtgaattaaatattccagcaaagagatgtcaaagcagcaaagtaggaaaacaatcaaaaacttgaaaatgagtgtgttcttaagtgaaaaattaatcatgctaaattagaaaaagtattaaaatagttttagattaatgcaggctgtgaatatcaatataattgcagcagcttaatttggcataaaaagcatctaatgaaatattttaatatcactgtccattcagtttaccagcttgaatttcatggagtattaagtgacttttaaattgtcattgcaagtcttctgaatgcgtgtagtttttgttattgttgtttacagaaagagtaagagaaatacatgtgtgtgtgtttgatgagtccacattcaaattcctactttgtaggatagatgagaagcagtccttcttgccactggtgccaggaatcagcatttctccaggtcaggagctctctgtgttttcccaagaaactgttgcaggaaggaggacccctttcagggcgcaaaactgggctctgtctaacactcagaaataatgtccgagaaga

SEQ ID NO: 55380 - DNA, 943 bp, Bovine  19866881173366
gggatttcggaatgcatgcccttaacttcctgcttgtctaccatattccagcccacctagtgaaggaagcatggagtggcctgggaacaccccagatcttctcatccctcattcttcaggctttcttttagttttggcatgtgcatgtaaatgtcaacaggtgaagtgagatttgctgtaaataagcagatggtggccccagggtaggctgtgggagagaggcgcgttctagcaggagatgtcagaggcagagtctttacgagtcgaaactcatcctttgtcagggcatcagaaccagtgagtgaaagaaacaaggggacacaaggctaagtgcttgtccttgtgacccttagcacaggggcctggagttcacacctgcttccagccggtcccaaaggcacagccttgaacatgcacagatttctccaggatggtttagtcatagagagaagcagactgtaaccaatcctctaaatggctcccagtaatgagctgagtgtctggtggggcagccccgggtgaggattctgagtcactgcagctctgcatattcccttcacgggagatgccacctggttactcttacttcagtgtagatgagatgtaggtggggtgtaggtggggtgaccatattatcacccacactggagcacttttcagagtggaaggagccactattaattatcctagggccataagcacagttggaactgtccctggcaaagagggtaacagctctaggaggactgtactcagctctgccatagatctcagtgttaaagcgccctctgactccgggcgtggacctctgcctcttctgtttgtttttatttatatgtctgtgctgggccttagtcgtggcacgcaggatctttagttgtggcatttaactcttagttgtggcctgggaatctagctccccaaccagggcttaatcctggga

SEQ ID NO: 55381 - DNA, 1140 bp, Bovine  19866881175570
acttgtgcttgttacaagtatcaacctgcatcttttgcagatggatctggtttgagaaaacagttcgagccaggatggagaaggtgggtgaggattcaagttcagggacagcaaagagaggggacatgaggagggacagctctcatggggcttgtctctcagacccaggtgagctgactgggactgaaggagggacacaagtcaggacagcacattatgtcctgggcgctgtgggggcctgcctgtcagtaggggtgagaaaaaaggagctaatgagaacagtcagatccctcctgaaattgaactctcagagtctgagcgggaggaaattgttcttctcttttggagcctccaattccaaattagaatgaacttcttctattttctttggagttcccctagcttcccatagcacaggttccagaaggggcagaaagagaaggcaggccacagagcctcagaggacggaggacaggaaggtgttcccctcccctctcaccgaagtcccccaacacccacaccaactctgcagagagtgatggccagcagctctgcgtttacagctttcatcagttatttttcacaccctcaaaaagaccaagtgcaatttggttcaactacgagtccatttgagccctgcctgtctgattagcagagctgaaagagaaatcattttggactatgggactctggctgcaagaaaatcagatttccaatatgttagaacttttacagattgctgtcagctgggacttaagccctgtacaaaccaaacaaacaaagcggaaattaatttaaacgattcccttgcaattcttgcccacaaaatgtgtatttattattaagaaggcaatattcttttccgacttttctggttttcaataaactgtgtttctttcttaaaaaaaaaaaaaaaaaacagaacaaaactatttttttgatagctcattccttcctgccaaaggagcctcatgtctggacagttcctatgagcgtttggttgctgtggaggagaaagccacctgcaacttacatcagccccttcatttggatgctgcgtgtccttgtgggcagtttcattgctttcagtcaggccatgagccggaggagggagacataaactgtgggagaagtctctcc

SEQ ID NO: 55382 - DNA, 894 bp, Bovine  19866881211707
tgccattaaaatttagcatacaccataataaccaagctgcatttgttccatgtttaagtcaattggcttctgagttttatttctttcatatacatcaaacccaataaagttgttgctgcagccggaggtgaggaagacgccgttgttctgtagaccgatccccctaaccaatccccctgttttgtcgcccccaacagagggctgggtgggtttcagagcagctgctgcttacaggggacagtatggatggacgggggcagagggagagtaggggggtgtcgatgtcgagagcccattgacgaagggagtatgtgtgaagtgagggtggtcttcactgactctcacacgtggaaactggggtgtggcagagagaattcaagtctcaactccatcctgcccccggccagccaggtaatcttaaacatagggccagaacagccacatctgaatgccatcatggctcgcaactcagaccagcgtggcaactgggagtcccccattttgctcctgggcttcccaggtggctcagtggtaaataatctgcctgccagtgcaggagtcacagacgcgggttccagccctgggtcaggaagattccctgggggaggaaatggcaacccactccagtattcttgcctggagaatcccaagattggaggagcctggtgggctacagtccatagggtcgcaaagagccagacatgattgagctcacacacacacatcctgctcctaggggaaccggggcttgagggtccagttcagacccttctcaccatggtcaccaccctacctcctccagatccctgggatggggtggaggaggggcaggaagcaactcacccaacctaggacctggccaagtctcctctggtacccatgcctccacctgtt

SEQ ID NO: 55383 - DNA, 2962 bp, Bovine  19866881257702
accttatgctctgggcctacggcaaacctctcatttcacacagggagaaaccgagctaaagctggagaagtgactgggtccagggcccagagctgggggtggagtccaaatccagagccccagtgccaagtgcgaggctccccaggctgccctggcacacgtggagcctgtgcgctcgactgggtcccgccggcgacagggccagagggaaggaggcgcctgctggagctggcaccactcccttcttcccaccccgcagcactgcccacagcaccctcacgcaaggcaggactcacaggtggctagccacatggaaggcactgcacttcggccaagggagcagggggtagtatctgtagagggccatttccagaacccaactgacagatttccttccaacaaacccagctactgggggcaacggaccacccgagtgaggcgaatgctttccacatggtgctgatcgagatactgaagcaagttcttcacccaacctcggtatgcataccactttgcacttacagagcagccttgtctgtctctaagaaattaacatcgatgtcatattttcttcaatcatttaacaacttggcatggtggttaggataagcatccttattttacaaactagaaacctgcacagaggtcaaagtgtgagctctgcatcccacatcactgcgtcagaggcagtatttccaaactatgggtttctcccacttgatctttttgcctgttcttggtacatactccaactggaaaattcctccccagtgaactcttgtaaaaatggagaaacacccacaccagtttcagaggcagtataacaaacattatccagtctgccgctcccctcccctacaaagccatggtcccctgtggggtccgggtgacagaccagtgcaagccccccggtcatcagaagggtcctcctccttctggtcatctcaaaagagatcacccctctcattttaggatgagaacatgctaaacctcaccgctcatcttgcaaagcaaaacacttggaaatgaaataagaaatccagctcgaaacctctcttcaaaatgccgcagagccaacatctggttatcactcagtacttctggttaggaaatatccttatttatccggcagcactttatagaagtagtgaagtattgggaatcgtacaatatcccgcatacccgtgtggaatggtcacagctgtgcttcctcattccacataaacatggcctggagacacatctccatagaagcacaataaatgatcaccacacacccccagatggaccatctcattccaggacacagaggcgtgggttgctgtgacactctttccccctcactgctctgaaaacagcagaacttcagccagcaaagcaaagacaccacaggaacggcccgctccagccaggcacccctccccactccctgacactgacctccacctgccaacactgacatttacccagaacccctctggtgtgctggctggaccctcgagaagggaacctgtcagcatggatcagagcaccttggagattttcaactgtctgaacatctcacagcccctgacctggtgcagcccgtgtctcaagtctctgtcttggttgacccaaaggaactgttccactgaagctgtcactcactgaagggttggggagaggccctggcgtttacgaatacaccctgcagtgtaacaggattcgaagagatgggagttttctgaatatgtggacctttaagtaatgtagggtcttagaaaagttcattttgtacagtgcatgtgatcagaaactctgaacatcaagcttccctcatgtaagccagcatttgttcttctcctttagaagatcttcaggctgcctgccgggctgtcctggccacactgacagagcccgcctgccgagttctcttattattaaacactgtggagcaggaaccctgagccaagtgcagtcagtcattcaataccactggcatcgtgaactgaccaagttatcctgtgtgtcatgggaccgaggtgcacacgcagaacaatctgcctctctaacgaatcacaggaaagagagaccataactggactgaaaagtaactctcagactcaggcgtgtccctgggttatatgactcggcctccattggggacctgactgacgggtagaagaggtcactctatggctgcagaaacagtctgttacccggtgttcacagcgctgctgtcctgggtgatgcacacacggcccccacttaatgcggtttggaaatggcccatggtctgggctctctggccctccgtatcctaactggtttgcaaggaaccctgggcctcagtgtgcgggcaggaggctgtcctctcttgacacgggcctctggctgattcttacagtcaagagctcgggcagcgtgattataaggatgggtcttcaccagctggcctgtgcctgtactcgggatgtcccccgttttgccttctccccaggcatcaccagcaggcctgccagtggccctccaggcaggtggcactctgagacctgataagcgacactcggttcctcccaattctcacggcctcactataagagcccgcagcactgaccacatcagaccgctgctccccccagaaccagccactgaccttggggttggtgcgctgctgcagtctcctctcctccctctcacgctgcagccgctcaaactcttctctgatctcagctggcgttctcctcctttccacaacctgtggacagaagtgagagaagtcagctgaggacccagatggtgaggaagacacaacagacccgagtgttaaccgtgtcccggtgctcctctcccccgggaccgtgagagcccccagtgagaccaggggacgttcctgtccaaccgtgtgggccccggtaaagccaggttcgccttcacatctgctcagtccccagtaccgtgctctccctcagcactccagaga

SEQ ID NO: 55384 - DNA, 1146 bp, Bovine  19866881274773
ccccgttctcagaaggggcccttccccagaaaagtcaccctcacccacaggagcccgataggagtgcatgtccccacagcaggggaaggggttaagccatgaactccaggcactggaaacagacctcggtccaaccctgatgcccaacaggagggaactgtgagcgcctttccaaaagcctgcagtgcatcatgggaattatggaaaagtacagcaaactcctcataagtctaatcacacttggctctgtggtgtccgggggcgggagcagcacggtgcagtcactcaggcggtgtgtgtgtgtgtgcatgcgtgtgtgtgtgggtctggttacacgtgcacagcctggaaacacggcccaggaaatatggctccaataaaagctttagatgccgatcgggcttggaacacacacacagggcaccagctccccgtgtttggggaaagcagaggtgtgtgctgcgagccaggaaggcatcagatttggttccagaatcaggcgtgccacccaacgccggagccaaacacattagcttcatcacattttcacataaatcacattccttcaaagacttcacagtttgatttcctgatgtttccaaatttccctgccctacagcagagctgtcagtggttcaatcaaaatgttgtgcgtatcaggggtgaagtgaaactgctcctcagcctctgcctcacctgttgaaggtgggtgggaggatctcacagaccccagcttcttgccagactgactccaagaactccaccttgactcttgcagtggtgaccttttgttgcatggggactttccttcagtctgcaaactgaaagatgcctcctccagatttaaaaaatgagagagagagaggaaaaaaatattcagataactgataggaattcccagcatgtttccaaggatgccttctgtcttttgcaatcccttcagcagtatttagaatatgggtcctgcttctgtgacaaagataaaaggaacagtggcttaaatcttatttctttttcacagagcaattcaggattgatagggcagcctcacagggacaggaattcggatcagccatcctggctctttccagctggttggtctgccattcctagggtactgccatcttttatgtggctccatgatag

SEQ ID NO: 55385 - DNA, 1317 bp, Bovine  19866881281714
aatatagcctcaactgggctacgtggccatctccccacctccacccttaccccggtacccctcccgacgggaggctactggaggccccacatactgatttgtctttgcacaggaagcttccagaatggcatgtgttcctccagtggtctttcactttcatcttgacaaccctgcccaggggacaggccccctcattttcatttattattgtcgtatatttggagcatctggcagtttttctgctgcttaaacgacgaggctatagccattgtgaaagtgaaagtcgctcagtcgtgtctgactctttgccaccccagggactatatagtccatcgagttctccaggccagaatactggagtgggtaacctttcccttctccaggatatcttcccaacccagggatcgaacccaggtcccccgcatagccgttgggtttccactctaattgtttctggcaggcgtgtgtatctactgaccccaccctggagctgttctcttgtaaatttctaccttatgatttagcattggagtcgaattgatttcaaccttgtgcctgtgacgtggtgcgttgttgaagatgtctctgcaatcatttaaacaatttaaatgtcttttaaatgatccaattatcaagataaagtggacaagagagtgcccctggtcttgtcacctgtttggttcatgccgacttgtaccaattcttcgctaattctcagtaatgtttgctctgtaactaaccactgacttagaatcatccttgctgcccttcctaagccagtctcctgggaagccccaaacacctgtctgtggatttgagaagttgatttctttctcttcctaatttttgaccagatgtgcatcatgtgggcttgtgtacagtcccttgcaagttgcccagccctcttaaggctctcttggcatgagtcacttaggtgtgctgagactggttattctggagtgttgagtcagtctggaacaaactgtcagccagagttgtaaattaagacctatttctttatctgtgtgagatttcctcacaatagctttctttcacacacactcatattccatcagccagtccagaaatttttttgttatgatctttccttttttctccgttgcagagcagtgattagggctaaactgcacactgacatttgctggtttttaagaatgtcttatcgagaggctggggggaaaactagaatgttgtgatattccttttttcctcccgtttgtagacattaattgggctataatgctcagttgggtagaggagctctttgccatctttcctctgctttggaaaacactg

SEQ ID NO: 55386 - DNA, 1104 bp, Bovine  19866881318230
cttagaagagggaagaaaagtgttagtcgttcagtcgtatctgactctctgccactctgtggtgtaggctgccagtctcctctgtccctgggattctccaggcaagaatattggagtgggttgctatttccttctctggaggatcttcctgacaccgggatccaacctggattttgtgcattgcaggtggattttttatcgtcagccacaagggaagacctgggagcttcctgggaggcggggtcatgagctgagctctgaaaggtggcagagttggtgtcagctgagaggaagggatagtttttcaggcagagtcatgaccttgaccaagcctccaggcaggagcctgccaggctcctctgtccatggggattctttaggcgagaatactggagtgggttgccatgtcctcctccagggaatcttcccaacccagggatcgaagctgtgcctcttacatctcttgcattggcaggtgagttttttaccactagggccacttgggaagcccagataaagggcagccagtagcaaagaggaggaaacagatcatgttcgggcttatgttgttcattcattggatgttaagtccaagagatgctgtactgcggctggcagtggcctggcctggcctgctcccctgccttctagaacaaggtgggctctgcctgcagcatccacctactcctgtcatccagccaaatggaagagcagactctgagcagactcagggcccaggggaggccttgattccagaagttttagagggctgcttcgtgcccgtatcactcagcaggcctctctcaagagacccctccactggctcctggggacctccccggacctcccagcgctgccctcacccctcccgtttccacggagaagtgctgactgttttgtttccgctctcccatcactttctggaattcatctacatcaaagcacaatcccttctgttcagcactcaacaaggctgtggtgattaagcacttaaattgattaatcaaatttcctgtgatgagaactactgtcattcattaatctgagcgggattataaataagagatggcaaatacagaaggcaaacgtgttgacagatcgatg

SEQ ID NO: 55387 - DNA, 1163 bp, Bovine  19866881320872
tggggtctgacctccacccacccagcacatgaccgatgggccagtcctgggcctgagaccgaagactggctgctccgggttgccggctccacagctttggaattaataaagctccaggcagcgtgaggggtgccagctcaaacatagaccatgctggcagccagccgcctgcccatcaaacccctagcacttctctagaatcctccgattaaataaatatttggcaaagcaccactggcaaagtgataataaattcaactcaattcccaccaccaactggcaaactccttcaacaacccaatccaatctgtctgcctcaacttccaaatagctagtaatggggccagctggggcctgtgggatcctcagagctctgggtcaatatcttatgcctcgttatctgccagaatgtctgagataaaatgcaggacagcccggacttctacacgcgggtcagaatgctgaggagctcaaggagtgggggatgggaaaggctctgatttgaggtgcccttcgccccccggaccctgcaccctgctagactcacactgtaacagcgtcaccagatgtcaccacccacacccctctcctgcactcattcaacagatgtcacttagcccatactaggggcttggcggtgcagtggtaaagactcagcctgtcaatgcaggagacacaagagacaagggttcaatcctcagctggggaaatcccctggaggaggaaatggcaactcgctccagtatgcttgcctggaaagttccatgggcagaggagcctggcgagctacagtccacggggtcagaaagagtcggatacgactgagcactggcttcaaaggtgccagaccctgtgctagaagctggagaacaataaagatacgttccctatgaaacagaacatccaaggaattccctggtggtctagtggctaagactctgcactcccagggaatcaggttcaattccaggttggagaactagatcctacatgctgcagctaagactttgcatgccacaactaagacccgccacagccaaataagtaactatttaataaagtctaggggagggcagtcatacaacgccgtcaatccgcttccaggtctgctcttaccccaggaccctgtccataccgggccttcccagatgctacctttctct

SEQ ID NO: 55388 - DNA, 1169 bp, Bovine  19866881347912
ctatgaggttgcacagagtcggacacgactgaagcgatttagcagcaacagcagcagtgctctttattcctttgtataaatatgagttttcatctactgacattttccttcagccggaagaactttctttaatatattttgtatttttgtctaaaaaggttttcatttcatctttattttgaagaatatgcttatttgaatatagaattctttggttgagggtttatttttttagcaatttaaaaatgttttgtcttctagattgacatgtttatgatgagaaatcagtaaaagctcttaattttatgatgtgtcttttttctctgcctaattaaaagatttcctctttgttgctggtttttagcaatttgattataatacttctctgtgtgcttttatttgtatttctcctatttcaagttcaagttcattaaacttattggacctgtggtttttatagttttcatcaaatttgggaaaatcttggcctctgttccttcaaatatttccttctgagcctggccctcccccatccgtggtctgggtctccacttggtattgttcactgagtttctgttacttttctcttaccgtttcttttctggtgctttagtttgaatagtttctactggtatattttcaggtttactaatcttttttctactgtgtctaatcaactattaagcccattgtgatagctagactctaaaatggtcccaacaacctcaacttctgttatccatccccttgtataatccccacctcctctttgcagacatgttaatttgcttctaatcaaacaaatacatcaaaagggatgggaggtcactcctatggttagattaccataggcgctgactcctgtctttctagtaaactctctctattgtcttttcagctcacatccttttgcagaaacaggcttctgtttttgagaggcccaaatggcaaagaactgaaggtagcctctggctgaaagccagaaattgaagccctcagtccaacatccactgaggaattgaattcttacatcaactaagatgggtacatgtagatcctccttaaaaagggaaccctcccttttcaaccctacactgttgacaggaatataagttggtgccgcctatgtggaaaacagtatggagattcctcagaaaactaaaaataga

SEQ ID NO: 55389 - DNA, 2096 bp, Bovine  19866881364095
ctgcttggttcccctgcctggaattctcagctccaagctcaaacttctgccaccttctagtatttctcaagatatgggacctgtccaccaggcccttctcatgttgcctgtgaagggatctgtcacattggggctgctggtctctgggctctgccctcatcatgccctgtcagaatttccatgaggccttggagagtctgctcagccatgtaggcagatgaacaagaaccatggtatcctatgcagaattattttgatactgtttcagtttgcagagtaagcacccagaaatcaggctgtgtacgctgtgcggggacaagcccaggaggcgccacccccacaagctgtgatggggacgtgtccctgcgaatggctcagtgcagtggctccaaaaggagtatccttctcccacaaagaaatatgctgtgcacatttctcctgaaacacatggcccgcttgctctatctttcattccccactttcgaaagagacctgggtagaggaaatatttctctaagaaaaaccacagtgcaggcaccatgagaaatggcaactgctcccctgggcccgagctagggaggtagcacagagaggtgtggacctggaagctgaccgcctcatcttgggagccatggttttcagcaaccctggctggttgctgccaggtggggattcagggcagtgaggccaggtcttcaggtttttcaagaaagtcagaaatcttgagttataaatctttatgtatacgttggctcaagtctttataaaacattatgtcagccaaacatgttggaaggcctggggtctctgtgtttgcaaccctggtctgggcaggtacagactcctgaaaattagaggtcataatttccatgatgagctctgatccctggtagggaggtggggggtttaagacaagcttagaattcagacgcctctacctgggacttgctggaaagtggtggtaggtcagagcttggatgtgtttttgctgttattgttcagtcgcccagatgtctccgcctctttgtgaccccatggactgcagcacaccaggcctctctatccctcatcatctcccgaagtttgcccaagttcatgcccattgtcatctcatcctctgatgccctcttcttctgccctcagtctttcccatcattagggacttttccagtgagtcagctgttcgcatcagatgaccaaaatactggatatgttttgggaggctcaaaaaactagaggccagggaacccatctccccaagtagagtagaaagttggggttcattggcagtaacaactccatgctctttggcctgagcccagcctggtgcagggttgtcactggggaaccagcaggtcttactattacctctttcagaaatcctacttctacgtcattattagggacagactcagcttgttgggtatgaggtttatacaacttgacgggtctctgttaagaaaaagaacacataactggagaggacctgcaaccatgatgtgctggcttttacagacacaagggagccattgacatggattcagtcccagctctgtttttagcgacttcatgttggtagcttgaaatgggccatgatgggactatttacaggctttccaggtggctcagtgatcaagaatccacctaccaatgcaggagacataaaagactcaggttctacccctgggtcagaaagttcccctagaggaggaaatggcaacccacttcagtattcttacctggaaagttccatggatagaggagcctgggcaggctacaatccacggggcagcaaagagtcagacaggactgagcgatgggcgcgcacgtgcacaggagtatttacacgatggaaattggcaaatgacaggaatcaagcaccccacccccttgccagagagtcaaaccagcacaccactgcatgtccaaatgaggacccctgaagcttatacctcattagcttcatggtcaacctgcctctgatcaaaatacattgattaggcaggaatgcgctgaaagacagaggggaagaaagagacagagcagtgatgtccaaaaaggaaggatttccttccacaatagaagaaagtagaaaa

SEQ ID NO: 55390 - DNA, 877 bp, Bovine  19866881571911
gactgttccctcatcctcccagagcccagatgtctggcgattcagcaaatagttgctgctgctgctgctcaggccaggatggcccataactcttactgtttcaccaactcaaggacacattggaaaccacaggccgaatttgtaaaaagcaaacaaacagcaaagcaatagagcagacaaataaaaaatatttaaatattgaggcctaaaattgacatctctatttcctcttccccctgccccagggaccctgccagcgtacagacagcgccagcccccacctcctcgtgggtcacctccgctccgcctctgtcacctgcagcggctcagccagggaggttttcaacttcactaaaatgcatattttgatttactgaagaaacctgcagtggccccaggcaaataataactgtgtgagaatatttcacagaacaccttcctccccaactccctttagggagaagactgccgtgcttaaaaaccagggggagggaaaatgaaataaaaaatacatcgaagtaatggccactaagtggggaggggaagcagatttctgagccaacttccaaactcctgtggctctggtgtgcctttgagacaatctcactctgccttctgttgcttaaatagtaattattaaaggcatcagtaaaaaatgcccgctccagcatccctgaccgtccttccttgccgtgtcagtggagtagaagctagctacaatagagtcccttctctggctccaagttccacttcatttaaggccagaagagggaccacagcccacccaaagccctgccaggagcgaggaaggagcagacatgactgttcttggcgtggaagacaattcctctgtaaggagaccagacttcccatctcc

SEQ ID NO: 55391 - DNA, 642 bp, Bovine  19866881622964
tataattttccgcgagacttctgctctgaagaagttgatcctatggtaagccttcctttcagaggggagcatttgatgctgcatctcatgaacctactcctaaaattatccctaattggcttggaaagtggcttccaacaggcagctggctcagtatcttgactttctggttgtgactcagggaggtgcctgggttcgatctggtttgtgatagtggtcttgttaactctgagggcgagatgatatcgcgaaggtgcagactgaagtgctgtctcaggggaggtggcgtggaaactaccaggggcagcctgtctcatcagggatgctgactggcaggtggggccaggagagggggcgttgacatgcaattccagtgtgcctagcatcattctgccagtctctcttgagtgcctgctgcatgcatgggttgtactgggcaccgtgcagttacaaaggcggtggaaaacatggcccctaatccaatcggagagacaagtcacacgtgtcttagataactagtgtgattcccagagagtgcatgggagcacctggtgtgtgtgtgtgtgtgtgtgtgtttgtggtgtatgtgtgtgtactcatgtacttgctccccccacacagagctataggaagaatgcaaaa

SEQ ID NO: 55392 - DNA, 686 bp, Bovine  19866881775498
tttcaaagatgctaccacccctctatttctgtgaacccaaacaaaaatagcatggaataaaatttaattatgctagactgaaatatttcatgtggaattaaggggcaagacttgcctttaaaaagcattaggtttggaaagaataaaggctttgtaagttctttggaagatactataattaaaggtttgctcagatgtatttttccctttttgaagagtttaaagaaacccagccctcccttccaaaattgattacctctcagaccacagccgtgctcggcaggaagtactatgagactgttgctgtgctgatttgatggcttctttctgttaaatgtaaaataagtttttaatcttctgatttagatgtttaattgaaagcaaacgtgtgactctctttggtttccactgaacctgtatttaagtccacacaaacagtttgaataaagtgaaaacatcgctggactagctattttaaacattttaggatgtaagaatgcaaaatggggttcccctttaaaaatagacatggctgcttgcatttacataattaccgctaaccagcacagcattttaagtggtgacaaacttaagggagaagaagtatctgttttttataaagcctggttaggggacttccctggcagtccagggttaagactgtgcttccaatacagagtccaggt

SEQ ID NO: 55393 - DNA, 734 bp, Bovine  19866881777234
cctccctttacccactccggggtgcagtggttcccgcgctgcggcccctggtggggaggggatccgggcttcctcaggagaggcagtgagcaggatgggctggcgctggtggcttcctgaccccagataaataccactttgaagcccccacagtatttttcgggcacaaacagtacagtgaagctgggacatttatatgcgattgggagacagttatcctgtgacaacattctattccaatgacttttctattaccgcccatgattaatgatggaaattctgtcacttgggatgatggatgcggggctgagagcctggcatagattacccaagccccagcttcccattggctcccaggacaatgaggcctgtgcttcggtcaagcataaacgtaaagttcctttagattaaaaaaaaattcgtcttctcctctggaagcagctggctcaggactaggggaaaggttccgcccccttaaacctgctttctctcgcagggggtggggtggggggcctggggcggtagagctgctaacatgccctccggttaagaataagtgcatagtgcacaattcttcacaaacaggagctgggaagaaggcctttgctacagcaggaaagttaagagatggccaagcagggctcgggcattcagggccccagtgctgggtctgacatagtccctccttcccaagcctaggtcccaggcagactttccctccttccctgccacgc

SEQ ID NO: 55394 - DNA, 1416 bp, Bovine  19866881895190
tatattactgcatatatgtgggatctagaaaaatggtatagatgatcttatttgcagagcagaaatagagacacagactccgagaacaaaggcatggacaccaagagaggaaagtgggggcagtggggtgaatgggagattgggattgatgtatatacaccactatgtgtaaaataggtaactaatgagggccttctgtataactcagagaactccactcagtgctctgtggtgacctgaatgggaaggaaatccaaaatagaggggatggatgtatacgtatagctgactcactttgttgtacatcagaaactaacacaacgttgtagagcaattatcctccaataaaaattaattgaaaaaaataatttggccaacttcaccccagtgatcacttttatacttttaatatggacagcaagtttttcagtacgtaatcgacagcttatgtattttgttttagcttggacccttcctgagtgttatgaaacattaggctcaatttaacagaatctccccatttctgcccccgggggtccctggtgtgtgcggtgctgagcctccgcaggccccagtgaatcagcaacctctgccgaggggcgtcctgtgctgcagaaacaccgcaactctgcatcttttctgcaggagccgctgagatgttagaacgagaagatgctgtagtttgaaaaagtgataaatgggccaggttcttgaaaagctagcagaacgtcttatttaaacatttattaggtctgaacagaaaacaaaaatgagtctcaaagaaatcttttgtagataagttgaggtagatgctttacattcgaatacctgtttctgtggcatgaaagtttaattttgtgtcacatttgtttgtttggtttgagttttggctccctctccattttctgcagctcacttaactcttgtggagccacgagttcagaggaacccatcggtggctgtagtgacagcttttctcaggctgttaagttctcaccaaccacttggctgagtttggtgcgtggttgtttttaaaatcaatgacatagggaatttcctgctggtccagtggctaagactctgcattcccagtgcaggggcccagattcagttcctggtcagggaactagatcccacatgccatgctgagagttcgcatactgcatgacacagctaagacctggtgcagccaaaaaaataaaatcagtatcatagatgaacccataaagccaaagtcaagtataagaattaagatatattttattttttaatttaaaaaatttaagatatattttaatattttaaagttctaacagtctcattaaagaatgatctttttttttttttttttaatgctgacaaagcatctgagtatttgcttggttctagcccggcagctctgaactggaacagcat

SEQ ID NO: 55395 - DNA, 1856 bp, Bovine  19866881186566
taaaaattacattacaaatcaactaaattttttaaaaactacaatgagacaccacttcacacatgtcagatggctattatcaaaatgatgacacatagaaagtgttggcaaggatgcagagaaaagagttttcttatgaacttgcactatggaaaacaatatggagattcctcaaaaaagtaaaagtagaactaccataagatccagcaatttcactttggggtatttttccaaataaaaatactaactcaaaaggacattaagcacccccatgttcatcacagtagtatttacaatagccaagatatggaagcaaatagccaagatatggaagcaacctaaggtacccactgatagatgaatggatacaggtgtggtgtatataaacaattaaatactgttcagccataaaaaaaagaaatcttgtcagttttgatgacacagatggacctggagggcattatgctaagtgaaagaacagaaagacaaacactgtatggtttcacttatacgtggaatctaaaaaacaaaacaaatggataaataaaacaaaacagaaacacatatacagagaacaaacaggtggttgcagggatggggagacagggggaaggagaacgagtgaaatagggagattaagaagtgtaaacttccagtgactaaacaaatgaaccatgagaatgagatgcactgtgtggggcacatagtactaataacataatatctctgcagggtgacagatggtaacgagacttatcctggtgatcactttgtatagaaatattgaatcactgtgttgtgcaccaggaactactatagtgttataggttaattacacctcaaaaaacaagtaacaaactcatagaaaaagagatcagatttgttattaccacagacaaggggtgggaagggggggaattggatgaaggtgattaaaacatacaaacttccagtcagaagataagtactaggcatgtaaagcgcaaccatgatcaatgtaacagtagtgtatgttacatacaaaagtcattaagagggtaaatcctatgagttctcatcacaacaaaaataatttatctatatgaaattatgggtgttcattaaacttattttggtaatcatttcacgatgtaggtccagtcatgctatacaccttaaacttacacagcactatatgtccattacttctcaataaaattggaagaaaaaataaaattatttagaaataaatagggggcagaataatattatgtttcattttttcccctacatgtggtctcaattgtttcatatggcaaactccattaaggatttagaacgaataaataaagggcaaacaacgtcagccccgtagaccatggacatgaactcagacacctctgcaaacacatgacagtaaggagagcttctgaattcatattccctaggttagcaagagaaatgacttgtttgtttgtgctcaaagatgtggtgtggcaggatgcattaaacacccacgaaagaagaagctggtcactcaactagagaccagaaaagaggaagagcaatgcttatggcttagcagttacaagaaaggaggatgcagaggaatttcatcaacacctatttctccactatcaatttctagaatctaaaaagcctgaaccatcagcatttctccctgttgtgcacctagatttataagttcccattcactacagccaggaaaagccatagcctcagcagtgctgagggaataacacccaccgcaaggtgtccctgacatgtagggccattaacactttctaagacccactgcttttccaggaacaagtcactaatattgagaatccaacatgaagatgaggttactactg

SEQ ID NO: 55396 - DNA, 1092 bp, Bovine  19866881321145
aaacttatttgtaagtaatttcccctagagatgaaaggtatgttgtttcactccatgtatatcttaagttcaggaattagaataaatgaagtcatattatgacattaacacatgataaatattgatctacgctgacaaataacattgaataatgacatttatagcactctgaaaccttcccacatttgttcttcttttttatattctcataactactctgcaaggtaatcaaccaagggatatttaatgagtttctagtgttgttcaggaacagtgctgggtatacagggaaatgattattggtcccacattacacattaggatatggattgtgagtaattaagtttccagggtcagttgatggacgagtcaggacctgcaatgacagcctggctcagcacatcctaggctttgctgcctaaaaacttgccagttcacctattgctgctgtgattactctggggagtctcctaaatatcagtgaaagttccatatattcatctttcttacccttttgttctctttctattgtattcaagcttccaattatatttgaaaaaaaatattcttttttcttttccagccagctgccagatcgtctcattttccttctattcttttagaacagatgatctgtaacaataaactctagcatcagctttctctcttagtcttcatagtctctttcctctcctcgtcactccacccagataactctaattcaggtcacacaaatcccgttcccagttaatcagaacagacacttttgaaatcttactttcttcttactcttctttctgaaagaacctttctctccctgtcttccaagtcctctgtctgcatgtgctgtcagtctttcttcagcctctccttttccttcctattctttcaattgtttctctagtcgttcctcacatggggacctaaatgggtcccctgcttctactttcctcattcagtcccacttcacacacagcttccaataaataattctcttcaactagtcattgtccaacccagaaggctacgtgagctctctagagcctgtgctattagatgaagtcttaccccttaagattttcagaaccctca

SEQ ID NO: 55397 - DNA, 1279 bp, Bovine  19866880383399
cctgaaaataatgataaaaaatattctcagtttgcaaggaaaatagactcttagtaaatgacacatggaacgttcatatccacataaataaattgtatttcatatataaaaatatagcgctttctcattcttcaagagaaggccaaagcccaaataaccaaaccaataacattagaagcagtgtttgacttggaaagaccacaagtatatctggcttttgaccatattaaaacagtcgtatttctagggtgatgttattcatctactcatttaccacctgaccaaataccatccatgactaaatcaataattaaaggtttcagaatagacatggaactactcaaaactattcttctaggaaggatacatataaccccacatccaaagaggtgtttcattggcttctgtagtagcagtgtagcactgttagtcactcagttctgtccaactgtttgggaccccacaactgtagcccaccaggctcctctgtccataggattctccaggaaagaatgctggagtggattgccattccctctccagaggatcttcctgacccagggatcgaacctaggtctcctgcattgcaggcagattctttaccatctgagctacagggaagatacatttactgttcatacacaaggacatttgttgttttcttattctattcccaactttgggaaactacatgctatgagcgataccaataatgctgctgctgctgctaaatcgcatcagtcgtgtctgactctgtgcgaccccatagacggcagcccaccaggcttccccatccccgggattctccaggcaagaacactggagtgggttgccatttccttctccattgcatgaaagtgaaaagtgaaagtgaagttgctcagtcgtgtccgactctagcgaccccatggactgcagcctaccaggctcctccgtccatgggattctccaggcaagagtactggagtggggtgccactgccttcgccatatcaataatggatgaccaataatggatgaccttcaaataaggtcatttggaaatttcctttccaaagtaaagaaagatttgtagaagtatcagagaagtgtcttcttattatttaatggagtgctaatttttttaagttctcttttatcaacactttgactttcctcaaactctaaggaactgatactgctttaaaaggttctaaccttctaatacagaaatgtaaattttcattatgtagtagctgcaaatgttttcttggctctcaatctcagaaaactagttttta

SEQ ID NO: 55398 - DNA, 1939 bp, Bovine  19866880450517
aaggctttggcatagtcaataaagcagaaagatgtttttctggaactctcttgctttttccatgatccagcggatgttggcaatttgatctccagttcctctgccttttctaaaaccagcttgaacatctggaagttcacggttcatgtactgctgaggcctagcttggagaattttgagcattattttacaagtgtgtgagatgagtacaattgtgtggtagtttgagcattctttggcattgcctttctttgggattggaatgaaaactgactttttccagtcctgtggccactgctgagttttccaaatttgctggcatattgaatgcagcactttcacagcgtcatctgtcaggatttgaaatagctcaactggaattccatcacctccactagctttgttcatagtgatgcttcataaggcccacttgacttcacattctaggatgtctggctctaggtgagtaatcacaccatcgtggttatctgggtcataagatcttttctatatagttcgtctgtgtattcttgccacctcttaatatcttctgcttctattaggtccatactatttctgtcctttattgagcccatctttgcatgaaaagttcccttggtatctctaattttcttgaagagatctctagtctttcccattctcttgttttcctctatttctttgcattgatcgctgaggaaggctttcttatctctccttgctgttctttggaactcggcattcaaatgggcatatctttctttttctctttcgcctttcccttctcttcttttcatagctgtttgtaaattatgtaatgttatcaatattgggtattttcaattcttttcatctttggaaatctaatatgtgtgtaaaaaatgtcactggagtttgcatttatttgattacaaatgagggagaatatccattcatacatttattgatcatacacatttcttctttggtaagttgcctgtttagggtctttactccccttgctattggtgtatattatttttttattaatttgtaaatacttctcagggtcttctctggtgactcagtggtaaagaatttactctccaatgaaggagacataggtgtgatccctggctcaagaagatcccctggagaagaaaacagaaactcactccattattcttgtccgggaaatcccatggacagtggagcctgatgggctacagtccatggggttgcagatggtcagacataacttagcaactaaataacaacaaatgcttctcatgtcttccatatattaataattgccatatattatgccaacatgaaacttgtgtgcagtttgccatagtttgtatatattttattttgattatacaaatttataatgcttatccatttatttactctttcctttatgtttgcctttctgtatgtaaaattataagacaatttatttttattagtattatgatttcttatatacattgaaatctttaacctatctggactatatttagattttcttgctcccatttaaggcaaacattattctgcaatagtttgaccttaatatctgagtattcaacaaagtccaaatggcattacattaatactgtaataagctgttttgcatttattcttatttgtttaatgctattaaaatatagttttctacctcattctttctcacactcctttccttttcttcttcttgtcagttttaagtaagttctattaattatacatacagttatttttttaaagtattttttaaaaatacagttattaaattattctgtttccctgtattccacatatgaaatgtaggggttaatggttttttcaaaagtgatttaatacatggcatgagccacctcttggtttcccatactgtgacacattgcagatttttgacaagggtttggaaaggctagatttacaaatcaaacaa

SEQ ID NO: 55399 - DNA, 1954 bp, Bovine  19866880499224
tctgtacctgaggaaatgaggagttttggcctctgccatggatcagtcatgagaatgtggcaaaacagcgtgatctggagactggcagatattctgctttcccaagcatttattccagggacgagaccccgtcattcccctgcacttgtgcacacttgcgatgggattctttcgccagttataagataaatgtttgattcggcaagagtagaagtctttaggtttgcacaatgatacatagctttaggttagtggaaaataattttggaaagcagatcttagtttccatgtcataaaaatatttctctctagtattttgtcctgacagctcaaacaaatataatatgagaatactacctgtggcttttttttttctcttttggtttctaatgctgaatttataatcttctctaactttgtgtgaccacacatatttaaaattcctgtatcaatttgattcacagccacatttccttgtgtgtagaaaaggaagttacagacctcaaatggcttttacattgtctggggtgataggtgtcctgtatgtatgggatatcagatgttatttcaaggctgctcttgacattgctgttgttaatgtctctttcatttgagaatgtttccattctgtatcaaaaatctatctcaggagtgaggggaagtggtggaaatgggtaccatgcggatgccagcaagtttcccagtgggttatgatcaccaaattcttccaagagggatgcctgggggtgggggagattcagagcggggagggaggtagaaaaacaaattttggcagactcaagtttagaagaaaaacaatcctttcaccgaatttagcctctgctctctgtcatagaaaattataataagtacaagagaattgcattcaatttgggtcaagtattattgttggaatatgcatcagtcagaattggcctcattaggagggcactttctgaacagctatgcagtggttctcaaagcatgcagactcctgagagggtgcgatgcggagtttaaaacaagctgatttcacgtctcgtatcatttacatttcaatctaggactcaaaccagggcttatacagaactttcaatggcaagacatggagcgaaatatctttatgtataaacatgcagtaacattatcagaattgccatcgcctgttgattataaacatagacccacctattgacactattggcttgggctctgggcctcttttttcccccttctaataagctgacattttccactgaacctacagatgcgttgaatttacataccagtctacactgaggcacatgtttttattttgcttccctatttataatctttattttgaaaacaacaattgtggtttggatttaccgtggggctggattttacacatgtatagtctcataatattttctttttcctggaggctcttaaatcatttttagctatgttatcagattcaccatcatcccatcaggacatagtagatacagtgtatatttccaaacacatgtaatagatgaagaaaatgaggtagaagattaagtagctagtccaaaccgaagtaaaattttagggggtatttgattaagttaaaactgggctaagagaggcagaggggaaaatcttgcctactttctatctagtgcagaaagtctgaacaaatcaaaacttgaacatattctgtatcttgatactaatgttaaatcagaaattctataacccggagcagagaagccaaaagctcagaaaatctcaaatctatttacctgggagaggtgctctggagaggatgcgggaactcccacaaataagcaaaggccttgccagtaggtttgggcttccccctaaaacatcgttgctgctcttttctttttccaggtaaacaaacaaatgctcatgcttggctgttgccattggttggtttatgtcttcaaatcagggctctactaat

SEQ ID NO: 55400 - DNA, 1680 bp, Bovine  19866880547852
atattttccaaatgttttctttcttcttctatagcttttaaaactgcatccttcaccacttctttctcaagcttcaaaacaaataatgaccacaacaaaaatatctgagtgaatgaccacagtaattccttgaataagacacactggagttaacctaaaaaacacaacactttgatcttactgggtttatttctgacattgttttttttttttttttttactcttatgtaataactgctataaaataaaaacaattatttggttttacacaaataaccaacttattttcatggtatttctaaacttcagagaaagccttaaagtagcagttttcaaattattttgccttaggacctctttacactcttaaaaattatagaggatttctaagagcttttgtttacatgggttatacatattaagattttccaccttagatactcaaaccaggagaagataaacatattaactaattaaaaattaataacattaaatatatattaataatgaattttatgaaaataactaattttccaaagttaaaaagttataagaatatctgcaaacctagttactatctgacttaatagaagaaagcttagattctcacatctgagttctgtattaaatctgccatgatttttttttggctgaagtgtataagaacaacccagcctcacaaagatatgaagtagaaaataaaatgtattttatacatactaaatgtatccagttgagatcactgtggatattctttctgatttcacagcaaaacttaacaaggagtagttcttaaaggtaagttgcaataaggaaaataaaatcatgtcaatgaacttcttgtactgttacattacaatcttttcttaccttctgaatgaattctttacagatgattttttgaacattttttatttggaaaacattgattcaatgagttatgcatctctttcagatgttgacacatttctcaatattataaccaaaacagtcatatttgttcataccaccatcaatctcattagaacagtctttaagtattaaaaagtagaaataaatcttccaaatttctaatttttgttttaaatctctaattttatcattggcaacaaaaactgtcaggttttttttttccccttaaggtgttgggctcattctgagtattttggagaaagtgtctgcctcatactaaagtctgtataaccctagtaattcagtaaaatggcattccatgaaaaaagagtccattttggatggaactcaaacagctgcctaagaattttcctcaagaaaatcatcatactttggtacacagtaaagtccatgggcctcccactcctgagagagttaccactttttatcttgttttcagctcacaagcaagtttgacaaaagccattaaagctgacagtcatctttttttttaactcttgctttatttcacagttcttttgaatcactcccttactgtgtacaccaatgccttccatgttgtttatactaaatggtactttttgttctttgtttaatccttattttcatgacctcaagcaatgttctacatagctgattatttctgattttgtaaagccctctcttttcctggtttgcatgacagcatgctgcatatatccttctatgcatcccgctgagtggtttcaattctttgggaacgtcttc

SEQ ID NO: 55401 - DNA, 1168 bp, Bovine  19866880718867
ggaatattgataacaggggggccatgtgtgtgtggatgcaggcagtatatgggaaactgtccctttctctcaattttgctgtgtacttagaactgtctttaaaaaaaagaaatcttttattaaaagaaaaaaacagtgagagctaactcagctgcaaactttctaatgctgctcccttagtggtaagtaactggaaactctatcattacactaaaaacttaaaacccagcggagcagcagctgccaccccagcatgttctgactcactcacacagacagcacaaccaagagccatattcaataatcatattcacagtggtcttgggagatattttagccctaaataagcacaatatgtaaggagggaaagaactctgaatgttgatgaacaaacctgggcctctctcccatggaatcacaatgagcgtgctcagcaaagatggaacagatgctaagaacttagagctggaccacagttggcttggccagcatcaaagcagaaggggtggtcggaccctgacctggcgtgagacgggagattcagctgtgggacagaagggcatattctgcactggagcaaagtctcacagtcacaaaaccctggtgtcctattgtgagaggtggaggcttagataagcaggagaggggaaaggcgccagcaggagatggtaaagtaagggaacaaggtctcagacaggaaagcaggcagtggtttggagaaggcctgggaagggcttttagtgtctgaaccagggttgatcatggagagttctcttctaatgccattagctcccattaataagttacatcaacttacctgcattttccatcctaagggcgcagcaaaaccactgcctcttggcaccacacttcgtggtgctgatccgtttctgtatggtttttctaggaagggtagagtgtcatgatgggttgaggctgcactgggacaaccatcaggcgctcgacttgctggtggccagagagatgcctgcggtcacacatcagagacaagttaatactggcaccagtcttacatttatttgagagacagggtaaccatttacaggctcccaagcactttcatatcccctctccctgaatcctcggatcacatctggtgttgctcaggcacatctggaaggccaggcgcgggtagaccacatctgta

SEQ ID NO: 55402 - DNA, 1631 bp, Bovine  19866880735005
tggaaactagcaagactatgtcttctatcatgcttactgatttgcatgtcaattatgtttttagtttactaaaattttattttgttttcgaatatgctatgtctttttagttattgcttttaaagcattttaattagttttgttatatggattagaagagaaaaaaaaacttgttagtagacttggagtcaacttataatgaaaataaaatgagattttaagacattatgtacattgagcatgctgattttaagtgtttcctcatgttaggactaccaagcatgtttaaagaagcccctttgatagtaaagcttttgatacagggtatgtttatttgacctaaaacacaaagccattaaacatcaggatatttttaaatgaccaaataatatgcaagatcattgctatcacctcaggagttgtatcagtggccttgattccactccatcccaatccttacctactagagaaggtgtggtatggatcaggtagggttacccacaacctgcagataaacaacccaaagcaagtatctttatcaatccttttaagtggatgaaactttaaaatacaaatgtagtcaaaacctgatgaaccaagaatgtttaacattcaattataagaaatataaacagtataaacattaatgtagttagttgatattttagggaaattttaggacgtgatgataggtttctgggaaagaagagaaggtgactttcatttattcaataagtattagtcaagcaaaaactataagaaaagagccttagacaaaaagctacagcctttgaagaggaaaaacttactgaagttttggctcacgaggctgagaaattcaagcaaaaagctatgagaaagacacttttatcttgtttattcttctggagcaaaataatctttaaaattacttaaaatggaaatttttctctttatgccttacttccaagaatttcaaagctaaattttatgtttaattgtattattatctaagatttgaaaattatcttgatcttccatctgttgaattttgaatccttttttcaaatgttatttcagctacatagttctcttaaattatttttggaattaagatattagtgagtgaactgaaaaaaatgaaaaaacagtattggagctgtgaggggaaaagctatagagctgattgaaaactgagatcaacactctctcctccctcataaacaggaaattgttaaatgtatttgtatattaggtaatgtgtgagcttccaaggtggcacggtggtaaagaatatgcctgccagtgcaggagatgcaagagatgtgagttcaatccctgggtggggaagattccctggagtagggagtgataacccactccagtattcttgtctggaaaatcccatggatagaggaacctggcaggttaaagtccacggggttgcaataagtcggaaacaactgagcaattgaacacatgtaatgtatatgaataactgctatattcttaacatttcacttccttctcgggagctcctcaaatggaatttatgtctggttaggagtaatacagtttaagaaggatggggatatactgggagagggtacaatggaaactatttaaaatgatgggcattctaggtttgtaaa

SEQ ID NO: 55403 - DNA, 3469 bp, Bovine  19866880874635
acttttaagaacaactaattgccttcttctgacatagaaattgtgttacttcaagtccgttgggttaattatcttctgagaatagtctgataatggtgacagcctatcaccaaaaagctctaacattggccaaattgtcttgcacactatcctccttctaatcccctgtccctgccgcccgcccccgcctcagagcatctctaaagggtaaaggaattaagggcaggtgaaggaggaaagaaatggtatgccttcctttcactgagggaaataactactgattgtaataaataaataacctaattgctgggtttgtctttctgaggttttaaataaacaccaacaaaaaaggaatacacattctataacaaactgtatttacctggtaataccaagttgcattaatttgacatttttttcttcattgttttttaaaagagagcacttaaaaatttaagtgttaaaatccacgtagttgtgtaaatgccaatgaagaggtgaaaccatgaacttgggtttgtaagcagacagaaggctgaagtgatagatttctgagaatcagcggctagacagccagctatactttagcagctctgctctgatcccttctcactaaagcaaaggctgctattatgataaatggaaattcttctggtaagtttttcaacataattattgaaacttgtacgtggtactctttttcctaattctctggtttataagtttttttttttttttaagttttatcttttaaagagaattgctagcttagtgtactatctaccaatcaaaagtattggcattttgatggcacattcaaatgtgttttatattctctcttccctttggcccttcttgggtaggtttaacttggtttcatataaagaatgaagcaaaattaggattttttttccattcccttaacagctataatcagaaccactttccatcaattttgatccatttcccccctttttttttctgaagtatgaaaatctccaaattaaataattgtaatctgaggtatttctcccgtgtattgtagattatttcttcttatgaaattttgagagctaaacaaaggcattgatggtaaaaaaaaaataataaagatacaaaataaatacacaaaatctttacttatatttaagattaaattagtaagaaagcaacatcaaaaaagaaaagcaatttctacatgaagtcaaagtattttttaaaatatttaaaagcaaagaattcaggtaagaatggaaacaaaaaatgaaataaataggtaagaattgactatatttggggaagagtaactttgagaagaaatgtacccaagaggcagatatcatcacagtagttttttgtgatactctatttctgtgatttctttaagaatttggttttaattatcaaaggaatgtttaaaatgaatcattttatacatgtgatactttaaaaaatctattgtgaatactatatatcaatcattttatacctttgaagtttatactttgacatcctcaaagcaatgaagaaaaactaaattcaagccccagggtataaacagtaatgaggaaaggtcaagctggatctttttccacgttaatgatggtgagagtgggtttaattctttattgaacagagtggacctttattttgatacagtttctctccttagaaaattggatgaaaacggctgacttagagcagacaagggaatttcttgctgtaaggaacaaatgtaatgctcaatcaaatttctcatagcctgaaaagcgccacagaaatccatacagatacagtagaatgccaactggctcggcacaaagctcccagttttgttgaaaacatccaaatgcagtgaaaatatgatatttctttaaatatcttcctctctctttttttgtggtttatcgcaaatattttgaatatgggtttcctcccacgctctctcctatttactaataacatcacaaatattatagttctaaatttcttggattgttataactgacataatgtttattcttcttccaagaattgttttatgtctaacctttcttcatattctgtgatgtataccggtaaccaaaggttttctagtagtttttgtgtttcaggttggaaaagaaaaaaataatatcacacattatgtactgtccaaagtaaacaaaactgaaatacttccaacatttgttttgctgttgctttcaacgtgctgggactttaaaggagattcttttaaaaaggactttaacaatagaatattaaaagaataaagattgatattcttcatcaatataaaaatccagctaaactttttaaaacattttttagtcacttatgctcagtaattttttccgttcttattttaaaacttgtaaattcttatttcaaataattacgataatgtttctccttgattgattgaaattatcctctagattcaagaaggatgatgatagaatttattgatctaatgctatgtttagctttcaatgaaaaataatagtcttaactattacatggcccagagacttaacactggcatttccccttttccctcatttccaaaatatgttgctgttttaattgtgaagcatttataaaattatttcttccccacatgtaaggaaaaattgcagcttccaattttaagatttagagatttttcacttttagcagaaatcgttttgcaacaaaaagctgaaataggcaagatctcattgtatagacagagttaaagatatataagtttgtcaaaagatccctcaagtgttttattttaatttttaaactaatcattaaataacgtagggctatttggtaattatgggttcttcagatattgattgctgattattctggttttttaaggttttcatagctataatattatgatatggggttcagttgagcagaatttcaagtttttatcttttaaacaaaaatcaaatttatattgaatcttaatgctatgagtaatgtgtttgttgattataattttttattgttatatgtagaaaatttttttcatactaacttacagacacctggttaagttttatggagaaattacctttgtattcagtataacacctaattcagccatatacataataaatgtcaggttagccaaaagctcattctggtttttccataacataattgctcagtaaataactgttctttgacatgttgtaaaattgatataatttcacataaaatgatctcatgcaaattttcctgttcatgtccctgaaaaaaaaaagactttattgaataactgtgtctctgcctggccttatttcaactgtaatcacttctcttggcagacatcaatgtagatatttctccaacttcaacgtttgtttgctaattaatttactcatatttaatggttcatttatttgggctgccatgtattcattctctattcctcttaagagaccattatgtatgtaaggatgattat

SEQ ID NO: 55404 - DNA, 1772 bp, Bovine  19866880892018
cccttaatttccttctgctcttgttgcccgctacttgaaagaagttcctcatagtcctggtctgctacatctcacttctcattcattgctaaaatctactgtaatgaggtgtcaacacccactactcctttgaaaccctcttactcaggccaaattgttcttattagggccaaagtggccttttttattgttaaatccaaaggcattttcttaaagctcattctacttgacttttgactcttggcaatggtcaatcttctttttttttaaagtatctcctccttcacttccaaactaaactaccattttctccataatttactcttattatgttaacaattccttattttctttctcttgtcctttaattctacttacacttaaatgttgatgttccccagagtttaatccaccatcatcttttcagaatatatattcttcttaaatgatctcatttatttccatgccttcaacttctattgataactccccaaataaaactccagccttcaccttgttttaaagttcagaactatatatattttttttactaagtatgagtagctacctcttaatcacttagagatcttgcaggcagctaaatgttttcaaaatatcaaatacattttctctctcattgtttatcttctcttattctcataacattggggcaaggaagcttggaatctttctccattaatctttttcttttatgttggtctcacattggtcatgatgttgattttatctaccaaatgctttcctaatcttttccttttgtttcctcactactgtcattgcctttccaaaaactttcaaaaccacttattaggattattttagtatagtctgggagaaggcaatggcaacccactccagtactcttgcctgaaaaatcccattgacagaggagcctggtaggctgcagtccttggggtcgagaagagtcggacaggactgaacgacttcactttcacttttcactttcctgcattggagaaggaaatggcaacccactccagtgttcttgcctggagaatcccagggatgggggagcctggtgggctgccatctatggggtcacacagagttggacacgactgaagcgacttagcagcagcagcatagtctaattcccttcttccatcatgtctcctgttgaatccatctttctcactttggtcagcattaactttctaaaatcccctttgcattagcagccttcatgttaaccagttgacttcctgcaacccacaagataaattcagatgacttttttcattttattatattttcattcccttaattagtttttcccttgtctatgtttctcttctcttgtccatgatccagaaattttaatcttctcttccttccaattgctgtattcatctttttattggtatgtaacaaattactagaaatttaaaagcttaaaatgacataaatttattatctcataggtctgtgaatcaggacgctggcacactttagctgtgtcttccacccagaatctcactaaagtgaaatcaaggtgtcactcatctgtatccatatatggaaagttaactagggagagagccagctccatattccttcaggttgtttgtagcatttatttccttgcagtatgagtgaggtagtcattttattactagttgctgtaggggccactgtaactaggatcactctcaggttcttacaggtgactctcagttgtccatcacaggctgtctgcaccgtggcagtgtgcttcttcaaggtcagtagga

SEQ ID NO: 55405 - DNA, 1035 bp, Bovine  19866880905835
atatcttagttgattgtcaaatagggttagatagtattacaatgcctgatttacagattaggcaacagagttgtgaagataaggcaattgaggcttggaacaaggattcaaactaaggtttttggaggtcaaagtctgtgtctttcccattttctttagtatattggcagcagagatgcagatcaatggatgtgtgcctttgaataataactttttcccctagaattcaggtctcctttagtccttatccactattatgacctctgacggagcacatttggagtttctgttgtcaggagaaaaaggcaggagaatatgtgtggtaagttttggaaacaaaacagattaggtccattttcatacttgacaggtggaaaatacactaaagtcataaaatactctttttttcctctctgaagtcttcttcaccaaacaggtacaaagtgaaaactcaccacttttatttaaaccacagatctacttctattctttctgtaaaagcacttgatccctgtgatgaagcccaaatccaaatcaagagaaaaacagctcttatttattacgcagtttgctctcattatgttcttcccagaaatgaatccctgtccctctcggactttctttcacaggacactctgatctggctctccttctcagcaccaggagagttgttttgcctggcttatcccatcaatagaaggctcagctcccttttctcacactcacagtccagcagaccattttcctaggtcatcaacagagaaatggggagtcttctcttaacaggctgcacttctgccaagttccaaagtgctctcgcccttccttaaggatgcagaatatttactttttacccaaaacatctggataccttgtgtgtgtaaccctctcctgagggtggtgggttgtttgaaagcagatcattccagtaaaaatgttcaggcactttcagacaattctgataggactccataacaaaacaaaacagatatcttccccactgcagtttccactcaatagcaggtaaacaataaa

SEQ ID NO: 55406 - DNA, 2114 bp, Bovine  19866881048905
cagtcctgtggccactgctgaattttccaaatttgctggcatattgagtgcagcactttcacagcatcatctttcaggatttgaaatagctcaactggaattccatcacctccactggctttgttcatagtgatgctctctaaggctcacttgacttcacattccaggatgtctggctctaggtgagtgatcacaccttggtgattatcttggtcatgaagatcttttttgtacagtgcttctgtgtattcttgcacagacagacatggatggggaaatttctctggttgcttcttatctattttccattctgaataaggagacatctaagattctgttactccagccagtgctttgtatttttgaatatttttttttaataatagaggcagatcatggacagatgaaatgctcagtgtaataataagagccaatatttttactccttcattatacatttatattccccacccaactcactttctcgagggactggtcaagatcattcacagaaaaacagaactttgattgttgagtttggcttatttgactgtttagaaggtgcgacaattttattcctcaaacgaaagagacagactttgtaagccagaacacacaagggaaatccactttccttgaaaagtctggcttctttttaacctggcacttaaatcagttctacaaaaggtctactttccatttctacacagtttcaatgaagtttaaagttggttcaaaggcataactgtatagaatggactaggatcatcaagaaatgaagagtatttgctcactacttagatgtccttaggagctttctgtgtttatctggcactccctttgcattaggtctggaagagagataccatatgcttcaaccctggaacagaacataggcctttatctttgtgtgatatttcaagacaactgggtgagccttattgtctaccaatgccaacatttttccccagaaaattatgctacttcttatttttaaatctggcagtgctgtggggttttctcaaactttatttggtaaattattataaaatattcaaataggagaagatagatgctaaaaatataccttatatttttatagcacttcaaagattgttgaaatattctcaacattaaaccataaaataactctcaaagcatcactaaaacttttatctgcaaatccctgaaaatggtgatatttaataaagcaacctctgttatctatccaaatagctctgaatcttggcctgaaaaacagtatttcaaataagtttttagtctgttatacaaaataacgtatcaaagatcttttattcaaagatatagaaaatattcatacccaaacatactttaggcacctgtcacttacatatttgaggtcaaactattagacatgtaaaaactaactaagctctgtaggcattcgtactgagaggctctgaatgttattggataccaaccaatgaggcaaccattcttactaacatccttttgcaagggtatggaaattcaattaagattaaaatgtcaaattctttgcttcctattcaaatttcattctgtgtagacgtttgattgtgctagtgtctacatgatatgaatgcaactagttgaaaaatgagctagttgcctatttcagggctaggcaactggtttgatggacactcttcaagtgaattgactgacttggcttgttatttggccaacttctttttcatgtagacacaggctaagagaaaaaatagccccacttatttcctttggcacttatcaggcaaataggttcctgtagtcaagttgttctcaagtaatagaacagctaataaatctgacctgaagattcttcttgggataccaattatccctcagtatttgaatcctgtttttacccactcacagtttatagctaacttggtttttctaccatttgtaaatccctactgttcctggctgtacagggatagaatttggttctctctgaaacttcagtcttaaagaagaaaatacaatttcaaggaattgaacattcactatcctaatggtttaattgtttttttttttttttttaactctcatgaattctcctttaactatctatgcaaaaattttca

SEQ ID NO: 55407 - DNA, 1296 bp, Bovine  19866881169840
cttctcagagacatctacttttcaaatgggcatttatcattgatttcatcaatattagtcagtattttacatatttaagcaactatctgatccctcactcataaagcatttattgagcactttctgaaattacatatgacatgcttcatcaaaaggcctacatataaaatttttaattcactgtttacctgaagttctttgtatctatcttgaaaagaaatggcctcttgctctttttctttaaggaaatctttttctaagatactatgtttctccatcaatgattccacatcctaaaagaaaaaaccaagcataaattgcgtaatatttatggcaaaaaatagactctgatttttcaatgacacaatataaaatatttggaaaggaaagaacccacaggaagtatggtctttaaatttcaacaatataaaatgtacgcttaactcccatttccagaccaataccaaacactaacattaacactaaccttgatataatactaaaagcattcatgctaaataaatacacaaaagcatttaagctaactataaacaacatgctacttcaacatattgtacagaagacaggaatcaagaccatcccgaaggaaaagaaaagcaaaaaggcaaaatggttgtcgaggaggccttacaaatagctgtgaaaagaagagaagctaaaggcaaaggcgaaaaggaaagatttgaatgcagagttacaaagaacagcaaggagagataagaaagccttcctcagcaattgatgcatagaaacagaggaaaacaatagaatgggaaccactagaaatctcttcaagaaaataaaagataccaaaggaacatttcatgcaaagatgggtacaataaaggacagaaatgatatggacctaacagaagaagatattaagaagaggtggcaagaatacacagaagaactatacaaaaaagatcttcacgacccaaataatgatgatggtgtgattactcatctagagccagacattctggaatgcgaagtgaagtgggccttaggaagcatcactagggacaaagctagtagaggtgacagaattccagttgagcaatttcaaatcctaaaagatgatgccgtgaaagtgctgcacacaatatgccagcaaatttggaaactcagcagtggccacaggactggaaaaagtcagtattcattccaatcccaaagaaaagcaatgccaaatgctcaaacaatcacaattgcactcatctcacacactagtaaagtaatgatcaaaattctccaagccaggcttcaatagta

SEQ ID NO: 55408 - DNA, 2777 bp, Bovine  19866881270446
ttttttgatgatccagcgaatattggaaatttgacctctggtttctctgccttttctatttttctaaatccagcttgtacatctggaagttcacggttcatgtactgttgaaacctcacttggcgaattttgagtattactttgctagcatgtgagatgagtgcaattgtggtagtttgaacattctttggtactgtccttctttaggattggaatgaaaactgaccttttccagtcctgttgcctctgctgagttttcaagtttgcaggcatattgagggcagcactttcacagcatcatcttttatgatttgaaatagctcaactgtaattacagcacctcctctagctttgttcgtagtgatgcttcctaaggcccacttgatttcacattccaggatgtctgactctaggagagtgatcacaccatcgtgattatctgggttgtgaagatcttttttgtatacttcttctgcatattctcgccacctcttcttaatatcttctgtttctgttaggtccatattatatctgtcctttattctgtccatctttgtaggaaatattcccttggtatctctaattttctttagatctgtagtttttcccattctgttgttttcctctatttcttttcattgattgctaaggaagggtttcttatttctccttgttactcttttgaattctgcattcatacgggtatatctttccttttctcctttgcctttagcttcttattttttcatgggaaaaaaatagtttaaacaaagaaataatgacactagtgatgatgtcacaagaggttgcctaattccccagtgtagagttcagagcaaatattctttagaaattaaagggttcctcattttctgagtctacacaagcatgaaaatgatgttgcttcatggaaaagctcattaattaaaaacattaaattcaggctgaaagaaaaaataatttctactgtattttctaatttacctgctactttctagtctattaaatagcaagcccccaaaactactcattcagtctctgctttctcttgtcctctcattcttctttgcacacatagagctccttagaaatcacagaagaaaatctaaattcttcaacaaagattgcaagattcatcacaatccagctggagactgtttttcttaccttctctcttcatgctggtcccacacaccctagttttatcctgtcggcacaccagccacctttcacaacaggccatggtacctgcatcatgtggtccttttgctactaatgctattaatatatgctctgatcagaatatcttcccgttttctccatgtggcaattttgtttccatctctgaagcagttgatatatcacctctgtgaagcactttttcctcctcttcccagtcaatcatctgctcttcaaggatcctcagggatgcatattctaccatggtgctgatgacacatggtagccgttgcacacaggtaggtttcagccccgagacaagaagtttctccagagcggtgtcctaaatgcatcacagcacctgcctgacacagtgccttcacataaactctcagatgcttatttgaacatacgagtgaataatgaatggaggaataagtaaaaatcaagacatacacattcattattgtgtatttcacagacagaacacaaaagcttgtgtgtccagagacaggaatgaaagtgaagtttcattttgaaggaagggagcagtttttgtacttactggttaaatgtcaacctgacttacaatacaaaatcatttactgtatatctgccgggcagggcacactaacattacagatgagagggctgtgaaaatcaattcacatcagttgactgctttcaagctgaaaagtaaattttattcaatatataaaataaaaataatgtcctccagcattttttttaaataaaaagaatccctttcttcatagaaaatgcgtggtaggaaagtaaatagaattgtttccacttacaatgctttcaagttttatccctggagccatttggcctgagatataaaggtggaaagaaactcagttttatgcatacacatgctcgcacacagtacaccctcacgagtaaaccaggcagtgacaagttacttggatgctaaatcgaaacttgtgcaccaaacaaaattgtgcactgtgtgggagagcattaaggctgctgggtttgaaggtttgccttggctggaattcactgcaacaccacccacctctctccagttgcaatattataaccaggtcacctagatgctgtgaaacagatgttcattgaagagaaaaggaaataggtggtgtccattgaaaagtgatagccagggcagaggagaaagcatatttttacctacaacacaagcttaatattctggaaaattctttgtagggcaaaaattcctagctctccaggaatctgcagcacttagtaagcacttcagtataccaggaggcaagaaagcagagtggggaatggctcagactttggtatcagcctggctttgactcccaagtcttcatttcctagctgtgtgcccttgggaaaattttgttgttcagtcactcacttgtgtccagcatgccaggcttcactgtctttcactctctcctggattttgttcaaactcatgtccattgaatcagtgataccattcaaccatatgttggccccttctcctctgtcttcaatctttcccagcatcagagtcctttccaatgagttggctgttcgcatcaggtgaccagagtattgga

SEQ ID NO: 55409 - DNA, 3155 bp, Bovine  19866881314041
atgtctttaatcctctacctcctggtgtttatcgggttcctggcacaaaatggaatcttaagaaaggaagggaaaattggaaagggtagcgagagaagagaaggggaggagcaggaaaagggcagagtgcagagaaggaaagtatgagacagtaatcaccatgtattacaactactgttgttttgacctggtatctgcaacaaaatgaccacataggcaatctctgttcaaaaaaggaagtacttggttcttagaagcaatttggccatgggccctggggcctttcatttcattcagatatctcaagatatcttttccattttctttttctaatacacataaataaaaatagatgagaagataagaatatgtcatcccataagactctaatactttgaagtcagaatatttttgaacaaagtcaactgaatactacccagaaaactgctttttctgggagaaatatcaataaccacagacacacagatgacaccaccctatggcagaaagcacacaagaactaaagagcctcttgatgaaagtgaaagaggagagtcaaaaagttggcttaaaactcagcattcagaaaactaagatcatgacatcctgtcccatcacttcacggcaaatagatggggaaacaatggaaacagtgacagactttattttgggtagctccaaaatcactgcagacggtgactgcagccatgaaattaaaagacacttcctcctcggaagaaaacctatgaccacctaaacagcatattaaaaagcagagacattactttgccaacaaaggtctgcctagtcaaagctttggtttttccagtagtcatgtatggatgtgagagtttgactataaagaaagctgagagctgaagaattgatatttttgaactatcgtgttgtagaagactcttgagagtcccttggactgcaaagagatccaactagtcaatcctaatggaaatcagtcttaaatattcattggaaggactgatgctgaagctgaagccccaatactttggccacctgacgtgaagaactgactcattggaaaagaccctgatgccaagaaagattgaagtcaggaggagaaggggatgacagaggatgagatggttggatggcatcaccgactcaatggacgtgagtttgagcaagctccgggagttggtgatggatagggaagcctggcgtgctgcaatccatgggatatcaaaaagttgtacatggctaagtgactcagacccagcaaatgggcttcccagtgctagtggcaaagaatccgcctgccagtgcaggagacacagaagacttgggttcgacctctgggtgggaaagatcccctgtagaaggaaaaggcaaccactccagtattctctcctggaaaaatcctacgaacagagaagctttgctggctacagtccatggggtcacaaagagttggacacgactgaacacacatgcagctatgcacccagcaaatctagaaaagagcctttcttagcattatactttgtccaatacagctcatgttttaaaataggagagtaaagagatcttattctaaatatgcattttaaaacacaaatgactcatggctcccttaaaacaaataaataaataaacaatgccagtaccctagcattcaggaacagccctacaacaacaaaccagtgtgggcaaattaaaaaaaaaaaaaattatttgcaaggaaattaattcattcccagagtttccaagaggttagtataaaaaacagtgactacatgttttgttaagacaagaaaaaattgccttaacatgtttataactattttctaaaggaagttgcatggcctaatgaactgcatcttggattgggagtcagaaatttcaaattctgctctttctcaaacactgcctggctgtgtggccttgaataaattacttaccctctctgtgtttccttatttttttaaagtgaggattacattgactgactgcatagaagaggtattgtgctcaccaatgaattagtgactagaatgaatcgttcaaatatgaacaaagaagcgctatgtctaacctgaaacacacattttaaagtagttgggaacagttccctcattaggtaaataaagctgtcccacttgttaatttttgaaataaattccaatttaaaaaaaacaattattgtgaaagccacatttctaaaactaccctagaaaattcataatttatttttgatattgaaactacatacctttttgcatagtttcttaaagaagatcacctatttctaaaaaatatgtttttcaggaagcaggatgagaaagaaattactttagtatctgtgccctcgtctacttctagcaaatcttattaatcttcagaattctgactctgacttattaattgaagtgaggcaaggtttagtcactcagtcagtgtctgactctttgagtcgcatagactgtagcctgccaggttcctctgtccatgagattctccaggcacaaatgctggagtgggttgcaatttccttctcaaggacttattaatgacccacagtaaatagtcaaatagaaaagaacctaggaaatggtttatgataccccataaaagcccactaggataagcccatcgtgttctgaacattctttctgatatgtctgttgctccggtaggttataaaataatccagggggaagactcccttatcgatctctacacacacaatatctagcataatgcttggtgtatggacactgttaagtaaatatctgttgagcaaaactgaaattggagtgggtaagctggtttattcaggaaaatttgagtcaaagtaaatttcttgaattgacagttttctaacagaatcacagataagcttcagaagcttcttctatcaattaattgctggattggagaatgcaatgaggcatagctaatttaataatttctgtaacctccatgaactttccactgcttcacagatagtctaaatttagcatgacatgtggggcccatgcagctctatagccgtcctttttgggtaaaaattctctccatcttcatttcaacactgccaactctgcccaatgcactttgctctagctgattaaacttgttgctaatctgcaaacacatcaagcctttctccatcctcc

SEQ ID NO: 55410 - DNA, 788 bp, Bovine  19866881322008
aactcagtaggaattcaaccatctggcccttgtaacttttgctttgggtctcatattagaaaaggcttttatctgaccaggtcatattaaaatgaataatataccctcacattcaatcgttgtctatactttcagctgtacctcattttttatgtcaaagggaatttaaagatttgtataggtatgatctaaaaggttactatttttctatcttatactctgaaagcttatttcatacagtacaccttaaaatcaaatttattgctgtttttcacttcatattttaacagtcttcttgatcctctttcttattctcctggactcacttacatgagaataatcttgaaagaacttactgataggttaacaatcatggacttcggtaaagcaaatctattgaccgtttccatttcaacagtggggtcattaagaagatactatagacataacaatgcttagattaagtactataattcctgtttcagggaaaagacataaatatgttctaacttaaaattaaaatttattttaattttgcacttaattggtttggcccagcaattaatttagtactcttctttgttctttgtcataacatttttgtttaagacaaagcaaaacttctaaatcagagtacagtaagtataaatattttagttagagtcagtatctaaaaatgcctattctgtttttgtgtaacttaaatgttcatctaaataattcaatcacttcttgaatcattatagtgatagtgacaattagctttattcttcattaaaaggttttag

SEQ ID NO: 55411 - DNA, 1766 bp, Bovine  19866881333636
ctgaaggagatcagcccctgggatttctttggaaggaatgatgctaaagctgaaactcccaggtactttgaccacctcatgcgaagagttgactcattggaaaagactgtgatgctgggagggattgggggcaggagagaaggggatgacagaggatgagatggctggatggcatcactgacttgatggacgtgagtctgagtgaactccaggagttggtgatggacagggaggcctggcgtgttgcgattcatggggtcgctaagagtcagacacgactgagcgactgaactgaactaaaggagaaaatctgggcttagatatgtaattgaaaaatggaggtgtattttagtaccttttccaataattatggatattctgctttgatgctatgcccaaactcaacaagtgctagtttcctaaaggttagttacaatgtagaatcttaaaccatatcaatgaatctttgcacttgtgggagaaaaatgagagtgaaaaagacaaataatatcttagtattaatatgaaaatagttttgaccttagagacttcctgaaagtgttttgggagcttccagggaacttgatttacactgagagaaccacgggtatatatataatttgtcaatagtctttcccaggttcttgagtgttctttgcatgctaagttgcttcagtcatgtcatactctttgagaccccatggactgtagatctccaggctcctctttacatgggcttctccaggcaagaatactggggtgggttgccacttctccaggggaccttcctgaaccaggattgaaccagtgtctctcatgtctctgcattggcaggcaggttctttaccactagtgccaacgggaagcaccaggttcttgagagttgttccaaattttccgtaccagttttctctgtttctctttctgatgtcttttctctttgacccttatctatccactatccttgcatttttttttctcacctcctgtcatttccttattgaatttactatgtgaacaacccccttcagtgtctaccggtatcttgtaagtgttatcattttagttgatgagccacctgtatttttctacctggttactcctatattaatagaagagctggatggtctaggtctagttgatttatttattggtgattcttttatcctcaggcttacctggggaaaaatttgaattctggtcatctggataaggaagggtaaagtattaatataaatgggagtgtttttcatactgtgtctactttttctctagagttatttataatcaaagaggtctcttttactattctagcctaccatctctattaactttctaacttcttaaacttctaaaaaatttctatattatttacttgatttatatctgtttttcccagtagcatgtcagctctatgagggaattgacttttttcttaaatgttttattttcagttcttagaacaattcctgcacatattaggagctcaaaaaatatgctttgaatgtctctcctcactaagaatattaaaaatgaaaatcttgaggtatataaaaaaaaactcatgcattctatattcatgactattcttttgaatccaaatatcttaggctttactttaatgatgaaaggctgtataatagagacaaacaactaaactatgaatataagatacctaggttcagatcctggttctctaaattttcaacattgtgatcctgggtaagatgctttgcttcttactcttgtctgtaaaatgtgagtgc

SEQ ID NO: 55412 - DNA, 760 bp, Bovine  19866881334782
ataattttctcagtttaacaagataagagtttatagaggattttttaatactatcatttagaatacctacaaaaaagcacttacaagatagtcactgaaacagattcattattaatttgaattatttttctggttgatcattttaaaagctttctttgaatagtttgattacacacaaacttttgattattattatgaattggactaacagtatcagtattatgtattcaacttagtaaataatttaggatgtaatttcagtataaattttgattcacataattagtatataggtagtataggtataggtaatcccttcatctgatctaagatgtttagatggatgaaggtgagtatttataaagtttagtgacatctctattgataacaaaaaaccctggtaaatgacatttaaaacattttctcaatataattttaatttaatcctagcataattctgattctaattctgaatataactgtaatactcaaaagggttggatcactgattaaaaacttgttgagtccagatacccagaaaaaggaatattatcccctatagtgatttgcaattctactgcacttaatattgtaggataaattataagctatttgaaaagatcatcatttcagatatttcattctgtttttcttttaaaacactgaacttttgactttcttgagacttgaaggctaagtcaaagatctctcttggtaaatgtcacattgcatgtgaaaatatgtagttaccttttaacta

SEQ ID NO: 55413 - DNA, 1420 bp, Bovine  19866881402758
tggaagttgttttgttatgtttccattccccctacaaggaatttttaatgcttagaaattaaccaatcatactaggtgtgatgaatttttatgagtttttcatagattctgtgtaacagtttcaaatttatgacaaaagctttgggatcactaaactcaattctcctctttagatttacagatgcataatactatccagaggtaagtaaattcccttcctttatctatctcacacttgaattctcaagggtttttaattctacacacagattaaataattaagagaatattaattgaacattggaatgtagggtataacaagataaagcacctattaaccttgctcaaaaggaacttgaaatatatcaatgcattaaagtgcaaatgaaaatttgaatacatgatcaaaattatacaaagtaggtgatttatataaacttctatgagactttggagaatggaaagatcaaggctttgggggagagttcagagtcaaaatttagtcttagaaatgagtcaaaattcatttagatgtattgagagtgataaaaacacatcttctatgaaagtaacatcatggatactaggattttagggtatataaaaggtagttgtgggaaataatgctagagggctgcattgtaaataggtccttgagagcattgcatatcagccatgttcccaaaactgaactgacaatggaaatttataggagcataaagtcagcattagtattgtttaccaagaaaattgtgtagtatggtgcaggagtggactggataagtgagaatctaacacatgaacatcaccagatggtcaatactgaaatcagattgattatattctttgcagccaaagatagagaagcactatacaggtcagaaaaaacaagaccagaagctgactgtggctcagatcatgaactccttattgccaaattcagacttaaactgaagaaagtagggaaaaccactaaaccattcaggtatgacctaaatcaaatcccttatgattatacagtggaagtgacaaataaattcaagggattagatctgatagaccaagtacctgaagaactatggacataggttcatgacattgtacaggaggcagtgatcaagaccatacccaagaaaaacaaatgcaaaaaggcaaaatggttgtctgcagaggccttacaaatagctgtgaaaagaagacaagtgaaaggcaaaggagaaaaggaaagatatatccatttgaatgcagagttccaaagaatagcaaggagatataagaaagtcttcctaagtgatcaatgcaatgaaacagaggaaaacaatagaatgggaaagactagagatctcttcaagaaaattagagataccaagggaacccagataaccacaatggtgagatcactcacctagagcccaacatc

SEQ ID NO: 55414 - DNA, 811 bp, Bovine  19866881442466
atttcagagcatggtattgcatctaaagagttattatcactgactgtgatagaaatattcatttaaaatatttctgtagttaaaagattagtaactgaaaaattaaaatattatactcatccttgcaagtaggtactccaccattagctaggaacatgtgaggatttactctgggtaagggaaatgatgatttaatttgctaatgcttgcttatctgtttaaaaaatatttatttatcaatttggccataccaggtcttagctgcggcatgctgactcttagttgcagcatgtgggatctagttccctgaacagggatcgattccaggctccctgaattgagagcacagagtcttaaccactgggccaccggagaaatccctgctcacttatcttgagatgagaagactggtaaaaatgttagtggaatgataaatgtactacactcctttttaatgggagtggttatcagtttcttatggcctggttttctcagtgactatatttgagtatatagtctgcaatgcaggaggaccccagttcaattcctgggttgggaagatcccctgcagaagggataggcaacccactccagtattcttgggcttcccttgaagctcagcgggtaaagaatctgcctgcaatgtgggagacctgggttcactccagtcttctggcctggagaattccatggactgtatagcccatggagtcacaaagagtcggacacgactgagcaactttcactttcacatatttgaatataatagggttttgctgtatcactcttttcaggtctcaggccataaaaa

SEQ ID NO: 55415 - DNA, 1296 bp, Bovine  19866881631741
aaattaaattgataactttatgatattgataccttcctacttagaaaaaagtgaatctaaatattcagtctgcaagtcttcaacagagtacctacttcttgtgctttacattgtaactgctataaatcatcttgtcatccatttgtatacatgaaaagtgaaagtgttagttgcttaatgtctttttgcgaccccatggactgtagcctaccaggttcctctgttaatggaatcctccaggcaagaattgggtaatcattcccttctccaggggatcttccgaacccaggaatcaaatccaggtctccaacattgcaggcagattttttaccatatgagctaccagagaagccctatttatatacatatgtataaatacacataagtatgttttttgtatatgtatttgttgtcataatagatccatggcagtctctaaataattgtctgcctttaccaggaagatggcaaagtgtaagaagttaataaagacataaatacaataattatataaaaccaaataaatcatcacaatttaaataatattctaagatttagcttatttccctttatgtgaaatcaatatatcttcatttgtaaatattggaatgaaaagaaacaaatgatgacctttattttgttattgatgttaataactgtgtcccactgcctcacagctatttcatggtatttagaagaatacagagaaggaaatattttctaagagcactgtgttgaaaggctgtaatggagtttaatatagttttggaagctcaattccacttactttgtctggtgtgtatacgtgcataagattaggttactgagaaagaaaaaaagtacactactcttttcattgtttagacaaagagtgaattacagctaaaagaggaggcgaggatagagggaaggaatgagcagagttggtggagtcaggagagataactaagatagccttggataaggatagaacaaatggttgatttgtagaggcaacccttatgtcttatgagcagaatcatttccaaagaattcattcaatccatctctcattgatgattttttcccttatgacctatgtgtcttgtatgggtctctctttcaaaatgtatcacataccatgttacctctataggggctgtctggcttattacaaccatgagcatctcaaaaactatatcaactaaatatttgtgttcacctcactgtccttcactgtgcgtaagtccaataaatcaagaaacatttttaaagaaagttatgatttaaaggtaatggaattttattctttttatt

SEQ ID NO: 55416 - DNA, 1983 bp, Bovine  19866880418686
gttggtacgctgagtacgtgtgtgtgtgtgagggattttcttacacatcaatggggacccagaggcagggttctcagactgtcctacgaagcctggggtaggggagtgcaagaggcggtttttacttaaagcaaaacaagtggttcccgctcttaagaaaaaagccatcgaattaagagtctccacagggcttaggtttaagacactctgaagaactgccctctcctcaggcaggcagggtgggtcaggagggacagacgtgggcctgtcaccgggcgttgtgagaaccacgggggttctgtggcttgaggtcagttcatccccagacagcacggcttggtccctctggtagaaaacctagacaccctgataaaagctccagatggcgctgcacgatgcgttggactgtccttgtttcaggagacagacctagaacagccgaggcccacagaagcggtgacccccccctttcttgcagagaccccgtccctggcggtgccgctggaggaccgcgtggtgtccgtgggagaaacggtggccctgcagtgcaaggcggccggcagccctccgccccgcatcacctggctcaagggggaccggcccctgagcctcaccgaacgccaccacttcacccccggcaaccagctgctggtcgttcagaacgtggtgctggaggacgcgggccgctacacctgtgagatgtccaacgccctgggcacggagcgcgcgcacagccagctgagcgtcctgcccaccccgggctgcaggaaggatggcaccaccgtgggcatcttcaccatcgccgtggtgtgcagcatcgtgctcacctccctcgtctgggtgtgcatcatctaccagaccaggaagaagagcgaggagtacagcgtcacgaacacaggtgagccgccgtggccgaggggactcacgggaggggaacagccaggatgtttgggaaggaggccacagaatgacaccattttctcttttgagaatagcacattttaatgggcatactcttaacgcaagtccattacaaactgtgcagttttctgagccatcgggctttgctgctgtgtggtgggttgtggctgcagggatttcaccaggctgtttttctcttgggagagatgtcagtctcccttctcatcaccgtgccccacgagctgggtaaagtcaggctaagcaggtgctaggagggcttctccagggcacagatgccacgcagtgtctctgcacagctttacagaggctgcccggtgcccaagtctgcttgtgtcatcaccacaaagggtcaggacccctggtgggtgaccatcttgtctccttgcagatgaaaccatcgtgcccccagacgttccgagctacctctcttctcaggggacgctttcggaccgacaggagactatggtcaggatggaaggtggccaccaggccaacgggcatctggagagcaacggtagggcctcagcccgggcgcatcctcttaagcacagggatctggcagctcgggtgactcaagtctactggtgggtctttggggacttaacctgtgcaagttccacaaggtctctgttgggtttaccgtctcctaatctggataaggtaggactgcctgcagtaagagcagcagaggacaagactgcttcagagacacaccccactcccatccctggagcagggagactgcccaggtctgctcttcagtctctcagagtaggaagtgcccacagaaacgggggaagacagagcagtggtttggagtgagtttatccaaaccaagaactgctcactgtcatggcacccaaggcctgcctggtgtgaaggcagtgttagaaaaggggcctcagcccaggaacaaacccctgggaacctcttgaacagtgtccctgtgctggtcgccttgcccgttcttttcacacagcatcgtctgaagcgctaagcccacctcagaggaagggcatctaaccggatgggagtctgttg

SEQ ID NO: 55417 - DNA, 1543 bp, Bovine  19866880483024
atatttaattctttttgttgcaattgtgaatgggattgattccttaatttctctttctgatttttcattgttagtatgtagaaatgtcaagtgatttctgtgtattgattttgtatcctgcaactttgctaaattcgctgattagctctagtaattttctgatactctgtggactgtctactaatcttggaagaaaaaagaaaaggagagatgtctcaaaataaatacgtgaatgtttctaaagagagacagaaagagaaaccaggaaacatctctgaaaactaagcatgttgttcctaaaggcaatcccacagaagagcgaaaatcatgtcagaaaaacagaagctctatggcattctcaatatttttttcgttcaatcgctcagtcccgtctgactctttgtgacccctggactgcagcatgccaggcttccctgtcctttaccatctcccagagcttgctcaaactgtggatagcttaattcatgattgtagtcatctggtattaagacaataatttcataaaaggaaatttcaaaataagttataggtgtccactcatttaggaattaaggtctgtagagtctttctctagctagaatctaagataagaactctagggaacaagatgaccatttttcacctccctggtttacaaagccctggtccctttctgtggtcagacactttggatcaagtcagatgggttttcaaactactttgcctcttaatttttaaatccttgtttattttaaagaaaatttaatccatatgtttccgattcatttacacttaactcatcaaaatgctgtttcataaaaagctctttgatgtttaaattgcctttggagctatttttaataagtttttttttttttttttttttaaggcttccctacttagaaacagaaagtttcatttcattgctatttaacaacttggggtccagagggttgggtttagtttattatctaaatgaaataatgtatgtaaaatgcttcataaattctaaagcaattgacacctgttagtgattagagttgctattgttattaccaccacacagaagacataaagtttgaggtttctccttcccatagttggctggattagctcatcttgtggctccctcctacttataacattttcttattctacgactttctcatccttagtaacacatacaataaacatgttaaatgactaagtaatgacagagttaagtcagggagagactcacccacacaaattaagccccttttaaatgagctcctggttggacctactatgagtaatgtggtcagtcttcactgaggttcaaggtctagctgggtttcactgactgaggggtcagggttttcctggagtattatgggcaggaatggttagattctgttagaaaaagaattcactaagaagggaagttttgagaacagacacctaggggcaggagggggacaatcaaagcaagggggggggtctcttccccagtcttatgaagcgctacatggaaaagctgcagttatcctgggaagctggtggt

SEQ ID NO: 55418 - DNA, 2647 bp, Bovine  19866880508063
tcgtctagtcaaggctatgatttttcctgtggtcatgtatggatgtcagagttggactgtgaagaaggctgagcgccgaagaattgatgcttttgaactgtggtgttggagaagactcttgagagtcccttggactgcaaggagatccaaacagtccattgtgaaggagatcagccctgggatttctttggaaggaatgatgctaaagctgaaactccagtactttggccacctcatgcaaagaattgactcattggaaaagactctgatgctgggagggattgggggcaggaggaaaaggggacgacagaggatgagatggctggatggcatcactgactcgatggacgagagtcttggtgaactccgggagttggtgatggatagggaggcctggcgtgctgcgattcatggggtcatgaagagacggacacgactgagagactgatctgatctgaatatgatggtccatatttcaggtgacatggcaccctctctcttacttctcttgacctcaagagacttataatcaaataagtgggaaaaaaaataaaaggaaacagggctttcctggtggctcagtggtaaagaatctgcctgtcaatgcaggagacatggattcaatccctgagttgggtaggtcccctggagaagaacccactccagtattctttgcatgggaaaatcccatggacagaggagccttgtggacaacatgtagcccatggggttgcaaaagagtcagacaagacttagtgactaaacaacaaacaagaaccattacagaaactggagaaattgctagtttttcttctccaggaaagcctgttgtcacaaatcaccatttatttaaaataatgagacattcctgaaaggtatgtctgtgtgatgtttgcataattttctttctttctttttttttttttggtggacaaaaaggaaaataaccttgacttcatgggattgtctctttttttggtgggagattatttcgtaactaatgaaataaacagttttcacaataaaagaattaacatcaacttttttttttttggcttgtaaagcgaaggctttaagaaaagaacatttagggggtacaatagcctgtctgctgtggctgactttcttacccactttgttagaatcatgttaaattgactttttcctgccactggaaaccactacagttctgagcaccaatcagattcctcatctctgttatgaaagatcacaaacataatgcttcatattcagtctcaaagagaggaacagaaaaattgtacatgtcaagaaagcattacagaatgacattgttatttggagaattgctttcatctctgagattcctcacacctgcttcatttggcacagactgtttccatctcatggaaaccagtctttgctcttccccaagtcccagagtacacagacatcacatggcaatgagaaaacttggaacagaaaaactcacttaaaggtgccatctaaaatgcactgtatgtaagctgaattcaccacattttgttcaaaagggactcttagttttgtgtgtgtaacagcatacacctaaatacacttacacatacatatgtacacacacacatatatgtctggatgtgtataaacacatttccatgtatgtgtgtgtgtatatttagaacaatgcatacaacaaatttttgtatatttggccctctaatactgttttttaactgcttctaaaatctgtgttaactctcagtaactaacagtgctgtaggccgaatttatcatgctggttgcttttactttctcttaaaaatcttttaaaaagatatttacttattttctgcttttaaaaaatgcaccaaaaatataatgaaaaggtacaaaatatatgtgtgtgtacgtgtgtgtgtaatgatcctctaattgagagttagatatttccaaatactaataatacaataaattctctgaagtcttcttttctttggataaacagtttctgtcttttaggtaataggtgtttttgtttctgtttttaattaaacattatgattacttgcatgtcatttaactacttgacacacttcctccatgctagggatttttgaaaagggagtattgatttgcttcagtttttcaatgggtagaatcagacttcttttttacattttatagatgacatatttggctctccctggacaaaatccagttgaacataatagtatttaatatttaataaactacccagcttttggaaccatctggaactttattttctttgcacgcagcatctgagtttcagctgttagcatttctcctttgctctaggaagggtcaattgcttttaaagtctttgatgcttgctgtgtcagcccttttcgtatttttcaaatgcccgtgtaaaagggcttttcatccattcatgctgataattcttttgaacttgaggtttcaaccaaactaatcaaatttaattataactcaaatcctgctacagtgaactccagtagacttatagcctagataattatttatttttgttatcctggaatttagcgattaccaatgttactagaagtgggtgggccctagattgtattttgggagatctttttgtaatttttttgttatattccagatttgttatatgacatcggta

SEQ ID NO: 55419 - DNA, 2957 bp, Bovine  19866880635070
atctgttctggaaggtctctcatggcatgtgtattctgaggttgaagattcaggacatgctgctcaagaaaaacacatctgacttgattaaaagtgagcatgtgagcacaggttacccttttacctttaaactattttttttattgcacaagtgacacatgagtattcctgtacaaaatcaaaacagaattaagacttaaatggttcctacctcctaccctaaccctatcacctccatgctttaggataaaagaaacacaaacagacacacacacacacccaaccccaaattttattcacttcacttctttaggggtttgatctgtccttttcctggtggtttcctgcttttatacacatataaatatccaaagaaactgtatagtattgttttgtgaggttttacaaaatgaacacatgctgtttctgcacactctactgaatgtcagaagctcatcaaaatgagagttgaaagctaggcaactgtattctagcagcactttggtgctgctatgaatttaataataaaagtataagtggaatactgtgttcagtgcctttcacttgcttctgtccttaatatcagttgctacagaaaaaccgtagatcattctttgtaatagctgtatagtattccctgtaataataataagtacaatttattgactgttgacagtttgccaagaactgttcttacttaatcctcaagaaacttcatgaaataagcagccaatactgttcccacttcacaaacaagaaatcttggaaccaacataaaaatgccatgctttatttcatctgctgctagacatttatgatgtttccagttccctactataacaaacatgctacgaaatctccttgtccaggtgtaggtaggatgaataggagcaggcaagagctgagggggaaggtatgtgcatttttagctttaagacatactccaaactgtgatggggtatggaatggggagtgtgctgaaaggatggccagaaaggggtggctgcagggacaaccgagattccaacttcatccacttttaagttgttcctaagaacaatcctgggtagaaaaaggaatttgtcactatttctcctaagtcccctaagccccagggcatcgtctcacttctcttcttttcccccagccctgaggaccttccacccacccagctggtgcatctgggcaccagctgtgccagctttgttaggcttaggagagatgtcaagcccttcagtatttactttatcccaagaacattaaggaaggtagacaggcctccatccttgtgcaccatttatacagatgtcaggctggggatgtgggttcatttttcattctttaatccgcaggtatgaattaaaccataacttgcctcgctgacaccatggcatcaatattttctcagactggaacatggtctccctgttcttgcccaccctttaaaaataaacttaacatatggtgtttgtcttatggcaaaggaatgcaatgtgtttttcttgacatgtgactcaattcaaacactaaggaaaactttgatatttcagaggaggtttgcagttggagggaatatgcttgctaccttccccattaaacagggtaattcctgaagcacaagatgtcccaagtttctcagatgagtaccttaaatcatcatacatgtcatgtagatcctagagtagtactgtagactccatgtgatgtcttaaaatagtcagaaactaacaagtaaaatgcatccagtttgagaacaaccctgatgatgtttatataattttctcaatgaccatacaatgcttgactaatcatcaaacacaccccaatgtcacaacacaaacagacagtaaaagtttgaaggcagagacaacattaaaatacagacagacaatgatttttaaaagtgactgaacaatcatattgggcacaatgcttaattgctactagagcctttctgggtctttgaatcagtttctctgagctccctgctcctttctcctcactgaaaagcatatatgctatatacgatatatgcatgcgatgttgatctaaggcttacataaagaaaaagcaaaattattttgataatttaaaatgctttttatcatcttcagaaagggtaacaccataatgtaagccagcacttcatgggccctgtcttgagcagtatcacattgaaagaaaccagaagtttaaatcaatctaatgttaactcacatctcttgagaaaccttaaagaagatttacttcctaaatgaaagcagcatttcctcacagatgctaactctctcacaacttcaagctggctcatgacttccttcttcctaacacgcactctctacgttctccccagactcttctttgatattcccagatggtagctcagtcttttctgccctcactctttgctcttccaagtgagttcttctttgtttgtttgtttcccctctctagaagtggctctcagagctctcaaagacaactcctcactgagtctgtcttcctcttgatgagcttatggtttcttcactttcacactaatgacactcgggtccatacaattcctcgttgtggggctgtcttgcgcattgaaggatgtttatcagcatccttggcctccacctactcgaggccagtagcactgccccttagctgtgaaaccaaaaatgtcttcagatactgctcaatatctcctaggtggtaaaagcaatcccagttaagaaagagtggattactccaatctatgtattaaaagccctgggagattggggaggagtggctttgcccagagcagtggctaatgccagagcttttcatggtgggaggggaagggaaataaatgaaaaatatatttaataatgtgtgtctttattatagtacatgatccgacactgtggtcaggaaatgaaaatgactcaaatatgagttaaaatcacatgttctcagtcatcaagaca

SEQ ID NO: 55420 - DNA, 949 bp, Bovine  19866880675386
gtgctgagtagtattccctatatattatgcaccacatcttctttatcctttatctattgatggacgtttaggttgtttccatgtcttgactgttgtgactagtgctgctatgaacatagaagtgtgtgtatctttagattagagttttgtctggatatatgcccagaagagggattgccggatcatatagtaattctgttttcagttttctgaggaaccttacactcttttccacagtggctgtaactttcctactgacttatgattgtagattgtatcttcaacctatccatctatgtcagcaatgtgctagctagatctgcatcaagactacctatcctatttcaatgattatctttttattcttgtaccagtgctacactgttattataatttcattaattttcaacttttaatttttattgtgagaaattttaagaatatacaaaagagataaaattatatagtcttgtgtattcatcaaaaaacattattttaaaagcatgatttagaaaaagcaaaaatgaaatggcaaagaaaaaggagagattaataatcctaccattacatcttgttcacttatgacttagtgtctatcaataaaataagtataaactaattagccccctgtaacatgataaaggaaaagcagttgttctgagaatactagctaaggagagccagtgacacaagagccagaacaaagactatatgaggttctatatgaggttcttatattcctgaaaggcatggaaaaaagaaaagttgtataagaggcatgtgagttcataagaagtgatgaaccttttctttacatgaaattcaaagaggaatgttttatttaaacagcatggaacaagcgggcagtgtcctccaaagtaggactgtagaagctaacaaagcaaactttagattactttttctcttctcaacttggataaaaccaaag

SEQ ID NO: 55421 - DNA, 1075 bp, Bovine  19866880729427
atggcattcttgaggcaagaatactggagtggattgccatttccttctccagggaccccaggattgaacctgggtctcctccattgaagacagattctctaccatctgctccctgagggaagcccaatggatgaagaggtaaatgaaatgtggtatatccatacaatgggacattattcacccactaaaaggaacagaaaattctgacacatgctacaacatggatgaagcttgaaaacatactaaatgaaacaagctagacacaaaaggacaaatattatataattccacttatatgaagtacctagaataggcaaattcacagacatagaaagtataacagaggttgccaggagcttagagggtgggggagaggatgctggggagtcattgtataatgggtacagaatttctatatgggattataaaagagttctagaaatacagatactggtgatggtgtacttaatgctaaatgtacttattgttaatgtatttaatgctatactaaaaaatggttaaaatgctcaatttgatgttatttatattctatcacaattaaaaggatggaaaagggagaccatcagccaaatgagaagagacagtgaagcaaagggactttggatttgattcagattcttatctcggctctgggcattttatccagataatcaccctcattgttatccattccaatgtatacacagacacagaggggataactttatagagacactactgaaatccatcaaatgtttatcttctcatagagaataaaagttattaatgttaaaaaccattaaaaccattttaaaacactaaacttccaacaaatcctaagcaatacaatccattaagatgaacgaagtccctctgattcttggagaggggctcaccacagtgttactatgactacagtgggtgttgtaatgacccattcataaatgcaggcaccccaattattggttcatccaggcatgtgttatgggaaacagaaatgtgcaaccttgacctccaaaatgatgaacccttgccaactcaactgaaagatcaacttgtagactgtatccagtga

SEQ ID NO: 55422 - DNA, 966 bp, Bovine  19866880741768
ctgagtcacaccctgtcctcactgcagagtcacggttatgggagaggaaataggagtgcttactcattctagggtgcaagggggccagcttctaggagccctgggctccctgtcacacgttaacagtggctggttggtgtcttcggcacacgggcttccatggtatgtctgtgcttcccaggacctcctactgagattgtcccaggagactgcctggtgagggctgtggggggtgcatgggtagcggatgctctgaactgctggcctcgtctctttagggacctcaatcggaatcggattcggctgatcgagggcctgacgttccaggggctcgacagtttggaggtgctgaggctccagcgaaacaacatcagcaaactgacggacggcgccttctgggggctggccaggatgcacgcgctgtgagtcagagccaggcgccagggcttcagcagggccttgagtgatcctctagggcccagcccctgccctttgggacctcagcgagggctctcctctgtgtctttgggatcttttgctacccctgtggtgttatcttgcaggctaggatagtctcttgggggagtttcagaggatttggtaaagggagcttgttggtgaggatggaaggcaggggctcctttgtgggggctgttcctctctcccatttgcactccccgttactgaatgcacgctcaggtgcccagctcacagtgcaggcaaacagtgctctagcgtcagactttggaacagagaaaggtttattacagggccgtgtgaggtgggtggctcatgccccaagaacacccagagtcccaaaggctttcaggaaagtatttttaaccgccaagtgagagaggagcatggttgcttgttacaaccaacagccctggtgtaggaatcccttgatcttgcagccatccattgaaggtcaggtcctgatgttcagtaacctaccagacaaaa

SEQ ID NO: 55423 - DNA, 1252 bp, Bovine  19866880755377
aaatgagtctactttataaggttgtgaggattcatgagggtaacaaaggggaaggacttgctgagcttatgacccatggtgagcccttgagaatggtggttgctatttttcatattctgggggcataatctgggttgtggtgatgctggtgtgtggatggggagtatttagggactgacagtgtgtttatgaaactcaggctcttttcaaagctctggcaggtaaaacctcaatttctgcatcagcttttctatggcaggacagccactccttaaactatgaggcccttgggaaatcttgggaaggtgctgataggatgtctctggtcattgctttcagtgcaaaatatttccactgtttgtaattattctgagagatgcttcttgcaaaatgattctgaggctctgtatttgaaatgttcttatttcttttttctgacatgatctttagtaaccccagcttttcctggtgatcccagttctacttcctgtgggcatggagtgaaaattctgatggctgtcccagtgggaacctgatgagactggcctgcttgtaaaagtggggtctgcatgtgcaaagtctctacattctgcaacttttcaactgtctgaaaatttcagattgttgaaacaacttctaaaatgtaaaatgtgaaaagtatctcataagagctcctgtccatatttaaaatacttttgggaactggaacattcctctgatttttttttaggccaagaaagaagttgtgtcttcgattatgatgttttgtttatttaatgccatccatctggttgcttgtggatggccaggtgacttctgcatgtgtgctctggcattttctggagtgttaggacagggagtcctggcgtgctgcaattcatggggtcacaaagagtcggacacgactgagcgactgagctgaactgaggattattgttttataaaaataaaatgcaacttttgaggcattttaaatgtgctaaacaaaactggttacaaaaatgtaaagcctttgtccttttaaacagatggggggaaaatccatctttttgctcttgcaaaaagatagtgatacatctaaataaacagggtgaaaaattctaaagtgaatttctttcagggaataatcttaaaatatttataggctatcagttctaataatttaaaatctcggttgtagttttgcaacttgcacataaatgggatcatttcttgagactgagctattgaaggtcagagaaatccagaggta

SEQ ID NO: 55424 - DNA, 2024 bp, Bovine  19866880801423
ttacacagatggttgtttacctgagtccccagcaagtggcttctgtgactcattgactgtcctctgtacttccttacacagaagactgagcgaatttatgttcatgtgatgttctgagactctcctgttgtttaacaaggtagttagccccaagcagtgttctctttgcctccaaatagattctggagaaaccttggccctgactctgacagtgacagacacctaattcaaaaccgtcctggacttgctttgtgcttagttgctgtttctgtggagcggagatacatttggggggctgcttctcattagcttgtatttcacatattcagaagttacaaggtcattaccacaggaggtggaatcacacacagtcacttcatctataaaagcagtctccacggaacacaggcatgtggggccttgtcgtgtgtattagctgaggaggggcattttttacctgcaaaaagccgcagggattgcataaccaagagcagacataaaacacagaatctcagtgctgtatataaaatggaaagaaagccacaagagaaaaataggattcatcactgatcctgggctctaagttgtctggatagtttatgatccttcattagttattcttcacagcacacttaagggacaaagtattgggttcattcagaggaaggagtataaactttgaatcagacattttagcctttccgatgcctcttccatcccaccctgcaagaatccctggaaggttgtaaccctcaaatgatgggagagcccagattaatggaaaggttggaattttctgttgacaacttgcatctgttggtaataggaattctccttcagagacctaaagaaaatagatctgactgtggttcattggagttgaggatgtttttattcaggcctccaaccattatgcttctagatttgggaactaatatttctctttaggggattccccggtggctcagcataaagaatcagcctgcaattcaggagacacaggagatgcacgtttgatccctggatcagaaagatgccctggagaaggaaatggcaacctactccagtattcttgcctaaaaagtgccagggacagagaaagcctggcgggctacagtccaaagggtctcaaagagtcaaactcgactgagcacacacatttctcttcaaagacatactacccctgggttgtttaccattgttcccagtggtggaaactctccctgtggattcagtttttaaaaaaccaatttgtcaaggtatggaatagtcgagagttggacaattacttggctaacatgacctctggatcattcatctgaagtttttgcataagctgttctcgaacattgtttcacctctccactttactcttcctggtaaaatactgtccatacatgtgtgatctggagacctgtggggtgtgattgtctgagagtggagcaaaatgaggtctgttctgaaggctaacctcagaggtagccattccagggagccatactgcctgtctccaaattaggtcagatctgaagaaccagtaaatagcttcctggaagagggccaggggcagagcagactctctgagctctggattgaatcaagggctttatgagtaatttggagtattttaggagagcagaggcctgcccatttgaggaaccaccctccccctaaatgggggtatgttctgactcaaaggaaaattaactcctgttaactgtgggtctttaaaatttcctcttaacgcctcagcccatcaactcctgctccctgagcagaacacacagctcggcgggaggggaggacttggctttgggtggagcagtagagtttcattcattcaaaacaccaagtcatttcttagttttgccaagtatttctcatgtatgtggggtatttaatgcttctaagtctctgtttccggatccttttttttttttttttttttgagtaataatagtctactttgtagagttaaaaaatgaaagaacaagaacagtgtgtttcctagtacataatctgta

SEQ ID NO: 55425 - DNA, 1926 bp, Bovine  19866880994695
acaggtagttggacacgtggatagtggctggtgcccctgagaccctgaagtcctagttttctgtaatcttgattagtttaagtatgaatgtcagggtcacttggctgggtgctgctggataggagagcaggggtttacagaacagtgggggatttctcagctatttgaagacttagctcttctcattctgtgaggtctgggtaggggtcttgccaggaaaagggctcagcaagcagattattgccgtgcactgttgaaccctttgctcttcagctgcagataaaacctgtttaaaacttgagccggtctctgcggaggggcctctggcatgttgggcaaacggtgggccggacagtcatctctcagcagattagcagaaagagtatctacggctgggctccattgttggaagagtggtgcgccctttgtgcaagtacaagggaaatttgtgttatgacagtggctgacaaactgtttaatgaaagctgcagttggcagtaactaaattccctaaggtttctttcctctgcgctttggtcctgaaaggtgcagaagtgcttttgacagcatctgtcctgctgatagatggattgttttgacaggagaatctgaaaccttcaaccaataacacactcagatgtcgggcctagtaaggctgaccatgtttgccgaaataagtgagatgccttagacctgtgtgtctgtcagctgccacctgagaaaaaaggtctcctaggtaaaagtttttcactaattaactcttaaattgttattcagacccttctttgcacagttcttggaccaaagcatatggatatctttcatcttggagaaatggacgttgtcagaaagtgtggcagtcaaagagtttaaaaaaaaatctttatatgttatgccggggtgtgggtgggggatgaccatgtacacagcagcatgattcacaataaccgaaagatggaaccaaccctaatatctatcagcttttatagggagaaacaaaatacggaagatacacgcacacacaggtgaataatggaatactattcagccacaaaaaggagcaggaacgcatgacacgtgtcacagtatgggtgcaccttgaggacactgtgctgagtgaaatcagccagacactaaaggtactgatggctccactcgtgtgaagtacctctcaagtccaagtcacacagacagcatgtagagtgaagggaggtagccaggccctggagggaggggagaatgggaagtcagtgtttaatgggtgatgagtttcagttggaaaagatgtacaagtgctagggagggagggatggtagtgatggttgtataacagtgagaatgtactttatgtccctgagctgtacacgaaacgtggtcaagatggtactctataggttatgtgtattttaccacaataggaaaatatttatactgagagtgtctctcccagagatgagcaaacaagaaaaatgtctgcggattttacttcagattgtgcttgtcagggagaagaaagtaaatattttccctggtttttgatagagcagttggtaatcacataaaagttcagagctcgagcttctcttggaaatgaaggagacttggtcttcacccgcccttgttttaggaaccaggtacaaatggccctttaggtggcaggcaagtgagtggacacggctgtgtcagcctcattccccgctttgtaccaggatttatttttcagacttaaaagctctttgtcccaaagcagtgtcattccaagggacctgagcctcagctactgtattctctctgtgttggtgaaaggtgctgagagcagaattactcttagaggcagtctgggttggcgatacgtggcttttccagttgatcgagaatcgaaaaatcgcttcatccaggcagaccaagtgaacgcttagatttcca

SEQ ID NO: 55426 - DNA, 2802 bp, Bovine  19866881038873
ggggccatgaaccaaggaacatggcacctttagaagctgtgaggggccataagctttaagatggcaaaaaatctgtaatctcagtcctgaaactgcaaacaactgaatttggccaacaaggcagaagagcaaggacacaaatccttcccaagaaactccagagaggaacgcagccctgctgacaccttagtctcgtgagagacgtggcagacttctacattccagaactgtaagagaatacatttgtgctgtttaatctatatttgtggcactcttttatggcaatagtagaaaataagtacagatctcaatgagtgagtgatatttactgagaagcaggagctgaagacctctcataagcttcatctccctttccgccacagttctgtttccctgctacagggaaacacggcttcttgtcctgatggggtctctacccaccgaggtgattttgaagaagttagccaacctctctgagctttggtttcctcctctgtcaaatgaggagactgagcaagaacagttgctcccaacttaattattactatttttaccatgacatgcttcatagagaatgttcccatccaccaggcaaggatggacataatctaagttggaagaaatttccaaggttctagagataacagtcttccttcgccccatcaagaaatcatctcagaatataagtgatgtctggacagaataacctcagatttactccagtttactgagctttaaaggtagctttaaaggtaggcagtttatgtaagtgctctcattttacaacagaagcacagaatttcattagtataacacaagacacaaaactgatcatatattataaacatcaacagtgaattattactgctagtgacttcactttcacttttcactttcatgcattggagaaggaaacggcaacccactccagtgctcttgcctggagaatcccagggacgggggagcctggtgggctgccgtctctggggtcgcacagagtcggacacgactgaagcgacttagcagcagcagcagcagtgttacattactaatagtagtaggaacactggattagatgttggctacactcttcctagtactgacattgaacagagactgaagaatggcctgaattagtcaagggtgaaccacttacagttaagaaggcaggtggatagagaagggaaaaacaaagttttctaacccttaaaaaaaaaattcagtctctacataccctctgccttcccatcacaccaaacaacttgaacacatccttaacatggtaatatattattagacttataattatttaattaggaaatgacacccaaatgcaatcttcagtttgtagagggagcacaggctgagatcgtccagcaattcttaatgaatttcctactgaacaagaaagagtgaaaaaatggtagaaaggaacccagcaatatcgacaacacaggcctgagttgcagtctatttaatgtttcatgttgaacagctgtaccaggaaaagttctaaatctgaacatttcaatattttcaaggcaattcaatttgagttaggcatcctgacagagcatgtgaattcctagaaaaagagacaagcagttgctggaggagggaggcccttatgttggggacagtgtaaaagtgtgcctacggtgctgggtcctggggtcagacaacccccgtgaatacatcctacttctgtcacttactatgagtctgacatcaggtaagatatttatttctctcaacttcagtaacctcacctgcaagatgagaatgacagcactttcttcacattctgagggtttagactgatgtctggtagatacaaaggactcaacatcagctctcactcttgttaataagaccacagatacctcaagaagaaagctgacaagtggactaggttgtttcttttattaattaatataatgctatgcattatattcataaaattccttgcctgccttataaaatattagggtacttctacataaaattccaaaccctgcatctatgcttttaattaccttttggaattctccacagcctggctttcatgtcatttccattgttaaatattaatttttggaaaagttgaattgagcaggctttttgaggacaggatgacacagggcactcctggccccatcctcagagcaagggatgtgtgagtcgttttcaccgccctgcaccctggctctttttctgtcttaaaaatggtcctgttacagaaggtaggtcggttgccaggggtcaagtggaggaggggatggggaatgactgctagcgagtactaggattcttccggggtgatgaatgctgtggaattagatagtagtgacagttgcataacttcgaaaacgtactaaaaaatactcaactgtacactttaacgggtacttttatggtattcggattacagctcaatcaaaaaaaaaaaggtttttttcttcttgacacacttcctctcctgtcaaactcatacctgtcctgtgtgactcaatttagatactttcttctcccccaaggtttttatatgcatggcctatagttactatgggcttccctggtggcttactggtaaagaaattgcctgccaatgcagaaggcgtgggctcgatccctggattggtaagatctcctggagaaggaaacggcaacccatttttccccccagtatctttgcctgggaaatcccatggacagaggagcctggtgggctacagtcctgtgtgtgtgctcagttactaagctgtgtctgactctttgcaaccttgggacacgacttagcga

SEQ ID NO: 55427 - DNA, 1791 bp, Bovine  19866881107750
gggcaaaatgtttgactttctgagtttcctttcctcatgtgtgaaatgaactgttgagataatcaaataaggtgataactgcagaacaaaggttagcctgcctcttctacaacacagaatgattcacaaggaagtttttattttcaactttgaaatactcttctagtatgtatcatgtgtgaaattcccttaaatgtatttcaaatattactcatttcaaatgttacttattttatcattctgacaattttatgagttaagtactactattattgttattattagttatcatcatcctgttctacagatgaggaaatagaggtgcagagacattagcctgcttgccaagcttgtaaatagactaagtggaaggactgagacttgtgcccacatggctggctctagggtgtctagtcctcaaacactaagctatcatagaacacagtctgaatggagacacgtgggatcagatgctgtctgccttcttcactggtgcatcctgagactgcccagggggtgctaccacatggtgacagacagcccatctgtctctcagcagcctgacatcaccaagaccctcccacatcctagtccgctgtgtttcaaatgtttgattctcactcaagtctcaaaaccatcctgtaagttgaaccaaaatactttcttttcccacctggagaaatcagaagacacacacagagagagcttaacttctcaaagtcatacagctaatcagaagtgtggccaggatcagaacccctggattcccgctttcaaaaatcagggtttttccagtatatttgcaggttcccaaatgagatcattgttgggtctacattttttcacagagtggctccttccttcacttgagccagttctctgttagataccacctcacagtgagtttccctgacctccctacataaactgtacccccctcacttgccatgctgttactctgcttgttcttcacgtattagtatttgacatcatattgcattggtggtttaccttctgtcttcccactgaactggtaggttctaagaggcaagggactgtctgtcttggtcacagtgtaccctagggcctagaatcatacagagaacagaccccagaaaaaaatattgctgaataaatgaatagacatgtaggagattccaataatagtttgttattaaccttattatgattagtagtatctccttttatcagttcagttcagttcagtcgctcagtcgtgtccgattttttgcgaccccatgaaccgcagcacaacagttaggtaacccagttaagacaaaggtttatttcctaagacaaaactgatgggaaattgagtgaacaatgttggtttcaatcagatcaaagcacaaattccaagcaacaccattaataaccaggagaccacacacttgggacaaggatgtcctccaagcacagaacagccagcatcactgagtcaccaaacacggccctggttttcactgtttctaaatcctcctaagctcacaaacagccctctgctgctcatcgtaatgtttttaattcatctctcctttttccatcaggaaacacctgccttggtttactttttatcactttatttacatgttcactgaaagaccgaagcattgattttcctgagatgatgacagtaggatcgataagccacaacgagaagtatcaaagggcagcttcttcacccctatagcctgcggcagctggtgctgcaggcgaacagcctttgctgatacccagccagccccggcgattctgaaggggcaggaggca

SEQ ID NO: 55428 - DNA, 1264 bp, Bovine  19866881109027
aaaaccaatattgaaattatcaagaaccagataaacagatgtcaagtagtatgggtggatcaaacatattattttatgtgactatttatgaaggactttcacctttaagcctttaaactaaaatacatgctcggtatagctaattctccacatcccgtctctcacactcttcatttgttacttttgaaaaaaatcagtgaaattttccgcagagatcagatgtgaagaaatctgtggcagggtgaaattttatagtctggatgctgcctttttattaaggtgtcatttcctttccttaagaagaatgaggctcttttagggtgggtctccgtgaatgactcaaacccttttagtttgggaagtccaagtaccaagataattttcacgctgggattacttgtccagatggtttgagcgcagttttcttggcatgcttataagaacacaggaattttcaggggaaacaagagaacatagtagggaggagaagaagtggagaggataagtgtggctaagaagtcagaaaaaattttggattccacaaaatggcactggttgaactggaatcagttcctagttatatttggcaatggtagccctctgccttctccaagagcacagacttttctttgtcatagtgggaattacaggactctcctaacagaggacagaggaggaaagaaccagagagaaattcacagtgctgatggaggtaagcatggaagggtagcagagaacctcactagcaggaaacctgggggaactcctgtatgcctgcatggggcactgagtgaggcagagaaggaaggctgtgaacggagatatcatttcaaagagcttcttagaccccaaaacatagtatgggaaggagactttctctgatggcttcagcagtcatagaactaaagtgtggcagtaggaagaatgctgagatgccccacaagattcccctagtaggcacacactatctcctggtcaggcagtcaactactgttctaagcactgctgtgaaaaattttgggagatgtaatttaggtcccaaatcagctgactttaagatcaggttttggtccagcaggatctaagacactctacatgagtcctttaaagacagagtggcatagatgagagtcagagaggcctggaggaaagcaaacaaccatgtttgtgaaatgcccatggaggtcatatggcaagcagtgcaggcgacctgtaggagctgagggtgactcccaactgacagctaggacatcagtcctacaac

SEQ ID NO: 55429 - DNA, 1853 bp, Bovine  19866881114254
aatcttctcaaaaagctgtaatgctaagaaaaatacggggacagatctttcaaactctgaggaaaaggaaagagcgacatattaatggtagaattacagactttttctggactgagtattaaaaacacatgagaatgtaatgactttaaagattgagaaattccaattctaaatccaccctgtatatttcaccagtgtgaagtatgaattaagcacataaattatggatgcaggagtgaggtgagggtgtaggcctatggaaataaaaacttgtgattaatacatctgtcagaaattagaatgctatgccagctggtgatttgttttaagcttgtctcactgagagttcatgttgcaaaagatgccagctgttcaattcaacatcaccatttgtttctggtggaccacctagaactggatcttagactcagttctgcatcataagaagaaaatcaccttctttcttagcttgaaagaagtctatgggctcccatataacatgcatggctatggctaggtggaatctttgggccaataaccaaattctacttttatgaaagtaccctatagaaaacccttggtgagggttgcatggctgtttcccaaaatttacttacaacctctaatggacctggcccaggaaactggtcccctcagcaattacagagccccctaaaagactaggtgtgtagtctgatgatttaaattctcagcagttcagggcacctccatgatgtgaagtccccaggcccacatgaacagacttgctctgaaatgacattctgttttctctgcctctgcttgtctttatcctctatcccgataccaggtgccttcctgcctctgtaagtggtgggtttctttgcaacatgactcttgtaaagagcctatgattaattatagaagagacagaggcttggataatcaattgtgcaatgcacctgtttataaccaatttcatgcttgctctcatcctcttaatggcacatggccaatttctcaaaggcttagggtgaatttgcacatatgtccgcagaaaatcctgtggacataacgttagtggcagtggagagctattaatacttgcctacacaatacttaacaaatgacagagaaactctatggaaggaaatttggcaaaattcaccaacattagaaaatgtttcatagtatttgacacagtgttaacactttctttttaccaacgggtggaagaaataacccctataataagaaaaagtacatatacaaagctgttttttgattcactcacattatagcaaagaaatgaatacaaattgaatggcaaatagaggaaatgtaaagtaagatatggtatgtccacttctggaaaataagtagttagcatcaatggtagttataaagaccaggaagcaaaatgaaaacaaaacaaaacaaaacaaacaaaccacttacaactaacgtaaagagggaaaaaaaacagaataaaagttaaatgtacatgtgaattacaagtaataaaatacacaataaactgcaagtaggaaacacattaaacgtttcaacaaaagtttttaaattgtgggtatattggctattttttaaaattttattttaattggaggctaattactttacaatattgtggtggtttttgccatacattcacatgaatcagccatgggtgtacatgtgttccccatcctgaccctccctcccaccgccctccccatcccatccctctgggtcatcccagtacaccagccctgagcacactgtctcatgcatcaaacctggactggcaaactatttcacataatatacatgtttcaatgctattgtctcaaatcatcctacccttgccttttccc

SEQ ID NO: 55430 - DNA, 1157 bp, Bovine  19866881117791
ctgccttactgtttgcgctgtcgttaacacttggctactacgctcggaccagtaggagccaaagttagtaactttgtaagaattattatttctctttttattctgtgtcttaggagttcttgatgtatagcttcttgaaaactggttttaaaaggctgtgatttaaacaaacaaagcaacccctttatatcgaaggctggagtgtttccaggataacccttcagctcaccagggcagagggtggggatggaggtgggactgcgtacacctttcagattcggtttctgcacgcattacactttcattttggtaatcaaggacatattgctaaatttaaggggtcaggaacaagtcaggagctgaaaagagctcccggttgtgagagaggaagacggtcacccctaataaaataactaaagatgcccccagcagtagattagtgaagttttaaatctgcatacatctggaaaatgggtgtaaacgttaagtcgccggccctgtttgcagactggaaggagggaaaaaaactttgaggccagaactctccaaagcgggggcattgccttctttaccgaagttttctcctcccgtacacccagagggcatacttttattccctctccccattgcgcatccccctcctccatcagtcagtaagtctcctttaagagccagaggccgactctccctttctcctcccagtcccccgcccttcacaccttgggtgggaaaagagactggggtggggtggctggagaggcgggaggggcgggatcatggtgaacgctccaatgggcgcccaaattggccgccgtggaccccggcagccaatgaacagcaggcgggggcggggcggggcgctgttgcaaagcatccaatgtgggccggcaggaggccgcgggcggctgagcccagggggtgtgtgagggcgagcggccgggggcggggcttcgggaccggcccgggctgggccgcggggaagcgagcggcgagaggctgattgttcggccgcgaggtctgcggggttctagctaagcggagcagcgtgcggagtccggaactgcgcgggcgcgctctgcctgaggcgctgggacagctaggcgcaccgggcccttggagcactgcgggggtggccgcgtcttccagcccggagtctg

SEQ ID NO: 55431 - DNA, 2448 bp, Bovine  19866881126862
ctctggatgcttctaaacaaatgttttcttataccgcttgccttgacactggagtggatggcaaaaccttctaaggagactcgtctttaatgcctgcaaaccttcttagaaaggggcatatctacttttcaggcctttgagataatttctgttctgatactgaccaaggtgactctttaagatcatttctgcaagaacaaggacattgaacaatgttctgaacctctcccaggcatctgccacaactcattctagaaatcctaaatcaaaaactcaactttcccatttatggtccatataagggtggcacatttctgccaaaaataagtgtagggtctggtgtagaatttccgtttgattcttgaagatgactggccaaataagaaagagaaaggaaaacagtttatgaagaaccccggttagcacctgctccactgtaatgtctgcttcttagctgccacagagttctataaatgtgacttcataccacacatgcatatcgtgcacccaaatgtaatgtgctatttgctgttgtcatatagctggccgtgtgcactctggcatttaaagaaaagcagcttttaaatgttagtatggcatttttcttccagctttttgaatttaatttttgcaactgaggtcttaggtccttatgccacagccaatacagttcattttattgtagaagttgcattgatcttgacagttctcttctactgagttggctaaagaggaagaaaagtgaaagcatgtcagtgtgtgatgttctagctttggaaatgaggataatttaaggacctgttttgaaaagatgggtctccctactctaaggttcactattattgctattattacagtcactttggagttgataacttaaccaaatgactaggaagctaagagagtccatagcctaagaaggggattaaccaaaggaaaaaggtcctaacttaacctgttgcaagcgccctccccaaaatcttcttctaaggacgagcattgtctgtatagaagtatttagtgataatgataatttctgttgtctttgaatacatctttccttttgtttttcacagcaactcagagaaatgggctcattctttacaaatgaggaaggtttaggggtcatgcttacagccactcagatgactggcaagattggtactcacatccagacctttcagtgtggagatttagagctttttcctcacctaggtcactactttctaagaagcagaaaatgggctcattaaattgttaggccttttaagagttaccatgctggcagacgaatagcatcttcaaaatccagctgtctccttcattgcaagagagttcataaaacaggccttttctcctcacttacactgtcagctgtgagacataaaacttcagaatgccttaaaggagtaagttggaattctgatgctgtgagccttttaaataccccattgtctcagaggagagggacaatccaggctttgtactgcagcacatttttcctcaatccccgatccctggaaggccccctttcctcagaagggctgttgtgtttttcctgccacaacatcactgtgacatatctcacacttaaggcacagcctactcagccccattcatggattcctctggaaattaatgtccgctcaccaccaccccctcaaaaaaaaaaaaaaaagttctggctttgtcaaaagagttattggaaatggaacttgtgaaaaaccttactatgtgatgtgaacccagacaataatgttttgtaatagttctgtttgatgtgtactgatgggaattaatcattttagttaacagaattgctctttgttatgtaaacttggtaaagtccgcctcatctgacctcttgcactggggaatccactgttcaaaactgtcatctttctgtgggcagcaggattcttttggcaacttctggaaccaaattaccccgtgaacttgaagttcgtactgccactgagttggatgccaaaccaagcgaagactaaaatactgtaaagtatgtatatccccatgtcccattccctaagaattggttaagtggagtgagcattattttcccatttctccatttcatttgttggtgtctcagatagccaaactctatcataaatgatcgcaaccctagaaatacactatttctagattagatacatttctgttcactgtagatatccagtgcttgtgtatgtataaattgaatccattggagaaaatagttggccctgggttgtatgcttttagattagctctttaaaaagcaaataaagtaggttcccaccttcatcaccacctcccaaacccctgaaaaaggaattcccttaccatgtggtttcccaggcatctctgacatggcttgacccagctcttgcagtctcactcaagagagctatattccataaaatcaccatcaccacgaagacagccaga

SEQ ID NO: 55432 - DNA, 1151 bp, Bovine  19866881149247
tggaggaaaaaaggtgcaaaatggaactgtgtactttgctgtgtttggattataaacaaatattcacacctgtgctgggcctctagctgatgaagaactcagccgactatttgaaacagacacattttcatacttttcataacttccagtcactttcgctcagattgccaagactgaaaattaaaagacgaagaagaaaaagagcaaacattctgtggataattaaccacaagaggaaaattgctaaattggttgaacttcataaccaatctgtgatataatcatttctgtattcaccaacttgctggaggtagaatacctttaaaaggagtctttacacaattaatggcgctgatagattgctccaacacgtaaagtgaaagagcaatgaatgcatttcaccacaatattcatgccaagtactaaagttggaataagaagcaaagtgaggaaaactaacatgatcaattgagtagaaaaatgtggccaaataaacctcaccaaaggtagtctcttggtctcttgtttttaagtctggtcagctgagtagcatagtaactccatggcatccaaatattgattgggtatccaacattccaaagtctgctgactacatagggacagcttctgtcaacaaacaaataagccctttgctgcttcagtctgtgcagttaagtgaatctttttgaaagatcttcaaaggtaattgcctggctatttttagagggcactgttaccttgctcagtttcctctcagatctgtacagagttatttgctggattttaatttcctggaattcagagttggcttagggactgagttagtttgctcagagctgccaactggtagccagacactacagcagacacagccaatgaggttgttcgtgtgatggtggagcaccatgggtggtcgtcgtgttcacatggctgactcacctgcacagccccaggcaggtccggaagcaactgtgatatttggcgaatgttaaaaaaaaaaaaaataatacatagccattttcttaaatgaaacctgaaagatttgtattagatgtttagactggaaattatgcccctgagtcttccttctttctgtaaacactagttgtggttatcactcacagaaccattttgggtcagtcccaagggta

SEQ ID NO: 55433 - DNA, 683 bp, Bovine  19866881155763
caaatgcccataaaggagcagccgcaggaggggcaggcagggtctctgtcaacgtgctgtgtgtcttctcttctccaccgtgaccatggggccaccgagagagggacagtacggactgtggcggcaccaggaaatggctctgatggtacccatgaagcacagcactttgttttctgaatccatctcctgggaaaatttcctgagccttccaggagctgggattctttttcagggaacaggggaaagtgaagacaagcgtgagactcttacttggaaccacataattgctggagcatccccaaatcagggctcttgttaacacacactagagaacgagggggagggggaagagcctcgagtggtgaaagggtttatcgtagctgtcggcaaggccaggaggagggggtcccctggaagggccagtcctcacgctgtctcttaaaaccaaacaacaattatggggcagaaaaacttcaccctgcacgctgataaccactgcttttccatatgcaagaagaatgacacttggagaaaatgtcacattcccaacaagtccaagggaaacttcccctcttatttccaaaattctagttactctctgtgacctgttgaaggggccaattccaaacacaaccctcacagaataccaatgaataattatccacaggaatgtcaggaccaga

SEQ ID NO: 55434 - DNA, 1514 bp, Bovine  19866881174375
ttaacacagctaaggacatggatcatgtggaaacaatcgcccatcataatcaatccgagctggcttcgtatctacaggcaatagtcttattctggattatcaattctgcaagtcagatggatccaattattactacaggatcctataaaaatgtatgttttctgttttcctgattactataacaagaagtccatccaacgaccattaaattggaaatgaatttttttctttcaagctggtatcctaagcccatgtatctgtcagtttatggggtctacatcaaaaccagcagttcatagttttctgacaaatctccatttcaatttatttcaactataattctcacttacctttatttgcaacaacaaaatgcctttctctctcagactgttacacctctcactcactaaattctttccagtctctgcgtcctccctaaaacctcactggaaaatgcgtatgacaaagtgatggatagcacgacattgcatattgtcactctactctttgtttaatgtctagaaaaatgcccagatgtttagatctccgtattttctacaccgtgcagtttagccttcggtaagttgtggagcagcctctgctctcctgacactagttaatctacgaggctgtcaaacatgtcacacggaccgtgaatcactgcctcctgcagaattcgctgaagccccccaagaagtgctcgaggcagacagctgcactgggagccctgcacccatagctcggctcttcgcagagaggccttgctacattatcttcaagataatccacgggcctgagtgaaggctttcataaaaagaaaacgaaaaatttgtcaaaaacaaattggctgtctttcaggcagacacctttttagccggaggtcctccccacacaacacccacccagacactcttttctcaaactagtggaactctctttttctaaacaatgtggaatttctgaagactgttgtttttgcatagttaatattttcacattttcctcccccttcttggtctttcccagtataatataatcctttgcacctgcaaaagccccacagactgctgcctgccaagaatccaccacacgatcttgcctccaggaccagagggcctgtggtagaggagaaagaaaaatacaagttattaaatatttgaatttatcagaacctcctgtgggttagctctggggatgggaacttaagtgagaagctattttggtggcattcctcactgatgacataagtgattttcccaaggacttaacggccttctaaaataagtcaaagaaaccagggggacagggacattagagtgcccaaaggaaaccattttcagggaatacgtgtgatacacatacacacacatttatatagaagtataaaaataaagacaactttaagacaatgtaacatttaaaatacttcccgtataattctaaacatgtaaataccataatacacaaattagtccaaagcagtgtataccaaattccacagttctgttttcagt

SEQ ID NO: 55435 - DNA, 1855 bp, Bovine  19866881322166
ttgtctctttgcatcaggtggccaaaatcttggagcttaagcttcagcatcagtctttccaatgaatattcaggattgatttcctttaggatggactggtttgatatccttgctgtctaaggaactctcaagagtcttctccagcatcacaattcaaaagcatcaattctttggcactcagccttctttatggtttaactcttacatctgtacatgactactggaaaaaaccatagctttcactatagggaactttgttggcaaagtgatgagatccattaccttttaaccaactctccataacttaaagctaactttgatcacaccttgtcatccacatttggcttcttcctatacatggttctccagtgaaaacgaaatttatttgttcctctctgttctcacacaaaattccaaatgctcaccaactctatttccatttgaaatgacacccaaagtaattgttctttgcacaatgtttaagatcaggaaagccagcttccacttataatagaattctctaaacttctgagcacaggatgtcaactctgtctctagatagtaatcaccgagagctctgtggtcctcattcctgcacttttgttgggaagaagaacagcagaatggaaagagcatgggtttgaatcctgcctgtgtatctcaatagttgtgtgtccttgggataagttattggaactctctgagtgtccatcttctcatttgtagaagggtgaaaagaactgtattagattgggaggattttattaaatgagtatctgaaacctgctttttaaattattttctttccaagcaaagctttatcaccagaacagtgaaggaggatcccgtttttcagtttctgcattgcagtaaagtagagagaatggccaaaagcttcagcccttctttgaaaatatttatttaaaatttttaaaagtcaaggctgggttttaaggaaggtctaggaggtctggacacttgggtctgatgaactcagtgagggacacctggctccaaatttttacacagggaggtaactttaaaaacaataaaggcacaccgcctgctgatttctttattgggaaaccaagaattatgtaactccacatcataaacaacctgcatgtgaaatgcgaaggcagaaaaaggacaagtttcatcacggttatgggcattcggagacctataaccacaaagcaagcacaggtgaagaaatactcagttttaaggcggctgaatgccaagtcaaaacctcagagtacacttgaggcagtgtggttgtattgtacaaccctgccttgggagagtgaaagggtagtgcagtaggaagcctgaagggaggatacttttatctgtcaacaatttagtttatggaaagtgatgtcagatcattaacttcgtggccatattgcagcaagagttacagaaagcagttacatattgggagttgatgacgttatgggatgaactgttggctactttttgttgatagggagagcaggtgtataaacatccatgaacttggctcagcgtgaggagtgttttcctttagaggctctcattgggcatcagagcatctttcctttagaccagagatcaggaaactttttctgtgaagagccagatagtaagtaaatgttctcagctttgcaggccatacggtcactatcaaaagtgttcaactgtgctgtcatgaatgcaaccagagataatttgtaaacggatgagcatgactgccttccaataaaatgtatttgtaaaaacaggttgtgggccagacttaggccgtgggccacagtttgctgactcctgttttggaccagtggtctctattttggtcaccccagaccctgaa

SEQ ID NO: 55436 - DNA, 846 bp, Bovine  19866881339577
cctgtagtagcaggttgattaaaagttaatgacaaatcaataaaactataattacaaccttctaccttatgtttgtaatttggaatacagtaaaatcgatcaaataagatttaatatgtaacaacagcaagaagagtcccatttgtgccatttttattaggaggtttgctgtaccaaatctctaaatccctgtctcaattattttatggctcagttttcatcagacacagaaaaagccctgtaagaagtaaatagaatctgtaattagaccagaaggcttggggtgcgtttactttagtataacagatgctatgacattgcagtggtaatgattttttttttaactttagaatttgacttttcttgggtcttattgtacttatggccttagtcaatattgttttcagaagcgaaagaacattaaagtttcttggctgttgaaagcagcccctgtgctttaacgtgctcacgggtgatgtgtgtggatgggggtagatttttcttttcattcccgttccaacttgggattgagaaagctaggaacacagtgataccatgttttctttttcctttttttttttctggccacaataggtggcatgtgggatcttaattccctgaccacggattgatcctgggtcccctgcagtgaaagcatagagtcctaaccattggacttccagccaatgcccagtgatactgttttctgaagtacttctaacagtacttctccacatagtaatatggcccagggagcaccgactttagaatcagttgcctgggcatcagtttacaaatgaagtttttgggaagtgacgctgtgggtcctgcattttcagcacgatt

SEQ ID NO: 55437 - DNA, 984 bp, Bovine  19866881409925
tgaccgtgacagaccatcaaatgctcctgattccagggtgctgatccggttgcttgccaggttgctggaaggattcaggagagaaaatgcaggggtcagtaggaggccttccttgtcctgttacagacgccagacctggctgagttgggaaaacaagctacaacacacccagcaggctgggtttccaacgagacatttgtcattctgaggctgcaaagcccatcttcactcccagcctcaggtattaggactgtcttcttcagacgtgacagaagcctggcttgttcgagcccagagctcaccctgctttcagccagggtgactaccccaggaggaagtcaatgacctccactccagctgggccgctgcaggaatccctccttgccagctgctacccaaggggcagggttcaaggttggtgagaagagcctcaggaagcagaaagtccactgtgaggcaaggtcggagagggtttcacaatttggggaaacggcctttaattctgaagtggatcccattgtatgacttctaaatgtgcataaaacatttcattttaaacatttcaaatgtgtcagagcaacattctagtgaaggagagctgcacgaatggttcccagcggggaagagggaagggaagcggggccacaacacttctccttccaccttccctggaccgatgctgcttgttgtgcctttaacaaaagagctaagaccagagagaattttctacatcagagctgggaagggaaggaggcattcttcgtctccatccggcagaggcccagtacagggcacgtgaggattctttgcaaacggagctggactgtttgttcttaacactccagattaaagaacagtctgtgtgatgaagatataccggccagcttctgccaaaacacagagtccccctactttcgtgcagagagagagaaggtcactgcgaggcggttcagcaggggaggtgtttttgtcccaagcagggtg

SEQ ID NO: 55438 - DNA, 874 bp, Bovine  19866881420038
tagtccagggatccagtagacccaaaaggaaagctcctcatccctacaaaggcaggtctggccctggccaagcatctcctttgtcttactttatcacccaaagcagtcacacactggagtcaagacctccacttatctatgaaaggatgtcaaaagaacctgaggacctctttgaaataaataattttctagttactttgttccatacctgatctctcaaagactatgagtttgcagggtggtccatttagtggctgccatgggattccctagtggctcaaatggtgaagaattcgcctacaatgcggaagacctgggttcgatccctgggttggaaagatcccctggaggaggccatggcaccccaccccagtattcttgcctggagaatccccatagacagaggagtctggctacactccatggggtcacaaagagatggacacgactgagtgactaagcacagcacatggtgtctagcacatatcttggtccataacagataaatatgtttagcagattcttcttgccaaatgtaaccatacctaattttatatccattccagtgagtaagaaaagattgggatgggaggaaaagcagggatgggaggctggggggacgggggctcgaattgtttgcttgtttgttttaaaccacctaaagattttgaaaatgaccatgtgatacatagatgaccatgttctttagagggcagaccatgggcatgacgatagtatttgtgacgtgaattatgggtaatcagtttggggttatattgaaccaatctttctaattggattccaatgaagcacctgctttctgtcaaactccaacttgtgcataggcaagtcacacagaaacccatttacatga

SEQ ID NO: 55439 - DNA, 806 bp, Bovine  19866881507007
cttgcttagaacttgtcacatagcagatctccagaaatatctgtgggacgatgctggaatgaatcctgtctcacgtagtgtgttgtaggcatgtttagtaaatgtttggggaatgagccaatgtatgaattttgacccaaacttattctgagtaaccaaactgcctgaaaaagcacgggagacatactcaaaaactgaggccaactgtaagtagatttttgaacacacagcaaggtagtggctctattaagagtggaaactttagctgtgaacctagaatatgtattctgagaaatcgagtgaaatgttctgtctagttctatttcagaacgaacttctgatcctgaaagttgcattctacagttttcctgaaacatctgactctggtatagatcttgttaaaagagagttaaataactcccatccaccccaaattggtgtacccaataatgtgtgttttaaagcaggcttctcctttactagatactttctatctcactctttctcatgttaagtggggagaaaaaagttttcgtcttggtcaccatgcagcaatttccttgggaacaaaaatagtaagtgtagaagggaaaagcacaaagccccttcttaagtgggtggtcaataccaccttaattctcggttgtaatcctcacaaacccaaagccctgtgaactattaaattactctggggatttcctctgggctccctgccccagctggtctcacgatgttcttggcaacaggcagattggggtaatgttctctgaacacctgtcacctgctatgtataataatctaaatag

SEQ ID NO: 55440 - DNA, 699 bp, Bovine  19866881520605
ggtgtgtctatccaagaaactgaagactcctgaaaggcaactgttaaatttttggatcaaacttagaattaaatgaaagtggacatgttatacatttcctcccattcacctagaaagatggcctgattgattatatttaaaataatgaaattattattgccccccataagttacaatattaaagtcttacaacctccttcttggtgcacacactttttttattttccaagataggctcccatgtgtggttaaaaaaaatactagttcccttccccttttcccatctctgttaattttattttttctttgccctccccctacacatacagcatgataaaatagagtcagtgcaaatgtaccatttttcaaatgaaaaggaaatctaaagtctccaaagagatttggtaagcatttaggaaaagcgtatgaaatctcaacactgacaaatattccatacccagtcctctttttagtcaggggacaatgtttctacccacgtggtcttgctgcagaacaaaggacaatgttcttcctaaaccctggtaaaacagagttcaagtgtatcacagtaagcaatgatctcattatgtatattgtacatgtgaaggaagcaccagatatttccatctgtccatctttatctgcagcaaattgatttcacaacttttccggatgttaaatgccaagccccgtataaaa

SEQ ID NO: 55441 - DNA, 722 bp, Bovine  19866881598268
agaggagcactgtcataggaaatcacattggtgtgaaccaaagcctcacatgccagcagcgttctcaagatgacagcgtctatcacatgactcagaattacatccctctccccttcagcccatctgtgaccccattctcagagggagacaaggaccaagcgggacaatgtttgatctgctgagcttcccagagcacaccctcaacccagaccagcttgatctttcaggaacagaacccacacagatgtggtccacacgggccctcactgtgcctcactctctgcaaccaaaatacatccaatcctgtgtgtgccaaaggagctggctacatttttcatctcagctattaattccactgccattactgccaattaacaagtactacgaatcgagagttcaaagtctcttaaggggcccagtatcacattaagtggcaactttcttttaagcttcctccagagacattccaatcaatactaagccagagccgagagccatttcactgtcaactcaagacatttatctaaataaaagtcaaaccacccttgaaattaatggtacatctgtgttcggggcacagcctgaattaaaagcaatttgtccagggattatgttaccataaaaattgaaggtggtaatttttaaaccacctattgaagtcaagtgtgagcttgtctgttcttgggagtatttacaatgagatacttacacagaaatcaaca

SEQ ID NO: 55442 - DNA, 1148 bp, Bovine  19866881764337
attaaagcaaatcacccagtggtcatgtagttattgctttccggtgaaatgcaaacacataagccagaggcatcaggggattctgtcacctttgaaaaatgattcgttttttgtgggcttgtttttccctcatgggaaacctggtaacatttcagagcctgaaatccttccttaaactaaaataacctgttgaagataaatttaaatctaaggtaaaagaggagaattttttttttcttgaatttagaaagatgtctggtcatgctattgcaatttttttaaaaaaagaaatcataattggatttcactgagtcacaatttaccctgaaattgcattaattaaagacatttaagactggtaaataaacttactaacacatctgttctagactctgtgccatcattaatcaatcatagggctccttcactgggcctcaaaatccttctcaacacagagcaacaagagaaacctaactgccatttcttgttctcagtgaataaagaggacacaccctttggccattttaccagccaagctaatgctaaacttatcccttcagtgtaggttctagattttataggtgaagcaagttcagggctcatctcagaagtttggtaatacttgctttctgtgtttccttttaacagataatctatttttcacttattctgcctctgtcataccataactgatttcctgctctctttataagagttcaaacacaaaaataatatcctgtacaagaataaggaaattcctagcagcagagaagcaggcagtcagataaacgaaattgccttattttccatacagtgaacttagtggctgtagtccctgctgaacaaacataccagaaggtgagaagctctgtaaacagatactgtgaaagttgtgataacaaccagcaactgatttttcctcagtgaagagattttccatcagattgcacttgaccttgagcactgtgttactagccatgaagtaatttagtggtacttattacagtaaggtcccttttaactgacattatcagggaattagatgccttaaatgagtgaattggctagatactaagacttgctccctttacaggataaagaaaatctttattataaccggttcggtacttatttttctcagatgtatg

SEQ ID NO: 55443 - DNA, 805 bp, Bovine  19866881890102
ccctgctctgagaatgagtccaaaggttccctaaggttctcatctactttccgaccacctagggtcccttccctggacttgatgagagactccataaggcccacagaggagggggatggtgaagagcaagcccctggcacagggccctctgtagccacctccaggctggcaagcgggtttggcaccctgaactcccacctccccccagggcctccacaggtgctgactcctagccaggcacatctgggtgctgagtcagacttgtgacccacttgccaggatgagaggatgaggccaacttctcgggctggtctcctccaacaatgagaatcacaaggccgatgactcagcttcctgcccctagcttccaagggcaggtcaccaccgggcaagacaccccacctggtgaccatgcccccgtgccgctccggtcggccctctctgactttctacaaggtctcccacaccttcctttccggaaccctggagacgtgggccaggaacaggacgggatgctgctcctggctcccgggagagccaacggggcagggagcttggaccatggagtgcgtcgcttgctctgacctttattttacagcagcatgagcagagagctgcaattcggaggccggaagggcctcctccttggcatcggttcttccctattcgtcctgaaacatccgggacctggggctgcagctttatgtgcctgtccccctgctccagtcccggctgccagttttctctctcttctctggcctgtaccatctgaatatcctggccatgtcagtcagcaccaccaggg

SEQ ID NO: 55444 - DNA, 643 bp, Bovine  19866880503495
gtggtgagggcggggcacgttcagttaaccctgacaccctgctcaccagggtgatggatgccctgctcccaggaactgtctcctcttgacaccaggtttgactgtgagccagagagaagccggtgccgcttctgcaaaacatgacatgaatccaatttcctcctgaccttgtcttgccgtgtattttacttctcttgttttatttatatttctttattgccagaagctttttattttcaagcctgaagttgccacccactcctacaaaaaaaaaaaaagggagtcaaaaaggttagatacaggcaagagttaggaaatgaacctctgggcactgtcctttttttgtgattttgaagggggctgttttgatgttgtttttttttaatatttatttggctgcacccgatcttagttgccaaataaataaatattttttttaaaaaaaccgcttcctgcaaaaatcaccaaaaaagtcttagttaccgaatgtgggatctttgatcttctttggtggcatgtggaatctttttgttcttgtttcagggtgtggaatctttagttgtagcatgagaacttttagttgctgcctgtgagatctagttccctgaccagggactgaacccaggcccgcctgcactgggag

SEQ ID NO: 55445 - DNA, 1773 bp, Bovine  19866880611286
tccccctggggagggagcgggccctggggtttgtctcagatttcaagagactggagaaggggttgaggcaggggcagtggctggagtctggcccacgggctggggtttggccctcgcctcctcgtccgccaaagcctcgcggtactgcgccggccagtccttggggtcctggttgtacattttagccacgaacttaagcaccttcatcttgctggtctccaggttgctgcgcaggccccactggagcttatagtccacgggttctgtgtgcaggatgcaccagtaatccaggtatcgctgccgcaggacatcctcggtaatgagtttcttggggtccctgaagacaaggtgcttcttggtggggtgtacccctaggcgccgcaggaagtcccagatctcggtctccttgatgctattgcctttcatgaagatgagcctcagcaagatcatgaggagcccaatggtgggcatgccctggtcgccgtgcacctccgcatcctcttccaccaactccagcgtgttgaccagaatgtaggtgttgctgcggggctccagctccaccagccggtacccgaacactactccaggtgcttagccgcccgccacagcagctctgggagcacgtccttgtcgttgccgactacatgccgcaggatgtcagtgcggcggatagggatcttcctctgatacttgatcaacaagaactgcaccagctccgccaccttcagctccagctgcttctgggagcgtggctcgggggcgggggaggcctgggcctgcagctgcgccgcagcgccacccagcccgcgagacgtgctcggggcttcctcactgccgccacccagctcccgctagacctgggagctggggcagccccggctctttggctttggccacatgttgcagcggcgcgaccccaaccgcgcagattcccagtaaccggcagcagtggcagggattgaaggttggttagcggttagtccgtgtagctgtgggcgggccctgaggagacgcggttgtgtcaaggaagctgtgggcttgcgtcacggaggctgcgcgttgcgtcatcgaggccgcgccgcgtctaggggtcgctcccgtctggccagcggccacggccagcagcggcggtaagaagctggtactccttgcagccttgtgggttttattatgactaagtgtcgtccttattcggagaaggcaatggcaccccactccagtactcttgcctggaaaatcccatggacggaggagcctggtagactgcaatccatggggtcgtgaagagtcgaacacgactgagtgacttcactttcacttttcactttcatgcattggagaaggaaatggcaacccactccaatgttcttgcctgaagaatcccagggatggcggagcctggtgggctgccgtctatggggttgcacagagttggatacgactgaagcgacttagcagcagcagtcgtccttattaccaaactctgcagatggcaaacaggaagcagagctcctgagcgagtgtgcagctttgatcaggatcacacccaggccagggctgtagaaacttgagagtcaagagctctgaaatcagggctgtttgtaggtgaaggaaactcccaggatgaatatgggagaaaaatacggcgaagggtgtggaaaggaagtaagagcaatttctttccacacaaaactgggcgtaaagagaattaaaagaccccaaggactactagttggccttcgccagccccttctcaccattttccgccaatta

SEQ ID NO: 55446 - DNA, 2075 bp, Bovine  19866880964841
gaggaagcctggaaggctgccgtccatggggtcgctgagggtcggacatgactgagcgacttcacctttcacttttcactttcatgcattggagaaggaaatggcaacccactccagtgttcttgcctggagaatcccagggatgggggagcctggtgggctgctgtctatggggtcacacagagtcggacacgactgaagtgacttagcagcagcagtagcagcagcagtgagattgtattcgtgtgacactttttgtggatatacttaccaggtttgatgttgagtttttttcttttttttgactgcactgtgtggcttgcggggtttttagttccctgaccaggaattgaacctgggccctcagcagtgagagtgcagagtcctaaccactggactgccagggaattcccaatatttttaaaatagtatttgtctttcagtattgtgggagtctgtcctttgaattgtggggtctgtctgtcagcattagttgggagcctgtcagccttgctctcccacagatagcaactttattttatccctttatgtaatatttaattaaattgcactaaaatttttattggaaataaatactgttgtatgtctgacatgtggtcagcataacaagagtgttggcaggcagacctgagacagtgtgcagtgtgccgtgggtcccgtcactgtgttctgtggaggcagtagagcttttgttctgtgtttaatacttagtggaagctgtttcatgaggccagactagtaaggcttagggcttattgcttccccaggtggcagtagtggtaaagaacccacctgccaatgcaggagatgctggttcaatccctgggtccagaagataccctggaggagagcatggcaacccccttcagtaccttcagtattcttgctgaataatcccaaggacagaggagcctggagggctacagtccataggatcgcaaagagccggatatgactgaagcgacttagcacacacaggactttactattcattcagttaaaacaaaatgaaaagtcagctttctacttcttacctttcttttaaattttttaaattaatgtttttggctgagtcaggtcttggttgcggcgtggggatccttttgttgtggcgtgagagcttttctagtgggaggtgtgtgggctcagtagttgcagtgccaggcttagttcccctgaggtatgtgggatcttagttcccgtaccaggattgaactctgtcccctgcattggcaagtagattcttaactaccagggaagtctctccatttcttaattgcttctataacaacctgaaatagaaactagatttcatttgtgtcaactgtatacattagtgatctagatttttgtgtgcttttggctatatggattattttcagacatttaaaaggcttatttagatgtacagctatttttacttagatagtttgtgctttttaggtcaggtgtggtcctggggagatggcgactatgggaagctgggcagaggtggcagtgatggctgcaaaacgccaaagctgattgaaaagctgcaagacttggatgttgtcaaagtccgatgtggaagccagttttctgttgccttgacaaaagacggccaagtttattcatggggaaagggtgacaaccagagacttgggcatggaacagaggaacatgttcgttatcccaaactcttggaaggattgcaaggtgagtgcaaaatgtaaacttttaaaaccatttgagaagttttcttcagtaatcttttaaagtttgcaggtattttcctttacatgacattctgtgaatgacccatgaaattagaagcttttacccacattttaatagatacagataataaatggaacgtggtttgtcggtattaaaaagtgacctagaattattctcagcaaatttaatttgaaactttaaatttttccaattttggagagttgttttttgttgtttttttctattttattggagagttttttttgtgtgtgtgtatgggatcggggggcaagtactcatttcattactcattaaattggccttggtgagattagctt

SEQ ID NO: 55447 - DNA, 1528 bp, Bovine  19866880996150
accaagaacagggcctggaagatatgtttacaacaaattctacgtattattactttaaatccacattctcattccatcctttcctctcacaaatgcaatacacttgtaaaaacattaatattttccttatggaaattcaccttgatttaatctctcagaattatgccaagtaacttgcctcaaaaaactacgaagcaggaaacctataacctttcagttcttcctgaatatgattaagaaacaacaagcccctaaagtatctaccaaatcatttactaggatttcaagaacgctcacccattcctaagcacactatggttttggtggtggtatggaaatcaaacccaggcgacacaactgcacagggcatatggcgtcactcctgacacagcccgctctgaagaggcggaggggggctgctggtaagcaacaggtgtccccaaggatgcccaagggcttcagaactgatgagttctacttctaaggtacactgatatgatattgactcgataccatacattagccacatgcagttgttcgaacttaaagtgaaatacaatgaaaacatcggtgcctcaggtgcactagctacacttcaagagctcaagagccataccgtggctaggagtcaccacactggatggctcaggtacagatcatcatcatggcagaaaatactgcagaacccatgctaccaaacagtaaaacctactttaaatagttaatagttaaaatactctgatattaaagcataaaaactagcataatggaaccaaaaaaagtctataaaggacccaaataagtacagtttacactacaataagagtggtcttcaagtcactgggaagaagatggatttagtcaataaactgtgttgttgcaacatgtttgccgtctaggaaaaagtaaagctgaatccctactttatcccctatatcaagataaatttcagatggttcaaaaaggtaaatataataacaaatgaagctcagcttggtgctctgtggtgacctagagaggtgggatgaggtggtgggagggaagctcaagagggagaggacatatatataaatatatatccctgattcatgatgtttgtgtaacaaaaatacaacattgtaaagcaattatattccaataaaaaaataacgaaaacaaaaatgattaaaagaaacctgagaggatttcttaaacaatgtcatgctcgtaccgtatttacagcataatacaaaatccagaagccataaatgagaaaatttggcagatctgactttgcaaaaactagaaatttctaaattctaaaatattaaaacaatgttataaggcaaactgaggagcaactcagcacagatggcagagaagggactcattttcaccagaattccttgcagcacaagacggctgcagcgcctccagcccacgcccctgcagctcagcccacgcccctgcagctcacctgtgggtaggcggtgcccatgccggacagcaccgcgaaagcacgtcccggcccttgtcccctgcccggcca

SEQ ID NO: 55448 - DNA, 1197 bp, Bovine  19866881190673
catctcctggcacatatcacaccctgaactctaaactgtagcactctgccgtctcagtcagtctcgtggggtcttgtggtggatggcatttatccagctcagtgtcctgttagataatcctgggtagaatctgaggcaaatgaatccacatcctcattctccgagtcgtcactgctgtcatctgcagccggctcccctgtgagggctatgcgagcataatcatctgtgtctatcgacttgcaaaagtggatggcgtatttcagtttctcctccagcacctgcttacaggaatacctgggcaacttcaacaagaagaagcatgtgtaggattcaggaaggaaatggtcaggtgggttgtatttatccaatacctgttaatgaaaaatgttaaataatcagagaccatatacaggacaggtaaaactgcaatctgttttattacgttcattagagttgacttctcatttcacatacagcatgatgtttttggctaagaataacaaaatatcagaaaaaatatcatctagtcaatttcagaaataaaaaggaacaactcattaattcttaggactttcagtaaaaaatagcaattggttgctgtgatttcacccccaggggctggcaggtaaacagagcctgattctgaccagtaagaactcaaggcagaactcttatcctcaatcgaatgggcactctgatttttctcagtaaggagcattatttattgattcgcctaattcaaccagagactcaaacaaatgcttttttacatgatgtatgtgctcagaatctagaatatgctgacttaatagcaacatattctgggggtggccagatacattttttagaagtaggtagtggtacccaacacctgtagtcataaaattctgagctctcatatcagagaagttaagtgtttttcattttgtttcccgagggtaggaaaaccatgtaacaggaaagaattgttttctcatctgtggcagagctctgtgtgaggggcatgactctcagttgatcccaaaggacatgcaggagccacacctgaatgacgaagtctctgccccgaaagtcagcgatggtcctgggcagccttgtgcggccccacacaaagcgaaggaagagggagcgctcagtgttggagaaggactccatcacctcccagaaccacggatcaggggcgcagagggctccacc

SEQ ID NO: 55449 - DNA, 3568 bp, Bovine  19866881266840
atttgagatggaaagtccgcattcacagacttttttaagtagagtgatcctggctcagggagcagcaggtcctaattttactttttggcatcttagttccccaaccagggatcgaaccctcacccagtgcagtggaagcagagtcttaactgctggacctccagagaagtcccttattattattatatatatattttctagtgtttcaacagacctacacagttcacttacactgaagacaagtaggaatatattctacgggaagttgataaagtttaagtccatgaacaggcagactacttcatattacattttcaaatggatgaggacttaatgaagatctctcaccatagcttcagaatgggcgtatttataaccctatcctgccaaaaataattacttcccatttttttcttgccaaccttttcaatgcctttcacagaaaatgggaaaagggagctggtacaaataggggtgtttcccacaagaaataaggaaggttttggaatctgagcagtttgaatgccttgtctgttctggaacattctgtcttggaacgttccctgtttttatgtttgtttatttcacatctcattcattctcttaagccagttgcacaacattcctttccaaatgccacagttataaaagactggactggctccttatggtacacatggttgtctgctgaggatccccagtgtggttctggaactgagctcatgacccagggggcctgatcctgggttctctggggaaggagcagaccagtctaagcagcctcgggggcgggagtgagggtgggggtgcttctgtttagagccctcttgctcctacttcaccctgaacctccaagagtctcctcaaccctcctggtcccctccccaggggctgtgtcatcttgccccctccacccccctgctccagggataggagcccttggcactgactctttccttctctgcccccagggtagcctctaaaaagaaggcagagagtccatttttaatgttattattgtccctcatttttaatttgtattcatgtgcagttatttcagtttttcagagttgtattatgtgttccgaacacatattactatttgtttttcagctcatgcatggaaatgcttcatgtttctcagggatgattccaactaaaactggtctttgattttagagtctcagagttttttcagatgaactctgggcattcctaaattaagaaaacatgtctaaatgaaaatagattttaaaagaaattaaaatgaataacattagaaataattttaaaaaggtaaatgagctaccattgtcagaaaccattgtgaatcaccataaacaacatacaaagcaaaaagggtgggtaggggcaaggctcattgcatggaggacagagaggagggaaattttatgttttgcatataaattacaattaagaaagtatggctttctcagcttggtaactgagttgaagaaattggagaatatgaatcagggtatcctttagaaaaaaatgatatccatgtacaacctggatcaaatttcatatgcatttgtcttttgtggctaagtataataatgttatggacacaaattttgtattaaatgcagccacgaagttaagagatgcttgttccttggaagaaaacctaggataaacctagacagtgtattaaaaagcagagaccactttgccaacaagggaggtgaaaccagtcaatcctaaaggaaatcaaccgtgaatattcattggaaggactgatgctgaagctgaagctccagtactctggctacctgatacaaagagctgattcactgggaaagaccctgatgctgggaaagattcaggtcatgaggagaaaggggcaacaggatgagatgtttggatggcatcatcactcagtggacttgagtttgagcaaactccacgagatagtgaaggacagagaagcttggcttgctgcagtccatggggtcgaagagttggacacaactgagcaactgaacaacaatagaatcaaaacatttgatgagaggaaagataattttgcttctttccaatcttcaaaatttttcttttatttcactggctgtgacctcaaataaaatgatgaacagacatggttatggataggtttctttatttctcacctcagaggagacactttaaatatttcacaataaagtgtgatgtgtaatgcagactgtttatagtgactgtttaagtttctgtctatttcaagactactaagttttgtgtttagtcagtttctttttttaaatcatgaataggtattgacttttctcttatgatttcttgctgtcttttgagatgaccatatgagagatctcctttattctgttggtatactgaattacctggatttgagttctcatgttgaatcttgtgattttgtgcctttttaattcaggggttttgattatttatttatgagggagaatgggctttcatcttgatttttcaaaatgtccatgtcagatttttatgttaagtttatgctttattcataaaacacatgggaatagttccccgttttcttttctggaagtattattgttcatattatttctgttttaaagttcaatagaattcactagtgaagacacccagatctggggtttcctttgaggggaagtttcgaatcacagattcatcagctcccaaaaccagtcaaactcttctgtgtttttgtaccagttttgactggttgtgcctttctaggaatttcccccttccatctgttttcaaaggtcttggcaaacgtagcagtaatactctcgttaccctttttctgtctgcagggatgcgccctgctgttgttcacaccttcgggagagaacagtgagctggttctgggagagagtgggggctgatggaggttgctgccagggcgggggtattgctaggaccatactgaccacaggccccacttcacccccctgtcaggcttccctcatggccactgcctggaaaaacccagcaggaagccttctaacaagagagaaacagagctcccaaagaccccactccaacatgaggggtctggagctgagacatcacagctcccaccttgggcttctcagtgtcctcaggaccccaccccacctggaggagaatccgtctccccactcttcttcttgttcctggggcgagctgaaagtgtttcagcccaggctcttatcaaaatatcccttcttctgttttgagaatccttatgaacaactgtgttataatttacattatcactgtccattagggttttaaaataaatattacaaaatgtgctcttgctgttactcacttcactgtcttcccctcccaaggatccttgtttgattgcgttctttggtgtgagtggctggagtgttttcacagcggccacctcagaagtcacactccccaccctgcacatcctataatcagttcctttgtgctgatatgatactttgcctggtagagaattcttaggaaagagtcccatcttttctctagtcagtaactgtgattctattatctactagtttccaagactaaaagcaagaaa

SEQ ID NO: 55450 - DNA, 877 bp, Bovine  19866881323329
agggtggcctgtgtgatgagtagggtctccgggtaaatctctgaacctctacaagcctcaggctcctgctgtgttcaaaccaacccagggctgttttgaagtggattcaatgctcaaacacccccgaacacagggaaacactatatatggacatcaccatgctatcacttctccccagcacgtagaaacccagatttccatgcacccatccagagaactgtgctccctggcacctcatttggctatgcaactcattatactaattattctttaaatctgcggatgttccttgaaaagctgctttatttataaacaagttgcctgacagcaaaccttggagcagaagtattagcttcaaaagccgccaattcaaacatcagcaattcagaggaaaaaccataaatggcctagcacctaatcccagtgctgaataataaatccatcattagcttgcagcaatatctacgaccaagatttctaatctctggaggcaagtttctaaggcaaaaacagctcggattttaaggcaaattttatgatgctatggagccaggaggtctggtcccaaggcagctgtgaggccaagtctttccatcctcgatggtggggccaggctatcggacaccttgctgcccggccacggaggtggagctggttggaagaagtagagaagcctgcagagcccaggctcagggcagctggctcctctcgaggctgggggggcagttccagaggcctgggtctggtgcaagagagatagcggagggggagcgatgaccactccctgatgctctaaggagagagcacagcccctcaggaacagcccggtcctctctgcctctgcacacacatcgggccatgcccttgaggatggatg

SEQ ID NO: 55451 - DNA, 2778 bp, Bovine  19866881512141
atggcagtgctcccagcagacgccacctcaggatcctcgccgacacagtcttccaggtgccatgactcagaatttgcgttggcaggtcacatctcgcctacttgaaggtcctcaaagaacaggcaggggcagacagtcttccaggtgccatgactcagaatttgcgttggcaggtcacatctcgcctacttgaaggtcctcaaagaacaggcaggggcagttgcgggtgcccataaaggcagtcatgcttacagaggtcttccacgtccaggcagcacggagaggtcagtagcacatcagtgttctcatcaagaacaacctgaatggcttccctggtggtccagtggtaaagaatctgcctgccaatgcagggggcatgggttccatccctgttccagaactaagatcccacatgctgtggagcaaccaagcccgtgtgccacaaatgctgagcctgcactccagagcacatgctccacaacaagagaagtgaccacacttcagctagagagcagcccctgctcaccacagctagagaacacccatgcacagcaaccaagacccagcacagccagatcaagtttaaaagaaaaaaacaaaacgtgaaaagctagacaaactatggaaatcaactccttgaaacagcttcaagcaatgaaattcagagatgccacagtaaggagagaccctccctgctgaagggattctagcctccacagcttctttaatcctacagacacaggcaggagtcctggcctgactggaagagacctggggtccaagcatggggttggctttcccctccggtcatgtgcaaaagacataaatcttaaccaaagagctactgaaagcacagtgaagacaaaaatttgtaatccggaaaccccagagggctgtgaagaacacaaaagactcttgtctggaagccctaaagggtcggtgctcagaacaaaatgcggtttacctgggctgcagaccagctttgacgcagcagagcctggatggttgaaggtggtggccaccaggtaaggaagtcagccaaccaatttcaaaacagttaccgtgcccaagaaaacagagaaaaagatgagcataataaatgagaggaagactttcaccaggtaattccagtctttaaacatggaactaaaaaaaaaaaaacacacacaaaaaaacagtatctaaattcggtaactcaacagaagggtttgacagaaaattagacacaacaggaagattggactagtcaactagaagacaggtcaattaaaacagacactcaaactaaaacagaaaacagggagtctggaatgaatatgcacatgctgctatattttaaatggataaccaacaaggacctactgtacagcacagggaactctgttcaatgtcatgtggcagcctggatgagagggaagtttggggaagaatggatacatgtatatgtacagctgagtcacttcaaggtccacctgaaactatcacaacactgttaatcagctataccctgatataaaattataagttaaaagaacagtattatagaggaagtataacataacaaaaggcctcacatttgtgatttagaccccagaaagagaaaacaagaatagggtggaagaaagaatggctgagaattttccaaaataaacaaaatatcaaatcggccaagctggcttactacagaaacagacagacagattacataaaagagaaaatcttaaaagcagtaaagggtggattttgacacacacacattatcttcaaagaagtaacaaaaagactgaaagtcaatttctaacagaaatgatggaaaccacctttaaagttcagataaaaaaataactgccaatggaaaccacctttaaagttcaggaaaaaaaaaacaaaaaactgccaacgtagaattctataacgaagaaaacatccttcaaaagatgaagatgaaattaagacttcttctaacaatccaacagaatttgtcaccagcaaacctgcaccaggaaaaaggaaaggaaaatgaccctgagggaagccagatacaccagaaggaataaagaccgatgaaaagggtgaaggaatactgactgcagccaaatcttagaggctctgaaaatgacaggtggtactgaccagttagtcctaaaggaaatcaacccctgcatattcagtggaaggactgatgctgaagctccaattctttggccacctgatgcaaagagccgacttactgggaaaaagactctgatgctgggaaagattgagggcaggaggagaaggggatgatagaggatgagatggttggatggcatcaccaactcaatggacaggagtctgagcaaactgcaggagatggtgaaggactgcagagatggtatggtgcagtccatggggtcacaaagagtcggacatgactgagtgactgaacatcaacaataacaatatacacataatatataagcacaggaaaggaaacagttcaactgtgaataactgggccttctccaaatatgaccttggactctttttaattcaaatccatatttaacactgtgcatagcggtttctgcactgcacactctacgcagggaatgctggcacaggaaatcacagtgggaactcagaaagagataggatagagtgcttttttaaaactgaaaacctttctctgactatataaatagcatatactcatgttgctgaatttacataacatgaaaaattatacagaggagaaaataaaattcacccatctaccacattcagagaaaccaacga

SEQ ID NO: 55452 - DNA, 1363 bp, Bovine  19866881729158
tccatgggatcgcaaagagtcgaacacaactgagcaacttttccacacacacccatgtaggtataactgaatcacttagcaactgaaaacactgtaaattaactatatatcaataaaaaatttatataattataccttaaaaaagaggaacactatctaatctactcacctctgtgcagtcattcagaagagataccgttgtgtcagtggggttgatgttgattgtctttaattcaattaggttatttagtgaatttccacctaggaaataaagggacaggagcataaaggaatcagacaaagaagttttcattatataatagaagatacttttttgagtaaagtaactcaattacctgacacaacaaccagggaaggcatgtagctactgtcagcaggatctacaatcatttttaatctatgaacaagaacatctgggaaaatctccaaacgaatccaatgctttaaaagaaaaagaaataagtattctactccattacttgtttattagaagaaagcctccctctatgccccagaaatgatgtgtttatagccttttgacatagggtggtccattaatatccatcaatgggtgggttacagaaaacattagaatcaaagtagaggaaaagcaccattctccaagtctaaccttcatggctagatgaggcacacccaaatataagtgcaattaaaataacattctaaaaaataaacatatatttattagggtatattagaaaatcttctaacaagaagcagaatctgaactcatacattttatgtgggggagtaaaacaaaacaaagccctatttaaccctctatcagttagataaaatccatcatttatattttttaaaatctctgacaatgaaaactaaatggcatattactctgtaccattaaaataattatgaactaaaatataaaatgagtactgacaggtgacatcccagtataccttcataggattttcaaagtttgtgttcaagctctaaaacgtaacacttctaaacaaagtgtctttggacatgcccccatggcacactacctttccttgtgaaccagaggactgccagcagggctcactgccatcaataagacgagaggcttggttcacagaggatgacacgtttagactcttcaccatccgtgcccagctatccagcagcattcccggctgactgttgtgacagcgtttcagctgttttccagaacggccacaaaatattgcagactgtcctatttaatgatggccaaacagtgttaatacttgtagaacagaaacttcacaaccaagaaataaagaattttttattgaggtccttacttcaagaaaacagtaagtttccaaattagaag

SEQ ID NO: 55453 - DNA, 1840 bp, Bovine  19866880117930
tgctttcctctatttctttgcattgattgctgaggaaggctttcttatctcttcttgctcttctttggaactctgcatttagatgcttagagaaggctaagtgctcagtaaatccatttctgtgtcttctgggcacaaagctacactatacttcccagccagcctgctggttaggtggggccacatgactggttttggccaacagaatgggggtagatcgtctccaagcctgtgcacaaagcctcctgtgggatcctcgattccgtttctgtcagcccatatagaggacactggggccctggccaaagatggcacctcaagatggatggaacctggtcccatgtgaaagcatgtagcagactctctcaaatgtgtgttggaaatgaaggtaggcaaagaaatgaacttctactgtgttcagccactatgatttggggatcgtttgacacataaagttagcccaccttgatgaagagagtaatattccaagaccatttcttttcctaaagtctagtacacatgatattttcctcatgtgtgaatccactgaaataacaaacaaaaagttagaaagctatcagtgtgatttgcatttcatttcatatttagcaaagcattttttttaatgtagaaaattggagcagtgcatgctgggagatcaagaatgcatggttaaggcattcttagtcctgaatttaagagacatctgagtatcatgagctcagatgcatttggctggattaacccaactctatggaacctggtaaacgtggggtgatcaataaaaaaggagttcctgaaagagaaagagaaagctagaaagagaattcttggtcttggactgaaaggatcccaccaacattcgctgccaccttgggaagtctgaccaggctagacagctgcttacgcatgtgtgctgtgcgctctgcctttgatctctcttcctaaacaacactggacatatagaaggctcaagacacccagtcctgagggcagggaagtggctctgtaggtgaacagtctctgtggggaggaggccctgagctgtggctgtctgagctacatgctgaattgcccagagctcctttcacgcattacagcttgctgtctacattgatcagattaatcacaagttgccatctccacagctgaagttaatgttttttaaaacattccagggattgtgtaagtcatatagtgtttcttcatgggatttctcattttctgtgcaaatacactttgccagaattgttagtatgcctgtttatggtcaggttccaggaaactttatgatattctccaagacaaattgagaagttaaaacttttttgctgatgtttttacatttaaatattgccaaacgaaagaaatgaagtgttttctaaatacggacaacaaggtctagccagaagagatttgtttttgctttctcctgtttttatcataccttccagcacgacaagtccatagtacccaactaattaaaataaattttgggctcccatccatttttgacatacagagtccaagtcctgcaggcccagggatgccccccaaacatctcactttcctggacgtgtaggcatctgagaacccaatccaaagtgctcaagctatcaagtgtatcccagtgtgtgttgatgcatcttcaaatttcccatgccaggagtatacaaaacttggaactcttcactgcttcttctattcctctcacttattcttaatccaatggagagttgctgggaggttttaaggagagagctgacctgacctaatttattctcaaggagaaaactctaagacatggactagaggggacaaaagaagaagctaggggaag

SEQ ID NO: 55454 - DNA, 794 bp, Bovine  19866880453319
cccagggtttctcatgatgtactctgcatataagttaaataagcagggtgacaatatacagccttgatgtactccctttcctatttggaaccagtctgttgttccatgtccagttctaactgttgcttcctgacctgcatacaggtttctcaagcaacaggtcaggtggtctggtattcccatctctttcagaattttccacagtttattgtgatccacacagtcaaaggctttggcatagtcaataaagcagaaatagatgtttttctggaactctcttgctttttcgatgatccagcagatgttggcaaattgatctctggttcctctgccttttctaaaaccagcttgagcagctggaagtgcatggttcacatactgttgaagcctgacttggagaattttgagcattactttactagcgtgtgagatgattataattttagagtaggctgcaagcaaagctgtctgctctttgtgtgtctagctccatcttccagaaatgcttgctacacaaacatcctttgaaggacaaaagggtagtttcccagtagcttggcatgctgaaagttgtaaagtcctttgtatccgacccaggagtctcatgtattctgtcaacatccatgaaattgctagcatccaggctgagtagggtaaatctgagaattttcctggtttttgatagctgtatgttggtccagtagtttggaggctgttgcagtgattcaggcgaaagataaattccttaactaaggctgtgaaaagcagtatagagaagaaacaatagattccag

SEQ ID NO: 55455 - DNA, 613 bp, Bovine  19866880695700
ctttccttatagaaatgaatggtaggctagatgtggcatgcaggccattttaccagcccctgatctagaatctgttctttgaaattttggttttcttgttgtttgttgcttttgtttttgacaatattttaatgttataataatgaagatttaaaaaaaaaatcatagatggtgcagatcttctctgaagggcagagaaatgggttggctgtgctgcattcgtatgaagaggccagctgttttcactctgcattgctagttgaaaaagccatccggtctcataacaagtttcaagcttcagtgtggtatttcaaaaatagaacttgttgctgaaacatctctgtccttaagcatttggaggggatgctaaagcaatatcatgtgccaaatacatcacatgtccaatactgtcattaggtaatacacgagaatctctgatttctgtatctaaatatttaatcatgtgcgtgcaaataagaacatggtgaatggatgccgaaagaataaatagatgacaaataatatggcttcacctgaatgtataggagccagtgatccccaacctttttggcaccagggaccagttttgtggaagacaattttttcacacatg

SEQ ID NO: 55456 - DNA, 798 bp, Bovine  19866880999341
catcacccaggagttgtgagagatgcagagtctcaggctcctggcagtcctgctgaatccgaatctacattatcactatcccctggcaactcaaatgcacgctcaagtttgagaaatgctgctctggacttcatgaaacatagcaccttgccttgtgagcagtcacgctcatctttcttccccgagctgcatagagcaattcagatttaaaaaaaaaaaaaaaaaaaaacactacccaatgttgcaaatggtcattttgaaagagctgcttctcaggttccctcctccaagcccgagaggccacactttgggggcggagacaacaagggagaagtatggcatgtttgcctctgtctgagcctgcagtcccccagagggggctggacacgctgctatgcgttcgtgggtgcctgatcaacatgggctggctggctgaccagcccagatgtgagaacaaaatgtgcctctctctgagttgggggagatggaccgaccgaactatttcttgtttagggcgagcagtcccaagtcggcttgactctaggctttgagaagcaggagggctacaggtgcagagcgggaaggaggggggtgattggaacagtaagaggccaagcaagaggctgcggggggcacagaacgtatttactgtactcagggcatggaataaacagagaagaagtatgccaatcactgcctaatgaattcgcttctggctgccaaagtaggagccgaagaacaatgaacaatccgagcggcttctgtttccacaatgcagccttggtcaatgtccatggg

SEQ ID NO: 55457 - DNA, 1299 bp, Bovine  19866881121043
tttgcatcttttagtcccaaattccctaaactcttgacagcaactgcaaacatggccacgccttccaaagctcccaatggtaaaacatttcctaatccgcttaatgatgctgaaatgcaccctttttcttagtagatttaaatatctcagttgactgcacctttgaccatggtgtctgtgactggaaacaggatatagaagatgatttcgactggaatcctgtggaccaagataatggtatgtagtcttcagtgatccatgtcttgtggtctggccctagaattaaaggtatccaatgattcgagcataattgttctcatggcttgtgaagtcagggttgtttgtcacgtttagaagcttttagaccttcccaagtctcccctgataaatgattgacttagtccatttcccacccacctaccctataaaagattctccagcaaacctcttccatattcactcctctgctgctgagacacagatgtagggctttgtatgagttttaagagtatttgggaaaaggtagaaagaagttgtttcttttccccagtttaccagctatggtgctccgtggttgtcttttgagtttaggaggaaggggaaaggaatctggaaaggaaatattaatatgacctctccctaaccctggagttttaggagcgtcacccctcagagcactgaaatcataataagcagcagatcagcactctgaactcctggactggacttgcccacctattgctggaggatttctttcattccaattaaccttgaatttttctctgctgacgctctgagttgcctactttccactgtctactattgatggcctctaacttcctttgaggcagagcatttggacggcagatcccatttggatcataaatagaattttggtcatttaaggctgactctgtaattagaaataactgttatactttcaggaaatctggttctttacccatcaaagtgtttctttggagaggtatatgcccagccctcaggtaaaagatacttctagatccttccctgacactgattcctccctgagagccttccttgcaagcccttacatgcaatcaggaaacctgggtatctcctaacaaaaattcctttagaacgtgggattaagggaaaggatagaagttccctatttacaaacacctgatttgcaaataaccctgaggttcactcaacatgggatgaatcagcattttcagaaggctgaaatctcaaggacagatcaaagtgggcttgaactggactaaaaaggaaagctaccacaggggtcacaaaaga

SEQ ID NO: 55458 - DNA, 1051 bp, Bovine  19866881193586
tagtgttatgatgacattatagggcctttaaaaagtttccccttctctagtcacttttgcagagctgtcacaggtttctagaactcagcggtgctcgagtagggagcaactagtgctcaggaattcacttctgaagggagctggcagctgagaaggccagacatctctttgtgcccaggcatcaggagagctgtggatgtggcaggagaatgtgtcggagaaagaagacatctttgggtactcagatcggcgagggaggtgggaggggtccaacagggaggggatatatgtgtacatacagaagattcttggaggaaggcatggcaacccacttcagtattcttgcctggagaatcccatggacagaggagcctggtgggctacagtccatagggtcgcaaagagttggccacaactgaagtaactcagcatgcatacatgcccagctgattcactttattatacagcagaaactaatacaacattgtaaagctactatactcaaatttttaaaaaatgctccgaacagacaccagagaagtatctgattgcccttggtctacagatgccacatactcctcactgcctgcagctgccgtttcaatcagggcttcactacagagcacattttcctcttacaatattttctttcacaggaatcctgtctgtgtgagcagtgtgttcaatcccaatgccaggaaagcccagctgctggcatgatacgggttggtgtgagtgagcagaaaaagacctcaggatgttttaaatggatgggcatttgttctatcagtattttcatggctcctgaccctccgactttctctaccactgatacagttagccaagcatgagacatcctgtttctttaagaaattactataatggatggaattgggaaaataagtacagatagactgttgctactgttgctaaaaatctattttcttgtatctaaatcaagactagtgatactaatttctataaagttaaacagacgccttccctatggcctttcccataaccaagaaagacagaagcacagggctataga

SEQ ID NO: 55459 - DNA, 1408 bp, Bovine  19866881229746
aatggattgatgaaaccaccccaaaatgggacccagtacacaatacagttcaagtccactagcaagtcgctaccttaaagagattcggacatgtgagatttgtgaacacagatgatggaggtcaatctcattttgtcccgtgacttcctaagcagggtgaagtgaggtaagaggaacacaactaaaagtccaaattctccaggctcccaaaccaacagcaactaaaattcttggccttgatatgtgtgttgcatcatacaagagagaaaatagacctcttttttcttgtgttgtatcatcccccacttctcccattctcaggctccacgatgaagttaggcacaagatgaatgcctgcttccatagctaatgaagttatctctggtccttaatggatagagatgtgtggccttgagactgtgttggccaagatggtggccactgggcatatgtggctgtttaaattactcaaaatcaaaacttcagctcttcctttgtagaaagtcacattttacgtgctcaagagccacatgggcttttggctatcatcttggacagaacagatacaggagattctctcactggagaacactgctattgtggaagatcaattttgacctgccacatactctcttgtgacatgagctaggttctgagttttactttggatttcattcattcggtcctttttgaagatctagagggtgataagcactgttgttggcactgggaatacaaacataaaataagacgcattccttgccttcaaggagatcagttagatgagtaacaatttctatggcacactgtgatgactaccaagacagaggctgctggagggccagtggatggtcaggtggaggagagagagacagaaggacaggaggaaatataattcaaattggagagggatcctgaaaggctttctacagtaaaacctaggatgccaaatatgtgaacagctgacatggggacactgatacaatttgaagaaatctgcatattactggtgtacattatcttactaagcctacatcctttctcatcatttggggttatggttaggtgttatagtgcagtgcactcaccctgtaacaagagaactcaaccttccaaatccatggttgcaacttcaaaacaatctttcctccacataggctagagctgtctgcttctttcaaaggaaatgccacagctgttccgtggctcaaaacagacaaggggggatcagaagaatgatgctcttcagtccccaattcaccactagatcaaggctaacattttcctccaatttgtctttctcatggactagttctagaacagcaggggaaaccagagactcaagactttcaggatcacttcaatgaagcatactctctcagcagaagccaatgctcttaggtttttg

SEQ ID NO: 55460 - DNA, 1212 bp, Bovine  19866881323484
actattcattatttttgtgaccaagtgattcatttgattatgcatactagtgagtcttcagtaaactttctctatttagctgtgctgcaaaatggacttctccatttttcatacagtgatagccacctgaggtcaagaatcctagggctccagtgataatgctccaaggatggagacataaatattcaggtctcattgcgggaagacaaaagtcaattcattgtttaagagtgttccatttccccttggtttccgagaaggtttgaggctcctactaatatgctgaccgtctcaatcaatacatttggctcgaggcatttgtgtagtcaattctccatgcctactcttcagcatcctctctatataaaatggctggctgtgttcagttagaaccttcctttcctcatcaatatatcaacgttatacaacagcttgcaaggcatggttagatgaaactattatgttaatcctagtggcttgagatttcacaaataattcccaaatcctataacatttaaaatgtctctctatttctatagagctactacaggaaaataattttttaggaaaactttgtctgggctataaacgtcttcttagacaagcaaaatctgtcattatagtcaagattgattgacctgtctatgtatcaaatagactagtgtaggtaaaggtttataaattaatgactagcatggattttcccctcacgtctacctctttatttcagtgtctgaaatcttgactggctttgactgtgtggatcataacaaactgtgggaaattcttaaagagatgggaataccagaccaccttacctgcctcctgagaaatctgtatgcaggtcaagaagcaacacttagaactggccataaaacaacacactggttccaaattgggaaaggagtacgtcaaggctgtatattgtcatcctgctcatttaacttacatgcagagtacatcatgggaaatattgggctggatgaagcacaagctagaatcaagattgctgggagaaatatcaataacctcagatacacagatgacaccacccttatggcagaaagtgaagaagaaataaagagcctcttgatgaaagtcaaagaggagagtgaaaaagttggcttaaaaccaagtttcagaaaacagagatcgtggcatctggtcccatcacttcatgggaaatagatggggaaacagtgtcagacttta

SEQ ID NO: 55461 - DNA, 674 bp, Bovine  19866881557470
ttttttttccactagaggttatctgcaaagaccacaggaagtgtctgagcaaacttaaaggctatttctcaaaagttattagaataaatatagtaatttagttacctggtttctaacaactcaaggcctgacccctcccaccctcagcaccgttctccacacagttgtgtgaattggccaacaaatagtaataatgctggctaacaaattagaaatggcttttaaaaacgtctgctcttttgtcatgctcaaaagaaatgagcattctttaagaatgagctcaaagaaatgtacaacttgaattagtagatggacagaggagaaggtgaataggtggataagcaagtatagcaaaagttgatggtggaatcttggtggtgggaacatgagagtattctctataaaatccttttcttctggtattatgtttgaaatttttaataagaaatgttatgaaaaaaaatctacctctcattttgagaacatctagaattctaaaatgtgcctattgggctcaagactgggagcatccatgttctgttgcctgacttagtgatttcagctctgatggccaatcaaatattgcagatttatcaaatggggctgatagtgcaggagatgagggttcagtctcagtaatcctctagatgctcaagtgtttcatgttcatttaa

SEQ ID NO: 55462 - DNA, 2344 bp, Bovine  19866880574105
caggcaagaatactggagtgggctgccatgacctcctccaggggatcttcctgactcagggatcaaacctgcttctcttacgtctccctgcattggcaggcgggtactatttgtagcatatgtcaaattgtgagtcatgtgattcacatgttcatccattcaataattacacataaataagaatgagactatttcaagagattcccaatttgttaaactagaaacctatcgaaacaaatggtagacatttttcttttaactacagacactataaactgacacggatttgaggggaagaacactcacacacacaaaatgcatataactaactgaaaacaatccaactttcattataaatcctctgattctttttatttcagttctaaggtatgtttaaatggagttaactttctggatgacttctcctatccccccaaaacaaaatactttaaaaaacttatggtatactttttatacatacatgcatatgtgcatgtgtatgatttttttatattctgagatattttgttaaataaacagtcttaaaacttttatgttttacattatcatattgtttaatatggattattaacagttttgcaaagaaaaaaaaatctggcttctgaaaactgttagaccagagaatgtcagtaacagcaatctgtacttccctgcttaatctttcttggcaagctctgtctgcaccagtgctgtctggcttcagcaagcacaatgccaggagctcacactgtatgcaaccttttcagtaccccaaacagtattcagttccttctttgccacaaataacgagtttaactaggtctataacattttctttttataaacttctctattatgctaataaacagtaatttaaggcttcaaaataatgagaggtaaattaatttttgtcaataattgaaccatactgaaggaaatacaaagtgttgaacaaacttagtcaagggtgaatcaacacgctctctgactccacctcactagcccaactggttttaaaaataataataataataatattgtcattcagctatttaacatagttgtgaataaaagtcacagtcaagaggaaaagaagatcaacgcatgttttcagatattacgaatgccaacttagaagactgattttctagtgcttcttgctacattttcatctatagaactgcatacattcaagatctaaagccttaaaaaagaattttgtgagaaaagaaacctaataaatatgtataattctaaatgatttggtttattttcaaaatcccttttattttgggaagaaaatcactttataaaaacttacccaaatatagaaattattttataacatttttactaataaaataaaaaacattataaaaattgccacaactatagaaaatagccataatttgctataatagtcagaatattagagtaagtattctgtggcttactacttgaaggaattaagaaaattaatgtaaaattaaagttctttactcttcaaaccccccagaccctactcatggcaataagatggaatttcgttaggctaaaacggtgacaaagtgatgagagaaagaacacatgcattagaaaatgcaaaggaaaaagcaccttagatacaggcatctgatcacaaggtaaatcctccagtgatgaatatttacctttggtgtataccttaccagtaattctgaccctagccaaaacaatcattaggattattatcttcagccttggcttcaaatcctcaccttatctcccatatccacaaaatctataatacactcccaaaagatacaaatctcccatgactgccaaaattagcagtcccaaggatatctgacttttgacagtttcagtgccttaggctaaaagaacagagctttaatcaaatgttcagggatcagcgttggtattttaccctagttatttcataggccagttcaaatttagcaaacaatcaagtaataataacctgtccaggctgagtttaaattttttcagtttgaaaaccaaatcaagctaggtttctgggttttaaaagccacagaagatttcttaattggtaacaagcacagacaagcaggtactgatttttaaccatcttgtaaatggaacagacataggctcagaggctgggagacttgaggtgacagtataaagaggatgagggaggctataaggaaaacaaagcttgtaagaactgggtagttcttctcaccacacaacctttaagggtcaggagataggtgacattactttcttgacaattaaaaaatggataaacaatatatgcaaaagcttttttactgctaattatttcaatgcattcttctaa

SEQ ID NO: 55463 - DNA, 1402 bp, Bovine  19866880762862
ctgaaaatgctcctactatgatacaacattctggaaaaggcaaaactatcgaatcagtaaaaagataagtggttgctagggttatggggaggaagagataaaaagggagagcaaaaaggatttttagcacaatgaaaatacttttcatgatagtataatgatacatacatgtcattgtacatgtttcaaaacccatacaatatataacaccaagggtgaaccctgatgtaaactatgcactttgacaggcatcatgatgattcaatgcaagctgatcaatcgtaacaaatgtatcacgctggaaagggataccaggggtggctgtgtgtatccaggaacagctatgcaagtgtaggggcagaggggacatgggagttctgtatgatgtctcacttagtttttctgggaacctaaaactactctaagaaacaaagtctattaaaaaagtgaaaacctcaatggttaccatcacaatttcctaattaccaaactttaaaatattagtgtttacatcttatattcaaaagttatattaaaaagtagaggcattacgttaatgtgttatggtttatgaaaatcagcataacaggctatcagactatgcaaacttggcctctatctgctaagaatgtacactatgtagaagttaaggcttgaaggcctgactagagaaattctaacagaccttgtaaacttggtcgccaagtatggagaaaccccatccacctaagcacatttctaactggaaagtacaactgaactaagcttcaggcaaaggtccgtatgatgaagagcctgaattatctgcaaattccgagaatgaacaaaaccaaatcttatatacctagattccaccctccggaaagttatttctgaatacacagtttcctttaatacagaaatgctctcacaaactccaaactaacattaatgaagtcaggtaattgtcatatagatatagctccatgaaattattatattagtatacatttatttatcaagttttcttggcattcaaagtagatagtttattattaaaatagatattatcttgagttttgcacatatctgacaagcaaagtctattaagaaaaacctattttatatgaaattaaaattactttcctcatttttctgataccttcaataacacttaagaaatccttccaggaaaaagcagtggtttaattttctaaaatgtcagttacttacaaccttaatcccaataaaatcatcaaatttcaaaatcagttttagactgtaaaaggatttcactaatgtgaattactatttaaaatatttagcaaataaagtgcatacattcagaaatgaaaaattaaatagattgataggcaccattcaaaacaacattgtaactgttattaaaacaaaaccttacttg

SEQ ID NO: 55464 - DNA, 2064 bp, Bovine  19866881160820
cgacgaattggtttagaaaatttcctcttgagagttgcttcacatcccatccctttgtagagacaaaatcttctatttgtttttaacacaggtatttttcttttatttagtcttttaaaaaatttcattttacttgggattttaaacattttaaattgtggactgctgctgcttaaggattctcttggagccaccctttgttaatttatatgtattttaacagtttgttttgttttgaatttccaaagtattatatcattcttttggttaacatttttatacttaaagatactaaagatggtactttttggtatcacttaaatggtatcaaagttagtctttagttttttgaatcccggatctataaaattttggggctgtctccggtaatcttttggaatctggattgtatgtgcctctcccccatctcccatgaaagaagaacagaacgatgggtatttaatttgggatattacttatgggctattttacagtgatatctaaagttatctttaatttttaggaaggcaactggaaagagacggtaaatgaaactggatttcagctgaaggtaagggtaattgtatgaaataatgtgtcatgtccatatacaatttctagcacagtgccatgccttaatggatacttgctatttactgaatgagtgaatgttggaaataggctttacatctaatatcactggtaattttaaagaaacaatgcggtttatttttgattggtgtaatttttggtaatagtgagactataatgggcatatttatgtgtgaatttaattctcttgggaaagaacattttgaagcagtaatttacgtttaagctatagattttccccgcagtatactcacattatgctttttatgtttttttctttcctctgtccttgtcactgtcacttttagtggtgcccacgtaattgctaactctattagatagaaaaaacacttctaaagggttgaacttgggttttcttatcttagtaggctaaaagagtagccatcagtcatgcttattttgtatactgagacacggtggccagttttgagtgggcataggattcattttgtatcagtgatacaggtttaattagattttgattgctcatcatattgatcattagaattagtgtttgggaatggaactgttacctaaaaattaaagaccatgtcagtcataagatgactaccctcactctgctctgctctcccctcctggtttacaaaagtaatttaacactgcatatttttaaaagttttcatcttttatgtaaacagaatatataagaaggaaaagtaatataaattgatatataaattgataaacagttcatatgatattgcagtaacagaagttcaataggtttaggcagcaagaacagaatgtctttacagtaattttcagaactagagatttatgcattggcatataggtattttaattttaacacaaaaagacaggagaaaacatttttttctgcacagaaaatgtaattaagtatctaattttgtcataaaccaattttaacttactggttcaacttatgagttatctgaaacttcagataacatgaaaaaattagtgttttcttagctgtaactcactatagtgctcaaagagagaataatagaattttgaagatgatttgaaataactctgaactttaaaaaattgtttatattttgatagaattttatgagaactagtccaggatttcttaggagctaataatgaagaaaagaacaaactaaaatatttttttggtgatgctctttatataatagaaaatttaaaaactgttaactttttaagagtttcattgatttagtcattattttagtaactggttatcagttgtttgtccttagcacagtttttgggcgtaactgggtggccttgagaaaattcatgaatttccccatccatttagactattctgtttacagagtgccttgaatcttgggtggtcggtgctacctaagtgtttagatataatgttttatatttgggtagccttacggtaaaatcctagtttcacttttataaaat

SEQ ID NO: 55465 - DNA, 1003 bp, Bovine  19866881296993
aaaagttttttgttgttctatttttattcagatgacagaaaataatttttcgttgaagaagatagaaattagtgtttcagaagcagaaaagcgaactggaagaaatgccatgaacatgcaggaaacatatactgcttacctcattgaaacaaggtgagtgatgagaattatgtctgaggttagaaaaagctttggtagctgttgatgtaaattctgttgtataatggaatcatttacaggtcattgtcttttagtttctttactttttaacaggtgacaaggttttcttttactctggtactcttagtagctaaatttgaatgtattaattttggagggagaacaaaggttactggatgttacttgatgcttgctttagtgtcaagtaacatccagatcccatccacatcacaggcctgcccatgcgggagacacgggtttgtccctggtttgggaagatcccacgtgcctcagagtaactaagctcatgtgccacaactgccgagtctgtgctcgagagctcgggagccatgacttctgagcccacgggccacaactactgaagcccggcccctagagcctgtgctccacagcaagagaagccgccgtgcaccgcaactagagaaaagcccacacagcagggaagactcagcacagccccaaataaaattatttatttaaaaaactcaccagaaaagtcttttacttcataaggaaaaagttaaatgaattaaactgtttgtccagagaaaagcaaaggatgtgtgtgtgtgtgcggtcatgtctgactctttgtgacctaccaggcttctctgtccatggaattcccaggcaagaatactggagtgggttgccatttcctcctccagggcctcttcctgacctcttcctgacctagggatcgaacccacatctcttgcgtctcctgcattggcaggtggattctttaccactgcaccacctgggaattttgcttattataaatagtttatataaagactat

SEQ ID NO: 55466 - DNA, 3079 bp, Bovine  19866881324797
gctgcgctgtaggggttcgcgtaagtggggttgctggaggcacgcgagttcagcgttgaccgaaaccctaggggtctgtgctctgtctccggagctggtctcggtaagtctccggtcctttgaccacctgcagccagttctagtggatcgatggtgtcctggccctggacagaggggttcacaaggaaggagaggagtgtaaaactgtgtcctcaggcgctgggcagctaggcagtcagctccgacccttgtgttgaaggagctcagggcaaaaaagagctgggggcagctgtgtttaaaagaacaacaacatttgagcagagggagtctgtgaaggatgagtgggatcaaatatttgggtatcaaagagggaaggagatgtttccagatgaggcaagacaaagttccttcctcagacagggcctggtataggaaggatgggcaataaggatccagggaaagaggagccagactgatcgggaacactgtttactttccagaggggtctccccacccagaccaccaggacccccatttccagaagaatggcccagatatctcaagtgcaggaactcttccacgaggcagcccagcaggtaggcctgggtgggttggggggtctgtgagaaaaggtcaccaggcaagatgctgaatggaaatcttacggtggactattttaaaagtaatgatctcagacatttattttggtattccagcttaatcgagaaaatgttacagccaactcctagccatctgtgtgcaaaaaatattctttggtatctagcagattccgaatcctggacactcctcctcctaccctgccccacccatggaggttttccatgaacagagtgaggactgagataatacaaactccttttaatactgtatcaaaccaatgtaagaaggtaaatttatttctgacaaagtcatactgtatatactgaagtcaaatagatttctggattccctggtatctgcaggtttttctttttctttctttatctgttgatcattacagtaagtattcagtgtaggtatggaattaaatgactctcccctaaaaaaccaactgtgcttaggcatttatcaaggagcaacttgcaccagggtctttgctgtatgatgatcactcaactgtgaagttttcagtctcttggatatctctcgtctttatagagagggttagaggggttttctggcattataacagggagaatgagccccccaaaaggagagagaatcaactcacggcctcacacagtaacaagagaatggggtccaaagccggggagccctgagccaaagggcagaggctggagaggcagatgggattcaggattggtggggaaatccaagctggctagttacccctcttcatgtgcatgggtacatatgaaaaatgcatcgtggtggctggcagctggcgagtgctcagcaaaaggtactgctccccttccccctggcgggcccagtactgtatcctgcattctctactgagctccttacacccagccccctaaatattcaaggtgtttagaaaaaatgagtgactggagacccagaatagctcctcagagagatttcagaactcttgcccagaggtctttgctcctaggtgaacgagccagtaccatatttttaatgtggttgagtacccttatagaaaccttgtcttacttattttatttaactttaagaatgtgtttagctcgaccagtttctcgtcatacttgccatgcattttatttgtgtttgcaagactgtacatgagtgtttatgcacctaatatatgttcatggactacttcctaaataatgggtactgttaagcttgaaaaatgtacccagatggaaaacataaggccctcatttccagggattctgaaaggagagcatttggttcattgctgtgagagggatccattgaggctcagctgtgaccctctctctcgtttaaaaccttcagtggctctcctatccaccactcaagagttcaaactccttagcctaggtcctgcacagtctgacccagtctgagtttcaaacctgctcccctgcatcttactctctgtaccccaccttccagacaaaggtccattctctaggccctgtacttgtatctttccccttgctggtctttgctaatacttctcactcagctgatttgtctctgaactctccaagtatctaaggctatgcttggcatttaagtagcagtaaatgttaattgactaaccaaatgaacaagtaacagatgaccacagtgcaagctaaattgccatgaattccctaagagagagttgattttatttttaaaattttttgtaattaattaaagccacaactacgtggcatgcgggatcttagttccctggccaaggattgaacccgtgccccctgcagtggaagcacagagtcttaactgctggaccaccagggaagtctcgagtgttgatttttaaaatgatgaatgtaaatgcctatgtatcaccttcctctccatctccctcagtctctgaacatacagggattagacagtgttcaatgtcaaggcctttggtgttcattatctagacatcttggaaatctctccctttgtcttcattgccctgtcttgtccaaggtatcattttttaattgaattatttcatatcttcctaacttctttctccacatctcgtctaaagcgatccctttttaaatcacaagtctgtacatttgactcctctgcttaaagcctttccatggcttctcgctgccttcagaattcagttcagactccttaccttggtccccacagcccctgcccacccgccctcacatgatctgactggcttcccctgctccctcccgtagcatgctctgtcagtgcacttgctctgcagtattgaagtgagctgtttctttcctgtcttcctgggtggtggtggtttagttgtgaagtcatgtccaactcttgcgatccccacagactgtagcctgccaggctcctctgtccacgggattctccaagcaagaattctggagtgggttgccactcctgtcttccttaagactgtgaatccctaagttcaggg

SEQ ID NO: 55467 - DNA, 1885 bp, Bovine  19866881603033
ctcctccatccataggattttccaggcaagaatactggagtgggttgcccatttccttctccaggggatcttcccctacccaaggaaattgcctggtagctgagttggtaaagaatctgcctgtagtgcaggagacccaggttcactccctgggttgggaagatcccattttatgtaaattaggagctataaaaaaaaaaaaaaaatcatgctccagtcatatagtgatataataaagtgtaaagtatttcaagtgtttgtgattcctgaaaaaaatatactttagcagtcatgaagattttagtcatgaatttctgttctgaaagcggtatgaatagaattgtagacatccttttatgcattttgtattcatgattattttaatggcttaggaaactcaagacatatttggccattgctgtaaaacctctcttttgtttttagttttaaaagttgccttaaatcctgtcattagtttaagaaggattatatagacatttccccaaataccttttgcttcagtgaataaaactttaacatgctgttgttaggaatttgagtacatgttctggaataagtgtcttttcctttcctatttaacaaaatgagaagaaaaaagtattattttatttgtgtcagtgattttaaaatactaattttgccatgtattttgcactctgttttagtcacaggattggattacatttattggtatcaatgatctttcacaatcatcttgaaaggtgacaaatctatttgattttgtttatttgcttaaatagtcattggtaggatatgtttcttcctctctttttggctaaatcccaacttgttatttctattacactgtatacttttcaataaaattatttattatagccagttcttactactctttgtttcttttaaagttcatttgagggattcagaagtaattttatgtttattgactcttgggtccttgtcttttgaggcatttgtgttgactttttgtgtgtctgcatgctttaaggagtacccccccattcaaatacttttcacttcatcatactctttgaatattattttcagaaatagatttattaattgaacttgttttaaagagaatagatggtagtttatatcagttccccaaggttatttttttaaacaagattttactcttttatgtggctcttagaaagtatcctatttgataggaatctgttttagcagaaaacatagaataagtaatcttgctttatagtttttcctgatgagagtcatattattgtttattattattgatttcgactcacctggtaagtaaatgaatcaaagtatctctatcagtcggttgttttagggagctaacctagaatggtctatttttcagtattctccagtgctcttaaagttgttagactcaactttttttttccccttgctgctaagtcgcttcagtcgtgtccgactctgtgcgaccccatagacggcagcccaccaggctcccccatccctgggattctccaggcaagaacactggagtgggttgccatttccttctccagtgcatgaaagtgaaaagtgaaagtgaagtcgctcagtcgtgcccgaccctcagcgaccccatggactgcagcccaccaggctcctccgtccatggggttttccaggcaagagtactggagtggggtgccattgagttttctttctatattctttagtaacatagctagtttcctaacacttttcatatagttctgtgtgatatttgatacctaattaattgatctggaattgtgagatagtggtactgagtggagagttatactctttcttagatcaaatagtgcccaaattgggaagtcatagacaaggctctgatagcatccatctagctaga

SEQ ID NO: 55468 - DNA, 1738 bp, Bovine  19866880425694
accaaatatgtggggtttttcctccacccccttccaattctctgacaccagctctacagtgcagttcaattctgatactaacccgagttaactcagatcccacattattaagagctcagtcttgtaagattatccctacttcatatgccatgtagattcccaagttacctgcaatttctgtctgacttgtctacaaatcgtacgttcctatccatcccctctcacatgtttaatagtatattagagtagctcatagaacccaggaaaatagagcttgcttactattggcaatattttaaaggatacaaataaaagccagagagagagatgcattgggcaaataatgtgggaaaggactcgaagcctccatgccctccaagtgtaccaccttccctgctcctccacactttcagtccagaagctctctgaatctcctccttttgagtatttatggaggctgcattacataggcatgattggtgaaataattggctactggtgattaattcaacctctagctcccctttcttcccttttccccagaagttcaggagtgaggctaaagttctgctaatcatgtggttgatttccctcacttcagcccctatctgtagaggcttttagaaagtcaactcatcaatctaaactcaggtatggttgaaaggggattgttatgagtaacaaaagactttcttttcatcttttttggctctgtatcacttaggaagtttcaggaagctcctttgtcacaaacaggacaaagatctaatatatatttcatattactataaatcacaatatcatagaaggaagatgtaagtttgcctaaattaagttcgaaaggtgattgttcatttctctgcttccataaaattgaatactcttccagaactgctgaataaggaagtattagcaagtaagagcttttcactataaacaaataggaactataagaaaattcctagataatgatgaaataaaagggaaagcatttcaaatgaatgtgccacatatgaagcttattttactatatattatgtcaactttcctggatgtttgaaaatttgtataatactggaagatgatgtgtattatcttggagtcaatatttatacttagaatttgggggaaagtaatctcttagaaatgactcttggcttatgaaaagtatgtatgttaggcaaaaagaaactgttaaccagtttgatttttaaatggctttataaaatttactttttactaataaagcacactcagtaaataaaacaatttttctatgaagtcaattcaaagagcataaatactaaaacagttacctaagaatatttagagaataagaatgatctacagagaaaaacttactagtcagaccacctatttaatagataatatatttaaaatatttgtttgaagcatggttgagctggcaggaaacttagggaaacaactcataggttgaaatgacaaggatgtttgattccataagagtaggcaaagtcacagtttgttttgagggcatttgctggcacctggcagtgaggtgcttggtttataaaggcggtgtactcagaggattggagacaaagcctagggctcaagcagaatgggaaattggatcagggattcccacatcaatttaggacccttgaagggcagcatcttccttgagagatctaaaaataaggaaggcatgagatgcaggaaggaatggttaaacctgtgggagcctaaacaaaaa

SEQ ID NO: 55469 - DNA, 1355 bp, Bovine  19866880437049
atttttaattttctttttattttaacaaactaggaaaggacataaaatgtcaaagaacttctattcctatttgaattcctaaaggttcaaggattctaaacctctttcagccctattataactttgaaggcaatgattcagctctgattcacatggtatacaaaatatttggttgttcttcctttcttctctgcctgcatgatgtgctggaacactttgcacgttggaattgtaagctctttgagttcaggaactaggtcataaattatgtatgatatttgagcaatgccaagcttaaatatttactagtatgattttatctactaccagccacacagacataaatgttcccagtacctaatctctgtaagcagataattcctctaccttgccttttaaatccagagtcctctttaaagagatttttctttgcatagtggttggcttataatccatctactctcaccagaatgtgagttccgtgagagcgaaagtattgtctgttttgttcaactctgatgtccccataacttacaacagtgcctggtacttagtaaatactgagtgctgaataagtgaatgaataaatgattgaattatcaagtcactggccatcttttgtaaatattaccctaaatatcctatatgcatatgcaaacacaaatggctcttccatggccttctctctctttccactcttccccaccaactcaccagaaaaactaaatagtcattggccattcttaaggatctgactgtcttttgctgaacagaaaatgaaaatgctttgcttttataaaaccttatgtggggaacttgcatctcaaaaaagatgtttgtaatgcctaagtgttttctgttttattaaatccagattgttgggtggagtcccttagctaaaagtcactctcaaacaaaatgaattgcttgttattctcacaaagaatttacaggaagcaatttgtagaggttgccatcaggctgaagtcattgttggcgctaggaatcggtgtgtcatcaacctcagagcagtcatttaacctgggtctgctcagagaaatctccataatgcaaggaaaattgaattctactgcttcagattacaatcacttttgatattattccaatttgatcatggactttaaaatatttgacatatcagtttcttccatcctgccactatgtagaaatatctactttatacgagctttgcactgtgcctatcattaccaactgcttcacaaatagcctttttttttttttttaaatctgcgctcctaatgggatggattataaggcagcaaacacttcatgatccaatagctccaaatttggtagttttgaccttgaatgaa

SEQ ID NO: 55470 - DNA, 2171 bp, Bovine  19866880450555
attgacaaagtggattcttaaccactggacccccagggaagtccagaccattgatatgattttgagcacatggagaaggaagtagtttcccttgggcagcctcttttgcccactattaccaaactttatcacaccccactccagtactcttgcctggaaaatcccatggcggagcctggtaggctgcagtccatggggtcgctaagggtcagacatgactgagcgacttcactttcacttttcattttcatgcattggagaaggaaatggcaacccactccagtgttcttgcctggagaatcccagggacgggggagcctggagggctgcagtccatggggtcgcacagagtcggacatgactgaagtgacttagcagcagcagcagcagcatcacaaatatatatggatatgcctttttaacaaggatttgtatttttttaaataatacagaaaacattatagtccgtcaatggctaaaaagaaaaatcctgtttctgtcttccagtctctcttttccatgaagtccagcagaaaatgaaggaaggaaagaaggaatgagggcatgggaaaggaggggaagagggaaagtgatagggagagagatgagaggagacagaaattttccctttttgtaaggacaccagtcatattagattagggtccactctaatgacctcatctaaacaacctttgcaataaccctaattccaaataaggtcacatcctgaggtactggggggttaggattttaacatatggatttgaaggggtggcgacacaattcaactcacaacaatccataattctcaatattccagaagttatattttgctccagggttcaagttctagagctaaatatatgcttaatactataatggggaggatgtcggtgtatatttcagaataccctctttcctatcaccaagaccattatgataattgaagggtagaagaccatattcttctatcttgaaagatttatatatcttttgaagcaaaaaattggaggaacatcaaaattccttttgtgtataagagactgattctttgactttcagtgggaaccttttattaatttacttttcaatagggaaagaagaatacagtacttctctctccattaccactccctgaaggaggggcatgggaagagggttggttagttcctgattcaacctttgagagcaacttgtcctgttgctgatacaaaccaagtgatcacatgttaactgcagattcccacttgcccggtgtgagtgaggctttgtactgaacaaaaggaagacagctctacatttaaccacagctaagtcctttgtgggacagacaggaataacatacagattgcaacccataaataatgcacctcaggtcatctgcattttgcctactctttaggacacaggctactattcctggacagtctgcattaaccctggattcctgactccagagcggattcttgcagagagtggtgatttccttcacctcttcctctccctatattttcagtccagacaaacataaataaaccaagcataaataagtgggcagtttctaccctgatcactgaagctctaaagatagggcactgaactcactaagtgatgaatacatgccatatgggctaacggcaagttcggatgtaaattgtctctgtcttgctctctgcattgcagataaaaagtcccttgtgtcatctctttgtactgaactgtgtgtatctgaaaacagctaaaatcactgagaaaagtggaacgtttaatttcctctgaaaaggactgggtgttattgctggcatttaataattagtagatattttaaaaacattctttgagtgaggttgcacacatttgcttttatttggaatcccatattttaagcaaatgtttgactccttttggctagctgccttaatagtgcagtgcagtatacaagagttggagtcaaaagattctcgtttgtctgacgttaatatttgccaagcacttactgagagccggcaaccattctaggcacttaatgtaagttatataatttactcttcacaataactctagaaaacaggtattcctggtattcctgctttttatacaaggaaaccatttaaatagttcctagaagagctggattcaaatccacatgtcaaccacaaagataatactct

SEQ ID NO: 55471 - DNA, 1526 bp, Bovine  19866880485984
aacagagaattacactgaaatattttacatcttacttttgaaatggaatcctgttacactctgtaaaactcacatagaaactaaagatatttaaaatgaattatcactaaaactaaggataaagtctgtctagggataaagcctttttcttttaataacacactaccagtcatataatatgtacacgaacactattttctataaaactgaaaaattctctgaaggttcaaacatgccaccaccaagcacctaataaaatacaattttaaataaaggcaaacaatttgcttcctattactaatctgatataggtaatattggaatccaattttctttcaaaggtgtgtcttttcaaagaatatccaaccatccaaacattatttaaaaaaaaaaaagaaaaatgttaaaaacttttgtgttagaaattgtcccaggactatatttttacatttttagcaacctgacaaaccactctgtttgctttcttctgccaatacaaatcaagccaaggagtagtttcttcatttatttcattcaatgtcacaagactatactatgtcagggtaaaggtcaatcatcaataacatgtgctgttgataagttgaaatataagtgttcatctgggccctatttcaaaggctggcccattgtaacctatttaataagatctataaaactagaagaatatgggaagtccaagaagtataaaatacccctttcccaccaaattttgtttgccaacatcctgtagtaaattaaagaaggtacttacagaactttatgtggtgggccatcagaaagatttttttttttttttttctttttttctagaagctttaacaacctcatgttttaaaaataaatttgcaggaaggctaccctgcaggcatctatgacagtgtcacaaggtttcatatctagcgtgggtagctggataaagttggacattgaccagttttgtgtatgctgaaaggcaccaggatggaacgctgttttcggcaattggttatgagactgccagtgcagtgggttggaagatgtatgcgttggcactctgtgtgaaaccagtatgcttgctgaaaaggttactgcagtcttgactttggcagctatcttcttcaagtgatcatgaagaactaagagtgagatccagagttaaatctatgaagatcagaagctgtgcatgtttgaagtactgcctgtcctttataacattgcgtcctctgaaacagaagcatggagtagtcccttgagggcggaaggggtgggagggttacataattgagaaagtgtcacattttaaaacactcaggtaattaaactcccaactttcagggtggcatttaagttaaaccattagcagatgtaattatgtaaatggaagaagcaactctgtaatatgtaagtacgaatatcatcaggttaagagccccacactctgtctactatatgtctgtgtctttctaatgtacattctgagccctctgcatccaaaaacaatttgtgagactatacagtctcacaga

SEQ ID NO: 55472 - DNA, 3197 bp, Bovine  19866880507730
ttttattctaatgctttgggttgacattgctataactatcacagaattagtttgaatgtcagatttcctccaaaaatagtatttcatggtgatttaaaaggctatgtagctactaaggaataaattatgattttgaataataatatcaagaatgttcattcctccagtatgttacactcctagaaaagctactggaagtcaaaattagagaagccaagtttttattttctatagaaataatggtataataaatccagaattatattcaaaactaagggtcaagtatccacattttcctagcaataactagcaacactgctttaaataaatgtcatataacgtaaagctttgttgagtttatttataaactgacaatttattgactagggcaactcagttacctgtcatgtgactttatatttcctaaagtatcatcatgttctataaatatttcttggtcatttctactattgcatttaatgttttaaattgaagtaaaattggaatataacgttatatgttacagttatacaacattataatttgacatttgtgtacctacagagtgaccaccaccaaaggtctagttaccatccttcaccagacagttgatcccttttacccatttcacccatccttcaacccctcgccctccaataaccactgatcttatctctgcatctgtgagaaatgtttccttttgtttgttcatttgttttgttttagatcccacataaaagtgaaatcatataatatttgtctttctccatcttatttcacttaatatcctcaaggttggatacccatgttgttgcaaatagcaagatttcattctttcttacggctgagtagattctgttgtctatatattcacacaccatatcttctttatccattcagccatcagtgggcacttaggtcgcttccatatcttggctattgcaaataatgctacaaagaacataagggtgagtgtatcgttttaagttactgtttttgtatttttttgcaaaaatgcccagaattggagtagctcaatcatgtaatagttatttcttattttttgagggatctccatactcttttccgagtggttgtaccaatttaccttcccaccaacagtgtacaagggtttccttttctccacatcctctctgacactattatttcttatctttttgataatagccattctaacaggtatgaggtagtgtctcattgtggttttgatatatgtttccctaataattagtgatgttgaatatttcatatgcctgtaggccttctatatgtcttttttagaaaaatgtttatttacatcttctgctcatttttaaaattgggttgtttagtttttctatcgttgaggtttctttctattttaaacaaagtaattaaaagctgaattaagatcataaattgcagagaagattctttggagtatcgctttagagcaagaatttggagcagaggttttggagtatggcatacttggtcataaaacctacttctgcctatcattcatttaaaaatactgaattctagtcgccacagatcccataatgaacaacagagacaacttccgcagtctcatggactttacatttgagtaccacttgctggccatgacataagaaaatttttaaaaacatctctagggtttaacctcctcatcataaaataaaaataatagcacctaccttattgcataatttttaaaattaaactaggtaatgtctgtaaagcacctagcacatgtgcctagttttatattttaacatctgcttttgaaaagaattgtaagaaatagaaattcataaaaaaggagaacctttaaatcatccataatcttatcatctaaatataactgttattgctattttaatataatacttccaaatttttctatgcatttttttcaaactttagacttttaaattttatttggttatagccaattaacaatgttgtggtagttttagatgaacagcgaagggactcagccatacatatacatatatccaatcccctggagaggggaacagctacccactccagtattcttgcctggagaattccatggacagagaagcctggtgaactatagttcatgggactgcaaagaatcagacacagctgagcaactaacaaacacatttatcctcaaaccccctcccatcaaggctgacacataacattgagcagagttccatgtgctatacagtagctccttgtcagttatccattttgaatatagcagcatgtacatgaccttcccaaattcactgtcccttctctctggcaaccttaagttcatttgctaagtctgtgagtccctttctgttttgtaagttcatctgtaacatttctttttagattccacatatacaggatgtcatacaacatttctccttctctgactgacttagtaagtaagtctgactctctctaggtccatccatgttgctacaaatggcattatttcactctttttaatggccaagtaatatttcattgtacgtgtgtaccacatcttctttatcccgtcctctgccaatgaccatttaggttgcttctgtgtcttggccatcgtaagcagtgctgcaatgaacactggggtacatgtatcctttcaaatcatatttttctctggatgtatgcacaggagtgggattgcagggtcatgtggtagctctgttattagttttttaaggaaccgccatactgttctccatagtgactataccaatttgcattcccaccaacagtgcaggagggttcctttctctccacacgctctccgacatttgtcgtttgtggattttttgatgatagtcattctggccggtgtgaggtgatacctcactgtagttttgatttgcatttctttagtaactagcaatgttgaacatcttttcatgtgcttactggccatctgcatgtcctctttggaaaaatgtctattcaggccttatgcccatattttgagtgggcagtttgatttgatgttgttaagcatcataagctgtttataaattttggagactaatcctgtatcattcacatgatttgcaaatattttctcccaatttgtgagctttttgcgttgttttctttttcatgcatatatttttaaaaactataacatatacttttattttaacatccattttgcctaattgcccttcaaaaaatgt

SEQ ID NO: 55473 - DNA, 1290 bp, Bovine  19866880531846
tgatggcaccctttgatttggtacaaacctcattagccatactatagtgcagtatagtatttgtaatggaataacacataagaactaaagactgcaaggtatctggttaatgtagagatgaaatgaatgcaactgcaaggctaagctttcctgacccttcatgaaagaatagatgaaaaaaggaagaataagctattgtgccaaagggagatgatgaaattcaagatccacacacataatctctggctcagcctctgaaatgttaatccctgggtagaattatttgagctatagattgcaatttatcatcaaaatggcactgtgtcaaacaatactttttatatgtgtgatgtttggaactatccaattttaatataaaatggttcacagagcactggctaatattttagtcacaactctttaaggttatgattttggggagggcatggggtggtttctttacttcagaaatactaattgtattttagattgagggctttcgggggatcttttctgcttttcttttagtgacagtttagttttagtgccaggaaaaaggatttttaaagaatgcctcttgttaaattaagttgtttagaattgttttctttcacatgctaagaatacgtttataattatagaacaattctgttgtattcttcgacattgcttaaaaatacactagctgatgaaatagtttcttttttttagaatttatatggacttttcctttattatatcagatatttgtagatttcctcttatttaaattaacccaacttcagcccactaggatatgttgtcatgattagtatctgtttgtgatacagtacttgctccttagaagtcaaatcatcccagttttaaaaataaattttaatcaagtaggtgggggaagggtattgcatgtctatcagtcttttagagtaataatcgtagatatttcctatgtaaaaaaaattaactttagtattttaaaggatcagaatgcttaaaagaactctgtttttgaatctagaagcttgaaattccagtttaattttatactttttctttcagttttatcatgcctgcatttaaaaggctcttattttttttccctatctttaattaaaaaccactcttctcctgcattggcaggcagattctttaccactgccccacttgggaagccccaaaaagcaactcttcgctattttattattgagaaattattttgcttaactttgtatttaattcttagtacctattcccaaaaatttgccgacagggacctctaacaaaaaccta

SEQ ID NO: 55474 - DNA, 2616 bp, Bovine  19866880592360
aaacatgaagttgaacttgaataagttaaatgcacttacgacgctactccactgcttttccttttatgtcttaaaatctgttgcctttcacctttacttattttagtatctgtggaaatcccaccttgtctaaatgcttcctcactcgtaaagcttttcctgttccttcctctaagaaacgtattgtcttctaatctctagtaaaaccatgtatttcattcatcatctatgtatttagattagttgtgtttgtctttgaaagcaaggacaactgtgtttgaatccgtataacgcctctgtaattccttatatagtaagtagccaataaatatttgtcaaatacttggttaaagtctgactcatttagaaaaaaagctgcatttggttgtaggatctgttaccctttctcaggcctctggtaatggagggcagatgagggtatcaacgtcagatttgtcattttgtgtaggttatgaagttctttgcagtactttgaaattccaaatgtttataatatgtaacctctgcaccaagaaaaccttgcctcaagtaatgctttgagttcagaatacttagaggtataaaaataaggatatcagtatcttaataaatgagcctggtgggctacagtccacggggtcacagagtcagacatgactgactgactgaacactgcacaaaaagtgctttttaatagttcactcaccaagttatctgtccccaggtttcttttttaaattaatttttattgaggtatagattatttacaatgttgtattagtttctgctgtacagcaaactgaatcagtcatacatacacgtgaagtcactctttcagattctattcctatatagaccattacagagtattgcctagagctacctgtgcgtattagttatctattttatatatagtggtgtgtgtatgtcagtctcaatcttccaatttatccctcccttctttttccccttggtaagcataagtttgttttctgtctctttgattctatttctgttttgtaaataggttcatttgtaccactttttaaaattccacgtataacctctgtcataaaatatttttatggtttccttttgtcttgttttatgcaatgatggaaaataatgatatgtattaacctaagtaagagaatttcttaataaaaataatgttttaaatttagataaattatgaaagtttcttaaaagcagaccattctgccccttccttttttgtaagttggtaaaagctaatatcaaggctgtttgtgtattttcctaattgaattgactggattaaaaaaatgtatttcaactttatattttacttttgttacaggatcctcatgcagaggaatttgaagataaagagtggacatttgtcatagaaaatgtaagctaattgtaaattctgtcacctttcatatttttaactatatacattactaaggggcattttggtggcagaagaaatgttgctttataaaaaattagtgatttgtagcttttagaattttttaagtgaaataataaccagtagaattatttgtgaacattgagtcagccaaaaatttcctttaggtttttctgtaagatgttatggaaaaacccaaatgaactttttggccaatatttttgttaaaaacataaaagtaaaactactcattgatactgaattatgtatatgctctatgtattctgttgggagtttgagggaaggattgtgtcttattcatctttttatctatttagcatctgacatggtgcttctgacataacataaatgctcttttaaacatttgttgaatgaaattatgaatgatcttagaaatatttgaaaataaactatatgctttaactctttgggttgaaggattctcaagtagtactttaataatcattttcaattagtttgcattttatgatggagtcccaggtgacttgtaggaagatagtagttgtttaatgaatgtttattaaatggagattagggaagacaggcaatgaaactatgtgtgggttctgaagtctgagagacagattgcaagccctagatcttccatttataagctctgattatgataagtttcttaacttctcagcagtcaatttatagggttgtgatgattaaataatttcaatgaatattagcttttatcattgtcattgacatcactatcatgatcattattacagttgtaaaatatatttgtaacagttttataacatgctttataaaacagcatgttcttcctctctgtaagtgattttgttttatattttagtggtaaaaggaatcttacacttttttgaacagtagctggaccatttttagacataaagatctggggagcttgggagggaggtcatgtccaaatacagtggaaggagttctggtggctggatgtcaaactagtgtcattgtgtaaaggttcacacgtgttaacaattctgacttttctgtagtgataggtttgaacactgtagttggagtaatgttgaggttttgaaaacagacaaacttacatttcttgaaatttgttacagcctcaaaaatctagctttcattgagttaaaatcttctccccaatggatggttttaacggttttcaatat

SEQ ID NO: 55475 - DNA, 1498 bp, Bovine  19866880593572
caagtgtcagatgcagccatcagtgaaaaatctatcccagtacccattcactctagcagcagccaaggagtctcagcctcttggagatggaaaacccagtgccttttcacctacctaacagagtgagatgcatcatttcatctttcacattatttatttttgacaaataaaaattgcatatatttaaggtgcatgcatatatgatttcttattaactgtgaaactgcattatcttccacaatggatacagcctaagactggtcttattgtatgattctgttctttcgtttttaccaatacttccttcactttcttttaagtgaaagaggaatatgaaaagtacttttataaatattgctggaatatttgaatgcttctccacaaaactatgctattccaccattcaaaggatttataactttttggaatctagtgtatctgaggctaaaaggttaacagtttagccagtgttctcaaattaagtcacatgtcttcagttctaagaacagggatcaaaagtcaccctgggacctcaaagaaagaaatcaacatctattttagtttgtcaaacggaaatcctattttcatacaacaaaggggtttttcccctttctttacaactattcaaagtggggttatgtatctggggaggtaggtatgctttagagcaggactgaatgctgaaaggactaagattgaaatatacaaagaaaaaactcatttaaaaaatcaaggtctccccgtaacacatatcctgttttctaagaaaacaaatgtactaccagatccagtaaaactctcttcggaaaatttttaagaggccagaagcaaaattagagaaaggcagtatttctatagttaaaggaaacagaagatgtcacctagaagaaactcagactgagctgaagctctgacagcttgaaaagatacagaattgagcaaattgacttcatttcaagaggttcaaatggaaacttgaaaaaaagtggtctcctttttctatattctactccaagaattgaagtggtcttatataagaatgttgacactagcatttagctgtacttaaaagagaagggaagctatgaggtccagggaaagctgccctggaataactgttaggagacaagggctctagtttcactttggtcacttgtcaatgtatggcaggttactctccctctctgagttattaataaccatggtgatggtggtagtagtagaatcagtagcagcagcagtagtagtaatattagcagtagcaatagcagtagtagcagcacaacagtagaagaagcagtagcagtaacagtagcagtagtaacagtagtggccacagcggtagtagcagcagtagcagtaatagtagtagcatagcagcagcagaggctgcaacagcagtagcaatggtagcaagtagcagcagcagtagcaatagcagcagtagtaacagtttctatttattgagggtccaccatcatgtactggctagaaacca

SEQ ID NO: 55476 - DNA, 1085 bp, Bovine  19866880630570
acttggttttggcagtgaggaccaccgggctggaagtttgataatgaatgacttgagcatgtttgtgtgcactcagttgtgccccactctttgcaacccggtgaactatagcccacatgccaggcttctctgtccatgggatttcccaggctagaatactgattaggttgccctttgaagtgggttgtcatgccctcctccaggggatcttccagacccaggggtcaagccagtgtctcttgggtctcctgcattggcaggcaggttctttaccagtagtgccacttgggaagcccaacctgagcatagaagcatgagtttacacaagaagagatcttacttttgtctcttctaataaaatacaggtaaattccctggtggttcagaaggtaaagaatctgcctgcagtgcgcaagacctgggtttgatccctggatcgggaagatctcctggagaagggaatggctacccactctggtattctggcctggagtattccatggacagaggagcctggcaggctacagttgatgggattgcaaagaattgggacatgactgagtgacaaatacatacaaataatcctctttacttaagtaggatctatttagtttgaaaacatgttcattcctactctggactatttatgaggtgaatttttatttttctttctttatatcatctgtttccagggacccacccttgtaatatgaatacaaagactagaatcatttgtaattttgttactgacttatcaacactaaactgtgtgccatttgaatttgtttgaataggtatcgacaaactttttctgtaaatgaccagaaagttgatatttcaggcttggcaagacataaaatctctgtcacaattcaactctgctgctgtaatgcaaaagcaaccatagacaacatagaaatgaataagcatggtagttttccaataaaattgtatgtatggacactgaaatctgaatttcatgcaattctcacgtcatgaaatattcttcttttgatttttttcaaactttctttacagtcataattactgggcaaaatttttaggtaggaaaggaaaaaaaaaat

SEQ ID NO: 55477 - DNA, 2798 bp, Bovine  19866880658952
tatattgtaatataccactactttatatcttgttgtgaaagtgaaagtcactcagtcgtgtccgactctttgcaaccccctggactatacagtccatggaattccgcagatcagaatactggagtgggtagcctttcccttctccaggggatcttcccaacccagggatcgaacccaggtctcccacattgcaggcaggttctttaccagctgaggcacaagggaagcccaagaatactggagtgggtagcctatcccttctccagcggatcttcctgacccaggaatcgaaccggggtctcctgcattacaggcgattcttgaccgagtgagctatcagggaagccctgttcttgttgtggttaaataatattccatggtatatatatgccatattttgtatattcattcatccattgacggacatttgggttgtttccaccctctggctaggatgaacatggtctcaaatcatttctttgaatctcttcagtttggggggttatgtacctagaattggaattactgagtcatatggtaattctctattttttattaagaaactatactcaattttaaaagggctatgaagtttatttagaagttgatttgtggaactcaggatatattttccaaaacaagtactgttataagcatctacaggccaaacccacacaaatctattaatttaaaatataactaaaataataataattattattattctattattataaaataataatagttattattagacctgagtcctagattcctagagcttgagcagctctgggttttaagcaccaacccctttaacactgaagctcttgcatcttgaggaggaggagggtgggaactggttggtggcccagacttctgtgcatttttccttacttgttggaagaagactctagcaaaaaagcaacaaaggattgtaagagatcctcagtcagtactataacaagatggggagatagcagggatgaaaatggccatgacatgggaagggctagaaagatcccaacattcatttaggggagaggcatcaatattagagtgaactcagctgtggtgatttatatgactagttccttctgaaattgagtaatcctaaatcagtgacagtctgaatattaaataacaatagtatgtgagagagagtatatgtgagactgtgtgtgtgtgtgtgtgtgtgtgtgtttctgccatcctatcttagggtctataaaaccctcatgcaaatgctagagaatttttttccataaggaatgttttgtgggttttgtttttatttttattttgtaattgttgcagaggaggaatttttaaatttctagcacttaaagtttataacaattagttccttgggaacaataaagcttattaaaaacatacatgtggtctaagctgatgttttataagtatagggctaatgaatctgaaccagcaatattgttagctttgcaaaaatggagtttataatgggaatgtcgataacccttttactaaagtgctacagatagtgttactctaatgaatggtttttctttcccattcctaatctgttttcatgtgatggttattaaactttcttactgtaggacagtagttttttaaactaataatttgggggtattaaatgacaatactttatttacattttgagtgtaaaaattaaatatcttctggctttctaacctttaagcactgaaaagtgatcatgattacctcactaagtcccttggccacaaatactgattctgtagctttttgtagactaaccactacaaaaatctagcaactgaccatttaaaaatatcaaatatattcaggggaaaaagaatgaaaagagataacttttctctacattcctcagaatgtttctttacctcagcctttgaggaatcaaaagtcgtaaatattaaagctgcttaaaagcaggaaattgggccaacaaaaacataaaaatgaaatttttaacttgttactaggaacccttctcactaagtcttcagaattagtcattatctttacctaaagataacaatcatagccagtatttgttacatgcttcttatatataagtttggttttatggaaaatgcttgatgtatataatattaaggacaaggagataatgtgtgtaacacattatctctcacagtggccctatgggataggttccatttaataactgggactacaaataatcacatttttagtgaggaaactgaggcacagagaaggtagtaacttgccttcaaatggtagtgccaggagtcaaacccaatctgaggactctgaagcccaacttccagataccacatgacatggtctctgcttcacatctcatcttagaggttaacttccaattttcctggagtctcattactaattctctgtacccttttatcaccatttcctgatttataattagaaattcagaagaaacagattaatattcatttaacttatgaaaaaagtcacttaaccaactcatttggcccattagagacctagcacactcatatacctcttaaaattatttcttttccctggtcatcaccatgtaatatacatgaaaatcaggctgcaaaacatcctcatttggaataaccaaagagatgaaaacaagcttcccttcaaaaggaacatctagctctttgctaatctttagaaagttctatactttaacatatttagctttcagagagtggttttcaatcaggcatcatctgcttatgaatacctgagggtgctgttctgaggtgtgttaaaagtaaaaataactaaaa

SEQ ID NO: 55478 - DNA, 1406 bp, Bovine  19866880671997
agtaagtgaatgttagatcgctagaaagatcataatatttttgagtttgaagcaaagaagaaattatgaaggaagggttcatggtttcatacttaattgaaaagaaacatcatttatttaacttaaaaataggaaaaccggatataaattagtgacacattaattttttgatctactggaatttgtgtggcctgttttattttttgcaccttgcacagtgctcggcatataggaaatgttcacactagttatttgttgaacaaatactgcaataattaactaaatagacttggattaattatataagacaaagaagtgaccctagggtccaattagctagttgcaactaagaatgatgagtgaaaactaatttctttggcccaaatgcaaaagaaccatgcaggaggctgtctactcagtggtgggatgggaagtgatgggaaccacaggtgggctgtgtaagtgctatcagaccaaatcatgtcacacaataagcatcagctgttacagggtaatagcagccaacaggccaccctggccaagtcgaatggcttgactcaatcaagaaatcttgttcaacttgggaggcccggagatcagggtgctgaatgacagggcttataaacaagcagtctcagctgctaaacaaagagcatgattgtgttctgggagcagagagacagaggaccactcatttcttgtcgatctttttctaggataaatactcaatgaattgaagcatctttaaccagttagacttgatggttattgcatcttccatctgagacaatcctctgactagaggggttttaacatcagtgtatgattgggtacaatgtacagcaagggatatattcattccaaatcatttagtcattggggagtctatgcagtaatatgtttctgcattatttttggtctatttggtgctgatggctcacagcattcagtatactgaatcagtaaacaaattgggcagtattttgataagtctaaaaaataatcattttgatttgtcaacatcttgtcttccaacttggtgttgggacatagggaactggttgaatgtttgctaaggatatgaatgtatgtgttatcatctttttagctctgttttcccagagtgatgaaagtaaatatattaagggaaattaggagcacagaactgtacatcttccctgcatgtgcgtgcctggatccagtgtttctctgctataatgatgcccctgtatgcctatctaaaacaattgttccacttgtcacctagactggaggataggatccttcagaacgagtagaattttttgttgtgattgctattattacttgaccatcagacaggttaccgaccagaatgggccagattacatggcaaaccattcatttgcggatatacctatagaagc

SEQ ID NO: 55479 - DNA, 1713 bp, Bovine  19866880687880
ctttcttatataattgtgctacatttctggcatatatgaatttgcatacagatttattgagtaataaatcttgttaaaaaatatcttatttataaaaatagaatttggaaagcctcttttaactagcaaactttgctagtacctttaaggattctatagtgcattaactaccagatccaaaagcataggaaacagagaaatcatggtctgataagccactaccaatataagaaaaattgaaaataagggctaaatatttagcctaaaattgcatcattaagaaagtgtgattcaactgacaaaattaatttactcacaggctttttaaaaaaatgagggtatcttatttcagatggggtaattttttttatttttacatcctttgaattttatctagagttttgtctctcagaatttgggaaattatagtaaagtgtattgatcagttaacaaatgatgttattattttgtttatatttattctcatatactttgctgtcaatacaatgcattaaaataatttcttggaaaatatagattctatattagataattttatattataaagcagtgaaagctgtttgagtttatatgatagataactaaggaattttctttaatcctgtgttcagttttgccttacaatgaaatcacatttaaggccaactacttgatatacacaagatttcttttgtttattaagccataggaataacggtggccttttccttgatgacttgaaactaattgagtttggttcttcttaggttgacaggcatcttttttaacttggacataaacttgtgtgagtaagtgcttccatattttagtcatggtgagttatgagcatataaaaataattatcttcacctcataaatctttctttagtgaaatttattttagtgcttactgtaatcttcctattaatgtctcctacttttggtcagatatatatagatggcagtaaattttcaatttgaactatatttagcatagagaaaaaggccagtggcatgatgcattgtaactgtagttcataatcagtgtctgttaaaaagggatttgagacacaaccaaacccatctattctgctgcttattggcattgggtacttcttttttaagttgaatacagtaatttagtttcattggccgattttgagaattgaaagagtcatagatgccattctatggagggatcaaaaataaggctgcatttgccaaacactaatggtgatgatagggttagagtggatcatttgagttaattcatgtttacaaagttaagcacgattagtaatatgaacattcaacatttggtctaggaaaaaaacagaagcttactaccaaaaattaggattattattataatttttatgatgtttagcaaatatggtagtaatatatataacacagttcaagattggtggcctacatgaaatacatcaaatacttctgagacagtgtgagcatgttaattacatattccacagcagcattttttctgtcatgttcaacactgtgctttgctatcatttctccatttgttgaattcaagatgacctttgcatgaataaagtcaaataggattaaggcaggaattttcaacaatggaaaagagcaacagatgtagccagctttgaacgtggaagggattgttgatgggctgtttcttaaagggagtgtctgtagtggggggagataggaaaggga

SEQ ID NO: 55480 - DNA, 1149 bp, Bovine  19866880741787
tcacatttatttggacttagggctttattctttgctctattattctactttccttgtttctagggaaaattaattaattcacctcttgcctgaagagcataaaaagattaacattaatgaagctgacattctggtggcagattcttggtggcctcactgtctccggcctgtctgattttatgtagtgatttggttgtgcataagtatcacattttataatgctgctggctttagaatactcatatcctactaatattcacacgttctactaatgtgcaattttctcattgatttttctcagacatagtattctaattattatttggatgtattttgatgaggtgactattactatcattattattagactgtagcttatctgtgtgattacatctgaaattgaacattgtctcttaggaatatactaggtttttcatgtttccttttttgtatgctttccattgtttcagttataaggaatgtttggtagttcttttgacagtaggctatacatggcattagaaaaaagaaacattagaagaaattgaatgagatagcttaggttagaaccatccttttgtttactctgccaacaagaagctctcctgcgtaagtgaagaggaaaaggccaagtacgattttgtatttgtgaagcactagaatcgcatcactttttcacttttttctggactttgctagccagtattttaatactcttaaaaaaagttattagataatggaataagtactaacagtgaagatcatcataaagtaaagatgaagaaaaggagcaccatgcagagtagggatatatctaagatcactcgctggttaagctgaggactcagattgcttaagtccagattaaaaaaagaataaaatactacattgattttaatatcaaaaagtatatagtgaggtcatagtatgagtttgtgctgatatacacatatactgtgtgggcttttaaaacaaatgttttggtttacagttttgtttttatcttgatagtagtagaagtccagagacagctttttgtttcttgaccttttttgtcttgagcaaatatgaaacgtattttgacagccttccttcaaatccaaatgaatctaaattttgaaacttacttctcatgtcctttactgacaa

SEQ ID NO: 55481 - DNA, 815 bp, Bovine  19866880837645
atcttctgaaaatagctttttgtaacatttcagtagaagaaactattaatttgttattattttattctaacttagtacttgatagtattgtcaaatcttttttttttttaagctcttctcacagacggcttcatcatcttatcatttttggcacaaaacaaactatgttttattcagttttccaagaagatgagctctcctgatataaacaaaagactggaaaagctctcagccttggattataaggtagagatttgaatgtatatggtcatattgttaattattaaggtatgctagagtattgcttgagttgatgttatgctcttttttcttaaatgattatggatttcaaaaaaaccagagttattcatagtataggattaagcttgatcaactagaaacagtggccatccaaagttttctttttttactctcatcatgggggtctaacagtggcatgcttgggagcagtttacatcgtacttacggacatcagaaagataatagaggcaagttacacatttgaaaatggttttcttgctggcagtagtatgtatgccattctcattcttccctaagaccccgtatcactattctaggcaagggtagctgctctcgcttccatttcacaagaaagaagacaacactttcaaaggttaatagaaaagtgtaataaacaaggagtgggaagatcccccttctcccaacatcagctataactgtggagaaaaatgcaaaaagaaatctccttcatgtgttagtctctttcccttcagtaactccaggtaatttgtttccttgtatcagggacttta

SEQ ID NO: 55482 - DNA, 917 bp, Bovine  19866880981381
ttattgtattaaaatgtctgttaaaaattcaaagtagcctttaaagaatgtttggcaatataattaccaaagtaaagtagcaggatcaactattaataaaatgaccgagcttttaggaaaaaagttgcaatattgaaaacagaatttcaattaatacttttttttcttaagattaaaatttaacttgcatgtttctagtaaaggcatacagcactggctaaaggaaatttttgatagtagaaaatgctgctacatcatgttgatcaaatatagaaaacggtatttttagggggctatggcaggtataggatagcacattagttcctcagttattgctgatagttttaaaatcagaattaggtactgatgtactactatccccatttctactctccccccagacacacactgaaaagaaaaagtaaaatctagcgtgggttttggtatttgaaataactaaaaatgacagagttaaataaattagattttgcctccctaaaaacaggttattatgaattgcaaataatcaatgtgaaactgctttgtaaactggaaagtatatgatataaggcattattattatgacaaaacaaagcctgaaataatctggccccaacatatctgtggttaccttctcttaacctcttccaatctctataaaacctcacatctatttatacaaattgtttgtatcatgcagtttcatgcatccatggatttgaaatgaatatatcatttcatcttcctgggaaagttctctcatctatttaactcctactcattcttcaagattcattttaaatccactaaatttctctgactacttcttctgtcctccttgctggtggaaaagaagttctccttcttctctgtggctacaaaagtgtgtgtgtgtgtgtgtgtgtgtgtgtgtgtgt

SEQ ID NO: 55483 - DNA, 794 bp, Bovine  19866881009748
cgaagagttgactcttggaaaagactctgatgctgggagggattgggggcaagaggagaaggggacgacagaggatgagatggctggatggcatcactgactcgatggacatgagtctgagtgaactctgggagttggtgatggacagggaggcctggcgtgctgcgattcatgggttcgcaaagagtcggacacgactgagcgactgatctgatctgatctctgatcatctcattcttggtgtaatcttgtcaggtgagtttggttgggcaagcaatcttgttcaacacaatccaataaaagaaataaacctgaggatcatttatagtactgtcttggaattaatatcccatcctatccatttaaaaggcttctggaagtaggatcaaataaatggcaattaaaaagacactaaggactcagattgtccttctcactgttcacatgtaaaaattatagaaaagaccagatatgtgaccccccaaaaaaacattttaatatcccatagattccctctaaggaggacatagcacttccagttgatctctatgcctattattaaatctattaggttaacagataaaaacctagaggactattgctctgtagtagggggctcaatttttgttttggttggcttgggttttttttgctcttcttttcaatgatctcatcaagagtagatactaacctaaactcacaggtgtctctcttgcctttatctgatctttctttactctgctttcaatggctttttttgcataacctcatttttccttaaaaactaagcttca

SEQ ID NO: 55484 - DNA, 1584 bp, Bovine  19866881040668
tttaaaaagaaagtatgattcctgcatttaaatagctatgacagatgatggtatatctttataagcatttcaagttttgaagagacataagaatatttgtgtactaaaatattttataagctctttagacaccaagttgttgaatcaaagaccatttattcctacattttagttaactttaccccaagtgtcaaaattacttatgacttatttacactccacttccatcccggaaaaattgtgactcatcctttaaatcataatttcccaatctactttaaaagtacttttaaaatttcctgaaacagtatttataagatgtttaataagattaaccttcgaaaaacgaagtatttatgacagttggagtggaatggaactttgtgtcttttatttcattagtcaccaatcaaattattcaaagccagtaagaggggtataatttttagaaacataatagattttcaatgtttaaattttgaaagttgtcatttaattgtactatttgattagaaaaactccaaaaatattttaaatcttatctccatctttgaagtaacggttatagaaatatgaatgtgtaagtttcataattaggtgatacatttgtgagcacaccatacatttgttcgctttatttttttttctaagaaaaaactggatatatttaacagcagtttcaacttttactatttttcataactgccatttcacctaaacaacaagtttttcaggaaatatttttgatttttaaaaacttttgaaagactgcacctaaagtaaggtaaaaatccaactcattaaaagcatgattaaagaattactaagtcaaaatcgcatgtttccctctcccaccaaaaatatccaattcgtttttcatgtatcaataaataccaataggatgactaaggtaaaattgatttttcaggaactatctacaacacacagccccacccccaaccaaaaaaaaaaaaaaaaaaaacctttttcaaataagtgtattctagacactcacacatttaattaaacagattctttcttaaatagagatgttttctccttgtcagaataagcaatgcattgttattattgagcattcattttttagttggtggtttttattttaggtactattgaatataaatattccttaaagttaatgagctactccaattaaaaataaaattttaaaaattaatgagctaatgagcttttttcattctcattttcgacattaaaatgcatgggggaagggagagatagtacggaaaacagaataattcgttgagaacttgttaggttttcaattaaggaattttataaatctatgttgatgctgttcttaaattaattctgcaacagcagccaagtgattttttttttttttttggtcttgaatagtaatgatacagattttctttaccaataatgtatatattaactacatttaatatatcagatacattttatttctgtatctctaaagaaaacctcggtgcctgtcagtgcctaatgacatcaataacattcatttattctgccaaagtaagaacttaccattctcacaacggaaaaaaaaaattt

SEQ ID NO: 55485 - DNA, 749 bp, Bovine  19866881148222
ggtcataaagaaggtgtataaaggaatgattctcatctgtaagaatgaaagtaaagaagggactgaattcagcatttcttttctgaactaatgtacaccaagcatttgagcaagtattcttattaatcttcatttttctccatcatgaaaaaaatctttgcgataaagtgcataaagtgcactaatctggaatgcacatctcgagcttttccatatgtctacacccgtgtaatcatgacctagatcacgagtcagcaaacttttttgtaaaggccagagagtaaatattttaggctttgcaagccatatggtctctgtcgcaactactcaactttgccttctttgcacaaaatcagccttagacaatatgtaaacaaatgggtgtggctgtgtgccaataaatatttatttagggacactgaaacgtgagtttcatataattttcacatggtatgaaatattctatttttttcattttccctcaaccatttaaaatataaaaattctccaacaccaaagaaatcttcctcaagccccttcttagtttataccctccctactaaggcaatagtcattcgaacttctattactattaccattcatgagatttgcctgtttgtgaacttcatacagggcttcccatgtggctcagggggtaaagaatccacttgccaaggcagggagatggtgggttccatcccctggtggaggaattggcaacccactccagtattcttgcctgggaaatc

SEQ ID NO: 55486 - DNA, 2159 bp, Bovine  19866881166059
aaaaaagattttagtttgttaagcagatagtagttttgtttgttcagcagtctaattaccatttcctgatcctagactgagaattgaaagagatcatttagaggaccagcattaggtaattacttaatatcactgtcttctaattctacccagttgtttgttggtctccacattccctgcttctcacacttttgatctctttctcatgcatataaatgttaagaccttagggattgaagactattttcttgactactgtgtgaatcagaaatagagctggctgtaatgttggttgggtgaagaaccctgaacttgaaaatcatggagctggttctcctacagattgttattatgggttcaggcaagccatttactctttattgcttcagtttcattatctgtacctgattagatttcctaaggatattttcaggtctaaaattctttgatggtactttttaaaattcagaattgttcaagtactatcttttctattgtcgctaataagaaaaattcaattattatagtctttttcaatgtatggggagactatgaaaatataattatgggaagtttgaagagactagagaaatagcttgatctgttgttagagtacatgagaattacagttgtcacaaatcttcagaattaagtatgtagactatatagagaggagttctaattagagattatctaagatggcagcaatttacttttcaaaattcagattgtttactctgtggggttgttttctaggactgtcaacaggcatagaaataaggcaggggaatagaagaatctctggagacgttttttaatcaacaaaactccgttctttaccactggctgtggtgtgctaagtctctattttttattaagtatagttgacttacaatattctgctggtgttttaaccaacaaggtatgataagatttacatggacatacgtttctgtgatcttgatcacttctcagttccacttcctggattcaaatccagtttctgccacttgcttgctgtgtggtcttggtcaagtctgtgtctcagtgtcctcagatatcctctcaggtgtgttaaacctgctccctgacatgcgtctgcactcaagtactctaacttcttttctattattactgaagaatgatctgtgctcccagcacaagccagtctgtctcctttcatactgttaaagacatgactctagcaattatttctcttctgcatcattaaaatttccctttcaactgagtgtttcccatcaccctaaaaatatttctgtcttaaaaaattctggcctgacaatatttctcagactagcactaacctatttctctctttctctttcagcaaaatagcccagagaagttgaatgtgcttgctagcttcagtgtctatcttcctattctttcttgaacccatgctgatccagtcaggtgtttacctaccctcaccactccactgaaacagctcttgtgaagtcagtaatggctttggctttgttaaatccagggatcattttccagacctcatcctcttgacctgttaccaagatttggcacagataattgttcatgtctccttaaaatattttctccactagactttcagaataaccacttgcctctggttttccttctatttactgacctttctttactgattcctccacatttcctggacctgttattgttgtgctccaaagttcagttcttgaacctttattttctccctctctctctgtttcccttcctccctcctgtcactcccttgggattacatccacccttaagctttaagtatcacctgtatgctgatgattcccaaatttataactccaggcaggtatatccagctgcctagttaaacagctacacttgaatatctaatagacaccttagatttaatgtgtataaaatcacgtttctaatctgattttccaaacctgatccttctgcagttttatctgttaatagcaattcctattttgtacttgctcaagggcaaaagccatacagtcatccttggctactttctttcatacagtcagacagaaaatcttattgattctgtcttaaaaataaaaaaaataaaaataaatctgatcatttcataccacttttataccaccctaagccaattcaccgtcaactctccttgg

SEQ ID NO: 55487 - DNA, 813 bp, Bovine  19866881168554
aaaaattatactaggtcaaaagagagctagtaatgttatataaatagtctctaaagcaaaatcagtagtatagattactagagattgatatcaatagaaaaatcaattgatataacagttctaaatgtgtacaattacacataaaataaaaattgacaaatcaacttttcacagttaaaattttaattcctttggtgtggtaattgatagattaagtgaacaaagtatcattaaggaaatagagaatactgatgtaatggacatgtatacagtactgttgcttcctgacctgcatataggtttcttaagaggcaggtcaggtggtctggtgttcccatgtctttcagaattttccacagtttattgtgatccacacagtcaaaggctttggcatagtcaataaagcagaaatagatgtttttctggaactctcttgctttttccacgatccagcggatgttggcaatttgatctctggttcctctgtcttttttaaaaccagcttgaacatctggaagttcacggttcacatattgctgaagcctggcttggagaattttgagcattactttactagcgtgtgagatgactgtaattgtgcagtagtttgagcattctttggcattgcctttctttgggattggaatgaaaactgaccttttccagtcccgatgccactgctgagttttccacatttgttggcatgttgagtgcagcactttcacagcatcatcattcaggatttgaaatagctcaactggaattccacacctccactagctttgttcatagtagctttctaaggcccactga

SEQ ID NO: 55488 - DNA, 1979 bp, Bovine  19866881282297
ctcatttcaggctcttaaagagaactccagtctttcacttgtttctcccactgtggctttttcactctttgactaaagaacctatttttcaacttgctattaataatagctaataactttaacttgctaataattttcaacttgctaataactttatttgtctaaacctatccacgtctaaacttatcccacccacctcaaaaaagcagcagaagcaactttctactaccacattttcttgctcaccaaagagtaattccgcttgtccatcccctacctccacgcagaaagaagtttaacccaggttttgactaatgtcccctctcttttctatccattgccacaaaatgagtctctaggactatccttggcaattgctttcatctgagggcagtggtacagattgaactctgacagggatacagcatcaaggccgctgacacttcatctgaatagctaggcacacccacacactctcccagagtttctgtttgttccctaagatgacactagcagatagcattttccaatgtgtgtgcacttgtgcaaggtaaggccactctgagatcttcctgtgaggtcttgtgcttagtgtgcctgacatctgttcttggactgaagagcgtcaaaaccccagaactacttggtgttcttaacgctgcttcatcatccatgatgggcctgaagcttttgttcataaaatggcaaactctggacctccaggttctagggtctatagctcgcagtagtgtcctagtgtgatattaccacatcatgtaaagctgttctaggcaagtggatatctgtcatttctgcctgcccaacaatcattcctccccttctcatgttttcccactttctgtctttgtaatttagatgctgaccttacttaccccacctctgtgtccctactattagtgaaaggaagtacacatatcctaagccaagccaatgaaacttgttctgaaactgctgggaaaaaggtgctgtctctatttgacttaaagtatataagcctggagtttctaggagccactagatgaagggactctccagagaaaaaagccaagatgagagagagtgagatcaagggaagtagggtggggtgggaatgaggtcttgacatcatcttcatctctggggtcaaccaagcctgaaattttcagttatgtaagccaacaaaccccctttgctcaggccattttgcaatggcatttgcaaccaacagtatcctaatatatccattgtttcatttgacctttcttctatcttctactccctgcttagtctacatagctatttttgttcttgtccactaaattgacatgtttagcacctcctaactgtgttgggatgaattttacttcaatgttcgtagggtgtttggtgaaatctgcagttgctaagtttatttttccacttgtagaatttatagttggctgaggatgaaagtgtttccccaaatccagaatgttttgttctagagtcaggcagtatagctgtctagaaggtaagaaaacatcatcactcgttataggcctatgacctatgtaagagcatctgtcagtcaaattcctaaatgtcaggatgatcttgatttatttctaggctttgtcaatcagtttatcacatgctaactgctaaaacagaatccagtgacatcctcattccagactgagtataggatttccttcatgtgagcttgtgtgttactttggttttgtagctgctatagaaataatcaaaaccactatgaggtaccatttcacgccagtcagaatggctgtgatccaaaagtctacaagcaataaatgctggagagggtgtggagaaaagagaaccctcttacactgttggtgggaatgcaaactagtacagccattatggataacagtgtggagattccttaaaaaactggaaatagaactgccttatgacccagcaatcccactgctgggcatacacactgaggaaaccag

SEQ ID NO: 55489 - DNA, 1556 bp, Bovine  19866881312847
ttttcctgatttctgtggtgtaaaatatttctaccatagccagttttgagttaccaacatgatatccttgaacttggaactgggaggagatagccttaattggcacttgcaaggccattggagttagtcatagtgagtgagtgaaagtcgctcagtcatgtctgactcttggcaaccccatggactatacagtccatgtaattctccaggccagaatactggagtgggtagcttttcccttttcccaatctagggatcaaacccaggtctcctgcattgcaggtggattctttaccagctgagtcacaagggaagtgttagtcatagtgcatcactggaatactttacaagttcctgacacatatatttcttgagaggtgtgtatgtctatggtggaggctggagtagatcagctttaaatggaatgctacctcacagcaaattgtaggatgattagacctgggcatgaggggcattttattttctttatgtcactagaaaaaccctgattcttctcttactccccttgagaacatagatttatggttatatgaagccatgttgtaagctataaagataattttttttagattcattgtcttatttaatccttttttttttttactttacaatattagctaaagataccacctcattttgataaggaagatgtatgattttaactcaaacttatacaccaacaatataaaaaatattttttgtgtgcaaagagacatcttggggacatagtaaaagtaaaaggaagaattgatataaattctgaatggagaacttaatacatgtaaaatatctgtaagaagtccaaagtcagatctaaagttaaataattttgtgacttttgttggcaaatatatgtgaaatcattctatttatttagaaattattctttctgtattagctcctttgcttggactcctttgctcctgatattacatcttatgctcgagtaaatttcaaaataaagtaagtcttttaaagtcagtatttaagaggctttaattcaaaagcattcttgaataaagcagttcaccctctaagagaatattcaaatttatttgtaccactgggtgtgctgtgcttagtcactcagtcacgtctgactctttgcaaccccatggagtgtagcctgccaggctcctctatccatggggattctccaggcaagaatactggagtggattgccatgccctcctccaggggatcttcccagtccaggagtcgaacccaagtctcatgcattgcaggaggattcttaaccatctatgcaaaaatgatttttttccccatagttgtatatagcattttaatttgggttctgtttaattatatgtactcatatgcatagaattttagtgctgaaaagactcttctagttatcttattttatagatgagcaaactgagatccccaaaagtgacttgtcagaaggttagtcttgactagtttagccaaactagggctagtctttcttgatgaccaccttagtattcttaaagtttgtagcataaaaactgcctgaatccatctgtctaca

SEQ ID NO: 55490 - DNA, 1895 bp, Bovine  19866881324719
cttgctcactttgcaataatctttgatttactactgctttttaaaatagtaactctaaactgacaaattatttcgacagttagcattggtttagataagagcatttcagtgttcttttgtctttaactcatctctttaggaattcttgaaattcagtttattttctcttcaaagttgcattttttttctatctattcaagtgtagcataaaactatatttatggaattacaatctagaattacttatcatggtcacattgccagcatttctatattccctgtctctctattgttgtggttgagatacatcctaaaaagaattaagtccatatttttaaagatcagaagggtgggtacatgtgttggagatggtggtgagcaaagattattttatggtttgctgttattacttgcttaagcaagcatactttttcccccctaaaacgcctgatataagccattgtgattatttgcaggatcatggaaaaaatgcacttcaactagacacaagtctctttggaataatggaaaattgtgtgcagtaaaatatttgaaaagagcatcagcaaacaagatgtttgtattaacaggaacctagaaaatggctatgcaaaggtcaatactgatctttaaatattagtgaaatttaatttgttgcatgtaaagagtagtagaagaggaggaagcaggccacaatgaagaagccattggtgaactgtccaaatgtcaaaactgcttacaataaagaaaatgttaaattgatgtgatctatttacctaagtgaattaaacggtttgaacagtgctctggagaaatattttccaaatttaagtataacatgagatttataaagatttttgccatgatttattttgggaggatgaagagactcctattattctttctaggtatagaatttcttctaacctctttaagagagtatggtgcacaacttctcttaaaacaggaacctattgcttttggcttcatttagaaatagcatcacctgaccagttgttagcagctatgaagaacttacctggccttggcactctgcacagcaatagctaaattgagttcaaagagttttctgtgatgtcatgcctgatttttaaaaaatgtgaattctgtgttctcttattttaatgtataaagataaattttaaaaagaaacatgtctaatgtatgtaacaaaggattaatattaatgcacaaagaatgagatggagaactcagtagaaagatgggcaaagttgggaaatggtagtttatagaagaaacaattgttaaaaaatacatgacatgctgtttgaactctttaatgaatggaaaaatgaaacttaaaactgcaggttttttcaccttttcatttttcaccttccagattggcaaaaattaaaaactttgttaatgtctcatagcatattgaggaaggacatgggggaaaggacagtcatattactggtggacatgtaaattggtagcgtcattttggaggccagtttgtcagtacctattaaaatgtaaggtgtgcatatttactttaatagtatttttatttgtaagatgaaaatagccctgaaatgagcagtcatgttcattaagtaaattatgatcagtatacagtggaatatctggcaccttttaaaaaaaagagataaatctttatatgctaacagaggatatccatgctgtcgtgttcagtgaaaaaaaagcaattgtatgttgagtaaaatactgatttactaaaatacaaaacaagtcagtatgtatatgaacatgctgttaagtacttcacagtctggaaggccatgttgtgtaatggctcccttcagagtggggagggcctctgggaagggaattcattttaacgtcaaatacttttgtatttccat

SEQ ID NO: 55491 - DNA, 1774 bp, Bovine  19866881363841
gtggtgcttttcctgatggtctgcaattgatgtctgtcaatcaagttgtcaggacacgtgaagaagaaaatgactttaattttcctaaaacacgtaaaataatgaacaggccgaaacatgcataccaactgagccattctctcaagtcaatattttgaggtatctatattataaaacatagtgctgtgaaaattgaagaggttttaatataacaatttatttttcattttctttcttacttattccataacatttattaaactataggaagaatacaatacaaggattaaattcggaggtagaaatacactttaacacgtacgttcaaaagactaatgccttctgagttgttacataatttcctaaactttctttttagaaaaactttgaattactatcctatatctaggttgttacaaagactagacattttacatcccaaagcaagaacatagctagaaggtccttactttttccaagagtatatctcagtgtttagctgtatttttagtgcttcctagcaacacagcgttgttttcaagagttagttcagcatagtaataattaattgtaaattgagaaacagctttgattcttcaaaactagaaaaacctgatgtgccacagtcatttaaaggctaacaaaagtaatacaatgcagcctcacattctaaactaggttgtcctactcaaaacatttcattctttccaaaatggatagagtgaaaatgcagtcactcttctcatcatgaaaataaatcttaattgggcatttaaaaaatgtttctgtttctagacttaaatagcagttatttgtattttataccaggcaatctaagagttagttcttttggaatatcaacccgtactttatcgtcacaaatcactgcaattacatgatcactgaaaagaggttgatagaataataaagctccagatgatttattatttcattatactttagttttttttaatcacaaaaatcaattctaaggttttatttttaatttttaactactcatttttgcttgttctcattaaacattttttgaggtatcatcaccatataatattacatcaatttcaagtgtaccacataataatttgatatttatatacactgtgaaatgctcaccacgataagtttagttaacatcctattattttgttgtttctgctgtttttaaaatgtgtaggatagtggtgatgttttaagtttcttctgaaaaattaaaatgtatggattgtcttaactcttcaatatatcttctgtttttctttgctctgaaggcatatgatgggtttgccagcattggaatttcgcgactactggaaccttctgatatggttttattagcaattcctgataaactgactgttatgacctatctctatcaaataagggcacatttcagtggccaagaactgaatgttgttcaaatagaagaaaacagcagtaaaagcacgtataaagttggaaactatgaaacagatacaaatagttctgttgaccaggaaaaattttatgcagagcttagtgacctgaaacgggagcctccactgcagcagcctcccagtggagcggttgacttcatatcccaggacgactctgtatttgtaaatgatagtggagttggagagtcagaaagtgaacatcagactcctgatgatcacctcagtccaaacacagcttctccgcactgtcgcaggactaaaagtgacacagaaccccagaagtcccagcagagctcgggaaggacttcaggatccgatga

SEQ ID NO: 55492 - DNA, 1684 bp, Bovine  19866881374844
tgggggtacacagttaagtcagcctgtagccacagtcaggtggcccaaagggctctacccattcagccctatccagctactttcaagaatgaaaggatcaacatttttcccaaaccaattgggaagctctgacctcagtacattaattatgtggaaaaaactgtacagtttaccagaaaagggggggaaagtgggaaaaaaaaaaaaagaaaagaaccagtgttcatatcttgttgcctctgggaacacatgcattcttttttgcacactcatcaggctcctgctttcatcccttcccaacggctttttctgaacttgcagcacaacagtttgaggtgcactttttaaaagctaaatcttgctaaaaagctaaataaaagcaacatgccttaacaaatatttaacagttaatgaagctcttacacactattatcatcagatgccaggctggcatttgtgatttttaaaggccatgacaaactagagtaaaccatgcatcctacttgaactgcagggaacagactgccttctgtgagctatagttaggacctcacaaaacaacctcactttccccaaattaataaaagcctgcagagaaggcaaaattgaaactatgcattttttttcctttggcaattcttacctttttgttgttctctttaatgtcttgaggattcagagacttgtagtcactgagggagaaaatggcacagtaggtacatacagtaattgataaaaacagctgtttttacaacaaactgaatcttaaaatctgacattcagtaacaccaaagagtaactagcaatttcacagcaattcaatcaacacaactaatagagtggaaaattaaagaaataaataaataaaaacagtgattacaagttccaatgcctgaagctttccatttaaaagagaagttaaggcaggggaccagcgactagtcttgacaaccaaattcatcatgaggcaattctttgttgtcagtatataaacagctacaagcttatttgtctcattttaatacacacacagttttcatagtaactttaagtctgttttttatatgacattaaggaaaaaaataagctctttgaaaacagaaaaaaatgtttttcagcatcaagaaggaaaaactgttctgagatatgggtaataaaaaaaaatcaagtatttcaggacacatgataagaaattattttatgctatttttaaaaaataactattattagcaaaatagttataggaatggaaagtttttctacttacattaaatctggtctaaagtggtgtaatattgcacaaaaagataaaccattcctccacgatgtagtaaaattggtgattttcactccccgatagttttttgtaacttctttgcaccaaacaagtaacgactgactagcattcggctttcgtcccaaaataggacttggtataggactcggctagaaaaaaagaaaagaagaaaacattaaaagaatttactggaaaatgaaaattaacattaattgacctaaccagatcatttgaatacttttgatggtcaggtttaagtccttcaaaactgtcacttaaagacaactgtaacctataagaaatgagacatgaatcttaagctattatcttcagctgtagcctatggagtctgcctgacagaaaaggtagataggcaatattttaacc

SEQ ID NO: 55493 - DNA, 1829 bp, Bovine  19866881379740
gagggacattgcattgaatgggcaccatgaagagacacaactttgagaatcttggtaagggggaggagaggaaagaagatggcatctgacataatcttgtaaaatcattaccattctcagtatattgggcttagggagcaagcacacggtttgacgtttttgaatgactacaatcataaatgcactaactcttgctagttgtgatagctgtattctactaagttgcaggaaacatgttagcgatcaatacataaccttgttttacctgtttctgtttaaagacaccttatttacttatttaataaatattatggattcattaacattgaactcttgaccagcaacactataacttaaacctgaacaaagcttacctaacacacatattttgtctataaggtgcttcctgtgcttaggaagactagaaaacacgtcagcactacactagggaattattttacacaatgaaatcacctaaaaaagcacaaaaatttgataaaagggtactaagaagaccaccaaaaggaccaaaaaaatttgcttacagtgtgagagctgacaaaataaggcagcattttcccttgtttgtcctcaagtaggaatgcatatgtcagaggactcaaatttttcactgctctgcccatatccacaatgatgatgaaagtgctgtgagtatttggttttggagttacaagtaaatttcagcaagtaggcaaatttgcaaatattgactctacaaataatgagaatccactacagctacaatttactgaacacctaccacatagatttgaactaggagcttcatagatacacatatcgtcaagtttatcaactcttcactattcaaatgagatggctcagagttaacactggtggatatatccttagatccaaagactatcaccactagaaaaagtaggactttattaagagactaataccatacaattttcacaccaagcctaagcacgcatgtattgggctggaaacttatggggttgggcttctgctcctgttggaaacctctgactcaatagtctgggctcttatagaaaactaagaatgtattgcacactcagcaacaaggctacagagaagctttcttatagggaacatgccccgcagttaagagtacaagatctttccaagcaatatgatgagaagccaaaaatggtcaagtaaacacattcaaagaaaaaaaatatgtctttcagggcattgacggactcagtggggatccaagaagttagcaagctttagaatgtaccatctgaaacatcatgacttgtgaagtgataatgctgtccactcatctgtgcattcatagtcttcccatctgctgcttgccttccattcaggtcagtctggactctgtttctaactgcatggtgctcattatgcctcttcatctttactcttatcactatgtcattctcttcccaagcaaattaaccttgactggcaagtctcaacatgtctgccactaacctctcttggatctcctcagccctctgggcctttttttgccttggaaggatatggatcacccaaaatctagctcacttttcacctcaactgtaaagtgaaataataatggacactggttaggacttagccagatagaatgtgaatgtgcgtagcatagacctggcacaagggaaatgctctacaactttagtgtttctgaatctgaatgtttttcactttggttcatatgaattcacttttattatcccttctgaggcagattttatgaagaaaaggataacatcacaagagaaaaggcaacaacaagaaagtacatgctaggggaggatttccaaata

SEQ ID NO: 55494 - DNA, 1157 bp, Bovine  19866881467442
tattattcaaaattaagtacatgggaatgaggtagattatactatttttttatacatttagcaaaatgtattataagtcataattaattatattacatatttttcctttttaaatcctaatcataagttggttaagtaattttcaatattatctatttaaaaaggcatagcagtagatctgtatattagaagctaagctttaaattctgctactgataggcaatgcaccttttggagaaatatctgtctagccctgggagttgaagaatatccctactattctacagtttatttttcatagggcaacttttattaataatgagatattccaaaggttattgcaattgagaaattctaaattctataactttggcttaaaccttcaatatttctccttttccctgtacagtgtgtgtttgattttgggcttcccaagtaaatatttactgtgagcattaatattaataataatagtttacatttattgaagacttcctaatggaagccatttagaagaatataacagagagaaaaagaatgagaaatgcccccaagggaaaatattgctaaatgctttcaaatcattaaggtattatacttggctatattatttaagtacaattagttgagagagcttttctaattgactgtgcttagtacaactatttgactaatttcataaaagtcagcaccatcatcctcattgttctcaaaaattcttctctaaataattctgtagtaaagggaaatgaatgaacaaatatttcctgagtaccaagaaagtgttcagaacacttcctcctgtcagagagtttactatcaatagattttaaagtatggtattttgttcctgcaaccagcctctattgatttctactgtccataattaatctagagtgaaagcacaaaattcaacactcattcatttacttattcaagaaacttctattgtatactgaaactgcaatttacaaaacactgctagatgttgaagagatatcaagttttataagatatcaagttttaagacatttattccaccttaaagttatatataagtgaaggtcactcagtcatgtccaactctttgcgaccccatggattgtagcctgccaggctcctctgtccttgggaattatcccggcaagaatactgga

SEQ ID NO: 55495 - DNA, 729 bp, Bovine  19866881570445
aagggtgtcttttataacattagatatttttattagtcgttgaaaactatagattgagaaggctttctatttaagaaacatgtctacacacattatcatgaaataggcttttacaaaatttacaaatatgttatttcaacatagtttgcactctttagtctttgtaaactctgtatttactaacagaacaaagcagagtatttctaccaacaaacccatacttccactgtcctttaactcccttaacaacacaatatcctgtgcttacttgtgttcttcagtgttttcatagttttaataaatgaacttgggctaaatacattttaacttatctaatttttttaaagggctttacttagtactgctaatatttcattggattctcttctcaaaatggtccgtgaaattcctcagttttatagtaaaataagagaaagaacttgactgccaccctttcatcattagacaggaagcaaagctctgttattaggcattcagaaaggacaaaaaaaaatttgtgcttgtccagaggcaaggattaccaaagtgcacctattcacttgcaaccaaagataaaaataaaaaataaaattacaagatctttaaaggtttgggtagactaggtattttcctgccagcttgatcagttcttgactgaataaataggatttagagtaaaacattaaaactgtttagcagatcttttcaacccatttcaaacttttctta

SEQ ID NO: 55496 - DNA, 1425 bp, Bovine  19866881717596
cttagtaccaaaggcagttacaatatcgaaaggttattttataaatatctataagtccaaactgatataaatagtaaacaacagaaaaggtcaactttgttctacaaaagaactccaaataataaaagaaaaataagggaaatagaaaatcatcattagaacactaaataagtaccataggcaaaactgactaatgaactgaaaattagtgactgaaattttaaagagaaacaggatatttacataacctcaaagtagctctcttctaaactttattaattttggggtgattttaacatatgtcctcaaagtttttgacacccctccttccaagaactagaacttaactctccagcccatgtgtatgctggactccgtgactggtagctagtaaacagagtacggagagtatggagtactgagtctggagaacggagaggggcagtaacaaccgtagagaaatctggctgaccccaccttaaccaagtcatcaaggggaacatcagcagtcataagccatgctgacatctatcatgtgctctctgatatgatgtgatgagggcacttcgccttggtcacatcttccccaaatccatagccccagtctaatcattagagaaacatcaaactcaacttgagaaacattctacaaaatcagcagcactcatcaaaatcatcaaggaaagcttggtagactgtcaaagactggagaagactaagggcatgcgacaacaaaatgcagtgtggtaacctagagtgtgccctcaaacagaaaatgctgtcagcggaaaaaccagtgaagtccaaatgactgcagtttggcctattagtactatactaatgttaatctcttagttttgataaatggccatggtaagtttatttaccctattttcactcaaaggaatctgagttaaaaagtatacaagtactctctatattatctctgaaactcttctgtaaacctaaaataatttcaacaaaaagtgtaaaaatgaagtaaccaatttttaaaagattattttgcaaattagagtacacttcaaattaaagctgaaccattaaactcaatttctaaacccactcattccatgaataaactcaatttcaattaagttagtttgtgataagagtgtattactacttgctctttgcatttaatgatttttggaggggaacagcaaagaatggaagtaacatttgagggaaactatttgcatttggtaaacaagcttgtagaagcttaagggaaataactggaaaagactagtaaaacagaatgaagataaatttaaaagattaaagttatcatactaacagtatcctagaaacaaaaggggaaatctagaagattccttttagaaggataacaacagcaacaatacaaacgaccaaaaggggcaaggaaagggttaaggactatca

SEQ ID NO: 55497 - DNA, 2488 bp, Bovine  19866880537612
ggaaggcagagtaggaagaggtaagcaatatttgcctttattcttcctggaaacacacaaacacacatccctaactggaagatgtggcttctcaaacacagtgtttaatgtgctaagatgtcaagtaaagaagtgtgtggatttgagacactatgatgaacagactcactatgctattcactatggggaattttaaaaactggaagctgacaaaaatattaagacaaagagagttaaatcctgaaacctcgctgttgtaatgccacctctgctcagcgctcagcgggggatggctcacagggatggcctttgggatccactctgggctgtgtgtggcggcagggaggccccacttcgggttctcagcaccaccactttccctcgatggacactgccttggatgcctctgggaccaatgggagaccagggcctcacaaagcacccttcctgtcacacctgcacaccgctgcagcctgagctcttaagtggttcagccggagcccccggggtctgaaggaagtgacacctcgggagaagcaggggcagctgaacgctgaggaggagttcccaccccacctcactcctgtgcacttgcatcatgcagcgtggacttccacgccaggagatgagccctcatctcgtgatttaaaaatccttttgttatccagacatttggttcttctcaacattactccctgaataaaggtactccctgagaatcctcctgaacaagaggatcaagcttcattcacatctagataaacgtaaaggcctgtgctcagcacaggggtcagctgactggctgggcctcaaattacagtgtggccagtaagtgccaaccgtccactgtcacagctggaactgccctggcactgacagctggtccgggttcatttacattctctccacgcagccactgagctactgcaggcggctgcagatgtctgttttttagcaacaaactggttcactgcagatgtgaattttggtgatattctactgctgtcgagtcagttaacactgaatgctaccaaggacaggatggggcctggaaagcatgaaaaaagatgagcagagaagaagctggcaggtgagaaagctacataaaaacaagggtaagtgacactgggaaaagatgagagcttacacaatcacgtttacattcttgggctccactaaaagacatcaagcaaaggggtctcaatggttattctgattaaagtcccaccaccagccatctcctcaatagcaccagcttcataagtattcctaaacctacctttccagaaagctctacttacacctctgagtttagagagcaaagtcatgattctagaccggtagaaagaggccccacagggaaatttctgaccctaaaaaatattccagaagcatcactttcaaatctcttaatttaatatcccacagtcccaactcaaacacatccaatccactcctaaaagcagcatgttaaaaacaaactgatgaattctttatctgagaatacacaggacgctgagggccttgacaatggcattccatcacatcaatgaaacaaagactctctccacatttcatcaaagatacagtgtcttattctttcaggatctcaggggaatgattccaggcattcaagccctcctccagataatgcattcatataaatgcctcatctcagagtgacaagctcctggaaatttaactggagttcagattactggcagtgacaatgcaataggggagcagatgcccttagtctcaaaagggccaaactggcttgtggctcatttattaaagaggaggaatcctcaaggaccaatggctggttcagccatctagctgaagagaaagtacgtcatcaggagaacaggtacaagtgaaaaaggtaacagcatctgccctaacaacaatgacatctctgatattaaattctgaatgagcagagagtggtccgctttggtactaaacctaaaagaattctgtaagttctcccaagactgtttcgctgacacacacacttttgaaatgcccaagagaaaacctttcctcgtggagtgttagtgccaccttgtggccaatctctccatggctcctggaggaggaaatggcaccccactgcagtattcttgcctgggaaatccatggacagaggggcctggagggctgcacgccacggggtcacgaagagtggaacgcgactgagcacgcacactcacacagtaacaattcacttttaagttctcccttcttttcaaaggacaggtggcaagttcttggtaagtatcaactgctaactggctgtcactgtcccttgagagagctttcccttcatctttcacactgggccagacgcgagtctagaacatgaatgcgcctgtgctcaggtgagggtcgagtcctggagcacactgcagtggacagactgtgtgatgcagcctcttcactgtagagcaccactgaggggacgtcaagagttgtgaaccactgg

SEQ ID NO: 55498 - DNA, 1395 bp, Bovine  19866880745813
tccatggtggttgtacttttttgcattctcaccagaaatgtagaagagtacctgtttctcactagccttaccagcaaagtatgttgtcagacttggtttttacccattcagttgttttgtttacttacatgctattctacactcataagtgttttatgtcagtcttttattccttctatattttgagtcagatttaagaatgttttctccatatattctagtacttgtaaagtttccttttttacatacagcactctgatgcattttaaatttattatcagttaattttttaaactagtaaactatataactgaagagatgactattaatcatcattttatgtttatgaaagtaaatgctaagtggtttatgacatcttgactagagttgcatctatgtgtctggttttttgttcctcagcatgaagactttttgcttgccctgcagatgaatgaagaacagtatcaaaaggtaattgatatttcatctaattaatttattctgggtattttcattagctgtttttctcatctcacatttcctacgcattttgatgacaaattggttcccttaacctctgctgttgacctgccgagtttgtggttcaactaagttaaaatcaggtattgaaccattgaatccaaactggattagactttgagggaagataatattgttagagttgtttgtcttaaacatttcctggaatctgttagatagactcttagagcaaaatttagaattcacatgtcacttcagagttagaaagaagagatatatttaaccttaggatcagatggattttgtgtggtatcagccatcctcacatttggccttttctgacatggtagaaatgaactaatgactgatcagtcactgcccttaataaaaaggagaagtttcctggtactcacagtacttgaaatgttgctgtatatggcttcagtagtcccttaaggtaaagcttggactgagacacaaccccatcgcactcttgtcttataacaagatgcaatatgcaacttttgaaacgttttaagataataccccacatgccacttgttcctgactgttagcatttgattatagatgttataatcctgccagtacaatgaaattcgtgaatatggtaactttatacaaaggataatgccaaagaataccccccaaaaaacataaaattgtactgtctttagctgttaatatgtactcatatttgtactggcatcttaagctagatttctacagcagaaaacagctcatcattgttttatggcttttaggaattgcttttcacctcggaatgtgtttggggtgggggaatatgaaacatggctgcctcctctactcgagtgtagggaatttcacatgtttctgcccacctccaggaggcca

SEQ ID NO: 55499 - DNA, 5143 bp, Bovine  19866880869231
cctggccactccagcacccctctctgcagtgtgcccacgcacacacgcccccctcccagcgtctgcaaagaccccaggcaggtgggaacgcaggtgacgcccatgcaaggaccagcgctttgctgagcctcagctggaggctctgtgccatcagaccccattgccacccctcagctgcagtctccagccttccccacgaggagcactgcctgttctggcagcaacacccccaaggctgggctccctgccccaaccagcccccggcccgagactgccgctccttctttccctccattctcctccaggcccacccacgctgcttcagactcctggacccagtcttctcctccgtaggaccctggacccagcccctcactgctgtcacctcactcagagaaacccagatcactggctgggatggacggaatgacgggcccaggtctcggtccccgcctgcacccacacccctgccacagcctgagtatgggtgcaatggcttcccacctcttgaccttgggcatggtcatgtgacctgctttagccagtggataaggggagaacagcttgaatctgaagggaggcctccctccagaggccttccggtccctctcgagcctctgacagcaggggctgtcagagaacaagccctgagcagcccagaggcccacgctgggcagacctgtccctggtgtcaatggactgctagctgtcccattatcaccagagcaagcccagctgaggtcaccctgccgtcctgctgacagcctattcccaaccatcactgagtctgcatgcttggtcgttacacagcgatagctgacaaacacactccccagtaggtgacaaagctcctcggggctggcctggctcttctcactgtactcccccaatttacattctttaatctcaagctccagacccccaggtccaagtgcctactggaagtcatcgccctgggatgtcctccaggcaccccaaaccccagccaacaaagcccagcggttccctctgtgacccacctcagtgacagctgcccccacctgccaacacctgtgcacaggccttgcctccccgcatctgctcacacagccctcgaacactccatcccgcccatgtgccccggctccccccacagggtcccaccacccctggacccactccctggcccaccccgactgctgctcactcagatcccccagcagtctcctaactcatcttcctggcccccacttcctgccccagccctccagttccctgtctacacagcagccaaagagcttaccgtgaaaccaacctgaccaccctgacctccgtcttactgttttcagggcaaagcccaaacccccaccgaggccctcaagacaaggggttctgctctgcctgcccccagtccaaagccgctctcccgccctaactgaccagcccagagtcacgctggccttcctgcagcttacctcgggcactgctgtgctcccgtccaaccttggggcctctgcacacgccaatcccccgtcaccctgtcccctctctatgcgagcctggcctggcccgctcgggccctgctggcagctgcctccggggaaccccctgcacccccatactccaggcccgcgccaacacggcatggcaggcgctcacctggggtcagcggccgctctgccgccccgcctcggggcaggtgctcgtcctcggagaagctcgagtcctggttgggctcaaagtcctcctcagcggccatgctctccatcagcttgctcacggctcctcccttgccccggttctgagaacagagcaggacagaccgacggctgaggccgggccggaccccggtgtcaccatcaggctgccatgcagcgtggcacagagagcagcagccagatcccacctgagcgccaggaggaggacaagacgggttgagggagcacctccagctgcacacagatcttggggttgggaggggcacccaggatcgcccgcatttgtcaaccgagcgaagcaactctgccgtgcctaggcccccggggagcctcacctccttcttcacctccttggccttggccttggccttgctcctcttggcagaggctgcggagctggtatgaggggcccgggcctcggtgggcagggcaggaacgcggggcgctggcagcgaggctccagatccggcctccttgcccttcttcttctggggatgaagccagagagtggctgtcagagggcagagcgggcccaggccccacattcaccctcccgcccctggcaagcatttccggttttaatctggctttattaccactatgcattacttgttataaaaaaaagaatatcgacgtgcatgtagctgagttcctctccaacgagcccaccaaccgcagaggtgactagagggaatgacaacagcgtggcgtgtcctttccagaactttccccaagcacacacaatcatgtaaactcacaggctacgcaaacgcatttgtgcacacacagtacttttttttccttaaacacggatgggaatttaccgaaaattccgctgtgcagcctccctccccccaccctctgccaagtgtatctggcagacagggagaagaggcctccctttttattgtgaccagccgaccgaggtgccttggcatggagacctgaaattcatctggctgcccgcctgctttttccctctgctgaatgaggccaagaatgacgacagcgtcgctcggcgaggcgggcacattcctggcaggagcgtgcagaaccgtgcccccactgcccagggcacttctggggaccagcggttaccttcctcttgccccagcagtgggggacaccgagctcaaagcccccagggtggatccgggatgctccctccactggaaagtgggccagtgcacggggaccgtgcgaagctccacttatcagagcaaaggagtggcaacaacctagatgtccagcaacctggagtgtccacagacacagttacaagcttctatcccaggggccaaggccctgtgccaaggaagaggtgacagcatgggagatgcacgtgatgatattcggggcaggcagcaggctcaggccacagaggtgacgggagcaagggcaggggtcacttggtgcattttagaagagacgtgcctgataccaatgaccgagtcacgggccaggggagatggaaattaagacagagaaaaaaagaagactgggcaaatgttaccgagacagcagtagaagtcacagcttccacaagagacgagtgaaattcaaagccaacagcgttaaaaggaacaaagtggggaatgttactaggataaatgcgttcgttttaatctctatttagggggagaagtatatatatacagctttatatatactgaagcaacttggcgtgtgcgcacacacagacacacacacaatgttttcttatttctgatgtgtcttgtaatcctcttcccatttctgaaatcagaaggcatcttgggggtggaaggacagtgtttcatgtggtcgtgtctccttttccacctgacttctattattaaatagacagcctgtcttatggggcatgtctttgcagttgcatcttcaggaagaaagggaaattgacagcaaaaaaaaaaagttaccgctgcgtggaatttaattttcttccttttctttatcatccaattactgttacaatcagataaaactggtaactttctttcccactaaccagaaagcccatatctaagaaacatttcttcttttaaaaaaagaaaagaattccgaaggtgacgagttctgtacacagagcagagatgtttgttgctgggatgattgccatggcaaacaccaccatcaaccagatcaccgatggccagcgtggctgttggcaggagatactgaaaaccacaggatggccagatggtgggatgctattccttcacttagagagtgactttaaacaagaaagaaagaaaagtaagctaaaaagttgatggcatgtgggaatgcacaagatctaactccaaatctagaaagcagaatacaaaagtgcacctcaccaaacggtgaactgtttggccccagagcggtttccttcgtgtctgacgccctagacagttaatctgttccgttccacctctgactgtatcgtcaggaggctgggatcaggtgagcccctggccctctcctaagggaagctgcctttttgggaaaggctcagagaggctgggagccctgtggttaggggctcaggcactaggcctccagtgtaagctcagctctgatgatcgttagctgctgggctgactgggatggttccggggctacctgtgaggtacagtttttaagacttccttatatggcttgtaaaaccctccttacatggcctgtgatgtcaaaagcagtatgtacttggtctctccccgccccctgctgtgttcctgatacagcgctcctacagcgccctggcatttccggggtcacaggcacatcttctgttctaagaaggggacatgtgatgagcccgtggatggccttaggatggggcctggtctgcagaaagaccagccacgacccaaacttgaaacttcggcctcatccccgttcttgggagaggagcaaggggctggatggagcctgagtgactgctctccatcgtgcctccgtgatgaagcgaccacgaaaaccccttagcgctggggctccgaccacgagagggctggtccacacactgaggagtgccggagggggcatggggctcgacgccccttcacacacaccctgccccgcacgtctcctccacctggctgctcccaagctgcatcttttacgataaactggaccagtaaatcaagtgtcttcccaagttgtcattttggggaattattgacctgagtggggggcgggggtggagtcatgaaaatccttgatttacagccagctgggcaaagagcacaactgaccacctgggacttgtgcccagcctcgggggtgagggctccacctgtggggtctgtgccagctcaggggagttggagtcagagtgtttcagcagaggacataagcgtccccccaccagcacatgcagcatccatggtagagcgattaggacatgccgggcccccaccgcggatcccccagtacggtcatcatcatgcattatt

SEQ ID NO: 55500 - DNA, 1268 bp, Bovine  19866880882018
gtgtccccaggtgctgtctgcctgctcagctggtgacagtctccccccagcccagcagaacctgctaggtctctgacccaattcaccatccagcgagggagccagcctccaccatggccctgtggcccggggttcatggctccacggagggcctggggcagcggcaaggacagagacctcaggcaggtgtgtgcccagcgccagcccggtgactgccctaggccctgcgcgtagaggcacccggcacagggagaccagagtgatggtcccctcaaggccaatcccaaggctcgtcttctgagatgagttctggcagttcttagccacacagggcagctagggaaccactccttcctctctgagcccagggcacccaatttccagtgttcctcttccagccagcgtgtggagtggctggcaggtcagcggccacagcgccgtcaccaagcgtaagtccccgcgtgtctgtgaaatgagcctgtgtgtccacatgtcctggagacagcacctgggtctcggtctcctggagaagtggtctgtcctagtgatggggtggggggagagacgggacatcctcatctgacaagacagtcagtggcctcaagacactaacgccgggacacccgcagagatgagcccctgtctggggacagcagtcctggaggcagccagcaccttcccctctgggctgctgggcttgctccccggagcgaaagactgcccagtggcagtcctgttcttgccttaaaactggagagaggaatctagtatttgcacttagcaaaaagttttaaaacaagtgtgcatgaccagtcacattgtataaaaacagcaaaaatgattagtttattacatttttttttctttctggtagtaaaaatacataattgtttaaactactgtgtgtaaaaagcttgtattatatgtaacttgtttttttttgtaaatagatgtttgtgcagactgctctctggtttcttttctccgcacacggcacaatcaggccctaccaccccctgcaaagttaccagggctgctgggacagaaagcccatggattcctgggacagataacgcctcacctaactgttctcccagagcagaggtcgggaggctgcacaagagctgcaggatctgattccagagcttcccccgaggggcctggcctgcccaggagggaggtctggcgatccatcccattcaccctgcctggggagctgcccaggtcaggtggggcacagggggtactttttccggttttactgttta

SEQ ID NO: 55501 - DNA, 958 bp, Bovine  19866881085086
tccccgagctgggccagagactcccggagcgtacacacaaaaatgaccgcggcttctgggggcgcgtgaaaaggatagccccggtccttcctctggctagggtctccggcacccctccctggtccgcagtgcagcacttgggagaaaaccctggccctcattgtggcagctcttgggggacacgcgcgccccaaggccacgacccgtttctttgccccccccaacacacacacgccccccgcagacagggatctttgcgcgcgcgcccctcccccgcccggtgcctcacaaaggccctttgtcccgccgagccctggaactcaggttcctgaaaagtttcaagagaaaaatcaaagaaagaggcaaaaaaaaaaaaaaagcgagcgcagcgaagcgggcagggtcggtggggcaaggccacggcggcggctgcagccggaggtgttccttccaagaccccaaggccaagggagcgtcagggggtcccggagaactcacaagagtcctagactacacttggtggtgggagaggtgggttgttctttttttttatttaaaagccgaaggtgggacgccaggcacagaggctggaggcagccggagagcaggggctgggtttcccgcagcagctaaaggcaggtctggggtcccggtgtcagggagtgcccccgccagaccgcagcggcccaggcaggcttccccctctcccgcgcggtccccaccgagcctgggcagctccgctggggaaacggcaggatccagcgagctttctccgcccgcgcttccatgtcagactcagggtgttcccgccgcggatcgtgcccggccgatcggctcccgcgccgcttccgtccccaagcttcgggatggcggccgcccagtgtctgcatccctgcggcggggcccgccggctttgctgccggagaataaggggtctccagggccgtggtgctgcctt

SEQ ID NO: 55502 - DNA, 1342 bp, Bovine  19866881252617
gagctaacatctgcctgaagacctgggcttgcatcctggttttaccaagtgactcgaatcctgttcctcatttgtaggataagaaagtggtcccgcccccatgctgtgatagaagccattgtatttagacatgaggttcaccttaccatcttgtttcttctacagaaggtacattttaaaagttcagggaaaaaacactgaaactaacaattagttaccgacttgaagtctggagtatctttctgaagatattctctaaaagggtctccacctttcgctccctgatcctctgaaatactttcccctcctcttctttccccaggccactcaaacaagagtctcaaagaagcccagtgccctcagtgcccctgacccatcaggaaggcagatgctggtccaggctggacggtactggagccaactgagggcagagggccggtgggtagctttgtttaagacgtggagagaatagaagacctgagatcaacacgggccactttttttttgtttgttttttaagtctggctgcaccacgcagcttccaagatcttcattccccaaccgtggagtgaagctgggcccttggcagtgggagtatggagcgctaaccaccaggtttccccatgccacattttactgacataatcttctgcaagtttctacatttatacaactgggatgatacagctgccttagagcatagtcacagaattaaatatattaacacatattaacgtcaggttcaatccactgcaggtttaggaaaaataaataagtctcctgaccaaatggctaggcgataatggtgccaaattgtaaactggttgtaaaagccctagggttttatttgaactgaacatgcctcaaattcttatatttaaaaaacaaagaagttgtagagaacaattctgtgcagtttctggtagccaaaacccaagataaaaccaactttgttttgtatttaaagagaaaatgctcttatgaattttgtcccacttctagaatccagcctgctaggtgactgctctgaacacagcttctagtaacagtaaggtgtaacctcgttaaccccactaggttaccactcatggacaagaaaaaagctcatctgggtccagtaaagtcccagggcaacccatcccccactgcaaaataatgtctgttcatttacaggctgtgatctgtctgtgcattctgacccctaaactagaaaactgtagtttgtcgtgactggcttgcttctgttacttttttccttcctaaaaagacatcttgttttacaagactcttggttgaatgttttgagcttattttcaacaactaacagataactgacagctct

SEQ ID NO: 55503 - DNA, 447 bp, Bovine  19866881326037
gaaggcgctggccaaggcctcagcctgtctctgaaagcctcgcgagaaggtaaacacaaaagggccgccaaagccaggaagatggaggtggggttcaaggccagaggccagcccaagtcgacccactcccccttcgcctcggaagtgagcagttactcctacagtaagtagtgggccgcgccgcctcagggctgttcttcctccctttccttcctttcttcctcttttggccttgaaagctccatggcctctggtgatggtctctttttccgctttggcgccggtaccaggccggaaacggaggtggttgtgatgaatgggcactgttgtttgggcggccacctgtgattggtgggtactcgtgattggcgggcgggtgggagcggaagtccgccagccctcccgtacccgccttaccgttggtccgcgctaaggccatcggtggga

SEQ ID NO: 55504 - DNA, 965 bp, Bovine  19866881422294
tcataatgagggatggctatggagaggaagaatgtcagaaagtgcatggaatggtgggaatggttaggagcccagttttcccaaaaagaacgttatgggaaagtcatgtaacttaacatcctgataggaataagtgggggaccaggccacataagactgggatggctgtctggattcctagcaaaacagttgtctgcatgattttgcattgtcacgtatcttctaggtgacaaaaaaatagagaagaggatgttctttctggaaaataagcggcgacattgtaggtcctatgaccggcgtgccctccttccagctgtgcagcaggagcaggagttctacgagcagaaaatcaaagagatggcagaggtaggaagatgtgtttgtatgtgtatctaggatctgatttgctggtggggctcagtgtaaagctgtctttgaagatttgccttttcttttaagtgattaatgaataagccatgaagtttttaaaaggaaaacaaagctaggttttgtagtaatactgactaaaattcatagtttcacaaatcagatttacgttattttaattggcacttagtaaacacatctgtttcaccttcttcgccctctactgggagaggaataaacagattccatttagctctttaattcttccaaaagtgaaagtcaaagtcagtcagtcatgtctgactctgcgaccccatggactatatagtccattgaattctccaggccagaaatgtactgtcaaatgtgcaagtcagctggaagatacaaatttggttttttaatacagacagacctcagagacattgtgggttcagttgcaggccagtaaagtgaatatcgtagtgaagctcatcataagaatgctttggcctcccagtgtgtaggagagtcatgtttacactacagtgcagtctagtaagtgtgcaatagtgctggtctaaaaaccaggtccaagc

SEQ ID NO: 55505 - DNA, 701 bp, Bovine  19866881630168
cccagcctcagcgaccccagagccaggccgaggacggaggctgagggtcctccccaaccccaagggctctgcccatgggcggtcaggcctggagcatctcagatatgtacgcaaagcctctcatgggcaggcttgtggctagggagcccccgaccaggtgggggacccggctgtgaccagttgggggggccctctaggacccatgacagccccccttcaaccagagcatccccgggcccctaacccctctacagcggggttgggggcgagcgtgctcaggactccgcttccaggaaggagggcttaaagaccccaccagcccctgcctgggcccaacttgaggagggccagaagccagaagaaagaggggcaggaggacagtggtggaggagggcgatttacggcgtaaacacaacacttgtgtgtggaagaaaaatattttctttgaacaaacaagactctcagcctcgtttcccagaagcaccattatctctgcacagtgctgcttccaaaaagaaaggaaaaaaaaaatcacgggccagggacagagggaaaagaaaaaagctttgcaacctgagaacaagcgctccagggcctcaggggccttcgcagggggcggcgggctgggggcagtgggcaaggctggggtgcccggctgcctcccccaccccgggcccaggggcctcgtctgagccggcttc

SEQ ID NO: 55506 - DNA, 1952 bp, Bovine  19866881644119
cctcccagcaactcccctcccaaccctggggtgcataaagcaagactggagcggtgggtccctgccccgggccgcacgacgaccaccgccgtctactcagctactcagaccccgtccagcctggctgtgtccagtcctggaactggtgtggatcaacaggcctaggccagcgagcaaggtactcaaagtggggcccaggcgccttgcgtgagcagcacacccctccagcctcagtttccctctgtcaacccggctcggtgtctctccgtcctgccaggagattgagagcatggaggggcccgatgccaagtagacatggggtattctgcccccacaggaggggctgggggtagtgtccactccatccaggggggcccctcttggctccaaggccatgccctgatgggaaaggccccactcggccttggagtctctaattagagctgggttactatgggaacagggttttctttgggatttttcttttcatcaacagcagcacagaaagcgtgagtcacaggcccactggagccccgggaagtaaggagagggatgcgggggctcaccagagcccacaggcacatcctcccaccccggagacgccgggccccgccccgtccatcatggctttcccagtctccagccccggggccatcctgcacagaccagcctgcagcacaccccatggtctcatccccctgcagccttagcagtccccaagtcccctgggtggtcaaaaatcaggcgctctccaccacccccattcagtttaagggagggagcccagaagcttctgtggcttcacttcacttctcctccttgctgtcaactcttgccactacctaaccaccttaaatccctactccatccttacacgagctgttccctggggccaacgtgacctgccttatcaagagaactcttacacatcctacaaagcctggcttgtccagcccttcctcagccagccagccagcctcaccttcgagcgctggggctgggcacttcctgagcacggagaccccagggcacagctggtcagaggcaaaggggctatgagatcagggtctggctggagcccagggcagtgtgtgtagatgttagtcgctcaatcatgtccagctctttgcaacccaccatggactgtagcccgccaggctcctctgcccatgggattctccagggaagaatattggagtgggttgccatgcccttctccaggggatcttcctgacccagggatcaaacccaagtctccctcactaaaggcagatagataccttaccatctgagccaccagggaagcaaagcccagggcaggtaggcaccaaagaagcttgaatacagctcactcagcggccctgcctgtgtggtcacagtgaccccacttcccaggacctggggtggatgtatgccatctgctttgtcacagcagctctcaggacccccaagccctggtggccgaccttgcctctaacagtggctgcgatgaccccgtcccagaaatacggtctagccacaaagaacgtgcccaggtggagccctttacagatggggagactgaggccggagagcagcttgcagcttcagcaggaagcaccccacccgcaccgggccctggctgctgggatgactcacatcccccaccggcaaaacccaggaggctcctccttcctggcccgcgtttcccaacatgtgtctggaggagcctcccccgcctccctgccacgcaggcctgtctaaaatggcctctgcaggcacgccccccaaccctgcgcggccccgagccccccatcaccctccatcccgccaggtagacccgacgtcagaacggaccccagaacctgaagccaaggcagccccaatcttggcccccagagctccctcccctttaaacacacagatgagcccggctctccagctgcaatttccggcagctcctcttgccccat

SEQ ID NO: 55507 - DNA, 1275 bp, Bovine  19866881690372
tctttggggaaataaggctcagagttgtctgaggtcaggagagagaagttccagccttgcccagggcgcagaagagagggcagggggccgggacagcccgcccagggccaggtcagagtgccgacctgcccaggggatgaccggtgagggcaccgtttgctctgggtttccagtttgaaaggcaaggggctcgccacccgcagcagagcccccaggagaagagagttagtgtggggcgggggcggggcagggagggggccaggggcgcaggcctagtactcccacagcgtggtggggtcgatggtgtcggcgcaggccttcaggacccccgcgtggtcccccttcaggtagtgcccccccaccttgatggccaccttgttgtagtcgcagaactccaggaagaagtccaccgggctgtcgctgctgctggtcaccgacgagtcattgcccaccatccagtacttgcccgtggagtctgcaggggcacaggggggaccctgtcaggccctgcctcgcgctctgccccccaccctccaatcacggctcccagagtgtggcttggggtctgccctgtccacccacgtggatggacggagcccctcccagagccctctgtctagtgtggtctccctcctatacccacgagagcggaaggaaggggctccccaccagctcgagctcccacatggggcctggaatggcccaagccatgtcagagggtcaagtggggcgcagaggcgggggggggggggaggtgcccccacccagtcccgcccacaggggcacctgcctttgatgttgtaggcaccgtctcggaactccagctggaagacgtcatagttggagcggttggcatccagggtgcccgtgaccttgcgacagccgatgaagccgtgctccccgcggaacacaatgatgggccgattgatcagcttcatgaggaagagctccgagtcccctgtcccaagaggtgggaaaggcagtgagcctcagggggatccgggcgggggccgggggggtgcgacgcccagggtgtgtgtggctcagagagggacagcaagagcctggggtcacacagcacgccagccctaggggaggcggggtgagggcggcctgggaggacacttggcacagggcgggcttccagtggggttggtaagtgaccatggcacagcgagaccccgccccagggaactgcggcttgaggtgtgcccaaggtggctacctgccgtctccacggaggccgccagctggccgttcttcttggccgtcacg

SEQ ID NO: 55508 - DNA, 740 bp, Bovine  19866880375371
tgccttctcctctctgagctgcaacctgacaaacatggtaatcaggttggcttatgcctcagtgtgagcctgaatttcttatgacccactcctctattcacttcttatcagtctcttcctcggttgttgtgccatcaataattgttctctactcaacacagtatgttcttttctgtacctgcttcaacactggtctgatcactctattgtttttcttgagaagcttcccattactttgtttcgacaacccaaggccatttttttcaacacagtttccacagaatataaatgcacatgaagttgtttacttatttccctttgaggacatgtaaccaacacttcactgggaaaaataagtctctctaccttttcacagtgcaaagaagccctgttatctttcacttaactgaggaacttaaacgctccttaaaatacatgctgttaggtctgctttcactgagcagacaaaaggcatctatttaaagtatgattcattctttcctattccagtactgcctgttgtctttttacattttcacctgtctcttaaacttcaggaaagaacaatggtgacatccacaggggcgatttgtttgtcctgaacatcctgctgagtttgcctgtctctaacaaggatacatgccttttctaacttgaaaaataactggcaagctctgatatttttcatgaggttgaacctctgaccccttcccacagtgctgggccctcccctgagtttc

SEQ ID NO: 55509 - DNA, 1632 bp, Bovine  19866880489739
taaatttgaataactactgaaattttaggtttgtgtaaatactatacttcaatagttgggctttcctggtggctaagatagtaatatctacttgcagtgtaagagacctgggttcaatccctgggttgggaagatcccctggagaatgaaatggcaacccactccagtattctttctcggcgaatcccatggacagaggagcctgagggctacagtccgtggggttgcaaagagccagacacaattgagcaactaacactttgatttacttttcacttttatatataatttttttcatttttgtagtttttaaaaataaatgtttagatttcaaaaaactgctattctgcttttgacatttagaacattacgtaaaaattgatctttaggagtttttttcttctataaaatttcctcaccagtaaatgataactactgactatgctgtaagtaattgtaatgtatcttgtaacagggaagatgattcatcacagcctccagatgcttgcagaattcgtggtcatctgtatgtcaataaagtagcagggaattttcacataactgtgggcaagtatgttcttttcacttgctgaaaatactttagacaagttggcagtttggttaaaagtcagatctttgctaattgaataatatctaactaacaactaaaggactcttcaaatttgtatttttgatgtcttcagattgttttggccttcagcctcaggatagagaagactactgactttaaaaacttctactttaaaacaaaaggataccagtcatgttatctttcatatattaaagtatagaaaatagtaggtaaatgtgaattaaaaccttcagcttgccaagtgttggtaacaaacctcttacttagacatttcgttaatttgttcgttttgttggatgatatcaggtttttgtttttcctttcagtgattctcatcaaaatggaatccctaattcaagacaatattttgatgtaggtagaaatgtgtctgggataaggttaaattaggtgaatgttaaagaaaaatctcagaccacctgcctttatgaacagaacccagcacagaaactgtcatatggtaaacacctggtaaatttctgaataaatagattctctgattatctcttccctctttctttgcttctttccctcccttctctcctcctagctagtttcagagctgaacagttgttcattgtgaaaaacatttcttgagtatttgctacatggcaaagtaccatgctacatactatagattaaacagtgaaaaccagagaaagggtttgcccttatgatgctgacattctatgagagaatctgaactttaaacagtgaattacactaataattacttaattatagttgtagctataaaggaaaactgtggctgataaaaaactgtataacaaggttgctggtctactctccaaatcagtggaggctttattgaagaaaacctttgaacactaatggatgattcaacattttatatgtaaaggagagaatagcatctaggctgaaggaaaggtcataaaacaggaaagagcatggctggatggatattttttttaatgtacagagaaaacattagactttgtttccgtgtttacagtgatcag

SEQ ID NO: 55510 - DNA, 1770 bp, Bovine  19866880524902
cccccccacagtgaatctatcacacatttttcctacagatacagtaggtatcggtaaactttcgtttgtttaactgatccagagaagtaaattaatttgttggaagttgcacagttaatcagacaagtaacgtgtatttttattggctatattactagctgttttaattcttgtcttttcactccctagtgtatttgaaataaatttccagttgcctctttcctagaaatgaatgtacttcgtgtactttggaaaatgacacacatcttatttttcccccactcatattttgtttgcatttcatctgaacctattaggttgagataagccataaattatttagccaactctgtcacatctgtgatccacaagatacaaaattggattcccttccagtctttctcattctaggaagttcagccacatccatgacatatttttccctaattttacaacattctgattgcctgatcaacttgcagtttatgtcaatatttagtatattcttgaatatgttctacctctcttgactgaatggggaggagagaagattatcatcagtttgatttgagaatcaagaacttttttcataagtattatttctcttgagataaacaatggaacttcattgagtttgggcactgtgccactgtcttaagttgaatgttttgaaaataaagaaaacaccacataagacagcccttctggtagcacattctgtggagtggtggcctctgaactcataactccaatgacattgactttaactgatcaataaatctttgtgctgatccaaccaaccccactgagccgtgaactgcacttacatcattttatagttgaggcaaggaagggctaattacctgcctgctcaaggtgactaatgatggcagggccccaacttagatctggacatcagctttgggacactgacttgctttcccttctatgtgtgtgggacccttaacttgttccctgttgcctgtaggtaaaaatcagctccactcagggaataccaaacccttataattcgttacctgctaacatgcacagggttattccctgctttgtactttctgtatcttctgcctggaatgcacctcactgtgaccacttcccttctctcctaacaccaccacatttaccttgtgagcattcactcctcagtcttcaaccccagattgtcccctccaccaggaagccctctccatcctctccctgtctcacacccagtttcctctctcacctggaacatttattcatttattgatttattcaacaaatgtttctaaacactcattaagtgccaggcactgagctgagcagaaaccacacacctctgaatacagctcaccagctcctgtcctcatagagcttagagtctggtgaagacaatagaaaaatatggtgagcacacagaaaaatatataattacaactgggatgagagtgaggaaggaaagaaagttggtgcctggagcctgcagtccccaactcagcatcaccactgcctgcagcagtggcactcagactacccactgcaggggctcctgaactgagggaggagatggccaagggggcctctgcatgcctgggatgcccgcctcctctccatctagtggctcccagagcctcgggcttctgctgagtaaaggacataagcatgtgccaccacagtgaggaaggcctttggtcaggcagcaaggggtgatactggggatgtgacggcaatgtctttttcagagctatgagggatgctcaccaataactg

SEQ ID NO: 55511 - DNA, 1141 bp, Bovine  19866880592868
gtaaatttcctgctcaccgaatgttcaagttaaggatcccattccgagttttaagatcccatccatgaacactacagaggtcatgttcaccctcactgaatccggggtggatccctgcagccccagggggctggtttggccattttacaagaaaaacccagaatgagtcatatccacagttctctttcatcctctgcctttctgcctaacaatgaacaagtcacttaaatcttttggcttctgttctccctccgtcctaacctagcgaagacccaaaatctcacctgcctctcacttgcactttgaactctgtggataaaaggaacagaaattggctatctatttagcacactgttgtatggctttagggtcaatgttttaccaccaaaagcaattggaataatcttttcttctggtgataaatgccagttttatggatatcttttttgaacaggcaggggagttcggggcttaaatcattctttcacagaagttttgatctcttgttcttatctcaagagtagcatataatttaatggctactttttgtatttcataaaaaccactttataatgcttcaaaggactaaaatttcttagaattgatgaagcagacatagttgttgagagctctcaaataaaatcataggatatgatcagagatccattcaaatgccagattaaggatgatttatttacttcagtgtcaaagagcaaattcctgaactattttaagaaaacatctacgaggggagagggaagaacagacaggggtaagtgaaggcagaaacaagaatgtagacagaactgatcaagaaaaactgggaccatggaaggagaagttaaacagataacatgtgtttgaggggaaaagagatactatttgagttgtatagttcttcagctaatggacacatcagacatggaaaatggaaaaaaggtgactcatttccattttcagttctgacaaataccttcaaatcatacctactaatacttaaatggaatttgtaatcttacacaggttatttatttctcaggatgcaaaatgagacatgttacctctaaaggaacattagtcctgttatctgacgctggggacccctactgataagccctctatgcgtatgttccttcagagt

SEQ ID NO: 55512 - DNA, 850 bp, Bovine  19866880700674
taacagtgcagcccactgggattcagtgtggctgtagaactcagatctgatttcagccccaagtaccctctcatctgggtgccatattgagcatcacacaaattgtacaatgtgtagttatagagagagatctagagatagacatggaaataaagatatatatcagcttatatatttttattatgtttccctactagaatgtatacctcataagatcagagatatttgaattttttgtgttctgttaattactatacccccagtatttagaatagtgcctgatacatggtaggaactcaaagaaatgcttgttaaaacagtatgtttgtaagttttctattttgcttaagctagcatgaattggctttctgtcacaaccaaaagagtcctaatatacccatgaaatactaaaatatttatgttgaacagcattagtgacataaattgctgtccccctgaacaactcatttcatgtttcattatttatgcttctttgaaaattctttttgatattgaactgaaatctatcttcctgaacattccatacattttttgcttactgattaggcaacacagaagaaatttaattcttttaccatatgacaaccccctgcaatatttgaaagaactccttcaatatttgaaggcaaatattattactttgtatctatttttctttattaaaacccctactttattcaactatttctccttcaaaattgtcttaaaaaatctcactctccctgttaaccctctttgaaagtcttttttctttaaattcctccaaatcagaactgaaggcaataatctgagtggtatttgaccactaggcaaagagcagaattattac

SEQ ID NO: 55513 - DNA, 1050 bp, Bovine  19866880913119
ccccccccatattatgaagtaattagcctccaatttaaataaattaaaaaaaaatctcagtgtttttccttttagggatatttcaaaacttatgcactgttttgtaagcaaagttatgtttctgtggggaatgagtttatatttgagggaaaatcattttaaatgatctgattttggtctgatccaagagaaaaactacttagtgaataacttgactgacttgtacatcattcagaattgtgactcatggacatggcgatacaatatattaactgcaaagtaatatttttattgtgattgtcattttataccacagttagcctttcctaccaccattatccttgtggattaaaagatttgggttctaaatcttagctggctgattagctccagacaatttttatctctacaggagttccctttatagtgatattataaaaataaaaggttagaatgagttttgaggacaagctaaaaaaatagtagaggctgatataaatgtaaactgtacacaattcagagttattagattttcagacatgtaattaatgagatttttgactcgtgatgagcataggtaaccaaaaactagtttctctccttggcactgaaaagctttgcagggatatacatggaaaaatttaagtgagaaataaaaagaaaagcatgtatatcatatgaaatttgttttcctaaagaactatagtataaatattgctttaacaaatatcatatatcatttgtacgtggaatctaaaatgtgatacaaatgaacttataaaacagagacagactgacagacatgaaaaaacaaacttatggttaccaaaggggagatggagtgggggagggggaaagttaggagtttgggattagcagatacaaactattatatacaaaacagataaatagcaagaccctactgtattgcacagggaactatattcagtatcctgtgataaaccataatggggaaaaaatgtataaatatatatgtataactgaatcactttgctgtataccagccactaacacagcactgtaaatcaa

SEQ ID NO: 55514 - DNA, 1030 bp, Bovine  19866881012653
ctgaacttaagtgaataacttagctgttatacttccatctgtaaaatgggagtgataatagcagtgacagcacatgaggtggtagtaaagcaaaatgagttatataaggcaaagtgcagagcacaaagtatatactcagcttctgctgctaagtcgcttccgtcgtgtccgactctgtgcgaccccatagacggcagccccccaggctccaccgtccctgggcagatgttagctattatagcaacaatacaggtccaatagcaacagtccacggcttcagatcacagatctgggacagagttatgactaaaatatattaatagttacaactcagaggccagaatcctttctatactaccagctttattcatagcttgactcacgagtggtggcaagaatgttctgcattaaggttagtctatgtcagaggttgtgctattgagggtcagttcccatgattctttcagcaatccaaaaagtcaaaaccaatctttgtaataatgctaagatgttatttgcctttttcactgtgtttgacattttcactaatggtgcaaaagcaatggtagttaagatgtaccagtaatcatactattcaatgccacatattttcaggcagggtgggggcgggggggaagtatcctttgaagaagtagtaaaaatgacaaatgttattaaaccacaacacttggtgtcacaaatgggaaacatacaaaaagtacttatgctgcaatggttgccttcgaaaaaaccactttgttcaactgagttccaagatcagtcacttttttgtgaaacaaactgaaagaactgacaaacaatagttattcggttgtagataccggacagacatgttctggaccaaaataactaaggaaaagaactgccaatatctgttgccagtgataaaacacactttcaagcaaaaaaaagaaagaaagaaaaccataatcctggaaaacttgtacgtaccacatgaacttaaaagcttttcaataattttaagacttttattagaaaacggtgctat

SEQ ID NO: 55515 - DNA, 1113 bp, Bovine  19866881060625
aatcacatggacagaggaatctgatgggctacagaccatagggtcgcaaacagttggctataactgaagtgacggagcacgcatgcagagacatgtcactatcacatctggctggggacagaaggaagttatgaccctctagtgaggagaggccagggtgctggtaaacactccatattgtcctggagagcccgcacaacaaatatttatccctcccaaaatgttaatactgcaaaaaaacaaaaaaccttgacaaagtatgattcctgagaggcaaaactcctgtttcttttaaaaaaatttttcctttcaagggctaccaagaaatatggattgtctaccttaaatgcttttttgaatcttaagttttttattttccagaggaaccacccaaagaataattaaagttcccatatgcttaaacctgcaaaaaatgtttaacttggcacaactgtttgtgattcaatattttaacacccaatctctagaaatgagaacagcctcacttctagaaaacaaaaggagagtgacaactatggaatttcgctcattaccatggagagctggtgatcttaaggagaaaaatgctccagaatataggaagaatctaagctgcataaggcctgttcactgttagtcccagtgcctggacagtgcctggcacatgcagacaatcactaaaaatgcattggccgactctcacgtcagccttgtcagcctatttgtcattcagccttgcattatacaggctggttcagatactgtcaaagtagtttatgcttctcacaaactatgttataagcatgaggaataggaaagtggcctttgttctctgcattagtaatctgagactgtaggaaaggtaagccatgttctaaacatgttcttccttctagagttatatatcctccatttctgagtgtaaaattattttaatttttgaaacaatttaattattttttaaattatatgtatggggatataagatgttattggaggaagctgaaagaagggtacgcagacctctctgcactctattttttaaaatatgtatttttttaagtatttacttatttacttgggctgtgctgggtcttagttgcagcacgtggg

SEQ ID NO: 55516 - DNA, 964 bp, Bovine  19866881064417
tataacttttttcttcccctaaatgtttacaaatgatatgtatcacttttatttccttgttttattttttattgaagtatagctgatttacattgtcatacgtgacttctgtattaagaaaatgtatattttaaaaactagctcagacaaaactaaaagcaaatatcaaaactgttttcaaggggaaaattcctcaaagcatacaactgaaaacgatatgtgaatcaaacttactggttcataaactagaccatctgcagatgcaaccattgtttctgctaaatccaatacatctgctccaacatctgcataaaaaaaaattagaagttttatattttatgctcagaaccaaactttatgtgatgtacactaacaaattaagatgaataatagaaaactcacaagtatgtgggatcactttcctatactgcttatttattcaagttaaaacagtagtattatatagttttggtggaaataactccaaaaattaataatgctttttctactttttactcagtaagaaagatgacttggaatctcacagtaaaaatagtataaacttaactgaactgaagagctttgcaaaaactggcaataaactaatcacagtattaaatggctgcctgacaaaatattaatgacaagaattatttttagagattaaaaaaatcttaaggcaaagctactgatgacatttaaatagtcaacaaatagggaaaatttattttgaaaagggtaaaattttaatggtattcaaacatctataataaagcaaaatatgataattcagtattaacactaactcaatagtttagatacaaaatatttatcttaaaaccactaacataaaaaaatataaatggaaaagggaaacagatttagatgaaatcttttagaaattaatttggatataatgagattcacattggatataatgagttcacaactttaaaaagttctg

SEQ ID NO: 55517 - DNA, 1236 bp, Bovine  19866881090719
cctttctctgttccaactctatgatgttttagtattgacagacctcacctgtgcatcaggcacatggacttgcaatttgtaacacatgctgaagaatgttctacctgtggtattagagaaatgacacaaacttctcttgtgatgattaagctgtaaaagtaggtatctgcatgaaagaaaacccctagctactttatatcaagaccagtaacaattatttgagtgcctaatatatacaatccaataagaactttctacttttgatggagaaggggacagtaagtacaaagaaaaggttactttttaaaagctttggtaatccctatattctgcacccacaagatattacagtaacaaacattacagaactgaaaagtcaacacatgaggcagttaattctagaaaaagttgaggcagaagggcacacaaatcagaaaaacatttctcacaaatttatactaacctaacatctccagctagtataaaatttaactcatttaaatttttagctcatttaaataactgacttagaatctcaaggtaaaattgacttgagaagggactaatagtaagtagtgtatctcatagtgaacattaacaattaggtcagcctaaagtttcttgtaaagagatcaaactagtcaatcctaagggaaaacagtcctgaatgttcactggaaggactgatactaaagctgaagttccaatactttggctacctgatgcgaagaactgactccttagaaaagactgatgctggggaagattgaaaacagaagaggacgacagaggatgagatggttggatgacatcactgactcgatggataccagtctgagcaagttcagggagttggtgatggacagggaagcctggtgtgctgcagtcatggggttgcaaagagtgggacacaactgagtgaataaactgaacatttctaaaaatatcaatgtttcaaagttccaagaatcacatgcaaatttccgtgtaacttttcccctgtacattttctatgcaaatctaaaaaattatgttttgggaaccatatacatatatgaaaaaatgctcactacctagattaccttttaaaaatataacaaattgccagaattgctgattttaagatataactgacttgagagacaggaatgccctgtgaggtgcagatacaaatacgacaacagatacttaactgaaattgagtgttaacagcctagaagagctctctgatataaa

SEQ ID NO: 55518 - DNA, 1991 bp, Bovine  19866881101794
ttagtgctaagacttggcagcacacagatcttaaagagagtcacccatacagaaggaatacatgtagtggcagaaaagaaaagaatctggggaaaaagttaataattctgacttgttgtcagggaccttctgggaccaggcacatgtggttgccagttaaactgaaatatttaatttattcaaaaacaaaacagatggggaccaatagagggtggagacaggggtctttaacagatctggagcaacatgccttccctcctgcctttacagtatccagcagacatatatggtcacacaccttgagtatgggataaatttgactctatattatttattatcagttctcttcattttataaaagcatatttgcactaaagcctgtgttaggcaaaagttgtttttatgttttaaagtgaagattaaaatatttcctaagtaggtataatagattcctaaactatctactttttaatcattactcttacaatttcaaaaatatgtctctctctctcacacacacacacacacatgcacacacacacccctctcccctgactcaaccttctctctcttccctttgctctaattatgaatttccagtgctttggttccatttgattacaaaggaatagtgttaaccctatgagaacactgtgagatgatagcttcataccctgtattaatagaattgaaaatctgttttcctgccatttaaccttatggcataaggttatcttgcacattctccatctggtccggtacttaaacaaatggattctccaaggcagcaacagataaagatgaaattacacaagcagacagggtctctttatgaggacattaatgttaaaatggaccagaagatctgtttcttggtctctgcattcttcaagcaagcattctgatggatcagaatataattatcccttttctttttctctgcagggaaactacgtgtctgcaagaacttattatgaaagagccttacagctggttccagacagcaaactactgcaggaaaatctcgccaaattggatcgccttgagaaaagattacaggaagttcgagaaaagaaccaaacgtagccagcatttgacccagtctcaagggacagtgctggtgtctttggaagaggaagaagtgatggaagctttgctttcacatcatttggggcacgaccaatggcattttcctctcactccaagttcagggtgacacattttgggacacctgctggtaacgctgtgctggagacttgcatttccatgaaagaagacaaaaagagcaagcaggggctaggagacctgagatggaaggaaaacagcagctgcacattttacagaattttttcttgctttaattctagatttcctttcatatatgcatctgcttttttaacctggagatctatttccatttcttagtgtagacatttcttggtgtagcctcccagaaatagaggcttgaaatgctatgaagtcatggcatctcttctttatgagaggagatatttcagagaggataaatcctctgggataaaccatttgggaaattcttccaagaggtatctcatttaattctctggaactagaaatgagtatctcacagtttttgtaaaaatcttctggaatatatggggaaagaggctgttgttaagtcagctttatcttatatccttttgaggatattgctagagccctattgagaaataaattaaattcccctctgatacaagctgttttcccattgcctaatatatcaataaggaagtttctggaattgtgtatgggtattcatattcctatgggaaaatcaaggatctcagtacccctgattgtttatggaaatgttttaaattattttaattttattacaagtattattggagtagtggctctgctctaagatttcataagtgcttttaaaaatcataaatgtttccacctccaaatatattgttattttggtggagaaaaaatagtatattcta

SEQ ID NO: 55519 - DNA, 1749 bp, Bovine  19866881326181
aatccagtccaggaagacactcactctggcaaatacacctggcttccttggttggtcacagccagctccccagctgacaatgccatagaggacaaagggacctttttcatgtttacacactagcagtccaccagaatctccctgaaacaccaaagaaaacgtgttctaaaattgctttaatcagaactcctggctttcaattttggaacatgaataattaatttattaaaaacatatttctttaattttttaaaaagatttattccttgtcatttggtataccttagaacacttagacataaataaatgaaatggcaaaaggaaggaaagaggagacactacagctggtattccagaaatacaaaggattataagagatcactatgaacacttataaaccaaaaattgggcaatttataagaaataaattcccagaaacatgcaacctactaacaacaaagtaagaggaaaaagaaaatcacaatagactaatatgagaaaggagaatgaatcaataatgaagaatatcataaaaaagaaaagtccaggaccagaaggctttactagtgaatttcattaaacatttaaataaagaatccttgtcaaattcctcacaaaaactaaagaggggggaatactccaaaaatcattttatgaagtcagcattatcctcataccaaagctagataagaacactacaggaaaagataattacaggccaatatccccaatgaatatagatgtaaaaatccccagcaaaatactaacgtactgaattctgcagtatattaaatatactatcaatcaccataatcaaatgggatttattccagggatgtaagaatttttcaatatatgcaaatcaacaaatgtgaaagttaaaagttgtgtcgtctcaatagtacaaacaaaacatttgaaaaatgcaacattctttcacgattaaaaactctcaagaacttggatataaagaaaacataactcaacataataaaagtaatatataacaaaccccacacttaacatcctactcaacagtgaaaggttgaaagctgttcctctaaaagcaggaacaaaagtactcatcctcaccatgcctattcaatatagtctgaaaatcctagtcagagcaatctggcaagaaaaagaaataaaggcacccaaaccagaaaggaagaagtaaaattgtttttattttcaggtgatataatcttttatacagaaaatcttaaaggcttcacaaaaaactgttagaacttatcagtgaatacagtaaagtttcaggatacaaaacaaacatgcagaagtccgttgtctcttgcctgtagtcagtgaggggctgtgcaccttgcactagttcccggtgggttctgctggacaaatactgggccagtgtcattgagggaatcaagcaagatctgctccacagggctaatgctacatctcccttttaaaattttgtagaaattataaaaagacagtggtatgtggtgtgatgatcagcactaagtcctgcgtttctctcaaggccacctgggccatgaatgagaagggaatcaaaatgaaatctgactaaaatattactgcacaggccaagtacatttagtatggcactgagttatgatatagttttactttggtgtgaattttgaatttcagctacacctagatagacatagaatgataattaaaatgctgtaccaacttatctaataaaattggcacccagcccctattttgttgactatg

SEQ ID NO: 55520 - DNA, 618 bp, Bovine  19866881724233
cctgcctatagtgggcttaagctagagatactggacaggaaaatagagccttcaccaggagggtgggagggcagggctgagagcagtgccctggcaagatcctgatgcaaagttatagtaattagggtcctggaaaggaaagtccttctctccttgtagctgtaaacccctggttttaccactgaagctcctggtcctggttttcattttgggctctgcagcaacaaagcacctttggcccaaatctctcacattatatttttaaaaagcaaagatttaagtgtgcaggggagcctataatttacccagcacttgaaacaatcaaatccacctcaaggcatagatgaagctcaaatcctcctgcgcaggttttgatggtcctacaaaagcacttaaaattttcttttatgtgcagggcaattgccatagttttctagctgcatccttttctgtctcatgtaacacaggggtggttgtgctcttgcagagactgtggaacctgactctgggttctgtttataggctttgggtttgcaaaacaggggatgatttgccaagtttagaacccctggaaacctgtggatttggaactccagatagaattccaaattttttttt

SEQ ID NO: 55521 - DNA, 1175 bp, Bovine  19866881758120
caaaataagcataagcctaaagtgctcattgttgtctgcatgttaattgaaccaatgatacccaatttagtatataatgagaaggaataccatttagtatctctatcactaaatagttttcaattgctttttaactattgcttaatttccatagaaacaaaactcacaagccttttcttaaagtccaaatagctttccaaggctgcatggatgagctgcactttgaaacttaagcactgttcagtaggtctcttattctactcgcaagcaataccaacagacaaaccattcagtctacactctctgggctccagatattcttcctaagtgctccctcttgcttccactggggttttgatagagggagaaaaaactttcagaaatcaacccctatcattaaaggaaacttcctctccacattcacctcagaagcaggcaacaagtttctcccgatgcatctagacctttcttgctgttttactttcctccaaggctccaagctcatcttgggactctcctcaaacttgatttctacaccaacttcagtagatttttaagatactttccttgcatttccagagactctagagatttgcttttaattaaaggacatcattttccctttatgaacatcttttctaaaataggttttatcaaccctcacagtagtttttccacaagaagacaaagcttgcttgtttaaggaagtgtctgttggcaggacttacagagatggcaaattacagggaaatgttttatatgtgcgttgctttacttcaacataattatttgcttgtaaaacacatgagaggaaagaaattcatgaggatattttcaagatcagagaagtcagaagtagaattgggttcatctggcctgaagataaaagttcttaatcctatggaggttaagaatatgggctccaaagtgtactgccgtggttcaaagcttggttttgccaaagctatgttggcaaattccttatctgtgccttggtttctgcatcaggataataaaagaacctacttattagtgttgtaaagactgaatgatttaacatacacaaaatgcctaaaatacctggcagatagcaagggctccataaaataataactattattggttgtagtctagcaggatgtagaataaagattttcctaacacgttcaaagtta

SEQ ID NO: 55522 - DNA, 673 bp, Bovine  19866881849614
tgtagtacagatcgtcagttctggccctctgtcatatgcaggcagctctcctctctgtttaagtcttttgggagatttccagcagcgggactatttattggtgctgtgtgttgtgcttaggtgtgtctgactctgccactccatggacagtagtccaccaggtttctctgtccatgggattttccttgtaagaaaatgggggtgggttgccatgccctcctccaggggatcttcccgatccagagatccaacccactgtttcccatgtctcctgtattagcagggggattctttactactgtgccacctgggaagcccatttattggtaggcaagctcaaataatagaaaagctggaaaccagaggttctcagctcttctaaagtcaaaatggatttgaactagctttaaagaagtgtattttagttgaaagaacatttggtggggcatcaaaagagatgggccgcaggctgacctttgttcccactattatattcttagttcatctgtttccccatattccagaaaggacacatgtatgtgttacctgaatatttgctaggaggatgatatgaaatgcttccaactccttgaggacaaggctatcagattaaaaaaaaatagtaataaactgcattatacaaagcctagaattatggcaaaatcaaacataa

SEQ ID NO: 55523 - DNA, 929 bp, Bovine  19866880486663
tattgctatatcaccatcttcccaccttgacaaaaaagaaaaaaaaccccacccatttcatttggactgtgtactaagaataattgccaccaatattgattggcccttggggacccagctgaatttaaaaattgcagactgtgaaatcccagctgatatagcctcgtggagcttgctgcttatttgtgacatgttcctatgtttaaacttacccacaaaaactgtgaaattaatatcctcacgttgagtacaatatggtgacacacccagctgacatgcgcagctatttttgttcctattgttttcatgctggcttctgtctgtaaacacagcagatctttctgatgatgaagcataagtccatttgtttcctggagtctccttttccaaccattttcaggggttgggccaacacgtgaagtttttcagtttctttggctgcacatttcgctgtaatgagtcaacgcagcagggtctcccagtggcctctggcctggggtgaactgactgcgctggccccattcagcttctccttggctatgcctacctctagcacaggcagcttgaagctagacattcctgttaaaagcaggggggaagatgtgttagtttgcctaaatccacgtaatgaaggatgactacgtagacttgcacgtacatggattgcaagcttcaaatatgtcaaggatggaaatttcaaatgtttctgaaatgagtcacaactaaaaatgaaaagttaatcctacgtatccttccttcttacgtcatgaagatgtacactttcaaccaagcaaaacatataaacaactctgatggtgaaattttcagggcgccacggattgttactgtttttctctgtctagaagctactttgtgtcgtgtgttattatcggagtcactgcaaaatttcatttttcttcgtcgccatt

SEQ ID NO: 55524 - DNA, 1455 bp, Bovine  19866880500646
ctctttaatttacaattttctacctgttacctggtacctggtaccagataagagaaaatacatttttttaaactaaatttcttgtctacatataaaccttcccacaaaacttcgctatgggttaaatatgtatccagccttgtgatgagcactgggggatgaagacttagcaaccaagaggtaaaggtcctaaccacaggaaactaagatgctcttttaaattttaaccatataaggcagagttgacaaatgtaactgtaaggtttcctttgccactgccacatcccagctaagttgcataactcaacttctcaatttcacagtctgtgaaatgggtctgtgagtcaaatctactccagcataggcatggggatgaaatgcctggaaagatccaatctgggcacacagtcttcacctcccctgtgtgatggggaacaagcacagtaggaaattcatgggaaggaaagcttgccatgggctgagctatgtaggggggaccagaggaggggttgaggattgacttgagagcatgaggtagcccgggataacatagatcattttgatccaaattgctgctgcgagcctgtgataattgggtgagcccaaattctggtttcccttgtagctcagtgagtaaagaatctgcctgcaatgcaagagtcccaggttcgatccctggattgggaagatcccttggagaaggaaatggcaacccactccaaatgcctggagaatcccatggacagaggagcctggtgggctacagtccatgggttgcaagagtcggatatgaattaaccgcttaaagcactaccaccaaattctctttacacggtgctgagttcctgtatattacttgtattagctcatttctagtgttcaacaaaaccatttcctttgggtttccaagatcccagccctcttggaggggcttctctgctagaaatgtgggagttcagatcccaagggacagtttgaaccatggccaagataacaacactgggttccagatttcaatcttttttttttttttttttttaacttctgttccctttagttctttcagatgaacattgcactttaaagatgagattccgaaatttccagtcagtcttatcatgggaattaaaaaaccattcaattgtaccaactcactatacattatggtacacaatcatgaggtaggtttgacattctgtttttctcttgctaatttatatcatgttcctattatgtggagagtagggaaagaggtgaccttacttgtcatagagcttttctctctctctccccctcactcagcccctctcagtctcagtgttttattcagagctttaaaagtccaagacaaaagactcctccatttttaattgcactgaatgcctgaacaccccaaagttatttttgacacacttgtacttagagaaccaatgccaatttctacagtcaaagcct

SEQ ID NO: 55525 - DNA, 2245 bp, Bovine  19866880802580
gctggaacaaaccgggccatttcggtaaaaatcgttgctgttcagtcgctcagtcatgtacgactctttgcgaccccatggactacagcacgccaggcctccctgtccatcaccatctcccagagtttgcttacactcgtgtccattgagtcagtgatgccatccaaccgtctcatcctctgtcgtccccttctcctcctgccttcaatttggtaaaaaaataaaaagtgataaacccacctgggaacgatcaaacaggctgtgactttgcaggactagcagatggtccccaaaaggtcactgcaacctttcccatctcagtgagtggcagctgtgacttaggccaaaacctgggaggcatcttcctctctctctctaaccctgcatccaatctgtcggcaaatcctaaacttgaaagcgtatctctctcctttggcaccagactgcctccatcatgggttgcatgcacgctccccggaaaggcctgtcccagttggttctgtccccctgtcacagggtccccacctggctgaagctgacgcctgaggtcatgaaggagcagacctacaaactggtcaagaagagcctgactccctcacgaatcgggggtggtcctcagagactcacatgctgttacacagtacattctgtgacaggcaataaaatcttgagaattcttaagtctaaaggacttgctcctgattttcctgaggatctctaccatttaattaagaaagccgttgcggtttgaaagcatcttgagaggaaaagaaaggataaagatgctcaattgcatctgattctgattgacagccccattcactggtgggctggatattacaagaccaaacaagtccttcccctcaaccggaaatacacatctgcagcatttggcttgattgcataaacttgtctgttgtactcaagcaataaaactagaaagaaagggatttcccaggtggctcagtggtaaagaatttgcctgccaatgcaggagatacggattcgattcctgggccaggaagatgcctcagagctactaagcccaagcactacaattactgagcccacgtgccacaagcctgaacaccctagagtgtaggctccaccacaaaagaagctcccacagcgaggagccttcacaccacaactggactgtcacctcacctagcagcaactagagaaaagtctgcacagcaataaagacccagcacagccataaataaaattattttttaaaggactaggaaaaaaaaagaaagaaaatatatccaaaatatgaccacttctcacacctctatccgggccaccacagtgtgatgtctggattcttcccgaagcctccccctggtctcctgacctcttcttacctatgatatcagggattattcgtgagaaaaaattaataagtgaacaaatgatcatggaagcaaaacaagaactgaagaggaatattccaagaatccttccagtccccctccccacgtcctcctctcaccatgaaaaaaaaataaataaataaaggtgatctgggagaagaaggaaccataatcttgagaaagagtggacttttccccaaaaattagattaacagtaaacaataaatgtagacactgactgagatcttctatgtcccaagcaccatgagaatagctttccctgcctcttcttgcttcttgaaaccaaccctaggaggtactcacatctccttttgtgagtgtgcaactttagtctttggtaactcttctgccaccaactgcaacacagttctagcacgactagccagtcacttccccaccctggcccactgcaccccgagttaaagtctgggtcctccacaggacagcccttccctcacactctggccacactcctgggggggtcccaggccatccacacttctgagactggctacaaattcagagcttcccacaacccctcgggtttagtaattccccaggaggactcacaggacccaggaaggtgctctacttacaatcactgttttattataaaagagccaggccaggcccagccaagtgaatgctcacataggcaaaggtctgagaagtccagatgcagagcttctgtggtcctccctgtggtcctccctgtggacgcaggcacaccaccctcctggaacgtcaatgagatcgccagccaccaaactccatccagcctcaaagtccagagtttttcaccggaatctcattacgtcagcctgatagactgactcattgcccat

SEQ ID NO: 55526 - DNA, 2519 bp, Bovine  19866880830020
aacctgagtctcctgcattggcaggctgattctttaccacatgggaagccctccagaaactctcccaaacacagtcaaatcatttttcaaatttatatctttcagaatcctaatggtaacacattaaatcattcaagaggactgagctgctagatctcgaatcttaacagctggaaacaacatttaagaaaaataaaaagataacaaggaaagaaaaccatacctgtagaaatgccttaaaggggagcagtgagtcctagagacatcacttcaagccttcgacagcctttgaggtaaacacactaggcctcctcaagaaacacactaaattcaaactcatttaattacatgtgtcagtcagggcctcacaatcaaacaatcaaccagactcctgcgcaataacaacactgaagccatacctagacataaatacaataatcaggtgtgccaaaaatatgtgaaacattgttacttgaattgactgatgagcccaccttgagcaagatctacttggcgtttgaaatgaacaactattaatatagttgcttatctgtgatggaggtataatcatgatagaaatgagacaaagtctaaccatagcccaaggaagtaccaagttttctgccacattcatcacttcagagagtcaggtactgagccagtgccagagacaaaatagtgtctaaaatatccctcctgcccgccagaggccctgcagtccacttggagattggtaaacaccagactgcgacctccactcaccctgggacagaaacgtcacatgccttatctctaatactcgtgcttaagtcacttggtcaaggccacccaactccctacaagtccatgctctgttctcgcctctccattcacgtgtaacgtcagcaccaaagggatatgagtatgtatgcactattgcacactacatgagactgtgctaagaacagacctttccaggtggcgctagtggtaaagaacccacctgccaatgcaggagacgtgagagacagaagccgcaagagacaggagacatgggttcaatccctgagtcaggacgatcccctggagggagggcatggcaacccactccagtattcttgcctgggaggtggggtcacaaagagttggacacgactgaagtaacttagcatgcacatgctaagaataaagccaagaataaaaatgattttgttgctactaaaaaagagacatcgagttcagtaaaatcaagtagtgtcaagccaagtaaaacagtttataaatggtactggttttgaataggaaaaattacccatagaagaaccaccaagggcaaggccaatatggatcaaaatatcaacactaattatattgaatgcagagattataggcaattattggctcaatttgaaattcttttataacacaaattgtttttaaaaatgatcatccaacattaaaataaaatgctttttttttttaacccagccaagattccattaatcagcagttctcaataagtatgttccactcctcaggagatgttcagaaatacgtgggggtatttttggttgtcacattcactgggaggcaccactggcatttaacaggctactcagaacagtctcatacaagtaaccatcccaagcgacttgaatgtctgtctagacattcctgtagggggaaaaacccatttataagtatctgggcctagaaccaaactccattttacacattaatacaaaagacattttgcaagtttttacttgcaaatgtcctggggtcctagtagtgtaaaatactttgatttcttctttagaaaaagttgggcagtacattgagatttgaaagtatgtatatgttattgataaacttaacttgatgaaaagaaacttgttgtttaggccttaaagtccgtgtccaactctttgcgacccatggactatagccttccaggctcccctgtccatgggattgcctaggcaagaatactggaatgagttgccattcccctctccaggagatgttcctgacccagggatcgaactcctgtctcctgctttgcaggcagattctctagcactgagtcacttggggagaataaaggaagcattacaaaaagggaatgctgggtctgacaaggttgagagtttgctgtgatgacccagggaatatgtacgcagtgaggagaatccagctgacttctattaagccagacatagaagagatccacaaaaaatgcagaacaaggccatccttctcactacaactctttgttgtgaaaaatagggttattctcattagttatttatgctaacttggaatgatttgagttttaaatgaataaaagtgttaaaaataagtaaatttttcagtttcactcttactatgggaacatcaataaagagaacaaccataagcaaaagctctttgatagccttcggtacattttatgtgcatggagggatttaagatgaaaatgtttgaaaactgttgcacttatagaaaaagataaggaagaagggcttagctggctggag

SEQ ID NO: 55527 - DNA, 1524 bp, Bovine  19866881034167
tcccctctgtctccgggacccgcgaggcagcatcccgcaggcttgtgggctcgcccgcggggaggaaggccttctgtctccctgggtgtggaaggacatggtgttggtggccgggcagctctctttaagcagctggaacttggcgactcagagcgggtagtgtgtcctggattttcaaaagccgggggaaagaaaaaaaaaatctgcccggcctgtcagggcattggaaagggggagagggcccgccacctcgagtgggaaccaaactgccagccgcacaaaccacctccagactgcgggaaggctgccaggcgggccggctcccacgtccactggctgcccggccggctcagccccatctgcccgggcctccgctggctctgacaaccactctctggaagggctgctgggaccagttcgtcagctgaagaaaagttgtatgtgtgtgtgtagcgggggggtgggctacggagcttttgaatttggccttttttgaaggtaaggaaagtgacccacccagcagggcccttgcaactgaggactgggggacaaaccctgggtcccaggatcgaggggtcaggcagggacagtgcacaccaatactctatgtggtccttaagcattccctaccagaacaggggaaaacatttttcattttgtgtgtgtgtgtgaaactgggctttgtcctcgaaagaacaggtcatttggggactggctgcacaaactaggaattctaaagccccctaccctccctacttgcaggttagaaggaccagaccttgacatatatcaagagcacctggacgtgcacgacctaaatataggatccacgatgtcctgcgtataggtccataaccaacccaggcagggtctggggagtaagtgggcagtgctcataatgaacagatgactgatgtcagtgtagatggctgatccaagtaattttagagtccaaagtggatttttcccccctaaagaatcattttgacattctcgctacttcaatcaaatcttcacccattctttcccgtataaagagaagtaaaaaatcaaagtgaagactgttaaggttttgcccatccaggcttttctctctctggaaggaagaagcatttaactgggcttcccaaaagctgccgtttggggacctggtagaaaactggactgcgtggcttttaaagcagacatgagttccctgcgctgagaccagtgtgggccaacatctgttgagcaccccagtcagaaccctgatgtataaccaaggggctgacgggctgcctggagccagggctgcataactgggaaacatcagcacaatggtgccaagggcttgtgggaacagtggttttccagatgctgacttattgcagagggagagaggcaagctagcttcagaagtacctggcattggacacttgcttgctgtggacaaactgaggcacaaaagcatgtgtgagaactcacttggggtcaaaccatcattgacaataggacccggaagcccagttcaagttccctccacat

SEQ ID NO: 55528 - DNA, 721 bp, Bovine  19866881095536
aattccctgtatcatctggatcgcaacatcggaaaaaagaagcagatagtgtttatggagagtgggtccctgtagagaaaaacggtgaagaaaacaaagatgatgataatgttttcagcagcaatttgccctctgaggtaagtaagaggactattatgtatttttctttttatatacctgaacctgcattttattgttactttatatctgatttggattctgtttcactcttcttagggccgggttaaacggcagggccgggttagacgacagatgaaacaacccgcagcttctcatttgacagtaactcgatgcaattcactttgtggaaccaagccacaaagtgaaaagcatcgaattgcagagaacagtgttatcacatccctacccaacattgggccctccttgcacttgtgggaaggtagcccaaggtacaactatttagcttcccgttttgcttcaaggctctatagctctagattttggtggtagcaaatttattgggtggagggatttgagcagagagaggcagatcctcaggttcaacacaagaactggattggaaaaggtccctgtaggctgatgtgagcatctcggatacatagcctgttgccctttaaataatggtttcttactatatttctctggggttgttttgtcagatagccctttaattttaatcattttccccttctgtgtgctaccttggcccttttgaatt

SEQ ID NO: 55529 - DNA, 992 bp, Bovine  19866881304139
ttttaagtgagcatcactagcataatgactattaataatttgcacttctataggcctttctggagggcgtctctaagtgctttcccagtgaaccacaggcctcagggcctctggaaggagctggctagggggatgagcctcttgccttaggtcagaaacccagcacactctctttcaaacctggactagatgaggtcaggggagtttttaaaaggtatattttgggcttccctagtggctcagagggtaatggatctgtctgcaatcctggagacccaagttccatccctgggttgggaagatcccctggagaaggaaatgtcaacccactgcaatatccttgactggggaattacatggacaaagtcggacatgactgagcaattaacacaacataatatatattttccaatcacaagaatagacgccatcacaagcaggatggatatgtgatgccaatatctttgggtccttttctttctcttcttggctttaactctctccccgtttgaaaacttcactgggcaattccagtagtctgtctggctgagtgctgggtagatttcagcctatgggactagtgctctgagtgcaaaaaaaagagggggggatgggatttgcctgccatagttctccaagataaataaacaaaaggacaatagaaacagtaaaaagaacaagtaggctgcagttttcagcctggagcagtcacagcccggagcttgtccgcagtggtctggagccctccaggctgacagggatctacaggtgtcaggaccaggagagggcctggctagggaggacttggcaaagaaaccagccctggggattggtctctctgaagccacttatttgagtttttcagctccaggaagatcgcccccgcccccaaacagggaagcctcaaaggacttgagaaggcaaatatccgctggtcacttcttttgcccagcttccagccacagtctctcaatcaacagcgccccttactg

SEQ ID NO: 55530 - DNA, 1628 bp, Bovine  19866880600080
aacccactgatggcacaggttcagtaatgtgtcagttctcaaattttgaaatattgtgtgataagggattaaactgctgtatttgggaggtaggtttgcaaatcactggaaaatcaaaagagaaatgtactgcgtttttaaaaaaaaagtgcccctaagttagaaaatgttgggtatagcaaatggggggccctacgtggtcaagctacatgtaggcatcctgtgacatcaggtttgtatatataatctgtttcttagaatctatacaataacttattgagggccacatcttacactcaagggcttgtctttcactgtttatctgtgagatgatgtatatatgaagcaacacaagttatgatgtggttcttcttccaaagacacacagtagaaaaccaagacacgtggacaagcaaacaaaagcagacaccacagtaaaccagaacgacccacagtcatttcaacagggaacaccacgaaatctgctttcctacttggctgctccctgaactgaaaattcatgtactttggtggccagaaagtataggtttcactgcacagtcatgatcttgattttcataaacaaagggccacaagattgaccaaagcaagtttggtaagagaatcaaaacaaaattctgagcagaaatctatcccttccactgccatgaaattcatgacactacatcagacccagaggctgggaatccagcctccagcaaccctggaaaagttataaattgcaagctgtacaaatctatatccagaacctactaagggtttttaaattctactatgctttacattgagagacatcttaaaattcaaaataacttctaataaccaagaacctcaatgttaaggacatctattcctgacaggggaaagacagcaatgcatgagctgaagcctaaaatactgtgacaatcttgcccggaaaccatttaaactttaaacaataagcaactctgagctcactttgggaacagcttcctctgaaagctcactgttaggacaggcttgttgggaaaatgcggcctgtgatgtcctccccgattgtccccccgaaagaaggcaatctttcatattggcccaatgtgtgttctccatgctgaccctttgaaataaagtaagttatttcatgctcttctgcagggagtatacaggagctgctaagaaaggacacaccctgcaccaggacagtggctggggtctgcacccaccagccaggctgggtagcgggccagcttctcccactgagtgaggatgacccacacggggtgctgaaccaacactgagatggaacaccagcctctcctccagaccccagagaggacttggctggagctctgtcctcatggtaaccagcttcctcatcaccaggaacggcagtcatggtgctaggtggactgttcctaccatggagcttgttataacttggccatgggttagctattcaacagccatggttagttgtaacttcgccaggggatttgttataacctggccacagagctagttataacctggccatgggcagggacagagcagcagagggacctggaacgaaggaaaaggctcggtgagggcagagacacccccgcagccgggtgaggagagcagccagg

SEQ ID NO: 55531 - DNA, 1720 bp, Bovine  19866880635423
tcacaagtggctgtacaattctgtgttcccaccagtagaagtacgacttcctgttgctccacatccagaccagcatttggtgttgtgttttgggctttcgcaactctaaaattggtgtgcagtggtatgtccttgttttaattttcaattccctgatgatgtatgagcatctcttcacctgcttatttgccatctgtttatcttccttggtgaggtttctgttcagatattttgcccattaattaggttgttcattttcttattgttgagttctttgtgtgttttggctaacggtcctttatcagatacgtctattgcagatttttttcctcctagtctgtggcctgtctaatcattccgttgacattgctgttttttagtttttcacatgtagacactttgttgaccctcacaatgataggtgagaatttaactcataaccttttgcctcctcccagtgtcatatcactgtttttaattcctttcctggttacctcttttattttaataatgtagttcatctttttttcttgttttgccaactatatttagtctctttgactctccatttatgagatcaggttggaaattgtcacaaccctttcttccagctttcttcacctggtcttctacctctcaatttcttctattggtactttaattttttttttttttgctaacaaggatgatagtattcaaatgttctataaaacagtctttcctactttggtataggtaaatttaagtagtactaatgttattatgactacaaagataggcttctgagaaagactgaggataaaaggagagaagaggcggcagaggatgagatgggtggatagcatcactgattcaatggacatgaacttgggcaaactccgggagatagtgagggacagggaggcctgcgtgctgtagtctatagggttgcaaacagctggacatgacttagggcctgaacaacagcaagataggcttccctgcagagtgcagtcatgtgctatgattttgttacctttatgcagtttcttgtttttgtgaggtttctgttttttcactatttttattatatcctcactccccccgccccccgactcttcttccaatgaggtgttctattaaagaaacctcccttcttagacactttatcctctcaacccagcatggacttgttctccagacttgctccatggacaccatccgagacttcccttgactgctttcttctgataaggccaggcttcctgaatgactcattctcttctgtttggtttgcttcattgttttcctggagcacatccttgaataacttcctcagaaaaggtgttggcagttttaattttctgagtctgtgcatgttttgacatgtgttttctgcctctctaattgatttgcagttaggttgggtatagaaatctaggttaaaaatcattttcccacagaactctgtaggcatttgctttgttgccttctagaattcagtattgctaatactggggggttggccaaaaacttcattcaggtttttctgtaacatcttatggaaaacctgaacaaactctttggccaacccaatacatgatgatggccaggctcattctcagttcacaccccttccccaaacttttacacattcttggtgttctgaaactttaaaaatatttatctatctccttgtggatctattttttgttttgcctgacataaattctatcgacac

SEQ ID NO: 55532 - DNA, 983 bp, Bovine  19866880778296
ctttttcagagtcttttcacatataggttatcacagaatactaagtacagttccctgtactgtacagcaggtcctattgtcaagtagatcattttcccgactgctttgtaattttgaattgtgaatgtattttcagtagcctctgtactccaggccacagagcttctggcatcagagacactataaactagtcactgcttgcagcagatcttataaatttggactcaaaacctcatctggcccagcttttccttccttccctccaagagattttgtgggttttggccactaagaaatccaaggtagagactgagcttccttatcacctccctggactggcaggtagcaatttttatctccccttcactaagaagatcagcgtttggggagccttggttctgtccaggggtctcaggcccaatgctctggttacaggagctcagtgccaggtctcctgccccttcatgagcacaaaccacagcctacacacattggaggccctttcccactgccccagtcccaccctggggtggccagagtccagcacatgcctcaggactctggtcttcactcctcttttaatttctggcatctagttatttcccgttccttcttcagagattggctgtgtattgatattttaaaaattacatcgtattcatatttccagggctttaatgataattcagtctagaactgaaatttatgcacagcgaaatcttcactgaaaacactctaaatcacatgtggtcagaccaactgtacacttttatatcaggaatcatgagtaatggacttcattgctgtgaagattatttagtagacggcataaagttctttctcatgggattaaaatatcacatggatacaaagggggacactcaccaggctgggtttgatgcctacactttcagctgcttcaaatgccaacaagagatttcttttctaggttaaaagtcaaacagaatgaaattatcagccaa

SEQ ID NO: 55533 - DNA, 1638 bp, Bovine  19866880804519
cccccatcccctttttgtggaattgaaggaatatcttagctacatgaatctgtgagctgttcagacattttcccttttgtaagctttcatgtacaggtgctcagcagcttaaatatcagtggaagtgttggtgaaaatacttattaaacacatcaaagcaagaccaatgctttcgtagggatcttgtataacaaaccagagatctcaggtggtgccgaagctgcattcgatgaccaggaaacaaagccaagaatgcagccgtgaacagagaaagatgaattagtaacctcactccagccatgtggccggcgtctcctggctcctcttaggctctggcccagtggaaatgttctgtgtctgatattgcctccaagaaatattaagagaggcttcagctgtttgcctcagaggacaggaaggatcaatctagggtctgtatatcctgcctctggggaaagtgctaagcagtgaatctttctccaaaggaattcctcgtggaaggtgcaggagaaatgaagggctccctgtaaaagctttgctgccacccaaacgggccatgctgcactagggagacagcacgacactggcctggagcacgtctgtcttatccttttgccagtgaaggatgggatcagatctttttataatacaggttgggaccccaagtccaagaagaggccgaggaagctgggtacagttggtaaaatggaactcagaagtgggcttcggagttcactcagatgcgtaccatggcttgatctgtttatcaggtgaagaaacaaaagcacagaaaaaaaaacaaaagcacagagataaagtgatttgccctgggtcacacagccagtaagaggcagagccaagattccaacccaggattccaagtctggacttagagctggtgccctaagctgccaccctgtgccgcccatgtgacatggctttccttcagccctgtccacaagccccggtggtgtccccagcgtctcctggctcctcttgggctccagcccagtggaaatcatgcaggccttggaaacacagtcccgggcctgcttcccagtcctgcctcacccatgcagcctcgagcgagttagttaatgcgctttgtcaagtccagtgtagtcgagttatgttttgaattggaagtaacatgtgagtcaaggacgtagaaggacccaggctgccgcatgtcatcagctcctatctgttcccttaattctacctctgaccctccaaacaggcttaccacccaatcttcacagcaagaacttgactttgccttccttccacctccccaggtgctctctctgtttccccacccgtgtctgccctcccagctgcctcctctctcccctcccccaacctgcccgagccctccttcgcttctgctcacagaggggtctctccagcagactcaactggatggctcgcctggctggaacacatgggtttccctgttgtctgctcatcacgtccgaatccttgtcactgcttctcctcatccttatttctccaggagccgggagggtcctgccctggccccatgtgctcccccttccttccccaccctgctccctgcccccagctcttagcatacacctgcagcctcagggacaccccatccactggtcctccagg

SEQ ID NO: 55534 - DNA, 1085 bp, Bovine  19866880841528
aatatgaatgattttcttaacatatacatatggaaggagaataaaggaagaataagttatgttgaattggccaagaaatttccaatattttttgacaagtaaatgcttataactcaagaggatatatttcaatgtagaagtagacttgcaacatgaaacgactcaaatgcaagagtaatgttcagagaaaaattcaaaaaaagttgaaaaagaatatatagttgatcctttttatttgtgaattcaactaacaactaaaatgttttcataaccccagaatcaatattcaggaagacatttttgtgctaattctaagacataatcagagaagctaataaattgagtgaaccaacatgtacattcccagctgccttcttgagacaacctttataatgcaaacaagggtcattattatgtctatttagtactattactttttcatttttgtcaagttttttttggtgattttgctttcaaaataggccccaatgatagtgttgaaacgctgtctagtgttcctaagcacaaaaggatatgctacgccttgcagaaaataatacttgtgttaagtaagcttcatttaggcatgagttatagtgttgttgcccacgagttcaaagttaatgaatcaatactatggtacacacagagaaaagaagaggaaatttgctgatctctatataaagctgctttggaaaatgctgaagcgacatctggagtgtatgatgaggctatggagaagatggaaatgtggctaaatttatagattgttgagatggtgactgattacaaaagagaagtagatggcattgttgtaaggatgtaagccacagaaatttacagtcaccttactcagcttcaggaaaatgttaaacccttcctggctagggctggctggctttcaagtttcaaaaggtaatacagtgtaaaaaatgttaagcttgcaggtgaagtatgttgtgtaggtcaggagactaggaaagaattattttttttaaatatctgctaaatgttattcaggaaaagggttacggaagaacaggttttcaatactgatgagacggcttattttataagaacagggc

SEQ ID NO: 55535 - DNA, 4840 bp, Bovine  19866881142344
cattgagacagaagttaatgactgtgggctatcagctgtttttatcaacagcaagcacataactcaattaatgcaatgtctaattaccaacgaagaaaattaaagagtaaatggctaaagctaatgaagataacacaaatctacactgaacaagatggtttctactctttatgtgacaacacacatgtgtattatcaatgaaattattctctcttctcatgtagcaactaaaagaaactcaagctaacctagaaaaaaactccttattcaagtaaagaatgttagcaagaaaattggaaagataatatacttttcctagtttttttgtctaaaaataacaagcatatatggatatttgtcagtttcatgaaattcatttgaaacctaaaatatccatcttctctacaaacagaatactcatagacagacttcctgcctctcaggggaacactgggagacaaggtctcaaagaattgttggctatgacctgggaactcccctcccaaccctgctgctactgacctaacgtccataagctgggagctccagttacaaattccttggagcttcttgcaagccaaaccaccaccaccaacgttaaagacatacaaaccttcttggtggctgataaccattatcttccccaaaacagacaccagtaaatatgagatactgctgctgaccactcttaggttaatctcatcctaaatctagtattttagtttttagacccgcattctaccatacgtgtgtgtatacatatacacatgcaccaataaacagtgacaaaatgttatgatctggagaaaattattggagctctatttttaagggaacataaaatctgtaacactaaaccaagaaaagagttcttttctaagtaatggagcattcctttaactgcccagtgcctcaaatgcacgtgtaagatttgacttatcagtgtgtgatttacacatatcttttcagacatatatattttatataataaagcaaataaacacccacatttcttttttatattgatgctaactggtagctcttattaaaaccagtattaatcaaagtaatgaaatttcattttctagattgatttccattgtctgtttgacaaccagaatttagccaagtcattaattcctaagacttggtttcatgaaagaatcatatgcccaggagtcaaccaatcagcaatgatgcactagaggacattagaccaagacaggagagcacagaaaatatctcatataaatctattggtttgctaagactggaaaaatctaacttgaattcactcacgatgggacttaaactatgtacactgtgtggacattgcctacctgatgagttcctactcctggattcatggccctgaagatgcccgcagcagcactgacggaactgctcaggaatggtgcccactgagagaaagaaaggggaaaggatggagaaatggctcagaactagtaaaggatggaacaggcaacaggtgcacaggctgtatattacagctcacagaatttaattagcaaagatgtagttcagctcgtgcatgctacgtggcccacatgctgggtgctgggctcacggagaatagagccccactgggcctacctggagagcagagtccggggagagagccaggcacaccctcgacatgccttcatgacagagaatgtgaaaagctggtcccgagcgtccagcctatggagctgccggggcccagtagctggccctctgcccaccatgttcctgccaaggtcgctcccatgccgccccaactgtgactggatgggtcacagatctggatggcatggtgcctggggatgctccttcagcttgggggatgtctccttaggactcactacctcagaactcctgcccactcctccccgctccctcacccttgggggtcaggcccataggtgctctgaagggcacctgccgcccctgcttcctccctgatctccagcagggtcttcccaggcactctctggaatgctctctgcatctacctctgggaagccaaactaaccagagggagagccggggaaggcttcagggagcttcggcagacgagagacacgtgtccaccaaaaagaagaggcactgacttaagtgtggctgggcctcgcccctggaactgggagagcctaagggttacagaggggatgaggaagagccacagttttgtttgaagaatatttttcagctaaaaatacttttaaaaccattgcaacaggccaagtgctgatgtaaccttttgacaaagtgtcactggggtcctgttctgcgaccggggcacctgggcgctgccgcagtctctcgctctccctcctgctgaggtgtctccccctgccctctcagtttcctccagcagctgtgatggggggtgcagccctcctcttggaagtgtctgtgtatgctggccctccctgtcctgctcccccaacatttctgctgggtggctgtctctctcagactctgcaatctcagttgctctggcctctccgatgtgtattctcaagttggagcattttctctgtctctcagttttcctgaaaatgtggtctggggtctttctgttaggttgggatttgctgttctgtggcctcccagggtgtcctgggggtggtttccgagctccccctgctgctgtacaaagtgaccgggagaggggggaggagctaccgcccctgccccctgtagcaggagggcctctggtggacacagcctggcacagttatgtacaccactgccttgtaaccctcttaaatcctagcaccaaagaagggcaggaattatatatgctttaacctagggtatctgattttgtgtttagagatgctttttatccataagacccatggatactatcatatttccaacagtgctctgaatggatttacaaaccctcaagaagcagtcagagcagtggagggttggagggagagacatggctccctatcagctgggactcaaggccaccaagagctgggctcctaagggagggtcctgtcacaggtgtcatcatgaaaaaggagggaatcaactgccacgtattctccttacctagaggggaaggtgagtaaggcctggaagagccagtggagagtcttcgtcctatggctggaaccgcatctgccggcgctggggagcaagatcccggacggaggaagcccagagggctggtgttagaccttcgtaccactgcagatctggggagaaagacaattactccctcgctggcagcttccaggactgtatttccgtcttttttcctaaagcttccaaacagtatgccatgcagtagattttttaaagtatggagcaagttgcatggaacagacatcaagtgtgtgaaactacagagtgaggtctccctcccaccttggatccctctacttaatttccaacacttcctcagtcctactcaaaaggttacttctatgttcatttctaatgtatccttccagagttccttaattcaaatatgaatgtatcatgcacgtgtgcatgcatgccaagtcacttcagtcgcttttgctaccccaaggactgtagactgccagactcctctgtccatgtgattttccaggcaagaatactagagtgggttgccatgcccttctccaggggatcttcctgacccagggatcaaacccacatcttttaagtctcctgcattggcggctgctgctgctgctgctaagtcacttcagtgtctgactctgtgcaaccccatagacagcagcccaccaggctcctctgtccttgggattctccaggcaagaatactggagtgggttgccatttccttctccaacgcatgtatgcatgctaagtcgcttcacttctgtctgacaccgtgcgaccccatggacagcagcccaccaggctcctctgtccacggaattctctaggcaagagtactggagtgggttgccatttccttttccccctgcattggcaggtgggttctttaccactagcactgtatcacaccatatgaattacccggccaagcttaaacatccactacaaaaacatttatcattattcaacttcgtacacctctagcacacatccacgtaagagagtagtcagctatggaaagtgatgaaccttcaataacaacaaggactttaaaagacaggtggaggaactgggaaaggggcgagtgcccacctaccgtggagagccatgtagatttgtgctggagccagcagtggaggtgaggttctgctctatgcgctggtagttcctcacctgcgtggggacgggaatgggggcagctgtgctgtgtggggacacggagggctggcactgcctgcagacatgagtcatggaaaaggaaataaatccagtgagaccactctcctttcacttgacccactggtgatattgagagaaaattctagaagaagccaagtgatcacatctgaatgtgattaagaaatgatcttaaatatatacatatatatatagccgaatacatcacacctgtcatttcaagaagtctcctggtttgcacacacacactgaggaggaagacttgcaacaagaaggggatacacacccctctacagcaacaggaagggcccacggccggcgcgatacagctgcatctgcttacattctgtgacttattccttatgtgatctagaggaaaaatacttctaggaaattatgctgggtaaaaaaacaggaaattcaagagcagagatgcctggaatgtttacaaaagttatgagtgtagtaagcgttctcaggaactggaactttgatgaagactaaaaacatactgtgtactcccagcacacaactcagtagatccaca

SEQ ID NO: 55536 - DNA, 1381 bp, Bovine  19866881326838
cgggcagctcctgccgccatgttaccaagccgcccgcccggagttccggtccttcgccgcgcggggcttcacgggaggccgcgcgccggccccgccccccgccacgcctcctcgcctcctcccgcggctgggcctcctccagccgctgggccagggccagcgcccgcgctgcccgcgcgacgcgcgcgctgcctgcacccggccgtgaaccccgcggctctcctgtttctgggctgtgcgagggtggcccctggcgagcccctgacccagccgagtgtggcccgcaccgcgctcctagggatcggaccctggcgtggatctcgggatgcggactgggtcccgggatgcggactcgaggcaccacctgtcgccgcgtcttcggccgtggaggaggtgcgttgggcttattataagacgcgatcgctgagaacgctcagctctgaaaggacagcaacataaaaacctctcccagtatttaccgggaggactccaaggatcatccttctagcctccttcaaatgccattttcctaggaacctctgacctccttcgacgctagaagcagagacgaacctcccacccgtggggcctcttccacaggactgggaatccctgtagcctcgctcgtgtgcggtggaggagcctgggaaaaagtggcaaatcaataaatgggttttttagtcagtgaagtccatcaagtgatggacagagcaacggaggtccagagagaagaggcaactggtccaaagttattcaggttgtcggtgttgagactagaacccggggtctagtcacgatataatcagagcaggttaatagatttgtttgagtttggtccctgagtgggtaaaatcccctggaggagggcatggcaacccactccagtattcttgcctggagaatcccatggacagaggagccaggcgggatacagtgcgtggggtcgcaaagtcggacacgactgagcgaccaaaccacaggggcatgtgcggtaacgacagcggacatgtatggaaaggtcactgtgcgcaggtgccaagccctccggacacatgacgacccttggggagtcttggtgggagaaccaagcgcaaagagataacctgcccaaggtcacggcctcaccagaggcgaagtgtgtgggacctcagacctagagagtcggcttcagagccaaggtcaagcctcttcctgggtaaggacagtgtcggggcaggagcaagaggctgccccgtctccgggcgtccgaatgtgtcctccctgacctgagcaggtgctaggaatggacctctgtctgaccgcggagtcttcaaggggtccgagcggctcccccacttatcagaagggcgctgaccccagcctggcgcaggggaaccactct

SEQ ID NO: 55537 - DNA, 1940 bp, Bovine  19866880353412
cctggcgtgctgcaatccatggagtcacaaagagttgaacacaacttagcgactgaactacaactgggaactaagatcccacatgctgtgtgatatgccccccccgccaaaaaatgagaataacaaccagattttcactgtccattgccctgtgaactggccttgcttggggtacattgatttcaggggaggcctgtggggattaaaaaaacaagaaaatcttcacccctctcctttcaagcatttgactgaaagttgcacgatagaaagaagaaacatgtgaaagacacatgcgcagagaaataggtaccgaatctttcccacatcaaactgcacttctaaagttctgccgtcgaagaaatgctagagaaatcagtttgggaccacgagtgatgttatgacaaccttgtagactctgccactttagaatgaaagtttcaagctgtaaccaaaaaaaaaaaaagtctctggagccacggtttatccaatatattgaatccagattttgtaaaccacaaaaatgtcatcctagagatcatatgtagaaacatgttttcttcagaagttttaaagtggaaatcaaatatacaatgaagacaattagatgaaatttggaaaaaaccaagcccaggagatctggggcaacttcaggctggggccagtttgcaaagggaatctatgcttcccaaacatggtggaaggggagggttccaggatgaagaggtaagggtagggtcgcaaatggagggatacagttcccaaggctaaagaatcccaaggatttgaataagtgggagagagcaggattttattttattttttaaaaatctgcagtgttgcaattttactgtgtaggatttcgttttatctaatcttggtaattccgtgttggatgatgctggtctccgctgtgtgctctgccgccaggccaagttcagtcctggtgaaggtttgcagtcacacaggggaagagtgatttccaaagtttgttctgaacacagattagcagggaggccttatgtgagctcgagtggggaaatgcctgcagtctgggctggggcggcgggagatgggggaacggagcgctggggtagcagctgccgtccatagaggccccgaagttctgactccagacccaccatctccttttcttgctgcagctcctacacgtctgagtcgagatacgttctgtaaatggggaaaacgatgcccacttttctagcattggtgaggattacagagaaaggatgtgaagtgtgttgttaagaagttggttttcttagcaatcactaaggtgatctctcaccttgaaccttgtctcctgaatcctgaccaggcctgtcccagaagctgaagtttattgaagcatttgccccatgctaagcacactccaggggatgatcttcttgaatccccacaacagggtaggggccacatcatctccaagatgggaaactgagcctcagaggagttgaaagtttacactgctgtgatggggattggagcatacccagttgggctcctgcatccctggaccaccgcaccccactgtctaaaccacactgtcctgttccctgcagttaccaccagccatatggtacaacttacatttgcatgaatgaaagctgaatttaaaattctgttccgcagtcacaccagccccatttcacgggcccaccagccatgcatggtcaatggccgccatatggcccagccctgaatctccccatcactgtggaaagtttccctggatggcacaaggccttccatttctacctcaaccttgggacagatagcttataaaatggtaaatttggttttgattattcacatgtaagaaaagaattgtggactctccaaaggagctgcccaaatgatttccattaatcagaggattgaaacgtctatttacagatcattaactgcctgacagatgaggc

SEQ ID NO: 55538 - DNA, 3037 bp, Bovine  19866880381675
ttcggctcacaggcaggtcgcctcacctcttcccatcccagcccgtgcttgcctggggttctgaggcctgttgactggttcagtccggccgcttacgccgactgcgcctgtgtgtttgagcaaatgttcatggtcacatattaagagcttcctcctatctcctatcccatttcacctgccttccggagattttgcccctgggcggggagcagatacgcaaggtagacccggagacgctaacatcaggcagcacatttagtgtccagtggaaggagggtgttaggttaggagattaggaagctcgagtgctcatggaagagatggaaagcctcctggccctggcttaaaggatggatctcagctcaagtgtcatcccattcccccgcccagagagcccttatacttcatcgccctccatcagcttggcagttcctctagccttagatcctctgttacatagcctgttgtatttttcttagcacttctcactctttgagatcatcgtttgtttaacttccacgcaaacataagcccttgagggcaaggatcttgcctgtcttgctcaataatgattcttggtaaagactcaatggttatctattaaaaaatgaaaattcttcgtggaatgaatgaattactggaatcgtctagtttacctgtttggcttccactagactgtgagctcctaatggggagggccttgccagacttgtccagcaatcccactgcacttacataatcattgttgtataaatgattgagtaagatgtgagctggtgggaaggaatgccatgcggtttcatccatagaggagcctccttcagtggcttgtcctttcttcctggtccccaccacactccacaacctgtaccccttaatagaacaatttgccgttttaaatgatggctctgtaggaaattttttacatctagtttcttagaagctagaaacactgcctcattcttgttcttagctcattcgattgctgaaaacaaaagtcaggttaatttaggagtgaggataattttttaaaatagccgaggtcctttatataaagaaacagaaaaattacattagacaggaaggaaataatatggttgggtagttgctaagtgtaatttgtggtacccaggactttaaaaacaaaacctacagtacttagagggaagtcttggtgaggtaacactttattggctgctcagagtgcctcagcctccattaagatgcaaagttaatgtcgctgggtgtttaaaatactggtttgggacccatcagcacagaacagtctgtctctgctattcctggagatccctgaagctgttcaccatccaggatccctattctgtttattttagagaaggttattctaccccttgagtcgtgaaaattaaatgatgcctaccctcctatccctctatcagtctatcgattttactcactaaagctggagtgatgggggtgggagtgcgaaaggaagactagaagtctaggtccaagtgtctcttctgtgtggaagtaacactgccttggacttggacttggagagctggacctttacataggttatctgctggagactcgctcagaaacacacagaggaaaccgactcaatggacatgatgaatttgacccaactctgggagacagtggacagaggagcctggtgtgctgcagtccatggggtcgcaaagagttggacacgtcacgatgactgaacaacaagaaagccttgtgtcacttaccgtgcctctcacagaaacagggaagtcattagtaggtcattaatttgactggaggttcggtaggtgacttgctcttatggcacttaattactggagtgacaatgcccagagcctcgtgcccttccctgtgcccggggtggggtggtggattccttccaaccagaagcttcacacctggctgagccaaaacacaagtcagaaaatagctagaagatcaacaacaaggtgctttagtatagcacaggaactatagtcaacctcttataataaactataatggaaaaaaaatctgaaaaagaatataggtacagctgaatccctgctgtatgccagaaactaacacaacattgtaaatcagttatatttcaataatttttttaaaaagtagagggcatttaaagcgggggtgcagggcttaggtgttcagaacagtggcccgtggttgtgaagatagctcttcttgtgagatggtgggtggagccttgtcatcctgggctcagatcaggggctgggaagtgaggcagccggcagccagccccggtggcagcagagccctcttcgttcttttgtaggtagggctcagagacagacctcgcaggaaaagtgggtggagtcacgtgcctcaacttcagctgggcaccagcgccttttattcccagacttcagtcattctcatgccatcttcacaacgtgccctgtctttgtaccatctgttccattattaagtttcttataccagcattcttacaaatacactttaaatgaaactttatgtaactaccatcactagaaaattgttttcttttttctcctggttttcacgtaacacataactattaaagccaaacagtaagtctgtgggctccccaccatctttcacagagtccaggagtgggtgtgtctcacattggggtcagtttccaagctgcttttttataaaagattttttttttgatgtggaccttgttacaacattgtttctgttttacatattagttgtatggcccagaggcacatgggatcttagctccccaaccagtgatcaaacctacaccccctgtgctggatgggcgaagtccccactactggaaggcagggaagtccccctaacttcttaactgcttttcaactctcacccgttctcttcaaactccaaactcaccttgacctctgaccctctcagccgtgatgtctgtctctgaatttactgagagctttcttcaacttgtgtcccctcctcttgaaaatgtcttgtcatctcattgcatacgtgctgtgctaagtcccttcagtcg

SEQ ID NO: 55539 - DNA, 1828 bp, Bovine  19866880477179
ttggttggttttgggttttctcttttgattgcggtttttcctctttggcaaaaaaaaaaaaaaaaaaggcgtgggggtgggctgttaactctaaggagatggcctttcccccatttttcttaaaggtgctgatttggaaaaataaataaataaaagaagcataaaagaaattgttgaaatgaccagaagaattacacaagcattaattagtatggaagttttccatttccttagtaatttggctatctgagtgaatttgctaggttaagacctagttcagggtcacatatcaacaaaacagcttgattataaagaataaaatgtaaagggctgtttttccgttgtggtggtgtctcctttgcttttgggggacgggtcatgtctttgttctcctgggtccagatttatgtaaagcagaaaattaagtgaaaataagtctctttggtgtttatgcatttgcaattacagtaattaaatggtacatatgttgagctgttgtcaaaaacttctaaaagtggaattatggtgtgtgaatattaattgcgtataatttgatttcaaagtataagcctagaaaagtctagaatcttccccaggaacactcttgctatctgaataatttaaaacaagtgtgatgcgaatggtaccttaaatttctgacacctttgcacagtggtcatagtctccctttaatttgagactgatgactctgaatgcacctggcatcactcagctaacctgccccaggtgtcctagtcctattatcatagaaagcctctggcgtggggctctgcagcccgggtcagtgccatgcgttttacgtctttaaatggtgattctcactgagtgatgccccttacccaaaaaaagaggaaacatgatgatgccctttttcataaaagaggatcatcttttttaatttaatggaataaaatttgaattacagagccacaaaagatcttgcagtagtttttcagtttctctgatttcctaaatgtggaaactgaggcacggacctctgtgtgcatgtaaaagagaggtgctacgaattttaacacaaaagaagaatattggagattctgattaatattatgtaccattaatattttaatttgtgagagttaggctcattaagatagaatgtttgctttgaaatcaatgtttctgtggaaactaattttaactttttacagatattgattacagccttgtgaaaaggcaagagaaggaggaatgcttggctctctgggcagtaaaacaaaacaataaaaagtgaagaggggctaaaaaaccaaataggtttgtgtgggagggggacaaaaattgtccactcaggattatctgttggagagaggatccatttacagaggccgagaaactagcaatcctcctcctagcttggtggaactatgttttttccataaaacatgtttttacaaatttaaggtgatttcaaatggggcatacgccctttttctagctctgttagtcgtgaagggcttggaatcatagaaaattcagtcgttttcaggaatattttcccttatgattaaagtcttgtcctttttaacatgttattaatagggttgtcctcaagcactgtatttaaatatttttcaagaagacagcaaatcgatggtctttcatctctccccccccacccccaaatggttgttatatccagagagagtttaccttagaaaaataaagtttgcagtaaaaggggggaggggtgtggagaagtggatcaaacggcatattgtggggctaagggggtgatttttaagtagcccaggggacaagaaccctgcagacaaaacagctactt

SEQ ID NO: 55540 - DNA, 3575 bp, Bovine  19866880563903
ggggctttttggtctctgtgtctccctgtacccaaagtctcatcaacctaagttggagagaacctggggagaaagaacgctcccctaggactgtccctgttttcgcattcaaggaaacaacaatggccattttggaaggctgcttccaaggttaaggtggaaatcaatgcaaaacaccctacgggtattcctctcagcttctgggttccactgagagctctttcagaaggatcccctcccttcttgtactcactgtctccactgcatgctgagcggcggctctgtaagttgccatccctttgtctgtggggctgttcatccccaaccagaagttgttgtgtaggttcatgttctggtttcgcacacactccagttgccagcagttacagccctaactcagaaatagctgaagaaaggcatcataaacaaagcattatggattggagttggaggtggctgtctacattcgtgactggagtgtcctggagggtaggaatgggggctgatttgtctttgaaacagacacacaaactgacaagatgaaaatcctcaataaccacttggtccattgttagttcatttgtcaaatcatcacagattttctaggggccaagaactcttccaagcaacttacaagcatgataacattgaatccttacagtgatgttccatgatcaagctagaagatggcattaactcctaatatgatgtgatgagaagggcccttcacctatgtgattccctccacgaagcccaccactgcagcttaatccctaggaaaacaccagggaagcccccaaaaagtattagtcatgtctgactctttgtgtgaccccatggactgtagcccacctttccatggaattctccaggcaagaatactggagtaggtagccagccgttcccttctccagggatcttcctgatccagggatcgaactccggtctcctgcattgcaggcagatttttttttaaccatctgagccaccagggacgtcaatcatgaggaaaacctcagacaaacccaaatggagggacaagccacaaaacaactggccgatcctcctccaaactgtcaaggttatcacagcccagaggagcctaaggagacatgatgatggccaaatgcaaaggggtgatcaggatggggtcttggacctgcaaagggaccttaggtgaaaactaatgacatctgaataaactgtggcgtttcattcatagtcccttgtcggaactgtcattgtcaccaatgtactacagaaacgaaagatgtgaaaaatacccctatttttcattgggtaaaggtttatggacactgtctgtactatcttctcaacttttctgtaaatctgaaactatattaaaataaaaaacacgtttaaattagaaagcttgcttaaaaaaaaaaaatagaaccctttaaagtagggatttttaactgccccaatttgatggtgagactactacccaggggagtcaaaacttattgtctcctaacctgcttatcattctagcagtttgtcccaccctgctctgaggctcctgttaacaccacggaaaccctcccaagcctcctgagaattaaatgcgagagcagatcttgaaggggtcatttctctgcttgaaaagttgagtcacccaggttgctctgaagggcagagagcaagctgacaaggtctgggagctcaggaaaacatcgccagattgatttaaagggatgttcagagacctcctcagaactcctgggaagtcttggatgtctgaggaggttgaaaaattgttccaattctgtgaggcctgggcagcaggaaatcatccagagtaacctctcacaccatcgagacaccaacttttctgcctctctgcgaagtccaagacccacagctgcttccaatcaggataagcaaaccctccttccggagcatctcactccacggtccccatggctggctcttcaaagcacactccgtcgccccatgcaaggaagaaaacacacaccctttcaccgcctggggcccgtggtcccttccctcttttccctcttcaccatgttatttcttttctgagtcctcagcagctccagccttatccactgggatttcttggaaggtccccttgcttctggtgtttgcgtcattccagtgaatttctcccaatgacattcagatctataaacttccagtgctgcaaaaactcgccatggaccgtgctgggcactatgggttctgtttcctcaggatccagtctcccttttctcccatgacagcttgggaggtacttcatccccacagctggctccttacctgcaaggttctttgggagaggccttccctcccttgttcaggcctggcttaatcacagtcccagtgaatatgggtttgtgggagggggatgtgaaccaagaagatttgccagggattttgtcaccagcaaatgagggtcctgagtgctcttcaacgccaaggaaagtcccctgtgataccccaggggccttctgttggctgctgaaagatatgaccatgctccttatgacatcaccctcccccaaaaaaagtcagcctttcaacttaccaactgttgtgtgatacattgtcctgtgtattccactgttttcctctaggctctgttccaacacattattccttcttgtttgttcttataaaaatggggacatccgataaacactcttatgctagactcggtggcccttccctaccatatttatcaatcgactcattcttttggaccctgaaacatatgtcttgaatggatgtactccggtttattgaactttttacttgctggtgggcatttatgctgcattctactacaactgccttggtgcacctgtcaatgtacttttttaagacaaagtctagaagttgacatgttagttgaaagggaaaatgtcagtgaccacgccacggatggacctcaagagctctgctgtcgcacaccttgaccctgcctctctgtggccaccacctgatggtgccctgagtcttgttctgtgaaatttgaggagagggctcctggtgagtgagaaccttctgtgtgtcaggctctgagcatttagaattttatgtgcatttaaccctgtgaagcaaaaacaattactatccccatttactttgcaactctatggactgtagcctaccaggctcctctgtccatgggattctccaggcaagaatactggagtgggttgccatgccctcctccagggaatcaacccagggatgaacccacatctcttgcatctcctgccctggtcgatgggttcttaaccattagcgctgcctgggaagcccacatttacagatgagaaaactgaagctcagggaaagtcagtaagttgccccaaatcgtagatctgatatatgggggggaaaaaggaatttggctccagtgttgcctgactttgtagcctgtgctcagcacccccacctccccttcccagaggctgttggtgggtgcatggatgatggatgggtgggtgacggatggattacctccgcaataattgattagaaatcagagcaattggtgtggggtagatgtaagttctcttcat

SEQ ID NO: 55541 - DNA, 1819 bp, Bovine  19866880791680
cgcaaggtccatccatttggtggcaccttccctccccgcacccctccccccgccgcccactctgtccccctgccccagattagcagggttttcagtggcttccaggaaggtctgagaaagggcacagaggtggaagacgtggcctccactggcgggctacagtccatagggttgcacagagtcaggcactacctaattgagttagcacacacgcaggcatggtttgaaataaaatgacaagttgatgcgatattaaaagtcatcaggaaagaggaaggctagatgggggtgaggatggggggcggtgtgtgtcaacggaagaccagagacccaaataaggaagcgtgagctgcttggcagggatctggggggaggcgcctctactgaggagaccagggcaagtgcaaaagccctggggcagggacaaaccctgcaggttccctgccctggtcttccaggcctcgtgggaagggagactgtggagacccagagagagccaaggccccacaaagtaaggcaaaagccagcatcagggctgtggcctctgcccccaccacttgaccctggcctgcgccaacgggccatcacgcagggtcccgccttgtgggcgggggaccttggagcccacctcgcccctcagccccctgagcccgaggaccagctgggatgagcaaagcaggcaggcgtttgtgacatcgccagatgatacggtgactaacggcttcgccaggtccagaggacacaaggcaggctcagggtggcagatgtttgagatgatgagggaatggaggcaggtggaggccccagagccagtggctctgcacccgcaaccggctggaccggcgcctgggggatggagccatcctgcgcatgtgtaggtggaaaggcgcgggaagagggatggatttgtgctcaggcaatctacaaagaggccccccatctgcttcccattaacgacacagccttgctctgtcgtagttgtaaacttaaccaaaaattcatttttttttctcttaaatgaagttaatagtttttaaagccgccatatatcaacttgggttgatccctttgcagatccctttgcagaagtttatgtaaccccaccttttttgaagaccaagccccaaaagtgcctttgtcaacctgagatgagtatatctgaaaagggagtccctaaaggagagtggtcccttctacttcccaaagaaggggccctgggctcagtgggcggcaatctgggcccactgggccacctgctctttgaattggttgtacattggaatgatggggggagttggaacaatgcagatggcccggccccccagggttcttctggtcccttgagcctgggaatatggttgcaaaaatctgcctgctgctgctaagttacttcagtcgtgtccgactcttcgcgacctctaggtgattctaatgagttttcaaggtggcaaaccatggtcctacctccgagggcggctgtaaggataaagcacttacaaactctgctattgtcctcatcatcataatggcaattattacttttatttgagcagagaaaattgaggctcagagaaatcaactggtccagccaatctgggctgagcacctgggttttctgtgattccaaagccccatgctacgatggaagctattttaacttagccaaagtaagaaaatgtgtattatttctgtcctagcccataatcagcaatcactttacaattttgtgtgtgtgtttcaagcagatgacagtttgcagggttaaaagaatcagagggaaattaaaagtttttccctggaattgtgccccaattccaga

SEQ ID NO: 55542 - DNA, 2535 bp, Bovine  19866881131045
ctctgaagaggctggttagggtcggctggtcggatacctgttctgggtcacctgggcacatgcatctccccatttgccctgcaactggttctttttgctgtctctctctttctctccttccctttgtgtctctgtccatctctgccttctggctccttcccctggataaggcttttcttcctgtggcctgaggccactcagcaagtcacctggaccccaaatgaggtcagtggcaggggcaggcatcctccaggctgtgttactccactagtgaggacaggccatcttcactttctctcttttccaagccaaaccctggaaggaaagggcttagttttcttttcgaaaaatccacgcgggaggcggcatcaaatctgtcagttctggctaagaaaatacactcagaagctgtaatcaggggcgagtctcgaccttctagacacggtatatctctatactaaaacctaaattttatcgtctcccgcatgctatttcatttcctcctgccctccccacctcttgtatttattagacactgggtatggatttctttccctgagagaactttcataataatgaagtatacttggcagacactcacagtgaatatacagggttggaggctattctgcaaggaaaatggtcaggcttgttttcctctgtgggagagaaatatttgagatcaggtagactaatcatttctcaagatagaagttttgaaggttgcttttgcctaaagaagttgaaaactccttgaaggggcagaaagtttctgagatgttcacccttatgatttccctccgtggcagtctgccatcatcctgtctctctgggtaccagcatcctctggggctcagtccacttcacatctttcttctgctctccccacgctgacttttttttcccctctttttagattttcacgaggggtctgactgagaaagccaagagaaccactctttgtgcttctagccctcattctttgatggatattcatgcaattttctcattatttttctgtcagcattcacagaaaacgtgtaaactactttatttcaaaacccttaagttagtttactccatgataatttaagccatgtattcttttttctgatttgaatttagtaataacatattttaaacagaagtcaagatttcctgaataaattttcgatgatgactgctgacgtttctgggttccaccccacctccttctttaatatccttttattggaccttgctctacatatgtgatgagttgtcctttctttctccgggcgttttaaacagactctgggacttttaggaggagaaaattttggaggggagtggtcgtcttatcgacccagctgtctttgattcaagaaaataaccaaggggacttccctgggggaccagtgtttaagacttcggcttccaatgcagggggtgcagttcaatcccggacctggaagcgaagatcccatatgcctctgagccaaaaaaacaaagcataaaacagaagtaatattgtaactaattcagtagacttagaaaagaaaggaagaaaataaccaggggccagatgtgtggtcaggtgcacaggtgccccaatcccaaccctgccggggaccacccccaggggggattccagggactgctggaagacaggagtttgtaaagattgtcttctctccctgtagccagttttgcctattttaaattctgttttttcccccagccccttcgcctttgtatatagtgcagaattttgtatctgctccaagtctcgtctcccactccattccttacctcttccccacgtggaattttctggattcccgacattatttctactcctttccaggcaacagttagaagtatctcccactttctgttagatctggatctcccttcctatagtgctcttgacttgcaaaacagattccctttgtgggtgatggaggagaaatcttcaaggaatgatgtaaagatttcttatatgcttgaaagccttgactttctccatggttctaatacgtcaattgctgttcttaaaaatctagaaatcaaatttcttaatgaatttcgcagcatgagcatttatacatttatttctatggagggatattcttgcctttttattttctctttctccttcatgttgctttaggagtcctatctgtacttccaagaatgctttcagttgtgtaactgaggttttacatttccagggcatttttaaccagactgattatatgtagaggaagacaaagtctgtgattccaagactgggagagtttctgaagttcaaaaaaaaaaaaaatcctgtaatttaagtttcccgttataaaaggcagaatttctaaagctgctgggaggacaaaagactgacttcctaggattctaaaagaattgggtccatctcttcctgttagtactctttcccctttgttacacgcgcttccaagttccacgtaaccttgaggttggagcctcttcatcacagggcagagtcaacccttgatattttatttccgcttcagcgaaagaact

SEQ ID NO: 55543 - DNA, 875 bp, Bovine  19866881285984
atttgggcagttgacacccgaatgcttcccccacccccagctctgtgcacccccagtgaattcagcaaattggctccctgcccccaccgccccgtgaccccagggcttgctccccgcaccgcccccccccacccctccaccagctctccaggtacagctcagcggatgtaggagggggcctcatccaagtggcagagtcaggtccacatcgaagcttcaggtgcctgactcattccggctcaggccggtaataacaagccccatgtttttctccagcgtccacttctctgacacacagaatagtcaggaagtaaaagattcgagtactatacagctgctttgctttctctaaaaagaaaaaagaaaagttgggggtggggagggagaaaggagcaaggaggcaggagactaggccggcaaataatgatgccgcaaaaacaagcttattgctggtgtgttacataaacagccccaccatcctttgctgcagcccagggaagaagctgtgctgtagtgacacttgggctagtttcacacctgagcctggagttactcagaggtgcattaacaactaatgattcaatcgagggaggcctggattgccattttgacttgccacatattagcatacccttctagaaacccggaaccttccaattaagctccccagtgaaactcagaaggggcctttccaagatgcctgatatttaggaaaaggaaattaagctaattgtgaaagcgcctgacatgtttccttaatatctaggtagttgaaggctaggattgaatattatgaattcctcacatgataagtgtttgaatatatgtcaggcttccacacaggttttccaaaggtgcagctcagaactactcag

SEQ ID NO: 55544 - DNA, 1073 bp, Bovine  19866881327324
aaaaagaaaaggaaaggaagaaagaaaggattcttgatgtttgtgataagaaaaggaggaaatgaacaccctcaggtgttgaaccccaggccgtgcagcagagggacttctgtgccctttgccaacaggcacactgatgaaccatagacctggttccctggaagccgctgtgaaggcagccccagcacaaggcgtatttagagtgatatttgttttcaggaagaaatgtggatctttggggaatggcttcaaaataagccacagacacaagcgctttgtaaattatgtaaatttctatttatctatataattggcaataactgggaattgtaacgcctgacagttcgcaatctctttcagctgcgctctagtggctacgctgagattactgagcagctgaagaagacggtgtttttcaaccgcagggatgggggagaggccgccccatcccctctcccttcccctgccaaggtgctaatgcaatggtggatgctggggtgttagccttggccaaatgctaaattctcaatgagtagtataaggtacgaatgtgaatattcatcatacggaaatggaaaggactgatgtgccagcgagatggtatacagtttcgagaagcgattatttattgtgaaactggtctctacatcaactcctttcggtggatgtgttcgcagcagaatctctgtacatagagatgttaaattctgttctgaatcccagcttgtgttccttagggcttgaattatgtttttgttaaacgcctaagcaccgtttggctctgtggcaggatggtatctcggaaacgcattcattgtgctaacactcagaaaatactgtcaaatgcaaaataaaaaaatctcaaagtttgctctgatttgtgggtttttctggctggtgtgatacacattgtttcacatcagctttctgtgggccctgggagaggacggaaaacagttccagttccagaagcagattcatctaaagtcagttatggagcaagatgagcaagggggctgcttgaattgtaaggaaggagcagatctgggggacgtctgaggaagataaaacat

SEQ ID NO: 55545 - DNA, 1101 bp, Bovine  19866882213331
ctggccatactcccagccagaaagcatcccccccagactggttgagtgagtcttgttgaagtggtagatgccacaggggtcagaggatcagagagaggtgcccagggtgaaaaggagaaggggggcccctgagggctcagaattggggacccagggtggtcttggggccccgctctgtccagaactggtcatgtccgtcctcagccaggccctcgagcccacctagaacaatagggccagatggaattcaccggcccctggttgtttgcagtaagtggtctggtctttgtgttagcaaatgtggccacagatccaccatgtttcagggtgtcctgggcatttggtgtccaaggggtgaattaaaccaacagcttaatcctcgaagagtttactgtcctggggggaggaatctggacagatatgaaaactatggcagaaataggtaacatgaaagcagtaaagagtgggggtgcgggctcaaggcaggatggacgaggtgagaacacatgagacagtatggagtcttccagatctaacagctgcactttgtgttgaaccctaattcaaaatgcttactttccccccagatgtgttgacctattcactagccaacaatataatcttattaaaaggctgctccccttggaaatcaaaggaaattactaaaaattattaaaaattaagaatttaattactctctattctcagctatagagtattatgcaaaggcctttcttctggctttcaggaaaagtcgagcttttgagcgcctactttgtgctaattagtgttgtctttttgctgagagctggggaaggaatggttaccgtgactcctgtagctgaaggaagagggtaattaaacacctgagcgcaaggtgatttctgttattagctagtggatggcgcactcagctagaaaagtgaagactggggtctgggtgcgctgctttgttcgcgtcttaacgaggagaaggtctcacgctgcctctccgtgcggtccccagagtgtgacaagtttaaccagtgtgggacctgcactgaattcaaagagtgccatgtcatcaagaactacaccctctggaaggtcggtgactacggg

SEQ ID NO: 55546 - DNA, 775 bp, Bovine  19866882261048
ccaaggttccatgcccagaaccctacagcccagagggctacagcccaggacgactcccatagtacccaagagggggttgggagtgacccggaaagtgggtcagacccagggcaatgcaggagaaggggtgactcagcgagggggggctggcttgtgagcggagctgggggctgagcaccacctgtctcctgaaataagcccatcatcaggggagagagaaaagaagtccagaactgactgccttgaggtgggaggagtggggcttcaaaatagaaattccagaaaaagagcgctacatctctgacacacctgccacgatgattattttgctctctgcagcctgttgcgtgatcacagcaaaattgacaccttttagtagcagctgatcgctgccaggaaggtagcaagcccaccagcaccttccggaggttcgggaggggggacatggcacttttcccaggaaaaccacaaagggctgcgctgatgattctcactctgaaccaagggggtgggaagccatcctatcgccatcaagcaggtgccccaggaaggctctaggaggaccacctgctcagctagacccactgccaagcgctgccccctccccgtcgccctcctgagggtccaccctgcagagagcttcttggactcctcgcttcctccatctgtcacgtgtgggcttcccactcaccgaagctatgttcctctaagcttgtgtgtggccccacggggagatgaacagaaaggtgggaggaacctgaggaaagtgactatt

SEQ ID NO: 55547 - DNA, 1598 bp, Bovine  19866880168235
tgagagactttattttgggggggctccaaaatcactgcagatggtgactgcagccagaaaattaaaagacgttgctctttggaagaaaagctatgaccaacctagacagcatattaaaaagaagagacattactttgccaacaaaggtccatctagttgaggctatggtttttccagtggtcatgtatggatgtgagagttggactataaagaaagctcagcaccgaagaattgatgcttttgaactgtggtgttggagaagactcttgagagtccgctggactgcaaggagatccaaccagtccattctgaaggagatcagtcctgaatattcactgggaagactgatgctgaagctgaaactccaataatttggccacctgatgtgaagagctgactcatttgaaaagaccctgatgttgggaaagattgagggcaggaggagaaggggatgacagaggatgagagggttggatggtatcactgactcaatgcacatgagtttgagtaagctctgggaattggtgatggacaaggaaacctggggtgttgcggtccatggggtcgcaaatagccagacaccactgaacgaatgaactgaactgaatctatacaagaaaatctatgggggaaaacctctatatctttcacgtagaccagcccacagtctcaggttattaacacctcataaacaccttcacctccagactgtgaagccagtctcctggcttttctcctaaattattttatttacctttttttccagtactcagtccttcttccatggatattttaatccatggccactttttattggttgttaatccagcccaattccatgggtacacatatatctgagctggttaattgtcttatttctgcttccctctaacacagctgtgaaacaaatgataaagcaagcaggaagtctggcaggatacatgaaggcagaaaaagaaaagttctcccctagaccacaaagcccattctatttctggatataaatagcttatacttggttaaaaggaagtacctagtacatcttattaaaaaaaaaggaggggatgtattctaaaaaatttagagaagtttgaacatttacccagaaaggaagaatagtttttacacttgaaaaagtttttgttcggtatattatacatcagtatgtgcgtgtgtgtgtgagtgaacaggctcaataaatagcaccccacttccccactgggttcctaaactaattaaaaaataagacaaagaaatattatctttcttactgatgagggcttgtaaagagaatatagcttcatctgtgggtaaacgggctttttagaactgaaatccaaagtgagtcagacttgagtaccccgtcacaggcaagactggacaagggctggcctcccacaagaaataccagaggaaaaccatgagcacaggctcctaggagctgaaggtgttaggctcgacttgcaaatttctccttctaaactcacccatcagtttagtggaaagcgagagtgaaagggtgtgagagggtccgagctggcgcgtgagcggaaagagtagaagtcagaaaacaccggatctgtcaccatttaagcagt

SEQ ID NO: 55548 - DNA, 996 bp, Bovine  19866880485388
atgaagacaacatattctgagcacttaagatgccagacatatgctgaacatatgataagcatcatctcataattagaagattctaatacaattactgcttctcattttacagatgaggaaatggagaatttaagatacctgctcaagactttagagctagtcggttactgaccgggcctgaaactggttctttttgacaacaaaattcatctccttgaccttgatgttacactgcccagcgttccaatatgtgatatgagattgggtcaattatttcacttaatttctagaagagcaacatttcgacatgtcacctagtctgaccttttcagtgaatagttgtgaaagcacagatccagagaggtcaaatgacgtacttgagatcaatcagcttgttagtgccaaaaacaaaattcaggtgtcagaaattctgtattggcaattattctgctacattctgatgagggactcatttgaaaacacagtttgagtaatagtaggtgaggaaagtggaaatgtttctttttaaaattcaaacttggagcagagttgccaggctctcttatatcccctgctttttctctgccttacaatctgtgctatgaattctgagagctttcacacggaaaggcattgcttatggctgaaccttaatatgtcatattaaggatgaaggtgtgtgtgtcctaagttgcttcagtcttgtccaactctgcaaccccttggaccgtagccctccagaggctcctctgcatgggattctccagacaagaatactggagtgggttgccaagctcttctccaggggatcttcccaacccctgttgaactgttgtctcctgcattggcagacacgttctttaccactagtgccacctgggaagcccagggataaaggtacatgatagcttctcttgcatgtttctatgccaaacgtgcattttgtttttgtggctgtttcatcaaaactgcttccttctcttcctaggtgagcag

SEQ ID NO: 55549 - DNA, 4295 bp, Bovine  19866880514083
gtaagcgtctgtctgcaatgcagcatacccgtgttcgatccctgggttgggaagatcccctggagaaggaaatggcagcccactccagtattcttgcctgaaaaatcccataaacggcggagcctggtaggctaccgtccatggagtcgtgaagtgtcggacatgactgagcgacttcactttcactttccttgtctttaaggtctttcctgtatcttaaattcagaaaccataacactttctgaatttttcctctcctctctctaactggataccgaatcctgcgaattctttattcatagagttgcttacatcctctttcttctgttttattcttaatgctgctttgtggctttatcaaatttattgcttcacagtttgaccaatgcaatgatctccaaaatgacttttgtatctcaagatagttttctgcttcacatccccttttaacatgacatcagtctttctaagcaacttattttgagaacatatcccttcctcaaattggtctttacctgatgaaaacaaaaaactaaaacttccaatctcttcactttataaataaagacatttagactgattaacagttagtcacttaaccagagcaaaatagctgaaaaatggaagagctggatttaaaccctggcttcctgattgttagtcttgtattctttctactacacatcctgcttgtagcataatgtccaagctctttcatctttattccaggctttgccccatttaaatcctatctatcatgccaatctccaatctaactcacatacctaacctgtcaacacattattcctcaaaaagccattcatccagccagtgtaaaaatgtttattgggcatttcatgcctaagtcattctgttagatgcctgaagggaccaatcttccctggctgtgtgggagataaagctggcaaggtgggtgaaggccaaaagcactgacaacactgaaagtcaggctaggagcttagatttaattcattaaacagggtagtacaacagacagcttttgattaagagtgtgagatgacaaatctggcagagtatgcagaacatattaaagtcagcagagcttggagtagtcctgagattgtaaagtggtaattcatggagagaataaagcttagaggtggttcttgtttggctcacagattgtctctctgtgtgtatgttcaaatacaatcagttgctaatgtttaaaaattagacgtttacataaaaatcaatatttaaaattctcttgaaaaattacataatctggttgtgttcttacatggcaagaatcagaacgtgtcaatggggagctgactaatttagacagggcatgcttttactggctggattctaccctgtatgttacctgtctgatactttaggcattgagactgagattaatccactagaagtaggactattagcagtaaggaccaagggagagagcagcatcagaaataccaatgatggtttgagtcaagaaaaagtgagagagtactgatatgatttgcatatgcttgcagtaccctttaaggctcaccttggtcacacttccatatactggctgaattcagtatgacttctctctatgatcatccctatgcccaccacttctgtctacattgctttctaatgatctgtttatatataatctctttctagatccttcaaaaatagtgtcgcctttggcaaccccatctaaaagaaaaataagctaaaaaaaccttagaaataaatgggcacttatggtataagagataatactttagctatattaaaagaaattttaggaaaatatttgcgggaaaacagttttaggaaagaagaaatcttactgaccaagacttgcaaagtagagtcacataaagagagagtcttaacctcttgggatccccaggtggcacaatggtaaagaatgcagctgctaatgcaggagatgcaggtttgatccctgggttgggaagatctcctggagcaggaaacatcaacctactccagcacagttggacacgacagagcacgcacttaaccgctttaagtaaactgtaattttaaggcaaaaacattctaaagaaaattttaaaacttacatgattgaagataaaatgttttcgtggcacatctgacaaacaatgacttcttgaatatataaagaatacctcaaattgataggaaaaatggtatattatacaacatatatatctttaaacactgaaataccaacttacagataaaactcaactaatcaatcaacatgaaaagttgctcaattttatgggtggccaggcaaaggcaaaaaaaacaacaatcaaatatcaccttttgcttttcaaattgcaaaaattgaaaaaaaatagcatggaagtgttgataaggatacagggaaatggtactttcatatgttgttaataggaaaataaattgctaagcttttgcaaaataatattgaacggtgtgttaaattaaaaataaatgcactttttgacctagtaattccacatttcataacctatcctataaaaataacagcatcagtgcataaagatgtgtgtccaaggatatttaatacaactttacatgaaatgataaagcactgaaaacaacttgaatgtccattgactggagaatggtaaaataaattatggttatgtggcagagtataagatattagatgggaaatgttgaagaaaatagataaattatagatagaatgatgtaattacaaaaacaaatgatgaacctccagttcgtgggataataagtaaaacacagaaaacatggaggaaagtagaggaagatgaagaaggagataggccagcttgtttaggcaggagtgggaaagattggtgggagtggaagggagaattatttaaactctatgggtctctgtatctgtttacaagtatgtactcattcataattaaaaaaaatggagaaaatctaaatattttcagtttatacccagatagagatcctatcaaaaagcatagatgggagtaggaggttggtgttagcagttgtaagcttctatgtatagaatgaataaacaacaaggtcctatcgcatagcacagagaactatattaaatatcctgtgataaaccataatggaaaagaatattaaaaaaaaaaaaaatatatatatatatatatatatatatatatatatatatatatatatatatataaaagaaggaaatggcaacccactgcagagttcttgcctggagaatcccagggacgggggagcctggtgggctgccgtctatggggttgcacagagtcagacacgactgaagcgacttagcagcagcagcagcatatatatatataattaaatcactttgctgaacagcagtaattaacacaacattgtaaatcaaaaagacctcaattttagaaaagcaacatttgtctgtttaaacaaaagaaatgcctcctcaggtttactgtctatactaagcctgttagtcatctttcatagagtatctttctctccaaattaccaaactttataaaaaatacacatgtgcagagatggcaaaccgcctgagtgtgaccactcctccttgtcatgctcctagcagatatggctgaccataccacctatcccagtggatgctgctggaatcttagagtgcttcccaacactggtctagagactgttactaccagtcaatcagaatagaaggtaaaatgataccatctgccattcctggtatagtcaaaagagcatgtatatgggctcgaatcacatattcatcattttagaacctggaacagtttaataagcctatcagagcttcagtttctgataaaatcggtcattatcttcttgatagtttttttatgaagagtgagtgaaatcctatcctggctacaagggcccttcatcatctctctacatttgcttgtatctagttaaaactttccacttagaatgtctatcatagctactttgctcttatttatgcttggtccttgcatttggatatgttgctgaggggaagatattgattcagcttaatctggaaaacaataactctcattttctatccattatatccatcacttctagagaaaaggcgcaagaagtaactctaggggtgagtctgctttcccaaaatttactgtcctgagttagtttcatcagttgtcatgtggtttccctttttttggtaaattatcactcagactctattctcatatttattttgagacttcttagtagattttaaattctttaactcttttttttttttttttgcctgtactgtatatataaagatt

SEQ ID NO: 55550 - DNA, 1024 bp, Bovine  19866880539032
atgaacgataagtgaatgaacaactgagaagttcccatggtgagcatgaaatcaaagcagggcttgtgagttatgtaatttaaatatgtaatggtaccaagctctaaaaattgaattcagtgtttaactcgtttttaaaaaactaaaatagcacacacatgtgttccatactgaactccaagacaacttaaaccattttcatacaccacatatgctgccatcctgacttcttttgactcaaactttggcagaaaatttctcctgccacctctgtgcctatgtttgaacttcactgtaaatgttatcatttggttctgaagatgactgcttggcatattgacttgatatttctactttcaggaaaatcctgattgcttacacatatagctctgaaggacagcaaaagcgaatcactagggagtgaatcagcctttgggaaaaatacagtaacgtgatttatccagataaaccagcgtagttcttcactttatctatgtggatgagggccagactttttcaaatgagtagcaaacagcagcatgtggtgggttgtataattgtttgcaatattcgccccctctttccctgtaagaggattatatatctcagttcattgctgtctccctcatggttgttacacatttccctgccttttgacttcaggcctagctagcctagctattagacttgctttggccaatggcctgtgaggagactcagatgtttgccacatctgagcagatatgggagacatcacctgtctccatcagtttcattgctcttccctcactgctctgtaaatggtgtcccatacggggactgaaggaagaagacacggggaactgagccacgcagagccaaacagagccagggcaactacagctttctcaccatcgcggatgtataacttgagcaagaaataaatgcttgtttttgtgaaccaccgagatctggaggctgtttattatgctgcaaatctgatctgatggattaaatataaggaaagaaaaagcaatgttatgtg

SEQ ID NO: 55551 - DNA, 4033 bp, Bovine  19866880558160
caaatatgtatagagagaaagtaggttaatggctgcctaaaatatgagggaaggaagctggtggaggaaataagggaatgcacttctaataggtgcaaagtctggggggaaggtgattataatattcgaaaattgcttgtggtgatggttgcaaaactctgtgaatgtacaattgtgcaatttaaatgagtgaatttatggtatatgaattaaatctcaatagaattcttatattaaaaagaaagagaaaaaggaaacattgtcctagtgattctgacgtgtggataggtttaagaaccaccatatcgagcctggctactcagagtgtggtccacggaccacactataagcatcacgtgacagcggcatctcagtgctgaagtagaacttgtgattctgcattttaacaagaaccctgggtgactgaagtgcatacgagagtttgagaagtgctactctcagggactatttagaaccttgtcagatcctgtctactcaatttcaaagtcagaccaaaggttttgactttcttaatgtctaaactggatgagcatgctaacatcaactgtttattcagttgtgggggaaattcaccgaaacaatacgtggggaaagtcccaaagagaaaaactttacaaataagtctccttaatatgtcacaggagtcttaagtattaatagtgttgctggagtctcactggggaacataaaagtgtttctgattttagtgaaggggagaagaaaattatgtctacctgatagtcaattggagatgaggtagagaggtttagattaattaggactgggagaaaggaaaatgctgacatcatctgtaatgtaacctaagtctctctcattattttttatttgcctttagttatcttgaaaattttgtgacctttttaccatgacacaaaagaactatgacttttcttccatggtctatgtaggtcatttcgcttggtttatcgccagcagttagggtgcctttttattttttatttaatatttttccagctttattgaggacatcacatgaagtgaaataagccagacacagaaagacaaatactgtatgatctcacttatatatggaatctaaaaaagtcaaactcatagtactagagagtagggcgccttttttaacaatttaattctgcatcactgagacgttatgttgaaccccaggggcaatgtgttcaagcagacaggcacagcatgttcactttgacattccaattaacaccgcagggtcaacctacctcaaatgcaggctctcacacacctacacgaaattgtcaaagctatgaaacatcacaataaggggccattttcatgttcttactctattcagagtggttttattatacagttattagatgaataggtgacaaaccaacttagtcggaatctcaagaagactctttaatagttgtatgattttgtgcaagatatttaagcattttaaacctaggcatcctcttctctaaactgaaataatagggtcataaaattgttgtaaggaaaagatggcataatgtacataaagtacttaatacacttctgagaacatagtaagctctcaataatgttagctattattattatcatccacatcagattctaaaatagggatgttggcaatgtttgacagcatatttgcttttaaaccattttataatctgactacaatttagtttaaaaagatgaaatgtttttagactaaaaattgacaatctttggctgctcttctctttcagtaaccacattttgagaagcactgatgtagatattcagaaaaagaccctggggttttggaggtggtggggaggtggcaatcaagaacccagtagtgcaggagagcacaagatttaaagtcttacctcctcagaaaacctccagacctccccaccatgccccccatactgcattcctgtagcaaactgggaaaactagtttatttttaattaacaaaatgtattgtttgcatactaatggttccagctgcatcaaatcaatcaggattgggaactgctattccaggtccttgaaaaataatttgccaataaactcttgggagctaaagttgaagacttaagggtgcatcaaaattacctaggagatctaagacccactctagacatactgaaacagaatttctagggatgagggcaaagcaactgaatttttaactggttcttctggtgatggacaccccaaagtttgaaaaatattgttagtcttagaccatcccataatccactcaacttttttctcatgtgcacaggaacttgtctttgtaccaaggggaagctctgagacagtaaggtagagtgaaatagatatgaactttggattcagtctaatttgagttcatgttctacctctgcccataaatagctgaatgattttgaatgctttatgtaggctcctaggtcacagcttatctatctatcaaatagggtaagccatgctcgttcttgaactatttgagaattagcactaacatacagacatgtgttttacaaaataattgatatttattagaaataaaagacaaagacattatctgcaatacttctggaaactgcatctataatcataactcttaagacagtctcaataaataacaattaaaagtcctgactttactggtaattccctggtgaaccagtggttagaacacccaatcttccactgaagggagcataggtttaaccccacttggggaactaagatcctgcaagctgcatagtgcagccaaagaaatcaataaattcctgactatatttacgaagctttagagacattaaatatcccagctgtctagcaatgcctagcatattggacgcactgctataaatgtatttatcatgatgcagtcacgcctgatagcataagtggtaagaatacaacatttgtagccatattgtctgagtccaaatcttggttttgctacttagtctctctgtgactcagtttcctcatttacagcatggtattaatacaaagtacaatcacacaggtgccagatgtgttaaataagttattttatgtaatacaataataaagcggtacctggcactactagagcttgctttatttttcttattcttattaacattattattaagtatgtaaatattgaaaggggcttccctgggttaggaagattccctgcggaaggaaatggcaacccactccagtattcatgcctggaaaatcccatgggccaaggagcctggtgggccacagtccatggggtcgcaaagagtcagacacgactgaatggcttcacttcacttcccttcccaggtgcctcagtggtaaagaatccacatgcaatgcaggtgacatggatttgatccctgggttgggaagatcccctggagaaggaaatggcaacccactccagtattcttgcctggaaaatcccatggacggaggagcctggtgggctgcagtctgtgggatcacaaaagagtcagacatgacttagcaaataacaacaaacaacaacaaattattgaagggatattcataagagcttggtgttgagaaacaggaaactttagggaaaagtaaattttgagaaatataaatcaactatgtattatcatatactagaaatgtttccaagtcattacaatgacttgtggggaaagtgattaggaaatgaaaccctctcataagtctgctttatatagatgatcaccattggtaatttgtgcctcaagtctgcgttttaaaataaaataaaagggatcagggatcaagagagacaactctgtctcagacaactaaccacaatattttttactatccatctggctatgagttgagtccatgtgacatatggatgaatattcacaggttaccttgatatccagatttctccaagcacagcagagtcctggtttaaaattactcattacagcatgatttgggaaatactacaaggtcccccaaatgttggggcctatctgagctctcctgatacatagaaaacatacaagaaaggtccaaccaaggt

SEQ ID NO: 55552 - DNA, 3242 bp, Bovine  19866880809960
ctagatgcaagtaccaactatgaattgtctattcagaattgctcagactttaatagatggcccagtgctttctgagcatctgctctttctgtgtggtctggagaaggcaggtaggatcctagaatcacagataatgagtcagataaaaatatggcaggtgtgtcagagacatgtagagctcaccaagtattaatatactcctgccctttccccagcctttgttgcaattaaggttaaagacacatgactagttttggccaatgaaatgtgagtagaagttccttgtgtcacattagggctaagaaattgagatggtttgcttccttcatttctttttacaccccaccaccacacacatacacagttccagattgcataactataagacagaggagagtgactgtgagacagaaatacatttttactgggtaaagagtctgaggtttggaatttgctattgtagtagctagcattggtttagtcgctaagttgtatccgcctcttgcaacccaatggactagagcccaccaggctcctctgtccatgggattctccaggcaagaatgctggagtgggttgccatttccttctccagaggatcttccctacccaggaattgaatgctggtctcctgcactgcaggcagattctttaccaactgaactacaagcattaattaccctaatagaatatgtgatactccttacgttagaaagttattggaaaagctgggaatattatctagattaagaaatcacaaatctgactttgaatcaaaatcaacttggggagttttaggaaattcacatttctgggacccatgtaagaatttttaagttaaaatttatggggagggcatgtgaatcaacatttttttaatcaagctccccaataattctagacacttctttcaaatctgaacttctactctacgacatgaaagtccctctaattattttctggggtgatgaaatggaaaattaaaaatgatcagagagaatcagaggatttagatctaaaacagaattaacaaactagacccaagggctgaatcttgtcttcagtctgtttttttaaatattaataaagttttattgggacagtcacactctggtttacatattatctatggctgcttccactataccggcagagttggatggttgcaacagtgatgttatattcactctctggcccttactgctgatctacatgcctgtctctgcttgaaaaagttaggaactcttgatttggcctctcccataagtggaagactcaaattctcagcattcctggtaagtgtaagaaaggtcagtcatggaaacatttcacttttagatcagctgcaccttatgatatctccatgctccatgggttagtttagagtcatgcaaattctcctactgtctcataatctgtggaacaaccagaaacacagccataggaagacagttattttaactgaatctagaaagagctggatgatatttgtaggggaaaaaattatagtttccaaatgtatctggattcttgtagttctttcttactacaaatgaagatatgacacaggattaatatttaacgggacccattctctttatatctttcattcatgcttaaattatatcaagggcttggtacaaccccctcatctaaaatgatctatatttaaatatgtaggtatatttaaatataaattttaaagctgtacagtccaggaaattcaaatataaaatgcaattctagggaaatggctattttaaccagctccaaatggagatttaagttgaagatctcttcagctcaatgcgtcatcactgtagctttcctttctttcccttccacttccccaataacacactatcaatcagaaacctagtgaatcacagccgagaaactgaatattcttgctttttagtgaacggaaggggaattttgtcttttggctagatgatctgtggtattgctcagtgaagaaaagaacaatgagccttatatatgaatcacagaagagcttcactgggtcattttggtggcctcaggagtcctgatcagtttcactacagagtaaacgctggaatatagctggagaattgtaggagctttgatgcacgtggttttcttacacttagaagaaaaacgttatgtttgagctctgttccctcacaaatttaatttatgtaacttcttggagctagagaagaaagaaaaagcaaagcaaaacatacaatttcattacactccttaggacataattagtaacatgtgtacctaattttgattactcactcttctattcacttgtcgctggttaattgagagtggcagtcccaattaaacaacccctagtagcatgtaatagctaattgtgagcaggctagaagccttctttgtctttgaaaaggtctcttaactctctagggcatgtctgttttggattgaagtcataactcggtatcggatgatttaaattcaagaatgtcttttaatattaagatttaaataaatgaatttacactccatgtcatatgtttagcaggtgactgagaccatgtgctctttatcccatttagcagagaattataatgtgtaaggaatttaaattaggctgtaaccagccttgctgctaggggcaaaaagtaatgtggttaatatagcaggctagaatgagaagtgggttcatttgggtcactgcagtgacttgtaattgaattcaggtaatttcttcgaaaaagagttcatgcttctcgtctgtctacttccagctccaaaactccagatccaaacagttcctgatttacgtagttacgatttccaaattgctgggctaaacaatatgtgtctatggctactggggtctatgaaaatgatcatgcagttccgatgcagatgaggacacattttatttgtggtaaccatagctgtgggatccccaggacagtttctaaacactgtacaggccagtggagtcactaaaagatgcgctatgatggctaaggctttacaacacagttctcatcagtagccacgggaatcgtgtgggcgagagccatagccctctcgggtgagcgtgtgtgcttcaaggaatactttaccgacaaaatgacatttccctttcctttacctcagaaccacatgtaaaatttaggcaagtcatcgtttcactttgagatgacctgtggatgaagacggacctggctaacccggcaaactggtacagcccatttcaggatgcgtctctg

SEQ ID NO: 55553 - DNA, 2668 bp, Bovine  19866880903936
tgttctggatgtacagattcccagcattaaagggaagagaaaggaatgcaagtatgtgttgaggaagcatttagtcatcaaaaacatatcaatgaaactttgggaatataatttaaaccagagacatacatacgaatccaggtttacatatatgtacaatcaaggtaactctgaaataatgacatgtgtttgataaataggtatatctattttccctgatttgatcacatgtggggtgtaatacaagcaagtgtcagatttgcttgtctttgttttattgtatttgttgtaagattccatttttcttatgcaaaagttcaatgactgaatttcctaaatgtttttcccctggttatagattaaatcagttatcactatttccataaaatagctcagtttatgaagatggcaaatatgtgttcagttgaattgcaacaaatgatgactttattgttaaaaaaaaaaaaagaactagtatttttgaactttggacaggtttccaattacttggactttgtttctctacctgcattgccttttgcaattttaaaaaattaccttttggacaatcttttaatatcaacagtaactgtgttactctgtagtgtcaacttaaaagacttcaatactttaaaagaatattcagttgggtcaatttacaagaaatatttggctccccataaaattttaaaagaagttcaaagtcataagcaaaagcatggaggcacctagcagactgtggtgtggacaaggaatgctgcctgccacccttggacatcaaggagatcaagccagtcaatctgaaaggaaatcaaacctaaatattcattggaaggattgatgttgcagctgaagctccaacactttgaccacctgatgcaaagaatggactcattggaaaagacttcattgctgggaaagattgaaggcaggaggaggaggaggaggtgacagaggaggaggaggaggcgacagaggatgagatggttggatggcgtcaccaactcagtggacatgagtttgagcaagctgcgggagatggtgaggtataggaaagcctggcatgctgcagtccatgggatcgcagagagtcagacatgactcagcaattgaacaataataccagtaaacaaaggatgttttggccatcaagcccataaccacctctgcctccaactctggataggccaagaattctgcttagtctatcaatgggaactcacaaatggtctatcaacagataaatggttgactaattgtttatagaattcgggcttcccttgtggctcagctggtaaacaagctgcctgcaatgcgggagatctgggtttgatccttgggttgggaagatcccgtggagaagggaaaggctaccaactccagtattctggcctggagaatcccatggacaaaggagcctggcaggccacagtccatggggtcacaaagagtctgaaatgactgagtgactgacacttcctctaacttcagatctatccatctatccctagagctgtcaaatagtctggtctgaagcagtcagagatgcatatgcagatttttatatttataaagttagtaatatcccctagtcttgctcaatgtgaggtcccttagtgagctattggtgaaattaatttgttccctgtttagtagagtagcacttaaaataagtggaagtgtaaaagtaaactgggattcacgtaactatagttttgagtgctagtgaagtaatcaggtaatgtacatggccagttctgcttccagtatagcgataagaatccacctgccaatgcaggagacacaggaagacacaagttcaatccctggtcgggaagatcccctggaggaagaaatgacagcccactccagtactcttgcctggagaattccttgggacagaggagcttgatgggccctatagggtcacaaagagtgggactcgactgaagtgacttagcacgcatgcactaggacctcaagcaggtctgtgatcttatctcttacaatgttcatgtttacaaaataaacctgtgagcattcctgcattaataagttatttatgagattaaaaattaactagacatcaaattcttgccacagtgcttagcttatagtaggtgctcaatacattaatgttcaatgaattactcaaaaggcccgctgttgaaatttataaattctgatgagttgagtttttgccccagtagtgagaggagcaaaagataagtggcttttgagatgtgctgccttcctgtgaggtagttggtagactaaaattgggtatttctgtcctagaagatacaagagatcatcaaaagtctttggtctgaactttgagactcactctccttgccagtacccttcaaactttgcaaagcctcatgacctgaggaatcctggtgttctcgatagtatgctatggagatgcgcataaattccagctagcaagagatagcaggctgtctgtccctggatggtgttgcagaagcatcagagtcaagtgtctacattatgggaccttaactcaggaatgccagggcttcctggtggctcagatgggtaaagaatctgcctgcgttgcagacctcggtttgatccctggatcaggaagatgccctaaaaagagaatggctacccactccagtattcttgccggagaatccca

SEQ ID NO: 55554 - DNA, 1154 bp, Bovine  19866880910476
cttgttcgcgacgcctgtgagcgcaagctagctttagagaaacttgtgctgactttttcccttttcttccttttaaactcatttgcactggagttcaccattgcccaccccaccccgccttaggcagtgtgtgtggcgtttgtttgccagttttaaaagcccagctctgtttgctctgatgttcttttagccgaggctctgttggggctggtaaactgcctgggctttagtgaccgatgaggtgttaaatgctaatccaacatcttttgaaacaaaccaggattttgttcaaacatttttaatcaagcaatcaaatgcttggaagtccagataataggaagcaagcctttttttaaaaaaacggtgttttaattaattttttaaaaactagtggagactgccggaacaaagtcgttgggcagtctgatgcttttatttctggggcggtgtggggcgttataagccattgttccggggatccaagcaccccctccccggtccccgcagtcacccactgcgcgctgggtggtagtgctcgttaatcatttctgagcagcgagctcagcttccagacacaggagcctccctggaggggctgcctggacgcggtgcacccgggcacgcggagccgggccggctgtccccaccatccgcaaagcatggggaagtcctcccgcaaggcctgcaggctgcgggggctcaagtggggctcgccgattggtttactgtagaccgaggcatgtcagaatggagccacccggacaacccgcgccgggtcagcccctttcttcgcggggcagcaaccccctcccttgcaagtcgccgggcactggcagaacactgccccctcctgcgcgttgcgctccccgtgagcacccgccgcctccgcagcccagttcagctggcgccgagcctctagggaccctggggaccggtgggggaccgagtgcgggactttgggctccagttctgcctggggcgggtgtggggcgaggagtgcgtgccgggtcctctgctccagaggcgacctggggattctggggaacgtctcggccgcgctgcatagccagcaggtaactggggaggtgctggccagaccagcgatccgcgctcggctggcgtaccacggggtggggcggactgccggatagagg

SEQ ID NO: 55555 - DNA, 809 bp, Bovine  19866881156748
tgaatgcaaaaggaggcacttcacatgtaaagtgaaagtgaaagactctcagtcgtgtccgactctttgtaaccccatggactatacagtccatggaattctccaggccagaatactggagtgggtagcctttcccttctccaggggatcttcccaacacagggatcgaacccaagtctccccattgcaggcggattcttttcccctgcaccacctgggaagccctaaaataagtcagtttgggcttataattcacattgctagttttgctttaattctgtaagtagaaaataaaacagaaaacagtcttcccaaaagtggtcttgacccctccagctcaagtgagtttcccatcaccgaaggttctaaaatagacttgggatggtcacttgtcagggatattgtgagaaatatacaaacatcagatcaggaaattcaaactgaatgccctttaaaagtcctttccattcctgacattctgagagttttcaagtcactacacgcacactactctctctcttataaaatgcctgcctgaaatagactaggataacaaaaaatatcttttgcctggacaaaaataaaagcaaaggctacttttcaaagaaagaatggatcatttattttcaatgagaacattcagaatcaagattagaaactccaattatctttatatggtatctagaacaatgaagatataccatttattcaaacaagattgttttattttagcacttatgggtctggaaaattctagatgccagagatataggagtatattagtttcctaccatgacttaaattaccca

SEQ ID NO: 55556 - DNA, 860 bp, Bovine  19866881214113
ggtcagccacatcagtctttctacaggacttggtcttggtggccactgccttctccttacttggctgctggtccagcacctctccttccacatgagccgccagtcacctttactgctcctttcttcctgccttctaaagtctttgcagttactctgtttggttcctagactcatagctataaagagtcacatgcctcacagcccaactccaaagggaacagaagcttctgcaagtggtgcccttccagaccttgccgtatgtacctcttcacctggctgttcatttatatcctttgtaaaaactagtaaatatatgtatgttctatgctgcgtgctatgccacttcagttgtgtccgactctttgcaaccccatcgactgtagcctgccagtctcctctgtccatgggatttcccaggcaagaatactggagtaggttgctgttcctttcttcagggaatcttcctggcccagggatcaaacctgggtctcctgtattataggcagactctttatgactagcaccatctgggaagcccatatatattctgataattcccaaatttatatctttagccccaggctctccacagaaatctagattcatgtatttccagttatatccatgacttttccctttggaaatcacataagcatctcaaacttaacatgcccaaaatttattctctacctttcttcccattaaaaaatgcatcatcagtggtgctaaatcataatgtaacaccttacccagctttatttttctttataacctttgttactacctgagattacatcacatatctgtatatttacccactggaatataaccccatgtcaacagggtctcctgtttattca

SEQ ID NO: 55557 - DNA, 1228 bp, Bovine  19866881224870
ttcagttgatacagcagtctcagtctttcagaataatgtcaccttggagaaagcgaaaagcgttatatttgtttagccagtgtgatagtatttggctgtgtcatcattcccaaaggatcttggtttacatacaactagagatccaaccagtccattctgaaggagatcacccctgggtgttctttggaaggaatgatgctgaagctgaaactccagtactttggccacctcatgcgaagagttgactcattggaaaagactctgatgctgggagggattgggggcaggaggagaaggggacgacagaggatgagatggctggatggcatcactgacttgatggacatgagtctgagtgaactccaggagttggtgatggacagggaggtctggtgtgctgcgattcatggggtcgcaaagagtaggacacaactgagcaactgaactgagcagatatgacaagatggtctgcaataatttcaagtgttagacttttatctaaatgctgaaaacccttccataattgtacaaacacataaaacctggcaaataaacagccttttaaaatataatggagttaattcaatggctccattccccaagaaacttcctgttgcaaacaactgttgcagcactatggtttaaaatcagtgtctctctcagaatcttcaatccaacaacttttaaagaaaataaaacaagatttctaggctattaagctgggaagaacatccttatgtatatggaaagagtggaggtttttgtgggggctttttttttctgtattttctttagaatatttatatgcttgaagactttatgtctcacagtgacagaaaacttacatacaagattcattctcagtagaaaatagatcaataatccttctatagataagaattgcagacagaacaattatctaataaaagtacttaaatcgccagctgaaaatgatttaacatgcagaaatcaggagtttatcattcacacatcacaaagcctagaacaagtattccataactacatagtttacagatagaatttttttttaatttattacaaacaaatgctctttcccctgatttcaagatcaacaggaagattctgagattttaccacctacttagggccagtgggttcataagtcacagatacttagagcagacatgatcttgagggattatctaaaatagcttcactttacagatgaagaaaggggcttgtgaaa

SEQ ID NO: 55558 - DNA, 1478 bp, Bovine  19866881327485
ccctccccctccttcccctctccccttcccctcctgccccatcaccaggcaagttttcttccaactggatcacagggaggaagtgactctctctggggccagttcacttgtgtaatcctgaaaggggagtatgggcaagggtcagggccagctggcctgttgctagctgctctagagattcttaggaaaatcaggtttgtaattctgggcccataggcccaagacagagcaacttctccagtagagggagggtggcatcgtctagggaggctgatttctctccgatgacacatcagccagggtcctctgactctgttgatttgggtttgatttggcaggtcacttaacccctgcttcctccacttcctcggctgtgaaatggggtcaccacttcctagtcagcatcacaggactttacaaagagaaaattctgatgacaagcagttttgcaacaggaagagctaaagcttcaacgctcaattgtaccagttcccacgagctgaccgtaggctctgctggcctctccctgcctcagtttcctcattgaaaatcaggataataataggactcatctcaaagctgctttgaggattaaatgagataatattgtacttgaagtacagtatctaatagccttagtaaatgttatttgtttcccctgatctgcagctcattttaccatttagtatgtgtaccagagcactggaatagataagagaatcctacaatgaaagagaaaaactctctcactttacagacaagaaaaaaaagagagagagaaagatgcagtgagattgggtaacttgcccagggcttctgattcattagtgagagtgaagtttagggcttctaattgttgggtcaagcaagcctccgttttcactcctttgaaggttgtgctggtatttctatccccagataaccctttcgaagtctgatattaacccttagaccaattttgaccattaagcaatacattttctaagtctccagcagtcccaggaaacctgcagaaaacctccacgaaagccaccgcctcccccagctccctgcagaaggccaggaaaggtagctggctcagagacctgaggaagccactaacggggacagcaggtgaggggggaggccggggagctgcagctgctgggaaaggttgccctagtaaccaggcagggctccattcaggaagtgagcctaactccaaggtgcaaaacgatcgccttcacgggggctcctgcaagcacaaaggcaccaaaggaacgagggccggcccggagaaaggaggcgcggggagaggtggggggcccacgctgtcatttacaaccctccaccttccagagaagaaagagaaagagaatagctctttgaatcttctggcctgtgtgaaccgtaaaaatccccatttaacatgaggccctttgtggcaatgggagagaagctggccccgactctgttcaccagccttatgaaacaatata

SEQ ID NO: 55559 - DNA, 1004 bp, Bovine  19866881629149
gaagcctgctatgctgcagttcatggagtcacaaagagtctgacacaacttagcgactgaacaacataaatctatgacattatagatattcaacaatataacttcatgtctagcatacaattttaaaagttaccgcgcatgcaaagaaacaggaagttatagcacacaggagaaaaatcagtcaacagaagcagactaaaatatgatagggaggacagattagcaaataaggacaacagctataataaatgcatgcaatatgttcagagatttaaaaacaaaacagaaatgatgaagacagaaataaaagctacaaaatgtgccaaataaaatgcctagagataaaagaaatatgaaataaaaaattcacaggatgggattaagagggaattagactgtgcagatattgcaatagaatcaatccaaactgaagactaaatactaatgcatagggcttcagtgacccgtgggacaataggaagcagtcctgtatacctttatttggagtctcagaaggcaaagcaataagtgaattaagcaagatcacaagatagaaggtatagtcaaaatcaatttcactcttctatactagcaataaatagttggatgcttaagtttaaaaacattattcataatagcttaaaaaatgtaaactacttcaaaatacatttagtaaaagatatgcacatcctgcccattaaaaattataaaatatggttaaaagcaggcagactctttaccatctgaactaccagagaaaccctggccaaaaagaagttgagaccttaataaatggtgagatatgccatattcataggttggaagattcaatggtgttaagatgtcagttctccaactggtctacagattcatcttcatttacgtgaaactataggaaagacaaattttattcaaaatgaagaaagcacatcaatggtaaccagagcagatattaatagaatgactgactgttaaaggacgcaggttatatgagtgcatgcatt

SEQ ID NO: 55560 - DNA, 1166 bp, Bovine  19866881662768
gagcccttgtctccttccttccatctatgcatgtcgcctatcgaatgagtagtacccatgctcacacacacacacacacacgcttccagtttcacacaaattgttttttaaaaaggaaagaaaccaacccaaaatattgcatttgaggtgacactccctgaagaattttgtacagaggtaagatactgtttagcacagctgaagtttcaacaacaacaaaaaaagtgagcccatgattttggtgtctttccaagatatcccctttgagacaatacaaatcaaaatatttacagagataaggcagaatcaaactacattaaggagaaaaaaagtcacaaggaagatatatgaaagagactgaagactgcaccataacaaggtctccatgatcattcagtgtccatgaaaatgtcattcagaattggtaacgttgagcatgctgcaaatatatcctttggattcaaaaagagcaaaagtttccattgtttttaagtggcaaactgctctttctccctttggatgatttcttttaaacccatcaaaggaaaaacacagttcaaacaaacactgtcaagtgatttaagatcaaatatttacaataatcaaatggaatatgagattcatttgattgattatttatttttgtttttctttttttttttttttgcaaactgatactacaaatacagagctgaaacctctctttggctcctctatatgcaaaattgaatcggtcttcactgaagacaatatagaatcagttccagatgcaaaagaaacagtcatacaaggccctaaagaacacatgctcctaccctaccatttggtcctaccctatgtacctggaagtcctcgaatcccagtccctgcaggggtaggctgtacacaggggtgtggagcaaacctactgcctctatctatacagcaggtcctgttcttccaacaggaagggagcaaatctctcccttgggaataaccaatgccatacgtggtaaccttgtctaatacagacagctggtgtcctgttgacacctggggccacatacaaagagagcagcctggctgatgctgctaagagaaactgctcaagatcggctggacacatcccagcggggggtgcccttcacgtggattgcagagagtccacctggtagacattctggttg

SEQ ID NO: 55561 - DNA, 1007 bp, Bovine  19866881694269
ttgaagagttttaaccgcaccctagacctgtgatgtcgagatactttattgcttaagatgaaagtgttagtcactcagtcatgtccgactctttgcaaccccatggatggtagcccaccaggctcctctgtcaatgggattctccaggcaagaatactggagagggtagccattcccttctccagggcatcttcccgacctagggatcgaacccgggtctcccgcattgcaggcagatttttcactatctgagccacctgggaaacaagtttaagatgaggctgaatttatttaagtaaactgtgggctgaattattttagtaaatataggtaaataataaggtggctcacaaccaaaattgtaaaagtggcatggaaatgacttaaatttaaggaacatctttccggcatgctcagaaagatgttaatatgtccatacagaacaccaagttgcctacataagacaaaagggtggggagaggggctttctttacatcttccccagccagcacccagcaggaacttgcattcgctatccctcaacaaaagcttgttagattgaaccgaatctccagcattcctcatcctttgatttctgttacccaccatccctgaaaagaaaaactaaatgcatttttttaataaaataaagtttaaggccttagggaaatagtgctttggttccttttggttgattggaagaattgattgaaccgcaccttggtttgtaccttttaactttaggatgtgtctctactggaagccctcaaagactcaaatcaatcactaagtccccgctctttattctgtgcatccaaggacagaaatctcacaacccaaaccacatgaaattcatcactgactgcaggaaaagatttactctttctgtgctgactcgccttggtaccattgctcctgaacagctgctttcacatttcttcactttattcctctatattttccccaaggaaaagaactcatcattaaggatcctgcccaaatatatt

SEQ ID NO: 55562 - DNA, 518 bp, Bovine  19866881707551
cccctcctctccctccctgctacagcctgtgtcaactgtgctgttattaataacagcctgtgtctgttattaagcttatccagtgaaattgtaactctgcttatgttactgttgggtcactagtttatgagcttcattagggaagggacaacttctgattcatctttttatcctcatgaactggcacagaatctgctacataacaaatactcagtaaggtatccaatgagaagaatgaacaaaggaattgatggagtagacttctgacccgatggactcaacaagtatatgttgaatcctcactctgctccaggctccactgtgggctctggtctttgagcaggaacaaagcaaagcccacaagcaagagaactgaagaaaaaatacaaacatgtggcgagagaaataaaagtagacttgaggtaaatgaaacatcatgaaccagcacttcatatattcaataatgttgatactttagaaggaacatcatgcctcttcacagccaattttttccatgt

SEQ ID NO: 55563 - DNA, 917 bp, Bovine  19866881861108
aaacatcaattttatatagttcaatctaacattttagggaaaaagtaagattaaaatcttgttatcaaagtgaaagagctatacaagtcttttatttggatgggtaataactcttgcatatagaagtgggacatgaaatatggttaagcaaagccaggatatttctgaagaaggaattttaatctcgccacatcacaaagcagacctaacagtattttattttagaatgcgtaccattctaaataaaggaaggagaaaatatgaaccatccccagttaaaagcccagcttaatgacaaactcagcaatgatgccttcccattttgacatgattgtttctactgaataactacttgtattaatatttataatacatgcaatggtcacacaaaaggcttaccagtgtatccatggagttatacctgtgtcggggacatggtggatggtcaatatacatctttttcattaaaactttttatgaaattttaaacagagtggatagaatcatctccaccctgaaaatgtagttggaagcatcaacagaacactttatactaagttaactatcaataatgtatgtttatatgagaataagttcatacatttttaaaagtataatcagtatgttattaatatagtatccatagtatcctactgtgtgcacactgtactagaagctatagaaaaatgtattgctctgttccttgagataagagactttaaatctagctggtgaaacacatattaaaaagaatgggagcccacaaggcatgtccttttattaggacatgctaaaagaattaaactgacagcaagtgaaccattaccatattgtgttgaagtcattacccatgaaaatcaaacaggaaagaagtcaagaggcccagaatcctgtcccgactgtactttcccagctag

SEQ ID NO: 55564 - DNA, 1414 bp, Bovine  19866881979505
ttctgggataaagaagtttaaacatgcccattgcaacccaggacacggtatataaaccaagtctcccatttacttccctttcagccataagtacatcttttcctcttctggatcttattgattccctcttgtaggacctcaagcctgcagctatccttggcttatttagtttatctccactctgcatctagtctttcttcaatcatctggccttccaactgctctcttgatgctgaaactcagcctctttgtgcagtgctgacgcaaatctcagagatggggctttagatgaagtagaaaagaatatctttatttctttgccagacaaaggggtacacagcaggctcatgcctctcaaaactgtgtgccccaacctgggatgatttggtgaggagttttatagcagtggttcaagggcagattgctgataaggattagggtgtgtgaagagcctgcatgcctttaatttggccttagatggtcccatgagtttctgtgagtcctttaatctggcctcaggtggtctcttgaaaagcttctttggttcctttaatctgaaatgaagaacactaatatgtttcgtttgttgagggtttgcttccctgtggctcagatggtaaagaatcagcctgcaatgcaggagacctgggttctgcaggagacccaggttcgatccctgggtcaggaagatcccctggagaagggaatggcaacacactccagtattcttgcctggagaatcccatggatagaggagcctggtggggtacagtccatggggtcacaaagagttggatacaactgagcaagtaacacgttcacttctttcttagtgctacagaagtgtccagatttgttatgtgtattcctgaggcagagccaggactttgccccaagactgcactatcgtttcttggctgctcctttcttgtctctacatcccctgcctcctcagattagcaactgtttcaatctgctctttggaactcagggaaggccatgaaggctgaaggctactccctacaaacaagaaacagggagcatggaatgacccaagtcccataaggtcctagttcgtttcacccttagaatacacattccttcctgtaattgcttgagctacagacacagagtcttctttagccactcttgggaccagaatggacaagaaatggagcaattcactagagcagtgtttctcaaagccaaggatggattgttctcaattgtttcatagttaagcagggtctttcagatgacacctgcatttgtctatgctacttctgtatgctctattatacttcacagaatacattgaggccgttagaggaacgtccccaagctcctctaccaaacataccaaacttcctacgtctgcagctacccttcctagtgttaaagcaaagcagtattt

SEQ ID NO: 55565 - DNA, 818 bp, Bovine  19866880527021
tttgtactgacatacctacattatgtataagtgatatcatatataatacatctccaggaaatattagattagagaaagaaataaagattaccaactccagtatcttgtatgacagataaattatggaacagaatataaaaggtgacaatacatggatgttgatataaaattttattttagttgaataattgcatcaccttgttttagaattttagaagtgtttttagaattaaagaggaaaaaagcattttcagatagttcataagtaatattgattagcaataaataattactgataagaaatgattttgagtagttatggttaaatatggatttgcttgctatgtctcagagaaagcatatctatattttggataaatgtgatatacctcttttggataaatgtgataaaagaaaaatactttctgacttcatctgagaaatctatcttaaaagtaaaaaaaaaacacacacaaattttctctctgctttaagagccactcacatgcaatatttatatactcattttgtaagaagcacatagtacacgtagtgatactaaggaaataccattataataatcataggctttgacaagcaaacatgacatctgctggttgaacagggaaataattcataattttccttctttttttatcctttaggcatttttttgttcttttagcaagcacaccaattttttttctcattctctcttatactcattttattttatgcaacattgtttgagtttacatcttttcagattaattgacctaaaactagtcattagtctaaattagcaaagtaaactttag

SEQ ID NO: 55566 - DNA, 1458 bp, Bovine  19866880588327
cccagacactatatcttgccatggaagaaaaactttgatttgtcttttggggatgtttcaataaagaataatggccttccactgtcctgccaatgtgaaagaaaggaaatgtttgtagatataaatattataagaacagaaagatcaagtataaacactactctttttccatattccactcccatattctttacatttaaccctttcatgaaaaatcttaacatgcaaaaatggcctcagtagacatcatttcttttgaagatcctcttgcacaccaaagttgaggactgtagggcagaagcattctagatacaatgaaattgatataatttttaagaatattctctgtttaataataggaaacaaagtcattaagtaaaatcatttttctatattatcgtagaaaatttagattcctacttcctcaagtatgcacatttagataataacattattttaagacacaatcaaatactagcatttaacataatccttctttaattctgatctgatgattattgtagtggagattttatatgacatgaatatggccttttcatgtcccagacttagaattttgaatcaatgagcttctgcatgtaaccaatgtaacttggatgatgtttaaagatgttaagaatgtagcaaattttatatttctacaaaataaattttaaatttaagcaacataaattgttaaaaaggatttcttctctaataattagtatttatgtctttgactatgactatttttttaacggattattaatttatattacatactttatgattttaaaatcattattttactctatttttattttgagcctatatatataaataatttcttttatccataaattatctatattatctaatgaaaagtactttcctttttaatatcaagcatgactttaattatacaacacatttttgatttgctgaggcatgaaaagtaaatttgacccttaaagactcatggtaaattcagttcaaaagagcccaccttttctttaatccacaaactgttagaaacttatttattcttaaattaagattataaaatcagtactgtatcattaaactccttgctgggtggggtttggtaattatacccagcattcctccaaatttttggtaaaattagctgactcttttgattaaattgtatggtctttatttaaatataatgagaaaagttattttagaatttgattattggcttatatacttttcataaatgttgctgcagtctataaaaaagcactagaattctgaaatcactgctttaaaaaacttaaaaatagaacagatatttcatgtgaagttaaaaaattaatgtatggaaaaaatttttctaaaaatcttaatgtccttaaattgtactttttaagctcagctaagaaattgtttaatctctttagacagctactagcttcccaactatttacttcattt

SEQ ID NO: 55567 - DNA, 1062 bp, Bovine  19866880656072
tttacttttcactctctgacagtagaatccttgagtacaaggaaatgtatagatttcaatgtaatcccacagtttaaggttcttcatataataaggattcaataaatgtttattaaacattaaattgatacatttgttaaatccttaaaattatacccaatctgtataacaatgcataatgttctatgccacatttgggttttaagcttttttttttagataaaactattccacagtatcactaagaatgtgttatgaaaactattcaaagcaaatataaagcagtgttattaagactcagagatattaggttacttttataaataaagaacattatttacaaacattatttgctttttcatagcctggctaacctagaaatttacactgtaacattctctaagcaaacttacctctcacaatgatgttggtggacttttttgcagggtttcccacattattattggcaatgcagctgtaagtgccagcatcttctgaagtgatggcaggtatggtcaaagttcctccattcaaaacagtcttttcaggcagagtcccaaaggacctgacccatgtgagagaaggtacaggctctcctcctgtcgtaacacatactaatgttatggcctctccaggatttacaacaatagggtcatccaccaagagtttaattgacggagacgctaaaagacaaacaaaagaacatgcacctatttagatctactagagctagacttcaacagtatgctttatatttacacaaacaattaaaatgaaatactgttctcttgtgccaaagtcttattgtattgatcaaatttaaaccttatagaatggttatttattttaattatatggcataaacctgtggaattttactaagaatcttacacatggagaggggaattaaattttatgtattcttgaattattgtttcacaattagaacaaattaaaacaaaaatccctttctctttttaatgttgacaatcaccatttgtttttgtccttccaggtataaatattaaagctgtttagttctttgtatttttcatggtcaag

SEQ ID NO: 55568 - DNA, 1420 bp, Bovine  19866880696469
aattgcagcacgccaggcctccctgtccatcaccaactcccagagttcactcaaactcacgtccattgagtccgtgatgccatccagccatctcatcctctgtcgtccccttctcctcctgcccccaatccctcccagcatcagagtcttttccaatgagtcaactcttcgcatgaggtggccaaagcactggagcttcagctttagcatcattccttccgaagaacacccaggactgatctcctttagggtttgtattactattttgcagcacgcatacaaaactctgaactaaacgtatgactgttatttgaatgcactgcaggactctatttctaaaaatgaaccaaaggtccatgggatctgcctgacttttttttttttttttgcagtgcaaaattcagccactgaataaaaattttaaaaactgcaggccactaaaatatagtaagtcttgatcatgttatgaaccatgcttgctcaacacagtggctcactcaattcataacagaagagaaatgtgggcatttctaaatacagtgactcacaacaacagagaactttgggtgggaaagtggaaactgagctcagccaccaacatgtacctaggacaacagcataattttcttatcaaatgtatgaaggaacttgttttctgacttgggagaaatgtagcttaatcactataatctcttaaaagatcataagaaaagaattgcggctctgtttctgaatgtccaacaaaacattaaaacctatgagattcctcttcagttttggagttcactatctacatagatggttaactacattatttaaagtgttttctatttttaaaaaagcaaatgacacattcagaaatgtttctagaatttattttttcctgtctgctccctattattttattttgtccatggatattctcaaatgatagtggaaactctatgcatagactatcctcatgcttgcttagaaaacctggtctgtggctcttgatttaattatggaaaggaatgggggaaaatgaacccagagttctatttgtgtatccatgacacaattaatctaagatatggcagagttctacaaattcaaaagacttgaaaataatttatttgctataataagaagaaaaccattttttctttaactgaatttcttgccctttgtggcagaaatcaaatgcctcatattactgtagcagtttttctcctcacaatttaatctaggacttgttaaccaaggctatttctatattcagcaagattacatacaaactcaattttatgaattatgtgaatgctactgctgagaaattctactggtaatatgactatgcaaatggacaccaggtaaattaaaggcataaaagaggatttataaattgaagaaatacattataagggtttatttattttta

SEQ ID NO: 55569 - DNA, 1812 bp, Bovine  19866880729856
ctggtgttctgcatgcacttctgtgtttaaaggtgtattcctgatgtatccatggagagatatgtactccacgtccacctactcctccgccatcttgttctctgagttcaatacattttaatataaactgtactagcgtactccaactatatgttatgtatataaaatgtattgaaattattcatttgattactacaaagtttactttacatataagaatgaatatattttcttaatttgttttttaaatcaggcatttacagaaacataaacatggatttttctcttcatgctaatgaaaacctagcaagatatttagagaacaaatctctgttgcaaacattgacagaaaatggacaagactgatcagccatctgtactagacatttttaaagctcactgaattaatcagttccattttaccgtatcaaattgcaaaaggcacactggtccattgaatttgccctaactgaaatgatacccaggcagcacttaacaggaatgtgcaagagaaagaactttcatcaccgagctgctgaatttgcactctcaggcctctaaggcaaggatttttttttaagtttgcagaactgtgagtggagaattagcctaggctcatatgattcccactgatagtcttagatctaaatgggtttattgcagttttaacttcaactctaaaagggaattatgttaataatttttttcctgatattttgaggtattattcattcagctttgtatttcagcttcagagtcgcccaagtctgctgatctttctcctattttcttaattttcaatttcaagatctatatttttaattttaattttttaataaaaatttttaatggtagactttttgatggaactttgttaaacgttttttggttgtcgttattgttgtttaattgctaaggcatgtctgactctttgcaattcaatggacagtagcatgccaggctcctctgtcctccactatctccctgagtttgctgatattcatgtgcattgagagagtatgctatctaaccatctcatacttctttaaaaaagctttgaagccaggcattgacttctcctctctaacagtgaaagtcttggagtagaaggctgtttcatctacactgaaaatctgtttttcagtgtgggcaccttcattagtgaactagattttctggataacttgatgcagattctacatcataacttttggtgcttcacctttcacttttatgatatgagggtgggtttttcccttaattctcattaaccaacctccactagccctaaatttttcttctgcagctttgtcacctttcagccttcctagaattgaagacagttagggccttgctctggattaattcttttatatttatttttaattggaatataattgatttacaatattgtgttggcttttaaggtagtgtttgatctgatatcctatccagaccactaaaactttctccatgtcagcaataaggcagttccactttctggtcattctgtgttcattggagcaacacttttaatttccttcaagaacttttcccttgcattcacaacttgggtaactagcacaagaggctaccttttggcctatctgggcattcaccatgtcttcctcactaagctttcgatttaaagtgagggacatataactctttgcttgaatgcttaaaagccattacaggcttattaattggcctaatttcaatattgttgtgtctcagaatatagggtagcccaaggtgagccagagagatgagagaatgctggtcagtggagcagttagaatacacaatcta

SEQ ID NO: 55570 - DNA, 1858 bp, Bovine  19866880816461
cactatgagctgcagggtcctaagagcctatccaatacgggtgctgacctatgagtggcgcttgggcaacaaattattgcggacgggacagtttgactctcaagaatacacagaatacccagtgaagagtctttccaatgaaaactatggggtttataattgtagcatcataaatgaagctggagcagggagatgcagctttcttgttacaggtaaggtgctgaatattttgctttttttttttttttagatcataggagcttaggctcttgtcagtgtaagaatgaaagcattttgcaaatccatggagcatattatgaacagcttgcctgttctatttagagtgtctactcatttattttcaaggcaagtcattttagtagttaagatagtttatgtgcctataaaataggacagaagcttatgtgaatttgaatagatttggtgatgaggttggttattttgagtatcacagtaataaagtgacaaatcttaaccagctttttttttttttagatcaaatttcaaatattaacacatattttttctgcaagtctaaaagctcttgcaatccattatctgtgctggttttaagagtgctttctttttcttgtttatttattaactcaatgtgtggtgaatgtacattttgtcgttggcttacaataggatcacagatattcaaagggaaatcaatatagttgtatttggtatataatgaattgagaaaattaccacttgatgtcattatattttactgtatttaaagagatagtacatctgtgttaaattatatatatttatttaaattatttttgtaatctaaatctctttttgagctagggtttaagcatatcttaaaagaatatactccttttcattattattttgtcctagataaagtttgttgtaacagttatagtgtttatgctactaaaagaagaaactggatattatatgttatatataaagcaatcacaaaaattatgattaaagtgtttcaaacttaattaaatcttgttcattggtaatataaattattattaataagttcttactcattagagaattctctaatatggattgccttgggacatttaacttcctgaaataggatattaggtattaataggtaaaatataattgactaaccaaagaatatgaatacatcctctccactggatcttaccacctcttggttttgcaatctcttttattaacattcagttgaacttaaggcttttctactataattcttcaagtgaactgttaaaattaaaaaatccctaggactgatacttacatgatgatctaatttttatccctaggaatatttaaaaggctaagagaatgtaatgtattactctaggggtaatttaaatggcatgatatactttcattccatatatatatatattattatttatatatatatacatattatttccaaagaaataagactctttcaaaagcaattatttttcacatattggtacaaatggagtactttactttctttcattatcccttcaaaataaaaataccccataaaattaactaaactcctttctccaattctttcagctttatacacattctgcttttctttggtgacactgttttctaacttggactatattagattatgctcctctgtgagattttcatttgttctttattatatgatccaaatcctatttcttgagctagaagacaagctgagactggaagaaacactagctccattctcccatcccagattcatggggtgcagtaagtagatttcaatagctgcagaaagggataaacctgttgtggattgccccatggagggagagaaaataaccccaggcattaa

SEQ ID NO: 55571 - DNA, 1534 bp, Bovine  19866880831238
tcaaaaagcaaaatttatgacccctaaaagatttttcttactttaagtttctactcaaaatacttacctgcagttattctgagcaagggcatttaaaagagaattaaaaattcaaccatactttgcttaaacaatttgaatgactaactgcagtaattagctttgagtaaattcacaaagtaaatagagccttgatacttcataattaaatagaaccccaatttcctttcagcatttaattcggcattcaaattatcaagggtgctattttaaactactttttggaaataggtgtaattttttttttgttcttacattattaatgagctttcattcagactatagattggcaatatttatataaaagaaatgagtataagaatagcaaatagtatataaaaaacaaataaagaacttcctcccccctatcatcttctagaagttttaatacacatcataacaatttaaatacattttatatcaaaataagatataaatcagatcagatcagatcagtcgctcaatcgtgtctgactctttgagatataaataactatatattattattatttcctcaagcaactgggtgagactatattttagcttgtatcaataattgcaacttataccgatgcaaacgcatttcattgctttttcatgacagttggatatttcaaaatgtgcatttccaagataggaacaaactgataattcagtttgaagaagtcctggtggtttgggaaaagaaagaaccacacttgtgttagtgcagatactttatttcatggctctgaagtgtgttttgcaattcattgtgtcattagacacaacttaaaaaaatcaagatatttcccttttcctttattttttttctaattataaattttatttttacaagagagttgtattgtgtctatcattttgtggtgcttataatgaaaatgcctataacaacaatggagtctaattttagagtacttttaatgatttttgtcagctaatagattctcttaactttatcctatgaaatactagtcctgaaagataagatgttccacaagtaaagcgtttttattaagtattattaatccctctaggaatatttcccctccatggatcacagtcttttcatggtgaaggggcttgtgtaactcaatgaagctatgagcctggccattatgggtcatagtgaagagttctgacaaaacgtggtacactggaggaggaaatggcaatgcactccagtattcttgccgtgagacccccatgaacattatgacaggggtaatccaagtctatttcccaaccactagtgccgaagaagctgaagttgactggttctatgaagacctacagtacctgttttaactaacaccaaaaaaaaaaaaaaaaattaaaaaagatgtctattttatcataggagattggaatgcaaaagtagagacacaagagatacccaaaataacaggcaagtttggccttagaatacaaaatgaagcaggacaaaggctaaagttttgccaagggaacaaca

SEQ ID NO: 55572 - DNA, 2681 bp, Bovine  19866880938512
gaaatgttggaggaaaaattaaataggccagttgaacctgaactgaaaaatccttaaatttcacatttaagaagtgagtgtggactcttcagcctagtgagcaagaaataacgtgatctgatctgtgaaaacagggacaggagaaatgtgaatttgaaggcaggaaacaaatcaataattatttaaaaaccatttcaatattcaaggcaagaaatgatgaggatatggtgatgaggatatggaatataactaatggtgtgagaaggaccttagcaacctattggaggtaaaatcaggtgggatttggcggtaagttcatatatatttggggattctcagcatatacagtatggttaaatataaattgatgggataaggaagaatgtgtaatgtgaggaaaggatgtaagacaggcttctttaccactgagccacctgggaagtcctttacataattatagcgcacacaagcattccaactatagcaggccttgtaatatcttgttaaagttgctcagtcgtgtccaactctttgcaactccatggactgtagcccaccaggcttccctgtccatgcagttctccaggcaataataggaatgggttgccatttccttcttccatgtaatatcttgcccctaacgaaaatacaagtttcaagtcagccaaaatggtcacaaattggtaaaagcagatgataacataacctggaacattctaattttttttttcaaactggtcttatgtaattaaaccattgagtaaactattgtgcatctcccatataccaccaaaaggaggaaaagcgagcaaagcagaaaaggtacctgccctcacaggttgtacagcctattctgtaaatgaaccaaagatggtcactgagttttggcccttagcttgtttacttcttcaaagcagactgaggcccattagctctaaagcttactgactccagactcgtatttttacacattaaaggaaagctctttctctacacgcagaacatatctggcaccaaatatgtgtgtgtgtgttttttccatactaacaacacattctccaagtttctatacaccaactgagtatcctacaatttaattctgacagaaactacctcgagttaataccaaccccaaaggttaagggcccaggcggacaaactttggatgcaagtgcgagtcttgggttgtcatctgtatttctcaacaaccagttatgaactgagagattccatactccattcttcaggctcgataatttgctacaacagctcacaggcctcagggaaacacattcctttgattactggtttactgtaaaggatattataaacaataccaatgaacaggcagatgaagaggttcatagggtgaagtaccaaagggtctcaaactctgtagcttctgtccccatggagatagggtatgcacctccctgatactgtatttctgctgaacatgtgtgttaatttaaaaaaatgcttcaaaattttaaagtgccatatttgcatggtatgagaagctgttttttgttttgttttttttttaagtagccatggggaatgcatacattttttcttatcactacaagttaactccctatttagcatcgactaaatgattcttatttagcatagatcaaactgaatacagaatagaaattatatttccattcctttatgaaagaaagccactttcagtttaaaatttcactcttctctaagatatcagccaaaacatcaaaaaacactgttagtatttgtatcttgtgggattttattactatctatctaaccaatgtagtgtagaaaagactaatggattttctgagaaagatttatatacagagtcaactactttaagaggaacagtacaactttaattatttttatcctacaatgtctcttttgaatatatgtcatgtctcttgaggaaaaaagactttaagtattcatataaaataggattattgattcattcagcagccaatatattgcctcataattgtatttcatgaaaaccattgtgttaaatattctaacttgttcatgccaatttaaaactgtcaaaatgtaccttgaaagaatgaccaacctggaatcaatggcaggaatttaaaactttgttatatttgtaaaccttttggaaagacctgatcatttcaattgctatataaggatgaagagactcaataattatctggataattctatacaataaaagttttctcagaaaaagagagaaaatttaggtggatttaaatgtatatgattttcccctttaaattgaagttagttgtccttattttgtgtgcaaagaaataaaatcaagtcagttattcctctgttagaaactcctgctttcagcattcctgatttttgcaagcttgtgtaggcctttgcagtaaataagttacttattccgattccccacatttttaaaacttgtagtaactatgtttaaataaaactgctgtctcaaatattttccttcatagaatataaataattccagagagcatcatattgttttaagtctcaatgaaaattttccttcaactttactatatgcctgtgaaagtcactcagtcgtgtctgactctttgcaacccatggactctatacagtccatggaattctccaggccagaatacacgagtggatagcctttcccttctccaggg

SEQ ID NO: 55573 - DNA, 3112 bp, Bovine  19866881328991
taaaatatatattatttatattacagttacaagaaattttcttgcaccaaaataattgaacaaacatcaaactgagaaaaggtatttaatcacaatgaccgttacttttagaaacataaaacagaaggagcataaaataaataaaatcttcagttttttggaagataagtttttctgagtcacaaaattcaaacaacacattctcaccaaagtagtgtgaatttagaaattagactctgagtgtcatagtaggaaatgattttgtgtaatttccatagttttacacttagtcttcgttactttgattttaaaatgtatatattgatttggatgactgtattttatttatttcttcatgatactgtgtgtacctgacgtttgttgctgtgtcacttcaccttgttttagtctgaaatgtattttgatctagcttgaaaagaaattaaggttaattcatttagtatgtatgtgtgctcagcactcaggcatgtccaactctttgctagtctatggattgtaacccaccaggctcctctgtccatggatttttccaggcaaaaagactagagtgggttgcaatttcctcctttaggagattttcctgacccaaggatccaatccatgtctcttgcgtctcctgcactgacaggcagattctttaccactgcgccacctgggaagcccatattgtttcaaatattggtattaggaagagttaagccttaaacttttcatatttgcattgattgcttttaaattttctcacaaaagcccagagttgtgctccttcactctgcctggtctctctcaggattctccttcctgccgagatcagcgtgctttctggatgctattagtttgcaaatctaaggcatttgatatttactgaaaaataaaaatagatttgaacttgctcatattcacctgctgttctcaagctgaaaatacccaggaaagcaatttggaactgcataaaactttttttttttgtttaatttaaggaaattattatgtttaatgaaagcatgtcagttcaattttgcaacagaggagcagaaccagtaagctttagatgatcatatcttggtagaagcatgaaatcttttgttgtctttttttttttttttaaacccatcagtcatgtataaacttaattaaaagtaaagcaacaccatgaacaatatgtcattttaatttaacaaaatatcatttcaatgcatttttaattttcctgagactttacaaaacttttgttggtagttctatcaaggaagtacatcccatttccagttcttctatgaacacatggtctccctcagaatgacatggtacgtgatgaggagagatgaaaatgtataaaatgcttggagggacacttccaaaaccaaacgtaacaaccagccagcagcagtgcttatgttacctattattagaattattcatttctagttgaattttatttttgattggcactgggcaaggagatccaatcagtccattctaaaggagatcagtcctgggatttctttggaaggaatgatgctaaggctgaaactccagtactttggccacctcatgtgaagagttgactcattggaaaagactctgatgctgggagggattgggggcaggaggaaaaggggacaacagaggatgagatggctggatggcatcacggactcgatggatgtgagtttgagtgaactctgggagttggtgatggacagggaggcctggtgtgctgcgattcattgggtcgcaaagagtcggacacgactgagtgactgaactgaactgaactgggagtccatgtaaaagatgaaccttctcttaggcaagttctgagcccaaatccagattctgcttcttctaaattgtgtgcattgggcaagagacttctctcagagggaatgtctaaaccagtaaaatggaagcgtctggcacaagtaggtgcagaaaagatgttctttctgtttcttttctcacagatgtttgaatatgtactgaagaactactttgaggggggaaaggcccatgatctcctctgtttgtatgttaatagtgataggttttgccagactcagaaaacaagcaggaaaatgggtcctgagggtagctaccgaggcactggagtagtgggattacagcaattacaacaaacacctcatccacttggtgtttccctctagttgtttgtgtccttttaaaatcactcttacatgtgaactttgaacacatcatcccaatgactccttctacatttccattcttttgcctacatttaagatcaaactgtaagagtagcttttcctagtgaatgaaatggataatggggaatatattgtgacactgtacattgtctaactagaaactgtcattcagaacaaagtcagaaagagaaaaacaaatatatattaatgtgtatatgtagaatctagaaaaatgatatagatgaccttattcgcagagcagaaatagagacacaaatatcgagaacaaatgtatggacatcaaggggggaagagggtgtggaatgagttggaagattgggatcaacatatataccttattgatattatgtataagatagataactaatgaaaaccttgtatatatgtatatatgtatagttcagggaactctactcagtgctctgtggtgacctgaatgggaaggaaatccaaaaaagagggagtatatgtatacatacagctgattcactttgctgtacagtaaaactaacacaacatggtaaagcaactatactccaagtaaaaattaattttgaaaagggaagtaaataataaaattaaatgaaagtaaataataaaattaaatgaaagcaaataataaaattaaatgaaagttttaagcttcatgtttacaaatctttcttaaattactagtcacagttcatggaaccaaatatttttctggcttatctttcctcagtactctgctacatgtctgcagaagtgctcttttgagaagaaagaaaacaaaatgtgcaaaggaaaaatgtatttttatttctcaaaagtaatggctttaaacctcacctagtctctctgtctttctctgtccctctgtcctccctgccttcttccctttc

SEQ ID NO: 55574 - DNA, 1594 bp, Bovine  19866881333647
ttctgagttctcataatgtaactctgggactttactggtggctcactggtaaagaacccatccacctgccaacgcaggagactgcggtttcaatccctgggttgggttgggaagattccatggaggaggaaatggcaacccactccagtatgcatgcctgggaaatcccatggacagaagagcctggtgggctacaatccacggggtcacaaaaattcggaaatgacttggcaattaaacaacagcaagtaattaaggtcttgtcttatctttttgtattaatcataaggggtttgaaaatccaaaggacagttagcatttgtattttccagaagatttcgtgtaaaagagcttaactgagtctacaaaaatgggatgggcaagagacaggaagtagcatttaatggaaagaaatgttagtagcattacaacaacaaagaatgaaattggtctggaatagcagagagtggagctcagagctattatcagactttttgggatgaaggaaaacctctgaggggttgaaaatgagtagctgcatccatagagaaatggaaagtagctaagtatgtgggtgccaggcaagaagaaatggtcagggtgtggaaaacagcctggctaatggctggaaggataggaggcaggaaacatagaaatttatcgaaattcatttttgtgtgtgaaaaatctctgaggagagataaaggtagaaaaacaaaatggctgacacacacagtagaagggactaagaaacagtttgctgaaaatgatcgtagacaagaagtttttttttttttcttattattcaaaacacagattatgcttttgagaacaggaataatatttagttaacagacttagagttttgaatctcatagcatttattatcagacagatggtaatatctgtgaataaattttcaagtttaaattaagtcatgtttctttaaaaaaatttcaagatgattataaaggtgacaggttacttttgaattgaattacattattcatgttgatgccattatttctatcaaattcttttgggaagtgtttgtatatgattctttctcattaaaaatcagattaatatagtttatctttttatgttttagacatgtatttagagcaatagaatgtatttatctgaaacaaaatagtccaagaaataggcaggaaaagcaaagatttttaaattaatatctgggtgagaaaatgctggcttcaaaggtttctttgatgtccaaatattacatttgcatcaatgaacacaagccaagacttccagaagttgttagctgagtccccgtgcttgtaattgcttctatttctcattaaaatatccatgaagtgttagaaaacttaagtaacaaataaacaaactgtggcccttttctcaaataaggacacttgttaagatataatcctacaaatgtgtgctaaagaaagcacttgaagggccatgtcacttgtccattgtctacataagcaaatcttcctttaagtgagctgatgaagggcaccattagaatctgaacaaaatgtataccatcagttattaactgaacaataatatgaattgtatgtttgaatggttg

SEQ ID NO: 55575 - DNA, 645 bp, Bovine  19866881448216
tgctttctgctactctggctgatgaggtattcagaattgaaaatgttgagatttcacaggtcactattgtggggattatcagaaatgcagagaaggctgcaaccaacattgtttacaagatagatgacatgacagctgcacccgtggatgttcgccagtgggttgacacagatgacgcagtggtgaaaacactgtggtccctccagaaacatatgtggaagtggctggtcatctgagatctttccagaacaagaaaagcctggtagcctttaagatcatgcccctggaggatatgaatgagttcaccacacatattctggaagtagtcaatgcacacatgatgctgagcaaagtcgaacagccagccttcacagggagagcgcctatcagcaatccaggaatgggtgaagctgggaacttcggtgggaataacttcataccagcaaatggcctcacggtggcccagaaccaggtgctgaatttgatcaaggcttgcccaagacctgaaggattgaacttgcagaatctcaagaaccaactccaacacatgtccgtagcctcaatcaagctagctgtggattttctaagcaacgaggaacacatctgttccaccgggatgagatcattttaatccacagatgcaga

SEQ ID NO: 55576 - DNA, 729 bp, Bovine  19866881896554
ttttattatctaatggcactacaattttaatcaaggtatacttttctggatgttaaatacgtttaatatcactcaatatttataacagatcccaaaaggagactgtaggtattctgtttctataatgagatgctctactcaagtaattttagttggcagatacattgatgctgttatttattaaaactcttcaatatataacttcatatgtgtattaaaaaagcaataactttgattctaaatctttaacttacaactataatgaaagtatatacttccgcagttgaagaataagcaattaaacacttaatatacctcagtgaactgtgcaaaatgtaaaaatagaaaattaaatgcatatacacaaaagaaaatacaacattagcccactgtttggaggtaataccacaaaacccccaaagaacataggacccaaaccataaccacaattgacagttccagagcatacccgtgagcatgttgatatgaaagcaataaagtatttatcatttcaattaaaaaaaaattatgtaacttcttttcctagcagatatgttcctttcgcatagtctagaggacctttttcactatttgaagatgaaatgagccataatttttctgaatgccaagatctgtaacctgaaatacacacattatctggaaatactgacttctagagagaaaggctcagaataattttatagcatgacatagaagagtattagaaag

SEQ ID NO: 55577 - DNA, 2555 bp, Bovine  19866880139576
acattactttgccacaaagctctgtctagtcaggctatagtttttccagtggtcatgtatggatgtgagatttggactataaagaaagctgagtgccgaagaattgatgcttttgaactatggtgttggagaagactcttgagagtcccttggactgcaaggagatccaaccagtccattctgaaggagatcagccctcggatttctttggagggaatgatgctgaagttgaaactccagtactttggccactcatgcgaagagttgactcattgaaaaagactgtgatgctgggagggattgggggcaggaggagaaggggacgacagaggatgagatggctggatggcatcaccgactcgatggacgtgagtctgagtgatctccgggagttggtgatggacagggaggcctggcgtgctgtgattcgtcgggtcgctaagagtcggacacgactgagcgactgaactgaactgagctgacgtgaagcactagacctaagcagtcttttgaatttagaatatctgtagcataaaggccttgcagtttaggacaatggtttagatctttttttttttctctgctggatttctgtgactacaatattttacctaaatttttgtggtgagaaaagttgagaaaaaatacagctgctttaggaatttgggaagaaaaaaatttccatgccatttggtttaaactaagccatcgagtatgactaagccactaaatcatatacgaaaagaccagaaaaagggttttcataagtgttcacatctgccaaattggaaccatgctaaggatattgaaactattatttcatttgatcttctaaaccaaccctgaaaggtaaatagatttatgttttacagcatgagctgaggctgagaactattacataccttttgcagggtcaagtggttattaagacatagctggaattcaaacccaagttttgacaaaccctgaacattatctaccttgctataggcacctgctcataaaaattgctaacatatccctaagtattaggactcttaagttagagttgcttaaagtattatgctacccaaaattaaaggagaggagagagccttcttttattagagcataaatgcaaatgtcttttccaaataatatacccaccaacaggaagcctgcagaaattaataattgtgccagctatcaatcttttcatgcataaaatcaaaatttgttactctgcctacagatgaaatgtcattttatgaaaagctaataatatgcacccacaagtttgcctgtcaacaccaatgagccaatagcaatctgccaaagctaaaattgagtataatattaaaatcatttgaacacaggcataaaattgcatagtctattcaaactgtgttgaatatcaatagaatttagcttttgaatgtaccagaggcttttggagttacaaaattgtggatgattatgacacaagagttcatcgtgacatacctagttgcagagctaagaactctcaagactaaagacagaagtgaattcctccaggatagaggtggggctggcatgtaacctccttgcttgtactctcaccccagggattattcatctttaatcccctcttgttgcctgaagttgtataaggattattcacttatttatttaattctatcataatcattccagaaagtaactgagacagcttacaaatagaatttttaaaggtggaataaactaaaagcaggagaaaaacaaagatcgagttacaaatggatgacagtgattgagatgacagaaagcataccatgaagacctatacatgttgctttaaattagcttttaatttggctgtaagctttgaagtacaaatataagaattaaaatttgagcatttgtccccaccccactcccccacatcccacctatttaatcttcacagagcactgaactgattttctatacttcatagcagcttcccactagctatttcgcacctggcagtgtatgtatgttaatgcatatgtatacttacagctgatccaccttgttgtgcagcaaaaaacaatacaccttgtaaagtagtaattggtcatagcttcagataatttatatcattaatcgaaaaaaattttaatatattttgcgattaaatggaacttgaactgttaaataataatttattaagaacataattctgattacatatagatactctgaaaaccatcatcttcaatttaatgcttttgaaactttcaaataaatggtgttttataagttagttttattggactttgtattatgcttaattgttttagtgttttggagaaggcaatggcaccccactgcagtactcttgcctggaaaaacccatggatggaggagcctggtgggcttcagtccatggggtcgagaagagtcagacatgactgagcaacttcactttcacttttcactttcctgcattggagaaggaaatggcaacccactccagtgttcttgcctggagaatcccagggatgggggagcctggtgggctgccgtactatggggtcgcacagagtcggaca

SEQ ID NO: 55578 - DNA, 3861 bp, Bovine  19866880462782
tcatgttcgactctttgcgacccaatggactgtagccttccaggctcctccatccatggaattatctaggcaagagtactggagtgggttgccatttgaagaaacttggaacactgaaagagggaactggtcagttctatgagtgcacttggaattaatgaaaacatacttgaagccaaagctaaacaaccggaataaaaacaacagcaaaaaatatcccttccccttttattgcgagttaatgattgagatacatacaaactgatggactgtttctgagtgtttgctggtatctcagtcaatctcatttcagtgacccgtgttcgttcgtttttcacaaaccttatttttgttaataaataataaaagtccttttgaatattttttgccaaaagcgtttgtcaagatcaaactaaaaacatttctattaagttggagaagctgctttcttaattaaatgtaaaatataatgaactctttgttaaggaggcctgccttaagttaaagatgttgctgaggataaggggcttgagattcatgtctgtctccctgttgttaacaaaagcacccttttgttatgcacacacagctcagaatgtctttccttttccttttttaccatttccttcttttaaaattcaagacgatgatgacaaaacatggaggttaataatacaattcaagccaagcatattttttgtgggaaaacattgagataactaaggcaacatgtgtatgtttcaattatgtgcattctttctcagtttttcattttatcctcaaaaagagggagacagaaggcatacagacactagtagaatctctggggtactgagctcatctttgtttcctggggagatgttagctttggaagtggttccctgttcagcattaatcgcttatttataatgtgtcaatgagtttcctcttacacttaatatgggaaataatacaaaataagcactgtgaaaaatatttggcaaatagagcaaagaagccattctgttattgttatttctagtttcccagacaggaactgaatggaatcacattcttgtgctaatagtcattagtggagtttcaaggtgtttaaagatttaggaaagtaatattcacaaatctgttagcttttatattcatcgaagaaaactattaattactggcttgggtttataaatagaattctgccatagaaatttataactttttaaacttttaagacacacaataaaaatttaaaaaatagaatcgttaaacatagctgttaaaatataaagttaaaagagacagaaaatacataaaatgagtagaaaaagatggaatctatctaaacggaagtagacttgaaataaatgtaaaatcatttttaaagaaagaatagttacaagagacatactttattatcaactaatatgtcagacttgagagttttaactggtgatactttcattaaaaatcaatatgcaccatgatattaaaaaaaaagaccactgatatcttcaggagcagtgaaagaatacagtgtatgaaaaaaaaaaattatcatcctactctgtattactcctaatagaatgtttaattctccctcatggtcagacatctatgggtaaacaacaataccctgaaaggctagcaactaagatggtgcacgaaactgtatcacatgaaaaagtgacacagttgaaggaactgaacatgaagcctggaaaagaggagacttgggcaaatgccaggaaaagagggaggaactttctctaagtgttagaaatgctgttatatgaaagaagagccacgcttgttctgtgtccaaaaaaccatctgggctccatatagaggaaaacatgctgaaagtcaaaactgtatcattatgggatagggtgccatattagtcacagttcttttgctttcaagtagaaaaatgaaaaaataaagacggggtacttattggcccacacatttgacaaacccaagggtggagtaagctttgggaacaggacatttaagactctaacagtgtcatagtgctctctttctgagcattcatctccttgtgtttggcttctttctcaggccatacagggtgtgccaaagctgtaaatcacagggaaaagaaaacagctctctctctcatcttctaatttgtgagttattatcgagaaccgtggctgagtctgcatgggtgcgaaggtgccacttctgggactccttaccatagacagggggatggatgctatgagagattcagcccagggaagtcatgtgcctgtggctaaaagtgcagtgaccatgactgacaccagcagaatcaatctgagtggaagagaggacagtagggagctgtgccagcaacaaatcaaatcaaaaaactacaaacaaaaatggatgtgtaaaaagaagtaaagctgtacatcacagctgcttggaaaggtaatgagtttctcatcactgaatgtgttcaagcggaacttgcagaacagcttgtcaatacaaaaaggtcacagaggtcaactgtgggaccctgagcaagtcaccctctatttccttgtttagtcatagattcagcattgagcacacacagtgtggcaggccatgcagacccagtggtacacaagacaggtgggtgcctgctctggaggaacttataatctacagtctctaacctgtaaaagagattacctccatcacatagcgtgagtgtgattaaaacaaaagatgtatgtggaaactgacaattataaaacaatatatgaatacaagatagggcttccctggtggctcagttggtaaagaatatgcctgcaatgcaggaaacccaggttcaatccctgggtggagaagatcccctggagaaggaaatggcaacccacaccagtactcttgactggaaaatcctatggacagaggagcctgggaggctatagtctacggggtctcaaagagtaagacatgactgagtgtctgaacatattgcagaataactaatatttgtgttgggaaaggtgaaaaggatttaaaaccaaacttcatctctagaggaatttcatctacacatgctataagcatcctactcaactccatgacacagggcttgtgatctaatcccaaatgaattattttctccaataaagatcaagggtaaaaatactcagcctatgatttagggctaaagatttaagaaacagattatctcatgagccataaacatggatagagcttctaggacgggggtctggctgagatccatagtaagcttgacctgagggctctgtgagccagcacaaagcagggcaacttctcagagtagctagacggtctcagcacccagccttcttgaacaccattggcactggcttgctaagctaaagcttaagggacatgaaacaaccttagaaggtgggtggccccatcatgagagacttaaattaaagagcttgggaatagcaacatcttatccagcaatgtgtctccagtgcccaggcacagtgccaaacacaccttttgtgtggatagtgtaattagtgactgctgcagtcgcttcatggcaccccactccggtactcttgcctggaaaatcccatggatggaggagcctggtgggctacagtccatggggtcgctaagagtcggacatgactaagcgacttccctttcacttttcactttcatgcattggagaaggaaatggcaacccactccagtgttcttgcctggagaatcccagggacgggggagcctcgtgggcttccgtctatggagtcgcacagagtcggacacgactgaagcgacttagtagcagcagcagcaaaggctttcctaggtggcgctagtataaaaacaaaacaaaacaaaaacctgtctgcc

SEQ ID NO: 55579 - DNA, 793 bp, Bovine  19866880527158
tacaatttcaaaatgttcacagtgatcctaagtaggctagggaaacagaaccgcaccctccatggatcacttcagttaccgtttcaccttccttaatcagtctgaattcaggttcaccttcaattttgacctttggtattgtgcgtcctgaggcattgttttaggagacaaattatcatgttaatgcagtcctttaaatttaccaaaacaggaaacttatttcaacattggtgttgctcaaatgtcaaagtgctttcaggttttatgaaatcgattttaaacagttcccattgtcttcagattgagtactatttaggagaacaaatgactcctgggtcaattagggtgctactaaaatgaatttcatcagctttagcacttaaactaatgtttaattgatccatttattcatagttataaattctgatcacatatatatataacacatatataacaaaatgttatatatgactatactttgtgaatcacacagtatgtacaaatttcagttgctctaatgatagctagtgtagatcttactttaccatactggtgtctattacttgcttttcttattatattttaaatttaatttttaagtacactgtatattatattttttatctaatgggcataactaaacatcaaaaaagcccaactttatgcctacctttaagatatgattttcaggttttgtgggaaaatgggagtacttaccttctctatgtgaatgctgcaaatatttactaattaatagttaaacagtccttcaaatgcaaaagttgtgttacat

SEQ ID NO: 55580 - DNA, 2782 bp, Bovine  19866880621993
caattcttcggcgctcagccttcttcacagtccaactctcgcatccatacatgaccacaggaaaaaccatagccttgactagatggacctttcttggcaaagtaatgtctctgcttttgaatatgctatctaggttggtcataactttccttccaaggagtaagcgtcttttaatttcatggctgaagtcaccatctgcagtgattttggagcccaaaaaaataaagtctgacactgtttccactgtgaaaccatttaggactcatctattgcaagttatataaaactgtctaggattcgtatatcgattagcctggtggccagctatagtttatcaaattctggtgccatccccacatcctacaatttgaagttgctttaattaggaaaatattttgggttttcaaatcttagaaaaatgtgtttgtttatacataaatagcataagtgtaaaacaaaacaaaacatgaaatcagaaccaatcgcacacttcccccaaattcttatgtataaacctgcctttctatcatttgaattttccacatatagaaatccttaagtaacaaattggtgcttctcattcaatactatcttgttctcaactggaagatacaagaggtttgtttcttacttttattttgcattctatgcttctagtgcttctgtcatatcaactccctgtagctgcttctgcccacagatccatagctggctttaagagctgtgtcctcttcctacaagtggtcccacttatctccgaaatggctgttccaagatgggggttaacaacagggctttgtcattgtgatgtttgtatctataatacattgtgcaaagctgcctttcttcttttgacattatattgtaagtatccctctatgtcactttaactcttcaaaaactttgtcctttataacactctaagacattttctaaatacaaaagcaatgattggtcaatgcaaacaacttggcagaagtaaaacagaaaaacacaagggatgataacacactatttatgcttatcattttagtgtatatacttccagtattttcttttgttattttttcaccttttctttttcacttattattctttaataaatgttttccaagtgattgtgtatttttttacactatgattacttaatggctgaatatcagcatagtatctgttgtatactattatcataattttaccaatgatcatgttaaaatttaattaaaaaaacaaatgtgatgactatccttatacatatattatacatatatacatatattatatttttagaaagttgcattaaaattatactactgagcccaatgtaaacaaaagacattttaaggcacttaagatattttccaaattgcattctacagaagctgttacaatatacaggaatctaccagaaatatgagggtgcctactttcacacactgtggctgctcaatagaatagtcaaagaattatggttcttcatgaatttattccaaagaggaagaaacttaaactattctacttacttttgcaataaaatacttgcatataactctgtctgcatttaggttggatgcctaaggacacagtgattatacttcaacatagaaaactaggctaaagtttccaagaaatgacctctttgttaagtatgcaaagaaaaacacattcgggggtgtttttcttgcatgtgtgtgtgttagtcgctcagttgtgtctgactctttgtgatcccttggactgtagtccaccaggctttttaaagctttttgaagaatattgttaagacatgttgaccatggttgttttgtgtgtttaataggtggaggcttaataaatgatgatagattgtgatagatcatgctgatgtaatatttataatatgtgacttggattttatattttaaagtattttaattacccccccaaagcttaaagcatagaatagtagaatataaaataaatgcaatttttagcacaataatgacacagtgatttttaaaagagggctaaatgtaaagaattgattagaattgttacatacagaagtatttcatggaaaataattttatgtaaggtcatttaaaaaagtgcacattcaacacacaagtattttatgaatcatatattgtcagtatctgccacttgttattcagaaaaaaactcattttctgtatgctcctctgctctaacagcaagattttgcatgtttgaatatttttaattatgccagatgaaaactccataaaacttcacttttatcactaaaacttacatgctaaaaccaatttatcacagtttatacagagtttacgattcagttcatatgtatgaaaaaatcttactaccttcctcactcagcttttcctttgagaacactgttaacccaattcctaataaggaaactgctctgcacatttacaggaaaaaaggcacgggtttccttggcaactggagccatgtgcagtctctcagaacggctcctcctacactcaggtttcctaggtagcaggctgcatatattttataaagacaataggataatgggagagatattaccctgttcaaacttgcatgtgaaaagcttcaatgggaaagatgcatttgctataataactggcaatttgagagaaaatattaattgtataataaggttgcttcctctgtctaattcaggattaataatttaattcaaggtccaaaatatattatgtgttcatattttgaaccttcactaccaaattaactcatataaatttgccgcgaagcgaaaggtaaattgcag

SEQ ID NO: 55581 - DNA, 1014 bp, Bovine  19866880743075
cccacacagccttggatccctgaccctcacttgaagaaatagactgattcaggggaaattctagatgagctctgatgttccgagcacatggctgatactttctgtcccgctgtccttcccttcacgttatttcttctgcacataggtgtggttgagaagccagatgtccagtaggacactcagtgtgtgtggccgagaatgccacttcttcaaggctggtttgaagtagtgccttttcaacttggtgtataaagacatttaacagcttgacaaaaagtgaaaaagttttttttttttgtttggttttggttttttgaactgtgcccatatagtatcagggatcttagttccctgaccagggatcgaacctgcacaccctggcagttttaaccactagaccacaaggaaagcccctaaaaagtgaaatgttttgttgatacttttacttttattgtttttaaatatctaattgtagctcatcttatagcccaaatacctgcctagtgggctgtttctgctccctttcctttcctatggtttggaccaattcagtatatgtacctttaaactcatgactgcctcttaagtctttgcgttcatcattcagtgcagaatagacactgttcagtttcaccatttccatccaagtaatgtaagcacttgtaaatattgcttataaaaaggtctttcaatatattttgaacttttgtttcattgactcaacttgcatttaactatggcctaagatagaaaccaggtcctctggggttagtttcttttgcaattgttggtatctgtgcctcaaatttacttgtggaccagaatagtcagataaatctgggtgttagtaatgagaaaatttggggatagcatttgttcaacgttctcaggacagcataaccagggaagaaattccctgattctcttggggaaattcctcaacttcctttcccagttcacagagctatgaaccaaagcataaaaggatcttctaacttggctccatctgtggcc

SEQ ID NO: 55582 - DNA, 798 bp, Bovine  19866881022835
gcagagacattccaattgttacttagtaaccactacacaaagaaaatatggacagtaatgtgattaaaacatccagcatagtgtggtctatagtaaacactcaacttacactgttttaataaatattgaacaaaaaataaggccacaaagcttgactcaagagcattataaattcaagtcgatctcacttttatgagaatactgacccagacacccctgaaacaaaacaggatgccatgaaaagagacaatccttaaccaagacaacattatgcatatttttccaaataaagaagaattaaagaactcattagaaaagaagaaatttagaaagagatctgttttgtacgattacaaacattaaatctgttataatcatgagaaattgatgtatccacacctagagtttttgtcttctctcatcacagagtctagatttttcaagggaagaaaaaattctgaacatttaagacaaaattctaaaaataacccccaaatttgggttgctttgctgcttgaagtttcacattttcagttttattattaggtttccaaatgtctcatgatttctttctgacatactaacatttttgtaatcaaacccaccagcagagtcctcacatggtgccaccactcaaagtgggcagtgaagtaaactgcatggaaaccaggggggcagtgtttcatttgaggggtaagggggagggaaatgaccagctaccttcactgaccgaaggacaagagcatcaccagatacaaacatgctcggttccacaggctccagaggaaggtaggattt

SEQ ID NO: 55583 - DNA, 3938 bp, Bovine  19866881094895
cccagcttgagcagcagagctttagatttatctcggtcccacgttgaggacagtttttggaaaagtgttaacctcccagtgtaaccgctaaacaatgaaagaaaggcatgcagtacatcaaagcaaatgtaagggaatatagtcggaattaagccacagatctgtgaggccctggtgcatccagaatttacattcctctctcttcaaagcccgtgtgtttcccagactcttccttggactcctaaaaccagccttctactcccacaactgcactcttaagagacccgtgtccatgacctaactgacaaagccaaggaccctcataatgttttcattgtgtgtcctggtttaaactttgtaattaatcatttgcatgactgtttaacacctgccttgccacattagactacaaggtcccataaggacatgtcactttctacactctgcatgctcactgttttatatccagctctaagcacgacgcccagtgtatagtagtgacttgacaaatattgttgaataaacagaaggtaacttggggccaccttgtacggaggtttcaaatgtcaggctataaagcataaattcattgcaaaggcaatggggaggcactaaagatgtcttgggcttccctgctggttcagtggtaaaggatctgctgccaatgctagggacccgggttccatccctggaatggaaagatccccttgaaataggaaatggcaacccactccagtattcttgcctgataagtcccatggacagaggagcttggtgagctacagtctgtagggtcgcaaagaggcggacatgacttagcgactaaacaacaaaagagatttcttagcttgtgccacttgggtttgacaacatgctggaataatcattctggcaggatgtggcagagccatctggattccaccacagggcccacaggggtagacacgtaacctcctgcagcagacaggtgaacttaaacaaagcttccaaacaaataaatcatgtgagtcaaaaactctcttaaccagttttgtttgttttgttatttatgtgtgtgctgtgtctctctcctctcactgacatgactggttaaccatccaaactaattaaaatcacaggcaattagggttacaaggctgacagccaaaatcagaaggaagtggcttctggtctatctgttgttgttcagttgctcagtcatgtccaactctttgcaaccccatggactgcagcccgccaggcttccctctccttcaccatctcccggagtttgttcaagctcttatcctttgagctggtgatgatgccagccaaccatctctgatctatttagtaagacctattgctgaaggagctttaactggacttcagttttgtaaatatctgaaaatggcctgagcatctgtccaatttctccttctagtaattttattacctttcacatagtgtcacaaatgtttcattttctggtctgcagtggatggcagtctctctgagccaggaaaaaaaatttggctggagagactctggtctaagcttgggtatcccttgggaaacaacctcaattacaagagaaaaagatcaggctatgggtcagtctcaatcagactagggcaggtttttatatcgtaaatcagcatcgtcattcacattttccttatgctgacttcctggagctccatctccaactccatctgttctagactcttgtttattcaacccagtggatttactaaacctcacctcatctcatgagccatgaaaccatattttacaaactatatggaaaatgtgcagttaacttattttcagacattcctggcctatactacaacgaattcattttcctcctgaattttatttcagtaaagacagccaaaaattccaaattcagcattctatatctggtagaccgaaagaagtatgttttattttctaatatttgaaagtttcgagattattttaaaaaataaaaataaactcccttcagagttgtaaactttggatattcaaaatcttatttcccctcaaattattaggactacacccatatataaccaaagaaagcatttatagtcatagacccaacaattctaacaatgtggtatcactattctttagggacagatatgataataagaagaaataggcatcaaaggagaaaatacctattaaagggaaaccattgacatcataatggtcttcgtactttggaatatgctagagatgggtcttatagcaatgaattatccaagcaagtatgtcactgtttttcctcactgtacctgtccctggtacctggtatagcctgacggagcaccaaatatatatttgttaaataatattagtggatgaatgaatgatctttgatttgaaataaataccttaccggcagtatgatactgtgttctccccacactttttcactcataatctattgcatctaaaggtcacataaagttcaatttctgagtccctgggtggcctgatgtagtcccatggccttaaacaccacctatatgctgacaactctcactccacctggacttcttccctgaatatcagatgtatctatccagcgatctacttaagtacgtacatgtgtgtgtgcacaagagcgtgaacaaacaatgtatccaaagctgaactctggatttctaatcatctccccactccacagcctgcctcacatatactatatcatatcattcagtcttaatcatatcagcaatgataactccacacctcagactaaagacttggggtcgtctttgcccctcttcctctgcatcctatacccacctcctcagcagatcatttgctctatccttggaatacatactgagtccaacgacttcttcccactccagcactaatccttctattccaggtgaaggaagttctctaacggggcagttaaagtaataagactggatgaaaaaatgccatagaactaagtccaagagtccaccttggtcttgcttgtgcctgcagatagcttagaatcaaggcctgcaataaatctcaggtctgagagaaccaccccctcgcttaccaggatatgtcagatggcccggatgtatgtcttggacaaagccatgctctccgtgtgtcctcagtctgaccacagctatggaggttaatgatttctccagagcagtctgagttttcagagtctggtttactagcagcctcctgaccatgcctgaagagtgataattcatgggaaaaaatgtcctgtcttgacaaaaaaacgggggaaagttttagttacttcacattacagactaatctccttcatctgaaggtcatgctgcattcatctcactgagatcaataatattggccatttatgacattcattttgaaataagaattgtatttttttaaaaccttaagaagctatcaaatcctgttttcaagacatgcctgtctaggaccagtcccttccttctctttttcatgctcagtgacatgctctgaaccacaattcctacagccttaggaaaaggctttcatttttgaaaagtttacacaagagaagcatcaacaatagcagtaattgcaatgcaaaattactctccctccctcgaaaacattttaggtcctcttgctatccaaaaagtaaatgtcactggaaaaataagtttctgtgaaaatatctgtataacaactctatttaaaatttattttgctgaattgtaattaatgattcacagagtaacattttcttgctataaatcagagaaggattacctctcaggagaatttttgagttttaatttttcctgtaatgatctatgctacatcccaaagtacatctgctggaagaggcatctcattttctctaaaaattcacttgagcaatgaattacaagactggaattaaatagtcatttttataacaaatcaattattatctttagacactttgtgat

SEQ ID NO: 55584 - DNA, 1569 bp, Bovine  19866881096981
atatttaagagaaatcccttattggttgaaaatgtagctcacaggccaagtgtatacttgatttgataagaattacacataaattctggtcagagattctaattttagtttcagttgacagtgcttatcactatgtcctttttggaagtcaccagtcctttgactcccataactggccagcgcattggctcaaaccctggctgtcctaatggtctgtgggaggctatttggcaacaattattggaacgctttggaaacattatttaagtcccctaaacttcaatcttctcatctgtaaaatggagaatattatagtctttacctaatagggttttttttttttaaggactaaaaaagtaatagtgaacaatatatgaatttaaaagcgtttttaatgtaatgtttggtaaaacaaaatctagtatgattgttataaatatcatcatcaccatccatcagcattttgtctggttgcttcttctcagtctcacttactagggcctcttctatttatcccttgaacactgtttctttagggatcaaaattaagcccagtgttcttttctttatatatatatatatgtttatatttatatatatatatatatattttttatatatatatactccctgaaagttggctgttctcatgttaactatttcaatgtttgccaatttattcttccaaccattcaataacactttggggcacccattttatgccagtcactcttttaagtttagggaatatagcagtgatcagaacagacaaaacctttgcctttattcaaactgcattctagaaagacagaaggaaagacacaccacatgagtggaccagtggatgaataaatccacgaatgaaggaatgtcaaatggtaaaggccatggagaaaagtagagtggagtaagaggaaataaggggtgtcaggggcaaggagaggcttctgccttatacagtgtgactcagaaggcttactgatacgatgacatttgaaaaaaaggctgtagaaatgtagataccaagctaagcttctaactaagagcacagcactcctggaagagagaacagcaagtgcaaaatcctgaggcttgagtgtgattagagtatttggccaacttgacagaagtacagttatctagattaatgtttcatgccatgacttgcataaactttctaattaattataataatttgtagattaaacttaatgtttatacaaattaactgaacatactttttatttcttctagtctttatatcttttatttttactctttttgtgatttaaaagagcctctagtagaatgtgtatggaagaacaatactgagaatctttgttcttgatattaacatgaatgtttttattatttcactattcagaatgatataaatgtaggttttggtagacactccatcaatttaaggcaaatattttgtctacttcattcctgatttgcttagatttttttttcttatcatgcaaggataaaaatgtagtaattggcttatttttttgcacctagtaagataataatttagttccttcacctttacctgttaaagta

SEQ ID NO: 55585 - DNA, 997 bp, Bovine  19866881192741
tatttatatatgtattatttagaatgcagcatattttgttttatttttggtttttttttggcctgtaccacacaacatgtggaatctcaatttcctcatcagagattgaacccacgccccctgtgttggaagcacagagtcttaactactgaaccaccagagaagtcccttccgtatcatttaaaaagtgtgtcttgaccttgtggaactatggtatgaaaacgctgtgagtcatgtttggttctaggtcatctttgacttcttatgaattctttttagctgtaactgcaaggttgcctggaaagagactgcatagcaccacttgtcaaactgtaattttgacaagcaatattttctagaaacttttcctcagataaagcgcattagaaccattttatagaaatctttatgtgcctataaaagtttaccatgcaactcattcaaaagagatttagttgctgaatggtgacagtacagtcgaagatcatcctaaatatttgactcagtataaaaattaccatgtaaacagtaaagtacagtacgctatgaaacaaaaagcttgtattaaaggggttttagttatttatgggattgaaacaatgctttagaaaaagttatttatgatgaaacaagtgcaaattatcagaattattaatacatagcacttttgtatactttcctcatagtcttttcaaacatgctactcacttctctaatgttcctatgaactattaaactcatattggtaaacttctgagaaacatttgttataagaacagtctctgacaagggcgtatcttttgacatgtaggccagtatgggtattttatctcgttctgatgcacttactgtgcggtacacgaagactctgagctgtttgcctccaatggtctcaagtttttgtccattgtaaagttcattgaggccaatttttactttcaatatatgattctggagaattaatttaagaaggcgcgatccatgctcagtgtatcat

SEQ ID NO: 55586 - DNA, 1274 bp, Bovine  19866881328111
ttcttactcagtttttatttcccatcagtatctagcatatagcaggtactcaatcaatatttgtttaattaattaatgttactttaaaaattgttgtaggtgcttcctaattacagtaatgttttacattccattaagtgcagtcatcaatgttcttaatgcagtagactatacactttgattcttgctttattcttattttaaagcttatctattcaaaggacagactcctcactcaatttatggctactggtgacagcagaggttagaaaaagctaattaaagattcttatcaaatattatcaaataaagatgccatttaaataaaaaattacatgaatatcctcacatgttcccacaccattactttatgtgacatgtttgtgctgaatcagagaccttgcaccggaaatctcattattggttttcttaggattatatacttcttagagatgaggaattgctcactgatattagcaattgctttgctaatattgatattagcactgaaggaaagttgcaaggctcatggtagcctggggttaaaactcccctccaggtcctccccaccattctatgccaaacaaagaactctctcacccaaagaaaaaaatggacattaaggttgattacgcccagctcccagctggtccagcctctggccgatctccaaaattccttgccccaaccgtttaagagataactactctgaacaaccttggagaaaaacagacccccttaagacagtaactttccacatacatgcctatatatacctactcttttcttgggtaagtgcagcagctcgctaatctgactgctgccccttcttgcgtcattaaaggtgatctgttcctgtaaagtgccggcctcattcttttttgaacctcgccttctctagctcccttaccttacaagcaccacctttcttgtatggtggtggggggcatagcagggggttgtgagctggtaacagtggcccagggggagtttggtgtttgcctgtgcagtgtggctaagtgagtattaccgtttggtgcagatataaatggctcagcacctgtcatcctaatcacactttcatgttttctattgatcccctgtagtcatttgagcttctgacccttaatgtgaatgatatgatttagggacatcaacccaggtgccaggcgactagagaccactcccataacccaaatgttaccagaactattcaaactagccagtcctaaagctgtttacctgcccctgccttgcctttcctgcagaaattc

SEQ ID NO: 55587 - DNA, 2767 bp, Bovine  19866881329583
cataacagaagactctacacatggacatcaccagatggccaatactgaaatcaatagataagaaggtgtcaaaaataaatgggcactgattttactttatgaagcttggaaaatagcactcttttaggagaggtaataatgagcagtttgctccccttttctcaatgattccatcctattctgaaccaccagctctggtctatgttgctaagcctaggaaatcttcacatgtttgtagtctgctcttttccaaactccaaaagaacaacttaataatgcagctgagaccaaatcatcaattagcaattcatcacaggatatctagttcacaggaccttagatagaagcccatctcttagtgtaggagacactaacagttacatctgcaggcgtagcctcctagtacatagcctggaaagaaattcaattaaatcaacattctgagctctggctgtaacatttatgttactgctgtacatctggtgtccattcaagagctcaaacaaaaaaggaagtcacagctgacattattggtattggatcaagcaaatagtctattgctttagggagggaaaaaaaaaaaaaaaacctaaatgaaacaatgagggcttgaaatatcacagagtaagcatggacagcctcactgaaagaaatttgctccatttggagaataagtgataaagaaagtaaacacaaatgaaaaaaatacacaggtaatacacatggaaatcaagtactttttcatagaagaaactataaataacatatgatttatgtatatataaagaatgtatgatttatatgggctttccagttggctcagtgggtaaagaatctgcctgcaatgcaggagacatgggttcagtccctgagttgggaagatcaagatcccatggaaaaggaaatggcaacccactccagtatttttgcctggataatcccatggacagaggagcctagcatgctgcagtccatgaggttgcaaagagttgacttgaagggactgagcacacacacatgatttatatattactttagcagaaaaaaaaactcaatggcattttaaaaagttaaaaagacatgcctattcatggtcttgtgtgtggaagtggctgtaaattccttcttcaaatatttactgagtatttaacttcataccaaacactattctagcaccagcattgcatgttgaacaaggcaggtatgattctttccttcattgaacttattttcttattggaatggatagaaatattcaagtaaatataggcttaaaattatttttgaaattatgaattctatggagaaaatcacagtaagaagtgaaatcaggagttagtgaggtgggtagaaaattatgttggatggtggtctgaaaaggcctctttaaggtgggaatttgagcctgtttgaagagtagagtacaggcactgagctccaggaaaagaaagaatgacaacaaaggctgtgagccaggaaaaatcttggaatatttgaggaaaaggaagataagcagggcgtctagagaacaatgtatgaggaagagggaagtcagagacatggaagtcgaagacaagttcagagagcagtccctctctagctagtcatttgttatgacttacagttcagctatggtttgtccagaagtcatgtaaggatgtgagagttggatcataaagaaggctgagtgccaaagaactgatgctttcaaattgtggtgctggagaagactcttgagagtcccttggactgcaaggagataaaaccagttgatcctaaaggaagtcagtcctgaatattcattggaaggactgatgctgaagctgaagctccaatactgatgcgaagagctgactccttggaaaagaccctgaatctgggaaagattgaaggcaagaggaaaagagggtgacacaggatgagattattagataacatcactgatttgatggacatgaatctgagcatactccaggagatggtaagggacagggaagcctggtgtgctgtagtgcatggggtcacacagttcaggttaaaaatgtgaaataatagttcatttcactggtactttaaaagagggcaatgatgaggtcagctcttggctgggctctggattaaaggaaatttctgacgttgacagctgcccctgggacagtgattggtatcaaaaaccaggtgtcagaagcaagcagttaggaggaacaagagaggaagattttgggggtataacctactcttatcttttttctgagacatgtttacaatacctctttggactgagaagcagagaaattccactgatttagaagcataagattttgtgttttcactaagaagttcctaagatattgtgtaatggaaatatttctttctaaaccttgagtatattctccatgggttattgcaattgtgttatgcaactcctgattcctattagctcttatattttatgatcatttgagacttggatctagctgtagcaagactgaggcaagggatggttaaaatctgaatgtacccagaatcagttaagatttcagatttggggaagaagaaaagttcctaacaatttggcagaacaatacaacaagacaacagatgataagcagaaggaaggtctggagtcactgagcttccaaaagtcctgtgtttaagggaaaattacctcgtggaatctcagaatggattccatggaatctgagagttttatgtcaaaatttcaacatctagaagaattcaaagaggaaggatttgtcgggaaagg

SEQ ID NO: 55588 - DNA, 1648 bp, Bovine  19866880068347
ctgattggtgtttttctttctggctatttactctgtataataggctccagtttatccacttcattagaactgattcaatgtattctttttaatggctgagtaatactccattgtgtatatgtaccactgctttcttatccattcatctgctgatggacatctaggttgcttccatgccctggctattataaacagtgctgcgatgaacattggggtacacgtgtctctttcccttctggtttcctcagtgtgtatgcccagcagtgggattgctggatcataaggcagttctatttccagttttttaaggactctccacactgttctccatagtggctgtactcgtttgcattcccaccaacagtgtaagagggttcccttttctccacaccctctccagcatttattgcttgtagacttttggatcgcagccattctgactggtgtgaaatggtacctcatagtggttttgatttgcatttctctgataatgagtgatgttgagcatcttttcatgtgtttgttagccatctgtatgtcttctttggagaaatctctatttagttctttggcccatttttagctctattgacttccgttgaggtatggaagaggaataaaaccccatatctacattctaacacagtcccctcagtgactctggggattttgctttgacattcactgtcatgttttaagggttggaatattatgtctgtagggttattttctttcaaaataaaaacatactcaagattgtgacaacaacaaaatcctctaaccaagtaactatgtcattttctgtatgtacacatcaagtcgtgtaccacacaggtcatcagtcccaaggaagcagaatgccatgcaccactcacctaccttgaagagggggcccattgcaccttggtgttggagtcaccgaggagaacacaccagtcaagcactggatggaacagtgctacctacacaaagaagaggcagaggaagatcagcttcagtagtgacctttggtccccagtggccagctgtctctcctgatggccaactcagggtgactggcctacgctcacgattgtcttaaactatggtgaaaggaaccttgatccttcttgtggaatctgaaacgctgaaagctgggcggtgtgcctgagggccactgacacacaggcttaagcagaaccaaggagttctcattgtgcctgaaacagggaaagatattcccacacaaagtgataaacccagtacaggctgtgtggattccctatctcttcataaggaagagttctagggccaaagcccattcttttgtagctaagtgggggtgaaaaggctgcaggcaggagactgctttttctaacagctcttttcctttatttgtagttttatagaagattcatctctctctgctcttagaagtgattctgcatttctcttagtgactcccttccagtgttcaaggcaattgtgacaacttaactatatggaggagagcatcagttttgagtcaggcagagtcaggtttaaatcctagattcattgaacagctgctgctgtttggcattttcaacctttgaactgggattatttcaaggaataaagtgattgcagatggaaagtatgggttccaagaagacggtaccaagaaaca

SEQ ID NO: 55589 - DNA, 1248 bp, Bovine  19866880442511
ctgctgctgcagctgctaagtagcttcagtcgtgtccgactctgtgcgaccccatagacggcagcccaccaggctcccccgtccctgggattctccaggcaagaacgctggagtgggttgccattattcactagttgatataaaatgcttaatagtaggccaaaatctcttttggactcaggccttgcattgctaatgagtgatacacaaccactttagcgtttcaaatggcagtagccttattggttacagtgctcagggtgcattatagtctgcatattcgttttcaggaactaatagaatggttgccttaaatgagttggcagtatatcgagataatttagagcatacttatgtcaatctttgatcttaaatattaaattggagtgcataagatacatattttgggacaagcactctttcagagtttaggctcataaatatattgattaaggcatcatatgtttaaagtactgatagagacatctcatctgatttgtttatttctagtgattcttaagtatctttgtaaatttgatgaggaaacaagcaagggcacctggattgtctttacatggtttttacttgatattgacctatatcattcctttaagctggtatttgatatgggatctctgcactgcaattttagtgatttctgaataggactgtaaattaagtgtattctcatacctttagagctacaagttcttattttgctttattttattttgtttctgaattattcatacagttgcctcaatattctgctttgatttgctatagagacctaggtttatttatgttaatctcataagaatgatgccaaagtatttttttctgttggctttgaaggtgcttttggaatttataaatatttcagtaggtagactcaatgaattttagagcaagtatagactctgaattcattctaatgttaaatctcagagagtttgagacttcgggtcacaaacatagaaccaagctgttactagaacctacatttttaatagtcattgaataaagctgttcttggtgttgatataactaaatactaaattaggtgttccacaggattctagtggataaaaattgacaggtggaagctaaggctaaattatctacttcaaatatctgcctctatagaaaaaagtcacaaattacttgataacaagggtaaaatacaatagcaagatgcttctgcacccagagtattgaagtctttcctgccatcaagaaaccttacta

SEQ ID NO: 55590 - DNA, 4433 bp, Bovine  19866880522399
gcctcctgcattaacaaataagtatgctctcaaggagaaagaacaaactcagagaaaattgggttgtctgttctcgaagtctaaaaaaaggacttctttcctcagggggaatttagtattttcataatcacgtagaaagtaaaacatgtgcctcttgggtataacattaaaataaattaattttgctgccttattcataatggctaatagcaaatggagtgtttatttcttgactcctcttgctcataaaaccaggtttttctaggaccttcatctcattaaagatgaatagctgtgtcaacttatagggatgaagaatgtggtctctgcttctctatttttggcattttattaataggtgagtggtcatggggaataacaagaccctaaagcatcattgggaaaagactctgatgctgggagggattgggggcaggaggagaaggggaggacagaggatgagatggctggaaggcatcactgactcgatggatgtgagtttgagtgaactccgggagttggtgatggacagggaggcctggcatgctgcgattcatggggtcgcaaagagtcggacacaactgagtgactgaactgagcatcaggatctcaacttcatgttatggaaatataatcgtctgtttttttctcttctgttcttgggatgtacaatgtcttctattccttggaaatatgttcacttatgattagacactgctgacagcctttagattttcctctgttcagcccaaattgtggttagtttttctcctattttgtcataacacacacccgattttccttcacctgttcttccacaattagcctctgtctgtatacccattctcctgaaatactagataatttattcagtcatgtatatttctttggaattcttcaagtttggtatggaagagaaacaattcattgcagatatagatcactacacatcatagcttctagtaagatgagattccccccccctttttttttttttactaaagagtattaaaattttaaatagttgacttttatgatgttcaaagtattggcaaggtatgaatgagatctgcaattgacactggagtcactgaaagattcagaaaaacagcagaccttctaggaatctccccagctgacaatgttgtagctgttaactggaaccctaattgttgttattcagttgttaagttgtgtctgactctttgagactctatggactgcatcacgccaggctcctgtcttctactattccctggagtttgttcatattcatgtccattgagtcagtgaggctatctaaccacatcatcctctgctgccctcttctccttttgccttcaatctttcccagcatcagggtcttttccccaaaagttggctccttgcatcaggtggccagagtattggagcttcagcttccgcatcagtccttccaatgaatattcaggattgatttcctttagaactgactggtttgatctctttccagtccaaggaactcaaggtcttctccaatactacaatttgaaggcatcaattctttggtgcttagttttctttatggttcaactctcacatccataataatgactactggaaaaatggtaactttgactatacagacctttgcttgcaaacaatgaagcagaagtaaatacttttctgaaattcccttgttttctctattagggaaccctaatatttcctcacaaaatatataagcttttgcaaatgagtagttgccttgtaatcacaggcagatttgcacaagtctgggaatattttgagggaccataaatgtaaccattggttttgtgccctctttgatttttctttccaaagttattaacagttttgacatttggctaagaagcaatattatccaagcttgttttaaaattgctacctgcccacttactcaaggtaaataattcttcctagtacattgattgcagactaaaaaacaatatatatatttttaaatgtgcttaatttcatgggactaatttgaaggaatagttcttacttgcaaggcagagttaagcctgggtaaaaccagaataatcacccttaccagagaaattgggggaaaaaaaaaaaaaaaaaaacaaactcctgctaagcatttcttctcagctagaaactggttgagctgaagcacaaatgttggattcttttgccttgttctaaccgagggacaagaggtacgtggctgaatatgggagatgagcagtaaagggaagatactgctacctgcagggaaagccaagcaagcagggctggatgtgttatctaatccagaagaattcttcacataaaaggagaaactaatcttcagtaaaaacgctaacatgtatcttgaagccattttttctgaccttcagattacattttacatcaagattaagaaaagaggaagttgtcttttcccaggagatttctgccccttaacctggtactgttagtcttaaacatgattaaccatttgacatgacttcccaaactacagactgtttgtattaaacacatattacagtttattttcctgcatataattaggaataatcattgccgccagaatgtaaaatgatacatcaacaataagtagagataacagtagctggatgcaagaaaaggcgtacaaagcacctgaagcttataattacctttctctccctaccccatgtatttgtgtcatgatgcatctgaggtaacgtagacctcaggtagtcattaaaatcacatgaatattccactaggatttactgcaaataagatatcccattggtacatggatttttatcaataaaaaaggttaataatttggagtgtcttttaccaaaacacgatttcttttcaggaagtttgaatttatacatttaacagggtactacttctgtgctagtcactattgctgctgctgctgctgctaagtcgcttcagtcgtgtccgactgtgcaaccccatagacatcagcccaccaggctcccccgtccctgggattctccaggcaagaacactgcagtgggttgccatttccttctccaatgaaagagaaaagtgaaagtgaagttgttcagtcatgtccaacttttagtgacctcatggactgcagcctaccaggctcctccatccatgggattttccaggcaagagtactggagtgggttgcccattgccttttccaagtcactttgaaaaatacacaaagcaaagaaacacgatctctcttcaagaaacttataatcccctcaaatgtggagcaagacaaaacagatgaagaagaaatatcatacccattgaattttgctaagttgtacagtctgaatggcataactttgtagaaactttgagaaaggaggtcaggagagatgtgtaaaggaagtaaactagcattaaattttgatggtggagaaggtttatgtagattaagataaagtgaggtatcagagatggtgcccatgattcacaggtgtttccaacttagtcttaattagattctcttcctattatctgagctttattacattctttcacttaaccaggattttctaacatatacaaataattacacttagcatgagagagagattcaaaagcaataaaactccccaatctgatctagcttagcaacagaatacggattcatcaaactcctagacaacaaatacaaagtaaggtcctttgttttatcattccatgggtatgcgaaccatatggctgtaaccttcctaacattttctctactcataactcagaaagtcctccacagcaggccaaacaagttttggacaatccaaaaacttacactattttcagtttcaggcaaaatttggcaggtatgtttgtcagagttttgctttcatttgacttgttgaaagtgaaagtgaaacaacgtaaaacaacatataatcaaagtggtttcaatgagaccttacaaagtccaaaagaccatgaattgactcacttaaaatgttctatagattatgttttaatttatgtaaaaacagtttttcagatttgtgaaaattacattttatctatgatattgtgaaatctgtgatattgtgatatctgtgaaatattgttttcttctttatggcatattataaacatctgtctgcaaaacacaggttgggcattttaagtcatggcttcattaagttatttagcaaaatatcttaatcaaatcttgcctaaccttatagctaaaggcaggtttaaatttagcaacttaaaatgtttcataactgatttgcattgacttgtatgcattgtactaagtcacttcagtcatgtccaactctttgtcaacctatgggactgtggcccaccaggctcttctgtccatggggagtctccagacaagaatactggagtggtttgctgtgccctcctccatagatcttccgacctagggatcgaaccca

SEQ ID NO: 55591 - DNA, 1648 bp, Bovine  19866880577630
gtgtcctggcccgtacctgaagccgagtcctttacgcgttctaccaaaggagtgatcgtgcctgccgtctgggtgctagcccagagctcctatctgacgtctgcccaagagctttgttgaaaagctacttccctccacgtccagcccattttcagccagggccgggaaccattttgctttgctggctctttgtagtttgatcgcttctgctgtgtctcagtgggacgttccatgttttatttgcctattctgctcactgcagctctaaaaccataggacctgccaattaatctattgtaagccattgtgtttttcagaccacagcaagctcaacttcagtgaaaatggacagagagtgatgaaacagggtggagtacattagataagatgccccaaggagtaaggacactcgtacaacctccagggacatttcttagccatagattagtttacctgtaatccccttgagcgttagtggttcacagtccagcgctctgtatcgttcatatcacataggatcagagggctgcctggactacaaacttgaaactttttttttttttttatttcagaaaatttcaaaaagcaaaactttttttttaactgcaccccagcaactatctacatagcatttacattgtcttagatattataatctacaggtgatttaaggtatgtgggaagatatgagtaggttataagcaaatgctatgccattttacataagggaattgacccaaggaggggtcctggaaccacattaatcctgagtgaagactgtatagactctggaatcaggttaggcaggtgtagaattctagttctatttaatgatggaatgactttagaaaagctgctttaatctctgtaaatcttaatttcttaatctccaatataagcataaatactaaaatagccttacatagttgttaaatcagacaacacctataaagcacttagcacaagaatggtaaaataataataatgatcagctttctaacatggtagctgtttgatcactgtcatcattttcttctactgctttagagagtgtcccaccaactgctcttatgagtgacgcttattccctagaccatcccaaagtgaaacatcattaacatctttccttcttctttcataatctcacattagattcatggaatgatcaatattttctaatatagttaaccaatatttagtataggaatgaattgccttcaacatattgcacaggttttcatgtatttggtatttttggttcccttaaacacagtcataaccattcatgaattagtatacctgggcttagacaggaaagagccatcttcaaagagaagaaaaaaacagaggcaagttgtattggacatttagttcatgaatcagggttctagggatttgagttcaggttttcagaatgaaatagaagagaatgaattatagctagtgacagcagagaagaaagaaatcctgatgagctagacataagggccatatttcttaaaacaagagtgaatcatgtcattgtctaaaaagcaccagtgtacctaacatgcaagagaatatttataacaaaactgtcctggaaaatctgggacttagtggttactatcagctaagacaacaagtcttggagagtccttcatatata

SEQ ID NO: 55592 - DNA, 3288 bp, Bovine  19866880594599
actgaagaaagaaaacaagttctcagtcccacttacaactgaaatgcttacaaaatgttgactcatcctaatggaaactatgagactgaattggtacacatatgactaaaattcttcaatatgaaagaagcattttcttaagccacatccttttaataaatatattattaataaatatcagagctagactagagagctgattgtttagaacatgcagcagaagttgtggcttaagcctcagtcatctaagtttcttggctttttgatataacttagattatacatctcattgtgaaagataattaatttggagaagctcttaacaatattcactgaagataacttgtatttaaagccttaaggctttgaggaaataaatttgctgtcttcattatataaaattcacttggttttttgatgcacaatgtatatatgaaaaggtcatgtttcccaatcaatcataattgtgataaatgttgacaactgaagacaaggaacaaactcaaggtaataataaggaaccactctcctttcctcactgaatgatttctgatttgtgtctttgtctcaacccagctcagaggtcacagactgtggggccatatgtaaataacttcatcccaaacttctcctagtcctaaagtaaagattttgtctatgtaacatctaaaatcccttccaatgtaacactgaattactatgttatatccttgtgatatccaaagaaatatgtcctgggttccatccctagtacctattttgggacttacctggtggctcagacagtaaagaatctgtctgtaatgtgggagacctgggttgtatccgtgagttggaaagattccctggagaatgaaatggcaacccactccagtattcttgcctgggaaatgccagggacagaggagcctggtgggctaaagtccatggggtcgcaaagagtcggacacagctgagcaacaaacactttcactttcacatggaattagcagcagcaaagaagattaatttttcaaacatgttgtgaaattgtactagaattaaaatgtgctgaaaagagaaaaagcaaatataaagggagaatcaaatgggagatatccctatcaaagcaacaagaacaaacagaatagaaagcatagaaggagcaatttgctgcaaagccaattttgcttatgtgaatggaaagtttatcatctgtcaaaaaaagagaaaagaaatatagaatccctgagaataagacataaactggtatatgttttaaacataaaataatatgtaattatcattgtgcacccagcctgttccagctcattaaagtacttagaacaaaaatcaacatctaaaaaatgttcaggggaaaaatattaaatacattcttaacaaaggtagctttcacataaaaagaaaacaaaaagacattttgaaatataaaagaatctaacatatatagtattataaaaatctacctgcaaatgcattgtagtcaaataaataatgaatcaaaattaaaaacaagggatcaatacatcaaggagtgaaaggcttagaatagaattctgaatctaggtaaatatatcattaaatcttaacatttataaaaactggctgcaaatggtatgttttaattatagaaacaaaagttaatacatttgaaaaacagcaggtaaaaatatgccagagtgccaaaaatcgggaaacttggacagacagggaaggttattgttgtttgactctttgcaaccccatggactgcagcccgccaggctcctctgtctatgggattgcccgagcaagaatcctggagtgggttgcaatcctccaggggttcttatctacccagggatcaaacttgcatcccctgcattggcagttggaattctttactacatagccacctgggttggggaagggtataatagtccttaattttccacagcagagagtaaaaggatattgtttactctctgtagctaataactagagaagcttaggcaatataatttaaagatatagatataatcacatttagaaaagaacactgaatacactatatccctttgaaattagcaaagatacaagagaaaagaatagcaaacaattaaaataaaggatgagtgagtgagtgagtgaagttgctcagtcgtgtctgagtctttgtgaccccatggactatagcctaccaggcttctccgtccatgggatttcccaggcaagaatactggagtgggttgccatttccttctccagggggtcttcccaacccagggatcgaatccaggtctcctgcattgcaggcagatgctttaccctctgagccaccatggaagctaaatataggatacacacattatctaaaagaaaggatacacatattaaatcacatgcaaaaaaaaaaaaaatttagatttaaatatgtgaagcaaaacaaaacatctgataagaattgcaaatcaaaatttctccaaactgagacagagtgcatcctgaaaacttctaaaggaaataaaataagctgtaaaaaaataataattattaggtcaaccacattttttatcagtaaaagtagatgccaaaaaactgaaataccttcaaaatttatagggaaatagtttgtaatctaaaattctacactcttgtggtagattgtacagcggctgaaaaatattcactttctccttgtatcaggattatacatccctatcaatctacctgtgatttttctgagcatatgtcatcatggcactgacctcagattttgaccaggtagatgtgctttggcaattgagatgtgaatgaacatgatatacatttgccatatttaagttggattctttaaataatactgcttgatttggtctgacatcactctcacatccctgccctctgctgtgagaatgaacatcctaaacaggggctactctatcagcctgaggctctgaataagatattgagctgctgagccacgttgagcatgctgagtcaagcagagctgaagctgatctacagccctcatacaatgtgagccagaaataaatttatgctgttgtaagttactgagacttcgagactgcttatcaccagagcaaaactgaaaatacagacattcaaaggaccccttaccctgtgaggaagaagtttattgtgttctcagcattcatttcccctttgttctaatattaccaaagaaactttcatctgggatccactcctttttcaagcaccattcaaatggtttgggtgattctatgcacaagtctcagctccatgaggtgcggatactgttcttcg

SEQ ID NO: 55593 - DNA, 1459 bp, Bovine  19866880667622
agttggacaccactaagagactaacactttcacttcacttaaaatctttgttgtagggagggcattatcttttgcctattaggatgtttagcagcatccctgatctctacctactaggtaactatagcacatactcatatagttataatgcaaaatgtgttcagatattgtcaaatatcttctgaagggccaagttaaaaatcaccagtctatggcataagcccaacattagagtcttacactatcttaacccagcctatatttttgatcttatcctctaatatttatatttctaacattatcttctataactttgctctctcgtcattctcacccctttaccatcctttattagctacatcagtcttgcccttcattatttacctctatgttttgctcatagctggagtgatttttccctgatttctttatggacatatcttactcattcctgaaaatctgtcttgaatcatgcctcctttttaggattcctttaaatcctcatgttagagtgaacctgcttttgagtacaaaatagacgtctattttagtgtttattataagctctcttgtggggcttccctggtagcttagatggtaaagaatatgcctgaaatgcaggggacccaggttcgatccctgggtcaggaggatcccctggagaaggaaatggcaacccactccagtattcttgcttggacaattccatggacagagaagcctggtgggctacagtccatggggtcacagtcagacaagactgagcaactaacattttcactcttgttgtctttggtattctctctttggtattcttctttcttctcaaactcactctagactcttgtaaaaattgtgtacaaattaaaataattcctaatactattggtagtgtgattattcattaatgagagacagtgagggactacaatgcggactttgagaagacaatgacagaactctgtgtatttacatgagactgtattcaaaatatattgctaactgaaaagtgtaactcatagaatactacatatattatgattcctttgagggaaaaatacataaatattatgcttatacatgcaggaaaaatttatgataagatacacaagtaactataacaatggttcgtcccttcagggaagtgagaagtgaggacttttacttctaacattgtctttatgcagagtttggattttttttatcataaatatgaaatacttttaaaattcaaaaagtaattacaaactgatgtgctgcaagctgcactaagatgctagatcaaaaaataatttaaaagttacaattttcagtgtactgtttatggtttacttgcacattcttgtagaaatttacttcctggaagactaaattcctaaaggggatgaagttagcccctgctgggcatggtatggtacccatttttaaggactgtgacctttttacactgcccttctct

SEQ ID NO: 55594 - DNA, 1034 bp, Bovine  19866880768844
catattgagtgcagcactttcacagcatcatctttaaggatttgaaatacctcaactggaattctatcacctccactagctttgttcatagtgatgcttcctaaggcccacttgacttcgcattccaggatgtctggctctaagtgaatgatcacatcatcgtgattatctgggtcatgaagatcttttttgtatagttcttctatatattcttgccacctcttcttaatatcttctgcttctgttaggtccataccatttctgtcctttatagaatgtaaaaacatttaaaaatttaacatcttgaatgttgaaaaaatatgtgtccataaaatggagacaattcaataaataaataataaaacccatattatttcacttgcattatttgcttgatcctgtaaattctacaaaacgtaagtttacttttaggtttcctgaaacttcttgtattttccaggacagcatcttcacaatctcaactgactctgacaattttagaaaattggttcactaaattaagcactcatcttatcctacgtgtgtagcaattagaatgccatgaagtcctttacagaaatccaaaatacacaaatgcatctgcaacatgttcccactgaattcccaaaaagggagaacttactttaaaaaaaaaaatttttttttttaaacaatgaaatctggatactctaaagatcaaccaaggcagttaaatgattcatgctgctggataaaactgctaaatatggctggctgcttttctatacagaaaagttcaccagaggccaagaaaggctaccctcatacactcaggtattttttcacaagagggtgagaaaaatctatctatcccatggaaatgctctacttggccctgaagtaagcactgaaccccgatggatttcacactgagacggtaatatctaccacaggcctttgaagaggccccagctgtgcctgttgccatgggcaaaccggaaaacctgcattaccaagggcttcccggtggtttaacattctcccctcaggcttcc

SEQ ID NO: 55595 - DNA, 964 bp, Bovine  19866880775066
gactctatgcttttttaaacacccagttccaagaatccaaggtgagggagaggtagctaaggaaacagttcaaccagctgttacagaatggaaggaccaatgtaaaaccacaaacaaatgaaaactaataccaagggaatgaaataaagcttgtgaagattgccaaagataaaaataggtttcctaaggatatgacgggaacacgaaacagatatgggaaaacaccacgaagtttaccaaaaagagtcaaaaacaaaacatttcgggtctttcctctgttgtagacgacctacatttctctgtcccatgtctcatggggttgcagtgtgcctgtcagccacatgcccagcctgccccggctggggccacgaacccatgatcaaacagggccggtcagatgttccccatgagatttgatacacagatactgagaatgtgtttctcttccttttgggtttgaacaaagcccatgagctatcttcccaaccgtgtggaaagcccatccacaaaaggaatcagaactcaaatagggcaaaaaatctaggcttctgatgacatcttctgaatccctgaagtcagccatgattgaagcaagccttacccagctttgtgaactaaggtattccctttttattataagagtttaaactgggtttcttttaatcaaaagaggcctgactaatacattggttgagaaggttaactgtcagattaaaaaggagaaagcaaatactggaaggaggaaattaaagtccaagcaaggaaagaggttgaaaaatacaccttcaaaggactttagttccattccataagactaaaaggctcagatgacatcactgaactgtaaatagtcatctttgaagaactatgggaacagacgtcttctggcaaggtggaaagagggcaaataaatgtttccattttcaaaaaggtgaaagaagttacagtctttaaactataccca

SEQ ID NO: 55596 - DNA, 1136 bp, Bovine  19866880812426
aaaaccgatatcttgggtaaattctagttacctacagagtttcttatttagctttgcaaatactgaaggagcttctctttctcctcttctcattccttccttcaccaacgtgttgggcacatctatttgactattactttttcttcaatgtttctacgtgatccttcagtgatatgctaggaatagaactctgtcctaaaaccatgtaaccagaagaagctgtcactcccaggaactgagtcatatttccattatctagtgcctgtctagggtcctccttgaaaaaatcaccagtgattttgagtgttagctctaatatgaaaagttaactttaattgattgattaatctttctttcatgcaccaaaacctgcctagactagatctgaactttcatccctttggatcttgctcaccatcataacaacctgcccttaagcaagccagctaagggaggacacatttattctagatagtagacaaacccaataatctttccctttcaccctactgctcatgttactgggacttgacatatctaaatgtgctcacaactatgatcatagctaaagaaaccttacactttatattgcataccctctctaaaaatacagaattaatgtacacaaggaagaatgaaaatagtcacgctggtacagaatctgtttactgacattgagcagcaaatagcacgactcagagttgttattcttctcagacacactgcttgagttaagcaaatttcatctagttctgcagcattagtcagacctccaagcttaaaatgttgcattgtttaatattttccattactgtgaaggtaaacacagtcattaatccaatatcatggcaacagtaatgttttgttgtaaaaaagttgatcactaagacggtcataaatacacgagtgcatagaaattttgatatacagtgtttgggagaatggataattaatcttcttgaagcatatttacctagatggtttattttataaatcaccataaccctttaaataaggagcttagaatgatgttaaaatattttttaaatagtccaaaaacccttaaatataattcaaatttatattccagcaatcataagaatcaaatcattttctccaataaaacaatattttat

SEQ ID NO: 55597 - DNA, 1141 bp, Bovine  19866880876411
ctgtaatttgtggcctatcagtacacgtatgtggcatgagaaacaagtgaatagagaggtcttcagtgacctctgatttcttcagagtaaacttcatctggagcctaatagagcatcttttgtgttccagtaaatttacataataaacttctattgagaacagcctcaatggaaagcagatgctcatctgactgaatccattaatcattctattctccataggagaatagtcacgaattgcattgatctagagttcaaatgtactacacaagtattttgtttggtgtgggcttgttctaaagttgcgtgcaacaatctctcctatcctgcacagttcagttccgtcactcagttgtgtccaattctttgtgaccccatggactacagcacaccaggcttccctgtccatcaacaactcctggagcttgctcaaactcatgtccatctagtcagtgatgccacccaacaatctcatcctctgtcatccccttctcctcctgccttcaatcttccccagaatcagggtcttttccaatgagcagttctttgcatcaggtggccaaagtattggagcttcagcttcagcatcagtctttccaatgaatattcaggactgaattcctttaggattgactgctttgatagccttgctgtttgagggaactctcaaaagtcttctccaacaccacagttcaaaagcatcaattcttcagcactctgctttctttatggttcaactctcacatccatacatgactactggaaaaaccatagctttgactatacagatctttgtcacaaagaaatgtctctgctttttaatatgctagctaggttggtcataacttttcttccaaggagcaagtgtcttttaattttgtggctgcagtcaccatctgcagtgattttggagcccaagaaaataaagtctgtcactgtttccccatctatttgccatgaagtgatgggaccggatgccatgatcttagttttctgaatgttgagttttaagccaacgttctcagtctcctctttcactttcatcaagaggctctttgatttctctttgctttcttcaataagggtggtgtcatctgcatttatgaggtaatgatattttctcccagcaatctgattcccg

SEQ ID NO: 55598 - DNA, 2189 bp, Bovine  19866880910848
cagagattctatctttctctgcttctcggatttttgacttggtgacatgactgactttagtcagtggacgttagcaaatgtgacacagttggagacctgaaaatctttcttactctgacatttgttctcctactgctcttggaacttgctaccaccttgtgaacaagtcggggttagcctggtctttggtaagagacatgtgatccaggatcgcagctgaagagaacctattatcagataggtggatgaggccatgctggacaatccagccctagcagagccatcacatgactccaagtgagacgacccagaacagaaaggcagagccttttcaaggaaccacctagccaactcagagaatcacaagaaaaggtgcacatttattattttaagacactacattttgggatttgctgttgttctgtagcaaaatggacacattgttattccaacttgtggtaaaattataaataaaagagaacaataaactcaaatgatctctatctctgaagagagtgtggatatgacaaactggaaaatcgatgaaggaacttcaaaattaatgataatgttctatttcttaaactatagtgtgtactttgcttttttcatcctttacagttactttatacatattttcttttaactagttaacataataatcaaaatcataaaaggctcatatgccttggctcttttgaagtctctttactttataaaatcattatgtgtaataataatatagaaccagtgttgaaacacacctcagtcaattcagttcagttgctcagtcgtgtccgactctttgcgaccccatgaatcacagcacgccaggcctccctgtccatcaccaactcccagagttcactcagactcacgtccattgagtcggtgatgccatccagccatctcatcctctgtcgtccccttctcctcctgcccccaatctctccaagcatcagtcttttccaatgagtcaactttcgcatgaggtggccaaaagctagaggttacctaataaaccagacaaaattctggtgactagtagattaaatcacgtattcccctaaattaacatattttataatcttatgtccctttatgcaaatcacgttcctggtcattgtcttctttagctcaatcttcagattaaataccattaccaaagcattcattatttgttcatgaggacattttttcctattagactgaaacattcttctatctatttgctttgactagtatttctaggagcccatttgtattttgaattttgcctggtccatgtattctttggattccaaataccaaagaactatccaaacccaagtttttgaaagaacaatatttcatgcaaagtattcatgaaaaaattatctttacatgttgatgacaaaatgtctatactttggcaacaagtctttgaataaatgttcaattttccaggaaaaacaaaccaacttgtggattacacaataacaaagtatcactgtcataagcacacagaccttcacgttctctcccatggaagggacactctaaatttcagaaatggacagagatagaccctctcgtgtgacagtcactattagataattcttatccaacagaagcaaggatcagctttaagagtaaaacccaaaacagcaatgatatgtaagaaccacatggtaacacatgtaaataagtcatttgatcatgataagaaataagatattcatgcttgtcctttgcagtctctgaacttttcatgaacctggaatgatgagacccaacaagattcttctgtttatctcgaaatgtgcaaagacactatgtatttgacataaagtgatctcattattaaagaaaagaatcaggggggatcctcaggagcaatttctgattttattactctggctggctatttacctctaaagtggctcaagatctctgtatttcacaatgttatcattatcaccaaaaatttattaccttacattgttcctatacctgcaattcaattggtgatgtttttataaatttacataataactgccagcttcaatatgctagtaaattattttcaattgtataaaatgggagatctcagtgatgtggggaagttttcattctgaactaatctactgaatgacctctcttctgtgcttagtatcctcatgcggcctttaggactgcagcttcctaaa

SEQ ID NO: 55599 - DNA, 1639 bp, Bovine  19866881049329
attttaaaagtcacagattctctggtagaataatagttgatatgcattgtgtggtactctgtcagtttagaaaaagcagaattacattttctccccaatctcttacaaatgaaaaaatgtctaattgatctgagagtagaattcagagatcctataagctcttcgttaaacgttagtttttctatattgcttccatttttagaggctcaggaaaccttgttaacctcaccattttcttactctgtagacttgggtaagtcactcgaccttcctgagtttcagaaccaataaaggaattgggctatatgtcttcaggttcattctagctttaacaggccacaaatctaagcggaaaaaaaaatataaaaacaccaccagaaagcatatgtgaaatgcttaagatttgaaatatcataaaaataaatatgagtggaaaataaaagtcatgtaatagaatattttacatacatatctgtaaccttcacaaaataagattatatgtttctcaagagctttgtgctatgagcagaaatataaagcgatgtgaactagaatcttctaagagatatcaatttttctatgcttctgtgcatttttcaatgatttcatgaattgaaaatgtattacattttcaagatttcattcatttaaatgaggtagttctaaacagctaccaaaaattgtccttttaaagtaatggtctgtatttataaatacctttaagactgatgcacaaaattagataatgagtcttcgattggtggcaagaagaaaatacagtgcctgctctttggaaacagagtgcattagattttttatgcagtctgtgtattaagaacatctccctttcaatgctctgaacaaattaaaatggcactctaggtgtaaaaggatatgattgtccatggctagcttggtcattctggttgagttaatatcacaggagactgttgtggacttaatttggcagtgatgattggtgagatgtgggtgcacagaattattcagctgactagaatactgttagctttgtatatatatggttaattataataaacgttaagccccactatgttctatattacataccagagatctgtgatcccaaattaccattctctagtaactaaaggttaagatgcagactgggtgacaaaaatacataaactatgactataaaacatcattatagaacagtaggttgagctccctgtttcacacagcagattctcactggctgtctatttcacatatgtaatatgtatgtttccatgctactctctcaattcatccacactctcctttcccaccgtgtccataagtctgttctccatgtttgcgttttcattgctgccctgcaaacaggttcctcagtaccatctttttagatttcatatgcatgcaataatacacaatatttgtttttctctttatgacttatttcgctttgtataaaaaagaaaaaaaaaaaaaacagtgtaacattctgctgctgctgctgctaagtcgcttcaatttgtgtccaacctctgtgcgaccccatagacggcagcccaccaggctcccccgtccatgggattctccaggcaaaaaatctggagtgggttgccatttccttctccaatgcatgaaagtgaaa

SEQ ID NO: 55600 - DNA, 1116 bp, Bovine  19866881072153
gaattcttgcccacaatagtaaatataatggtcatctgaattaatttgcccattcccaacaattttagttcaatgattcctaaaatgtcaatgtttaatcttgccatcacctgcttgatcacatccaatttaccttgattcacagatctagcattccaggttcctatgcagtgttgttctttagagcataggactttactttcaccaccaaatacatccacaggtgagcatcctttctgctttggtccagccattccattcttactggagctattagtaattaccctctgctcttccacagtagcatattggacaccttctgacctgaggggtcttcttccagcatacctttttgccttttcatactgtccatggggttctccaggcaagaatactggagtggggctgccatttccttcttagtgaactgtgttttgtcagaacccttcactatgacccaaccatcttggtggccctgcacagcatggctcatagctttactgagttacataagaccctttaccaggccaggtctgtgatacatggagatatcactgataccttccccaaaagggaccatgttacaaacttcacctagcagccatgatagatacctgggaagtcaagcatctccttaactgcttttagcatttatggtggaaaagtaagctccatgtgatttcaccatgctcctcaattgtatagactgtggagtaggccatcagactccactccagtctaagtcctgttgaaggagtacctgatgtcactggcttctgtcagagccaacacccagcaaggcagcacttgctgacccaggcctagtctggctaatctaataaggaagggaattaatgaagctttgctctggctattctaaatttttgaatatcttagagaacagccttagtctcttttcccttctcttttcctgtttcttcttagatgatctcatccattcccagaaccctaattaccatctatatgctaatgactaccaaatttatatcagcaacccgcttctctccattgaattccacattggaacacccaactgcctaatttacatttattttgaatgtctcacagatagctcaaatttaatatgtcaaaaat

SEQ ID NO: 55601 - DNA, 1314 bp, Bovine  19866881100030
aattaagagagcaagaaaatcaataaaatgatgccatttatattatctttatttactagcgatgtctattccaaatgaagccttggctcctatgaataaaagtaaatcattttggcagaatgtacctttctcctaaagtaagagagaggaaggagcagggagagagggaaggtgggaaggaggcagggaagagcataacttctagaagatggttgcaactgcagattgtgaataactataaacttttcattaagaagttccttaaatcaattaaaacaatttaactcaatcccatacttggaaaccacatctgactcaatccaacaagattaaagaaagaacattcagctttttgtcatttatagtacattcacaaattaatatgcatccctaacttgtaaaggagatcagacctgggatttctttggaaggaatgatgctagagctgaaactccagtattttggccgcctcatgcaaagagttgactcattggaaaaggctctgatgctgggagggattgggggcaggaggagaaggggacgacagaggatgagatggctggatggcatcactgactcgatggacgtgagtctcagtgaactccaggagttggtgagggacagggaggcctggtatgctgcgattcatggggtcgcaaagagtcggacacgactgagcgactgatctgatctgatctgaacttgtaagacatgatcattactatcataaaatgattaaacaaatacggagagaaataggaaaaattaagtgatgaaagggtttccattgatccaaaaaaacaaaaaacaatgctttattgatttattatcttactccatttcggagtagagtgggactaaattataagaattttttactttgattcttttccagactacctgaatggtcttccttaaataaaagctcatgcttttttataggagtcattatcataagatgatttcattgtttttaagcagcaggaaaagaagaaaataaccaatttgggggaagtaactgttttcacacaaatctggactctattgaggcttacctttccaatatattaaagttttgggctatgaaataacatgattattgtatcaacattacctaaccaagaattctaggtcaaaagtagctattttacagaatttgcttttttagatttatttttagaagtgcattttgccaagtgctctgacatgcccaagttcatatacatagcaataattcttaaagggttagaaacaaaatccaacctaaatttcattttatcttcaagaagtccagtcacttcttggtgatgaagg

SEQ ID NO: 55602 - DNA, 1066 bp, Bovine  19866881270265
tccatcatccctttttatatcattcctgaactggtgttcttgatggtgtagatctttatataattatgtgttttataacagtccattgagtttattttcctaattaggattttgttctcttgtccacattggctaccaaagtctcaggcaaaacttattatcaaatacatatctgcccttatagtctacaaagaagcagtgagtgaaatgaaagttgctcagtcttgtctgattctttgcgatcccatggactaccaggccagaatacttgagtgggcagcctttcccttctccagacaacctccccaacccagggatcaaacccagggattccacgttacaggcagattctttaccatctaagccacaaggaattgacttagtaggaccttcaagtcggagatgatattgaatataataatgtaaactttatactttataatattatgcatggcattcattttcagtctgtacatatacccattaaagtaacaaatacctccttacccataggtagagacagtaaggaatagaggtattagcataatatataggtggtgctagtggtaaagaacctgcctgccaatgcaggagacagaagacacctgggtttgatccctggatcaggaagatcccctggacgagggaaaggcaacccaccccagtattcttgactgcagaatccccatggacagaggagcctcgtggctacagtccatagggttgcaaaaaatcagacacgactgaaagtgacttaccacacatgcacacataggaagcatagactactgagaagggagtatacaagaattccatagactaataaacaggcagttcctctcctagactatatgctggaaatcaaatagagacattcacaacatccagcaatatcacatttatgcatgaaatttacacactgcaaatgaaaataaatgtttcagggtctatatttcagattcagttgtaattttctgtctagataattaattaaaaattaaaacatgtttttaatgaatctggttaaaggcttgtcaattttctttatcttcttaaagagcaagct

SEQ ID NO: 55603 - DNA, 1117 bp, Bovine  19866881330115
tctatttttggtgccttgtgagaccccactttatctcctttaattaagctagagttaatgtgtctctatgtttcaacaacagagagccttaatgaagacagatgaaaaggtgggaaaggaaatcacaaaagaggaaaaagtgatgaaccagtctgtagagaagatcatagcgtatgtggagacatgatctatgttttcctattgcactggtcctattttgggaattttggataaagcatcactgactcaatgaacatgaatctgagcaaacttccagagaggcagtaaagggcaggggagcctggggtctcaagagttggacatgacttagcgattgaacaacaaccagcctggagatgaagaatgaggagatgtgatgaccatggtaagaatctcaagggagtgacaggtttgcttctgtttttcagaagaaataagtgaaagcaatgtagaggatgaattattgtacagagtagagactggaagcaaggtgatgttttttggaggtggaggtattattacaatccagcaaacctgagaggcgcctgaatgaaagctctgacagtgacagatggaaagagagtgaagcacccaaagggggtgtaattgacaaaacctgatgactgttgtgaaaaggagatggaggacaatttttttttatttgttttttgctgactttctagatttaagattttttaacttagatgactgaagagatgtcaattctatgactgagatagtaagttaataggatttataggtttgggggaacatgaaagaaatacctgcttatttattgggttggttttttgttttgtttttagtcatgtccgactcttgcaaccccatggactgtatgtagtctgccaggttcctctgtccgtggatttcccaggcaagaatactgcagtgggttgccatttccttctccaggggatcttcccgacccagggattgaacctgcatctcctgcattggcagatatattcttaaccattgagccaccagggaagcccctggttgagggtatgttgactttaaagagactgctatatttgagaaaagaacaaaacaatgactactactctgtcttcttcaaagatactgaacaaaagtt

SEQ ID NO: 55604 - DNA, 960 bp, Bovine  19866881405037
ataatttttatgggattaaatccaagaattcattttccatttgaacaaacttcttaagaactggtgccactctgcacttcatcatgtgtagaccttagttggaaaacagctggtgtcccaggaatataaacatagcctttgaagttatgttctcaggattggaggtgatgctttcctggcttgttcattctcttggtgcacggactgcagttgtcattcccttccttgcctttagttccttcttttccttctgtttctacctctgcagagctggaaagctgttcaaaaatccatgactttaaagatcgtatatatgtaagcctgcaaggccttcagagattttaggatgagcttccccggtggctcagatggtaaaatatctgcctgcaatgtggaagacccaggtttgatccctggctcaggaagttcccctggagaaggaacagacaacccactccagtattcttgcctggagaatcccatggacagaagagcctggcagcctacagtccttgaggtcacagagagacacgactgatcaactaacacacatacatgattaatttcatattattattgaattattcatattatttacaaatttttattatcttttcttctaaacacctttagttacaacaagactaaaaggtgaagcagtttcctccaggaagtatagaaagtcatggagatgctaacaaaattgaatttaatcttagactgcatttaagagaagcacagagagaagtttaagctggaagtttcgactgtggtcagcccataaagaagatgttagattccaaagtcagttgttagaccactgagtggaagtttctaacttagcaacccaggataggtttgaagagtttaacctctgctacatgtaaagagatgagaataccagaccatctcacctgtctcctgagaaacctgtatgcaggaagcaacagttagaaccag

SEQ ID NO: 55605 - DNA, 1018 bp, Bovine  19866881457471
ctgaaattgtgatctcctgtaaataaaagttctgcaaaatctgtacaatcttttgaactccaaacaattcaggaatggaaaataagcttgggctccagttgctctctgatttcatgcactgaatttgggccgaatgcctgagcttcttagaacttcttgtgttcaccccccctctggctgtaattaaatgtgctcagatgtcttgtcctatcagctattgggagtgtgacaagcttggtctcatgggcccttttcatttttaagaagattcaatctgaggaagcagctcaggaaatctcagacgaagtttcttttttcccccacctgagtttttggactacacataaactaaatctttatactctgctgggactgttctaaacagcatcaaaaccaggaggtcaaaggcatgagctcaaagaacactcacaatcttgatcatcttctccatcacatcagatgacaagccagatttgcaaaggtcactgcacggcttccctgattatgcagtgtgtgctagacataccaaatgcctctgggtgaactgaataaactgttgaaatgttccccccactttcatgaaaggtgccccaactgaaacaaggggaactgctgtcttatgtttagatcaaagtataatcatctgggggtatttatttagaatgcaggttcctgggcatcatgtggaatccaaatttccgagggtccatctcagaaatgtgtactttaaacaagattcttaggtactctctgaagtccgagacatactattttaggctgcactagctcatgggtgctatatcattagagaaaatgaaaatgtctgaaaaggtatgagaggttgcatttggttcaagcattacacattagatactcctgatttagaggaacttgaaaaaagaagagttaaatatagtgagtgtagaggagactgtcaattgacccttaatccccattcccattctctctgaccacattcttctgtattgtagtggcttcaaaattaaaatttccatgt

SEQ ID NO: 55606 - DNA, 1153 bp, Bovine  19866881613707
gactagctggtttagcattgagaaattctactcttagttttctttatggactatggaatcagaagaagttacattgttttatagctatcgaacctttcgcctaccactggatgtaaaatttaaggacagagttcagctgcatttaacagaatatcctagaacagtggtttaagtgacataggtgttacatgactgcctcaaagcaagagattcagaagtaggcagtctaaagtctcaaggaagtcaggctgattttcttggcttttccctcatagccagctcaagatggttgccagagctcttcatttctggctgggagtaagggaaatgtcccaagggcaaagaggatacatgcggtattgaatgaatccatttcctatttaaggtgctttcccagaaatccttcccaataaatccacttatatcttatcatccagaaatattattacgtgactacccatatcagcacaggagtctgaaaaatgatgtttaggtgggaacttttccaaaaccaacatcagtattctgctaaataaaaaagaagaaaagtaactggagatgttactagcagactcttaacttgaaaacatttaatttcagtttctttatctgaaaacaaatgatgaaaatttatacttttcaagatgtttattgacattaacctagataaagtatattaaagctgccatcagtgaactctacgtgtgttggatggaaaactgaccactcattatccaaataatgtggaatgtaaggtaacatcagctcacaaatgtttattaactcaagtccactggcatagattttccaaattaaagcaatattgactatcaaaatggagtatggataatttaccctcggcattgtcatgatttttattttctgaaaggctaagtatgggcagtgtccttctatggcacctcagttgtaggttggttgctggagaatggctgacctgagatttctgaaattctgaaggaataaatgatgttaagtcatagaaaaaggagtttatttgacttaaatgtgattgtccaataagtatatgctaactcacctctatattatgaatgctctggggcactgtaataaaggctttttcattgcccttgctggctaagtcgcttcagtcatgtctgactctgtgcgaccc

SEQ ID NO: 55607 - DNA, 1140 bp, Bovine  19866881958253
cagagagtgctacagatgcactcaccagggtatggacagatgtaaaccagggtcacagaccaagggaaacgcccaaagggatgtgggcatgctctcaacagcaggccctgtactgctgctctgagcctcagcttccatatccacagaaggaagataatcccttcaaatctctaaggaccaaagagtccagtagaaaggctgctttataagaaaggctgtgatttccctgacatttcagcaacaaattgttcccataaatatctgctgaatggttgaacacgtgaaattgtatgcgggagccagcctgtccaggcttactagagcagattgttaaatactcaggaattttgcaagtcagttgttaaactgttgatagctcgaaaccagccatgctgggtgtctttacacacgacaaagtcagcaaacactgccaattgggtttttggttttcctttttttgcctgggaaagtcagtttttcagcactgaatggatgtgaaatggcagagtgtcaatcatgtatgaggtgcttgaaaaacgtgcatttcattttcttccattgaatgcgaaattggcattgagaaagctacccttttcactgtgttttgcttttcatttctggttaccaacatgtgttcctcaaagtgggctacaactgtatctgtaatcctgtattcatttcaagaaattaaaagggagagttacagtaagtataataaaatgtcagatctgggtgatgcattcatgggagtttattattccttgttatttctgaacatttaaaatgtaatcaaaaaaaaaaaaaaaggaagacaaaaaactgaagatgctcctcagctcccagactgatgcctgggcccctgtgaagtggatggaaggaaggtttcaacagcaacacacccagcacaagtgtgaacacatgaacagcacaagtcctgtccatctactgtaggaccaaggcaggcctgcaattaagccatcaccagtctgcaacgctgagcacagagttacaagagcctcccagactcagatggagccttcctaacatctataatcatgaggtaatggcatagaaactgtaattaacacatgtcacatacaccttgtaaatgtcaccaaagaacacatctaaaaattcaaa

SEQ ID NO: 55608 - DNA, 2373 bp, Bovine  19866880566562
aggagaaagagtcctggggccagggtgccccagatttctctgtcagggccccagggaaggctggtgagcttgtgacagggagcgtgtgccgcctagcagaacagtggggcaagaacgtgcttagctccaaggtgggtggccgctgggacacctgcagctcacctctgctgaggtgccaggttcaagggctctggcatacgaaggctcaaagcctttagaaagggagcaagatggaaatttctaaaaataggagccctggaatatagcagcagaggggctttgtgcttgcttggatatgttctcttgagagtgagggttaggggactctttggcaacttgtggggggcaacgttggtctctcccaggaccaccaagctatagcagtgggaaatgtaggggatgggctgggttctgccacttgccagctattatggactgaaggtttgtgccaccatccccgccatgctgaattcctatgctgaagtcttattccctaatgcaatatttggagatagggcctttgggaggcacttagagtctgatgagggtggggcccccacaatggggttagtgcccttataagaagggacaccagagagatgctcgctctctgtcatgtgaggacgcagagagaaggtggtcatctgcaagtcaggaagagttctcaccagaagcctagcctgtgagcagatgtttgagcctggcgggtgtggtattttgttacaatagcctgagcagacaaacgcacaagccacatggtgatctctgaactgctctgagttgtagaaaacatattttggagaggaagatacagcatgtgtttatgtttgggtctgctcagaacaccacacccttttctctgggggaatcttctctccagtcatggggctctcagggtgtagctgaacaaatgctgttcttatgagaactgatggcatctgagagcacttggcacagtgttggccatagagaaggcatggggtgaacaccatctctccactgttccctccccgtccaccaccacaagggatctggggccggaggcagggctagaccctgtgcccagcgagcactgggcagataaaacgtggtggaggggaagagctttgaagtgccttctgggatttgcatccagttcaccctcgcaggctgcctctgggcctttgcctggctccttattcttcaccagaggggagatgaggaggtctcagtcttcttctgaggctctgagcccctgatgactggcatccggggcactggctggctgtgtgtgtgaggatggaggcggcatcctcagggacctcggtggaggtctggggtatgggcactgcccaactagctccctctggggaagaagctttctgtgagggcatgaagctcagaggccaaagggagaccagggctcagcagctaagaggccacacagccaaactccaagtgggaatagatttagcatctggcaagaataccatattaagaggtaatttttcatctgttataaatccattaggaaattaaaaatctaggctgtgactttaaaatatggaatgggattttcttcagagcccctgaaggtaagatttttttttccccttaataaatgctgaaatccaatgaatctaaatcccctggccgaggataatgctcccagaggcggcggccgctccgtaaccatttgctgacttggggccaggaccatattttcagaaatattaacataaactctggcagtttggcagtctttgccctgggctggacttggagcggtactcacaagtgttaggagacagtgactagttgccaggacccaccaggcgctgagctggggccatggaggcgggaggggccgacttccaggtggctgaggtcagctcagaccctgcagctcagggctggttttggagacaggagggaaacaatgtgcaaaggtgtgtgtcgaccagggcaagtcagagttcaacggggactagttagtcttcaactagggaagttactgtccaaccaggtcaagttcttgcagagtcagggaaatcagtgtacaattaggtcgtcactgtacaaccaggttaagttagtttttgacaagagctagttagtatactccaaggtcaagctagtatataaccaagacttcagtgtaccatcagagaaagtgaatggactgcatggaagtgtttttaatactccaccaatctggaaatcagacttggaggaaatcggggtctagaatctgatgtctgagctgggagtgcggatgggggaggcctgcggaggaggctctgggtcttcatgcctatggctcatccctcacctgggcttccagtaacacccaggttggagcaggagtgagtctcccagcccggagccggcagg

SEQ ID NO: 55609 - DNA, 1427 bp, Bovine  19866880840093
ctgcccattgacccaaaggtgatccagggctccccctgaacctggggcccagggctctccaccgactttacttgtggtggtgtggtcatgcaaaaggttttattttaatgtgctcaaacatcatagtcttttttcctgactgcttctggttaagcaactcttttctatacccaggttgtatagacccttcacacccgtgtttccctctactaccttaaggcttcagcttttctatttaagtgtctgatcccttttggattttatcccgatgtgtggtataagctccgggtttgactttttccatatggccatccaattatctccagaccactcatttggaaaaaaaaaaaaaaaatcaaatttccacacagatttgtgaagctgcctttctcatggaataactttccagacgcagttgggtctatttctgaattttcctttggtccagtcggtctatctgtttattcctgtgccaacaccaaactcctaattacaggcattatagtgtatgttggtggtgaggaactctgccaccatatggctcttcttcttttgggttcttctggcttgctttgcttttttgttcttaagcataaactttttaaacaagttgttcgctccggaggaaaaagaagcctggtggtatttttaaaattggaagttcattaaatctgttaaatgaacggaggcagaatagacgtctttatggcgatgagtcttttcagtcaagaccatatctcttcatccgaaatagcattttgagggaaaaaaatgtaaagaggatacttacagaatggttagtattcaaatgaatttttttaaaaaacacacagaacagtctgtctggtttatggattcatattaatgtgatgtgctgtgcttagttgctcagtcgtgtctgaccctttgtgaccccgtggactgaagcccaccaggctcctttgtggggcttctccaggccagaatacggagtgggttgccatgccctccttcctccagggaatcttcccgacccagggaccgaactcaggtctcccacattgcaggcgggttctttactgactgagctatcaggacagaataggaggggaggttggtagatagaaagggagagagagaaagagagagagggagagcgaaagaggtttgaattatggcaaacgtttgatcttggtggagatgaagtagctgttatattatttttctatgcttttctatatgtttgaaagatttcataattaaaaacaaaaggaaaacagacctgtctccactgcttgagggtgctccccagaaaacagcacatttcgatctcttttcatgtggttctggagtggtgtccactgctaggcctctgtcaggggaagcctgtagctctttctgtggaaaagaattctattaaagacttgtcagctccctcagcagctgga

SEQ ID NO: 55610 - DNA, 993 bp, Bovine  19866880862175
aatgataagagttgggacttgaacccggcagtctgacttcagaggttgctgactcttaccttgtggggctgccctcactttttcaggcctttacacgtctagttcctgttctcactgactgctctgtgtcctcaggctgcttccttgacttctttgagcctctttccttatctgcaacatgagagacttgactgagaagatgttgtgtcccttccatctttgaatggtgaacacaggtatatcagtagaggaggaaacactccaaagatctgaaggaaatttctaccctgcccctcgtaggtcatttgaaggttgggaagatctctgcagcctcatgtggtttgatggggaaactccattccaattgaattatgctctagtgccttatattttattgtttttcactgcactgcatggcatgcaggatctcagttccccaatgagggattaagcctaagccccttgcggtggaagtacagagtcctaaccactggactgctggggaagtcccttgccctggtgtattttaattacaccgcatacaaacggatttcttcaagatgcaaaatccccatgcagcctgctatgtctgaagcccctatattcagctctgggtcagagtgatgcttgtaataaccagaaggtgctgtgtgaagctgctcccggtcagcctcacgggcagcattagttaccagatgccaccagcacgagatgtgcagacgttatcagctgatacgtaattgattcggcatcctctgtaaaggcaggttaaaattaaacttgttggtaaatggtgtttaaaccttggtgtctggggacgaggggcaaaaactaacggagcagggcacttgtggaagggcttgatttttttttttttttccccagattgtggaatgagctcatccctcaactacggtaaagattttcctatttaaaggggctggaagcgtgtaagcttccgatcataaatttcataggaggggcctctacttg

SEQ ID NO: 55611 - DNA, 967 bp, Bovine  19866881095529
cccgccccccagccccccgcccccgccccgcaccgagcagtggccccgggcgcggctgctccaggaaaccaccgggctgcctgaggtcaaggaagtgccgcacccgtggccgacctggagactctccaccgaagataaaccagttgaagaaaacactttgaattcggaaagactcaagcccagcctctcagaaaacaggtctaaggggcaggaaaaaaaaaaaaatccttgtcttcggtcacatagccttttgccggccgagtccccttgaccacagtccagcatcttgtcctaggagcgaccagaagtggggctgaaaattctccgtgtcaagtgctgacacaccgctaagggatgcgtcctgagggtatctccccccaccccaaccctttcctctctttctggaaaaacatgatttttattgcctgaggctcctctcacccccagaaactgtagcccaccctgaggtcataaacttctgctcagcatccatggcaactaacgcgggggtcacaatcagaggattataactgcagatgtgaagctgggatgagaggggaattcttcaaaacggtatcttgttttcctgcaaataatgcctcttacataaaatctacggagagattaatgcagcaaagagaccagccttagaatctcagactagattgctttttccatatacactccacttggtgggttttgttcattattattattttttttaacaaaaagctttttctgaaaatacaatgagctgctttttgcagggttcacaattcccaatagatgatgatgccatttttcaaggtcttacacacgttatggctttggggcttatttattagctcccaagaaaagcctgcctttcagtgaggtttatatactcaagtaattgtgtgggggggggaggggcacagagcagggtgctgttaaagaaggtggttgtgcatgcgtctgcaaggaaggc

SEQ ID NO: 55612 - DNA, 806 bp, Bovine  19866881158992
acaactgcaaaataatttctggccccaaagataatcaatattacccagcagaacattcttcgagcttcaggaggctattcatttctggtactttcaaaaccggagggcaaagtgttatttccatcttcatcagaaggctccttcatgtagagtgtttaagaagacactgacatctatatggctttttctgaccatccatctccacgtcatcctccagggtacaggcataaaaccctctgcggcggacggtgaatgatgttcacgttattatgaacacgagttgctgtcttgccctgagccttcccaccaaactttctagggtgtgtaatgggatatgagactctcaaccatctgccaggtggtatgtcctagaagcccccctgagcccatggacccggcatcttcccagaagcgcctctggaggggccggtggcatcttccctccccatgctgcgatgcaggcaattccagggctgccctctctctcagtctccctgctgtcacaagggatggtgtcctgcctgcttggcgaggtccctgacattctgtccagctcaggcctggccttctccagggtggagggtctatgcgtgtggaggaggggagacgtggaataaaggtttatagttggttcttgctctctattcccctgctcctttttctggattcacttcaagttctgctctgaagtctgcaggacttcaggtgggagggaggtcaccaacagggacgatcaatggaatgggaagagttttcctacactaacagaaaaagtgatcctcagagcaccattcatgtgcagtagg

SEQ ID NO: 55613 - DNA, 1785 bp, Bovine  19866881242565
aaactgagctccatgcaggcaggaaccaggaatgtcttagccaccaccagctccccagtagccaattgtctatttccttgtctgtgtccatctgtgggttaaggctcagaatggggacaccgaggcatttccaacacctggctgtccgtcagtgtcatttcctcctctccctgacatcttctgtagaaagagtggcgtgcagccatggggcaagtcctagaaccaaatctcagcccagccacagccagctggttgaccctgggcaagttgcccaaacctgtctgagttttatcagcctctctataaacaaggatcggtcatctacctctcagggctggaggggagactgacttatgttaagcactgaccacaatctttacagtttccttccatttgaggtcattgcccaagaaagccaattcacagcccaaaacagggatctggactgcgattcattcattcgtcagcaggacccacgcagtgtggctgggtgaggcatggacacagtaggtggaccccacagacaagatcctggccacttcagtgtttgtgaggttttgcagaggtaagaggtatttgtgaggttttgcatgttcatctttcgtgtttctctctctctctctcttttttggtttatgcatcaaggtttttttccccaatagttttaaacccaacattatcattaaaggtatctaaatctcccacaccagctaataaaaatattgtgggcttttcttcctgttatttttcttttcaaagtaaaaacaatgactgcggatgtcttcacaaggaaaataagtaaagccagcttttgtttgcagaccaaggtgcgataacgtgtcatttcctgagtgagttaagtcctggctgagcacaaccttgaatgggaggatgtgattccggacacccaggtaccgcagactgtctcgggctcagcaagagtagatgtggcctccagaaccactccgactgctgagcagctctttctgaaaccccagccaggacaggcagtaaagacggcttctttcttggagcgtcgcagccccattcagacccagcggcttgtgacaatgaaaggcgagcacggcatcctggctccctttgagctcacacccctggtgacctctgtacaaactgagaacaaaagaggggggaatccacagtagctccccacacaccctcccccaactcccgccccgagacacagctctaaagagctgtccttagggattctgagtggagcaacccccagcctcctccctcaatataaaataactttaatcctcattcaagatctccggttccaatgtaaacccagcaagtcccagctctcctccgctggaacctccccctccctttggcagccagcccggggatgctaccttccgcttctccactggcttctaagaggaaacaggcacccactgagcccgtacaagccccagctcaacatgccggagagaacaaagacttcacacaaagaagaagtgggcttttccaagccctgcagccactggctcctgaagagagatgcttcggcagccggggtccgcttcctcgcccagatgccccgtccaccccctcccatctccacggcttcactccagggctgggaaatgacgaggctgacctatggaggccttggaatcctggactctctccaggggtcttccactcagctgacagggcagagcccaagtcagggacaaccagagatgaaagtccagagggatggggctggttctctaaggaccgaggccccggggctgcaaatagaaacacaca

SEQ ID NO: 55614 - DNA, 1709 bp, Bovine  19866880709566
acataggcaactgaactagcagaatttgtctaatgtaactgttttgcaactcagaaacctattgaacatttgtagtttccaggggaagacttgggcagcaaattgccgttagtttccgtcagtttaagatcttacttcagaagaggctactcattctgcccaccctttccctgcaccatcagcctcatggcaggcaactgtgtatgtgtacctgacgcaacttgcaggaaccgtggtagataataaggatcctgtttccaaatattgaagatctgtgttctgactgctgagtgctgcttctgatcataaaggtggagacacagaggcagacagctatttttgtaagccccgccccccgcctttgttacaagcccctccctctccaaatgaagttatttacagaggattgaaaagggctagtacattttttccaccttcccccccccctttggaagcctgacattaaagactaggaatattcaaaagcaactgcatacacaggagaaattagaaagtcactgcacatgcttagggaagtgtgcaggctcagaaaaggcctcagaaaacttaagtttacttctaagggggtcagtcctggtcatatccagatcaggactcattatattcaatctatcaataaccagagacaaagggaaccttgaaagcagcaagagagaagtgacttcttacatacaagagaccctcagtaagattgccaacatttctcataagaaactgtggtacctaggagacagcagaccaatatattcagaattaaaaggaaaaaaatttttttaaactatttatctggcaaaacagcttcaaaagtaaggaacaaattgacatattcccagataaatgaaaaatagttcattagacttgtccttaatactaagcagagtctttgtcggttgaaatgaaagaacaccagaaagtaactcaaagccatatgaagaaataaagagctcagtatgctgctgctgctaagtcacttcagtcgtgtccaactctgtgcgaccccatagacggcagcccaccaggctcccccgtcctgggattctccaggcaagaatactggagtgggttgccatttccttctccaatgaatgcatgtatgctaagttgctttagtcatgtccgactctgtgcgaccccatggagagcagcccaccaggctcctctgtccacgggattctctaagcaagaataccggagtgggttgccatttccttctccattactctaagagatggatccaaaaaaaattgctttttaagttgaattaaagtggcaagagtgggcatttttatcttgttcctaatcttagatggagtcttttgagcttttcaccaatgagtataatgttagctgtgggtttgttttatatagcctttattatgttgagatatgttccatcaatgcccacttttgggaagggttttgtcatacatgggtgttgaattttatcaaaagctttttctgcatctcttgaaataaccatatattttttattcttcaatttgttgatatcatattgatttgcagatattgaaaaaaatccatgcatccctgggataaatcccactttgatcatagtgtgtgatccttttagtgtattattagattcaacttgctagtattttgttaagtattctgttgtctgtgttcatcagtgatattggcttctagttttctttttgtggtacctt

SEQ ID NO: 55615 - DNA, 803 bp, Bovine  19866881197961
ctcttatatgggaatctgtatagtaaagctctagtatatttctaggtgtaacacctataatgcttaagaaagagaatttgttcatatttgttttggtgtggcactaacgtgaagggcaatatattacatgacttgtgtaaatcacttgcagttctttgattctaggatgttcatccttttgtatgcttgcaatttttttaatgaaagagaaatcttaatcatagcattactatggtttattataaagcagctgttatttccatgtaaagccctacatggattctttatgtaatggaagtttgatcaattctttccctaagcatttttatttcagagaactgatggacagagtgagactcatagaatataaaattcatcactgcataatacccattcaaatggtaataataattctcaggtatctatcatccctattttgggggagggagtaatttattcatgccttctattttcttttcttactactgttcattctttggcagtttcactgttcattagcatatctgtcagatagtgaacaagaaaagcaaggaaaataagtcgaaacaaatcagattgttttattattcatcaccagatctcaaaaagcagctgtaggaagagattggaaattaatttttgagtggatattttggatatcctatgaatgcctatgaatcacaaaaataatcaactttattactgacagaactaaatctattggttttgattttatatatttgctacacctctctttaaatagtacaaataacagaatagtccataaatattttactgtcatt

SEQ ID NO: 55616 - DNA, 1370 bp, Bovine  19866881330707
atgatatgatgtacctgaaggaaattaggattgtgagccaaatcagtaatctgcattctttccttaattccagcttttttctttttaaaatatttttaccattttctcccccttctattcattttttctgcctttttcttctaagcaatccttcttgtctttaatcctattatttctgatgacaaattagtaatacttatatgcatatttgtgtatttacatttcaaaagttccattgggagaggaatctctaatggtgagatttaatatattgtggcacctaaaaggggggatgtgtagaaatactggggtgtcttctctgtgccttaaatctcaacattccctacactacattagtctatgataattataactttttagggtgtctaactaatggagattttgttgttgtagttcagagttcagaggtaataatccttttacacagtttatatgcattatttccataatgaagtagttttaagaataaaatttaaaaaaaaatcaaaatcaggtcaagaaaacacggaaaggttgacatagctgctacagttaagtatcacgtttgtctctgtgcttcctagcagccaaggggaaaaatattaaatgatttttattgtatactgaacacatattgtgtgccaggaactttgatagctgtattgactttatatctatcttcactacagccatggaaggtaggtgttataatcctcatcttgcggggaaagttcctgaagttggaacattatcttgccaagtgtcacaaaactaaatccttaagtggagcaaagattcaaatccaaggactctctgacttcatagtctgttctcttatctaattctcatggtcagaaaggaggaaatataatgattccagagataaagacttgtcattatattataaaattaattttctgtgtgacattgtataaaggggacattgagcaatgtgatgaatggtgcccttcataacagatttacaataaatgcagaaagaatatccatatagctgtttggctatttttaatgacctttgataactgtctaaagcataacattaaagtgcaagtgagtaaaactgattcagcaaatactaagctaatacgatcctatggtacagtcttctggtggtccaaggtaattaaaaaataaaactgaaaatacatgaaccagacttcagaatgctatgatattagcaagggttttgacagagaccaaattcaattgttcattcattcagcagaagattatgggccatctatatgccaggcactgtgctgggttctggatattcaaatatatttttaaaaaatatttatacttcaaagggtcttgcacttattttagaattagggagccagtgcctg

SEQ ID NO: 55617 - DNA, 800 bp, Bovine  19866880240105
aacagactcattagaaaagaccctgatgctgggaaagactgaaggcaggaggaaaaggggatgacagaggatgagatggttggatggcatcactgactcaatggaaatgagtttgagcgagctccgggagttggtgaaggacagggaagcctggcgtgctgcaaagagtcggacatgactgactgactgaaatgaactgatagggctggcagaaatggggaatgactgctagtgaatgccaagtttctttttggggtgatgaaaatgttctaaactttataggggtatggttgcacaactgtatgagtgtactaaaagctattgagttgtactttggtgaattttatgttatgcgaattctatctcagcaaagtgattatatatttgggaaaaaagcaaagtgccctagacctgagccagactggcacttactcagcaccagtttattaagcccctgtgtgtgctgtccacatggctcagcatcgcccttctggacgttttctttgggggccgagtgaacggtaagggtgagatttgtagggggggtgggctctgctttgtcaccaacaccccttggcacttatctaaggaattcgaagatggctttggggtactgacatctcttccttgtatttatagacatgctccgggaattcaacccttccctgaagggcttctctgttggcaagggaagcgaaagcagttctggggcctacctaaaccaggccgtgccgggagcccaagctgagtgagaatcttgggggtgaaccccaacggtcccctggggacctggttgggct

SEQ ID NO: 55618 - DNA, 1858 bp, Bovine  19866880427437
tggccctctgtgacccaggagggtgatttccaagcatcacgtgcaggtgtgctgcccttgtacgtatcaaagcgtcacacaaacaagaggccttatggtgacttgggtttagataacactgctggagcctgattttctctgtaatgctcctgaataccaggggaaagcatgaccctactctttctgaggagtatgcttcacaaaagtcaaatcaaagagaatccgcagaaagtccaaacctcactcaagcatgtcctaaagacaattaggtaataaatcccaaatataatatataaataaatgctcaagacagaactttccaaattttatgtgcacagcacaacctatgaagcttttaaaagcctagatttcagagccctcaaaagtctaacttggtagtcctgggatgagttcaggaaatctatactacacatgaacagtcttctggtcacacttttgaaaagcacttctttggggttccagaaagccatctaataaaacagcaaaattctgattcaacacattcaacaaaggacttggaggtctcagagacagcaaaacaagtgaaatgaatgaactacttttttttttttaaacacagctttaattaaacagcaatgtaagtggctaagatttagactagaatctctaaaatcttgaccaaaaagaagctgaactgaaaagctgttccaaaaacgcaacctcaagaaatactcacgtatatgaacagaataaagcagaacaaaagcctttagatagaaaaagtgattgctacaggctttgcattttcaaatacaccaactagcagctcagaaaacaggtgtgacaaacaatgggccaatttaatgcccattaaagaaaaagtatgagggaaaaaaaagccatttgtgaataagcctctgaaaagaggagcatccaagaaacaggatccaaaatcctaatgtgtctttgcattcttaaatgctaaagtcactggggagaaaaaaacaactctatgtgaaatgttatgaggtgttaatgtatcaaagtgttacccactaagaataacacacagaactgctcaagtgattactggaagcttttattacaaagaggagaaggggtagaaaagatgcagctgaatgaagaacagaactataaacgaacagaactaaagaacagaagagctatctacaccattccccactctgccccccagctaaattacagactgaactcctgcaacgaatagcatgtaactcagttgggaagattccctggagaagggaatggcaatccactccagtattcttgcatggagaagtgcatggacagagaagcctggcaggctatggtccatggggtcgcagagagccagacacaacagagcaacgaacaccacgtgaaactcttcttgtcgtcaccagccaaatcaactgatgtttttttaggactcaaggcctagtagttagtgactgtcctttaaaactcagctcaaatcacacttcttctgtgaagtcttcccttccttactccaccaagggaaattttactagttttggtattctggtatcacactatttttacaaatcaaaatactgatatttctgttggtattccagcatgaatccacaagggccaggcagcatcattcatcctgggttttttcaattgttggttctctgcaattccttctgtccagtcctgcctccccaacctccaaccacagacacctttatggtagagcagggaagcctcccagctcctccttgctactcagctcctgcaaagtcccctctcctcgccaagaccaaaaaaaggcccacgctagattcaaggaagatggaaggtcccctgaaagctctggaaattctcctgt

SEQ ID NO: 55619 - DNA, 2561 bp, Bovine  19866880516230
tgtgcgtaggtggggcaggcggcaagctttcagcccctgacaaagttgtgtttaactgacttttctcttggctcccttccctctgtgcagagatttgtggattcaggccaaagacctggtgaggaacatgaaagagaaccaggtaagaatccatccgactctgctgggggctgttctatctgctgggaggccatcagaccaaagacaccaggcaaccaagggccctgcagccatcatgccctgagcttggcaaccagtgtggcctgggccctccaagaacacccctgcccctggtaccctctggaggccagtagaacacaggacctcttctcatatccccagtttggtcctgtcgaagtcagcagatgaactaaataacttcttgctcagtgaggtggttgaaatctagggttctagagggacacctgttggagggtgaatcctgaatttccacctattagctgtgtgatgctgggtaaggcacttaacctctctaagcctcagttttcccatttatgaaatgagaataatacgagggcctgcagcgcagggcttggggtggattcagtgaggtgctgggtgcgcctagcacagaggcagtgcccagtgccagcccacagctgtcattgtcgttaaagagactgttgctgtcattattaatcatcacacccattctagttcttgggtggaggcttctgtcacatgcatcctggggccctagtccccacactcctagcagtgtagacaccctttactcagaagctcatatatgagtttgtaataagctgcctctaatcttttgtgctctccttatggacaagtatcaaatccaggcaagatctgctaccaagctagcttttaatgagggacttagcctgaaccactggaaccacgggaagccactatctcagccagccatgcattcattcaagagtcagggtgttcaagccaggtcatcccaatatatacaaggagaggggcaaatagagcagcaatgctataaagagtggcttcttccaaactacagacttctcaaatttctggaatgatcataacattctggagaatggctagaggtcttgaatcaaatcctgtcattttacagatgaggaaactgaagccccagaaagtcttatgacctgtttgagttcacagccagttagttagagctaaaatcaaaagtgcctgattcacatctaatgctcctccagagcaccatgctgcctcttacaaaacagaagtttgttttttgttccacaagtaacacatgttcattagagaaagatcagaaaacccagataaacaaaagaatactgaaacccatcccaaagcatccttaaacctgatgtctagagataattactgttgacagtgtacattcccttatataatttttccaagcacatacgtttgtatacattttataaaatagccgttacttgatgtatatactttttacagtctgcttttcttgatatcctatttctgctgatggcaatatgctttccagcactgtttgaacagtcgcatggtatttcatgtcatgagcattccatagtttacacagcaatcctctgttttagacatttatgttgtttccaacttttgactcttatgacaaggcttcatcattgtagctaagtctttcacacatccatttccttaagactcacttttggaaatggattgttggatctaatggtaagcctcttaaaaaagttttgatgaatttttccatattgccttctagagcagggattgaacccaggtctcccgcattgcaggcagattctttaccgtctgagccacggatcttggggattctgatctagcagattctaaagttctacagctttaaatgcctactctatatgtctccttttgaaaaaacccatacatatggttttgggaggggttgtatgaaatcaaaagacatgcaaagaaagaagctcttttggcaccaggattccctgccatctctttttcatgctatcgtcctttatttcttttttacagcaacttgactttcaaaatgattggaagctcatcaacgtgttcttcagtaatgctagccagtgtcgcctgtgttcctccacccaacaggtaaaccgcaggcgggaggcagagggattgcagatgctggggtgggtgccgagtgaatgaactaaacctgactgacctgcacctggcaggctgggcctgatggcacatatttccaagttagggcaggcaggtagacagacggacagatatctaagggtcaaggaaccatattgaaggacatgcatatatgcatgcttagtcactcagttgtgtccgactctttgcaaccccatggactgtggccaccaagctcctctgtccgtggggattctccaggtaagaatactggagtggttgccatgtactcctccagggaatctttccaatccagggatcaaaaccacaactcctgcattgcaagaggattctttaccactgagctatgggggaatttttaacttaccatcctatcaggaaaaggaaaccataatatagataaactagtgatcattctacaa

SEQ ID NO: 55620 - DNA, 4833 bp, Bovine  19866880550699
ctcttgagattagaggtttgcctgtgaggaggttatactctttttgttcagtcacttctagcaaagggctctctttgattcactgtacaatgctgaagctcctgctttttcctctgttcatcgagtctttattggatattcctgaagagctatctttcctataagtgaaagagcatttagtgacttttccattgtcatttattccctaagtcaacccactcattggggaaaaatcattattattcttttaaaggatgtatttctttaccttctgtttgttttcttttgatagaagacttctctggtgagattggtcatggcattaatgaatgtgattttttggtattatataaatgaaatgtgttaacatttggaatatctccataactcagtgaatcagtattttctaaatgaccaatgaatgatggtgcaaagtcatgcatgagtaagtttcatttaaagtacaggatagacaaatggaatttagggtaagagtgtgaaatatttatcaatataattttatcctactgattaacacagggaattgcattcagtatcctgtaataaaccataatggaagaggaaaaaagtagctttagattccacgttacaactaacctttaagaaaccaccacttgttgagttttggtgtagtatcaaagaagaacatccagaattatttggaaaggctgtggaactactcttcttttttcgaagtatgtatttgaatgaggctgtattttcttcataatacttcagccaaaacaacatattgcaacattgaatgtaaaagcacatatgagaatccagctctttaattaaatcagacattaaagagttttgcaagaatatgaaacaatgccatgcgtctcatgattttttgggaaaatacagttttttcattataaatgttaacgtagtaggattgttatttttaaatgaattagtatttgaaactttctgttttaacttttactatagtaaatttaatccatataattcatatatgtagaagctccttggggtccccaatacatttaagaaggttcctgagaccagagtgtatgagaacctgtgctgtagtgcttaaacggggacttggagccaaattgtttatgttcaaaactcagctttattatttaatagctctgtgaccttggacaagataccaaactacttttggcctcagtttctcatctaaataaaatgctatagtaatgtaacttgtaggttgtcttaaggattaatttgaatatatgaaaagttcttagaatttatatagtactcagcaggctataaaattatcaccttttgagcatttataatgtattggagttttcctttatagatgccagatttctaaatttctggagattcagtgttttgcggtattaacatggtctgtcatcagtaaagtcccagatacccttaacttctctacaccattccccccgccccaaccccgtcaaagtcagtggttctcaacctttgctgtattttagaatcacctggggagcttaaacaaacaaaccctcagtgcccaagacacacttcagactgactcagttaaaccagaatctgaaggtgggaatagggaccaaacatagtatttctcactcctgaagcctgaatattcagatcctctgccctgagattctgtctttccttccatgttctcaaataatttatttattacagctgatttctctctcatcttttgtatcactacacttggaggggcggtaggtgttctccctgctcaatgctgctgctaaggaaaccatcgttcccttttccctgacaccccatccccagccttgaaactcagcccatcagacagtaggacacacccctccctccttgttatctagagacatcctttgaagattttggcgcatggctcacagttattttctcagcactgttgattgctctttttgtgattgcaggtgatttaatattcacataaatgctccttcccacatgtgggcctctcagtccctgacttcctttcctgcagggatcttgtccttcctccacccccctcagccagacacatgctcatccagtccttgtcagtacccattacagatcaaacatcccgttctctgaccacacctcctgtcttttagaattcatttttttttagaatctcccagctcaccaggaccattgttcctgtcattttcccactaactctcacttgtcttatgaacttactttgctttttcctggcttagggagtccatgtccataattacaatcagtcttctgcaagccctcaaagatctcttgcccctctttctttctattgtacttatctagcaaaatcccaacctttgttaaatctaaattcctcccactctacattgcacccaggcgagggaatttatgctgattggtctcacttacaaatcatacctcaagctcaatggggcttttagtgctgtctggaattcctcctccatttccccagttcattcattgtttattgttctaaatgactattgcatactctcttctcaaacttcctgtatcccctccttcttcctcactctcagctgatggccttgtttctaggagaaaatgtaaactcttaggagagaaccaccacaagcttctatcaccgcattgagcaacctgcctacatttgtaattctaagctggccttttctcttatacctacagatggattctctgtgctggtttctaaggcatccctcttggagatcccattctgcctacctaattgttatcttctctgatggtgttctgtgcccacttccctttacagcagcatgttcccctctctctatggggatattccctcagactataaacatctgagcaaaactttctcttctcctctggttaccagttttcattgtctgtgtcacgtttctaatttctttctactcattctctcttaaagcctctacagtcaagcttctgcttcaccaagatagcccttgtggagcacactgctgacctgtgtgtcaacaatacccagccgtcagttcctaggcctcctcttactcagcaacgccatttggcacagctgatcacttctctcttttgaagctcttccttcaccagtgttctcagtagcatttattaccatatgattttgttgattatttattttggccaatgaaactgtaagctcctttagcaaggactcggtttattcctgtcactgcctgtaacagtggctgatacggaataggcacttgatacgtatttgttgaatacgtatcaacatacgtatactgtgagcttaaaatatgtgactgtgagcttaaagcagctatatacttgtcagatctttcccatctcctttcctggtcaggctatcacagccatgtcctttctctttttctccggaccttgcatttcctaactgtattttctgtcatctctactccagtcctatctttttcaggctgaaccaccaccattgtgcttacgtgtctctggggctctaatgtttacagagcgttcatttatatctggtattatagatgcagatggtctgtggatctgagttgaatgacattagcatttaatgctgaatttaggtgcagatggaagaaattaaaattatgaaaaaataagaaacaagtctttatggtcttcttattcttcttaaaattatggtcttcttaggatgttttggtttcttgttttgttactaccctactttacactttactatttctgcctgcccatagtggaattctccttgattgtctgcaagaatttttagaaagcaggagaaatcaacaagttcaagaggcccttttgacttcagctctgagcttatcattaattaagagtagtgtgtttttctcttagattatttgtgggaatataaattggttcagcttctatggaaaacagtatggaggttccttaaaaaaataaaaactatagagttgccacatgcccagcaatctcactcctgggcatatatccagaaaaactaattggaaaagatacatgctcaccaatgttcatagtagcactgtttataatagccaagacatggaagcaacctaagtattgcttaggcagcattcattggcagatgaatgctaaagaagatgtggtacatacatacaatggaatattactcagccatagaaagaaggaaataatgccatttgcagctacttggaggttagagattatcatactaagtgaagtaaatcagaaagagaaagacaaataccctatgatatcacttccatgtgaaatctaaaatatgataaaaaggaacttatttacaaaatagaagcagactcacaaacttagaaaacaaacatggttactaaagggagaagggtgggggagggataaattaggagtttgagattggcagatacaaactactctatataaaatagagatgcaaccaagtcctactctatagcaagggaactgtattcactatcctataataaaccataatatgaaaaagaatatattatacacatatatatctgtgtgtataattgtgtcactttgctataccccagaaactaacaaaacactgtaaatcacctatacctcaattaaaaaaaaaagtagtctatttctcttagattttcatccctctttccctctatattgatgagccagtgtgatactggatttgtgtgaaaactcatttgttactgggcttttctttttggcttctacagaaccttgcctcctggaatccatcaaaccctgaatgtctcttactggtggtgaaggaacttgtgcaacagtatcaccagtttcagtgcagccgccttcgtgagagctcccgcctcatgttcgaataccaga

SEQ ID NO: 55621 - DNA, 1820 bp, Bovine  19866880601907
ctcgctccctggagaggagtgtgccaggaaacataagaaactcagatacagggttaagacgtcagtttcctcagctgatccatagcccaaatgcctgactgctgtacttgactcctcaggtttgggccagaaggacccttccttgggcacctcttacagtccaggctgaccagctcaccagctctccaccccacaggtggtctcccgacttttccacctgttactggcttaggagagattccaccctcttctggggcagccaggccccaaagcaagaagaggggaaaacaatctggacttgaacttcatcagcagtacccactgccaggacctctgtgagaatgtgatgtaggaaagggtgaggacaaccatcgggtccaggctgacccagctatggaagctggtcaggcagagaaaacaagtccaggggcttgcatagaccagatctcacagtccagagaggtgggtactggactagtgtggggacccaggttctattcccagctctgatagtctccaatggtgggcaactcacaagacttttctgagcttacgttcccctcagagagacacatgggataatgtgttagaacaatgtgagttcatattttatcaataagtcccagaggtatcctactggcaacccttctctgggctaccacactttctcagctgccttggaatgaaggggagaagtccttattgctttgggttccaatttccttaaactgtcagcattacacacacacgcacacacacacaccacactttgcagcagattaaggatgcattacttctcaaaacaagtaacatttccagctttggaataagagggatgagggctcatttggggccacgttgcctcttcaacatcatcccacccccacaatcgccagtcctctcccctccccctccctccctgaattactcacactcctggaaacatgactgatgacttcgggatgagtaagaggcccatgcgcgtcatggcccaactgctgggagggtgaatgagttcaatgctccctcaagctgggccacttaaacatgtgccaggagtcctgctggaagaaggggccacaagaccctagacgggagctaggaaaagccagtcaggacaagctagaagtcctttcccccttcccccaggctttctgccaacctttgggtgaggtgacagtagccttctgaacatgggttgacagcccccacccctttctgggcagcgggtgcagcggctctcactgggttccaagacactgtgtttctttgacccaagcaccccagcctcaccccagcacagccaggccccaggcaaccctgaacttggcagcctagccttggctgctttgaaaggaccttaatccagggctcaatctgcagggtgcgtacgtggagtgggtgtgtgtgtttacactctcctgtacgccctaatccatggtgccagtcaagcaaatattttgggtctgttttccattatccacatgtcccatttctggacatttggtggaaatgggatctcagcaaaggggaggtattaattcaacatgttctgaaatgtttgctttacattcttggagttaaagtacaagcagaacatactactataagcaaaacaacatgcaaactagatttcctgcacttagtaaatagtgctgaagcatcagtttccccattcctagcatgggcgcggtcaggacatggacggcatggatggcatggacgacaacgcagggctgtgaagcggaggcagacccacgtgggtgttctctgcaaccagggtaagacggtgtcctcactctgagcctcggctccccaga

SEQ ID NO: 55622 - DNA, 961 bp, Bovine  19866880662984
caatccagaggatgtgatggcgtgacaaaggatgggtaacatttactaggcagggctcattgctgagtggccttgtaggcatacttctcttgggagctatcaaaggattttaaacaagagaggaagcctatgagaactgaactctagaaagagtaatctgtctacaacatggaggagggactggggtcagacctgaagctagaagactggggagaaagctggtgtccatgcaggagtccaagcaagccaggcacggtaaaaccagcatctcccggagaaatccacaaggacctcgtcatagtcaaggtctgattgtttgaaaagaaggaaaagaaaagagaaaggaagaaaaagaaaacctgcttggagaaagtcaagcttttctccagtaaatcagttgtcaggggtgcaggttgctaagctacagcccactctaaaaggagctttgggggaggggggtgtcatcagtcaggttgctccctcctccaggcccagaggaggggaaggggtcgctccacctccaggaaggacccacagggtgcaaatggcagcagtacagcaggcagacgaggctgcagggccttggggcgtctgacgttcaagctgggtgcgcatctcatcagctactcagcatggctgcggagtgcagggctccagggccagcgagcacagcgctattttgctatgtagggtcacaagcttccgtctgtcttctaatctgtttttaggccatggaggtttggggtgtttctgcatctctcctcttgcaggtttgcctgtgcaatcaaagaggctttcaaaaaagaaaaagtcagtttaatcatccaatgatttaactactatcacctgtagcttcttaaaattcagaggatgggggtggagagagtggaggctcactttactttccaatgtcttaaattgatgtattttcccctggaattcaaacgtgaagcaacaaggc

SEQ ID NO: 55623 - DNA, 1843 bp, Bovine  19866880674085
aaacctatttttgagaaatactgacctctagtcactgaaaatatggcaaagtttcaagtttcattctgcaattggtctcctatgccaccatttcttggcctattttagctgtcccttactctggcaaatgctcaaatttcatgggtaacaacgaataaaatgtgtgcattttacatgtaattacatacagtatgtacatcaaaaataaatcttaatttatttctgccaataagatctaatacgcaaaccttactctttttaagtctaaacactggagagaccttaggacagagcattatatcgtaacataagtaaactgtgcttcttctctaagggttaggactggggttgctcaggtctttcccagaaacatgcttaatgctactgtgcctgccctgtccaaagcctgaaatgccatgtgcttcattcaataagcactaagctatgcagggtcattttaattgcagtgacagcaaagcaacataaatgcatttacttgtggtagccagtccgtttcttcaggacttatcagcagttaaggaaggaaaaactgaaaagtttggatcttaaaggagcaatgaaatagcaggtggctcagccacttaatgtgtgcctctggcatatcatctaacatctcagccttaaacacataaacctgagactctaaaaaaagcgttcacccagtccatcaacctgtctcctttgcatgttcctcatcatcatttgcggtcctcttcctccaggctccatcactgaaataaaatgcttagctacataatacatacaaaaaagtcctaaagaccactgtgacaaagatgccaagaattatcatcattttgtgaccaaaaacaagcagcaacagtctaatttttctaaaaatttatgaaccactgctttaactcctgtcacccaagaaacccagcaccaaatcgtttttctccactaataagtataatgtcaccaaaatttgtccttgggtggcaaactgccaattactaagccagagaatactcctataaaataatataaatctacaataaaagcttacgaaaacatgttagaacttaagtggcaaggatcataacccagggacctgggagcaaaggtagaaaatgaagatttgcagcaaccactatctttaaaaatcacctgactttacaattttacgaagtacacatgcaagtgtaatacaggaaaattgcttctcttcctaattttcaagtgaaattgatgctccacgagaatacaatcccaagatgaacactggatgtctctacattgctcccagttcgcaattctatgactcaagatctaaggttcaagtaagagcactggatcagcagtcaatgccctcgactctaatggccacaactacttcactggttattaaggcttcggtgaagtcagttaaacgttcttagttctgactctcaagtttttaaaaatgtgactttagggtatttcatagagtcagctggctaaagtgagagcatacgagtaaatggatactgaagcctgtaagaactttttttaatgcagcctgactctttttcaaggaggcctccaaaagtaaagtgacttgctcaatgtgacaaaacaagtttggttcatgggtatgaaaccaaacccatttttctaccgtatcattgtgctataaacaatcccaaactgattttaacagtaagtttaagactaggtaaaagttttattcttcagacatatgattgcaaggcaagagaaaatcaagtgggtgacaaatgtctgccagcctaatagtaacgatttgttgctcataatgaagagctgagctctaaacactggtattctagtcctggttctattt

SEQ ID NO: 55624 - DNA, 763 bp, Bovine  19866880715450
ccccggggccctcccaggttaaccccgccagttcttggtaacgcagggcacagcatgctcagccttgactttctcaagctgattcttctcacctgcaggcagctcctggccaccccgtctactgtgcccgcctgggttggcctgaaaggcgccagctgacagcgtctcagcctttccctgagcacagggaaaagactcctgtgtttctttctgcttcttgcttggagagacaggtatttctgtctttgatccctaagctctgttttctttctcctgttactaaacggttcactccctatctcccctgccccctgccatcccaccctttttgcaacttcatcatttttcccatattgcaccgtttggcacaggagaagaagggaaccacatcaaataaaggaatgcaaccacaaaagctgccttgagaagcaaggccccagagtctttttttctttttctctctctttttttttttttttgccagtttaccgtttttggacttgatctcccataatcaaatcctccctgtcgtgttaacaatgtggtggtgtgtcaatacattggaattctgcttcaatcagcgatctggagcttaataggaaaatgaagcaacaaaatgttggtcttactgttaaccttaggctaggcctgtacttaggatcgggatgttggcttcttgatggtatgtgggccaaaccttcaaagttttgtgagagctcagggctgtcagcagaggcctcaagcatattcaggcatccttctg

SEQ ID NO: 55625 - DNA, 1489 bp, Bovine  19866880728390
cttgatatgtatattggaaggagtggcttcctgttggtcattctgtaagaaatgccctataagagataataaaccaaaagacccaaatagagatggaagaagtttgactcatctgggatcttattaaaatagaaccctgcacacacatttcattggtttgttattctggaaacctcgatttgaattttgttaatatcatcatatacgataaagacacagcctggaaccacagcaaagcactttagcaattgctctccttggggagagaattcttcagagataagattaaatttgtgtgggctgattagcctaaacattatctggtacagatagtccatcacctcgaaagaagttgataaacatattgttaactcatcaaaatttttacagaaggggcctcttatcagaaggccatctaaactatgatgaaagatcacgaattaccagaaaatggttgactagagaacagaatggggaaagtgcccactgaacacaaaaggaacggcagggagaagctttgatgcttgggagttcttaaactacctggggctataatctgaaaaaccaactttctctcaattgtcagctagagctgcccaaccctttgctctcagattttagggacttatatcaggacttttgcagtggtggtaaactgctggcccaggttaatctatgtttctgtctttgaagtgctttggcatgagtttatatgaaaaaatatgtgactggcacataggagctcaagaaatgtgtccggctgaattaaaggctaagaggccctgtatcagagactttatagctcttgaagctctaaatgatggaaactgcagggaagggaaatacattcatccaagtgtcttggggagagtttgaatttgttcagtaggtgggtcccgccaagggaacaaagtgaagtcactcagtcgtgtccgactctttgctaccctgtggactgtagctcgccaggctcctctgtccatgggattttccaggcaagaatactggcatgggttgccatttccttctccaggggatctttccaacccagtgatcgaacccaggtctcccacattgcagacagatgctttaacctctgcaccgccaggggacaggcaggctgttattccctgtggggcatcatgacttcctcgtcacaggctagttaggtcccaagactcatgaacatgtggtgactctagaaacagcttccaggatgcacacaggacagctcaccactgactcacagtgaagcgaagcccctggtggtcacagggctgcagccttggccttttcaatatcagcgctggaattgctcgttttcaataaatgacgtcagggacttagaaatgacttgttctaatttatactattggtgacagtggcatagaattaactttgttctactttcaaatgctatgaattttccccctttgcaggaattagcagctgacttcaagagagccaacttcaatagacagcctgtgcc

SEQ ID NO: 55626 - DNA, 2345 bp, Bovine  19866880801595
aatctacatacacctacaactgctctaacaatgtttattagctaaaaaagaatgcactaataaaaacgtgaatgatctttttaaaaaaaatttatccaaagagagtgctgtctattattaggtgagaaagggaacaatgcagaggcagtcaaacaagccaaagcaaccttgacaatcagaggaattcagtggccagaaggagcagtaatcagctacaacaacagtaaccagaattcaagtggaggtaacatgaacagatatgtttactatatacctcttgatttttgaccttcaagcagtactttaaccaactgacaatttttagagactttctctaagaaaggaaaattcttcatgatctagttttagtaatagtttaattaatttattcatgaacaatgataattctttgcctctagtagtatatgactcttccccagcagctgacagcccttttcccccttctatagtttctgatactgagtattcatttggcactattatcaacaaaaacatgtacacgtttgtgtacatgtgtacatgtacacaagaacgttcagaggagcactggagcactgtttacaacattcaactcaactgcccatcaacagcagaacggataaactgtgctttacttataaaatggcaactaaaatgaaataaccactgctacatgcagtgactgaacctcacaaacagaatgttgaatgaaagtaacctgattcaaaagaatacagtactaaaggattccttttatgtaagattcaaaacaggcaaaactcatcaatggtgattaaagtcagagtagtggttaccttctacctttggataggataaggactgagagggatttgagaaggtttcaatagtacaataatattccctatcttgatctgagtaataactacatgagtgtgagtgagtgagtgaagtcattcagtcgtgtccgactctttgcgaccccgtggactatagcccaccagactcctccgtccatgggattctccaggcaagaatactggagtgggttgccacttccttctccagacatgagtgtggtcactacataaaaattcactgaggtatacactaatgatctgtgcacttttctgcagctgtgttatgttctaataaaaatttcagttaaaaaaacaaaaagcatggaaggggcaaatagaaagcagagagagggttagacagaaaatgacttgaataaatgtacaaaatagaaaaatcattgcttacatttgatttcaaggagaatgctctctatcacaaagttacgtgaacattttctgaaacatctgtatctatttaactttctgttattatgaacagattgaatgttttctttgtcatctaaattcaattcatttaccctagtctcttacctgctttggataaaaataagctcattccaccagagcccgagccagcttccaaaacagtatcacctgggtggatattcatcatcgacagtatcatatttatatcctatgattgaaatacagcaagggtgattgtgtggccaataaatacatactaagcacctactccttcaaataccatgttgggcttggagaaaagtggagggggaaaaaaaggattaaactttggccctttctacgaaaagtttatagtttacttgacaaaatgagagattgaggaatcaactagcaaatacagaaggacttaagtataatattgaaattacagacaataagtaacattgagagctctgagaaagagaaatcagcagactaccctagcttaaagacatagaaaatgtaaggaaacagtcacaaggtaggggacagctttcaacaaaaaagaggtagaataaaacacagtttgcttatctgaatccaggctaaagcatttaaacttaacatggtaagtaactaggatgtgtcactgaggtaatataaatggcactttataaagattaatctgtcagggcaatataggatgtactagaactgagaaaaattagaggcagaaagacaagttaggaagttattacataatctgcattaaatgatgaattctcatttagaattaggataccaggaacagacaggacatatttgccaaactttataactaaagaattgttttgttaacaggaatatcatggatgatagtagtaatagctgtttattgcaacttcaccaggtgccaggcttctgttaactatgcaaactgctttcaaatattatcttgtttaatcagaataataatgagaaaatggtcaccattgccattataaggatgagaaatcagaaaggttaagtaatttgcccaaagtcacacagccaggaattaagtgggcaagtaacactgat

SEQ ID NO: 55627 - DNA, 2485 bp, Bovine  19866880864823
gggtctgtgccggacccctccttctgggagttaaagtcgggctcccacttccctgacctcagggtaccactgaacctctatgataggggaagttgctgggcagaggtcagggctgggccacacactagtgtttgagagacagtgcagcccagcctgtgagaaggagtgacatacagatgtgtccacacacggtgaaaccataacaaaagcagagctcacttaccttcgcggggaagaagtgacctggggagcgacacgcagagcttccagttgggagtgttttgtttcttaagtggagtgagaaggacacaggtgtgtgttttattgttcctcctgcattacacatccatttattcacctaacaaatgctttttaaaatcttactctgcaccaggttctgttttgagtagagagatcttttttaacatccggtagattttatgagtgtgaaataattcatcataaaacaaaaaggaacacagcaggacactagtgtgaattccagaggtgtctggggacctgagcaacagaggctcgccaaagcatgcgtttgtacttatttttaaacactaaacatgggcttctcattgcctcaatgcatttgttcagtgtaatttgttgaaggcccagggcccgtggtccaacacttagtactttgttaacgtgagagggtgcccatccatatatcctccccttgtgcctccctgggtcaggcctgaaacctgcccctgagcatgtgtagcagagcctcctgagagccactccccccacctccaccctgaccgcagctttggctctgggtccttctgtctcccctctttttgcagcattttgtgcaattgtgttctgaccccgcgggagagctcccaagagctggccaagttggagtccatcacccgagcctaccaggtaagaccaagaaggtctctcctccgcctcaatcagcacaccagcccagagcccccctggggaggctcatgggaacggaagagctattcagagtttgagaggcaacatcaccatccaggcaacttcctggcttaggtatctcaggcacccaaggcatattcacaaaggaacctaggtgacaaagtcctcatggctgagctgtcttgctggctcagccccaacccttggcctgacaaggggaatagccctggttgtcccatgggattgccttttccctcccctgtcccccagatgcccagctgcccccgcaagcccccaccactccaacaggcaggccacgagccaatgagggtgttgcaggtcccaagcctagcagccctctggagacctctcctagattgctgttccttttgggacttcctgctggcccttcagaacttgcagtccacttataaccaggaccaaaaggaggcacaacccatttccagttctctgggaagagatttgtcatcaagtatgtttgtgttctcaagagaagaactgagttagcacacctgttgagggagattggcacaaagtcactgcccatcacccccagccttgcgctaacgggtacctggagctcccaggcctgtgctgaagatgcccacgggtgtgtccccagagcagcatgcgtgagctggtggagtccggtcggtacgagacgcgggaggacttctctgtggttctgcagcccttcttctacaacattcggctccctgtcctggcggtaggctccctgccctccctgacagggctcccacaaggaggaggaaatttaaagtggaaacaccaagtgcttccacagactgggaacaaatggggcggacccaggcagctctctagctgctgctctggtggctgcagccttcttgaacatcagaactgtattcaagaggcagcccaatgtttgatgttctcatgactgctcgttgcagcctccattttactaagtacctactacatgccaggcactgtgcataccataggtaaaatcttcacaattaccttctgaggtgagctttatcatccccgtgtaagagaggctcagagacatgaagaatccttcctaaaagcatgcaagaaataagggacagaggtgaattttgaacacgtccgactccagactgttcactttcggccccatccccagcactgtggctgttgtttctctccctggctctgctctccacctgactcttccattctgagcagaagggctctgtgaatgggccagggtggacacctgggtctgtccacctgggcctcccatcccaagggcctggcctaccagaagaagctttaagcaccgagactttgcccaggcctgaagccctattctccccatcaagctcactgggaccaactggtcaagagttgggaaatagctgttcccagctggctggctaagacttcctcagggactaggatcttattccctcatccatggcatgggttgcataaatgcgcctaaaaatatatatagcactttttaaattaaataatgggaattgtgagatccagaaagcaggttggg

SEQ ID NO: 55628 - DNA, 2557 bp, Bovine  19866880881526
aagccttgggagattggggggtggtggttgagtggcatggtgatgggaatggagagatcaccacaagcatagtacagcatttactttgtgaccttgttgaattgcttagaggtgaaaagagccttaggaggacttgaagtgaatcccttctggattcaacccttcagttataactacggaatggtagttgtgtaacgtaggtcagggcagaatagactgtggaagtacagtatggggtaggctctgcagcccaaaacagtcctctttcctcagagaacagtgcttttcttccaccttgccttaatttcttccttatcaggtatctttaagcactttctcttaagtcaaagattgctaggcatgggggctttagtaatgtacacacactcattttcactgtttaaaaatttaacatttgaatgaaatactcttatttactttagtgtcagataggagggcaagtaaaggctagttaaagggcaaagagtagggtccctatttctacagctctggagggacgaataaaataatttcctgctttaatttctgaagcataagtcagaggaagtatgtttaacaggaagtatgtttgaaatactctaaggtcagctttgtagtctgtcactctgtccagtgggtctctggaagctctgaaaagcttcctctagctactgggacctaatggtagaggttgatcctgtgatatcatcagagaggaagtttcagagtgaagtcctttttaagaaatatgtggttgagggtacctctttatctagtttctcctttatattgatgttctcaaaaataatatgatcagcacaaagaggccccagcctgcaatttgtcttgccttgcagtttctcctgaccttgtatcattcttttttaaaaatgtattatttgtttttgccgttagtacagtaaaggcatctgaaagtttgagattttgctaggctatgtgacaggctgccactgccgctagaagtgcaagcatttgcttggggctgaatctgcaggcatatgtgagcatgatttatatatttgttatctatgttttgttatgatagtgtcaaagtatcttttttattgtcgtctttctgtagttgcctgacttggtaccccagctggggaccctgtaccagttaatggaaagcagagtaaaaacttttcagaagctctcccaccttcacggaaagcttatccttctaatcacacaagtgagtagatcagattgttttgtgccaaacatttgaatgtgagagtaatggagagaggaataaggattgtttgcctggttgttgaaagtgccccatttcagttaaaacaaaaactggtagatgaagacctaatttttaactaggcagtgctatgtatttgatagtaagtaagctttgttgtacttgagtcaactttagctcatcaccatcaatgtttgaacttaatatagttagagtggttgtggtgctgtgagcaagagttgcagggtattgctgcagcttttggtcacagaaggaaatcttaacctgagaagcattttcagagtaattacacagagtaattctttcttggatttgatgcacttgccttttgcctgatatttgaactgcatcatgttaaggtcatccatttcatggatgagggtgagggtgagtttactgttggggaggttgtgtgatacttgagataaatttacattccacttcacaatagcacttgattgtctttcaggttacagcgtcagagaaaacaaaggaaacgacttgtcctgctcagaaggcaaagttggtgtatgaagaaggtaaagacttagggtatatgcttaacaattcattttcacattggctcaactctgtgacttgtgagtaagatcgtgctttggcacaccttccctgataaaacggacaagcccttggcgaaaccggcagaaatgtgatcaaatgaaagagagggcacaaatagagtaacaaaaaagagcatcaggtatggaagagatttaaatagaacaccatgaacagccatgcacatacagaaaacctggatggtataggtaatttcttgggaagcttcaatgaccaaattgacttagagaaaccttgaagtaatagttttgaatttacttaatcaaaatctttcctcacaaggtaccagacacaggttttataaatgacttttattagtcttttaaggaacaagtcatttttgtcatatatgaacagttcaggcattttatgaatcagaaccagaaaaatgtagtcaaaatagcattttaggccatcctcaaatatcctaagtagcagattaattatagaaataaaatcatgtttcattgtcaagtagaatgtatttaaagattataacatgatttagcgtcaagaaaccttatcactgtagttattaccacattaacagattaccatgagcactatatattaagcaacctaggattttaagtaagggagtttccttaataaatctacatcagacataaggtttagaagcattcccataaagtcattaacaagacaatagtgtaccttttattacttcggatatcctgc

SEQ ID NO: 55629 - DNA, 1701 bp, Bovine  19866880900564
ttagctggaaaaatatatgaagataaagggaataaatacactgagggctggagaaggtgactttgtacttgacactctgttggctctatgatctggagctggttttgcaatacctctgaggttttttactgaacacctgtgtggttttggtcactggacacattacaaattttatttcatttcgtcttcacagtcagcctctgagtcacacttatcttcattttgtggatgaggaaattgccaaagtttgcagctagagtctgggtcctcacgactctaacctcaaagcttttgctatgctcactccctgctgactggtggccacttctgatctggctagtagagggcattttctgaaaagagctacagaactttaatttgtaccttcttctttttttagcaggctggcttatttggtttatttctttttaactttaaaaggtccaaattaataaacagtccagacttgaacaaaattcttgaaatctgacaatccataaaaaaaattcggtctttgcccactcaaacagtgcatttgatgacaaacccttttgaggcctaaaaatatgatgctaaatctgtaatttttttatttggggggggaggttatataaaattccttctctttcaaaaatttacatttgcagacttgcagaattttatatacatatacatgtacacacagttttcttttacatgtgaaatttctcaaatccagagtcttacaaatgtgtctgaaatgtaggaggctctcctataaaactcatgagttgtcataatatggaaaaaaatagttgccatttctcctgtgttcctggggaccaggcagccgttataaaccatcgtcgcagtggatagtatagtcttagtttcatacttatagatacatatgcacatagaaaagtctggaaagatatatgctaaaacattatttatgcttacttcaggatagaggagattgtggatgatttttagttcaatgggcatttcaaggattttctgctatgaacatagattatttatatgcatttttaaattattataatgaagattatgtagccacataataaagatcaataatcaaaagttaaatgagacttctctttatgacgtaagagaataacataggccagatttaccctcccacaataaacaattagaaaaccagacaaaacaaaacatatgaaacacttgttcagacaatggacaacaggtagcacagtgagtcctaaagaaaggaaacagatgaagttaggctggtaggagtccttactttcttcctggaggcaccctccagaccacacagcaaggacagagaaccccaagccagtgtgtcgaggagacagagatgggggttcagagaagctgagataccttggaagtttggaagttgaaggactgagttctgatggagagaagtagggagaaaaacagcttaaaaaaaaaaaaaaaacaccttcccaggagtgcccttgagtctttactgaatacaagatgctcacatgtagaatgaaactccaggttaaagagctaccaagaaacactgagctgaactgctcccagaaattacacagcgcttaagttttaactaaccaggaaggagagagtccttgttgatgataactcagggcattcactagggaattcagtaggaccatgtgatgaatatctcaaaccccagagccatcactaaagaaataa

SEQ ID NO: 55630 - DNA, 3115 bp, Bovine  19866880907746
cacctactgattctggccttgagtatctccaagtgaaaaagagtgctcactgcctgatcttttccacagctgagtcctcaataagcattccctgctactgctgctgctgctaagtcgcttcaatcatgtccgagtccgtgcgaccccatagacggcctcctaccaggctcctctgtctctgggattctccaggcaagaacactggagtggattgccatttccttctccaaggcatgaaagtgaaaagtgaaagtgaagtcgctcagtcatgtccgactcttcgtgaccccatggactgcagcctaccaggctcctccgcccatgagattttccaggcaagagtactggagtggggtgccaatgccttctccgaagcattccctacacacacacaaacacaaagtcaatctctcttccccccccaccacccactgcaagacacagcttctgtttagactcttaatatctcattcttaaatataaaagaactaccaggttttcaaggaaagcttccaacataaacaagaaagaactcagagaaaaactgaaattaaaaaaacacagaattaatatcctaaagatatgatagcaaagtttaaaatagcaatggaaaagataacgacaaaaacaaaaaaaacaaaacctcccagaaagtagaatgaagaaaagcaaagagaatcaggagaggcataaccaaaaaaaaggaaagaaatataatccagaagtctagtttccaataaattggagttctagagaaagagaacaaagaaaatgaaatggagtacattttcaaagaaaaaatataagacaatttcctagaaagataagagtctccatgccaaaagggtcccaactgcctacacattcaccttctgtttatccacactgaagaaggacaaaatgaacaggcaactatattatgatgaattacatgagtagacttttttgttttgttcgaacagcagggttgcttctctgctaatttgcagagaagatctgcttaaacagatactaaaattaattttgcattcttgaaagaaaaataaatcaaaaagttgctaaagtacagtggcagagcagaggaaaaccaagtcaacatttgttttctcttaatttggaggacgggaagggggcgagagaggatcagatagttggatggcatcatcaactcaatggacatgagtatgagcaaactccaggagatagtgaaggacagggaagcctgacatgctgcagtccactgggctgcaaggagctggacatgactgagcacctgaacaacaacaatttggagagtaggctgactacacagatatttttaagatatatgaagccattagaaacaattcaagaaaccatgttggaatcaaggaaaatgcaatttatttgagacttataggtgcatttttgtgcttgtcctaagaacttttttgaaattattcatttgaagaggagaaaaatacatctctaccaaagtacttgttttactatttcaaagaagttttacagtagttaaattataaaatcacaagactagaaaaatagataaggcccttgaaagcatatttaaacatttgctttccttcaggcaagaaaaaaaaaaaaaaaaaaaaacacctcaatcaatcacaaaaggaacttacatgccatgccatgctaaacttaaaataaaaacaactgttaaccctgaaacaggtgtccacatgcattaaacaagtattcattgataaacccttccactggtaaagtgaaaatgtaagctcctcaaaaatggaggcatgtttactccagggtccaaatttactcacagtggttaataaataattaaattaatttagttaggaagggggaaaaaaaagaaaattgtattatgaactcaaagagtatttgtgttttaaagcccaagtcaagtttttccttgtagtggggattgtgtcaatgtgttagaacactgggtcatacacaaaccagccatatccatgtggatatgagcttcacacagatacatccaaaatgctttcttctatttgtctaagtgctaaatcattttttcctgcagttgggcatatcctatctacaatttacagatggacaagctcatttgaaaactgactaattaaaatatattgatcataaaatatgtactgttatcttttttccttaacacatcctaaagccaatcttagctgaaaatgtataccgtatgtatccttgcacagcataagacaagaatataattcaatgaaacctttacaaaatgtcagatcaattacattttttcagtgcagatggatttaaggaaatcatctctgaaaacagtacttcatttaaagtaaaataaagacataattttccctgataaatcaatgtgtaggagatgccaaaatattaaaactgccatatattaaagatgccatgatatgaatttttaaagtacatacaagtagtttgtgatgatcctgaggcaaagtcccagaaacactaagattctcttcggtttgcccaacaggaaggaaagaatgataatatgatatacgagaaataaactttcagttattggggctaaaaagctcaaattttagagaaatcattaacacatgactcaagtaattaattcatttaacaaatacttattgaatatcagcaatatgtaacttttcaactacatctataattctgaaagtgaagttggtatgaagctgatcacacaggcaaatcttacctctccctcaacacaggtcagcatgacatttctctaaaagacttctttatgaggttttgaaattcagtgccataaaagtcagatgcataaatcacttctgaagaatacattcacaatgcaccatgcattgtgcaatgatttcatgatttggtagactttagagatttactgttacttgagttaaacattaacagacacaaaatatttatctctttgcccattaaagcttaatatgcaccttagagcaatttatgtatttgttaacacaatataagttatcttctattcatctccaactgaaatgtggtatttaaaacattccctatgttacagctgattataaatgacatttaagagcagtattcaagtgggaaatacacaaagggaaaggtg

SEQ ID NO: 55631 - DNA, 1266 bp, Bovine  19866880922411
gtatgtctttggttgctcctaaaatatccttatgaataaaatctacattgtctggccactcttctacatgacttattctccatgaatcacgccagtgtctataattcttcatagccagtttgtggtggtcctttcgaatttcgaaacttatgactcgtccttgtgatccgacttaatttaaaaaaaaattatgacagtacatagtataagtcagtttattaaaaatgtcaaaaatttatttttcaaagatattacatggatgtgaaaaaataattcaaatggttcaaggttacaaaagtctctatcctatcccaaattcccagtcagtctccctcttcagaggcaaccatatcaccacagttatttacccttcccaagatagtcggtgcctctacaagtgtgcaagtatctctttttctgtttttaacacaggttcccatcatacatactgtcctttcccatcatacatacttacctttcttcttatttaccaatggcatttcagtgattaacaatctattgaattttttaaaagagctattatgttcccttgtatggctatgttttttaaccagtcacctgccaaagaacatttagcttgtttctcatcttagctattacaaacaataccgcagtgacaattattttgcctaggtctttgtaaacataagccatttatatatataggataaagtcctaaaaatggaattgctaactcaaaggatatgtgaattttttttactttgaaaattattaccaaattgttctccaaaaagatgataccaatttacatttgaccaataatgtattaagagtgcctatttctccatacttcctccaacagagttatcaaactttgtatcaacctaaaaattgcatacagtttatcactgtagttttaacttgcatgtcttttgttaggatgaagttaggccttttggatacttaaaaatacttggggcttcccttgtggctcggctggtaaagaatccgcctgcaatgtgggagccctgggttcaatccccgtgttgggaagatcccatggagaagggaaaggctactcactccagtattctggcctggagaattccatggactgtatagtcccgctgctaagtcacttcagtcgtgtccgactctgtgtgatcccatggatggcagcccaccaggctcccccattcctgggattctccaggcaagaacaatggagtgggttgccattttcttctccaatgcatgaaagtgaaaagtgaaagtgaagtcact

SEQ ID NO: 55632 - DNA, 4220 bp, Bovine  19866880927687
ttgacaataccctatgatttagaaggaggcagatttcatcccaatactttgatgtctagaaatggattccagttggttgttgtcctcgtaaaacagcattttatttaattcaacacatactgagactacagccagctttctcatgggcgaggagcccgagctgtataagacagagtctagacaccaatctaaacatctcaaactcaaggcagaccatggctgggcctgaggttagaggccagtgtgccatggaacccagcagaggggagattgattccagctgagagcgagggcctctgcctgaagctgtgagcgtgttctcagtgtgatatcaagctttttgcagctcttgggttagtttccttgctttgtgagcttagattccttaaaaacaaaccaggcctgcttgaggattggcacctctaaggagactgtgtacatgaaccagttataaccacttgtttgttcctaaagcccataccagcaatccaggctggcctggcagggcacagctacagattaagctcccatcatgccaggcatttgctcaccaaggcgcccagagtcggtgggccatctttacaggggcttttggagggcttggggtgatgggcatcgaggcagaaccaggtctctttgtagagatcctattatgaggatgaccctttgtcaccggagagtaacccccgatgagtcagtctttaccatggccgttcaggaccatgaggacaaggcgagaccacaaggatgattagcgggacttgtcttaccctatttacaggaccgctttgattttcagaccacagtcagcttgcatatgactgattaaaaacatgtgccagttgatgtcacagctgcagaagaaaactcgaaaaaagaaaggagccttagatgtttaggaactcgcctctatttgcaaaaatgaattctgacttgatttgtgtgtctttgatttcctgacagtgaggttcgtgtccccgaaccacttctcccaccctgccccacccacccccacactggcctgacttgagcaaacattgtaaggctcatcttatgattgcccaaagaaaagcatttgggaattccagaaagagacctcagagtcctatttcggaagacagcagctgtttaggcttctgcagaaataaaggtcccaagtaaatgaggctaaaggcagcaagatcccaggggctactccgtcaggtcgtgctcccgtgggaagacgagctctggtgggactggtatcagaggctctcttgactgaactcgctcagcgtctgttttctcacctgcaaaatgggaccatgactcctgccgcacgcggcagtactgtgagcaatgttcaatctgctttgtgggtttccttcctctttccccggagtctccaacctcttgggactttttattctctgttttttgctttcattttcttaaagtggtacggattcaaatgtttagatgttaatttcacagatttttgtccttttgaaaaggtccattgaataaatcgaggcttataattccagcagggaaaaccccttttggtgagaaaggctcctaattgccttcatctcaaggtctctgaggattcctctcacagctctctgtccccactctccttagtgtccccagagcccctgcccaggagcacctagatgatggattttccaggcattgttaccccctgatgacttagcttgagctccctgactctggagctctgctcagtgggagggcagacatggccgagagaaacgagcgtccctccttctcaccactgcctgtggttcccagaacatgtgttcggagctctgccatgttcgcaaaaaagcatcccagataatgatgagctctgcctccctgcaccacaagtccttacaatgccttgaggcttgggcttggctggtgccttgatttaaccagtgaaggtcaagacacaaagaggttaagtggcttgctcaaagtcacgtggatttctcagaaccatcactgggtggcacctagagatgaccaagtatccatctgccttttggaggtgaggagccaggcctggactagagcccatgacttctgcctcgtggctcagggatctttctgttcaccccgctgcctctccttttcagtacttgtcctggacagagaaaggtctgttcgaggactgggccaactgtgatacccccacttctggtagccagagccacgtgattatcttaaacatctgtcaggcccacagctcaccttccccccaaccacactcttgaccagaactgtgcacaagagcacacccagaactcaggcaaaagccagccaggggtgcaggtgcctcctgttgcagagcccatccttagataccatgagtccacctccagcctctctgggctgcatttcaagaggttcacagtgtcctgacaactttggctggtgtcaagtcctgagaccgactatctctgtgcctccaactgcgagcgcatatgataagtgaaaagtgatccaagaaggcccagaggaaaggatgatctgggacttttccatccacacagggtttttctcttttgcagccacacatgccctagctgttcccagggactcagtctttccccctcaaacccaactgggtccccatggtaatagttgacatctattgatcaagtagtatgccaggcatcaggccaagtgcttacttggagcatctcatttaatcctcatgaggattactctttaaggtaggcattatggctccccttttatagtcgaagaaattaaagctgaagaggtgagtcacttgcacaggtgggacagccagtaaggagcagggccaagccttgagcccaggtgtggctggctccagaacacacagtgcctatcttgcacagcctccagcctgtgaggccttggagatcatcgagcacagctccctgccttgaagatgagggatctggtgcccagaagggaagaaacttactcgtggaccccagacccagaaaagcagacccactgagctccccagcaccctgattcctgacctcagggaattccctcctggcagtgcctgtgagctgaggccaggagccaatcctgcttccaattcatggaaaacctaccagacctcggcctggagtcagttctttaagttttattctgttgacctgagactctgtgatggactaagttgtgattttataaacccagagtgaaggaactgaggtcagtggaaagggtcagaacctgatgtcatcctcaggcatatttagctctaatctggtctaaaaataatttcccttccagtgtgagtagaatgggagcttgactgactcaaggcctctatcctgcaggtccttttgaccagtgaagggggatgtgagaagaccttcccttcaccacccctgtaacacacttacacttttgaagcttaccacacactttgtctttgggtcaaagagtttttttaaaggtgacagactagtgccattggcaagtgatacattctgagcagctctccactttctctgattaaaaaaaactgaaataaatgaaaacaatgcttcaaaaatatatatataaatggctgggagccagttgtcattttccccttcctccccctttccccgagctgacttcgtgcggctccgtgttgagaggcgctcactgacaacagcgggtagcatcatgcctttaaatagccctgctccgtactgcttccccttggcgtcacacagtttgccctggcagggaaagcccaggacagaacaggaaaattcagaattttctgaaggaggaaagagcttgctgtaaagctttctccctcttgccaagacctttctgtcgaaggagcttgcactggtgtggccccttcccccagagctttccaaggaaaaactgagctgaggagattcgcttcatcagatttgccccatgtgacaccgggcatgaggagagagcacgggagagaggtgcccatcctggagcccagggccccatttcagcagcagtcagtcccactccctcatccggcacctattgtggggccgacagcctctctctatagtgtcctcacctgtgacctaaaacaggggctccaccccacccagtgctctaactccaggtgtcctttgggcaggaaggcaaatgcagtggaggttggcagcagcccattggtgccggaccccctgaagaagggccagcaggcccccctccagcaaacacaaattctgctggggaga

SEQ ID NO: 55633 - DNA, 1677 bp, Bovine  19866880933245
ttaatgatcagcatgcacagctttccacaattttctcttcagttcactttctactctttcttctcttttctaggaaaggagagaaaaagtaaaaaaggagtgtttgaaaagtcttaaaaaaattttttgggggggacttccctggttgccagtggttaagaatctgccttccaatgcaggggacaggggtttgagccctggctggggcaactaagatccctcatgccaaggggcaactaagctcgcttgtcgcaactattgagccctcatgctctggagcctgtgctccacaacaagggagctgcatgctgcaatgaagacttagcacaaccagaaaacgaaaaaaagaacaaaacacctcattttaaaaaaaaattgaaatatagttgatattcaatgttttagtttcaagtgtgtagcaaagtgattcagttttatatatacatacatacacacacatatatttattcctttttagagtcttttcaattataggttatttattacaagatatgagtatagttccctgtggtataccatgggtccttgttggttatctattttatatataatggccgactctttgcaatcccatggactgtagcccaccaggttcctctgtccatggaattttccaggcaagaatactgcagtgggttgccatttccttctccaatatataatagggtgtatattttaatctcaaactcctaacaaattcctccttgaaaagcctttaaacaaagaggatgtgtgtctgaggtttttaatcaccaaatgtacatccacatggtgtggatgaacctgagtggatctctctgtttacttctctacagcgttgtggagcaaatgaggggggatgtagggggaagaagagagaaaggaaccgacttctactgagtgcctctaagaactaggaactgggtgggtactttgcagatattatctcatttaaggctcacaacaatccccagaattaggcactataatattatctcactttatagatgaggaaattgagacagaaagctcaaaggacttgcctaaggtcatgaagttggggttcagagctagaacttgaacctgcatactgaggtcggtacctgatacaaatggaataataataatgaaatacgtttttagaaatcggctaggaatggaactaaaatatgtccaaaacactcgaggcatgttacctctttgctagaacaagggctgacatgagctttagaaaccttgaattttgttcttaatggagacttaagtctaaaagtgtaagtataaaaggataaaagtataaaaggaactgcagttgtagctggaggttgccgcctgcaagtctgctttttcagaagatcttgcattaattaaacattcccagagctctttaagatacaaagataagagctgtcataggtgtgacatactgatcccaaagcaaggaaacattccagaaacactgcaagggcctgaatgatgcataggtgagtcccaaccacctgcatggtatagggaaggccctacactttggagacgcaccaaactgaaattctgcagggagatttcagtgtttggcagaaggttctcattgtcattaaaatataaatgctgggaacttcctggtggtttccagctgttaaaattctgtgcttctaatcctggggacctcggttcgat

SEQ ID NO: 55634 - DNA, 658 bp, Bovine  19866880962713
cagaataaaaattatcaggaaaaaagaatcccacaaatagattataaactcagtacagtttctataattaactttaaaatttggtttttagttccctagtagtcaaagcaaaatagtatgcagtattttattatttgggaatagaggcatactagacccaaaggaaacatagcttttcttgaagtgaacaagagtgtgataaataactttgtgttttatttttacaggaatcgtgggaaaccaaaatgagacataatcagctgtgttgtgagacaccacctactgtcactgtacatgtaaaatcggggtcaaatagattgcatcagcctaaaaaacccattaccctgaagcgtcctatttttaaagatagttggccagcatctgaaaaaaatgcacataatagcaacaagtctaaacgccccaaaggaccctgtctagttatacagcgtcaggaaatgactgctttctttaaattatttggtaggtttaaaatattgtaatagaggtaattataaagtacttaaaaatgagagaatgtaagttctgttttatcattttcatgataatcaaaaaggatgctgttattttctgtgtcagattttccatctccaaccaaatttgtttttgccttagtctgttgtgtttttttttcccccca

SEQ ID NO: 55635 - DNA, 1454 bp, Bovine  19866881094333
cttgggggtgtttccctcagggcactcactgcccactgaaaattgttagtgttcccatctaatttcacctctcggcccacagctactcacttctactctgttagagaggcagaaactaacaggtgatcctggagactggagaatttgcccaaggatctctctccttaacagaaactctcagactcagtgactgattgcaagggacacatctggcacaagcaaacaggtgctttcagcatattgtactgagtatcttgataccaggaaccatagggatgggaaacaaatgccgatccccctgcatgtgacatgtctggtgactttaatggaaacagtgaaaatggagtgttgggagaaacccgtacaaacagagcaaggcagttctgtacgtacacgtgattggtgtttgcccttccctccttctgtgtgttttttgccatatcaaacacactaaaggagagctgcccccagccccagccctgactggagagagtggagtgtgttctagcctggaataggcctctttctgggccactctctgggctgtctgcacagagaaaacacaaatagaaacctcgggcacgtaaggacacacacaggccacagatcctgtcaaaggggctccatcgtgttccgagtgaacagatgtttattccacaacattctccttgggttttgtccaacgcattaaaaaaaaaagcaaaacaaaacagtttacactaattattcccttttgctgcctttgcttgttttgctttgctcttttctttttcccatacgttaaaaactattcgtgtgaggaaattctgcccagctgcttgctggaacagacccttccatagcttaaaccaggaaccctttgttcttggatcggagtggagctcagattgccttgtcacatgtgtcttggcgcttcttccctgaagtttataggctttttaaaatccatttcctttttactccaaagatgatcggctttcataacttttcttcaagtgaattaatccagagcccctcattgttttgggttttcttccatggttcagtcagtattttactcagcaatcatgtattaagcacatcctaagtttggggactatcataccactatactgggtattaaaagaggaattaaacacttttcgctgtcactaatttgttcatatcttcatttcattattcatttccttcattcaagaaatattttttccgctcttgctgtgcaccaggtctgcactgggtgcagaagaatcagtaatgaggaaaaccaggcttggtccttgcctcaaggaattcccagtggtagtggtggaaacagacatggagagaattaattgcagttcagggtgatgcatgctgtaatagcaagggggttcaggattctttgaggagtgggaagaatgtaatgggctctgcctcaggcatagaaatttcagagcatacctgatatgggg

SEQ ID NO: 55636 - DNA, 1850 bp, Bovine  19866881124984
aagtcgctgtggatgtaaaatgggaaaatgattgtaaaatgtctgggttattgttgtgtgcaattaatggtaacttgttattaactgctgtgctaagacacttgattctcttttctgtaggcaataagattttccttaaatcagcaaattacatactgatatggtgacctaccttggcataggatcacaatagatcctccttgccttggaaataataaggaaagcagtgaaaacggagatctgtggtcacacatgtccattcctataaaggaatccttgtcctgggcccttttgcctttcctttgccgcctcaatgcccaaagacccagtcctactctccaagttaggggctccagttacagcaattgaaaatacaagttgcccaggtaaatttgaattctatagaaacaacaaataccttagtataagtatatcccttgcaatatttaggatatacttatattaaaacgttatttgaagtttagttgaaatttaaattgatgtgggcatcctatgtgaagggacagctcaagaatcaattgaacagtctgtccactgacttggggaggaggactcacccattttctagtcctctccctctggtaataaaggctcagcaagactttggctgtgccttcaaatcatttcctgggtagagacagtaaatgctgacaggtcctgctgtgtgtctttggggtgggagcagaggtggggggcggggtgtaaggatgtcttataccagccttcacatctcctcagccctctttcttctgaacattctcagagacagttggcagaataaagacagcctttgtggtctagtaacttgtctcgtgaaataagggcaagccctcttcacagaggttcttctaggaacattgctaaaagtggggactgtagctgctcctgtgatgtgactaacttgaaacagccagagcaggcgtgatggtaaccgactggatgctccttactctgggaagtctagggactgcagaactggagcttggaggatgatccagctgccttacagcaggtgaagtaaagaagacccagtgaagggaagtgctttgctcaaggtcacacagctatccagaattggagtctgaacttcagtctgggtctgctgccttgcattcttctgtaataattcagggggtctgagaactccccacacacttgtttggcggacttggcaatgttttctctggatgacttgataactctcatctccagatgtcaactcagtcgtgtgtccttcagcactgccatgctcagcttcatgcttgccacccttaagagcaagatggtagagagctcatggcactttctagaccagcttgatcttggcccgccccaacagtgcctccttgctgatccctttgccccaccctgatcaagtagttctgtggttgagatggaaaaatccacctcaaagcagagagcttttaacctcagtttcagaggagtaatttgtccacataacaggaggtgaaaattaaaataaagcagggcgtaggttggagcagtacagcactcctgagcttaagagtgcctttgacctgtccccccgagactggaatgatgatctggctgccagagagttcttagaggacgccctctgttcagtggtgtcactggcgaggtggtattagccctaagaccagctttatctgcacactctgaaagcggacctgacggtgcaggcagagccagcccacgtggaagcccgggagcggtgatcaatgggatcttccactctttttattttcttggtcttgccacaacctgtcatgagaccaagaaaacttgttttgaaaatgcttgacagccaaaacaacctgttctcggcc

SEQ ID NO: 55637 - DNA, 758 bp, Bovine  19866881203933
agtaaaagggctaagatattcttatggagaaagtgtctgagttcgataaactgttatttaacataagttcatcacctatgtatgtgtgtattaaaccatcagcaaaaagacattactgaactaatccagtagtcatttctttcaacaaaatcagagattttcctaaaaaaaaaaaaaaattttcaaggtttttaaactgcccagtcacaaaaatattcagcctagtgtacctttaaacaagcacagaggaagttctataatgtaacactcttaaatttttctcataaagatctgatttttaggcaggcttaacttctcattataagtcaatgtaaatctaacattagatacaataaagccaatctcatattcatcacttatattaaccatgtaaatgtgaccaatcctttcaaggtaatgttacctcccaaatccaaaagactacataccagacattaagtaaccggtcatggactgctccagataagaaataaagacctgtaattccatcaaagggttggatctcattaggaggtctgatagtagtgaacgtaagtgatgaaactggtgtcgcatgtcctgtgaagtgctagagaaagttaaatctcatttaggagaagatggatataaagcagtaacaaaaattaagagttcacatgtaccaaacacaatatagataatacatatctgaaatcagagctccagactaattatttgtgctatattcctctcactttaaaaaatttcatctgaaaata

SEQ ID NO: 55638 - DNA, 858 bp, Bovine  19866881301846
agtggggttctcctaggaattgcaggaaggccccatgaggccccaggaaggcagcgctgaggtcctggggcctgggtggtgttagcacccagggaagtggggggagtgggctcctctagcatagcagttcttgtctcagcctccctccagctagcacccagcgccctcctggagaagccatcacagctcttgagtggacgtggggaccctggcagcctcaaactggatgctcccctgaagggctggcaggccaggaacggccaccccaggaaccttgcagccttgtctctgggtccccacccgctggtgccgctcccttcgctgaagtcagaggccaacagtgtggcccgggataccacccagatcaaggacaagctcaagaaaaggagactctcagagggcttggcagcatcttcccgtggtgagccctgggccctgcccagaccccagccctaaggtcagggaccccaggccacttggactgtgagagtcagcaggtgtgcaactggcagctggggtcagaggtggtcggggggcaccctctctacagcccctgcctcctccgtggaatgccatctcccacttaggcctctgcagcggctcccaaccggactccccattcccaccctcgcctccttctagtcttcactgcagagcaattctttttgaacacagatctgaccaccttcttcctcccactcctgccaactatgctaaagccacccagtggctttcaagtggatacaaggactagaacccgctgctttctctcctaattcagtactgattttgttcccctttctacccaacctgcctctgaattttaattatttaattaatttattctaattttaaata

SEQ ID NO: 55639 - DNA, 1017 bp, Bovine  19866881321393
tttgttgaaaagctgtctttcctcccttgtgttgtctttgcactcctatcagagagcagttgactctctgtgggtctatgtctgggaactctctcttgttccatggatctctttgtctgttctgccaatatcaccctatagctttacagtaactttcgaagatgggcagcgtcagtcctttgactttattcttctccttcaatattctgtgggctattctgggtattttgcctctccatataaactttaaaatcagtttgttgatatccagaaaggtttttacactttttttaatggttaagaaaaataaaaagatatttcatggtacatgaaaattatatgaaattcaaatttgtctctataaagttaatttgtttacatattatctattgtagctttcttagtacaaacagagctgagtatttgtgacagagacggtatagtcagaaaaatctaaaagactgactatcttgcccgttaccagaagttgactgagccctggtctagatcctaggctgttacttacacttagtttggttctgagcatggcccatgggtccagactccccgttttcaaatccttccatcaccatttgttcactgtgtcacctttaaaatgtcacttaccctttctgggcctgtttcttaactgtaagatagggaggatagcatttatctcacagagtcattgtgaagattaaatgaattatttcatgcaagtgcttagaatagggctgggtacctagaaactgcatataaatattgacttccatgcttgtttttatcctggcttaaaaagaatattaccaaaatggtctcaaatctctcccctgctaattcatctaccccactacttcccagagtgatgatcatcttaaaacacaccctaatgctcatctcttcaaagacctgtcacagcttcctgtttcctatggagtagcctggtgttcacagctccacagcctggctgccatctgtctgtgcagcctcatctaccttgccctccggttatgatcc

SEQ ID NO: 55640 - DNA, 1522 bp, Bovine  19866881331182
taaggaacccccaaagcaatctgcagtaatgtgtctgtgcaagatatagggttattgctaaccccttcccagatgacacttttgcttctcaacctagggattctgccttaagaggctgcattaatggatgtacagggtcccaaacaatggaggtgatagttggaggaatggaacctggactttcctaacacaaggcacattaatgagcagggcaaataggtagggtggagaggaaaagcacgaaagctgtgaatctagagcagggagttaattccagataaataaccaggacagttcttgctttcttttaggaacgacccaggcccatacttcccctggagagaacacattggaagagcagctgtggccagaggtaagggctttgtcttcatgggagaggtagtgacttcccttctgaagggtgagtcctagtcttgatacaagttgacaggcccttccctgaggccttgggggtatagactaagtgagctgcttcccctgggacaggcaggttacctggcagagtggaggcagcataactgtagctcctggaatttggggctcaaaatctcttcagactgagcaggtagttcccagaagtgcccagaaagacttataaacagcctggttatctctgtgaaccttgaagcagatgctgtgagttatccgaagtcatttgggtgaggttttcccagaacatctacaagataagagttgagagtaaatgctttatctcttactgaaatcagtaattcatgagaaattaacttgtgtctcctggtcacagatgtgcaaccaatttactgcacattttcccccattggaatatttccccttttactctcggttctggggagaatacatatgacctcctttcccaaagtcctccacctgattcccagaagtggaggctgctttggatgtacatgggcatctgaggcagccaagtggtcttgaggaccagccctccccccactacacacacttgctttcagcagcccctctgggcttaggacacattctgttccagtagggacacaagagtctcccaatttccactttatccaattcccagctttaaataacttaatgccccatatacccgcttttgtataagcaatcaaatttaaagaaggaaagtagataattcaaaaaatataacactatagaagagatttaaaaaatttttagtctagatatattgggtctcttcatggtttcctttttattgtgataaaatatgcataatataaaatcgatcatttttgagtgtacagttcagtgacattgagtacattcacattgctgtgtacctgtcagcactttctatctccagaactttctcattatcaccagttggtttttattctttatcctgcctccctctctctctaccctactgttctgaggcatccttacttgccacctctaaaatcgttctcaacaggcatatgtctccttttactaagtgaactggatatagggttaaaagagcatgactatggacaattggttgcttctg

SEQ ID NO: 55641 - DNA, 729 bp, Bovine  19866881335490
tccgtcccaagagtgcatatgggcttcagaacagatgggctgaagtatctgatgacatctgaaaggactaaagagagagctggtttgaggctatgttcccagcagccgatggtcacctgtaaagactgacccactctggtgaggtgccaaggtcactgcccctgccccaaagcatgacctgccttgggctgtgaggtccaccttgtagcaggcccttagaagtgaacagagttgagaaaaaggagcatccatcgggtgccaggccagccaagtgctaagccctgaggtatgtgtgtgtgaagggaaaccgaggctgggggaggctacaccagctacctgaggtggcgtgggatctgagcctgagcactcagatcccacagttcttcactgtcctgcactgtgtacttgttagggaaagtgtgctgggatgggggactcggcaggctgcctccctgtcctccctcctcctgagagtgacagcagagcgggaaagctccggggagcacacagaagatgcgtcccagagctgacagccagaggaccgctaaaaatagtgctgtcaggagcagttaggctgtgtctgctccagagagaggagagggcagacgggagagtgtcacggcagcgaaattggtgtccccctccctggcccctctttctaccgcccccatccacaagtgcctggggcttttttggagcagaatccaaaagacagctttagaggggctg

SEQ ID NO: 55642 - DNA, 879 bp, Bovine  19866881405719
ttcactttaaagaaaagttggcaatgaaaaagatttctatcaattgaattgaatggagtgaatcacattttcccattaagttccactttaaaatttataatattgaatcaaatttggcctgctactcaaagatgtccctagactacctaaactcatttaaagaaaatacttatttctctctaatcaaagtaataaaaaaatgcatttcaaacaagtcacaaaatcaaaattccaaataggtctcaaaatttcataaagctgctgcattgggagcaaactacaggaagaaaagataaagcacatatagggcctggtctgcaaagctaaccctataacctcttcccttttagggtaaatactactttctaaacgtcttctaaaatcaattattttgtaagatgatttctgatagcttatttataattctgggaaaggctccataactactaatatataatacaatattctttaaatagtccatggagaactgtaattcacaaatattttaaaatttactcactctgtgactgatactcaccaggttttgtatttggttttgtacacagcaatgggaaaagaaatataaataccatgtagtctctaggatcttccaactagtgacagagataaactgaagaaattttaattcgatgaagttaaaaaccctgattgagcataaaggccatgcaggagtatgaaagagagcacttagctctgttatacagaatagtgccaagaaaggctctggagaggagatgacatttaatctgaatcttgaaggaagactaaaaactgactaggatagcaagattacaggcagaaaaaagtaggaaataaattttctcatgctgtctcttaagtgtgggtacatatacttaa

SEQ ID NO: 55643 - DNA, 1801 bp, Bovine  19866881409527
taactgccaggtgacagaagtggttaacagtgactgtccatgagtggtgtgaggcagagtactttcacttttcactgcatttctttctggagtatgtgcttttgtaaccatgttcgtgtttcttttataaaagtaataagcataataagagtcggacacgactgagtgtcttcacgttcactcttcactttcatgcattggagaaggaaatggcaacccactccagtgttcttgcctggagaatcccagggacgagggagcctgatgggctgccgtctctggagtcgcacagagttggacacgactgaagagacttagcagcagcaagcataatattctttgttggtttgaatagtctattgatatgtctacaagctgcaaaggaccattttctgtgtgtttgaacggagaggtcaagttctgagggcttaacagcccaaaggggctgcataaggcacgtgtgctgatgaccagggggcaatcctagtgtgcggctgcaccttggggccagcagagccctgtgcctgagaacaaagcagcagccctgaagagagaataacgcattcacttcaaaaagtctgcttacgtacacagatggttcttattgatctgtgaccacacacgtggatatgtaggtttgtgtatatggcttttttaaaaaacataaaaaaataccctaagaaaataccatttatttcttctactccctgacctgggcacagtgtgggggaagcaagtctttgaaaggtatttctcccagtttaagaaaactagaatttccatgttaggctgaagatctttcatacacacacacacacacacaggaagtgggcttgaatgctggacagctcagtgcagaaagggtgaggatagtggtgccctagggtcaggtggcactgctatggagagcagcagatagaacaggcagatcacccaacacaaaccagagagtctttcaaaggccagagctgaagataaatcaatccttgctaaaaacatctgatggctgcgtgctagaaaggcatattttgctttgctatgtaatttcctcagtccttaactaccaaagtgtatcagaattgaattcaagtgctcgtcctaatgggagctgagtcacaggtacctcggtgctgtgtctgcaatctccagtgggtgactcatgcctgtaaaattctgagagaaagtaccaaccgacccgttgcttagtcatctttcgcatggatgctgggttcatgagctctgtaaactataatgagcgatctagccttttaccatctctttattcttttctaaacagtacaaattacatctctaaaaataacttcatctatgcaagtgagtcactgtgacctgacaagcttccacaagctacccagccaaactgtaatatttacttgtgaaggtataaatcttactgtcacattagccccatttgtttttgttttttttttaaagatcaaaatttggtagacttggggaagggaggagaatttcatcagatggcttacagaaaatatggtttactcctaacctttgacatgggcagggctttggggtgcaggatgggggaaggactcctttgaaaaatatttctaatagcttatgaaaactagatttttaatattttaagttgaagattaatcaaagactctgaacttttagtaaggagtgcttatcagcttttgaaagaaatatcagtaatcttgtttattctaaaatcctaaactgtgaatgtatgacatatttgacaaaagacccagccatgctaataaatgcatggggtattaagcattcatcttta

SEQ ID NO: 55644 - DNA, 685 bp, Bovine  19866881616777
tactgtttgcacctgtgaagtcgtggctcaggtgggcagggctggaaggaattcggagatcttagcggtaggggtggagaggaagttggcactcatttgtggagctggattctgagagaggtggccaaaaccttactgtgtccacatcagtaactggttttgacatacaatggggcttgctagagcccaactgtgggacacagaaaggggagtctcttggtcatggggagaaggaagcaagagttggggggtagccacctaaaaacccatcaggtttggagctgggtgagccggggcaaggtctcatagcagggaccagctgaggaggcgggtgctccaggcctagaagcagagctacccaagaactcagtggtgactggatggttagagaagagaaggtaagtggacatgtgggtgtctgttgcaacagatgtgcgcctggaaaggtgatgtcaatgtcctggctgggggctgagagggctggatgcctgccgggattggcttcagatcaggaaaggtgtgggggcagggggaggcggggctgtcaatgcctgagcccagattccattgctgggaaacgacgtggggtattatcagttagatagtttccaaggaggtcatggattttccgagctttaatgacaagtctgccttcactcatgcgccccccacctccccacactgt

SEQ ID NO: 55645 - DNA, 1704 bp, Bovine  19866881986931
agaacactaattaatgaagaaacttacattgttcctaagcagacagaaacactataataagagatgttattgctccaaaaattgatttaaaaatttaacaaaatctcatttataacagtatcagaaatcctaaagtaacttaatttactgcaaaagtaatctgaaggagaaacaaaaaaacaaacaaaaaaacagaagagggaataataattaagaataatgtgaattattttatcagaaatgaaaacttactgttaaaccaaagagattcagacaatatagtgctcacccagaatgtgcaaatagatcaaactgtttcagggtccagaaatcaaacttaacatacagcaatatcagttcagttcagttgttcagttgtgtctgactctgcgaccccatgaactgcagcaggccaagcctccctgttcatcatcaaatcctggagtttactcaaactcatgtccatcgagtcggtgatgccatccaaccatctcatcctctgttgtctccttctcctcctgcccccaatccttcccagcatcagggtcttttcgaatgaaatttcaaatttgaaatccttagatgagaacaatagcgtatcagagtgtcttaagacttagagacttctaaaatgatttaatccaaatctgttattttacattttaaaaaactaaaccctatatgtaaaatagataaataacaaggtcctacggtatagcattaagtaaaaatgttagttgctcattagtgtctgactctttgcaaccccatggactgtagcctgtgaggctcctctgtccatggaattctctaggcaagaatactggagtcggttgccatttcctcctccaggggatcttcccaacctggggatcgaacccaggtttcctgaattgcaggcagattctttatcgtctgagctgccagggaagcttgggaaactatattaaaatcatgtaataaaccatgttgtgaaagaataggaaaaagtgtgtatgtgtgtataactgaatcacttagctgtacaccagaagctaacataacattgtaaatcgactatagttcaattaaaatttaaaagctcaaaaaactaagccttagagagtgactctaagtgactggctcaaggtcatgtaacaagcctagggttcggatttgctgtattgggacgagggaactattcagtgtttttcagcaggggagtggcctaatggaagtggtcctctgggcaggatgagcctgctggcttcagacatagaaggtcacaagctgaaagaggcgacaggctggtgagtcagtgggcctggctcctagcaagaggccccgcgtggtgtgtgctgggctctggcaagccctgctttcctcctggcttaggcagccatttcctcttacacccctgcgtctcagggagaagcagtggtcctcaggcaatggtcccttcttcacacaagcaggtggttttccagggaactccaagcccttcatagatccatgagcttgaggataaagcagctttccaaatgggaaaattcccttgggattccatgattagcgtccaagcaattcacaaatgctttgatgatttctcccaaaaggcctaagggtgatgtgagaaaggcaagaatttttcttcccatttacctggtaggaaacagagaactggagtgaaggccagagagtcaatggggacaggtccgaggggtc

SEQ ID NO: 55646 - DNA, 1033 bp, Bovine  19866880097821
tggtaaatagttggggaaacagtggaaacagtgtcaggctttatttttttgggctccaaaatcactgaagatggtgactgcagccgtgaaattaaaagacgcttactccttggaagaaaagttatgaccaaccttgatagcatattgaaaagcagagacattactttgccaacaaaggtccatctagtcaaggctatggtttttccagtggtcatgtatggatgtgagagttggactgtgaagaaagctgagcgctgaagaattgatgcttttaaactgtggtgttggagaagactcttgagagtcccttggactgcaaggagattcaaccagtccattctgaaggagatcagccctgggatttctttggaagaactgattctaaagctgaaactccagtactttggccacctcatgcgaagagttgactcattggaaaagactctgatgctgggagggattgggggcaggaggagaaggggacgacagaggatgagatggctggatggcatcactaacttgatggacgtgagtctgggtaaactgggagttggtgatggacagggaggcctggcgtgctgcgattcacgaggtcgcaaagagtcggacatgaccgagcgactgaacttaatgatgctggtttagccttcatttgaccaatcagagcaggtttttggcctcatttaacagcaaagaaaacagaataatgggcaaatgtaatccatcctaaatgtcaaaaaatttaatttttcagccattgtagccaaattttcatattccctttcatttattcatatttgtgaaactatgttactatgaaatcaccctgagtaaaatgctcaagatatcatcagttttggcttatgtgtattataatttcagataacttttgttaaaatactggtttgtatgttcacatattctttttcttaggtgactgtaagtgaattgcacttcagtaatttattgcattacagagaaatgtagtttttctcttgctgatattattcctgtattcaaattttgggggttc

SEQ ID NO: 55647 - DNA, 1893 bp, Bovine  19866880531154
atacacacatatgagctagccacacaaaaatgtttatgagttgtgatccaaaaatcttgaaaaaatactgatttataaagtatttttatacatttctcatgccatcctttcacaacagtgctgttttaatctccattttgtctaggaaaaacagaaatgaaaagatttaatttaaatatggtaatataactattaagtgatcgcattaaagccaagatcatctttctctttcctttaagcaaaatacgggtctgagagatcttacatgcctgttttacagttaaatatcttacgctgaatattacccactgaaatgaaagagaagttgttgtaattactttagaatataaatgttagttgcagagctccatagttgttaaccataaaagacgcattctattttaagcattccaattaaagtcttatctacctagttcctataagaaattctttaacaacatcctaaaaaactggattacaacagctctaaatatgttaagaatagtattagagaacacacccattttcatgctgttaccacctgactgccgtcactgtggtagtgtgtttgtatgataaacaagattcactcataacccaaaggtaatcccaagcaaccaagcaccaacagcagatagttaagtattctgagggtgggttattgtggaaatgaaaaatggaactgtcacagatgtaaaacaaaatcaaagagctcggagtagaaagaaatccttattgttgttgctgttaagtcactaagcctgccaggctcccatatccatggggttttccaggcagaatactagacttggttgctatttcctactccagggatcttccccacctaagaatcgaacccatatctcctgagtcttctgtgttggcaggctcattctttaccactgagccaccaggaaatccccaaacagaaagtttaggagccatcaattcttactctttaaaacagactaagagatttcctcttatagccaagatgaagtaatatggaccagatttactctcacacttgaaacaactaaacacaaacaaaatcgattaaaaaataaacccaatatacgaaacaatgattttcaaaattctgaacattaggtaataaagtacactgatctctggaagaacaagaaacaagtgcccgcacagctaactgccttagtttctacaccacagcacaggaagtcctctcttaagcggagcccagctaactccctgagttgaggaggggaagctgacactctgaggagaccaaggcaaccaggttcaaaggatacagtaccagaggacagagctgcacacggagagaaggccagggatcttcagaggacagcctttgggtgtgcagcagagtactgagagggcaggcacacaaagaaactaactgcagctaaggaaagaagcgcataaaaatgagaagacacagagctcagcactcaaacaggaccaggaaccgtgcatgttcccaccagacagactggaaaacttcaaattcacggggcactgactgggtagaggactcaaaaaggtcttgcctcagtagtgggaaataattagccccagactaaacatggacctgatcctgccaacaaatcttaaaagcaagacctgaaaggatcgaattgtttccatttaattgcacaagcctcacaaatatttatagaaatataaaaatatctagcattcagtaaaataaaattcaattttttgacatccaaacaaaaatgatcagacatacaaagaaaaacgcaacccataattttaaaaattaatgattgaaattgacctagaaagacacagatgctggaattcacagaaatacattaaaaaagctattacaactgtatttaaaagacactcatgtccaaaaaacatagggag

SEQ ID NO: 55648 - DNA, 1449 bp, Bovine  19866880591794
ggccctgtgcaaattatggcattacaccaacttattgccaatctttttaattaaaacattttgctttcaactctactaatggcagagatcagtaaacagggaagattgaattactgatattgaagctcccacatctcttaaaaggcttaattactggtgggaccacagtgaggccagagaaaggttgctaacaagcaggtgggcctcacgcatgaagaggccagcccctgtgaaggtgaccaaacaaagcccagggcactgaaaagatacatattacaaaaaaattgttttagaactcttaaaggacataaaaagctgctagagttatggctacaattcagcttccaggaactatgtcacattgctggctgctcagtttgtgtttaattaaattgcctggcctgatacctggaggcagaaccctgtgtccatgcatccatggtgtgtggctgatggtaagggggtgacttgcttcaaaggcccctcccaatctcctcctgcagttaacatccatctaaccaaagtccccagggagcactttccctcccagcaggccccatcagggtggctagaagtggctcagcaggaaatgccctcagatgggcctcatttagtgaagggaaaacaaaggccccagagagaagggtcacactgaggctccttctgtgtataatgaattgtgctaattacagtaatctccttcatctccttcaggatctataatgcccaggtaggaatgagtagctatttttaaacggaaattttctgttaattaaaactgcttcaagtgtgtgtatgtgtgtgtgtatatgtgtgcatgtatgtgctgtaagagtgtaggtgtttgtgaggtgtattcgtgcagtaatgtacttgtagtacaaacttgagcacagatacttctgggttctttcctcctgagggttcgggacagtcagggtccctccaacagagcagatcttggttcccatgaatgcagtggacatcacagatgcacctaatcagatcataggaaaaggtaaagggcaacttccctggcagtccagtagttgagacttcaccttccgataaatggacggtgcagatttggtccctggtccagaaactgggatccctcgcggccaaaagaccaaaacatgaaacagaaacaatattgtcacagattcagtaaagactttgaaaatggtccacataaaaaactcttaaaaaaaaaaaaaggaaaagggataaaatatatgcccagaaaatcttagaccaaaatgtcaaaaaaagtagacatggcaatagtaatttcagacacaacagaatgcaaggcagagagcaatactgaggataaagaaagaaaccacggttatgtttgccaatatgactgactgaccagggacttgtgtgaacttaataatatgatgttgcaaattagcaagaattgcataaaactaacaaattgcc

SEQ ID NO: 55649 - DNA, 1123 bp, Bovine  19866880945673
ttttttaaaagatgatgagggggaagtgctttattgcaaagcactttgcaccctgccccctttctccacagaagcgtaaagctacagttgaaggaaggacaagctggtggccgtgctcccaggatgagctgagtcccgttaaattaaaataaatgaaggcgacttccagctggtgactcacacacgaaggaggccggagacaaggagatggctggctgccttccggaactatgcccaggctttgtgatgaggcaggaaaggaacaccttcccaacctcccactctacccggagaatcccgaaagtccacactcacatctgggggagctgaggggatcccagagggaccagaaaggaatcttactcacccttcagaccacaccatccaacaaacacattggcctgacagccatcttccacacctagctgtgggccaggtacacagccaacaggaacacctctaccaggaagtcctccaggatgcagcaacaaggaagtgctatgcagaggcctggggatcaactgcagcagccagcaagggaaggctcatgagcagggtatggtggatgatcagcaggactgactgccaccaaggtaccccaaggggaggacacagtgggcaggaggctgaggagatgctgggtctgcagaatgggaagcgctggggggtgggggcggttcttgctcagcacgtgtggctcagatcctccctaactctgactctgtagcacataaccctcccctgggggtgctccaaccccatccccagagcaacttccagggcccattcagtgcgggactaacgtggaggactgtgaggcccctgagggccgtgtccttgggactctccttctcacgtgggcgagccttgaagagccacacagcctgagtaagaactccttggtggctgccctcccggggccaagtggggagctcaccctcctggtccttccaatcccaggaggcactgtgtgccccagccctcgtccaggtgtgtgcccttccccagctcccaggcctttagtcctgaacaggaatacaatgtgatgtggtgtgcagggcctcaagaacactcccagcctggttctgttaatccccaaaatctgggtggggaactgcattgg

SEQ ID NO: 55650 - DNA, 782 bp, Bovine  19866880965498
atcatctttttaaaaaaaatttcttaacagaagcaatgggagaaatttactggcctgtcagaaaagccattgctcatcagactggagaaaggaaaagcagaggtcatcaattcatgggcagtgtctcaggaagggattaaatcatttagcaacatgttcttaagaaatcattgcagcctcacactgccattttctttcttggaccttcccatcaaatacattttccaaatgtaaggtgagtcagctgctgatggtcagaaggctgagcctgttccatttctagaagatgatgcagacctgcgtgtgcgtgggtgtgtggatgatacacacacatgtgcctatgtgtgccaacagacctgtatttgtgtgatactgttgcataaacacacacataaccattgtctagctgtgatgttcagtttgttggatttttttttttttggatgcatcatggcatgtggaatcttagttcctaaccggggattgaacccatactccctgcagccagaagtgcagagtcttaagtactgggcctccagggaattccctgatgtccagttttcttatgtttgtgttatttggtaagttgccacaaatttattctgataaatatatatatgtatacaatatgtgtacatatatgtatgtatgtatgtatgtatacgccccaactatagggtttcagaggctgggttagagcccctggggtgtgtcacttctggcatgtacagggctctacagcacttggcatggtgtcatcaggtgaccagggaggctttaaa

SEQ ID NO: 55651 - DNA, 1448 bp, Bovine  19866880979478
ttttgagttatagttttgtccagatatatacccactcacttttgctattaaaattcttcactgcagttcgggagatgctggggctccacgatgctgtgcttgcaccccctgtgactagtgcctccctgcctcgggctcgcattggccagccctcccctggccacgctgcactccttgcagactcttgttcagacctggacactcttcattcaatacacactgactgagggcccactgtgtgtcatgcccagctctgggcactcagacgccacagtgacaaaacaaaccagaatcctgcccaaagggcttcagtgttcaccaggcagtgtgcaggtgccaggcaggaggagacccagggccaggtatgccctggagggttagagatgagctcgggtctaacagagcgcaggaagtggagggtgaacagggcaaggtccaagaagctgctgcggggaagaggacggccactgctgggttctgtctttagcctccaaaggacttgtggcttgtgggaagggacagactgtagggcaggtgggcacagaaggacaggcacgggctggtgcgggaacggagtgagagaggatagggctcaggtaggtaggtgggcaggggggtgagtggaggtctgattctggtgtataggaaggtacaggtcacagggtctgctggaagccatgctgtgggggaagggaggaaaaggcactgggagacaccaaggcttggaccctgagaaactggaatgttccacctggggtggggggaggggagggagatcaggcaggtgccttgtgaacacctaccggccaccccagtggaagtgtgtctgagtggacattggatctgtgagcccgcggccccagccccggcccttgtccctggcctcccacggggtcagcacaccaccaagatgcagccagtcccctggggaccctgctgggtgtcatggacccgacaccgcacccaggcctggcacacaggggtgcctggtgggtgtattgtccctgatggctgtttctgctttagtggaaattctctgggagccagtgccccaaccatcgtgaagtgagggacagttttgtgccttggactggacacctcggtactccgacgcctgccctgtgcatcgcagcctccgctcccagaatcgcagctgcgtgccttccctgggaccagacccctgggggttgaactccctgcctgtcactattgagggatgacttttcttctcttcgcaagccggcaaattaattcataccatctatttccccgactcggatcaaaggttgtcaaattccttcacccacttaatgatctgtaatatacctttctatttcctgaccaggctattagatgaattagaattcataatagcctgccgacagcctccgtgcacctgtgtacatgtgtggggtcaggcaggaccccagcatccccctcagccagga

SEQ ID NO: 55652 - DNA, 905 bp, Bovine  19866881059637
catggacaccaaaggttcctatccgccctgcaataaaggaaccttggcagtcttgaaggtaggccctgaacttacacgaccacgtaattcaaggctgctagtgatatccttctggatctgtctttaaggaaagcaggatagaacctgactcttgtacaattttttcttgttttgcattatttgaaaagccctttgtcagaatgtggaggtgagagttcctgttccatctctgaaaggccgtggtggccctggcatctcatcctcccttctggccaggcatccctgtgcctcctgccagcatcagagccaccatcctcacagccgcacacagagaacaggcaaacaaggggagcaacatgttcttttattgatgcaagtacgtccagtcacaccagtagctgacatcctgcattatggtacagctttatactcagagttcatctcgaaataccaaaacatcagagttggggtatgtatcaaattggaaaaacaaaatagcaaatgtagacactgtggcaggtcggtactagaactgataacccagtgaagtgcacattgatgtggaagctccttaacacgtggatgaaaaaggttctaacattgtattccaaatatagattctcaacttttaaacctttatttcaaatacataaagcaatatgtactatcagtatacagtatgtactatctagaacatctgaaaagtgcaaaaccactgtgacaatacagtgtgaatatccttgctccacccggggctgagggcgacgtcagcagcagatcacatctccaggctctcccaggagttctgggaattggcaactaacagatccgtcctcacccaggcctcccagctggaggctctggcgaatgccagccatgtgcggagagagagggttccaggtatg

SEQ ID NO: 55653 - DNA, 1240 bp, Bovine  19866881140363
gaagccaaggtgcccaaactcggcccctgagagcacagcctgtgggtggcattgttagaaacacacaccctcgaagcagtcacatttcatgtagggtatgaatcctaaatagtactttttttaaaaaggaattataataaatgcattaaaatccaaagcaaatgcctttttttaaattgatttgtgccttgaggctgacctatttgttgttgtttaatcaatcagtcatgtccaactctttgcaacccatggactgtagcccagcaggatcctctgtccatgaaattctccaggcaagaatactggagtgggatgccatttccttctccaggggattttcctgacccacagatcaaacccgcatctcctgcactgcaggtggattctttaccactgagccaccaggaaagccacctgatctgtttgtaccaaaaagctctttcttaagttgcattagagaggatttgttaggttgaaccccagcctctccatggtggagggcagtctttcagaggatgctaaaagggccctgggataaaataagtgggaaaaaccagactcaagacactcacactgatttcttccctcagagcttctcagaagggcctttagtgtgttcatttgtgtcagaaattgccaaggtggaaacactggatgtcggtttcccaaactccttcaccctcagatatcaggggagatctcgatggaagtgcttccagcctacacactgggcagcactcagggtgcccctgatctccccagaagtggccacagtggggcctggcttgcactcagcatcagttccttgggaagtggtgcgtgaccagcacgccttgtacagctgtgggcaggccgactggctccctccagtgtctcagccaagctttggaaggtggggctgggacgccagcccctgtgaggctgtgctgctggtctgcacccaggaacacactggagtcattactcagcatcccctcagagctgaaagagcctgagacatgcccccccacaccaggtcccaggatctcagagcaacattaatgcctttctttgactccctccttagggtcggatcccagtcaagtggatggccattgagtccctcttcgatcatatctataccacccagagtgatgtgtgagtctggatgttgccttcctggggtggaggttacacgtatgcacctgtctgggcagctccactggggaacagagctgccctgagtgcctgtcaactcatt

SEQ ID NO: 55654 - DNA, 869 bp, Bovine  19866881174562
ctgaaattggcagttaggtcctaactctgggcccataacttaagagatgaaaaggaagagaagctacagaattaataatggagtattaaggaatgactaattcattcgttcaaacctctgagcacctactatgtgccaggtactacatgagttgcttggttagagaactactgttctgtgaggtttagttgtgaaaggacagaaacctaatggtagttactgggtactgcacagttgggtgggggtctctgaaggataggggagacctaagcatcatttgcagggagagaaagaacttaggaaaatggaaggaaagaaaggtggcaagtaagagacaagcttaggagatgatataaaagtgaaaggattagacttagaaaaaagttaagagttcaaaagaaggaaatgaagagtgaatggaggcaaatacaaaggtgagtgggccacagagtaacagcaccctaatcatgccacgctgaggttaaggaagacgagtcattagagttgcatgaataaactcaggggtgaaacgaggaacttacttccaccaccactcacatctcagccaactttcaacagcaactattcaaaattattaattcattaagtatctgaaattctcattcttctgctattatacatacaagacttcaatgtggacatggctcaccaaccttgcgacagattctaggatagacttgactttagaaagtccttctttaccaaaatacaccactgtgagatgaattctcttgtcctgatgaatacatacatccctgacagggttgaaaaataaagttcattcaggaaaatatagaaggcactgctcattcagaaggcaatcatacgaagcttacaagaaaacaaag

SEQ ID NO: 55655 - DNA, 2023 bp, Bovine  19866881197493
atggtcctaatatacaatggccctggggaggccatatggatatggggtaggagaagggcactggattcgagtggagatgagataaggcaactgagccccccatgtgtgaggtgccattagacagtttaaaggggacttaaaaggggacacttactatgctggtcagctaggaaatgaagcctggattcccaccaggttgatggcacccacacatggtcataatgttagaggaaatctcagtagtgtaaggaaagtagtcactcacattcccagcatcctttcatttatcctgcaacagggatggatgtctttgtacaaaattgtccccaaagcttatgctttagtgtggtgcctttttcacttaaaagaaaaataaaagctgtttttgtaaccataatcaatagagggaaacgtgtaattcacatgtaatatgtggctttgatgtgatttttccaccaagtggagttgacagccctcctgaggttggctatggggtggtcactgttcaccttcaagccttcagcttttccccctttctgggtcgtttctggaggacgaattccgggacaggcttgggttgaagagtatgttgttattactggtcctcccctcatcacgttgcagtgagtcattgaacttttgaatacacacagcatctcatcttctgcggcttccctggtggctttggctgatagagaatccgcctgcagtgcaggagacctgggttcgatccctgggttggaaagacccccccctggagaggggaacggctacccactccaatattctggcctggagaattccatggactgtatagtccatggggtcgcaaagagtcagacacgactgagcaactttcacttcacttcatcttctggcgaggaaactgaagcacaaagagacaagaaccatcagcctcaggccatgcagcctgcaggtgtatagggcagggatccaaaccagacagtcagaaatatttgtgtgttaacatgaaatcacaccacatgtcccccatgttggttttcaagtggtggaattgtggcttttttctcacattctctaaaatgagcatgtcttgcttccatagttaaggaaattcctaacagtttttcgaaaaccagcaaacgctaggagctggatctctgggctgcagcctgactggtgccagccctcgccacagaggaggcaggcagggtgtgtgaaggggtgtgcctctcctaggtgatcaggttgaggacctgaggcagacctcctggttccctctcttccctatcagcaccggtgcaggctgcaggcacagtgatgctcagagcagtgtcttcactgcaaactgtgcttggaggctgtgctccactgtggagctaaacaggggtcgcagcgcagggccagcatgcaccccagctctgtctcctctcctgcgggcccctgaggaaggcagctcgccctccccgcacttcggggtcatcccggggttgctggtctgcttggtgctcaggtgagagtctgcctttccgctgcgatccggacagcctggaggtgagcacgcgctgggccctggaccgcgagcagcgggagaagtatgagctggtggccgcgtgcacggttcgcgtgggcgcgcgcgaggaggaggtgatggtgcccttccccgtgaccgtgtacgacgaggacgactctgcgcccaccttcctcgggggcgtcgacagcgccagcgccgtggtggagttcaagcggaaggaggtgcctatgcgtttgtctggtgctcgtctagtgtctgtcgtctctctgttgggcatctgggtccctccattcgtcatttgttccttggtctattcagctgtccatctagccatccagtcatgtggctgaccactctagttattcgtctttcatttgtccatcagtctgtctgtcggggttttgttggtttccaggacagctgaggaggagagaggaccagccccactggcaccgagctgatccctgccccgggaggagggtgaggggaggggcttggagtgccggt

SEQ ID NO: 55656 - DNA, 1241 bp, Bovine  19866881206818
agcagtgccagagatctctgaattttcatctaaccctcaatagctggagtgaccttaggaaagctacttcattatctctgaacatcaatttcttccatcagtgagaattatcttagagtcacctccatagagttgtgagaattaaatataataaaaatttaattaaaataaaaaatatataataaattgagcacagggacggtacttagtaggtaaatattacttcctgggctcattccagtgttaggtgagcaagatgattcatttatatctgattatttaaaatagataagttcagctttaccaatagctaatatgcagaccgactcaggtgcctgccttgatcgagtgtcaagtgggctttggtcgtgcctggcaaaggccacatgctttttaaagggcagagcaggagctccctgcagaaggtggacagtgcttctctcacatgctttgcagctgtcatcattttgtacctactatagtttccaagggcccagctacacacaaatgcatgtagactctattttcttaagtagctgaatctttgcttgtactatctctggttcagctctgagggtaatgtgagcctcaccaaatgatttacaaagtcatccgtctacttcagtcttccggaagtttttagaaaattggaatactttcttacatgtttgatagaatacatcagtgaaagcatatggggctggtgtttttggtacattataaattattgattcaatttctttaatagatgtgggcctattcagattgttttttctcaagtggcttttggcagattgtgtctttcaaggaaatgggttgtttcctctaggttatcaaatttgtgagcatagagtggttcataatcttcctttgttatcttttttaatattcatgggctttgtagaaatgtccctttttcatttctgataagttatttgtattctttcttagcctggcaagagacttattgattttattgattctttcaaagaactagcttttggtttcatggattttccttaaaaaaaataaaaacccttatatatatagagttggtttacaatgctgtgttagtttctgctgtacagcaaagtgattcagagttaaagtgattctgttttgtatttaggttcatttgtgctatattttattttatttattttttttttgtgctatattttagattccatatataagtgataccatatgatatttgtctttgtcgacttacttcacttagt

SEQ ID NO: 55657 - DNA, 1184 bp, Bovine  19866881236825
tagaggccttccctgcttcctgtctcctaggtttaatcgtctctatttctagaattaagtatccttaaagtttaaaaagaaacatggaagagctcatataactggttgtagtatgaacgatagcatataattttgtaaatttataagggattctttggagaagggaatggcaacccactccagtattcttgcctggagaattccatggacagaagaacctggtgggctacagtccatgggatcgcagagtcagacataactgagcgactaacccacccacccacataatggattctttaatttttttcctgcagataaacatgttcatgtttttttttatatagactccaaacttttccagacttgtaggaaatctgttgctgtgtaatacagtggaaagaattatgtgatctaatgctcaaataatccactggaagaaagactttggatataaaaatgtttcttaatgtgttttccagatgtctgtggccttctgaaattgcttctccccccacccttaattttaagtctcttagattcactaagttgaggtatagaaattaataaagtagaatgcttgaattgaataaacagtaagaaaatatatctctctagaaagccattatcagtataacaaaaacagtttatagaagctcaactcccaaatggtgatatgttatagttgggaaatggtgagttaattgaaatattatgttagtatagaattatacataaggtaatttacaaatagttagggaccgatataatctatgtaacacaaactatgctaaacataattttaacgtttccttgattcattcaagttatggacgtgtagatattctggttgaaagtattacatatattttagtgtttcagaaggtgtttttcttaatactttcccccagcattaactgaatattatatagtatattagtggctctcatggtgcttagctatgatatcacatagctaagcttactaaagctgtcaacagtttgatatacttaaggaaacaaaattctgattgattctgatgtgtttctttcagaaaaatcaacacccatggattttatctgactgtgtagatcaggtttttttattctggatatcatggtaacagtattgggaaaatgcattatttctcatgtctgcaagtagtcttcactgctgaaggaagcaat

SEQ ID NO: 55658 - DNA, 3326 bp, Bovine  19866881258933
atcagtgatgaccaggacagctccctgcccattgccgcggattcacctgtcctcaggcacctaaggggagggagctctgctttcctgaggcccagagatgttgcaaacatgttaaggtcacacagactagagacagacagctgggatacaattcagagcccacctacaaccttcacaccaggtcgctgcccccagcctaccacccagacagcaccttggactttagaggacccctggaagaagagccaaaaaaaaaagctcattttctagaaagccagaaactgtgctgattctgtcaaagcttcatttgggttcagcctcacagcaatgccaggtagttagttactgtattattacttccatgttctagtacatgatgaagaccctgagaacccagtgatgcagctagcctggttcttgtgctgcagggaggaatggagaagagattcttccagagaagggggagggaagcaggcagggaggaaaacgaagaacagaggaaggaagggaaaagagcaaggtggggccagaaattcagaggagaaaaacaactccattgaggtggctcatggaagggtgattggggccaagagttgacatcaggctttctggtggaggtgggccttgtttgggtctcgtgggtgtctcatggatatgcaggaccggaggccagaaagcccagcgattcacctctgccctctcctggatgactgtctggtcgggtctctgggcatacacatgggggagagtgtgcatccgcgtccctgtacatgacacaggtacatgctcatgcatacatgtgtacatacacaggtggggacagaactgcacataggcggctccctggacttttttctaagaagaaggcaatacccccaccatagtgtcagatgtcctctcaagacccccaagggtggtggtggagagggagtggaagggcctgaggggatcaggcaggagcacagtgtccaacaggcccttgagatggtcacccagagcacgactggacattcggcctgaccagtgtcagccaaggcttggctggggcggttccacaagggtggggccagttggaagaatgctccaggctacccctcttccttctgcatcctcctgccacagaagcctgtaacaaagaagtctctcttgggatctcccttcctaactcaggtcccttcgctgtgcacaggcctgagcgctcagccttggtggatattattagcacaagaggtagggccggtccacacccaggggagtcccccacagccaactccagccccagaggtccaagggcctgaggccctgggacggtgaggcaggaaacaccaggtctggtggccgcagggtggctctcctgagctggcagcactgtgccctggccttctgccaacaggccggcttggacatctcggctggcagagcccccagccagcctgtcttggcagctcctcctcctgacggcgagtgacttcactttgacttcatatctgcagtgatgtgcacagctcttactcagccctgagctcagccaggcaggagggcgcggctctgtgcacagcaggaagaaaagaccctgaaataggggcacctcaggcttagggacctgggatcctcccaccccaaggtccaatgtgcttcccattcctctgcgccttggtgggggccagacctcaaaaggcagcttgcaggcgggaggagaacagtggacttttcccacaggagcctagcactcacccaccacctctccccaggacctcccacgttagggatccagaatcttccctctttaatatcagatgtgtttatgggcatcatttcttggggcaaaaatttaattcctttgggctccagttcctccttgctacttgctctgctaccctgtcagccccacatcctaagaattctaatgtgtggtgggggagaaagggtactacccttcaagcatcccgttaaagccagctcccgtctctttgaaaggtgtgcccagtctgattcttgttttcattggctggaccagtcctaaagaggggttcacaaactaacgctaggacacccccgaagggactacagaagccacgcgccaggcgcacccctggagtgcgcagaaggcgcgccggctcgcggccgctcgcgggggctcttccccgcctccctcctccggccccaagagaggccgcgctcccaccgcacctccccctccgagaaatggcggaggatgcgcgccgcgcccggagcctggaggcggggcgcctgcctagtctgcatgtccgctccggcgcaccccccccccaccccccagaccccgcatccccgcctggttcccctgccctctctgggcggcagggaaggtcgaagcgcagagacagcgagaggacgcacaggctgaggaagagtgactgtgcgtgcggaggtgcgcggcttggggctgcggctgccaggccggtacccgggtcccacacctcgcccctactcgcggagctgcaccctgcgtccggctctggtctcctaaccctcgccccggggaaaccgcaccgggcatcgcctggagtggtaccccgcgccccgcccttactcccgcaccctggcccctcccgccccgcccccggcccgcccccctcaccgccccgccccgcccctgccctcgcttcgggtgcagcccgcgccctccccgcctcagtcccgcgcccggagccccgcgcacagctgcggagagtgcctgggagccggcgccccgacgctaggcgcccgcagtgttcgccgcgtcctccgctccgggacgggcatggggcggcccggctgagtaccgcaccccgccgctgagccccccagcccaaggaagcgtccctctcgccgcggccgcagcgtgcatcggcgatggcgaaggcgacggccagcaccgtggggctgcggttgctgcttctgctgctgcccctgctcggcgaaggtgagttctgtcggggactggtgcccgcggcggccggggcgaagttggctccgcgcggtggagtggacgcgttcgaaaacgcccttctgtttgcggcgggcagcgggccacgcagttactggcctcctgggctccactgggagtggggttgtgtggcgggcagcgcgcctcgggccccgggctgggcgggtctcgggcccgagcgggacacgggccgggcggccagggtcggtgcccagggcccgagtcgcagccgcgcttgcctgcctggttgcgcctcgcgccacagcggcgtctcggggcgaaccgagcgggtcttgtcgacgtttcggtgcaggtgggggaggacggtaaggtagccctagaaagcctgtcactgggg

SEQ ID NO: 55659 - DNA, 819 bp, Bovine  19866881331430
atgccacattgctccactttctagcatttatgcatgcttttcctatttctatattttactgatggaaatttggaaacaggttagcattgtgtacaaatgtagccatcttatccagaagtgtattgcatcaagtacaaaagctaaacatttttattgcctctagaacatgattatgggctcgttctctgaactgagacattctttctttcatccaggctaagagctcataccttaagtagtctaaagtatgtgcatttaccaaattatcaggcccaggagaagctagaaggtagaggaggttgggtccttcaaaatgcccccaggttgagcttttctgttcaccccacacggacccattcaaagaccactgtttgcaaggctctttttagggtcatggttttcatggcaaagcctgtgggtccctggggagtaagaaggagggtgagtgtgagactccagagccctgtattctcacttcatccaagcagctctgtgtgtatctatgctaggaacacagcttgagtcctgatcagacacctatggatgatataaggatgattgattcagatgtatcctggtgagagaggcatgggggcttctgagtgaggctcagtcctcatcctgagccaggaagtcctgcggcagagacggaaggaccctgccccagatggtggtggtgagttcatttccatcagtacccaaggcttgggttcaatttgtctccttaaagatgtcaaatttttctcatttcacaaaagaatggggattttttttttagctacatggaaagggaaatatcaaacaaacacatatttaaaa

SEQ ID NO: 55660 - DNA, 1481 bp, Bovine  19866881348783
ttgggcgggccggcggaaaggtcatctcggccgaggcaatgggcggcttgtgggcgttcttgtggtagcggtggatgcagaacgtggacagcagcacagacacgatgaaggagaagagcacggccgccgtgatcactgtgcggcagagctcatcacacagggagtctgcgggcaggcgggggccgtgagagaagacaccccgggagagggacccccaactcccaacagagccacacctgtgacagccaggaagtggctgctgtgactgactgtgagctgcctgccaaccctccggacccatggcaggtactgttcgtatgtttttgctacaggagactgttattgcccttttctggaaggaatgagcactcataagcagcctgcctgaggtcacacaccagaggttgtgcacccctgcaccccaccacccccgaccctggaatgctgcactgaagccagaggcccaggggctctgggggtgggaggagaagctcttctcctgcgctcctaatatcgtctgtattttctttatgttcgatatatagtggagaggaaagacaagtagcccaggatctgggctgtgcaatgatcactcaaatgccagaaaagctccccatgtgttcagtggggcccccctgttctagaagaagcacctggaagctgctgggaggggggacccagctggccaatgccacaggcccagaaaaggctttacacagggacagtctgaggagatgctgagttatttggtggaagaactaatttttcagtccaatctttattatagaacttgaggccgaattctttggtggtccagcggttagcacagggagctttcactgccgtggccaagattcaatccttggttggggaactaagatcccacaagccttgcgaaaaaaaaaaaaaggaacttcaagccacaaggcggtcttagtagccctgagccagctccttgtctgcacacatgggggaaccaagaccccagggaaggagaagttctcctaggtatctcttccttcctgcaatcttctccctcgctccctggaggctcagggaggcatgaggatcccagccagctgtgccccccgcctcccccaacgcaccctggctgtcctctggctcgcagaagcacttcttctcctcagggaagcagttgcagataccgaagccagctttaatcccccggcgctccccaggctcgtgcccaccaatgatgctgccgccccctgaggacagacatcacccactcagcagcccactctcagcctccagggggacctggccagccaggaccaccagacagggtcatgagaggccccttcccacctgatgtcagcactctcaggcccaggaagcacagtgagctcagaagtctgggtcaccctgggcaggagcctcagcatgcatgcatgtgtgctaagttgcttcagtcatgtcaactctttgcaacactatggactgtagcccaccaagctcct

SEQ ID NO: 55661 - DNA, 1336 bp, Bovine  19866881483778
tggccaggtgagccagcagagacaaaggctgggaagagggttggaagggatggccacctgggctgagagggccaggataggtgtttacgtgtgcagggtgctgccctgcccacggagagtgggctgccagttccccagggggccgtgtcaggccacactgctcccctcttactgtagtcatgcacggttgccctcacaaagctgccgttggcctgggccaaggtctcattgggcgcgtgctccactcggaaggtccggagggccttggggtccccagagagcagcgtgttcgtgtaccgtctcaggagctccccggaggctggcaccacgtctgcatcgaagacacgtaacgtggctaccactgtgccctgcaaagaatacgggggccagtcagggccccgaaagccagagcccataggagggcacgtgccccacaggttgatcacgtgtgtgcggtcagagctggctccagggtcagactgaccaggattcgagctgcaaggggcccccagccagcatgctggtcacccttcctgggccactgcacctcacctttccaacaggtgcgatggcatctccagacttcccatgattattggttagaacagacgccctggtgctctgtggaagacctcattcaggtccccacagtgcagagtggtcacccccacactccttcgaggaagctgggccccgcacagtggataagttagctcagtgtcatggagtgaaagacgacagagctgggacctaagcacagtgtccaccagtgtctctcctaaagcttcttctgtaccccaggctggatgggggtcatgaggggctttctgagtaaagtcacaggtcatttctgctctcactactgaccaggctccacagtgtcaccatggagttgccctgcaaggctcatgagacatttccctacgccatgtgctttcctcctgcccatccatccaccaaacctgctcccggggtgcccagagaagcaggcaaccactgcatatccgactccgaccctccccttgcccccgccagcctgccggctgcaggagagcccagggcccagcaggtggcagtcacgctccgcctgcgcgggccagaggaagacgggacccgatgggcggggcggcgcagggacatccctgtcaggtccactggcctgtcttcctccactccggggtaccttccctgaactcactggccctcccttgaggggccgacagcccgaagaagggaacgccctcctgcagatgtcctctccgtctccttggggcagcgcgcccccgcctgtgcagcagcacagttgcgccccttctgatgtgagccctgccggatg

SEQ ID NO: 55662 - DNA, 1774 bp, Bovine  19866881497578
gacagtgaaaaagccgtttaaaactaaatattaaaaatataagatcacagcatccgaccccatcacttcatggcaaatagaaggggaaaatgtggaagcggtgacagacttcttcttgggctctaaagatggttactgcagccatgaaattagaagacaatcacttcttggcaggaaagctatgacaaacctagacatatgttaaaaagaaaagacatcattttgccgacaaaggtccatatagcctttccagtagtcacatatggttgtgagagctgaagcataaagaaggcagagcaccaaagaactgatgctctcgaactgtggtgctggaaaagactcttgagagttccttggacagcaaggagatcaaactagttaatcttaaaggaaatcaaccctgaatactcactcactggaagtactgatgctgaagctgaagctccaatactttggccacctgatgtgaacagccaactcactggaaaagaccctgatgctgggaaagattgaaagcaggaggagaagagggtgccagaggatgagctggctggatggcatcaccaatgtaatggacatgaacttgggcaaactccgggagatggtgagggagagggaagcctggcatgcttgtagtccacagggatgcagagttagacgtgacttggcaactgaacaacaatatgcagtggaaagggagcccctgagtcaatcaggaaacatggaacaaataaatcaggtttcagcttgcttccttaaactatgctctgatgctttatttttgctgggtaagacatggtgggattcggcaggtagcttagatcagattcttcatggtcaacttggtttaggggagtggatgactaaggcagtgattctaagtcccttactccaactacaaccacagctagagacagagatttcccgcccccccacttttgttttagatactgaaattctgcattatgttcaaaagacaaataaaggtggtttcctctctaaataaaaaaatatgaaagcccttgagctagataatccaacattacttctagctgtaacaatctgtgactgcaacaccaaagttaggtgcagatcttttgttacagtactagaaacaactgcaaacacgggtattttacctttataacctcatttttctagtcaaagactctaataataaacttattttatcttttgtatttcctgactcttcagctaatctcagatattcaaaatttattaggaaaacattcaaatctcagaccttttagaaaaacatcttaagatatcatagtaaacacctaaagtcctattcttaaaagtaaggtatacttaccaatggtcaggaaatctgattggtactgacaagtcattccaaatccaaaatctcgccaaaagccagaatcctttttgtgaaccttaagtttaaaaatcaaaactcaatttaatccctcaaaaaccagaagtagtttcaatcaacaatgaaacaaattaaaatattttccaaataattttttctgtaaaaaaagaatcatttatgtgattgataatgggatcacatggctttatattattaaatccttataaaaaccaacaaaagtatagtaatccccataagcataggattcttaaccgccttcaacttaatctgattcaagtcttgtacgaggtttgagctgaggttactaataatcaaagagtgtgatgcttgatcctcagggggcttacattctattttaggagggataccagtggtgtaagcacatactgtata

SEQ ID NO: 55663 - DNA, 1006 bp, Bovine  19866881737908
tagtaacttctgtgtatatgcatatgaaaattgtctgatagactaacaagtatgaatacctggataactcaggaacagacaattaggttatgagtcaagggttaactccccaccactgggtcagccagttaaacttggagttctccccgtgctgaggacaaactgctacagcctctcacgctgagtaggcatttttaataacttgagaaagtttctccctccttctgcatttaacaagacgatcattaagcacatctgaaacccacaagtttactaccatgactagatacctgtaaaagaacttatcacagtgtgtctgaacaatggctcaaactaaagccatgttgcatctgcagttaagtgtttttcccgtgctctccctgagtgtgtgcacacacacgtgcatgcacatacacacactcacacacatacggctcctccacataactcatccaagccttcttggccacaaaaatgccataattttaccactttaccactttggtgaaatggctataaaatccagcgttttcatgagacatcgttaagttctttcacagtgctttaagtttgaaacccaggcagtgttttggcaaccaaccctctcctgcaaagtgacagcgtttggacagaaagaagagcccctgggacttcccgaaagccacccccgcaggatgggaggagtgctgagtgtctgtgaccacaaacaagcagtgaagaatgacaagaagcttatgagtcatggtcagaacctaagaacaaaaatgtcttgccatagcagcgttacgttacaaacacaggaagaatggacacatgtagcttttcacacaagctctataagagccaaaacactgtcgtttcccaatcagaatcgtcatcagaggtgtcacagtccttggtcatttgtcgaccctacttctaacctaactagctgagactgagctcaagtcccaaccacaaacgtgtgagatgagcccctgccactttggggcactggatgggtagg

SEQ ID NO: 55664 - DNA, 1045 bp, Bovine  19866880216700
catcaggtggccaaaatattggggtttcagcttcaacatcagtccttacagtgaatgttcaggactggatctgaatccaggactagcatctggtacacactccaaatttgttgactcgatgaatgtttaatttttagcgaccacttcctgtgtggcagacattcttcaagacttggtcatttcatcctcatcaaatctatgactgtcctctgaggggcacaatgactcttccaggtcacatactgcttagggcagagctgcgattcgaatctcggtcttggcagcctgactccggagccaatgggctccattcccacacaacgccctttactctgtgaccctgctccataaactaggacgttttacacaagtaatacaagtcagtccctggaagagggagaggactgtgatggtcattcagtggatgaggacacggggacagaggcagagacttctagcaggtttcccaggcatccatgccctctctttttctaaaaaaatttccagtgtttacaggggagtttgagtaagctccaggagttcgtgatggacagggaagcctggcgtattgcagtccatggggtcgcaaagagctggactctactgtttgactgaactgaactgaactaaactgaacagtgaacagagcccccgaggtgttccaatctggataagatggtcccagacagtgaccccgcccccagccactcacggccacgtccggggtttgtggatggggccaagccggcctcactcggcagttgcaaagccccaaggctgtttgtcttctcctgcttccgccacttggctcgctgattctggaaccagatctgagatgaaggtgagagaggatggagataagcaaaggggcttttctccatccagttcctctccttaaaatacatgatgactgcaccttccaagggaccatccctttacagtttgtaaaggtcaacggcagccacgatttctttggatctgatctgccttgggagagaggatccgaggtcacaaccttccatgcctacaggggctggggggctca

SEQ ID NO: 55665 - DNA, 1204 bp, Bovine  19866880349171
caacctcagaagtggtcacatgggaccaagactgtgcccctgtcccctgcctggaggctacttcagagatagcatctgcttaagggaggggaggagtcccctattcctatcttccccatctcacctgattccactcaggtaggcagtatgagcccactttacagaagagaagactgagatccaggccagggaaggaaggggctcacagtccacagagtcgtggccgggcctagggctgaacaggagccttgcactctccccggtttcccaacagcccttctcgctcttggcactgctgcctggagctggccttaattgccaggcacgtgacctgcaggactccctccctctgagccacgtgctaagccccaatccctcttgatgctgtcatggtgggggggatcaagcctgtggcagaaacacctctcttttggcttttaatactaaaatagaataaagtgctgtacgttttctgtgggaaatgaaagatgggactggggagaaaaacagccctccagtccccaaatcaacacccccgtcagcacccctctcagcttccagaaagaaaacattccttccaggtgatttgttagctctttctggggcagaagaaggtggaaaactaattttaacttctcagggattttttttttttgttttagcttttatgtttttcagaccagaggtagggcatcaagtgcccttaggtccactgatatggggaaagacttgaagcgggcagtaattttgcctccaccagccaagtcctgcaaatcttagtgggtagagatgccgagaaggtcaaggtcgggtgctaaccctccccagataagctcccgctcctccctcccccaaatccaaggaaagtgtccccctaagagttaggagactgaagtcagacatgtgaatctgtgaaacctagatctgttttttgtccttgagcaagtcacttcacttctgggcctcagtgacctcagcagtcactggggaacaataattgctgtcttgaccacttcctaggtggctgtgaaggttcaaagcagtgctgggctgatttcttggtcccagtacttagaggggcatagcaaaactggtgagggtcccacaggactcatcagaatggggaaggaacccctcggccatccactggagcaagagagcccagagaccaggccctatcttgtgcttagcccagtgtctggca

SEQ ID NO: 55666 - DNA, 1494 bp, Bovine  19866880434498
actgggttctcggctgaggctagatgtcctctgccaggttgttggcagcattcagttcctttcagttgtagaactcatggcaacttgtctccaagttcagggccagcaggggagcgtctcccgttgggtcttacctcttttaaggtctcactgaataatatcttgggtcacaaagagtcggacacaactgaactgaactggataacatcacggcccactcaggataatctctctttgattcactcggattcaattcgcttaggaaccttaattacatctggacaggttcttaggaaccttaattaatagcaaaaaaatccccttttgccatatagcataatacgatccatgggagtgacaccctctggtattcacccgtcctgcccatagtcgggggagggtgttttacaaggcatgtccaccagaggggcagaaatcttgggtgccatcttaggatcctgcctaccatagagataacatgactgagtacctcctgaagtgccaaactgatgaattcccacctctggaaacagtattatccaagctcagtggtatcatccaggttttacttacagggaaactaaagtcagattctaacctagctatgtcggcccccaaagcccaggatctttctctttaccacactgtgtctgataaatcctgttaacttttccctccctttcaattgacctgcttctctccaacacccctgacttggccatgggccttcatccacccctcccgggtgctcctgcagcagccttctcacatccacaggactccctgcctccagtccattctccatggtcataaattgcaatctgacctagtgacttcctgcttgaaataattgcctctttcagatagaacccttactcttcaatacagtttacatgtcatccatctctgagcactccctgcttctctggcgtcatctcctacctcctctctgatgagtatcaccacgttgagagcctagaacacttgtaccactcttcacctggataattctacccagctttagggtctaagttaaatgtcctttcctccagaaaggaggaccttcttcaactccctgattagtgaggcggtcctgttgtgtattcctgtagcagccagtacttcccctataataatgtcacattgtattatgatgacacatttatctgtctcctctgttagattctgtgtctggttcttggctgtattcccaatgtctggcatatagtggatgctcagtaaatattaagaaatgaatgacagtactttgatgggttactttgtttcctttgcaatctcctccttgttagtctagtctctgcttttccttctttgccgctgaaatacttttaatggcacatgtcagaagagctatccacttctcctgtgttttatttcaggatcaaatcattagtataaggtgaagctgagaaaagatggtgggcctttaaactttatgtttcaaaagttttccattttatgctgcttgactgc

SEQ ID NO: 55667 - DNA, 1127 bp, Bovine  19866880580784
cgcatcactgactcgatggacgtgagtctgagtgaactctgggagttggtgatggacagggagccctggcgtgggggtcgcaaagagttggacacaactgagcgactaatctgatctgatctgattatgtggctttgttttggcaagagctaactgatacatcttgtcagggcctgaagtgaggcaagggagtaggaagggccagggctagctcagaccccaggacacttcctggtggagtgagaaccagtatttgggaaaggaaaaatgctctcttgatagggttacccatggcaggaggctgcattgaacaccctcctgggggctgggggaacatgaaacagtccctgaaatagatgcagtagctggatgtgcccaagtctattaccccttgctgtggaggtggaggtagcatggagacccctcatgggagcagagtgtgtatctggcaagaggggttgagctggataattatccatatttgctgagcaaggagccagggagtatttcaggtgctgtgtatacaatggtaaacaaatcagtccatgaccctgccctcttacagcttactttccatttactcatgataataaaattaataataataataatacctatgttaagttgaatacatacatgaaataaggctaagtcttaaaacagaagtgactggaaaaatgactagactgggctgtgtgggctgaattggactaaatttaattttcttactgtcaagtaggaatagaggcttgttaaaataaagtatgggcagtataaaactgaagtgagcttaggtgctcctgtatataacctgtgaccatccagatctaactgtgatgctggcgcacatacgttcccgtatccttgactgtatctctgcctcctgtcctctcaggcatagtgaggggctgcctattccctaaagatgcctcttcacctgtcacccccttgagaggccgtgcatgtcactatgagctgtagaacattcccctggcttcagatcattgcccctgccccatcttggtgcagaagcccttctgctgagattcaaggtctctctcacactgccaccctccatcattcctcgtgatggacattactcaacctcctggtccctcttccactct

SEQ ID NO: 55668 - DNA, 903 bp, Bovine  19866880593166
tcttgtggaaataagtaaggcagagtctctgctcccagataatagccagatacatgaaataaagtcagtgctacccacacacaaaactggtttatttattactaattcattgcatttgtgggtagaggagatattctgagccacagaagccaaacttactctgtctcttttcaatggtcagcacagatttaccttcattaaagctgagtgatcatttaagccataattccttttagctattctagaggaattgatggaagggaagacttacctaagatcttttccttctttttttttttcagtagtattttattttattttatttttattactttacagtattgtactggttttgccatgcatcaacatgaatccgccacgggtgtacatatgttcccaatcctgaacccccttcccacctccctccccataccatccctctgggtcatcccagtgcaccagccccagatcttttccttcgaaggtcagtgagggaggaggtggagcagagggaggcaggcagaagcgtggctgttgattatgttcaagattatatctgagcaacttccctggcagtccagtggttaagacgccacacttccaatgcagagggcccaggttccatccctggttggggaactaggatcccacatgctgcacagtgtggacaaataaataatacaatccattttaaaaagattatattttaaataatttctaaggtgtcacatagaaaatggccctttaagtggagagcaatgcgccttcatgctgccatttttctcccctccatccatgagaatcttctagctctatggtccctccccctcccacccctgagcaatatacaggcacatttcagagaagccaagaattaaatcaaaactacctttcttgctctgt

SEQ ID NO: 55669 - DNA, 1312 bp, Bovine  19866880618533
tggcaccccactctagtactcttgcctggaaaaatcccatggaatggaggagcctggtgggctgcagtccatggggtcactaagagtcggacacgactgagcgacttcactttcacttttcactttcatgcattggagaaggaaatggcaacccactccagtgttcttgcctggagaatcccagggacgggggagcctgttgggctgccgtctatgcggtcgcagagagtcagacatgactgaagcgacttagcagcagcagcagagcttacaagtacacaatcttaattctgtttaagctgggtaaaatgttattatttcagcatgtggtttaaataagagaacctgaataaggtaccttgtattctttttagcactaactttgaaattcctgtgtatttcatacacttaagcacaccttgctttggacttgccacagttcaaaggccccttggcagcatgtagttctcaggtctctacaaagatgatgggactcagggtggggaagcttttcggagagtccggagttcaccttactgggagagtgtcacttctctcagcctcagtttactgctcagtgagcccagctcctggaggctgattcatgagacagtcgggctcaggtgagtgatggatatgaacagccctggggagagcctccaggccagctggggctggtggccccccatcagaggaggaacgctgagattgtctgtgctctgcaccccgctgtgatgtgtgaccctgggcgagctccagctctggaggccccttgactcaccggggtcagagcctggggggctgtgttgggccctgaccctcccgtggccctcccccaggtgtacacgtctgggaaaggcagcagcgccgccgggctgacagcctcggtgatgagggacccctcgtcccggaacttcatcatggagggcggggccatggtcctggccgacggaggtgtcgtctgtattgatgagtttgacaaggtgagcctggcagggcgagggggtggctcagtgctggtggcacctggtggccgtgggctgggggcgtgaatggcagaaacccccttggatgacgtagagacctcccatcactataggggcataactaaagctctccgagcctagagagtggggagacaagagccaagcctgcacgttacccgtgtgactagaggtgacctggttcctgccgttggctggcacggagcagggacttaggaacagtagctcctgtagggtgtcctgctcccgctgcaccccagccccctcacctggagctggtggacattcctctcttgcacacagatgcg

SEQ ID NO: 55670 - DNA, 748 bp, Bovine  19866880623851
ctacatccttctcttttcattctcttccccacagctctgtgaattttgcttctttactaagaaatggggagagtggcctatattagaagcagatcttgatatccagataccagataataaaggttggccccaatatttagaaaatgttaagtcagaagtcagcacacttttctgtaaaggaccagagaatacatattttaggtctgagatccatatgcattctctgtcacgtatttttctttatttcttctacaacaaccgtttaaaaatctaaaatcattcttagctcacaggccacacaaagtaagttattagccagatccaacccatagtctacagttttagcatatgcctggtggagctcatagaaagggaaaaccgggaagaacagttttgtggtacaaggccctgggcaagctttatcgctctgtttcttctctgttctcagcttcttctatgggagtactctcaccccagaagaaatccccacccaccgccatgctgttacctgcctcgccagccaaagctcctgagacagagcccattgatgtggctgctcacctccagctgctgggagagtccctgagcctcatcggacaccgcctgcaggaaactgaggtaagggcacccgtcagtggcaagctccagctgctggtacagtctggacccgtgtgctcattccacatccacacagtgagcgactgctgtgtgctgttataccaggtgctcaggatacagtgataggagg

SEQ ID NO: 55671 - DNA, 1964 bp, Bovine  19866880633141
ggcttcctagccgcatcccttcctaccttatcaggaaggacccaatgcctatgagtacggcacttcttgtaccttcctcttgtttatcattgactttctccaatttagtgatcttcacctccaccaacctcaggttctcagctccaattggagctcactcaactgtatgtgtgacttttctctttatcttccttccaccccagccccattccctccctcccttccttccttgggtatcaatgccagaccctgcactgccctttgcggatacaatggtgataaaaacagacacattctgtgtccttgagggaccctccagggagcctctattctttctgtcccctccctctgctcctaagacacccgctcactgacgtctagttctgagactcccattagcccttggaatacaaggtgcattgtcccaatcattcccatatttagtcttcacattaatcttgcaaagcatgtgctgctactgctgttatgacaaataatagctaacccttatattattagtgattcagacctgccagcactgcctgaaggttttccacatactcaataaattcttacaaagccctctcaagtcaacattattgttatcctcattttactgatgaggaaactgaggtacagagagcttttgtgaactgcccaaggaaggtctcactgcaggatgtgattctggagccggagtggaggggcagcaggtggctgtagtgtggcgtgggatttgaggcttggggaaaacattgtgggaagacagggtggggagaggccaggagaggaatggtgagtgaatgcagagtggttctagccgtatgcaaatcattctaggagaaaagagggtcagcacggctgggtgaggtgggctatgggggaaatgcaatcaccctccaccccatgctaagcagtaatgccacagtcgaataattctgatgaaggaggcagttttatctttctcaggaagcttggaaacacttaaaaaccatcctgcattaagggcctctgaggcttatcctatttgaattagaaaaatgcatggggtctccagcctgtgaaatcccaaaggcgccttccatctgcctcccagctcactgcttttctccgtaatgtgaactacagtcatcaaacaatgcctggcctttatctatccagagagttcacttctgttttttcaaatttctttccaagtagctgaaagctattaatagagctgatggtggtaactcagaaggtttggagtttgcttttcattttcatttgaatcataaacttgtggcttgtactaaagttaagaacaactggagataatgccaaagaatttgtgaatcagaaagcagattagtttaaaatctcctttttatttcggttgtaaaaacagaaggcgagtcactggtccgtctgtattctgtggaccagggttgtacattttttctctagcatctattgatatcacagatgtaattgctgggtagtgccttgtaaaactgtctacagtctcttcccccgactagattctaagtgtaatgactttctctttcccttttagtgcaattttccagtgtctggcatgtagaagttggtcgataaatatttgttaaatatgagaaacggatgaatggatgaagctaaatgaaatccagagctgctggggctggtggcatctctgtctgcattaactctgactattcagggtttctgttcttggtgtggggcatgatgaatagagcattctgggaaggaagtgcttatttctgcttggttgggcttggaaatcagctcgccggggtcctggcagcacaggccccaccagtggggaggagggtgtggggaccaggcaagggtagagctggggaaatgtacctggtcacagaggtgggctccagaagggaacagctgggacatccaggtgtagggtctgggggctgcatctatctagacccaggttggcagcgggg

SEQ ID NO: 55672 - DNA, 766 bp, Bovine  19866880716205
tccaggccgactcggactggtgctgtgatagaaatgcaagacatttggaagaacgagagattcattgccactgggattttcatgcattagtatacatgcgtgcatgtgtgtgtgtgtgtgtgtgttgtggggatgaaatctgacttggactctgcgggatggatgggattgacatgtccaggggaggagtgggtggagggaaggggattagctaatttctctcaccatatctctcctggttttttttttaattcttttgttagaattcttgccaccaaagcaggtggatccttaaacactagagggatggaaatccttggaaagtatttatgatctgaagaaaaagtaccctcattcccagctgcatggacactattaattgggatgccccctcccccgccccgccatgtcatttggaatcatcttggccagctgtccctgcactaggggaggccaggtcacagtgtggtgggtgggctgagtctgtcaaatgaaatgatttactacagccaccttaagcctgagcagactgctctgtaataatgatgccatcaatgtgaaagcaaatattattaaattttagaattgagatttatggtgctgatttctgagccatggagaggctgtagtttcttgcttttaggttttcttggcataaaccatgaagttgagcagctggagcctagagtagggcaggggaaaattcccagctctgacatggctctaaccctgatgctgggaggggagtaagtccaagaataacaaa

SEQ ID NO: 55673 - DNA, 1212 bp, Bovine  19866880894406
ctggctaccagatcagcctgtcagtggcccccaaggaggtgggttgcagactccagaaacactgcactgggggctcctggtccggcctctcctgtggaccacatgtggtttgatttggggtctctcattccctgggcgtcgttcctttgtatgtggaacaagggggttgacccttgattgcaagtattagaaccccagttccgtttagtctttctggaggaactcaagagaagggcttgtgttacaggcaagcctggagatgcagggcccagctgggtctggtctcagggttgtctgcctctgcctcggcctccctgggtggagttttgttctccggcagcctcgccccgcctcagggcagcagggagggccctgggagctctggatgttgttttaccagctgacagcccccaaggaaagaagggccacctcctctccactggttctagccctgggagccctccctctcttcctgctccagctctgtgttgggacctggctcggaaaggcctgtgggctgaccctgggtcccctctgcctcccagatgctggccaaacacgtcatcacgctgcatgtgagcgcattgacacaggcccaggccgtggagggcgagattgacctggccaagctgaagaagttcatcgcctactgccgcgcgtgagtcgcagacgctggcccccgggcgtggggttgccagtcttccctggttggggagatccctttcaggatacctgagatgagcccttagggtttagctctgcttcttcctcccactacagtcacccactccgtggctcttggcctcaagcttccccgtttctaaaatgagggtggagggtttagatggtcttgaaggcacccttgactctgatgtgtggggatgcgttgtggacatggtctctggtagcgcctgcccccactgtgtggccttaggcaaatcagctgacctctgagcctcgctttcctggggtggttgtgccctcaggtttttctaagaatcacacaagatgactcatgagctcttggcacggccctgtgccgaataaacacttagtgaacagcagatgcagccttaaatattgttgttctcacagactgccagcgatggtagtcatacatatagtgattattctgtgccaggtgttattctgagcatttttaaaaattttttaaaacttgggtagcgctgcacagcttgcaagatctcagtt

SEQ ID NO: 55674 - DNA, 3198 bp, Bovine  19866880976052
ggaaagctcttacctttatccagtacttttgattaagattctactgtacatgctttagcaaactttctatcttcttcttgacttaataggggtattagcatattggaattggaatcattcttagaaggtggtttttcagtttcccaccaatgtagaaatcctttttatagcctcctggacagatggttgccagtctctgcatggacacctccagtgatggaggacagaagagaacaggaggcagattgtttcattttggaggcagttctgatgattagaaacattttcaattgagttgaactagattctgctgtgtcagtaaggattcttcctgtttcaaaaaatggaaagcacaactaaagttggatttttaaataatgaggacttatcaagtcagtgattgagaaatgcagtgtgggtgtaagtttcaggtataatttgagtcaaaagcccgtagtgtcctgagggttctgctccatttctccagaattctctctgccctgacatcctccaggtgtcagtgtctccttgggctccttttgttttgcaataagaagaaaaaaatgcagttctagggccttttagctacacattactgttacatggaggaagaaagaaagagattttgttccagtccatcaagaaaagtcataaggcttagtctgaccagacaggattaagatctggtaactcatgggaccatgtggtcagcacatggggactgactgaacctaagtcaaaggtcccaaggctgtgggaaggtgagtttagtgaacactattgaaccctacaacccttctactcttccagcagaaaccagattttattaatattcgtgtgtctacctattgtccatgcagttcataggaccaagaagaagcccttccatccctgggtgaattttcatttttacatcctgattagcctaatacagtcagtgcatggaactcccctggtgactgctcctggcttgggcttaggccatcagctaaagattgtattctgtgcttacagaagaggttatcctttctccttgagtgagataaataggaaagtctaaggtcctgattgctaaaagcagccgttttgtcccaatagcaatggtcagacttagaaagaagccacttctattggaagcaggagatagaaaagaccaggttaccagcaatgttgttgagctcctagtggtttcatgcctggaccttccgtaaccaagttcctgatgtcttatttaagtatttacgttgggatttctacactttgaaataaaaattatctttactggcacaggtggaaaggatcttggcaatactgtcagtcagcaagcataacctcataggatttctctgtcatctatccactggctcaaaatctactgctgaagaatttaagaatgagttccctccaaggtggtataatactttgccagctaacaggctcatctttagaagtctatccttcaggctgtgattcccaggctggttgatagatcaccatatgatgtggcattcagactctcatcatgttggtaagtctcacaaagtttacaaaactggaccccatattccaaatgtggtctggtctccttgggtgcaaggagaatattatgtttcatatatatgattcagcttggtgtactggaaagaaaactggagtgagtgtggttgtaatggattcaagttttaggatccgcccactagaagcaaatctttcaaccacgctgagcctcaggtatctttctgataaaatggggagagcaatctctgtttacctcaaagcattgctatgcgaatcagatgaaataacagatataacagttctttgtaaattgcaaaactattcgaaagtaagaatgaagattaatgtatcttaaggtggtgtcagcttcctttggcagttgtatcacatggtttaattataccctgccttgtttcagaaagaatttcaggcatcttacaagaaaacataaaaaagataatatagcataaattagagacaaagttaaaaaaaaaaagaaaagaactgtgtagccaaaaggcagacattgaaaacctggttcagagtgggcactgagtaaacatttttcaatgaatattggagttggtaagaaaagttcttccaaaaattcactgtatgaggtagggagctcaaatctgcccctctgtgacaacctagaggggtgggatggcatggaagataggagcaaggttttaagaaggatggaacatacgtatacctatggctgatttatattgatgtatggaagaaaccaacaaaatattgtaaaacaactattctccaattaaaagtaaatttaaaaaaatgttcctcggagctttctagaagtcagtgtgattacaaacattgtttttgttagtgcagttctcaattcccatgaaataaaaatgaatgtaacctctctgttggtagcttttctggatttcctaggtgagaacacacattatcatcacatttgcattaatatctcaaaactcatatttccatgaactgtattagcatattacagaacttgtacctctgagatggggctctgcaggctcagaccctccctaggaaaaacttcattgtgtgtctttttgactagcttccaggctattttcacaggtcaaaggtccctgttccctttccaccatgagagtgtccttgtgcatgcccccatttccagccctgaggttctaagtgcctggtagttcagagggaagaagaggttctgttctcactcaggtcaaggaccaccttgtgcatcctcatttacgcttcacaatctactcttctcattagattggcaaattgtcccctgcttttcagggaaacccagtcccatccagagagatgtgactttattctggacagtcctatacagtcctatacagtaggacaactatatcaacatgcaaaatttccacctagtacagttcccctgggcagagttattcactcttaaataacaaagagatcaaaccagtccatcctaaaggaaatcaaccgcgaatatctactggaaggactgatgctgaagctccaatcctttggccacctgatgcaaagagccgaatcatggaaaagaccctgatgctggtgaagattgagggcaggaggagaagggggcaacagaggatgagatggctggatggcatcactgactcagtggacatgagtttgagctaactttgggag

SEQ ID NO: 55675 - DNA, 2458 bp, Bovine  19866881005839
ctggcgtgctgcagtccatggggtagcaaagagtcagacacaactgagtgactgaactgaactgaatacatccttttattttgttttcattaaaacctggctttaaacagactagctctggatgaattagtaaataagtacctcagcaaggtgaaaccgcctagaggcaagattttggtagccacagtgggccacaggaattaggatactgcctgaataaagttcttgtgcatgcatgcttagtcgccgagtcatgtccaactctgcgactccatggactgtagcctgccaggctcctctgtccatgggattctccaggcaagaatactggagtgggttgacgttcccttccccagggaatcaagttcttacctgtcagcatttaccgactgccagtcaagaagtatgcttgcaagaacatttaactggtgaatgcaataaaccaaacattctccgtcttactaacattatccatttcttgcactcctcctctgccactatctctacacacagaaactggacagccagagtttgatttgcagttcatttggtgtgtaattctgtcacctgccctccacctgcccacacacacacctaccactcaccttttaaagtccatcaactttcaaagcagcagtgcttagctgctgagtcgtgtcggactctttgtgaccccaaggactgtagcccaccaggctcttctgtccatggggattttccaggccagaatactggagtgggttgccatgcccttctcctggaattcaacccaggtctcccacattgcaggcgaattctttaccatcttagccaccagggaagcccatgaatactggagtgggcagcctatcccttctccaggggatcatcttaacccaggaatcaacccagggtctcctgcattgcaggtggattctttaccagctgagctatcaggaaagcccttcaaagcagctatttctatgtatatgcgctatttatcagagcaaaccagaacaaagtcacagattaaaaaaatcatgttaggttcctcaaaaatgtcattaaggcttccctggtagtccagtggtataagaatcctcctgccaatgcaggggatgtgagttcaatccctcgtccaggaagatccacatgccctggggcaactaagcccatgcaccacagctactgagccctcactccagagcccaagagctgcaaccactgagcccacgtgcctagagcccatgctccacaacaagagaagccactgcagtgaaaggcccaagcactgcaatgaagagtacacccctcttgccacaattagagaaagcccatagcaatgaagatccagagcagtcaaaaaatagataataaataaaatttttttagaagtcccattgcctgcatgttcagtctataagttgtgtctgccactttgatgggcaccaaaaagaagttcattgaaacaatgtaacattcttaattcagttgatatgctccctcctgttctaacaagttcatgaataattgataaaagaagcttcatctgttttaattaatttggtcttgaaattaattcagtccagtacaaaagtagcaggcaattaagcctcattggcccaactggacaaaaatatgcccatatcattgcctagagaaacaaactggaaatggacaagggctgtggtccactctcccaaacctgaacaccaaacagagcatcaccaatccccatgagaccacggcttgttctcctttctggacctcgtaatcaaacaaaaaacctcatcactggacttttagcatttatattttaggaaatcctgtagggagattccaaatgcatagcaagattgcttttgtttcggttgcatttcccttttgaaaccttcaaataattgatgagaatttactaggtctaaggaacagaacataataacaattatccgctgcaatacttaggcacatgcaataaacacatttggtcctaagaaattatcacagtttgttatgtacatgagtttagcaaattcttggttccattatccacttggcaattacatatagtgttataataatagtttatcttaaaatagtacatttcctctctggatcttggcatgcttaataagcactattttcttaaccctcagaatgccctttagaatggagaagatagaaaatatcattacagttactttgggaacaaagatactagggttcagagatgtagacaatcaaagaggggctttgggggggctgggtttattggggaggttttcggccatgtggcatatgggatcagatccccaaccagggatggaacccatccctgcatgaccagggaagtcccgatcataacagttttaaaagacaactactccatgcacctttatggttgcttgaattctacctggatttttgtaatacctccagcaacaaagaactcattacttcacaaagccaccaattccat

SEQ ID NO: 55676 - DNA, 1671 bp, Bovine  19866881142125
acccttccgcccctcaccccctagtctggcatgcttctagcccctggacagcagtcaccaggagcctctcgtgggtgtcattgcacatctcacccctgaatgtgttggggggaagcaccgctgtgagcctgccatctggtgggcccagaaactgtgtctgcaagccagcagaggctggccagggtgggtaccccaagattccttcccactctcatggcagctgctctccccaacccctgtcctgcaggaagtgtggcccccggctatcagcagaggccgcagagaagctgaagaatcggtatatcatcatgcggagcggggcccgtcagcacgagagggacagcgaccggcgctccagtatccccatcaccgtccggtgagcgggctgggtgggctgatgcgtggcctcggcttacagggcatggtgtgccctgcaagtctggggctgggacccactgctgaccactggtgctggccatgatcaggctgctgggcagggaccactcctttaggagtgaaaacagtggcctccctaattatccgtatcttttgctttgtttactgttgggaaaatctggaagcctctcttctgaattctgtctagcttcccccattttagggaagcctgagggtgagggaaggtccagggatggagtcaggagacctggtccttgcctcctgcccaccgtgtgacggctgagagattgctttccttttctgggcctcagttgtcttagttgttaactctcttcactgtggtgagtttatccaattgagtgactaagagcttaaacctacctcatttgaatcctgcttccggcactgattagatagaagtgggttttgctctatataatggaaggtccaaataaagtcacttaagtaaattgggagtttatttccaccttaggtgaaaatgtttgaaggcaggtagtctaggatcgtgtgatggttcttcagtcatcagcagcaatttgcgctccttcaggctcacctttattctcattgtccagtgtggctgctcgaactccagtcattacccctgcattccaggtggcaggagagggaggaaaagaagtgccttttttttaaggacacttcctaaagttcccataaaacgtttggacataaaacatactggccacatcttagtcacacagacatacctggatgcaatggagactgggaaatgtcttgtagctgggtaccatgtgctggaatagaagctggggttctgttactaagagagatagatcacggggaccaccagcagccttcgctgtgaaggggctggacagaagagggacgatggactgagtgcaccctggcgtcccgttgctcccacacaggcagctggaggccatcgtgcgcatcgccgaggccctcagcaagatgaagctgcagcctttcgccacagaggcagacgtggaggaggcgctgaggctcttccaggtgtccacgctggacgccgccttgtctggcaccctgtcaggtgagcaggtgtggggagacaggccgggtggtccgtggactctgggtggggctcatgctggatgcctgctgtgctgattgcttctctgcacttgctgaggtctctgtgcttcctcctgcgaagaaagccaccccccactccccgtccccacccccaccagccattttgttccaagatgg

SEQ ID NO: 55677 - DNA, 1615 bp, Bovine  19866881332181
ttcttgcctagagaatcccatggcacagaggctggtgggctacagtgcgtgcggtcacaaagagtcggacatgactgaagcatgcatgctgtgacatggcagagacaggatcccctggctagaccagaccacctgacccttcccaggggcacagctcctcaaacagtacaggtgatctttcctctgactcaccctcctcagggaggaaggctcaagcttccccttgcccctccttccacgagaaggtctgggttctcacaccccattcaggtccacagactcccccaggtatctatcaccctcatgaggacacaccttgtggccagcctggcagtctggagctcccccaagtctcgcttagatgaggccatgacttctaccacaccctcttggtctggacctctgtttccccacacaccccagaaggacctcagaagatggccctcaagtccaggaaagcacatctgaaacggactgcccacagccaatacccagcagactgcaccctggcccagcctccagcctacatatgacccataaattctcccagctgaacaaacacattttatggggcctggggacgcttcctggcctcactgttcccaccttcccgtgtcctgctctggcctggccagctccccaacactgcacctctctgggacccccaagccccatccttaagtctccctccacctcctacccgtctcccccagctcccgccacaaggagggtggaaagtttcttctcttatcagccgttttactgccccctcctccctggttacacagtaattgggaacagaactcctggcaagaacgggttgatcctatcagtttgcagtcaacagtttactagacagagggaaagggtcccctcagtgaggacccaggaggcaggtaagaggtgtgcaaacaagagggggacagaaaggacccccaaaggaagggaaaggagccaggaaggagcctaccgagaggcttgtgcagtgaagtcagggagagagcagaagaaagtgctggctggaccagagacaccaggagaggttcagacaccagcgttcagcccagccccggcacagagagccagcctggcggtgacctcgcgaccctcttcagaagcctccacctgcaggtgctctgggaggaaggcctgttctggaatctgggagcagcagaagccagaggaatctaggaggatttctgggagcaccccccaagctgcagtgtggcccagggctgggttggccacctggggctcgctggtggcactccggcgcccagccgcccgaacacctgcttccagaggtctggccggagccagcaggaaagagccacacaacagagaaagggtaaaggtgcacactttgcctccagatctcctctgggggcagcctcccttttccttccagctcttttgtcctgttcccgactggccatgacttcagggtccctggcctaggctgtggactgtgaaagtgaccacctcggaaaagacccatcacagtaggactgaattcagtttagcaatggtgattcctttgatgttgagtcaacgagggctctaagcccatgggcacaggcacagccccttccagctttcccaatgggaccagcat

SEQ ID NO: 55678 - DNA, 819 bp, Bovine  19866881406873
tcaacactaatgtccttacagttgagctgccattgatctggttttctgtaacctgaagctgaaagcattctttattgctaactgaggattctctcattgaccgccccctggcatgcctaggctgccttaagatgtgccacaggaacggcagacacaggtgctgggtgcaggcggggggcttgggaagactggggagtgggggtggtgaaatgaggaggccggtgcaggctctaagtcccactccagcacactcatccgaatggtgcaggaccaagtcacttcccctctagttcttctgtttcctccctggtagatgcagggttcagttccatcaggggcctctcctaacaatgactcacaagcttcgagacttttaagctcccagaccacacggactgcctgagcttttactgatgacagtgacgagtggagagggtccaagctcagctcactggtgagtatttggaggtgactcagtgaagaatcagaaggccccagagtttttatttattcctcttccccatttgtcagaaatccttcattgtgccccagtttcagggtgtatttttagtggaaataaacttgagcagctcaagatgacacgattccttcaggagtttcagcatcacctgctggagagaagggcaggtggagtcagtgagagctcctgacccagtggttcaggcttctgggctcaccagagaaatcatttaatctgccagaaaaacaaaagaaaaatctcccatggctgcaagcctggggtgaggtgagtaccttcagtctgggatccaggatcaagctttcaagacagtggcatcg

SEQ ID NO: 55679 - DNA, 535 bp, Bovine  19866881490893
attttgccatgaataaaaatgtaaatttaaattctgttaaaatgtaaatttcagccagaagcttgctgttatttgactaaataagaaattaaaatttcagagctgtctttacatgacaacatcttttttgctatctaatcaatttcaacacttttgttggcatcaagtccccctacaccatggctctcaaagataagtaaaaaaccacatcatcagtccttgagctcgctttgctagacacagtcagatgtgtgtcaaggagccccagaattccctaagactctttgagtttaatttgttttgtataatcccctttgtcctagagttaatgaggtcagttttcgcaagttctctgcatttttgatgctgtctgtgtcagcaaggtgagggtgagattccagttcaattgtaaggctgtctaaacaacagtaaatgtcaaaagaactcagccccatttccagggggctgcagatttctgcttgcagagcaactgacaaggtgttctcactgcgggcaacaatccacaaaagcattt

SEQ ID NO: 55680 - DNA, 845 bp, Bovine  19866881564621
agctctgtccccagcgggctggaaggctcaccctctggttctgcacccccaaccccacaaagggcagggaaggaggggaagggagagacaaagggctgggggagcctgggaggtcccagcagaacctcagacccctgtcctctccctttaatgcgacagagaaagtcgcaaagggagagcgctggggacaggcctgggcctagaaacagccacccctaccccaccccaagcctgcctgctgagcgcagggcacggtacagggtgggtgggaacccggccctggaggcccacctgcttggtgaagtcctggatgatgctgtgctcagacacctgggagccgatggcaaagcggcgcttgagctgcttctcgatgcggctcagcagctcctggtcctcctggctggtgaagccttccacccctgtgggtgcgaggagggaggcgggtcagcgggtggggacctcagtctgcccacagcggggaagagccagccagtccccgaagagaacatgagaggaagacagagggggagcctggggacagccaaggcctgagcgagacgacggacagaggcctggagtcaaggacagggcaggcatgagcagaaggatgctgcaggcagagggaacagtaggtgcaaagattcagaggtgggaaacatgcccacttcattcaaaatctagtcgtagggccagggacagggccagagtgggggccacatgggggccaggtcccacaggctagagggcacagcccaagttttcctgattctggtgagtggagcagccactggaaggctgtgaggagggcctcgagctgaggacagcacctgggccccaggtggcta

SEQ ID NO: 55681 - DNA, 1781 bp, Bovine  19866880901707
acagaggcaggagggcacaagtcatatttgctaagcccttgtctcagaggtgggatcccatgccctcctcccacagtccaatggccgtgttttccttcattttatagctgggaaactgaacccaggtgagactaagtgttttgtccattgccacttaaaaacaagattgaaccagaatcctaaggaaggtttgcgtttccaaagcccaaaggcaggaaatgccaagaggctgtgccagacttggccccaatctcaaggaaactcaccatgtcttttctttggcaggggtgggaacagacctaatttctttggtggtgacaaaccacagattctgtatcaacagaattcatttgtctgctgctgttctctcaaatatgaaaaagtcagaattggctgcctgagacccttgggttggatggggtgttatgcagctttgtgccatagattctatgtcctaaaggcaatagatccaatcataggacttcattcaattttctctttctattgagcattagtaagtcttttttttttttttaactggtctcattctacaaagaatttgagatgcctttttccttttcatagctgtccacttgaaacttataaagacacctctcattatgaagattaccctccgtggcccttcaactcaaaattgcattcagagtccaatgacattcccaagctgttttgcaatttcatgaaattaattttcattaagtctactcaaaagctttttcattttccatgtctggaaatcttttttaagaaagagacacacacatgcacacaaggaaatcattttccaacaaagacttaaatgtatccagagctcccaatttgaagtcatttatttagtcttctccaagcactgctttttaaaaccaggctgggcctcctatcaagttctagcactctgttaactcctgactgtcccattttacgtgggagctgcaggaatagtggaagaccacagccagagagccctgccatctgctgtgagatgaaaagccacatttctctaaaccccaggggtctccagcttgtagcaccctagttctctctctttcttgtccttcttctctttcttcttctctttattctctgaatcttggggaaaattctggtcccagagaggaagctaaaagagatttattagatcctccagttagggagggaggacatgggaatttaacatattattgctactgaaagagctttgggggaaacttcaaaagcaagcaatttggaacaactgtaagaagaccccctccaaagaaatgcatcaaaagcttcttttgtaccatttattttacaatttgaatctcacatttccattccatgaaactgtgctacagaagaaaatcttagccacgcatacacatctgtaagcaatcatctccttgacccaggctctgaaggtgtgtcctgtgatagcaaaacttaactcttctaatcttgagtgtcagcctgggcttcttgtcagacactgagtatcagattcaagacctctggatctccctggttatgtcatgtaaaacaatgtctgttcacgtcttagccactgtaaacagtgctgctatgaacactggggtacgtgtatcttttcaatttagagtttttgtcttttccagatatacaccaggaatggaattgctggatcatatggtagacctattcttaactttttaaggaaactccatgctgttctccacagtggccaaaccaatttatattcccaacagtgtaggaggctccccctttctccacatcctctccag

SEQ ID NO: 55682 - DNA, 1555 bp, Bovine  19866881045173
cagcaccaggaactgaagcactccatcctcaatccggcttcccagcggacttcacaaagatgtacctctgtgcgtaatccaaggcgtagcccaggttgagggcttttgcctgtcttgagcttcatcctcttcacgagattcaggatctcaggcttattctggtgctggtcaaaacgggactccaccttgacatcatcactgaactgagccactgcaacccgggtcccctcaggtttcacatccagctcgtcgatgaccttgtagagaaagtcacgggcggcagtgaactggcccatgaggttggctgagccgtcgaaaaggaacaggatgtctcgcttgctctctgcaacaaaagtgggtcgtggggcacagtgagggacaaaaacacaataggctccaaaccgacctcagcccagcactgccagctttcagtcatgggaattcaggcaattcacctgatgatcactgtaccagcaagggaagagaaaactcacaccagctgtcattcaaatgccccctctcaaagcagtgcatctgtgcacagggctgggaccactggaccgtttgcccaatctagtgccctgcttcctcaacgctgcaagccagagaaaggccttgggggtctgttctagcatcagtgccaatcattctgggagaacagatggtgttttcaaattgttaccaacttctgaaaacattgtgcttaaaaatcaattctgtctctagtgacaaaggctgctatgggttatccacccaagtgtaactgacacataatcaggtgtcatcaatgctctatttggattctctttccattaaatttgaggttatgggttagaacccaagatagtgtctatcacgactctgtgggtaaggatctctgtcagtgacttccagtctgctgtggtcagactacagaaaacccagcagcagccagtcaggggctacaatgtgtcacgtgaatataattttctgttcaaaccactcttagaactattttgattaggcttcagtgggctccatctagctacccatctgcgtgatgtcagcaactggtgtaagtaagggtccataactcatcatcttactaatttgccaccataatcatcatcacctaggctgcctttggaaaccactttaccatcacaaaaagacacagcctttgttgggtttatgacaaaaatttttctagatacagcagatttggaatataaaaacatcctatcaagaaaatcaattccacttttaaatgttcccaatgtatactcatgtataaaaggggatccagctttctctctctgtttttctcccatttccatccggatttgcatgccagtatcttcagagacattggggcaaaaaaaaaaaaaaagtaagtaaaagcttctgaatccagggtgggataacctgggtagaacataaactggattttctagacgttcaaggacaaacaccctttagacagaggacctaagcttgctggtacagtgtcttgagcctcccttcaaaaatccataaccaaagggaccccatcatctctgcacagctcgtcgccagc

SEQ ID NO: 55683 - DNA, 1414 bp, Bovine  19866881128100
tatgccaaaagtgttcgttgcttagtcgtgtctgactcttttttgaccccatggactatagcctgccaagctcctctgtccatgggattctccaggcaagaatactggagtaggttgctatgcccttgtccaggatcttcctgacccggggatcgaacccaaagccatattaaaaaggattttagcttgctgattagtttcccctggtaagtgttaatgctaagtcacttcagccgtgtccgactctgtgcaaccccatagacggcagcccaccaggctccccgtccctgggattctccaggcaagaacactggagtgggttgccatttccctctccagtgcaggaaagtgaaaagtgacggtgaagtcgctcagttgtaagtgttaggtgatgaaaactgaaatctggccacgataatgtcagcaaggtatacatagttgtacattatgtgacaattttaatgaccccagaccctctgcagactgacgtgcagtttctcactctgagagtgacagaataaacaggctgccatgcttctttctagacatctgcaacattgacccatcctgtggattcggcagctggaggccttccttcagggaccggagggcagcaggcagtgatgtggacatcgacatggctttcatcttagatagctccgagtccaccaccccgttccagttcaacgagatgaggaagtacatcgagtacctggtccgacagctggatgtgagcccagaccccaaggcctcccagcactttgcccgcgtggcggtggtgcagcatgcgccctacgaggcggtggacaacgccagtgtgccgcctgtgaaggtggagttctccctgaccgactacggctccaaagagaagctgctggccttccttggcagcaggatgacccagctgcaggggaccagggctttgggccgcgccatcgactacaccattgagaacatcttcgaaagtgctcccaacccccgggacctgaagatcgtggtgctgatgctgacgggcgaggtgcagaagcagcagctggaggaggcccagagagccatcctacaggccaagtgcaaaggctacttcttcgtgatcctgggcattggcaggaaggtgaatgtcaaggagctgtacagctctgccagcgagcccaacgacgtcttcttcaagctagtggacaagtcgaccgagctcaacgaggagcccctaatgcgcttcgggaggctgctgccatccttcgtcagcagtgagtcctgtgtgcccttggtttgggaatgatagctggtgtgcccacgtcgacctgtccattcgttcagccggtgtctattggcatctcccacgtcccagacacactggtaggagctggggttgcagggacatagatgggaatcctgccttcttccacttgtttgttca

SEQ ID NO: 55684 - DNA, 1377 bp, Bovine  19866881742494
caccgacgagttcttcctgaaggacttccccccccaagcagcagattatcgacgccataaacaaggtggtctacaaaggggggaggcacgcgaacaccaaggtgggcctggagcacctgcggcggaaccacttcgtgcccgaggcgggcagccgcctggaccagagggtcccgcagatcgcctttgtgatcacggggggcaagtcagtggaggacgctcaggaggcaagcatggcgctcacgcagagaggcgtcaaggtgtttgcggtgggcgtaaggaacatcgactcggaggaggttgggaagatagcgtccaacagcgccacggccttccgggtggggaacgtccaggagctgtcggaactgagcgagcaggttttggaaactctgcacgatgcaatgcatgagaccttatgtccaggcgtgactgacgtttccaaaggtaacgtcctttaggtgcatatattcaatcttgtcttttcaatgctggcacgttatctggttgcccagatgcccagtgctggccttgggtctcctgcagcacctgctgcttctgggactgacttacatccatgtggttgggtcctggttgtcacctgcctctgagataggatgtgtttcctggataggagtggacgtctgtcttttcttgctcttaccagatttacccgtcctgtctaatcctctaaataattcagactgattgatgtctatttcaatttgtaggttccttagattatttgagaccagagtgtttgaattctcaagtgtgtttaatctaaagccgacacttgggatgcatctagacactggctatattctgtgctagggctgattaagtccccaaagccaacatactaaaatgccaacagttttggttcctaagagtcggtatgcattttcccggtgagagaggcagatccagttgcttctcagagttcgtacacagacgatctcatcttgcccttgagtgagcgtgttccctgtccgcgtccccagctgtgcctgtacgttgaaagtgtctcagcagcttgactttgagctcatggcctgcttctccctttatagcctgtaacttggatgtgattctgggcttcgatggttcaggagatcagaatgtctttgtggctcagaagggcctcgagcccaaggtggacaccatcctgaggagaatcagtcagatgcagaagatcagctgcagcggcagccagctgcccaccgtgcgggtgtctgtggtggccctcacgccctcgggccccgttgaggcctttgactttgctgagtaccagccggagctgtttgagaagttccagaacatgcgtgcccagcacccctacgtcctcactgcggacacactaagctctaccagaacaagttc

SEQ ID NO: 55685 - DNA, 1702 bp, Bovine  19866880369542
cagttatcctgaaaattttatggactaattatatagcatgatactgatcatccttgtcattttttttttccttcagttcagttcagtcgctcaattgtgtctgactctttgcaaccccatgaattgcagcacgccaggcctccctgtccatcaccaactcctggaattcactcagactcacgtccatcgagtcagtgatgccatccagccatctcatcctctgttatccccttttcctcctgccctcaatccctcccagcatcagagtcttttccaatgagtcaactcttcgcatgaggtggccaaagtactagagtttcacctttagcatcattccttccaaagaaatcccagggctgatctccttcagaatggactggttggatctccttgcagtccaattacctcatgtttccaggagattagctttaatagtttaaggaaaatggaggagctgacagaatccagggcctctttttaagaaaactctttttgtaactcttctgtaactttttaaaacttaaaactctcaaaagcctcagatgaaaaggtaggaggattaaggagatgacactcttgtccagtgatgcgtttttggaaaaatgaggagatacctcccagacctcccagtggaaaaccacaacatctgggggtgccagcaagtaaaaataaacgtgaaggaagactggattgtaccacacatctcattcccagggttcctcaagcaaggactcctgccaagtcatgtatttctagcttgatagatttactaggtgggaatggtaatacaactgtcatacatttttccaaagcttttttccaagaacaactgacaaaaatatgcattctgcttgggcttcctaggtgacacataagtaaagaatccacccgccaatgcaggagacacaagagatgtgggttcaatctcttggccaggaagatctcctggaggaggaaatagcaacccacttaagtagtctagcctggaaaattccatggatggaggagccttgagggctatagccatggggtcgcaaagagttggacatgactgagcatgtacccacacatgcatgctctcagcttgtctattcatatgcctctggtcagatttagaaagcaaggaaaagcaaaaggaaaagattgagtcagaagaactgaaaaagaaagagaaaaatggaccagttagaaacttaaaaataaaggaaagtcattctgataacaatggggcgatctgatattctttcaaccataaatacatttcctctatctaaaagcatcatcggtatcccaaattagatgtgccaggttttcaaaatttaacctatgaattttccagtagaattttacattagtgcctgaacaatacaagaacaaatccatcattgcaaatcatcctagccatttagggccatggacttaaaagtagttggcaaacttagggtgttatgaagcttaattaaaaacagctcattttttctgaacatcattacttttggcagcacatttatcagcaagcctgaaatgagttggatagcacagaggaacagatataagcttttttaaaacaaactcagagaccctgagtattacaaaatcttacttaattcacctcactaatttcagaactgggagacccactgtgtcagccctgcctgattgccactggctccactgatgggtgcctgcttctgcccccttg

SEQ ID NO: 55686 - DNA, 1681 bp, Bovine  19866880427741
gtgaatctcttcctaaaaataaggacacaaaataactttatgcactgataaaagcccaagtcaaaacaactgtgacaaagcacagaacaaattataaattacttaaaaaaatcatcatggttactcataaaaatctcaacatttgccaaccaatttttcttgtcaaaataccttgtttcttctggggtttataacctcaatttgtccaatttctctccataaatgctctttttaatggctggggcacacaatagtattcagattctaaagacttctttctgtaggaacaacatttgagaagcagatgaatacctttcaaaggcatttgtagttgagattgtggatgagaatgatggggaaaatgaaaaaaagttatctgaggactctggcctatgccaagaaataagtgagtagagcaggaggtttgaaacacagctcaggtaactaaatggcaggcaactctcagattgttgacatctcattttttcctttctagccctatttatccctggtcttcgttcctttactcaacccatgctcctgttacttctcttccctgactccctatcctccattcttcttttcctgtcgttctctctgtgcatattggccttctgagatctatacttcagagaaaactgggctgtgagacctgcaaaaatggatatctatccctttgtggttgcttctaggaaatactaaccatacttaagatatgattaatttcctaatatcttaccaccagtaagatattaaaactcattaaaagttaaaaacttttattattattaagaacatttagtattttatggttgtgggttcagttgctaagtcgtgtactactttttgtgactctgtggactgcagcacgccaggctcccctgtccttcactatcccctggaatttgctcagattcatgtccattgagttggtgatgctatctaacaatctcatccctctgcctccctcttctgttgccttcaacctttcacagcatcagggtctttttccaatgagttggctcttctcatcagttggccaaagttttggagcttcagcttcagcattagtctttccaataaatattcagggttgatttcctttaggatttattaatttgctctcctggcagttcaaaggattctcaagagtcttttctggcaccacaattcaaaagcatcagttcttcagcgttcaggcttctttagtgtccaactcgcacatctgtacatgactactggcaaatccatagctttgactatatggacctttgttggaaaagtaatgtctgtgctttttaatatgctgtataggtttgtcagagctttctttccaaggaacaagtgtctcttaatttcatggctgcagtcaccctccacaatgattttggagcccaagaaaagaaaacttgtcactacttccacttttttccctatttgtcacaaagtgatgggaccagataccatgatcttagcattttgaatgctgagttttaagccagctttttcactctcctctttcaccctcatcaagaggctcttgaacagagaatggataatagtgggaaaattgctgaaatttgaggaaaagggttatagtttagttgataatactgtatcaaggccaatttcctgttcttgattgttggattatggggtatgtaagatgataacattaggg

SEQ ID NO: 55687 - DNA, 3720 bp, Bovine  19866880458068
atactgtatgtaaataccttcttcttcgctcgggtttgactattatgattctatgacaaggagagttacatagaatgaaaaatattatgtgatatttattttcttcataaagttaggatgattttttgaaatgcatgttcatttatgattggggagtattggaagcgatagtgaggaatctcaataaaatgacatctaacaatcatgaaagtataaagttacatattacttatgttaaaatcagaatagcaatagatgatatgtgctacgcgtgcatatgtgggtgggggaaatttttattttgggaaagtgtcacaacattccaagaaactgtgattttactattctcaccaaaaggctgttagtaatacagaaaaactgctttggaaaaatgttttattattaagataaaattgcaacaaaaatatcctgtcttgaagtctgtaccttggtgtaaatgatgtgctaagtgaagtgaagtgaagtcactcagttgtgtccgactctttgcgaccccatggactgtagccagccaggctcctccgttcatgggatttcccaggcaagagtactggagtgggttgccatttccttctccagtggatctcccccaacccagggatcgaacccaggtctcccgtattgtaggcagatgcttttaccatctgagccatcagggaagtcctcaaatgatgcgctaaagccccccactattattgtgtaactgtcaatttcccctttcatcaatgttagcatttgccttatatattggagtaccctatgttgggtgcatgtatacttacagttgttatatcttcttcttggattgatcccttgatcatcacatagtgttctgccttatctcttgtcacagtctttattttaaagtctattttgtctgataagagtattggtactccagccatcttttatttccatttgcatggaatatctttttctatcccctcaatttcagtctggacgtgtccctaggtctgaagtggatctcttgtagacagcatatatattggtcttgttttggtatccattcaaccagtttatccttttgattggagtgtttaatccatttatatttaaggtaattaccaatatgtatgttcctattgggcatcccaggtagctcagagggtaaagaatctgcctgcaatgcaggagacctgagttcaatccctgggtcaggaagattccctggagaagggaatggctacccactctagtattcttacctgggaaatcccatggacagaggagcctgatggcctatagcccatggggttgcaaagaataggacacaacagagcgactgagcacacacacactcacagattcaacaggttaaaaattagaggcctttctttagttttccagaaggtggtgctatagcacaagtgtttggtttttttggcctgtgctatttgtatttgaaaagcagcactttccaccgtctctgcttagagttgatgtccagtgtccccatggtcgctgcttctgctccggagtcacttgtgccttgctgctgctgttttctctgtcatcactgcaaggggtaccaggacattgggcacttaagtcacatttgccatttcttgagccacaggctcagccaccacagggagtggagggttgggggtgcctgggttgtggccccttctgccatgtcagattcatgggctgcactcctgtgagaaagcagcaggggaccagattcttggaggctcgtttcacttccactgctgccccgctatctatctgactgtgggcgctgctgtggctgggaggccagagttgtgtgtggtttcccttgctgctcccaagttctctgggatggcaggccgagctgctgcaatcagagggccatgattgcaggcactgcctctgctgtccccaggttccacctcctctatgagttccagtttacccaccttcagatgtacaggtatgtggaattctccagggtcccctgctttgggcagaggaaccttcatggtcagtgttttgctggttgtagattgaaggggagagatagtgtctcacccagttatgatgctgatgttaactctgcttctctcacttttaatgttcaggtaatagtttaaaattttttgccttttaatgtacacatatacacctgtgttttcggtattttgggggaaaatcttcaaaattaagttttgagtagcacgattaatagatccaccaatatgatttttaaaaattgcagtcaataaaagttttaattatataattttattttagcaccttcttttgtactggaacacagaattctccagcttggataatattataacttatgtggttgaacagtcttcctgaaggaaaaaaggctaatccaattttacctctaaaatctgttaggtatttagtaattttgtccattctctttgggggggaggaggggtggactgaaagataattgaggcagggattgcacttggtactttataagtatgcaatgttgtcagtagctccattttaaggataaggaaatgggtttatagacataaagtggtggccgggaacatgtagtaggcagcagaggtgaagctgaactccactggatttaccagcttcccccttctcctgccttagtatctatgagccactccaatttaacctccatggccacatctatctacttcagtggttacttctcattttccttctgcctcttccttggccattctcttttacagcttcagatttcctttgtttaaatgtcttgatatgaatagcccccaaattattgatgaaaatgagtagtttccattgaaaagtcttcattctaaatccctttctcatctgattgaggcaaaaaataagcacacttgaccacaaattcttaaagagaaggctcacctattagagtagtgctatatgtaggaaccatatttcattatcttctaccccttaatcctagagacagaggtcttctcaatcctggatcccataggtttatcaatgagtatgtctgatgctcaggcttcccaggtggttccgtggtaaagaatctgcctgccaatgcagcagacactggtttgatccctgggtcgggaagatcccctggagaaggaaatggcaacacattccagtattctcgcctgggaaatcccatggacagaggtgcttagtgggctacagtccatggggtcacaaaagagtcagacacaacttactgactaaacaacacgcttgatgccaatacagcaaatagattttaatgagctcttttggtactcagcaccctgccctgcggctggatagccataattatgtcttttgtggaagctctgaagaacagggtcaagtgtcagccagtatctcaggttaatcacaagatataccaagacaatatcctcgactgcctggcttcacacagttgtattgtggtcttgactctttgcttcttggcatcacaaatggcagacagtgatcagcagcttcttttatctcactcagattccagatggaagtagctctaggttagttgctcaaagccagttgctaaatggccaatttaatgaatttgctttaaaaaaaaaaaaaaacctaattcattttaccttatcaagaagttttaatcttagtatcttttaaaaaacattaaatttgtctctcaaatatttcttgctgcggtaaggcaaaagaacagtgcaagacaaataacatagccatactgaa

SEQ ID NO: 55688 - DNA, 3825 bp, Bovine  19866880462408
ggcaggaacaaagttgcaacatttctgtattccttcccaaactttatacagcatctcactcataatacgtgctcaactaatttaacagtgtatataacattttaaaattgtgtcattttgaaagtaatctatatcagaatttaaacattttaacaagaaggagggttatgatatgatttcttttgtgtgatgattcctacttatcctgagtgaaagttataggatttatgctatgttaagccacgctaagtatttcaaaatggagtcacagtggccaatgtgctttcatattagttgatttgacatgtctgctgtaagagttcaagtgtctttgagtaatagactaacagtgctaatttagataagcgatttactaggcaaattaggatttatgtcactggaactgaaagagcaaccaatagagacaagatcccctgggatgttactgttatgcctactgacagacagacttctcaaaatgagaccatggagctgagtaactgtaaggctctttactggaggacccaactctgagctggtgagagttgttccagggataccgctgggggctccctcagagcttcagatgactttccactcatacttgtcgcttgcagtgagccttgctgctgaacttgagactccttctgcccaggcttctccttggggcatttcattacccctttccatctccccatgttgactaactcatgttgtgcaattttctgtgccatatacctagtgacttgtgcattgaattgggtacaattcatatgtctctaattctgtgactcttacctggcttcatggctggaccctaataaacaaggagaaaggaatgtactcctgataaggacaaattttagtttaaactttttttttttttaatgccagccctctgacattggtatgggagttctaattagcaagaagatacccataaaatagacaaaagaatggtaaacatggggaataattcattaataagagtattgtgccataaattgtgcactgtagtcaattgagaattgactacaaagaagaaagtatttcttaaaaatctgttatttgggagaagatttcttaaactgctttgtgtttttcactctgcctatatcaatctcaaatcaattatcccttaaaatgccaatgtaatattctgaacagtttaatccatttaacatgtcctcatctttatccttgcccctgtgtcacttacagtttcttcacacaataaaagcctcgaattaataaagtgctttcttctagaaattcaaaatgctttctccatgttactgtttaattaattctcaaagcatttctctgtggagtgggagtggagtgggaagaggaattttcttttcctttatgacacaggaaacaggtttgaagagcaaatcatttctatatactgtgaaacttgatgttaattcagttttgttcaaactcatagaccatggtcttctagcacacctagtctttcaaacagaatcgtgttcatggatttattcactcaataaatcatgaaataattactgggtgctcactatatgtcaggcttccctggtagctcagtggtaaagaatctgcctgccaagcaagatctctgggttgggaagttcccctgcagaaggaaatggcaacccactccagtattcttgcctgggaaatcccatggatagtccatggggtttcaaaagactcaaacaagacttagcaactaaacaagaacaacacaatatcctgttctagaccctggggatataatgaacaggagaggaaaaatgcttgacctcacagaacttaaattctttcagagggagagagacaacaaactcatcaattgcactgtaagttctctacaactggacaaatggatacattatcacaccttacaatttaatttgtttgagaaaaatatctcaaaatatagggttcatgaggaaaaagataagtgattttgagtgatgatagctaagaatcacatatttacacggttttggaaagatacagaaaaacatcttagagtaaccatattgttttggtgcttgcaacataaaaagtcattacatgggccaaaaatacaacaagaacatattaaagcctcatgttataagatccagatgaactttgagggataatctagtctaattccctcagtatcatatgcaaaatgtgagtcttagaaatgttgagatgatggacatgattttgtttccagcaccctgttacaaaaattatgaattgcctaatgaggcttagtaacaacagtagaagaaatagtgaaatgtgctgttccttgaatcttcctccttgatatttgccttgcaagagtaagtggtcagaagcattcttgaggcataaacacagagagagagaggtgtaagtcaggtacatggagggatgacagtgagatgagagatgaaacagacaatagaatgaaaggcatcttggtggggaacccctgatttttttgaactcatatttttgctggaggcatttttacacattattttccacaggactttggagacacacacacaggcatatttgaatccaatttctaatagaaggtatatgaccacggtcaggtttcctaacttgaacctgttcctttacatagcttgaacctgttccttctgacaaattttgtcagaaattttaaaaactgttgagaaggaatatagatacaaatggtgtctatatataaatatagatatggtaggaatccagtacattttagtcttattacagtaattttcctaacatgtttcagaacctcttgtgtcttactggaaaccctttccgtctcatcatctctacatggagatatgctctcagtccgtgacgagttcaggcttcatgtcaccccatttccttcagtcagttcacctccccgcgatcatccagttttgcactttcccatagttatcggtttcagggttttatctccctaacttggatttcttgtagaatagtgaacagcactaggaagacttggatttgaactctgccagccactcagtttgaatttgagcaaactccaggagatagtgaaggacatggaagcctggcatgctgcagtccatggggtcacaaagagtcggacatgacttagtgactgaacgatatatttttaaaaagagtgatgagtttcaaatatatgcacactgatcaaagtcatcgttgcccttttttaggcaatctcacttgaaaagagtcctgcatatgagtgttgctgttcttattgcatagataatatcatctctttagacagagtaacaccgaccaggaagtccagaaagctatacaatattagatgtttatttcaaaagttgcatatataaatagtactaactctagtaatgcacctctttcctagcttctctgctccattttttttgctttttgttattcatctacttactaatgatgtacttagtaagcatgtacttactacaccaggatgcatcaaagtttcgattgagatctgttccaaaacatgtgccattattatgggatgaacgggacttcctccaaagccgatcctgtaacagggaaacaaacagggatgttgtcattctaaggtctcataaatcacagtgttagtgatgatgggtggtccttgaacatgaaaactagttcctaggactgtctggaagaacctgcctcaacattatgaagctagtgcatttaatttttagtcccccagatgggttagtaacccccaataacaggaacatctgtacaaccctaagtgcacatgtgtgtaaaccatcactttggaggggtaatttggcctctccctcatgggcagattaatag

SEQ ID NO: 55689 - DNA, 1801 bp, Bovine  19866880497814
ctagtgatagataaaatttttgagatcttggaattcagtaaaatgcggtagctgtttgcggggagctgcccgtgagaacggggtcctttatctaaaggacacagctctgggagctgcctcagtccttgagggtttgcttgcaaacatagctctctgtcccgccaccccagagattaggcgattatttactgcagacacctggagttctggacaaacttctcacgcacagagaaatgttatctggtgtaagaaataataacagggtgccattcccatgctctcaagatttcttgtgactttttgtaagatgtataggtcaaccaagaaaaatgctgtcttgtctttctcacggtctcctgtataaatataagatgctgaataaagtcatggtcagactgcgtcccttcgtggagatgtgtctgtccctctcgaccccatctttgttgtagaactcttttgctgtagttttctttctcagccgtgccgtgcacgttctcgggacctgcacgttctcgggacctgatcgactttgccggctggcactggcagctgttactttgtagccgcttagattttctttctaaacttaaagagagctgattcaaagatctaggagaccagattctgacgttggcactgtcatgaattatgtattgactgtggccacgtccattactttttctgatccctggtttcatcatctgtaaaatggaagaagttaaaagatccttaacgttcttgctaactctacatttgaatctaggccacttggtagtgagataggctagacatttacagctagcttcctgtttacacttccaggtagaaataacaccaggaacaggataaatagctggtctttgtctgtggtggacattctgagatagcagcaatggcaggggcagaaagaggctaaatactgcttggttaaaagatcaagagacttatttctcatccttggggtcagtgagaccttaagtacgcatatggtagaaaggctcctcctggtcaaaaaggaagggccctgagtcaaagaacaaagcaagactggccagaggaaaacaaatacccagaagatcacccccttataaatgactcatatttcccaaaggcacgacttttatctgagcttgcccatgcatgtactctgcttttgtaataaacgccttactttcctctctaccttctgtctccttgtcaaaaaacattttttttttttttttccaaggcaggcaagaactgggacccaaactttagtcactggccctcatggtctcttggctaggatttggcattcttactgtcgtggtcagtgtctgatcttgcttccagctgctgctcactgctatctctctgaaatcagcagaacaagacagtcaaagtgccaaagtgatacaaatgaaattgaattattctcctctccctgtgaagcacctgggttgtttccaaatagaaaatgcacttagtaatagttgtgagcaagaagtagccaagcttagtgaggaaatagcagcagaatcacaagacttggagtatgcgatcacacattttatatatctggcactaccttgggctttcatatgcataaaaatgaaagacgtttttaggttttgaaaataaaatgtttcagatttgatttgcctctgatttatacttagaagtaaagggaaattaactaaatctccaagacatcctccaactctccatctgtctgctcgccccatgcattcccaatgtccttctgcctaccccaccaccagtgccactgagtattgttcccaggccacttctccaggcatct

SEQ ID NO: 55690 - DNA, 1116 bp, Bovine  19866880853310
catttttcttccaaggatcatgacttggctaaatttaagaccttcaaattacagtcagaaaactgaaaaaatacaaaagaacccataagtcattactagcccataccaggttaaggggaagataagagaaaaataacatacacagaactcaggggaaaatccttcaaaacagaaagagggtaagaattccacaaattctctccatggacagcaatgaaataaaacatctgaagaaaaagacactaattaaaaaaccactaataataaattgatgtgtcttgtgaaacaactctcttcagagtatgagttgtctagccattttgatgaaaagtcattttggaatttttaattcatggacataataataaatacacttggtcttctgaggaaagagaaaaaagaacaggctttcccttgataattgaaatatgggcttggttattttaatcagaaatatcctggggcttcctctttggctcagtggtaaagaatccacctgccaatgcaggagacacaggttcaatccctgatccaggaagatcccacatgctgcagagcatctaagcccatgcatcacaactactgagcctgtgctctagaacatgggagctgcaaccactgagcccacgggtcgcaaccactgaaacccgcgtgccctggagcccatgctccacaacaagaaaagccactgcaatgagaagcctacctgtctgccagtgtagctacgaaacatgcccatccctccagtcttgttctcaaacatgatttgagtgttataagaatagaactggaactgacactcaaataagaaaagagtcagatatgagctcttatttcagaaaaagaaatacaaatggactttaaaatatgaaaaatatgttctcctgattcataagataaatgtaatttaaaaccacactgacaatgcattcaatgcaagccctatagaaatgtctgccttttttttttttgagaaatgtataagctgattctaaaaatcatataaaaattcaaaacaatcttgaaaaaggaggaaaaaattggagaatcacacttccatacttccaagcttattacaaagctatggaaataaagatagtctggcactggaataag

SEQ ID NO: 55691 - DNA, 3370 bp, Bovine  19866880857501
aatgagcgttgacttcttggttttttatggactttcctatggttttctatcaaatgtctttccaggaggcaaagaaagccagattgctgtcaagtttctgtctttgcatatgctggccctttctctgcctcaaatgccttctctgccttgcttcctgaaaaatttcccctcttttaaaatccacctcaaatgctctcagttcttttgtgagatcactctggaaaccctcaaagtaattctcttattcttacaaacttccatctattttacatataccactattaacattcactaggcacttcacagcaacttcttttgtgtaattctcttttctcacttagcctatgagttactcaatagtgtagataaagtcagagtctccttatcccagtacctactatggcccttggcattgaaacaaatcttcaataaatactcgtaaaaatgatatttaaaaaccatgaaatattacaatgttttaaaactgtagccttcaggaaaatgtaagaagcagcacttattaggagcctgtttccttgaagagtttaattaaaatcatggttgttgaactgagttcatttgaagtagactgaatttgattcactatgattgaatttcctactgtatcttttctcttgtttgcatttggcctttcatgtttaacaaaaccttctgctaacaggatcacaagatccctcaaataatagtgagaaaagtgcagtgtggaaggcaagggacttactacaaatcatagctaaatagaagaggtgaacaaaaattctggctctctgaacccctttgttactctttccagtagagtaacaacaataataataatccttttaggtttatttatagctctttaatctattcaaaggaaaagtatttttttaatagtcacaggaggcactataacacggaataagctgccaccagatttggtgactttccaaacaaggtcatttataaattcaatgttagaaatattaccccctattgaaatttttagtattctcttctcagtgacaaacaataaaatgcaagcacatatttatccatacataatggtattgtcaacaacaaaatgaagagatagtgcactgaccatagtctgtgttttccggctcccaacaatttgatggccaaaaatagggtgtctgtggaatgaaaagaagtggaacttaggttaaacacatgaagagttagtggggctcctggtttatgagccgtgtttatctttagcaattatctagaacagtttgctaacaatgtgttttattatctagaaaaaaatactcagagaggcactgtaaggttttccttttaaatttactttgctaatcaattgttcagcctctaaataagtacagcatgtatataaaacagtgtgcctttgctacagttgcatgtcatctgacataaaggtaaaaggactgattgcactatttatacagaagtgttaatagaagtgttaatccacaaagactgaaagcaaagtattatattcactgagactcatgatgaaataagtttatatttagacaattaattttgttgattcatgtatttcatcgttgccctccatatgtccaaaagcacaaccatcagaatctttccttaagatgggcaaacagttgcttggctctattaattatataattcaattctcaacattatccagctagattaaaacaacttttctccttcactttaaaaaacatttcttcatagacacacttactgctctaaatttttaatctgcacaagtcagagatcagttttttaaactaatatcttagttgactgcttaacaatagatatatatgattctgtgaaattctagaaactgactgatgaaactataaagaaactgtctgattgagaaaaccaattattatcatcagcaggttatattttctgatagggtttttctagccctgatggctggacatgcttgactccaaaccctaagcaaactccatgactatctgtctgctctttcaaattgttccttggatgatgatggccctgggattcaatggaacagtctctgtagataccagacttgtggatttgattatatttttcaattttacattaacaatctgtgtgtagcaagcatatttggtgtaatctctgattgcatgcatgcatgctcagtcacttagtcatgtccaattctttgcgaccctatggactgtagccagccagggtcctctgtccatagaattttccaaacaagaatactggagtgggttgccgttttcttcttcagatgatcttttcaacccagggatcgaacccacgtctcgtaactctcttgccttggcaagcggattttttgcccctgtgccatctgggaagcccaatctctgattactggtttgataattctgcctcttagaagagggattctcaaggaggggaaaagggtagttgggaaaactttttgaatctctgagagagggtccttccaaacagttcaggactcccaggggatttgattcactctctatactttcttggaaattgctctggtatcataaagaaggctactaatattaattctgtatacaggtgaacaaatttagagggtaaaaaggttgaagcactagataaagggggatatcaaggctttatacagcaccccctcattggcaaataaattcacttaacccaatttgagggcaaaattgggtcactattctaggggaagcatagagaaacaaaatagaaaaaatcttcttttcatgtgggctgctagtgtttgagatacttctcagagaatgcattattccctttgggttgcttctttagtttgggggatgtgtgtgtgtgcaagcatatttatttaattttaaaaatatacactctagtcagactggtcagacacataactttttttttttcctcaaaactgcaaggaatgttttcaccagtattcttacaatttttatttatttttctatcatttacttagtgaaaacttcctgactgtaaaaataaataaatgaaactattttatcctgtgatattatgtggaaagatgttttcaggtcttccaaggagatcaaaccagtcaatgctaaaggaaatcaaccctgaatattcattagaaggactgaggctgatgctgaagctgaagatccaatactgtggccacctgatgcaaagagtcgactcattagaaaagaccctgatgctgagaaagactgaaggcaggaggagaagggagcgccagaggatgagatggttgggtgtgtggcatcactgactcaacggacatgaatttgagcaggttccaggagatggtgaaagacaaggtcgactggtgtgctgcagtccatggggtcacaaagagtcagacacg

SEQ ID NO: 55692 - DNA, 2204 bp, Bovine  19866880910741
ttggtgatggacagggaggcctggcgtgctgtgattcacgggattgcaaagagtcggacacgactgagtgactgaactgaactgaatgaaggtcttgcatccttcttcctgcattatttcaaaatagtctcagctggtgtcagctgtgttcgtttgtctctgggttattgaccagcaaccttccttctgaaatacaaacagctataagggtttttttttttttttggctgcaagagagttcagagagaataaacaccaggtgcaggatataatttacacagtgtggaggtggaggggggggtgataggttaactttgtgaaggacaaatctaggtaccaacactgcagattagtaagttaaaaaattaagattgatcagctctttcaggctcatttgtcctgttctctgttctctttacttgttctcaggagaggaaaaacttcatttcttttttgctgcaacacaaatctgatagtcaatgtcctatattttccgcagcagtggtgccattgactctccttccctttggaaatctctttactgatcttgcaatattggatctccctctagttattccttcataactattctttgttagctcttcactggaagatgagaaagtgcctcagagctctgtcttagatgatctcttctttttctcctggtttaaaaaaaaatctttttagcaacctcaagtagaaagggttgaattaagtacacacctaaatttatgacattatggagtattagatccattcttaatttattttaatatttatttccgtttctattcatcccctgtgcttccccagtggctcagtggtaaagaatctgcttacagtcctggagacaccggtttgattcctgtgtcaggaagatcctctggagtggctatccactccagtaatcttgcctaaagaattccatggagagaggagcctggcagctaccgtccattgggtcacaaagagtccgacatgactgtagtgactaagcacattcattccctataccttttttctttttggacctaaacactcagagccagccctgcaaagatagaagaaaacatagagctgcaagtgccaaaggcctggtgtaatgaataaacaattactgagcaagcagagttcatcaaacagagtgagaccatattctttcaacttcaacagtttaatgaaatgaaaacaacagagcaaatattgtacgaattaatctctactaaattttaatttttataaacttttattactcccaataatgcagattttttaaaacttaaatgtagagaaatatggaaatattcagtgtctcctgtaaagtaaacatactgtaaagtgtgccgctcttgaagtcattcagttggaaaaggacctgattaaaggattaacaagtaaccaaattccaatgagggtgaaatgcagctgctccgctcctgacacattagttaccccataaattccttgtcccacagcctcacatttttcaggctcagaggaggaagaaaaaaaattattaatttctttttttctcaagaaaatcttccagagaaaaggaatgtggtcatctttaactttgctgaagcccctctgaagcaactctttctactagatttttaggaagactagaaagacaagtagccatggctgaaatgtagctttgtaatagttaaacattttacaagcttttggtgccctttctctcacagatgcccagggacctcatgctatccttcaatttataaagttattgactatgttattctactcagatctgttttctcctgtctaacctcatacaaaaagttaattttctctttcattctcctccaacccaaagaacatcaaatccacattattcaggtcttacaaaatgtagctactttataattcaaatttcatttagatttgtattgtcaaaaaaaaaaaaaaaaaaggaaggcaagatgagtcttgaaaattgtcacctaattggagaagcagtaatactgattctccctgctatggggactggggaaattcctgggaggcaacagtacaaaatatttttacctattctactgagagtgaactgagacaagaccagggtcttgccagtaaagtaactaaagtgataatgatcattgcctatcagtccacaagcatgttgttgcagactgcatagaaccccatgattcatcattaactcttacataatctacttg

SEQ ID NO: 55693 - DNA, 1363 bp, Bovine  19866881032169
ctgtgaagtcaaagggctgaccggttcttacccaagcactgtgatcactcctttctcgggattacatttcaccagcctgtggccaaagtgcacttttgcattggagtatttctcaacagctgaagaaacaaagagagaaaactaatggaaatgaaattccaattcttatttcacttaaattgaattaatcattttctgagactggtgtgatagagatacttaacaatgtaaacatcaattagttaaaatgtgatttgacaactgtttggcaaatgttctaaggataatctggtagtaaaagagataaataaaaatcaactgtctccatctcaaaaaaaaactaactatgtatattcttgcatcactgtaattgttggcaccctaggaaagaagcaatcatcacatattttaaagttactcccaaattaaggcttaatttgtgattggaaatattcagtcaaacttcttttttcatactatgtctgactttgtatctctttttagcaagtcctctagacttctgactcagtttgttataaatatagatcattgatatataaatatagatctttttgtatcaaataggggaaagtgagtaagaagactggaaacttcttaataaatagaatcaaattattttagtgcttttttggcctgctaaaaaatctatagtgaatttaattttcttaactattagtttttctcatgagcagcagatctataattaggggctatttattgttcttaaagccacaaatctgaatgtagatgttagagctggtgtagacctcagagagagtttattttaaaactcttcatttcataaatgaagtaactgagcttctggagggaaaagtgagatgactaagatcacacaaagtaaagaatttaggaaaaataagccagaagtctgactttgaattcaatatttctatctgtacccatctctccttttcatctcaggttttgtatttgttgttgttgttgttctgctttgcttaagtttgatttggggtttgcagactttaagattcttgaacacaggattggaagctttagaatattgaaattcgagatatgccaaagacttatcgacatttaagaaatcttttgacaaataacttggagaaatcagggtttactcaaaccactatgggtatctttgacaaacacaatatgtgtttgtggaatcaagctttttgtaatttttttttcaaattaaatgtagagaaatgcagctcaaagaattttccatgggacactagtcctatgataactgaaataactgttctgtggtcacagtcattacagaaatgctcacactctgaccctctgactatgccgtcttggtccccagatacat

SEQ ID NO: 55694 - DNA, 1090 bp, Bovine  19866881198072
tttttttatttttattttttattttttgggggcaagatttattgtgattgtgaacagaggagaagggctcagtccttcttggctgctgctttcctcattggcggccaagacgttgctcagctcctttctcttcctcttcgcgcggatatgtgtccccacccttttcttgatgaacttgagggcccgcttgtccttggagaccttgagcagctccatggctcgtcgctcgtaaggggcgaagccacacacctcccggatcatgtcccgcacgaatttggtgtgtttggtgagacgcccgcggcggcggctgtgcctcggcttgcccacgttcttggtcaccttgtgacccgtgttgaggcccacggccatggggtagcgcagagccatggctgttgttccacaatggctgccgcggcggaaggcggtaccttctaataagtttttaaaagaggtaagagccatttggccttagttataagttgcaggggaaaaggggtggcttgcaaatgctccacatgctttccctgccgtaattgactttgactcaacctgaagcccaggaaatagggcacccatgagtgtgtgctaaggcatgctgtgttctatgcgcatgctccatgctctagcgtgctcagaatgcgttcagcttccaaaagtccagactccatctgcagggtgggctcgctctgtgattcctatcatgctctgcaagattcagttccagttcactaatgactgctctctgtatgtgtgtacatacttatttaaaaagtaaagtctacaattacatttcctaagtaagttttattaaatgaatacttgtatttgcacacagtccctagagagtaggtttgacaataactggaagaaagactgggaaaaaagtggaacttgggtgagtaagtacgtagatgagggggacgaagactgtgtgggtaggagagcagttgagaggccagtgaagtgaccgcaggattagtttaggtttagtaaagtccctaggctgcagaatcccattagatggactggactttgttggtgctgcattcgtttcccagtgtccatttgtttgtcatcttttctgatttca

SEQ ID NO: 55695 - DNA, 1573 bp, Bovine  19866881332936
aaaaatactggagtaggttgccatttccttttccggggatatttccgacccagggatcaaacccaggtctcccccattgcaggcagactctttaccctctgagccaccagggctcctttgcatctactgattccaaactcccaatccatcccttcccaacccattctccaccctggcaatcatgagtctattctctatgtctgtgagtctgcttttatctcataggtaagttcgtttgtgtcatattagattccacatacatgtggtatcctatggtatttgtttttctctgtctgacttcacttactatgataatctctaggttcactcatgttgctgcaaatggcattatttgatttttcttcttatagctcagtactattccactgtgtatatataccacaccttctttatccactcctctggcaatggacatgtagcttccaagtcttggctattgtaagcagtgtggctatgaacataggggtgcatgtatcttttcaaattagagttttatctggatatatgcctagaagtgggattgctggatcacatggtaactcgatttttgttttcttgaagagccttcacactgttctctatagtggctgcaccaatttacattcccactaacaatgcaggtgggctcccttttctccacaccttctcgagcatttttcagttacacactttttgataatggccattctgacctgtgtgaggtgatacttcattatagttttggtttgtacttctctaataattagtgatgtgcagcatcttttaatgtgcctaatggccatctgtgttatttctttggagaaatgtctatgtaggtctcctgtccattttttgattgagttgttttgtttctcgttattgagttgtatgagctgtttaacaactgactcttgtgaaacatcacaagtcagctttataatcacagcttgagtttccagtaagcaagatgacctggagccaaatatagggaaaagatgtgcctcttgctttctgcattcatctttttgtggatctctcaatatgcctagaagaagctgccatcaacccttcagctgaggctttttaagatctcatgtaggaacccaccatactaaaccacacgcctagtcatccaggattctgatgacaggttttgaaagcagagaccagtgtggttcccacatatcaaagtatgcaacctttgtaaaacatcatggaataaacatataaattatttacactacagacatatctctttggattatcaagatttcacacatctgtttctcaaccactcctcagttgctgttgttggatgtgttcttaggttctgaatatagctttaaggataataatatcatcatctcctttgccaaagcagaagataacattgtgcagtaaacagtgattcatatgccataccagttattctgagattccccttaagggccttggcttccttacataaactaaatcctttcttgcatatccacatgaaagctatctcctgccatcttgatgctcctgacctatgaagaatgagcatgatacttattccttggttaatacattt

SEQ ID NO: 55696 - DNA, 716 bp, Bovine  19866880552139
taaaaaaaaatgaatacatgtaattagcaacacatattaaaagtgcttgaacataaataaaatcttgcacaaattccatgatgctttaaacataatagaataatctgtgtgctgtttcttaaacataagaaacattatgtttcttaatttagtacacaatgaaatagttcttacttttttttcttaatttaatatacaatgaaatctgctttggcacttggacgtctgattgtggctaataggtagaataaatattttttccctaaaggtatacttgtgaaattccagaggaattttccctaataaaaactatgaaaaaataaaagtcattttgccaaaatataaagtcacagtttctaggactgagtttattttcttaacaaagatcagggcttctctttgaaaatgatgtgtttcctatttatagtttgatctttaaaaacacctccacattaaaataatcaggatctaattggacttcctattaaaatgcaggcattattcacagctctcttaatcactccttcccctgttcttatcacatctctgagctacaataaggctcccaagctattcatctaaacttagctttccatccgttggactaaggagttctttgggccatggggaggtctgtgcattttactaaggtgtaagcattagtgcccatagagatgtcccaaaacaatgcaaggaagctccaacataatagaaaa

SEQ ID NO: 55697 - DNA, 1066 bp, Bovine  19866880588693
ttttctcaaaaaataaatctttctgaaacttttagctcttgtagttctacacagtgagcacagggactgtacttaccctacttcctgctcacttctctccaacatgcagaaggtgctgttatccttgatagtgaatggaaactaagacaagggctattgaaaagataacaataatacagtgtcttggttcaaataaaagaatatatgtaaaaatgcttattgaacagaaaccaatttttatttttggcttaaatttaaatatttgatatgttttaagggtgccccttaaaatgaagtggtttaaatttggagtttaaagtcagtgtgtggactttaaaattttagctgtaaatacacataatataaaacttgccatcttaaccattttaaagggtttagttcagtagtatgaagtatatttgcattgttgtgctatcaatctctaaaactttttcatcttgtaaagctgaaactgtatccagtaaacagttgaaactctttatcagttcaagggccaatattatgtacgctgttttggaactttcatctgcaatcatctgttggaaaacctgctttcaattcttttgggtatacacctaggagtggattttctgggtcatatggtaactcttatgtttaactttttggagaactgccaaactgctttccacaaagtttgaatcattttataaatcccatcagcaatgtacaagagttccagtttctccagtcctgattgttttcctttttaaaaaaagtatagccatcctggtaagtttgaagtgtctcattgtggtttgatttgcattttttttttaaaagatatattgaactttttttcttttttaaaaaatttttttattttattttattttttaactttacaatattgtataatggtattgagcatttttccatgtgcttattgcccatttgtatctatatctttgaagaaacatttatttgaatcctttgcccatttaaaaactggactgtgtttgttgttgagttgtaagagttctttatatattttagacatgatttgcagaattttcttaattctgag

SEQ ID NO: 55698 - DNA, 1050 bp, Bovine  19866880600515
ttatgggcttgtgattctagtaatccagagaaccgaatccaaaacagtttaatcctctgactgacactaatgctgaaaataattttcaagtatttttccatgattctatataaatatcatatcatagccagatcatcaaagcagtgagaaccaaccagaaaaatgccttcacctacccccatacccacagaactctgtcttcccccattacactctaactgtattatttgaccatccatctttcctatttgtccatgagtttcctgagaatagtgctcatctgcctctctaacttattattgcaagcccagtgctgggcccatggtaggcgttcaatcaaccattggggaatgtctttgttcaattactatgcacaaagcacaagttgaaccagaggcagtttttcattattaccatattcatccttataccttaaggactcaggcttaaatttctcttgggaaaactgccctttgactcattcatcagactctgaccttagactgccttgaacagatattcattagtcagttaatcaacaaactgttctatgtcccacacagtggaataagaacactgtgtatcaccactctgattgtgttactgatgaagttacagaagtggaaattcctcttcagagcatcttcaggttgagtcttgacacaagaaacattccgtgggtgttatctgagaacacactgtaagcaaagtttataagttgggtttatttgatttttatttcatttttcaaatctaactcccttgaatctgtgagtaatcttgtgcaattatgaaaatttgattcatcctgggaatcaattccaaatactttatcctttcaaagaggtgctgcttttgtcatgatggtgaacagattttcaagccgtggttcacggaaccacagactttcctaggggttgttgagaagcctatttatgtaaaacatgcaatatattttctcaaattctaccctaacatggcattaaaagctttagctctacagtagaaaaaagtttaaaaaaattttttaaaagtcagtgcacattaaaa

SEQ ID NO: 55699 - DNA, 4735 bp, Bovine  19866880620450
cggatgttggcatttgatctctggttcctctgccttttctaaaaccgcttgaatatctggaagttcacagttcacgtattgctgaagcctggcttggagaattttaagcattactttactagcgtgtgagatgagtgcaattgtgtggtagtttgagcattctttggcattgcctttctttgggattggaatgaaaactgaccttttccagtcctgtggccactgctgagttttccaaatttgctggcatatagagtgcagcactttcacagcatcatctttcaggatttaaaataccttaactggaattccatcacctccattagctttgtttgtagtgatgcttcctaaggcccacttgacttcacattccaagatgtctggctgtaggtgagtgatctaaatgataaactatcccataacttagtggcttaaaaccactaatattaataattgtattatttcttaaaattctgtgagttggctgggtccagctgatcctttttctcctgctctacctggtgtcagctgggttctctatgtggcagcatccttctggggcttactgatacaaggtggtttagtcatgcatttggtggttagtactagctattgagtgggacttctttttacatgttgcatgtccactagagtataactaaatttctttgtgtaatacctcaggattccaaacaaaagtgagaagctatcttgtctcttgaggcatgggcccagagctcagcctgagtcacttctgtcatattctattggcaaagcaaacagcatagccagcccagatgtagtcttgaactcttaaagggcatgttcctataaagatgagaatacttactaatggccatctttgcagacaatataccatatcatccatagcatgtaagtgacatcagagatggtgaatttattggtggccatctttgcagacaacataccgtgccaaccatagcagataagtgacatcagagctggtgacaatcacagtacctggatactgagcttaaagcacaaagacacaagcacaggcctacccaaattgtcctgcatcccataaacacacttggcagccttttacctcactaaaattgccaggtcaagtttgcaggtgatctggtcatcaaaggtacagagatatttctgactaattacaagagtgtctcagagaacaggagcagagcaaatggacaaatcatgatttaatgatcccagaaattcttcagctcaaagtagcaactaaaactttggccattgatttcaggattaagagacttagtcataggggaaaacagagggctttggagagttagagctaaggttgagtcctgactctgtcactgacaagtttggtgattggggtaaatcacctaattctctgagtatcattgttctcatctataacatgtggatgatatcccctcccttgcagagtggctgagaatataaagtatctggcacacagcttcttatataaaaaggcttagtaaatattaactatttttatctttgaatcattcagctatgaaaatatggcctatgactttaggacttcctatgggacagtcagcccctccacactcactcacctccagtttgtgttaatattttgaaggagcataaatctttccaattctgtgaatatataggtggatccttctcctctgggtccattggttcagtgaagatagcctttcagatgacttttccttcttcctatcttcctgcccttctatttactctttcctatgtggtgttagagaagactcttgagagtccgttggactgcaaggagatccaaccagtccatcctaatggagatcagtcctgggtgttcattggaaggactaatgttgaagctgaaactccaatactttggccacctgatgtgaagagctgacatatttgaaaagaccctgatgctgggaaagattgagtgcaggaggagaaggggatgacagaggatgagatggttggatggcatcactgactcgatggacatgggtttgggtgaactccaggatttggtgatggacagagaagcctggtgtactgcagttcatgcggtcacaaagagtcagacacgactgagcgactgaactgaactgaactggggagaagccatttgaacattatacatttttctgtcttttaggaagaatggattttgctttgtttgtcccttcgatacaactcagaaaatcaccctccatcctgaaaataagtgcattgcatttctaaatggttaggagtctttgcagcattgtcagtatgacctgtaaagaactctctgctaagagttctctaaaggtacagttaaaacatatgtttccccttgcgtcatactctaatgacagaaatgtcttatttttttgtttgatctttgtggagggccattgattttagtcctcctgccccagatcacttgtctcttccctccgttcttcaagaacaacaacacaaaaaaatgagtaaacaaacacatacacaggcatagtttgtttaaccctaacgtaaatcccgggcatccctagagactcagtgataaagaatctgcctgccagtgcaagaggtgcgggttcaatgcctgggtcgggaagagcccatggagaaggaaatggcaacccactccagtattcttgcctgggagatcccatggacagaggaaactggcgggctatggttcatggggtcacaaagagtcaaacgtgacttagtgactaaacaacaacaatggcaaagtaaatcccattttatatttgtataaagcaaagacccaattgttttaagatgaataagcattacttgattatttttaacaagtattttatagttttcttatgttcagttttttcagagtgtttccatcattgctctttgttgaagatcaggttccctgggaagtaggctctgagaaggcagtagtgtccaggagaggcatgggggaagggaaggaaacaggattgtatagacgagaatctcactgtggtgcagtctcagtaaaggcctcagctaactctcggggagctctgaggacaggatgtcccttcagagttttccacagttgagacgagggtccaggtggttgtacactcatgtcaatcagccatgggatgcaggctgccatcagggatgggatatgacttatttgaggcaactttgttcagtctcgagctattccaagagagggagagatgtcattgaggttgagggctttgagctacaggacttccagcagctggaggcatgtgtctttctgtcccacagaggattctgggaggtacatcagtcttttagactgtgacactttagacatggatccttgccttgggtcctgtcatttggaggattccaccctgatatttcttctttttccaaacttgcccctcctcaagggtcaagggccttagagcccaaagcctgaatccctcctaactgcactttcccaaaccccaatctttcaagcttaggctgcagaggtggccaagagacagacatttggaagggtacttgcacacaccgggctgtccacaatcatccgaatgaagacctccatatgtagaaccatgggaagtgggaagaacagaacacttggagagaggtccatttggacttatgctccaggccctgtaaatgttggacgtctgccctatttgatagctaacccttccctacagctggagaaatggagacaacagggagactcatctctggttacagagaggcgcaaactcagagacgtgactgggcctctggttattgccactagactagctgctctcctcaatggaaagtgttgagtcagatagagatgactaaacttttcctcggaagacttatccttcactttctttatctcattgaaatgtttgtgaggctcagagcaaaagtctatatctatgaaattcccaggagaaaggtactttagaaatacaaggtattatagtataatcctcagaacacaccagcattagagtcctgggagcagaaactctgaattgtgagttctgcttggcttgctcaaatgtcaaagccttctatgattgataggtcaatagtagctgaaagattatgaagttttgtaaatgtgtgattagctcataaggaaagccaaatattttacctgataacacccaagaaaaaatagttattgcaacttgtagaaatgttgccatcaataaactgaagagttttcagtgtcaaaatttggtgccataatttctcttcatctatcactgctaaagctcttatttactgaaaacaccttccaaagttctctcaaggttaacccagtatccaggcaatagataactggcattcttttttgcttctgaatcatgtttccagtagacttcacatgactatgactcctgcagaaaacacagagaaagcaggagggacctttgcatcttgtacaactccacctaattagccagggagatgctccattccaaccagcacccctgaactcaactctactccttccccatggagatatgtgctggtcaattattcatagtctcctgtaagttcactgtcttctgggttcttagtttgctttcttcatgaagattttatattttagttcataaacaaatgatctagaattatgaagaaatatgccctgtgaaataccgtccttccgtcctctagataggaatagccaagcattccattctgtgtcctactccctaaagttaggaaagcactaagaaaactcaagaat

SEQ ID NO: 55700 - DNA, 1570 bp, Bovine  19866880724948
gactctggtggggttacaaagagtagacatgaccgagtgactcagcatacaagggagacccagagagagaggtgagcagagaggactgcctaactgtggaggagtacagccaagccacagcccagcatggggatttcccggggaaaaaccacccacgcccacttgcttcttgcttctcatctcctgacactgtaccacctgtgaaatctgacaggcgccaacagcaaggggttatgttgatgtattctgaacatgtcatcttcttagggcagagagcagggtttagaagaatggagaattcacttggaggataaaaggaggacattatcccaaatatcattttcagtgcagcggagagttaggaagtgatcctgcctgctgtttaagctgttctgccttttttctgttaaaggccataggtggtagataatctagtgactggaatggttcacttagtatgtgaaatgagaaagaagtgtgatagactaactttaaatatcttccttacccaagaagaatgaggtattacatcctaccatactcaagatctgggtttagagttaactacaaatcaataatactcttatatataaatttccatggattgggtaagtacaatacttaagatcaattgagaaattcaaactggtttatgagtacattttgtagaaatagctttgacagccaacctgaagagacttgatctggtaaactgtggctccctatttctacactcccgggaaggaatagtccctggagtcagggggtaaaattgtgggtgtctagctttgtcactgactagggtatgtgtgtgcatgttcaagtcacttcagtcatgtccgactcttggcaaccccctagactgtagcctgccagcctcctctgtccatgggattctctaggcaagtatactggaatggttagccattcccttctccaggggatcttcccaacccaggatcaaaccctcatcttttacgtctcctgcattggcaggcagattcattaccacttgtgccacctgggaaccagggcatatcagaccatcttagcttgagaatggaggaagataatcgtgcctccccaaagggtccttgtgaggacccttagcatagcgtctggtgcagaggaaggatctgttagatatgagttgttctagcttgggtgagtcagggagtctggctaacagcagaggagccttttatttcagttgaaataaggaagtgatacctttgctggaatgctggctttctgaaaatgaaaatgcagtttcaaaggggatatgtgccttctccagaaaatgatgaattatgggtgtttttgcagtctgtgataccaatacaaataattaaatcaaagtgagcctggaatggactcaaaggctaatggaagtgtcaggatggagattaagaactgagaagcagctgaggaggaggaggaggaggagaaacacttcttatctaccaagggaattttgctatatctgtggcagcctgttcatagcttcagggtcaaatgcaaagaaggatgtgcacagctgtcactcccgtgactatatgagatcaggaaa

SEQ ID NO: 55701 - DNA, 1886 bp, Bovine  19866880781113
tcgtattacctaggaaactcatgattttaggagaagctgtatgttcatttaggaaacagctgttttctttatttcagtgctgggtattttataaaggaaaacccccatttttctttgatgcttgttgtttctctgataatccaagttcctatcttcattccacatgatttaaaatcctgtttatatccaatattcattcagtaaaatggcttgagatttgtgatgctccaaatgaattccagttcgagagggggaaatctcagagtcctactggagctggctgtctgaagacaactgaggatttacactcagaacagataataatagaaatgggatataaaaaatgaaaaagatttgattgcatggactacaatgattatggaagctttttttttctccttagccaagtgtaagtgagtaaaaaaaaaattagaggccatgtatgggagccttcacaaaattctgggtcacatctttcaaaacaatgaacatagcagcaaacaaataattataaattccacggactctgaaaaataggctgatctcttaggttttgtaaatgctttccctaatgcattttccttcaccatcacattttaatgccatctgttgcctgttttcatgagtgaggtcaattctgagtcactttatgcaattatgcaaatatggtttctatgaagtacagggaaagtaatgttgctttcaatcatttttgaaagccttccagtgatcaagtctcactctagactggtaaaactatattgttctttcaattgtttaatatagtttagcagtaaaagtttgtcaatgtcttttagaagtggtttctaatatacctctctcaaaggtttgcttatttttaagatgaactggaatagtcttatttttttagttggtgtgcattactaattgctactcccagactggggccaatctgactataattgtatttctgcacattaggcccagcaaaacacagacacatcctctcatacacaccgtgataaccttctgccccagccccagtcaaggggaagaatcatgtggggttttctcattatctgtcttctgtgattacgcagcttacacagcagcagacatagactgacccacagcacgatgcaggaagtgacatcagcccggcagtgctgtctagtatttgtgtgtctagggcaggagggctgggaggagacagagataaggagggaaaatgttttctctctagggcctaatcagaagattatacttgtatccagaggaacataataaaaatactcttgccattcagggtacataggctgtatttggactactcagagatcaagagtatttaggtaaaaaaggcagagatgtagcatctaaaaaatagaggagtaagtctagccataattaggaagtgggtaactggtattgaagggataaaaattcagtgtatgaactataaacaaaatgaacttctggcaactatataggaagatactaaagataaaggctatattgggaaaagtaacagagcatcacagaatggcattgggcatccagaaaattcaggtattcaatgatcacatttattgagtgcctgctgtgtttcaaggactgtggttagcagtggaatacagcagtgaaaaaaaaacaaaacaaaacagatgagagattacattctaattggaaagcagagaataaatgaataaataaatgggtaaatgaatccatttatggagaaatgtatatggacaaataataagatagttatgacagtaataattaaaataattccaggtaaagggctctgaagaggttaaagcaagataaaggaatagaactaggggtgtttgtgtttcatggtagaatttaactgggacagtgggaaagtcttctcagaaggg

SEQ ID NO: 55702 - DNA, 992 bp, Bovine  19866880797954
tggcagtaactgaaaacattgtaagactttattcttattaagtgttttacaatttagaatatctttaacatatgcaccaatctggatcattcatttttttacagcagaagaaacaatctcagtaaaatttagcgacctacacagagccacacacctaagtggcaggatccatggttaaagagacataccaatgtgaactcagactgtagacacctatttgcactcagactacatacctggtgggcagggtgaagtctctctcgaagtttctcagatcatgtcattctagatttacttttactaatacagctggtgagcactaagagaatacagcttggtttttcttcctctggtttatataaacaacacaagagccttagatactataaaatcattagcttgcttaactgtatggttaagaaacctactttcagcccctctcatatccaagactctccaccccaaacaaaacaaaacaaaatccttagtttaaatttatgatatgttaaagtcaagaaacatggatgtgttccgaactctgtagctaataaatgtcttcatctctagggtcctcaattccccctctgtaagatgagggcattagagccttaatagcctataatagactataagctttacatcctaagattcaatgcgggcctggttaaaaagccactcaagcttactgaaaggagttggacatttcaaaagttaagatccatgacatgataaggaacagtaccggaaaaacatggcttgcccacatgacacgatggcctctataaataggaatctcagaatatcttttcatgagactagctggttagctctcagctgcctggagctgctatagatttagaagaaacttcttagtttggctctcatcctgtacttctaaaaatccagtagctaatttaggatttaggactgatagatcactgttttatgcagcttagtacactgacaagacttgtagaaccaggtttccaggt

SEQ ID NO: 55703 - DNA, 2565 bp, Bovine  19866880805584
aaaacatctatttctgctttattcactataccaaagcctttgactgtgtggatcacaataaactgtggaaaattctgaacgagatgggcataccagaccacctgacctgcctcttgagaaacctgtatgcaggtcaggaagcaacagttagaactggacatggaacaacagactggttccaaataggaaaaggattttgtcaaggctgtatattgtcaccctgcttatttaacttacatgcagagtacatcatgagaaaccctgggctgaatgaagcacaagctggaatcaagattgctggaagaaatatcaataaactcagatatgcagatggcaccacctttatggcagaaagtaaagaagaactaaagagcctctcgatgaaagtgaaagaggagagtgaaaaagctggcttaaaactcaacattcagaaaacaaagatcatggcgtctggtcccatcacttcacggcaaatagatggggaaacagtgtcagactttatttttctgggctccaaaatcactgcagatgttgactgcagccaagaaattaaaagatgcttgctgcttggaagaaaaactatgacaaatctagacagcatattaaaaagcagagacattactttgccaacaaaggcccagtctagtcaaagctatggtttttccagtaatcatgtatggatgtgagagttggactataaagaaagctgagcactgaagaattgatgctttttaactgtggtgttggagaagactcttgagagtcccttggactgcaaggtgatccaaccagtccatcctaaaggaaatcagtcctgaatattcattgcaaggactgatgctgaagctgaaactccaatcctttggccacctgatgctagcaactgactcatttgaaaagaccttgatgctgagaaagattgagacaggaggagaaggggacgacagaggatgagatggttggatggcatcaccgactcaatggacacgagtttgagtaaactcagggagttggtgatggacagggaggcttggtgtgctgcagtccatggggttgcaaagtcagacacgactcagtgactgaactgaactgactttgtacaaaggagagagaagaagtttacttattgaaagagaaaaatcattcattagaacctcatttttctggggtcattatctaacatggtattattgatgggctgccttggggaacttctcttgtgcaaatcagacccctgttcaacctttctcccaacgtgccggttttagtttgcctcttctattgctaacattcacccctcaacctagatgactttatgtacgcaaacctgcatgagacattggcaagctttccctcctacctgtccctgagatttaagaaagcatacatatgaaccttgacgtaaaaagatttaaagctcaagcttacactgaaccccgtaaggtttcctgaactcagtatgggccaattcccataattcgcctacaattcccttctgtcctctgtgtgccttataaattattattcgttaaaaccaagctaagacatcttctggaaagcctcccctgagacctcttaccctacccctaactctacacactgcacatattttgaaaactcatttacattaatttatcctacaaagccgtgatcaatttcagcacaggggttatctttattctttgtactttcagcacagggcctggcctagcaggccctccttttacagacttttctatttgttttaacttgggaagttccagatataaggagtatttactgctaaataagtcactggtcaaatttaaatgtaagctaacaagagtttatatctccacattttttcattctccattttagatcaaatccctcttatctaggttggatgacagagtatttaaacctggagccagttaaagaccatttagtcctgtctcttgtgagttatggctggggttcagtcactgctgcaggaacttactccttattcttttctatggatttagaccccatgcggtatctgtgcagtggcttgactgcactgttttgcagctttactagctgaggaagctgtttcctatcatgaatttctgggttcagattcaatacactagtcttacctttttccctgttagagacctgagacctttccctcactccaacttgaggaataattttgtactgtcctcttttctgtgccaaactgctattctgaacatgcactaatgagagattatccaagttattatctgggcagtcatctaagcagccaccatacttcaaatgaagggacccaaaatctaatgggaacctgatgtgttgtaatagtaacttccagtaccaaacagagttgcttctctcatgtttaacagataaactattcttcaccataaactgccgcttcagagaaaaattctaatttctaccaaaggctttgcctaaaggcttttcctttaaaataaatggttcatattactgttgacaaaataaaaaatgaaaaaaaagtttcttttttgtgtttataaacacatgaagtccagaatgctggcagagtaacagaagtca

SEQ ID NO: 55704 - DNA, 1304 bp, Bovine  19866880946778
ttacatagcagcaggataccaggttgggtcctattttggacagctgtgaaatcccaagagagaagctcagccttgattcagtggagagtggggagtggggagccaggctaagtgcataagcagaaatgcaacacaagacaaatgagtaaacacagagtcctgccccccatgcagcccagggacacctacacgctgccattgccttctcacctatgctagcacctacacggctctttctgcttcaccctgctaaccctgaaagtgaaatagaaatcaggttcccgagagctggctattcttattttcactaagttctctcctcttttttttttatattactttatatcttaaaaacaaacaaaacaaactttgttgctgttgagttcagaataataaaatcgtgatggtaatcatatatgtaaaaaatatccagacttatcctgaaaccatcttggacattctcgtatatcgtaagtttgaattactgtttgagttccgaaacaactcaagatgcacattgttgtgttcagtcagtcgtgtccgattctttgggaccccatggactgagcacaccagccttccttgtctttcaccatttcccagagtttgctcaatctcatgtccattgattcagtgatgccatccaaccatctcatcctctgttgcccccttctcctcttgccctcagtctttcctagcatcagggtcttttccaatgagtcagtcagctctttgcatcaggcagccaaagtactggagcttcagcttcagcatcagtccttccaatgaatattcagagttggtttcctttaggattgactggtttgatctccttgcagtccaaggaactctcaagagtcttctccagcaacacagtagtatgctttccatttcttacttaacccatgtggggctttaagaaaaacagaatctgaacattgcttatcccttcacactttagtaggccaaatgtgatttggaaagagctacttgataaatccaaagaataactttctacttttaatgagtttcccacctcccttaaggggtaataataataattctaatgcaaatcaactcagaattctccaattctaaccagaaattttagccacaaatattcaactcagtttgtttctttgtttgctagtaatgcacccatctcctctatacattttaagacacattttgtctacttggtgtcactcccacccccttaaatctgcatgtccattttcacagcagagttcagctgagccagagcacaatgggcttcaagagatattgctagcacattgatcttg

SEQ ID NO: 55705 - DNA, 817 bp, Bovine  19866880981696
actgcctttgtatctgctagattggatactactgaattcaaatttttgctcaaataaacacttaaaatgtttaacatgcctcagtttatcttttagcaccagcttcgcaggaaatagaggatggatttcaggaggtggtctctgcaggcttcccttctgggatattaaaatgtgtcagtgaaatactaatattatttctccaaatatggcatttaggcaatattacatagcaatcaattgttttctcttttccacacagccctctctgacctgtaccacagcttcattgcccaccagcaccatccccatatctgacaatgtccttcaggttttcggctgggatatctacattaattgtactgtttagagtcatggaattagaagatgcttccgagaaaaaactaccaaaacatcaaaaggtgatcataaatatgagaagtaacttgtactacaaactaataagagacagaattcactgctgaaactgttgcagtgatgatcagggacagaatggaaagctgtcatgatccttacgtgtgaggacaagaaaagctgaaatttgtaggtcgtgtggtacacatcagacatactagccccactagactatgctaatccttgtcctcatttaactgtcaaaagaaccctacaacccaggtaacattttttaaaaatactttataaataaggaaatttaaattcagaaaggtttagaaatttgtctgaggtcatacacacagtaaatagcagaaataaaattaaagacttagaaaggaccatgaagattactgaccagtgaagcaagagctcttgcacacaa

SEQ ID NO: 55706 - DNA, 1335 bp, Bovine  19866881056522
atcctttccccttggcaaccattccctaagtctgtaagtccccttctctaagtctataagtctgttttgcaaaataagttcatttgtatcatttctttttagatttatctacttttacatagtagtatgtgtctgttaatctcaaattcctaatttatccctccccctctttaacctttggtaaccataaatttgttaccaatgtctgtgaatttccttctgttttgtccacaagttcgattgtattgggtttccctggtggctcagacagcaaagaatctgcctacagtgtgggagacctgggttcaatccttgggttgggaagatcctggagaatggaatggctacccactccagtattcttgccaggagaatctccatggaggagccaggcaggctacagtccatgaggttgcaagaatcagacaagaccaccaccaccactagactgtcttctccactagaatcaaagtacctctgtccagcactctatcctcagtgcccaaaactctactgggcaataaataaacgatggaatttgtccaaagacttggggtcactgaatggacaggacttccttccaaatggtctgtctagagtccttcctcttccccccttctccccgacaactcccggcacacaggactgcctctaagatgatcctcccccactctgtggatggggaatagagtggcatttatttacacttgtatccccagtgtccccacccaggttggctgaactgaaagaaaaggtgcatgccactgagccaaaaaaggaaaattctgcaccttatctccagtcccagccattctaagctgggtagaaacttagttctgcttccccacgaagcaggagaagccactactgttggcattcagaagacagggacaaaggcagcatcattacccggaggtgtcaggctctggacttgtaccagctttccctcccttcccacattattcatctttcagctgaatcacaaaaagaaacaggatgtacaaagccacaaacagtatcatctctttctcctggggactatagcaccactccttttgtataatctcctgaagcttttatacatttccttcctctggtgctgttttctgcttctcccagcctttctaactcctccttgattttctttctgccagagaatttattcactgtgagcacgtgcacacgtgtcttttaaagcacaacgctggctgcattcccagcaagggaggaagcagctttgtggcccaactaattcaataagcttcaattattcatggaatatttattaggtgggacgaaagcaatggttccaccacttgttattagcccacaaat

SEQ ID NO: 55707 - DNA, 1539 bp, Bovine  19866881083373
cttcttttggggattatggacattttattagtatcaacactcaggatggagaggaggaagaagagagaaagatgtatatttactgactttgaatacttaatagcttacacatttctttctcatttggccagctttctgaaacttttagatgagggactttcctgaccagttcagggacaaaagacacttgtgactatattgtaataactgagattgttctgggtactataatggaatattataacccctcattgactagttctcagtcatagaattttagagctgtgctagaaggacccacattaccagctggttaattgtggcttcaattcattatagtctgcagatgttattgctaagttaagcattttgatgtattcccaaggcttaaaattcctgtgacacagaattccaacattctctttccttctgtattccactctcaatatatgaaaaataaaaggactccaatacaagtccctttaccacgctcctctgctcttccacaaaacttcccttgtgaaattctatatgataaacccttagtgtacctgtgcataaataattatactagttcgttttggaaactattattagaaccttcgaactctgtggaacacagtttttaaaactgctttttaaaaaatatatataaaaatatttaacaatttcaggatccattttataaaatagtatttaaaactcctaatttagaatcataggtcttagtattatcagactttgtttctcagataagaaagattttatatttagtcattcagtgcgatagattaaaaataacaaggatagtagaaaatacaatttaaaatcaattttgtatattgtgaagaaagtgaaatagaaagtcattatagttgtgaactttatgttgatattagttctctatgtatttatcaacattctaaatttttttcttagtgtaatcgctcaaattcttcttcacctgttgacaaacttaatcagcagcctcgtctaaccaaactgacacgaatgcgcacagataaaaagagtgagtttttgaaagcattgaaaagggacagagtggaagaggaacatgaagatgaaagccatgtaggctcagaaaaggtaattgaacgtgtagtgtaattcttgggcttgacattagcatgtcattggaatagttggacagatattatttaggatctttgaatattttcatattgatgaaagcaaggcctagttagctatttgcataaataatgaattcctttcttaatagatttttcttactctagttgatgtgcaaaaatgaaatttaaaagattgctgttcatatttgtatttttggttttccccatcttgcctgcctttgtccttttaatttttggttgaatagatgtgaatacttgaagttagtaagttgccttcacaacttagttttacatcttacgaaactgttttctacatgattatataaacattacagttatgttttatccatgaaaatctaaccaggatctattaaagtttccttttttaataactattctctaattt

SEQ ID NO: 55708 - DNA, 1634 bp, Bovine  19866881314273
ctttttaatatgctggctaggtttgtcatagcttttcttacaaggagcaagcatcttttaataccagggcttcagtcaccatccacagtggttttggagcccaagaaaataaagtggcagaaataaatagatgcaaaaattgtctttcgagtgcctttaatatcaagtatactcatagatatttagtgagtcaaaaatctgtcttttttccctaaatatcatcttaagaagagttattacctggaaactcttagaaatgatgtggtatgggagaaaagacacctggcataaccctgtctaataaacctgcctcctctagacagccatgctacctctgagctgttgcatgagagacatataaactttatattgttcaaggtttgtttttttttaagaatagttattgtatgaagatacaaattaactgtgtccttcattccagactccatgaaatcccaaatgaccaaaaaatagaggttaaatcccgtcaaattaagatttctgtatgaagaaatgactgcatagtactacaaaatacatacttcaattccaaatgggattttggacacaaagaaatgggcaggaaaacaattctctcacctctgaatttccattgcacagcagttcatttttcttgttcttgacatttaatgtattgtattctgatggccgttcatttctcttatctctctgccaaactgtaaaatccttaaaacaggaactgtgtctcacagtaaaagacagggtgctagaaagaaaagaataagatttttattagtaagtagaatcaccatccactattggtacaactttgggcgaattattcaacttctttcgtctttgttttattcatctataaaatgaggttgataatcacatggagaattattaggtaggcttttaaaagaatatttgaaactttagttaaacatagcagattgaaacatacatgctttattccagaaacacattataatttcagtaaataaaaacttcttaaattgataagggcaaagaaagcaaggaaaagagataagagaaaggaaaacaaacgaaaaaaagaacagatgtatagaaagcaatggactgatttgtggtaactgattagccagaccagccagcacggaaactcttcaccagataaagtcagtaagaaggtctgtttgcctttcaggatctcagaaggctcaggcttggaggcaggaggaaacttggaaatgagtgttggtgggggaaaaaagaacactgatggaaagtctttgtatggagcagtgaaaccctggatacattctgttccccacacacccaggtgtctacctggcttaatgtgaatattgtttatgtaaacctagcaggaaatggcaacccactccagtgttcttgcctggagaatcccggggacgggggagcctggtgggctgccgtctatggggtcgcacagagttggacatgactgaagcaacttagcatcaatgtacaggctgaatatctgacagaaaattataagttatattataaaaacagaaggtagaagtgtgtattagggtgaaatgagatatttgaccactatctttccctgtagaaagttcataggcaatatctaaaacggacaaataaagagcagtgtagcatat

SEQ ID NO: 55709 - DNA, 1703 bp, Bovine  19866881334783
ctgtcctctctcccactctggtattgtagaagcatagacataggactgggggtcaggaaattgaatgttaactcagctcctgcattccttgtacaaaccatctatcatctctgggcttcagaagtctgatgtaaaagaaggttcaaacaaaatgatctcttagccaattatcaaatgtcttttgtaaatatcctaagttctggaactgcaatagtgagcaaaacacctgctcttgtgcaaatcatagtctaatgcaaaaaacagacctaaaacaaattattcagccatataaaattctggaagagaaaacatacataaaccagagatatgggagcaaaatcaaagagatctgagccttaagagtccaggaaatgctttcctaaacaagtcacaatccagccaagacctgaatgcaggggagcggctagctagaggaaagaacagttgggatgaagagccttccaggaaaggaaactgtatctgaaagatttgagagagaagattgcttggcatctccaaggagttgaaacaaatccagatgtctaagtctaaggactggggagaaagaagtctcaggctagtgatgcaggttggatggagaggtggtggtgggcgggggagggaaccactcagagtgctgaatgctatctcaggaatatcaaaataccttcctaatctatggttctatttaaaagatatttatatacagatatttgactttaaaaaagaattcaagggacttgcctggtggtccagtggttaagactccgagcttccactgcagggggtgcagtttgatccctggtcagaactaaggttctgtatgccatgtgacacagccaaaaaaaagtttaaaaaaaaggaaaaggaatttgaagtccataaatacatcataacatggcttgggatttgagtgtctagctcataatagttgctcagaaatagttgttgaatgtcaaatatattcattatcctatggctcttgagcctaacaagcgcatctgataaaggatgaggaagtcatcataaaattactaccctttccattagacgctggcatagataaatctgatactgacagagaagttcatcaacagtgacagagagggaaacagtcctcagaatagaatgcttcatggctgcaaaatcacttcaagttgtagccacctaagatctgaaatgaacagtgaataatcatcccttggctgaaagactgacaatacaagctaacatctcctggctgtaaattagaaatgtagattagttcatggaaagttacacatattatgatttctaaaacttctctggaataataaacatcactccctttggggcttatgttactctgattttaagagaatagcatatgcccaccataaaggttcaccaagaaattcatgctgttataaaatggggacaatatgggtcaaaagctttattttttaaattaatttttattggagcatagttgctttacaatgttggtcaatagctctaaatcagcctcagctaaaaccactgggcatcagcctcagctaaaaccattgggcttcagaacattttccagaaaacattgtgtctggatttttatcttctgcaaaggccaataaggctgctaatctaatctgctgctgtgttccctcagggcagaatcaagcacaaagcccactcacagtgtctactctctcaccaaaaggtactga

SEQ ID NO: 55710 - DNA, 1358 bp, Bovine  19866881508010
ccagatattttctatgtaaatgtattttataacaccaaaattcaagtggaaaaaaattgacttaaggagttataattcagtcaggaaattcaaatgaactcataaaatacaacagcttgattgaatcagtctctcgctagtcagttctctacccacataaaatatgaaatgaaaaaattcttttgccaaacagttggaagcaaaagttcaaaaattttaaagtcccctgatcagcaggaagaatcagatttgttactttattttctcctctactgatatccctgaaagtaagactttgagagaagtgctttataaaaatgtttcatctaaaactgtcatcaggctaaagagagaaaagtagatcactacgttacctctatgtaaacaatttcccctggatatttcagtaaccttcagtgccactctgatgcaactttatcattatacacaaagcttaaaacttatgcttcaaatttctgggaccattaagaacataattttattgttctcaatgatgcagtaaaagaattacaaaatacacatttgtagagacctctatagtttataaagtgtttcattaggtcagggagatactattctttttctcagataagaaaacgaaggctcagagattgttgggtcacctaactcgaaacggccgtgttgtggttgtaattaggtttcctgtgcctcaagttcacgttgatagcctattgtactcaagtctgttaaagccccatttcaatggatccagggggacgtttgagtcacttcccataaaagatcaacctttacctttggaactgctctggccaacttttgtttcatatgcatgtgttgcttatcacgatgtcttgtgtttctattgctcatttctctgagaaaatccaggcacattccagacactcaagtctaatctactctgatagcagggagcaggaatggacaaccatgggggttgtttggcgcgtgcccagaggctgtggggtagactgctcatttctggtcttcctgaaacaagaatgggcccctgccacctccggtgtgctgtgtgcttgactggttttcccttctccttagactcatactcacacgtctctgttgctgatctcttggctatcatcccttttgtgcctaacttctcaaaagagtagcactcacctgcacattctaattcctcagttcttaacttcaacttgtctacctggcgttagctttgactttccctctgacttttctctccaaaagtgaaagtgaaaattgctcagtcatgtctgactctttgtgaccccatggactggggcctgccaggctcctctgtccatggaattctccaggcaagaatactggagtgggta

SEQ ID NO: 55711 - DNA, 1523 bp, Bovine  19866881512062
tcattgcttaagcccaacctcatgaactcctccctctgcctctcattaatacatttgtcactcaagttaccagattttcactattttgcattctaattagttccttgtatgtgcatcttcccaaagcttccctctactccccaaccccctaacatacacattagcacacagggaaacaaactcctattaatttagggccatttgtggctccagctaaaagtttaaacttagtgccttatgatcaagtaaaacttgttttttcagacctaagcacccctgcagagaaggcaatggcaccccactcctgtactcttgcctggaaaatcccatggacggaggagcctggtgggctgcagtctatggggtcactaagagtcggacataactgagtgacttcactttcactttcactttcactttcatgcattggagaaggaaatggcaacccactccagagttcttgcctggagaatcccagggacgggggagcctggtgggctgccgtctatggggtcgcacagagtcggtcacgactgaagcgacttagcagcagcagcagcagcaagcgcccactgcagtgctgttctcaatgaaacttcaggccacagagaagcttttcactttctacttttcttcttattgctatgtaagtgactagttcttcattcccctgctcttcaaattcacccctaattactctaaattcctacttaactttttatagtgtttttaaatgtttactttataattccctggaaatcatggctttctcttaaacttttcaattaaaatctgtaagaagcgtttaatgatgacctccccccaaaaaatggtttgagaagccctacaataatatcaatagatataagatgagcaactacaaattctacatttgagcctgtgagatctcccaagttcataagatgtatctcatccaagaaatataaattttccaaataaattcatggtctagtggtaaaatgtcttggatgttaaaaagtgcacattttgttcatttttcattagggtgaaatggtctgccaaactaataaaattgggctggactttgctcaaaagatattttcacattccaataagggaacagactgaagctaatgaaaattttgcccaaccaaggactctctagtttcatatccagaccctacaccttctgctctcagctttgctccagtaaatccttgggaaggtgaacacaaactgaaccttgtcatttgcctggatgctttttctcctctgtaagcattttcaaattcaaaataagctcaatttacaggaagttggaaatcattctgtttgctccacacattcaagggatgtgcatacaaatatttactggacatgaaaatgtaatgtcctaacacaaaccatctgacttcaggaatttggatacatacagcaataattaaccacagatgaaaattttacactctcagagttccacattttgaacttggtcatgccctgcaggggtaggtgctcactaggggactgtcgggttttgg

SEQ ID NO: 55712 - DNA, 771 bp, Bovine  19866881523770
tggtttgctaaatgaatttccttctacatggaggcccattaaatcctatgacctcgaattaaaagcaatgaagacaaagccaacatgataaattggagattataaaatatgactgtttctgggccttgactccttcacttaaaaggactgcaaagattgcatcagtcccctactcatgtgagatggctcagatctcctacagcactctcctcccaagatacatggaagaaataatgaatctgattatcttttcaggttcctatcatgccacatatttacacgggcttatctggtcgaaggaaagcgtgtggtacatatcttcactccaatagctatgagaagtccctatatgctaatacaataaaggaaacatttaaaaagcttgacacttgttaatctgagaatagtgctctgcatggaattcaaacttattatacatgaattcatgtacaaggctcctttatgggctaccatttgcaggcatgccatggtctcacatgcaacaaggatttaaatttgaatcttcaaattctgcctataaataaataggaaaagctatatctggggtgtttctataagtatcattttatcttcccaattatatcattctcttttatgtactccaaagaaaattaaggttacattcttgtgtgattttccagctaaagtggttgtgattaaaggcagacaactaatctaatatgagctctacacatgggagattcccaccttcaggcatttgtcaatccttaagctacacaggaaaataga

SEQ ID NO: 55713 - DNA, 756 bp, Bovine  19866881540796
tggaaatctatgaggtcactgagctcagaccccattcagggcagcacagggctgcaattatgccatccaagacagacaggcacttgtctgttttctaaggcatccaggggaaacaatttgcaaacactctgattaccgtaatctagatctcagaactttgctgactagaaagttaccttgtgcaactgaagcccgttctccttgtgctcccaggagattatgggaaatagctggtcattacacagataacgaaaataatttctgaaatggtgccacaactagttcaagtgtgaaaaaataatcaattgttttatcaagtcagtaatctcccacaattatttgacaaaatttttttccctgattttcttatttaagactgtgtttatactatactgagcattggctcagtccatacaactaattcaaaacataaatttttcttagctttatgtaaacatgtagaatttattgttattattattccatagaccaaataactgaatcatgacaattcattgtaagatattcctgttgctaattctaaatcatttaagttttcctaattatcatagtaataaagtgatctaactttttaaaactaagtctttgatcacaataacaacaatggaacaatatatggctacttggtctggctagttttgcagtagtctttgatccttttctcaagatatcttacctaagctttcccacattcaagtaatgcaacctcctcagttacatcttaagaggaaagga

SEQ ID NO: 55714 - DNA, 793 bp, Bovine  19866881553776
tgggacttttgttctttccgattgttttgtgaagaatatgctgccaaaacccgtttttttgttttgttttgtttgttttttaatttaactgcttcttttgaaaggcctttatttttcttccatggaagtttattatcctctcatttcttctcttatttgttttttgaattatgtaccccaacgtctagataactgggaccattagttttcgtatttcccagatgatagttttatagttcattctgcaggtttattcagagcactccagtgaaatttaatccccagatcacctttgtttgattctaagaaactggatgtgtttcttcatagttcacctgtcccgtgttctgaaatcaccttttgttcatgtgtagttgctcagctgtgatcaactgatgctttgttgggcattgtgcatttttctgttttgtttaaaaatggaaaaaatacaacatgtattaagaacaattatgacacaataaaacatgaagcatggagggatagtaaaagagtttcatcctgacactgaatatttaaataattttcaactttaagtcattcgctttttttaaaaattgaattgcagttgatttacaatgttgtattcctttcaggtgtacagccaagtgattcagttatatatagattctttttcagatgcttttccattatagtttattacaaactattgaatatagttccctattctatacagtaggtccttgatgtttatctattttatagatagtctgtatctgttaatcttaaattcctgatttatccctcttcccat

SEQ ID NO: 55715 - DNA, 985 bp, Bovine  19866881795293
caaaactaggattttgcctttcctcttctttgtcctcattagtcatgcccagtgttctaagtaactgctctcagcatggcccaaatcaggggtgagatctcctgagttccagtcctagttcctctttttttcagggaaatccaagcttagatgccaggttggctctggaaagggtactgaaggcctggcagggagtggtggtgagagatgaggaccacctaatggcatttttcttgtgtaatttgagacactcccttggttttctaggcccaagtgtggctgaaccatatcagcctttgctctttcctgtgctaattagtgttgctttctatcagagaagccggcggagctgactttgcagttccttccgtagtatatcatcactcttgccagttttctccagatgatttttcttcagctcagtaattagttatgtttgtagaaaatggtttgggatgttgagatcagagagatggcctttgtccatggtctggaaagtctgctttcctgctagttcaaagatgaggaggaaagaaatgttgagcagctttgaccttggtttcatagattcagattcattgtggctgcatcagttattttcctaagtaataaagccacgcaggcatcctctttatatcttcttcttttaaaagcttctaggtttgcttataaaataataaatcctataaatatacaaatcatgctatacttgggatgtaagtggatatgctagcttacttcactgcagcctatttatcatgctgctaactcctggagtagtttaaaaatattccagtagtcctagctagattgtgctatcaatgtctcactgattaaaaatattgcatttaaaatccatacatttctcatattgtaattatttggttatgtcctatgctaccagtgtggtttcccagatggtgctagtggtaaagaacctgcctgctaatgcaggagatgtgagagacacgggttcaatctctgt

SEQ ID NO: 55716 - DNA, 694 bp, Bovine  19866881895242
gagtccctcttctgggccgttccctgcactctcactctcactgcatacttttggatggtataaaggggaaaaaatggcatgagaagcctttatttaaaaaataataataataaaggatcaaatataactgactactctcctcctccaacatgaaattactgtgccctgaaaatgtgcttattccacaagacctagaaacaacataaatctgctctgacctggcagtcaggtcttagaagacaagcaaataacaaaactctttttcactgggcacctgtagcaatgatgcatgaaggtagtacttttgtttcttgaggcaatcttagaaacatggttttaaaatatcatttttctcccgacagcattaatcctaaaacataaattctgatttcagctctcttctctctgacactaatcctgggcccagcatggaccattccttaaatttataacatatgaagcaacagaaaccaaccttaatcctctgctccaagtttctaaagaaatgtaacatcttgattgattgaaatactttctcattttggagagtggtgttcacctctgcgtgattcctgttgagagaaagctcttgtgaaatttcttttctcccattagtaacccttttcctacatacctaggtgtgtttcctacccctagataaatttatgttcaaatgtaaaatgcttctgcagca

SEQ ID NO: 55717 - DNA, 1089 bp, Bovine  19866880736608
tagcctgcaaatttacctaatcatagatgagtcttcaaccaattcaaaggtaatttatactaagttaccactgatagcgccttcaatttaagaaattatttatgatttagggaattacataatttgggttttttgcatgagaaataataagcttaccatgtattgtatgtgtagaaatgaatctgggatagatgaaaacaatgattttaatggcagccttttcagtaggtttttttttttttttttagtagaattttaaatgtgatattttagttcaaataatgatatatttttctgttttgtaatataactttgttcatagagaaaaactcaatacacttttgtatgtacttcagggcataatgttatcaatattctttaagcacagtgtaatctactcagccagtaatacatagtcataatactcagcatgtctgatatatataatgctgttcagtatatattattttataaatatcatgtatataaccttgtttataaaggcttatcaaagtaactaagtaacaaagtaagagtaactaatagatatatatcctcatccagccttgtagtgagtaggccaaatcatacttgtgtcttaattagatagataaagggacagaatgttctctaatttaaagactgtactctccatggtggggagaaagatcttgcaccaggcaattaggcatatttccattgctgcaatggctcaaaaaattgatctcaggcactagtaaaatgaaagttcttcaacataaacattggttatgggtgatgcagagaataaaagctacataatgtccatatttatcttccaaaaagttctgtagtttttctacaatacagagaaattattttttttttaagtcttttgttttcacactttactatgagtatgaagtctaattataatattgtctctttttctatttgatgggggtcagttttcatattatgactttcacacctgtactagctaagattaaacaatcatgtcatctgagaccacccatcaactaaactgtgaaaattaatttcaatttcacctaaactcaaccccatgctgcttttctattactcccatac

SEQ ID NO: 55718 - DNA, 2033 bp, Bovine  19866880755317
atgtgtttcttattatcaccatgtcttagttagctcaggctactataataaaataccaaagactgggtggttcaaacaaccagtcatttatttctcagttatagaggtcaggcagcataagatcaatgtgtttgatggtttgatttcttgtggaaccctcttggcttggactgctgccttctcagtatgtccttctagggtggagacagatagacagagacagagagacctggtctctcaacctcttcttataagggtaagaatcccatcatggagatttcactgtcatgtaaacctaattaactcctcccaactccaaatgccatcacactgaattgaggagggggactcaaacattcagtcataacaaaatggatattcaatgtgtcagagcataaatagaatctttcaaattttcagttcaatctctttttataatcaaaaccacatagagaatctagtagataaataacagatcacctcttcctttactacaactctcttgcaaaaaaaaaagaatgtttattgtcattaaatatttactaactaaatggaggcatataagaatgaaattgtgaattcatgaatgaataaaaagatagatgatgccatttaggcttgaagttaaatagaaatgattcaactaaaatttatttttaatcatgaattatgaaggcaggagaagaaggggacgacagaggatgagatagttggatggcatcaccaatgtgatggacatgagtttgagtaggctccgggagttggtgatggacagggaagcctggcctgctgcagtccatggggttgcaaagagttggacatgactgagcaactgaactgaggctgataaatgctacttataggaattgttttatttattcatattttaaacaacatattttattatattacacacatataccacatctctgcaaatattatcttctcatatttgtgcaggttttttttcctattgggtgaattagcttccttcaacctcaatactaaaacctaacttgttcacatcgtcctgcacatcaacttgtcaagttttaaaatgttatcctattctccgaggtgccaacaaactcattcaaattaatgttgtcagttatttaatgaataagctttctactctagcatcctcaaaagctgaatacacttgtcatagcaaacttggacctgaacaataaaataataacctttgttccatacaaaacaagtgtgaaggtgacatctataattcgtatagcctgattattatttccagtagataaaacagatatatgttgagccaagctcagtctcactaagacctcattttctgaatttttgtgacctgtgtgtctctggtccactcaggaactgagtatttgagattctcccatatttacttagctaagtggatgtatctatatgatatttaaggcacttaacaaacatatataatcagcacttagtttaccaaaatggattcaagttaatggtctaaaagaataaaagtgttagaaaagagttcttggatgttatagtatattatacaaaagtacaaaaatatatttcatgtaaaaatattacatataattgccattgtataaatgtacagtcatcataccctagaaatagttcagaattatactataggttgaaagattaaaaatattggtacaagttataaaatagaggcctgaccataccttaatatgcttactattcttaaactagagaggaattaaaaaaaaaaaaaaaaaaaacttaggagaagaaatattgatgcttcaaaacttatcaaaagaaaaaaatattctgtaacaagcttccttcagaattcttaataaaaaagaaaattatgccattgaagaagatattttttatgaaagaaaaattttaagtaatgaaaggaagaattttttatctctgtaatttagaagattttttgaaagcaaccataccaggacagatatgcatatgaataaagcaaattattaagataaatgatccttcatctgtgagaagattaagctaaatgatct

SEQ ID NO: 55719 - DNA, 798 bp, Bovine  19866880789290
ttgaaatgcaatctgaaaaattaaatagatcaacaacctctcaatcacacatatacatatcacacactagggattttgaactactcttatgtcaaaaataacatatatttttaagactccatgaaccacttaaactttgatagaaactcattaacaatgtaaattcaaacatgctctttttagccaaaggttaaaccttggaggaaaatgtcaacaaagaatcctgttgataaataataatatttgtaatgcacagtgaatgaagtatcatcaagcaaagcaaggcatctctttcaaaagtcattttgaaatatgttagcaggtgaaatattttcatttcaactgcagacttaacattacattcactttgtacaacagcatccaaagctcatttgatctggctgatgattcagaggcaggagctaagcctgggctctgtttattattctctgcaaattttatattactttgtgatactctggaaacaaaacaattattattcatctcccacagggaaagccaagttgtatataatgctgtagccagtcagctctgtttctacagtagtgttatataaggagaagagttttcttgcaattttgtcaaggaaagaaaaacaatcagaatgcatttcaagttcaaaatccttcaaatctgtcccaccagcatctattacatcttgatatcatattttaatgcagtaggaattcagagaaaattagcctgtcctgctaaaaaaagaaaaatactacagaaagattctttggtttaactttaccttttcagaaatagataaga

SEQ ID NO: 55720 - DNA, 1275 bp, Bovine  19866880813306
ccctgttgtaaaaaagatttgtatcataaaaaggtttgaacaaatgcataaagccatgaatccaacctactattataggatcatacagaatagtttcaccacaaaagttatttttactcaatgaacaatattcttaaagaaaactttacttaatatttatcagggcccttgaaaattatcaccatctgattgaatttttgttattctttatttgatgatagtgattgaaaaacaatgctacactattattaatgtaattagtattaaatttattatcatcattattaaggtaaattctatctgagctaattagaacactaggattttgcagtgaatttttggacaatgataacaggaaatatactgattttcaatgtttcaataaagtgttataaatcaaaatctttacaacaccaaggaaaagcttgtatataacttgttctggaaatattccctcacataatgtttgaaatcactgcacaatcagtttgtagcttggggatattctgaacacaatgtttgtttgaataatacttttattagttttgagtaagtctttgtgctgaccatgagttcatgagacttgtgaacagcattatgctttgcaagcaactgaagcaaaaaatgcttatttattgtatcagtatagtaagtaataaaataactgatttgtaaaatagtttggagaaaaagcaataaaatgttatctctaaatcttaggctactaaataagcacaattagttctataactcaaaattcagagtgttatagtcttgggacttaatgtttgaaaagcaaacaaacaaaaatccatctcctttttaaaaatttgtcactcagagaagcctccattgcaatatcaatatttctacataagtcacaatgcccgctttcattttgttgcaccctaaacttttaccttaaaatgtatctaaaggcctatgtctcaaataaatgatatagtaatttattattatttattgaaatagaaataaaacgtacatagtaaaattaaatataaatataataatgtattattacacattaaattcaaatttataatgaatgattttaaatgttggtgcctttgtagttaaccaatgtttattatttttatacttatacattacttagtatgtattagtatattagtatgagaaatatttttttaatttaatttaatttaattttttaactttacaatattggatttggttttgccatatatcaaaatgaatccactacaggtatacatgtgttcccatcctgaatat

SEQ ID NO: 55721 - DNA, 867 bp, Bovine  19866880833867
tttttttgtgagctatctctgtttccagttttcatttatttgtaaagtttaacaattttcttcctccatagctcatccaatctatgagctaaaagccaaaagcctaactaaccttttttcctttggtatcattttctaaacaaatgcagttcttgttcaatggagaattctggatcagctattaagaaaatattttttcacccccactggctgaaaaggtcagtttttactttcaaaaagatttgaaaatatcttaagaacaatttcagtaactattagaatatttagaaaaattgaaattaaaaattaaaaccatgcttaaatgttcccaaagacattcattaagaatattaaaattactagcagccttgatggattttcatatgcattttttggggacttcaaagagtataatttcaatttagaaaatttattgctactcaaatgagtttttatgaatatcctctcaaagtcttacaccaaaacaacagtgatcccactccaagtttataaaaattatctttcgaattttgatgtcaattagtacttatactttaaaatctgacacagaattgaatggacagcttaacattaacattggaacaacattgtacctctttttgattttggtgtgatagcactgtataacacaattcttttattttaaaactgtagttcttttataagaatgatgctctgttaatcataagtgtggcagctcattgcttggattgcagcatgaaatgtaatttattaaagtctgtttcaggcagatctgagacagggagttcagtatttattaatgctttctccattttaggcttagggaaagccgaattaaatacagtaaaacttggacactctttt

SEQ ID NO: 55722 - DNA, 1151 bp, Bovine  19866881200047
ttgaattctacacctgatactttttctaaacattgacgttaagacatattattgttattcacataaaaataagcatttggatatatatattgttgaatatcattttggggggtgaaaagtaagggtagcttgtaaatttgaaatatcttggcataaatattctatttggaaaaagaaaacaaaaattattttgagaataaatcatgatttaattttctaccaggatgtatcagctgaaaagcactgaatattttagagaattatcaggctggctattgacatttgagggagacaaaaaaattcagctggagataagacctatatagtgtatgacctatttaagtatccataacaccaagagacaagctcaaagagacaacaaaggcatggaggagtcagggaagccagactaacagtgggagtgaaaataaatctttctttaaacccagtgagagaaaagaatcctcatggaaaaaggatattgcttatgaaatgaatgtggccataactacaaaacactcgagagaagaaaatcacaggttaacaagtaagggtcacacatttccagatttcagatattagctgtgactacagacatatttccaattactgcaaaaaggtattacattgtgcagaagtttttataaacagaccccaggaaatattttccaaaggcactgccatgttatctgttgaaaggagactacagcctagatatgataaaagggtcattctgtcttttgtgtggggccaaggcttgagggcaagacaagaaggggtcagatttaaggatagcaaaaatttcaaattggggtcacaatgactaaaagccagacacacgccttaggcaacaaagaactataagctagatccactgaaaatctcggtcattttcaagatgaaaatggtgggaggctagagagagaggaaagagatcacttaacttgtgaaatgtagtcaaatactctaagaaattcaacatacatcgccaagactgactagaaaaagtttgtggaaatatgaacatgataatgactgagcaaaataaatgaacacgaacacaacagtctgggaaattttcatttgttttttggtataccaaatagtgtgtccctcatcagctggctaacctgatttatgtctacagcttc

SEQ ID NO: 55723 - DNA, 2872 bp, Bovine  19866881268255
attttttgatgatggcctttgacagtggaagatgatatctcattgaagttttaatttgcacttcactaataattggtgatgctaagcatcttttcatgtacctcttggctatctgtatttctttcttgaagaaatgtctgcttaggttttcctcccatttttggattgggttgtttattttttttgttattgagctgtttgtatattttagagcagaatcccttgtcgattgcctcatttgaaaatattttctttcattctgaaggttgtcttttcatcttgtttatggtttactttgctgtacaaaaagttttaagtttcattagttccatttgtttatttttgtttttattttcattactctaggaggtgagtcaaaaaatatcttactgtgattcatgtcaaagaatgttcttcctatgttttctactaagagttttatagtggccagttgtacatttatttaatcctttttgagtttctctgggtgtgtatgtgtggtgttagtgagtattctaatttcattcttttgaatgtagcttaataaaacaaacaaatggctactttatgtgctttgaagatgactcaggagtggctcacatgcagagcagatgtctatcactaggacacaggtctatatactgatttcttatttgcttgcagtcctcaagtatttaaggaaataaatatcttagaattaaatttttacatcacacagagatgcatgcagtttttattatcccatatttcaacattgtcagctattttgctaaaataataataaagaatacattgttgaaataagtagacattttaaaaaatcacttctacagtgttagtgttcacttgcacaaccgaatgcatttttttccattttgtccagctttgcgcatgttatgattttctaggtcaaaaatctttttacaatgtaattttcaaaacatgcaaaccacctttttgtgcctggaagctggatgctgatcttctagctttgtgtctttttcattcctcaccctaatcacaatcaaactcttcacttggttccatgattggcttgagaacgatttggattgaaatcagatgagcaacacagatggcatctaatattgcatcttagattttggctttactctgcaagctgcttactcagtggtagaggagaaggggaaggctgctgacaaatgacactattatgaccatcatagccaagctagactggcaccgttagagtgctcaacaatctgttttatatctctatctttctaagcccatcttcttaaacaaaggtgttctttcctcatgtaacataatacctgggactggggacactttttcctcttgaaatggcttattaagcataatgatttttaaggatgtttatattgaaagagagggtgtatcctttggagattaactctatgttgtagtaatatattaacttctactaacttaagtctcattttctcatttaaatctataatatacatttatttgacatattttgaagacaaaaactttgttataaactcatgaaagctaagggtgggcatataatatcaataattgactattgattttaaatgaatatgcattatgacttaagtgaaagtgttagtcactcagttgtgtccactcttgtgaccccaagaactgtagccttccaggttcctctgtccttggaattctccaggcaagaaactggagtgggttgccatttccttctccaggggatcttccagaccaaggattgaactcaggtctcccacattgcaggcagattctttaccatttgagccaccagggaattcctatgatttaacatggatattattttgagaaaaggatacgtatttcaaaagggtatttcttttacgtaaattataattagagtctcttttctgattatgagatttatgtataagccatgaagaatatgtttttaaatcaaagatagagaaaagaaaatgcaagtcaatcatatttcaatcaaatgagtgttaatttaatgatatagttccttttgtattttatgcctatttctcaatatgtatgacatacaatgtacactgtttaggaatattatctccaattttatttgtaagataagttagaaaatgagaaaatttcattgtgaaaatgtagcaatttatgcataattaataacagttgcaaccagagttatgagggtatgcatataaaagagtagcatgtcaacagttgtgtttatcatttactaagacatttttcacattcatatcatctgatttttttttttttttgacgtttatttttagctctgctgggtctttgttgctgctcaggcttttctctagcggtggtgcaggcttctcattatggtggcttctcttgctgcacagcacgggctccagggcacgtgggcttcagtagttgtggcatgcaggctcagaagttgtgactccccggctctagagcacaggctcagtcattgtggtgcacaggcttagttgctctgtggcatgtgggatctttccagatcagggatggaacccacgtttcctgcattggcaggtggattctttaccactgagccaccagggaaacccttcatctcatctggttttgatagtaactttctaagataagcatcttatttttcacttttaatttgagaagactcttcaaaaaagataaaggaatttatccaacttgatgtagcctggaaataatgaagtcagaacatgatgctggtttttccaaatttaaatactatattctatctctaccctttggtgtagaagaaatgaataaactttgtgaattttgaagaatacatcagcaaaatgaactaaccggtaatattttagggagtgcattaaagaaaaaaatgtgt

SEQ ID NO: 55724 - DNA, 1182 bp, Bovine  19866881334792
ttatgaacataagcaaaagtaacttatgaacacaatatatgccaggtatataggtacatatgtgtgtggtttatgtgtgtgttcatgtgtgtgcttacatatgtgtaaacataggagttcttgaggtcttttgaagctaaagccgctgttgctgaataaagaataaatgggggaattaacgttctcaataatttttaaccatttattcctagggaaaatgtcctaatacaaagtctctcattttactaatgatacagctcatataaaagaaactttgaggaatattctaaaccttacacattttcaggattgaattctcagactttttttaaatggaaaatacatatgtaaattttttaacattacattcagttctaatcactttctctccctactgtggcttccttgaatcagaaatgctttcagattaaattaattttacatgtttccataaataacagtaataatcatcattcaccattcaagcataccaaagtatatttcaatattcatatcaattcaccaaattgaaagaaatatcaatttaactcaaaatcataaggagaaatgtggcagttttcaaaagaagttactcaaaatatttagattatttaggacaaaaaggccttcatcagttagaattatttgcataattaatttctatttccatttcaccttaattccatttctcctaatatagatgtgccttgagtgaatatagactaggcaactttctgttaattgtattaatatctttcatttaaaaataatatattgtgatttttttcctatgattaaaatgtaaatttattaaatcttaccttttaaacttttacacatatttatgaaaagtaaattactctgaagataattttggagagtattttctttactttggggataagacagtgtatatttgaaaaaaatcaattgctgccataaaaaataagttctttctgaactgccttatagatctattacaaactttaatgagcaagtaactgcgtttattaactacatttctggccagctccatctgctttcattttccaaacagcctggtgaagcaaacagagataagcaggtaataaaatatttgactgaatcactacctctagggtaccaccaaaataaaaaggcactgtggtgatatttgggcttacacttgagattaaaatctag

SEQ ID NO: 55725 - DNA, 798 bp, Bovine  19866881402849
ttacatttgcctgacctgaatgaatctccctgtgtaatttccctaatatttttattcctccatctgtgcaaaaaatgactcgatattaccaactaaccatctgaatgtttatggaaaggcagcatagcgcctgcttatgtgaaaccacacatatccttcccctttacaaattgaattcgctgaaagaagaggctgtaaaaatatttttaaatgttgtttctcttattaaataaagatacgtaagatggctaatgtaatgtaatcaagctgcataatataagggttaaccacaatatttcagtttcattctttgtgggagaaaaagagttttaaaaattaatgtacaaaataaggagatggttttaaagcaaaactatgctaaattggcagctttgcctcacaatattttgttggaagataagaaggcaatttctgccaattttgcaaaaagacctccatttctctgccttagttactatcccctgggcattttatatcttttcaagtagactaaggagatgctattcctctagggaatgaagaaagaagtaatcttaccatttgctattcaccattccaagctctggttttctgagattttcaaaagcagagctatgatgttgggaaccacatctttcactcctggaaaccattcccatagacttagtccaggctttcatcattttgcagttttcaatgttttctatctttcctcacaacttcctgtttcttttgaaatatttgaatatacttgacaactgaaatcgcatattttactaattttcaaacatagcttgg

SEQ ID NO: 55726 - DNA, 1217 bp, Bovine  19866881461230
tctgagactcccgttggaaacagactttgctagagtaaaagcagatgcacagatcagaaacactgccaaagtggaaataccagtaagaatacaaaatatttttctatgagtttgacaatgcctaaacaattttgggttgttttcagcactttagatcctaggaattagtttgattaggaaagcatatataatgctaaaaagaattataataattttcagctacctattagtctcaagttaggtacagcacaattgggtttccctggtggctcagacagtaaagaatctgcctgcagtgcaagagatctgggtttgatccctggatctggaagatcccctggagaagggaatggctaatcacaccagtattcttgcctggagaaacccaaggacagaggagcctagcaggctatcgtccatagggtcgcaaagagttggacacgacagagtgactaatactttcagtttcactttcatagcataataggcataccacaaaaccaactgacactgagataaggaaaagtctcactatctgcatgagtcaagtttatgggatgggaacaattaccccatcaaattattgtccctatccccaacaccacagttacatcttgttcaataatgctggccaaattttaggttggaaaaaaaaaaaaattgctgtcatactgtgtaatttctcaggttctgtccagtcagcttgattaaatgttgactcccttgatatctttcattcttcaggttcatcaccttcttctcacctacttaagtcatttgttatgcaggcttggagcccaatgtttaactgtgctcctgctgataccttacattttctcaccctcctgtctttgcctctcttttagtcctgtggccaaggtggctaataaggctcaactattttctctcctacatttacatgttgtcttgaagggatttatgtgttcacccagattgatgctgtctctacctgtttctacctgtctacccttgatgttttgtttttatttatgtttcaactgtgaaattattttatttttttagtgagctctttttcacccaaaactgttttcaacttctttgatccagtctgttaacgtctttcctttcatactcagcagaagatttcacgtcctgagtggaataagtgccctcagtaatcttttcctcaaattatagccccactgtccttttttcctaatattttgtcgtgatga

SEQ ID NO: 55727 - DNA, 1231 bp, Bovine  19866881503790
tataatcctgtaactttgcaattgttgcttttctttcagttatacaaacagtcttactttattattttttaatgtaagaaataagatgtgcatttcaaatttgtgagagcctgacaattttttttttttttttctatcagctctttggcaagggaacaaaaaaaagatatagagttagagtaaggtacagagacatgtttcctttaagtgaggctgttcaaattttaagcaaagcaatcacactaagctagcaatagcacccattgtttgctcgttatgactacacaattcagtctgttaaattgtaaactagcaatagaaggtctacatggatacgctgataggctaagatgcagaatgtaaatatctaacatatgtttaaatcctctggtagatgaagaattatttagaaacataaggaaacattaataaacacacacatatacaggaaataccccattttcaactgccaattcagtctaatatgagtaggaatatcattctaataccacaaagttaaattgcattgcacttccctttctcagcaactggttaattcaatcatagcacatagatttttcatcagtttttaatttgcttaatttttatgagctggtggtttagaaaatttcccatttttcaaccctaagactgtacggataaagccatgcgctattctttctgtgtcattttcattttaatatagattttatagttcattacctgtcaatcagttttaaatggcacagtattcattttatcatgttcagtaaaactgttttatgcttctttcaatgtcttacattcattttagactgagccctatttatttctctaacagccatagccatctgtagctgtgcacatttgaacttgtatttattttagcaaatgcaatattttgctttatgtagtatattcatttaggatatttattcaagcaagtaaattctgaggaagcagagctgtgtaaatgctttatctgtggcaagccattttatgtcctgtgtttttatttgtctcaaactttgagggatacaatttcaaacacaacttaaagtactgacacagtatactttgtcacctgactatttctaatctaacaaaccatacttacagaattaacattcaaaaccattgagcaaacaaacataagttttgagcctcagagttttcacataaattaacacaaatatttaacaaaggaaaataggatatttttttaaattac

SEQ ID NO: 55728 - DNA, 1555 bp, Bovine  19866881559591
tcataaataatgatgcttgtataaacgagacagtgctacaatgattttataaatcaataacctgagaattacccagctgtgcattttgctatcatgcagtgtttatattccataatgaaacttttaaaaaattattcattaaattgatcacttagttttaaaaagtatttattaagtgaaacacaccaggttagggtctttgttttatgacttaaagaaacaaagtaattatcctcatggaacttatattttaatgacatttaaaatgttgaagtatttagattttcagaaataactaactgttgcaaatcttaatggtatcagtgttaaaatggtgaaagttgaatgatgcactctttgaaatttaagtttcaaaaaaacctttccagctgtttttgagacttgaccaacagagtgagaaaatctattttattcgtttttcaaaagttgcccttttctaatgtcaagctactacacaatggatgaactttggatgtgtcagtcttggagtgttatgcaatttgttctgagtatgaattagtcaggctgagtctttgggtgaattagaaataacgaaaatgagctgagctgaacacttcccaaaagggcaaaaatacttgtatgtttgcttagctcagtgtgtgcatttcagtagagagctcctggttttactctactgttgtcttatctgccaacatatctttaaaatattataatcagtacataatggacagaagacttggaataaagaaatgacatactttattgggttgacttactaccccaaaatgaataactctgcttctgtaaaagacaaaagacataaggatgttttttctatagttgttgtggtttaactttatctcagtttaaaattaaatagtccatttactcaatcagcattttatctgaacatatgaagccatttgtatgattgtgttttaactatattcacacattttctagttgaagtgtagttaatgtctttaatattgtaaaagtacacaattatgtcctaaaaagtcccttgacagtgaaaggtctaggacaaatgtagtaatactcacatactaaagcacagtgtgatcctaggatgctgggaagtagagagagttattgaggcaccaagaggagggaaaagaaaacaatggagtaaaagggagaaatagtagaagcaggtgagtagaaggacctggcttgaaaaatgttaacccatgtttttcttccactcattctgccttccctagaccctgacagcttctacctgaacactgaaatatacccttgtttttaggacagtcttaatgaagacagttcacagctaattttttttttttttttctgctctgattctgagaattaccctcccccattttcatgtgattcctgtgacgatatcagagtatgagatctgcactttccaccctgtgtattggctgcgtcatcactcggggcacagaggtcggttcatcggtgactgagtgcattccccaggcagtcagccaggaatattcattggaaggactgatgctgaagctgaaactccagtactttg

SEQ ID NO: 55729 - DNA, 1031 bp, Bovine  19866881716320
aaaatactttaggtaaattttccttgggaattgctctctgtgcctatagcacatatatttaaatatccataatcgtgaaaatatctgccccttgagagctgatttaattttgaaaacatctcggaatcatctggaggcaagtgttaggaataaattttgatgatcaggctgaacattagagtctgggtcaggaataaatctaaagtaatgaaaactaatttgttttcacagcttacaacctatttttatggtaatttctccctctccccaaaaaaacaaaataattttggaaatggcagcatttttagtaagtatatagattaccaaagataaacctcattggatagggaagcttgagtgtaatatttaaaatcaatcttattactacagaatgaattaacatcctctgatgtgcctggcacgtagcagaaaaaaaaaatactagcagaattaaggaaatgacacagacatcaataatacttgtaggaaaaacaatttaagaaacccatagggcttttaaatgtactttctaaaataatatatatcacatatacttcatttataaaactgaaacatataaaacttatacttacttttacttttattcattgtacctattttttgacagtatatgtactttttctacttagaatgtataataagaaaaacaaaggtaatttaaccaactattatagaccatgtgaatacctgctgtttcatagatatatattgctatttaacttaaactctctggcaacataagaaaaatcaccttaaaattatttaatcacagcttgaatatcaaaatattttcaagaattcatggcacctcccctcctgttcaatttaacctctctcattcaaaacagccattttgaactacttacctttccccgtcctttgaatgtgaaaatacctctccactgcacaacttctatttattatatctttcaagccttaaacccagttattacttcctctgtgaaattatgcaaaaccaatcaaataaactcagtatccccttctctaaa

SEQ ID NO: 55730 - DNA, 1026 bp, Bovine  19866881734991
tttgagggttttttcctctctgcttttccggaatagatcatggtttcttagaggaattctgaaacgtattatcttacaaaaaacacatcaatttgctgccccgtttaattttttcttatagccttaggctaacttactgtgaatggagtaaacttgattatttagtattgaggattggtaataacagttataattatagggcataaagtcttattcatctatcatttatttcagaaatcacatttttctagaaatgcaataatttcacagaacattaaaatggaaacaaattataaaattgatttaacacagataattttctaaataacatgttgctttcattgaaattggaactgcttcaaggttttaaaacattggtcaatgcttatttttgtgtttgtttcttagaactctttatcttttatgttgaaaatacaagaaccaatatgctaagttgagatgtttcatatttaaattttggtttaatatgatcaagtcattttgttcaagaaaaactcagtaggatttttatgtttgccatatattgatagatatattaattttgtaagaaatctgtagattttactaaaaaaatcagatccacatgatcaaatatttctaggaagtactggaaaaataaagtcatagtttttcaatgtagttcttaattgtcaaatttatcagaaatggtattaaaccaatgtatataccaacctttcaaaagtaggttatagaatggtaacaatttttatttccctaaagtactcaactgtgtaatgttacataagacttgcttcttctagaaaaagcttttggaaagttatatgctgtatttgacaggtaatctaaataatagagtaatttgaaaatgttgtattgttatttaatatgccaatgatctgaaacttgttttgttctttaataccatctgctttgtattattctcctctggatatatatttctaatttcatttaaagtagatttcaccatctcccatacttaagttttctgtaaatttttgtgtt

SEQ ID NO: 55731 - DNA, 885 bp, Bovine  19866880386462
cgaacatgaaatacatgaggtaaagtaaaagggcaaagtaatgagatcaatcacgccaagaggataatgaaaggcagacctacagagtctactcagggaaaaaaggcatggaagcagatatttatagcacgctggaagagatgttgatagaattttgcacaaagtgctatgggaaaacagaaggaagcaacattaattgtgctagagatgggaggggaatgaagataagaagagaaagctttatttaaatctctgttgccatcaaaacagcagatttttcagttattcccagcacaaaacacttagtctgaccttttaaatgtatggcacgagaccctgaccttcagctatttaattcagtgttgtaaagtgatcctgcaacaacggatttctctgtttccctgaaggagcccatttgtcatatatgtggaaatgccatgtatgtagaaatggatggtatatgtttcttttctttaaaaaaaatattttagatatttatctagctatttggctgccgtaggtcttagttgcagaatgtaaactcagttttggtatgtgggatttagtcctcttatcagggatggaatcctagcctcctgcattgggagtaaggagtcttggccagtggaccaccaaggaattccttgtctgtgtatgtttcaaatttgtgaatttcttagcaggtgggtagacaggcaactgggagactggaagatgtggaaagtgctccccgtcttttgtgctggggaaagagagcaggttgtgaaataataagcacagctgatcctgaagatgagatccctcttcttggcagttctacccaggataaaggtttgggaggagaggcagaatgataatattggaattctcatccaaatcaggttg

SEQ ID NO: 55732 - DNA, 849 bp, Bovine  19866880414440
aaaaaattttaactttattttaccaaaaaaagtatattatagatgagagaagttaacccagttttttaatattgtgatgctaaagcatagcagatgtgaggttaagtctcaggtctgtttattctggctccccttcactaaggacaaatgcgagtcatttttcataaacacaaagaaaaggaataaaattgcaaaagcctaaaattaagccagtatgatgacttatctatggtgagagatttaaagatggagattctatcactagagataaattcacaattttctatattcttgctgaatatgtaacatttcaatggttgacacagcataaaacaaactaatgaaaccctgaagcttccatgaatccattgcaagttgtctgttagtgtcataggattaaaggctgctgggaggaaaatcaacagttgaaaaccctaaaaaacaagtgatagatgatgtttctcatttctttcttcaacttaagtatatgaattgtaaaaaaaaaacttttaaatttatattaatttggttgccttatcttcttacagtgttcaaaagacagaagcaaagacaggcatcacagttgatacatcacttttcatattttgtcttttctttgcctgagtggcaaggttagagtccattgcaaaaagaaatataaattgatgttccttgtgtttggaaaatattggaatgtcattgaatatttgaaccttaatgtgcagtcttttctgaggttttcttcaaaaatcatagctcagtattaagctttgggttctgctatagaatatgttatgatatttttaaagcaagaccattaaatcattctaaaagcaaatatgtagcaga

SEQ ID NO: 55733 - DNA, 2007 bp, Bovine  19866880448513
caaaaccctttcattgctttttttagtcttaagtaagaattgttagtaggatggtggaaggcatcattaagatgatccatttcgccctgcagtcaccatatggggtttatcatccaagtgtgatttgagaacaatgagggtggagaaataagttactcttttcacctaaccttcaaagaacctgggacttcctgtagctcaaatggtaacgaatctgcctgcaatgcaggacaccagggttcaatccctgggtcggaaagatcctctggagaagagaatggcaattcatgctagtattcttgcctggagaatcctaaggacagagaatcctggcgggctacagtccatggggtcacaaagagtctgacacgactgagcaactaacacacacacacacacacaaagaacctaatgacatatttctctcctttactactttaatctgccttgtatgtctctaatatatagtgatttgagtaatgcttaaatatgtggaaaaataggtaatgatatgaaaatataggaaaagtgacaatgatattgcctcctatttctgttttcactgtgcctgcttgggccagtgatttattataagtaaggtgaaggcaaaatattactcagtgaggtgaattgaagcaagttcttcaaattactttaatctctttccacgtgaagaaaatatacattttagacatgtgatgaaagaaaattttttttttatcatcttcctttcccaatgcttagtgggtaaagaatccacctgcaatgcaggagacacaggagactcaggttcaatccctagttgggaagatcccctgaagaagaaatggcaacccactccagtcttcttgcctgaaaagtcccatggacagaggagcctgacaggctacagtccatggggtcacaaagagttggacataactgaagtgactaaacacaagcacaaaccacttctaaagattaaaaacataagaaaactttttacctgtatcttttttcagcattatatatattttggaaatatatattagtatgggcttcgcaggcagctcagtggtaaaggacacttctgccaatgcaagagatgtgagttcaatcccagggtcatgaagatcccctggaggaggaaatagcaacccactccagtattcttgcctggaaaatctcatggacagagaagtctggcaggctaccatccctggggttgcaaagagtcagacacatcttagtaactgagcacacacacttggttagtgtccatgtggttatttacattttggagaagaataaggagaaagattcggaagtgatgacgaataattaaaatatcatttattattttaaaaaatatgtatttatttggctgtaacaaattgtagttgcagcactcaggatcttcaatcttcattgcatgggggattctggagttgaggcatgtggaatccagtgtcctgaccagaaattgagcccccagtccctgcgtttggagaatggagtcttagccactggcccaccagggaagtggtttctgagtcatgaacttttgttgtgggggctgtcatgtctattgtagcactcctagtagcattcctgtcctctccccaccatgtgtcagtagccacctcctccaccagttgtgacatcacaaacataagcagacactacaaaatgttctctgacgggtaaaatcaccttgagttgagaatcacttgtttggagtttgtcagtgttttgaatattcctctattctttattctgtattatttctctcatcctaacttcacagggacactaaaaataggtgatgtattttagaaatgagaagatggaatgttagtgaagtaaattgctgaaggcagcacgactactgtttggtacaattaagattgccagccacgtcttttatcttccatattatagtaatttttccacccttgaccagtggttttgaaacgttgtgcaccagaatcaactggagggcatttataacattatataacatttcat

SEQ ID NO: 55734 - DNA, 2105 bp, Bovine  19866880477524
aaaaaaaaaaggcgggggtggggggagaaacgaggttgatgaagaaaaatccaactgcaattatccgtcaattttagtcaacataggcacaaatccaactgtcctctgctggcttctctcccccaatcaatgcctcattctgccgcggtcaacttttcttctccgaaatttctttgcagatgtattattaattccctctcctcttgtgggaaattcaaaaagaaaacaccaccatatcaagtctttactttcctaaaaaagccccaaacttttcattccaaaaatatctccttggcttactttctcctttatagaaaaaaaaaaaaaaaaaaaaagcacatacttttgtttgtgaatccacggttctccatttccaatcatccttttggggaggggggatcgctgtttttatggttaattatttatgtcagaatacatcaacccccgcgggtctgacactggtttatttcatttttcaatgctccctgtgtgcacatatacacatgtgtgttaagatccaggtctcacaagaaaaagcttcattcttccttctctcttgcacaatcagtttatccactgcgttcggttccaagagatagctgcgtcccgcatccttcatttttgcaacacacccaaccgccaccgccaccaaaaaaaaaaaaagtctcgttttacatcgccgattcctctccccaacccccacctcgaagaagaatttggggctcaactccccccactcgccacccttccggccggccccttctccaaagatctgattagatttctcatcacaacccagtgcgcaattggatttttgatttcagccacccggccagccaccttcccctctccctccaaactctctgttatatcctgtctccttccctccaccgcctctgcaatttcataatctcacgttaaatggagtgcggggggcgggggcgggggtaggggcggaggtagtggaggaaaatttcaaggctccgtcagctgtcaagaagaaacccattccttcccccagctacttcgttttcttcttctttttttaaaagctcagggtggcttgcgcttcctctgtccccgcccccacccccggcacccggtccagattctccaggtgtagcagaactccacggtcagggctgggatcacgggggagacgcgtgacgctgtccctcgccggtggcccctgccagccaccgggtccccttctcatccatcagcgggctgcgaatccaggggcgccgcgacgaaagaagttcagattgggcttttatttcaaataaggagggcgaagcgaggggctccacgggggtgtgaggcaagtgaaaaaaataataaggaaagaggatagaaaatggaacgaaggcggttaaaaaaaaaaaaaatccttagtcgctggctcctctcatccttctcgaatgaaactgcagctctgatctcatttccagctgcgtcgggtacattttggagccacaagttggtccctcttctcgcagaccttcccgacgccggctagtcctccgccaagagatgcgttaccgggagcgcagctgctccgcgcggtccttagcgccatcgccccggctcgcggctcccagcgcggcataaaccccagtccccttccatccacttcggctggaactctctgccacccccgcccgatcctctctcccctcttttccctccgatattaaatgcgctcccagggcgggcggcagctcctttctctaagccaatgccacgtcccgaaggtttgcgtccccgctccccaaatctcctttcggactgcggtccccttccctctgcccctctttctttccctttttcctttccctttctctgcttgtgatcagtaaaatacaattacccaattacctcccatcatcttagcactgattggtcaattgcattaacacttgaagtcggggacgaggggattggagcctctgcggtgtggcaccgctgccacctggagggcagagccggaacagccgtgtttcagagccacccccgcgcttggaggttagtaatcagcagagaaactcaggggtggtggtgtgggagaagttatcttttttttttgttttttttttcctctcaaa

SEQ ID NO: 55735 - DNA, 777 bp, Bovine  19866880762492
aactgtagatattatctgtaaactatgccaattccattcaagggattggctcctaaatttcaattatcttttgatatttatactaaatttaaaagccaagggatttaaattatacatacttactaagatacaataacagtatgcatctgttgatggttcatatttatcacctatcacctatcaaactgtatgatgttaattccagagataaaattataaactctactttaggataagtatacaggaagagagtggtataattgcttggagaaggttattaataaaccaatgctcaaacgataagagcaactttgttattacaaagttctatgccaaaatgcatctgcttatatatttgccaatttaattttgtccaacagttcactgggttcgattgctgagttgtttcattttactggaaactttagaacattgccaacatcacaaaaataactaactaaagacatgaagcttgatattaaccccttatagaatatacggtttgtacatatttctcccatatgttgcctttttgctttgctacttgttttctttactctgcagaaatcttttagtttgttgtggtacacttatttttgcttttgttgcctgtgtatttgctatcaaatccaaaaagagaaaaaaaaaaaaaaaaaactcattgcaaaggccaacatcaacagtaaaataatgtagctttcagaacttcatgatggattccagagtcagatctaaactgcttgattcctatcatttactaggcagtagtaaattatg

SEQ ID NO: 55736 - DNA, 999 bp, Bovine  19866880848247
attgtcagatattcacaatgcagacaaaaatgccaattttgacatggtgagaacaattaatttcattgtcattgtgatttttcaaatatttattctatttaaagtacctgagtgggttgtatgaggtatagacatagctccattttactttttatatctggctttgcaggccaatacatactatcagtaatattttaaatcagtctcagtaggaacataccttgcatacactctcatacatatagtataaagttcagttcagttcaacaaaatttattgaatagtaattgaggaattcaacatagcttatcagaactttatgagaccaggattctaatctcaatataaccaactagcttcaatacctagaaaaatatgttatttaactttgtgaaaaacttttgtcttttagaatacaataagatttaattagattattctaattaattactgaattagattattaaggttgtttctggttataaacactgcatattctatgtatccatgtactcacaaatgtaccagaaactgagaaggaatcaaactagtataaaatgtttcctacctttgagaaaattataatttgattgagtaataaatggtgtacctatttaactcagaattaattatcagaatgtttattatgttctaggcttggtacagtttgaaatgattagaataggcttacatttttagagagatattgccagtcaggatttttgaaacagccttgtaaagaagttgagatttaagatgaaatttgtagaatgaatggtgttaacctaagaatattgtgaaaatatacatcaggaaaatggtaagtttacagagaaaaattttaaaaaaattttacccatattatatgtattatatatactatatataatatgggttatatatatatatatatatatatataaagtttacaatagatacagagatggcaatggcaacccactccagtactcttgcctggaaaatcccatggacggaggg

SEQ ID NO: 55737 - DNA, 786 bp, Bovine  19866880924361
aacttctaattatctcatcacttagggctgccagatgaaatataagacaccacacatgtatacctgtggcggattcatgttgatgtatggcaaaaccaatacaatattgtaaagtaattaacctccaattaaaataaataaatttatatttaaaaaaagacacctagttaaacttgaatttcagaaaaaaatatcactttggttttttcttaatacaagtatattccaaatattgtctgaaatccaattttaatagagtatcatccagttttctttgctaactatggctgtcccccaaatctgctctacccacagaaccgaattggtgattactccatccttccacttgattaggccaaaaatcttggcatgatctctgattgcttcttttctgaccctacatccaatctagcaggaatgacagaatatattcaaagtctgattacttttgaccatcaatttactaccattctggtccaagtttgaagttaccatcatttctcactgaattattgcaatagtttcctaccagcctccctgattttatatcacctctctcccacttccaaataattctcaacatagcagccaaagcaacatttaaaatgtaagggttgatcatgtttcttttttttacaaaactctgtaatagctccccatttcatatagttcttataatggtccataagtctctacacgatctgacagctaccgagtaatgtgcataatctttcttaccttctactactcactggtttacttcatatgcttccgctatattcttgg

SEQ ID NO: 55738 - DNA, 1021 bp, Bovine  19866881029606
agtctgttttaattactcaagttaaaagaattgagatgcataaagggtgatgaaggagaggaattagaggaacttttaaatattaaagtatagatttatgccaaatattagagaaagtatggaatatttaatggagaaacacactagtaaaaatggacatgattttgaaattacagtttggtgatatgtattagatgcttattctattctttcaagtgataaaaagaagtaagataaattttttaaaagcctgttaatacgattttgttagtaaaccttacatttgccttttgacagataattttaaggatctcctcacaaacacattctagttacctcaagatcacttatgatttgttgaagaggtaaaaataaaaaagaaatataaggttccctagaggtcatcctatttgaattacaacatatctcagtgttctgtattatccaagtattaataagatccaagttttttttaattatactgatacatgaaccatgaatagaatcaacccaaatatattaggcgaaaagtaacctgagctttaatatactgtaaattgaaaatacacttcaaatttgaaagccatctaaaacttgctaggatttaatgggtttgccatttaaatgaatcccatgtaccataagattcagatatcctgtgatttataacacagatttaaatgatcaggatgatttatcatcccctccccaaactctggaaatatttcaaatagatataattttaaaagaggtttttatcttctaatctcagtgtgacagagagtgttcataatgttttgatgatgaggtggagaaaaatcttaacttcaaaaaatgaattcaggaaatagtgtaattaagcaaaaacatatggggtgatataatattactggcagtcatcctagacatcaatttttgaagttaactaaaagtgaagaaagggaaaggagttctgctgtaacaagggaaaaaaaaaaatttttaagaatttagacacatgaaatttacagctctgagtaat

SEQ ID NO: 55739 - DNA, 1005 bp, Bovine  19866881104902
tttagaattttcttttatgtggtacttaccaccaataaccataactgctattatgctattataatcaatatctattcacaggatatattgactgtagaaacaatttactgtccagttcctacataacattgtattgaatttcagaatatacacatattcatgcatatatagagtgaaatatatgtataattactttcaatttcacatcctaacagaggactgggatcagccacagttcaatctgtacacttgatacctggacaccagatgtctttagaatggaaatattttactcagtgatttctttaagagagagtttatgttaccttactctcaccttcaatatgaataagaagagattgagaacatcaaaggcggtgataactccttttgaaatgcagcacactttgttttaaaccctctgacaggcagccaatccttattaaaatcaagccttcaagatactgtgaagctgtccttctctctaggctgttttatcaaatttggttcaaaatagttctgaaacttttcatggatatagatgtaccctgtatgtggtacagtggtttgggtatggataagatgcacccggctttctgggaaataggccaagcactggcttaaggggaccactgtaaggacttttcttgcttggctccttgacaaataggatgcctgcttgatcaagacatggtgcaatattgttgctgccctttaacaaaatgaccatagaagacacaagacaaaagagacaggtagtggacgtgattagagggataatggagcctgcagatgaggtgagatggcaaatgagaacctcttagccagaaaggctaagggtaagttgggaattaaattaaatcctatttcatgaaaatgaccacagtaaaggccaccatatcctttccttctgagtacttggtgcttagaactataagttaaagtgccttatctttgattttggacagcctgggcttctggaaacctggctctgctgatcaccag

SEQ ID NO: 55740 - DNA, 2492 bp, Bovine  19866881187822
tttaatatagatagacattgatataaacatcaacatatagatgcagatacagatgtagatatttgccttagcttagaaaaaagaaagtgaagttgctcagtcatgtccaactctctgcaaccccatgttctgtagcccaccaggctcctccatccatgggattttccaggcaagagtactggaatgggttgccatttccttctccagggtatctttccaaccctgggattgaacccagtactcctacattgcgggcagatgctttaccacctaagccaccagagaagggtccttgtgttgtaatattgaagtatgtcatgtatcatatgtatttcattgaaagaagttttttatctatgaataaatttttgtacataaatcttgagaaacttcttacttaaaaaaatttatgtatttgcctttgctgggtcttagctgtagtatgcaagttctttggtctctgttgctgcatatgaaatctttggctgtggcatgcaaacccttagttgtagcatgtgggatctagttccctgaccagtgatcaaatccaggccccgtgttttgggggtgcagagtcttagccactggaccaccagggatgtcccaagagacttctaactcttccctcatcctttgtcatgagctcagagcaacagagatgattatctgtttattttaaccctaatagccaaatggacattaaaaaaagtctagaaaatacacactgtaatttacagatttctgtttgatatataaaagaaaataagtaaatatgggcattggagtaataatcagaactagattcaattcataaccctactataattagctaggaaattttgggcaagtatccaaacttctctgagtctttatctctccatgtatgaaattaagagctttgtgcagaattgcctccaagtcctctcccatctttcaaatcctgtgataattttccttctgaggatgtgttgtgatgtaggtagaatggtcagaaagaatttatggttgcaaacccctcatgtttagataaagactgaatttttcaaaaatttattccaggtactcaattactggcttctatctctgctggacaattagtttcttgtaagtgagtgatacaaagttgactgtaatcaattattttcaggtttttctattgagtaaatcaacagtgtatctcatggagcttaacaaaattgaacttttaattcacaggattcataatcctctggggccggtgatttagctgtctgtcttcctgctattctaacattgagagaaagaaatcctgaattctctagaaactgggaaaactaaaggctacttgtaagacagcttacagaatttgacattatatcacatgttccctccatccctgtcagatatcttccaaaggaaaaaaatattttggggagaaatattcatatttaattgatgtttcatgtatcattgtcctgcaaaaacaataattactaaaattgagaattgagcaataactgaaattactatttataaggataacttgaaaactaaatcatgaacattttttgttgttattaatgtatattaatttaaactctttattttatagattaagccttacaagtaccctatgtatcctgaaatttttgatttatgattctcactttataggtgaaaaaactgaggcatgagtcaatcgcacaaaaagagatgataagtggcagacttagcacgcctgtgtgaacccagtgcctatagtccttactatgctatatactctagctctgcaaccttgttgcctacccctgctgctgctgctgctaagtcgcttcagtcgtgtcggactctgtgcgaccccatggacagcagcccactaggctcccccgtccctgggattctccaggcaagaacactggattgggttgagatatttaatttgagtaggttctctcggtctgttattatctgaatgcactggtaatattcatctcttgacatatggaggtcttgtctgatttctctctaggactatggtttttatatttcatttctgtgttcatgggaacaaaatgctgctttctccatcttagcctaagttttctgcctggcatttagcaggtttcaaagaaatgtgttgtgagcagaatgtttactttgtctgcatgtgcctacagagaactgatctaggtggggctgcctgcagggccagaggcatcagatgtgaagaaactctggagtgggtgtttgtgaagggaagaaccaggcagaagctttgttgatcagaacaaaatgaatcatatcattacacaaattcacagaacgtggggctggaagaggcctcgctaatcaattagttcagatttcacagtgtgtaggtgaaggagataagatacaaggtgtttaggaactaggaactgggcttctggatttcttccagccccccaacttctccattgtgacaccaaatccttaattacacgttcatatgcatctcttcagaaagaaatcca

SEQ ID NO: 55741 - DNA, 2041 bp, Bovine  19866881292141
atgagggagtgcaaacccaatagcctaaggatgaaaatagtccatgtaagaatactaagccaagagaattacagagaaaatagagcaagaattcccatgacattgttaacatctggatcaaatcataactgaactccatgcactgcagaccttttcaattgcatgtcagtaaattctctgtttttgcttaatctagttagatcttttagttttttccaatgtgaaacatcacagctgatacaagacaacagtttcacacgaaaactctaacatggttgaatttaaacttttgatctagaatgaatgcaacaaaaatctatttcaattatcctatctattcttctttcaaactgtagagttataccaaatgtatcaggaatttaccattccaaattcacaaattcatcttccaatattatttttcctttttttcattaagcaatctgcccttaactatttttaattttgttctgccttgaggcacatacctagtgattatttcataatattgttgtatgaaaacacctcttacatttttacaaataatagcttgagtgttttctacatgcaagcattctgctaaaagcttcacatgcattatttcaattataattcaccacaactttgtactatattaattctcatgctgcacatgagaatgtgaggttcaaagccgtgagtaaattgaccaaagccacagatctaagcggggacaggtctccagtcaaactggctcctgtgtctatgctgtcaaactttccatcttacagaatcattggccagtctaaataagaaacatgcacagtacctggaatacagcatttagcatttggcagctactaccaatggggctattgaatatgaatattcactggaaggactgatgcttaagctgaagttccgatactttggccacctgattagaagagccgagccttataaaagcccctgatgatgggaaagattgaaggcaaaaggacaagggggaaacagaggatgatgatggttagatagcaccaccgactcagtagacatgaatctgagcaaactccaggagatggtgaaggacagaggagcctgatatgctgtagtccatccaatcacaaagagtcagacatgacttagtgactgaacaacaagaacaaatgcggctatgctttgggagataaaatttgattctaaaatttctagtatatgaatctccccccaaagcaaaaagttcctctttatttaacaatacaaagtctctgatgactcagggcttccctggtggcacaagtggtagagaatctgcctgctgtgcaggagaaacaggttccatctctgggttgataagatgggaagatcctctggagaaggaaatggcaacccactccaatattcttgcctgggaaattccatggacagaggagcctggtaggctacagtccatggggtcgcaaagagtcagacacagcttagcaattaaacaacaacaacaatgctaatgactcatttagccctgaaatacccatcatctctttcaggtgagtatctgggcatttgtgccgggaagtctagagacaactttgatgccagttgtagggaaaagaaaggggacctctgggtgtcagaacccactggctgctccaacctatctgtgatgctcaaaacccttcatgtgtcctttctacaaacacctagacgtgttgtgcttcatcccggcccacactgaaaggcccggagccaccttacaatgaacagtagacagagaagaatgagactgaaagctttaatacagacagagcctctgtcccttcttggctgcagccagcagcagcagggttgggcctgaagtgatgggcgcggtgccggcaaagcactttggcacatgccgggatatgaaaggctctaatgagacccatttcacaattcactggccacgtgcattcagcaggcaaagatttcttctgaacgtccccacaatatatcctccggcccaggtctgcaacgggtcccccatcacccacgaaaccagatctctcactgtcccctcacgtct

SEQ ID NO: 55742 - DNA, 1614 bp, Bovine  19866881297014
atgctagattgattcaagcttcctaagtgtctttctccccttacccaactataaattccaggaggataagcttcccttgtctttttcattgaataaatttggtatgtaacattgtgcaagtttaagatattctacatgttacttgaatacttttacatattgtgatgtactgtgactggcagtgtagtgatatgtatcatcctgcatacaggtattgtacagtctcgtctatattcattgtgccatatattagatatctgtagcttatttactactcattacgaacagcatcaattttatccctcttttacaccccccagtaagaaacattttactctctgatttttacgggtttaacttttttagattccacatataagtgatatcatatagtacttgtctttctctggcttatctcacttagcataatgtgctgaaggttcatccatgttgttgcaaatggaagattaattctttaaattttatatctccattgcatagcataaagaacctgcacacagcaagtgctcagtagatatttagtaaatgaaacactaattgttagccatggtatccaagcaataagctcctagaagtctgagttttctatttcaaacttatgctctagcacaggaagcaatctacatagtgcgaaggattagatttaattatttttttaaattacatttcctaatacattttttatactttggcatcagtacacagccatttctcattctctctgtctctctcacacagaataagctcttatctgaccacaaacatatgtatttgcttgaagaacacggtacaaatggggcattgacctgaaatgttatatttacgaagcagtctgccatcctatgtctggtctgcattcactgataggtatgtgggatgtggcccacgaaaccacgtggcttattttggctatcacttactctatgagtacctttggaaattggctgtattaacagaagccgccaacatctcacattagaggttccagagggttcattgtgtgttgattgctttctctgtcgattcattttggtttgccagtaatgaaatcagtatgaaactatcacaaatataaaaagcaagacaaacagcccatcgcttctgactgaggaacagtcacgtgggcgttctttaccactgtagacccatgcacacgcatgttttctggcaggaaggagaaacataatgagaagacgtaaaatgttcttcactatgtgaacattgtgtgtgtaaattcataatctgataattcataaggcactacagccaaagcccttgtgtatatgtgggttttttttttgttgttgttattgttgttggatttgctatctgcttctttgtatataatacataagaaatattacttttcttctgaaataagtatgtatacatctgtgtttttcagacaaagagaagatggactgaagaaagcatggaaaaatgggtagggtggttgagagtgaatggaagtcaggtaactggacagtggatactggagtttcagagaaccatttgagcagagaacagcgtgtagacatagagctcagtggtctccatccacatcctggtaaatgtcaggatccccaaggcaaa

SEQ ID NO: 55743 - DNA, 1116 bp, Bovine  19866881335868
taatattagtaaattacctgcaatttacttgaacacataaccaacgatttgaaataagttgataattaatattttaagttgtactttgataaataccctcccaatgttttgatcttttctgacaattcctaatgctcttcagctgttgtaagtatagaatatatgatgcaattacactgagtttatgtttcttgagttaataaattggtctcaattgctaatggattctttatactgattgaatttgcatgttgaattggtttaaattgcctgaccatatttcaaggttaaatacaaatgtatgtggagctattaattttgtgttgctgttgttggtttgaatgatttaggtacttgaagctagagcaggaattaaattaatttgtgccttcaccttagcccagcctttctctttgtataatgtatctgtgacatttgtcttcattccgagagaaaatgaggaaaactcatcagaacaaatgaccagttctcattaaactgatgattttgagggggatttcctttgattccatgtaatgatacattaccttcccaaagaatgaatttagcaatgagaaatctaaatctgaatgtataccaacccaaatcaatcaaatcatcctaacaatttcaagggcaaaaagaagaacaatatcatattctgcagctgctgacaaagaaatcaacatgtctggtgcttgggtctcatgtgtgaggaacaaatatttccagcagatgctctgctttctcaaatccacatgagctggacatttacaactttgttctagaggctagaagaagtggaatagtttttacctttcagattataaaatgtaatcctatgcaaatgtcctttgagactagcccataagattctctcatagtctctccagagaagtgaaatttcagttgcaaaaacaaccttaatccttaaagcttctatgaaaacttaggcagaagacaggacaaataagcctttgcaaacaagccccaagggaatatatgtagcccacatctatcaaccacagtgtatcccctgtaacacacaaatttgtcttaggaagaagcagaccatattggattttcttcatctctctggggatagaacttcagaat

SEQ ID NO: 55744 - DNA, 1131 bp, Bovine  19866881461842
tcaataaagtaaaaatagtattccccacttacagccatagtgaccgttatatgaaagaacacttgtaaagttcctaacaaagtaggtgacctggaagaaagtattcaaataatatgagtctcttatcacactgtactatgatcagctgcttatgttgtctgcttctcccaggagactaagtgctctttaagggcagggccacaggcatgaagatccagacctgtgcacacagcagatgccctgaagatgtcagttacatgaccattgaatgaacacagtacaccagcagcagagagaagacagaactctgaggtctcaccagataaaaccagaatataaagcctcagaatttgaagttcaagatgttataatgaaagataggaaagtctactttgatctttttggcttaacaatgttgataacacctgtcttgtgtgtgtgtctgtgtgtgtgtgtatttgcataaacataatagatagctgatagataggtagatagaaagataatagatatatcacagtctctcagtcaactgttatttggcacactttcaacaagaatgatgccttgaaaatgaactgtaactaattaagtagataattacacagaaaccattttcaattacctaatatcttaaaaaaaaaaaactattggagcagtaattaaagtaagaatgaattttatttctaaaatttgattgctaaaatctgactttgtatttatgatccaaataatataattatcaaatcagccaaggtattagttcttaaagattaaaaagctaaaaatcatgcattatgatacaaacctagtcacctatgcacatacatataggaaaattgaaagacatattttttattaaaaatatgacattgaataacctaatatgatggtttgctcggcaatttccactgttaacttagagtggaaatgaatcttttaaaaatcccctcataccccaacctttcaacctggagaccctaaagtcagagggagcatatgttggatagggattatccttgcagcatatccagaagtctagtctatgcaacatgcaccaagtcagcagaattaagggaatacataaagaacacatttactggggattatttcctttcagaataggcgagc

SEQ ID NO: 55745 - DNA, 2463 bp, Bovine  19866880392481
ctttttacaaattatgaaagcaaaacgtaaggtgctattcaaatcttaaaaggatccctgactgtagggatgaaccagatttggaaacaaacaacacaatgtgtttccacatcagcaaaatacaaacagttaagggaagtaagttatattttgcatcagaaacaaaattaagtaacattagacactagcatataaagctttttttgtcagaattgagtgggcaagaaatattgtagagttttaaatagttctctttttaccgtgaaattatggaagaaaaagaccatcactaaccttagaggtggagaaggcaatggcaccccactccagcactcttgcctggaaaatcccatggatggaggagcctggtgggccgcagtccatggggtcactaagagttggacatgactgagcgacttcactttcacttttcactttcatgcattggagaaggaaatggcaacccactccagtgttcttgcctggagaatcccagggacagggaagcctggtgggctgccgtctatggggttgcacagagtcggacatgactgaagcaacttagcagcagcagcagcaaccttagaggattgacagggatgttttcagatgctgacagtctcctcctttgtgctgtttaaataccacttatctctgttctcaataggcttaaatgcttcgtttctgatgcctatgactcatacttgtaaataataaatgtatgagacgcatattttgtgcatcatcatacactttcattttgaattaaacacttttttttttaacaaataaatctttatcctgagaacaatcatacaccaaaaccctagggaaagtcaatataacgtcaatatttttatgagcactgtccttaagaaatacaacattaaggaaaacagttactcttatcttctttctcctacttcccatatgtaggggaagaccttaccaagggatggcctcccattgggtcctaggaactccagcctgactcaaggggacaagtaggcagggactggagatggctgcaaatatggagaccttgaaggatttgccagtgagcggcaatccacatgtgagacgcctagagaaagaggagatggtagtcagcgaggaaaaaaggaaaatacagacatgggggaaaacaaggggaatggacacagatagagaactaaaatggtatgaaagccagcagacaggtaaacttcacctatctcaaaagaaaatcaggctgttgaaaagatccctgggctgtggagaagataaacgaaatagtttatttctaagagtactgaactgttaagtctgagctgagagatataatgtacggagaaaattacaaaaataagcctcttaggtagcctgttgctttgtgtttacaatgtacacactctactggactgcaagcaattaacttatctataggtataaacttgacctggggtttctcccacttttcatctgtggagtgtggtttaatcactcggacatctatgtttgcagatttggagaagtggatgttatcatcgaagcctggatgtgactgagtatttcttgtatagtttagcttcctagattcatttcagccatcctggaactccctgagtttcagattagtattgagcctccctgaaaagggaaataaatattgggtagaaagaagggaaaaagattcagaggggtggggatggagaatgggccatggaaagggatcaggtttgctaatacacttcagaaaggatgaatcttttctctaacaagaccctctgaacactgacccccaaaattccctgggtctgtgctatctcacacttttgtatatatacaatgggccttccccagtggctcagtggtaaagattctgcctgcaatgcaggagatgcaggtttgatccttggatcagggagatcccctgtagaaggaaatggctacccactccagtattcttgcctgggaaatcccatggacagaggagcctagtgggctacagtgatggagttgcaaagagtatgacatgactgagcatgtacgcatatacagaatataatcgctccctgcctgacaatggcttatctatgtgtctgtctccccatctagacagtgcatttcttaaaggcagagatggagtcttattcatgtttgtattcctagctcctagcaccaggcttggtgcatgactgctactcaatatctatttgttaaataaaggaatcattttccccttcgaaacattattatttatgaaactttttaaagcctacaaaataaggtggaatgcattgttttgtgctcaaaatcccttcagtctatatggaagtcaatggaaatttatgtgatctgattatttataatgtcaccaaacctccagaattggacacagactggagagtaaacccagttaaaagagacagagggacatacaagtactttgcacagtactttacacaattgtgtatttttaat

SEQ ID NO: 55746 - DNA, 2553 bp, Bovine  19866880584276
ctcctttgtgatatgtttaatatagttgctgtgtatgtgtgtttgcatgtgcacacacgcacacatacatgtataatcatctctggattgttagaggaactcaaaatgaaagtgctatgtgctaagttgcttcagttgtgtctgactctctgcaacgctatggacggtagcccaccaggcctcctctgtccatggcattcttaaggcaagaatacttggagtgggttgccatgccctcttctaggggatcttgccaacccagggatggaaccggtgtctcctgcattggcagccagattctttaccactagcaccacctggtctgggtaaaaatcaaccattctcataccttgtcactaataggaacaaattttcctccagtggaatgactctagaaggaggtaatttggataactacagattactcataggtgattgaaaaggttagtgaaggaaataaggaaataaaagagtagagggcttcccaagaggaccggtggtaaagaatccgcctgcaatgccagagacatgggtttaatccctggatcaggaagatcccctggagaaggaaatagcaacccacttcagtattcttgcctggcaaataccatgggcagaggagcctggcaggctgcagtccataggtcacggaagagttggtggtggcttagggactaaacaacaggtttttgcaatgggaaaaatgaaggtaggtgagccagacaatgtcctggggccagcctgggtacttgtgacactgagctgagacagttcgaggacccagagtcagaggacaggcaggagaaggaggcggaaaagagaaggattcctcagccacaaaatcagaaaggcaccaaacatctgaggtagtttctgtatttgaggctagattctgggtcaggggctggcagggagtgcttagcatgcatactatctgccaaacaaatttacaagcatctcttaaaactgtgggggaggaagaggaagatttttttaattttctactaagaaagtcaggggaaatgaaaatagttcacaacttgttattacgaattgaaagatgcaaacactgcctttgcttttggctttttttttttttttaacagcgctgccttattttatttctgtgatcacagaaatgtttgtaaatacttctctaatggccaaatttatcagcctttcgtgccttggagtgtgaagaagtgaaaaacagagcctgggctggcaggactcactgctttccaccgagggcttagagggatagcgagaggaaccctgaatcgcagacattgtcaggctccctgcaggatgcagtggcaccacaggtttgtcattgaatctggtcatctaactagtaaatggtgcagcccgcatttgaatgtgagtctttctcctcagctgcttttcactatgccagaggttctcagtcttgtgaatgcgtcagaaatctccgaatggtcatgtcaaaacacagagggctggacctcacccccagaatttcacttaaccatgctagtgcttctctgaagtgtagtccctggactcctatcatcaacatcatctttgaacttgttacaaatgcaaattattaggcctcactccagaccttgtaactggtgtggggcccagccgtctgtgttctgacaggccttctcagtggttctgatatattctcaagctttagaacctctgtactctactaccttgtcttccacaaatccccacccgcaccttttttttctaattatccccaacagaaataactctactgaagcaaaagttcttcccagtaaattaagtgatttatgtatttatgttttgctttcagtaggagaggaggctagaaaaaaaattaataggattcttttttgattactgtcaatttgtactgaaatttaaccagatactactgggttggaggtggaactaatctcatttgcaaactactctgtgcaagggcttaacctgcattttctaaattgatcttcactaccccactatgaggttttatggccttaattgtacagaagagaaaaactgaggtttagatgaagtaattgacttaaaggccacattcttattaagggggagaaatcagggttgttcaaacaaagatccctctaattccaaaactcatgatctctctacttcgtggcaggagcttgtggaaccaaattccactgtgggcttcaccaccccaactatgcaacattgagtaagcgatttaatctctatttcaatttctccatctctaaataatgttatcataaatctgcccctcccacactggaatgttagaacaaatgaggaaataaaagcataagtgctctgaacttttttgaagaaaagcaataagaagacaagttattgtagtgctaatatgtttagccaagtgttgctatgtgagcctgagcactgactctttcctggttatctcccgattcgtacataagaagttcaaagattgtagctgatgccacagaaaaagcattgacttcatatatcagtatctacggaggttaaagaggataacaaaggcgtatacgtatctct

SEQ ID NO: 55747 - DNA, 2136 bp, Bovine  19866880645619
cctgcggcagagcacgaccgccgtgactccacggcctccatccagagctccgactttacagggcttcagcccagcaggcctgggcagcaggaggaccctgtggggtcaatcccgttctccttcgagaaaggcatgcctcctagggaccctcgttcccaggctgttccagccaaagctgagaaaaacagcctcaagtctgcctctgaggaggaccctcatgagaaggacaagtccccccaaaagtggaggctcccggactccagccacacctccctggcaggcctaagtctggatcccatgaaccctgagccacttcctttactggacccagaaacatcctcagagaccagtggaatcacgtttgccgcgggttctcgagtctctcctgatgtgctgtatttaatagaaaacctggacaccaaagaaacagatattgtagagttcaacaatgaacagacggaggagtctcccaagggaaggccagaacgttccaggacctggttctagcctagattcttacttccccaaaagttcaagcagtagttccagaacatacctgggggctggtcaattttttttgaaatgatcatattgtgtaagctacttaaaactttgaagggcattacaatactgacattacgggaagatcaaacacattcatgctatctaccacaaagtgactttcatggaagttacacagaccacagtgatgtaccttaaacaaataaggaatcatacaaattcatagactgttgtaaattataaattcatagattgttataaattataaattcatagattgttaagctgtgaaaaaggctttatagatcacagtccgatcccctagttttgccaaaagggagacgaatgattctctcttcccttcttttcccccctttcttcttttcttcagttataaagactgggagatggatcatataatgcttcaaaagccccttcctaatgctgatttccctgtgtaaggctttctaaccatctcactccgctttcataactatcttaatttcctaattcttaagtttcatcagcatcagaaagctccatctcccttcaattttcttttcaattttcaggactttattttcctctcatctgcctttatttcctcatccttttatcctctcttccccctagtctttctccctctccaattgactctattccctcccctgctttcaggttgtaaccttttctcagccgactctgttgcttacttcctgccatgattttcaaggaggttttggcaaagtttccaatggagcaattaataagtgtcagtaaatccagcctgacttcacccagcctcgcaggaaggggcgtgggaacttgctgtgtctccaccgtggccatctccttccataagcactcttaggtcctgaacactggaggagcaatgaggccatgaaagctgcataaccaaatgcttcagaagcaaatgacaaggtttgaaactgttccactcagactctttaagtaaaaatccccattatgtcacaacacgggaccagctactgtgtctggcaggttgtctgggatgaagtagggtattggagctgggaggttaagggagtccaggatcacaatgggaggggatgctgactaacttcctccaaggagttcttggtcttatctgctgggggctcccaactttgcccagaaggccatgtctaaagaatgctgctctatttctgtcatatgatgaagctcgactgcaagcttaagaaacaaaataatcctaattgctaccacttactgagtgttcacaacagcatgtaaagttcacagataatcctactaatcctcacaggaatcccatgaattgatatactattatctctatttttttttttttttttttttttttggaccttggctatggcagtcacatttattttttagttttttaacttatttatttttcaattaaatgataattgctttacaaaatttttttgttttctgtcaaacatcaacatgaatcagccataggttctattttttacctattttttacctattttaatctactttttaaaggagtctttcatttcttaatgttagttgttattggtattctcttattgaaataatataccttaaaccaatgcttatttg

SEQ ID NO: 55748 - DNA, 1373 bp, Bovine  19866880662313
acttctgaccaatgaaataattgaaactggaattaatcttgaacagctggaaaatggaaaaaaatatatgaaacaacttgttctcagactttgtacaacaggcattgtgggactgtgacccctgagaaaagatggccctaagatggccctcagagaaggcaatggcacccgactccagtactcttgcctggaaaatcccatggatggaggagcctggtgggctgcagtccatggggtcgctgagtcggacacgattgagcgacttcactttcaattttcacttcccacttccatgcattggagaaggaaatggcaacccactccagtgttcttgcccggagaatcccagagacaggagagcctggtgggctgccgtctatggggtcgcacagagtcggacacgactgaagcggcgcagcagcagcagcaagatggccctgactttctgccctgagacacatgcctggccatcgagtagggaacccatataaaccacaatgattgtcttgaattgaggaggcaaaggtcggagttcaggatacctaaagctgatggaagctgtagggcagagttgcagggaggaggaagctacctagaaagaaagttccagaaatctgtttaggctcattttgaatctttgctgaatacagtgaaactccatagtttggtaaagaggtttaggagctgtgagctgaacagtttctgagcttacacaaggaaaactgctcaagttctgactagccagagaagagtgttctcgatgatcactaggaacatttaatagtgactagagaaaggccatgctttaggagtcttactaaactagtcctggaagaaaggctactttatatctgccctaaaaaggcttaaaagcaagcccccaaaggatcaagtaccctttactacctgtcagaataaaacacaaatctttaaggaaaagcaacaaaatctagacactcaacagtgtaaaatgcacaatatccagtaagatattactaaacatgccaagaagcagaaatatgtgacctataaccaggagaaaaattgctcaaaagaaacagacccaggaatgatagagatgcatagaattcacagacaagaatgttaaagcagctattatgtttgactatttaaatgaaaacatggtcagtgaggagaggaatggaggacattcaacaaaagagaaatgaagtttcaacaaagtggtagaaagggatatcagaccgaaaaaagggaagggatgaggagggcaagatgaagatagtgggcaaacacggattatttaagaagtctgatttcttaagtatgtatgtatgacaaagactgaaagggcagcaagacctgtcaaaggcttgggttgttggcttatttat

SEQ ID NO: 55749 - DNA, 1944 bp, Bovine  19866880666426
ttgaaagtgataaaccttcaaggaccagatttggtagagaaggtcaggagctcatttttggactattgaatttgagttgcctttcagatattctggcaactggatgtgtgagcttggcattcagtagaatttaaagggagttttattagtcaccatttttgatgtaataaaaaactccaaaatctagtggattacagcaacaaacatttatttcttgctcttgtgacatatgggtaacaggttgattacttttctgctcgaggctgtgggccagctatgtgtttttttcaagtctattctaattttgggcctaaactgaataaacagccactgttcaggacacgccatgctgctgctgctgctaagttgcgtcagtcgtgtctgactctgtgcgaccccatagacggcagcccaccaggctcccccgtccctgggattctccagtcaagaacactggagtgggttgccatttccttctccaatgcatgaaagtgaaaagtgaaagtgaagtcgctcagtcgtgtctgactcttttcgaccctatggactgcagcccaccaggctcctccgtccatggattttccaggcaagagtactggagtggggtgccattgccttcaggccatgagagggggctaaacaatgaaattcaatttgaagcttctctttgcatgtggcatctatcacttgattccattccattccattacccaaagaaagtcgcatggcccagccctgcatggggcaaagatgtatattgtgcacggaagaggcatttcaagacaaaataaaagggtagagatgtacagttctcatagaaagaaaatagttgtaaaccataattcaatctaccgcaaaatgagtacattgaagagaagaaatccaaagactgagatttttcagtgttcagaggttggaaaaataaagaaaaaccaacaaaggagactgataaggagcaaacagtgagggagagagaaaaccagattggaagtcaagtaaagaaattgtctcaagaagttaggagggattaattatgtctcgtgttgctagtaggtaagcaaggtgaggactgatattgacgattagatttagccgtgtggcaatcttcgatcatcttgacaagagaattaatgacatggtggggcaaaaacctgaccgatgtggattcaagagagtgagaggagagaggttagagataagagataatggctacaagcagactactgcctatagccatctcaaggactttggctaaaaggagaaggaaggaaacagaggaataactgaagggaaaagtgaggtcaatggtagtttcttaaaaattgttttaagatgggagaaataaaaccatggtttcataatgataggaaggatccaggaggcccaggggttaggactgcacttccaccgctggggtataggttcaatcccacaagttgtgtggcacagtcaaaaaagtaaaaggagggacttcccttgtagtccagtggctaagaccccacattgtcaatgcagggggcccagattctatacctggtcagggaactagatccaacatgcttccgctaagagttcacatgctgcaactaaagatgccacacaccacaaatgcgtgctgcaggaaagatccaagatcctgagtgcttcaactggcatagccaaataggtaatttcttaaaaaaggaaagatccagtagagagggaaaaactaacaatgccagaaagaaagcagaggattactgtactgaggctctggctaaaggggatgggctctagagcactggtcttctttagaagtatagacagtccagtgagagtaataggtgagaaggcaaagcgtacgggcacaagtgcaggccaatgaggagatatgatgatgggaacataggaaagttctctttttattgcttctatttttcagctaagtaagacacatatcatcgg

SEQ ID NO: 55750 - DNA, 1841 bp, Bovine  19866880707664
atcagtcaggttttcactccctataaaagatttttcttatattcctagctgtctccacaacagagaacatgcgtattaagtcgcttcagtggtgtctgacactttgcgaccccatggaatataatatagcccaccaggctcctccatccatgggcttctccaggcaagaatactggggttgccatttccttttccagtggaccttccagatccagggatcaaagccgcatctcttaaatctcctgcattgtcaggcatgttctttaccaccagtgctactggggaagtcccacaacagagagcatacatgtttaaaaagaaaaaggccctcatccacgccatttggcaacatttaggaaagtcacacatccagcaattctcttctaggagtcttacccagaggttgcagtaataatatcacaaaatatatggctttattctgttccttgaagcttggggtccatgtcttgattgtcttttagttatggactttgtttgttggagaaaagaaacaatactaaagatgtattcagtagtcagcactaacattaatggtgtatgtgtggaagaaatgatgttttgaaacgttgctgctttgacatactgtcaggttaaatatttcatcaattaacattaaataattcatagttttatttattctttcagtgactgtttactgagcacttagggcatggcagtcattgtcttagatgctcgagagatagcagtaaataagagaagaaaaatctgctctggagcttaggtttctgtagatgtgagggggaaatagacaagcttaataaataagcaattattatattattttcaaacattcaattttaggaattccctggctatccagtggttaggattcggcactttcactgccatgggcctaagttccatacctgggcaggaaactaagatcccttaagctgcaaggcaaggccaaaaaaaaaaaaaaggcccaaaagccaaatgtgcaacttcaggattccttttccacctcttccttttctcgttttcctgtcgaaagtggcatccttaggaattgcacgattgatgggtgaaagggattgaggactgaagacattgttgatttttatactcagtataaaaacagttaaacagtattaactgtttaattctggggccctcccacctcatcctcaacactgttaattttttttagaagcttggttaagaactcttgacagttccctgtagtcactaatatttagataattgtccttaaaaattttatatttttgttataatatgttcttaattactacatctttatttcagaaatgacctttaagaagtagatgcccagatgcaaaagtgatgaaacagtcaatttgtcataaagatgcagctgtggcttttcaaccagattagtaagtgtataaatttaaaattcttttttagctttatatgtactttgtctactttgaaaaacatttaacaaaaaatgtagttgacttaaaaaagtgtcaacttgtatttttgtttttcttttggattgcagtacaaattctagcatatagctctagaaaatgtattgtcttagctgtaccttttttaagagctatataaaggtaatataaaattttagttttgaggaaatataagaaaaagagtaactgtaatactgctgtccacatacagccactcttagaatttttaggtatttgtttccctgatctttgttctgcacattaaaaaaaaaacaacaacaacttatgaccgtagtgttgtaaagaatatgctttttgtatatattttaaaattaaatttgttaagatgtttcttcctgggaataaaaatacccttcagta

SEQ ID NO: 55751 - DNA, 1756 bp, Bovine  19866880829746
aacccctgaggtcagagctccaagtgcccgacaagacagtcaagatcacctcctcattttccagatgagaaaatagagccaagagatgatgaaatcaggaaattttgagcatttaagaacaaagagagacacaaaaataggacttaaatataaaaagaggattacaatggataaaatgaaaagagagacaagaaatgtgaggagctgtcccttaagcccatgtctagactagataatgtctcctttctctttgtcatgttgtagaaggtgtcaggcttcagagtgggccaccgccattcttttgaggtaggcctgggctcctaaagaaggttatttacccacaggataaagaataagtctgtttgaatatttatttgttggagttcattgcttttcatgacactgcctcatccttagcaggcaaagatagagtaagaacccaagaaaaatacttggagtgtggaattaatcaataattttcaattaactgtgattagattttgacagatagacttctgagtataataattctaaattccaaattctgagtataataatctatacctgaagagcttctttactggtctttcagcttcttgacttcttcttaatattcacagtcaccctgtagtaggtattactcttgctgggcagatattttaaagatgaaaatcttatcataccctttcactgttaataatctttcagtgattcctcattcttcgacaattgactcattaatccttccttggggaactgtgttataagcttaacctaatagaaaaaaggaggggcaatttggacaaggatgtacataatagctttactcatgatattaaaaacctggaaacaaaccaaaacccaacaataaatggcagggctaagcaaaccctgctgtatcaacacactggaatactctgtacctcctgtaaatgataagaatctggtctgtactgaggcaggaggtgtatctaaaggtgggaaatgtgaaataaacttttataccctgcttttgtctctgtaaaaatatacatgttcacactgacaaagactagacagtaataaaatatttggtattgtatgtgaattagattttctgtttaactatgacataaaatttttaatgggagaaataatgcccttggaattttctgctgggggcactcacataggatttttatcctatgaagaaaaaactagatgtggaacttaaaaacccaagacctcagtacagggagttccttagttgcccagtggttagtactctacactgctgaggatgtgggttcagtcattggttggagaactaggatccttaaagccatgtgacatggcccaaaaaaatagataaaaatttttaaaaataaattaaaaggagacaagaggaattagatggtttaaaaaaacagagacctcagtacaacaggttgggctaaggacacagtgagagttttatgttgggatgttagtggttgagtcaattcaagtcagaatggggtcaggacagacagcccacagcccatggggcttagtgtgctcacagatgcacatgcacgcttgggccatggtcacgtcaggtactgctgccatagcagctcaaagccactggggaagttacagagcagcaaaagaactgccctcctaaccaagagaaaaactggtcagacttgatcaagcagaacattagtctgtgatgtcaaactgaccttaagcacagtttccaagaggctccaggaacagttcaccaagttctctt

SEQ ID NO: 55752 - DNA, 1686 bp, Bovine  19866881060663
aaactccatactttggcccctgacgtgaagagctgactcatttgaaaagaccctgatgctaggaaagattgagggcaggaggagaaggggacaacagaggatgagatggtttgatggattcaccaactcgatggacttgggtttgggttgactccaggagttggtgatggaccgggaggtctggcgtgtttcagttcatggggttgcaaagtcagacacgactgagcaagtgaactgaataggcctcataaaggatagtttattctgcttggggtacagttgagtttgtataatcactctccctatgtatacttattttcaagtttatattgtcaaagtgaagggtattgactgggtttatatcacttaacaaaatgctgttgaaggttgaccttccttgtatccaatcaaaacacacagggctgattttggctcaggcaactacacaggtccagtattaatggtcaacacagcatggttggtttctcttacttgtataatggcatgagtcacagcaaccttgtgcagaaagactacctaccctcacaagaatatggtgagtatcatcagcacccctaggctttcaaactgaatattatcctttcaaaactgttgcttcatgggaactgggaacattacttcattagtaatacatgtgtttcaaatgtatttgaaagctttttagatgtcctgttttgaagtgtcagaatgatacaatgagtagtagactagtattccaaaaatatatagactagtattccaaagacctgggttgaagaccagcatatattagctctgtgactttacataaatctcatatttctaagtctccttttcctcgtttgtgaaaacaggtgaggaggtgagatgaattaatattctcctccagctcccatattttatgactcaaattactttcagagctttcatagtattgtgaacattcccagctgtatagcacatcttctctttgaatgtagatttggttttttggaacaggtaaaacttattagagccaggtcttttaatactatgtatgacaaaggtagatggtactctttttaaggcttggaattattatgcttgcctttatttctgtatattcatttgcaaatggcagaaaacacaatacaagttggcttaagcaaagagaaaattactggctcatatgactgaaaagttcagggtctccagcttcagtcacagcttgacctaggaagtgaaataatgtcatcaggacccactctcgcttttctcatctctcagttctgccttttccccattagttccattctcaggcatgttctccattgggtggcaagatcactgctggtagccccaggcttacatttaatggtctcagcaattctcagagagagattcacttttccccaaaatttcccaaaactctcagaattgactttttattagccctgcttgagtcatttgcttatcatgagctaatcacagagatcaagaagattctctgactggtaaagcctgggtcacatactcaccctgaaagtaggggtggggaattcagttttacatgggtcacttggactgaacatggtggaagggtactttcccaaataaaatcattgtgctgatctcaaataggtagaatgattctgaacttttgagaaggaggaggagagagggagggtgagagagagagagaggaca

SEQ ID NO: 55753 - DNA, 1935 bp, Bovine  19866881068248
aatctgattacttatgacactcaataccagagtaggaaaaaatatccagcgagatgaagttactcagatattcttacccttagcaattctgctgcgagaacagtaacagatgtagtgccatcaccaacttcatcatcttgaacccttgacatatctaccaggaaaaagctagttaataactcacttatatgtgattctgcttttgaaattattaatacttcttggtacctcatctaattctccaaacatactcactaccagtctaaatcttacttatctaggtgtcctcacctaacaaattctttggaactcttcagtctgaaatacagtagtttcaccgtcagtaagtacatcacactccaagactctatttaaaaaattttgcttaagtatagttgacttaaaatgttaatttttattatacaacaaagtgattcagttgtacacatattctttttcatattattttcagttacagcttatcacaggatacttaatacagttccctgggctatatattagggctttgttgtttatccattctatatacaatatagtttgcatctgctaatctcaaactcccaatccttccttctttcacctctcccttctctcctggcaaccacaagtttgtctgtgtatctaagtctgttcttatttcataaatatgttcatttctgtcataatccacaaataaatgatatcatatggtatttgtccttctctaacctacttcacatagtttgataagctctaggttcatccatgttgctgcaaatggcattatttcattcttttttatggttgagtaatattccatcatgtatatgtaccacatctaggagtttgtattttaataatgataattatcagtaaaaaagtagacatcgattaatcaaaaggacagtcagtcaacacagtctgtttaaaaactgtttccaaatgctaacaaatgccgtcctaagactcaccaactagaactttagcagctgggttgtccacaccaatgttttttaaaatagttgcaccatcattggttaccataagagatgcatctcgtccactgcttaacaatattttgtcctgaaaggaacatatttgcttcaggttaagacagaagtacatctggaatgatgcatggattaatcagtaacctcagattgctaatgtgtaaatactctgaagggttatatggcagactccaaactgtttcactgtatatacccgctcccaaagcaaaccttgatgtcctacccttctccagtcctagagacactagaagagcgagacattaacaaggctgtttgaatactgtaagagaaaaactaagtgtacctcacaatacaataataaatacaaatgataaaataagcaagatgcagaaaagtatttgacagagcagagggagtatatctagttatactgaaaaaaaaactaaaaaaacagaagctacagaaaaagtacacatcaatcctatctttgacgagacaaaacatcgtcatgaaaagaatatataaacaaatgtcttataattcataagatacctgtacatccacataaagacagccgttagatttatatccaaaggatataagtggttatcactggggaagggagtggtattggggatagtgatcagaaggagaccttagtcctaggggtacggtcttgattttcagtaaggagaatgtacctatgtctgaatttttataattaacagttaagttttaaatatgaaaaagcacccacaagtttttgtattcccaagggctctataacgacagtaaaatactaaaattccctgtttttcttaccatgcccttgggtcccaacgtgctctttaccaagtctccaatagcaatggcaccaataaaagaagacggaataaaaatcagagatgaccaaaataaacttcagtcttaaaatcgtaaaaca

SEQ ID NO: 55754 - DNA, 1625 bp, Bovine  19866881253827
cagttctgcattttgttggctttttattttagacagtaactactcacttccttctaagaaaaatgaggattagtcatcttaatctctctaccgcctgcaaacgtttatacatatttcttcttctctattcttccttttataggatatcaggtttggggggggtaaattctttatttagtatttaaatttttatgactatgcaaatttttttgcagctgtgtcacaagattcactatgatcgtatttcttttcttatccaacttaatgttttctcaaataattatctgagtttgaaattttatgtactttgtgcctattcatttgcaattctctaacaaatataaactataatatggttggatacatcagataatcagataatctcttatttcctttttcttcttggagacaaccttctgcctatgtagaatacagaccttcaaataattctcctgtttttcagtaattgttttgtccagctttcagttttggcctatgttccaaagatcagagtctgtggtccaccctctccagcgatggtgagaagatcagttttggggtgaggccacttaaatgaactttcaaccagtcatctagtttccagccgcaccctgcatttttgtcttcatcatgattttaatacctgaatctctccagcatgagtcatcttgctgctgctttttttaaaaaaattgtggcaatgtggtaaaatatacataacaaaatttaccatttaagtgtatagttcagtggcattaagtgtattcaccttattgtgtaaccattaccactgtccctcatctctagagcttttatatcatccctaactgaaactcagtacctattaacccagaaatactcattaaccacacctaccccccccgcccctccccccctctagcccctggtgaccattattaaactttttgtgtttatcagcttgatgacttcttcctttcaggtttaggcttcacctgttttgttctagttagtttagttacctctctcccattgccacatttctagcatccagaatattgttgacttctcttattttctattgtgtccttccccattctcatatccttatgaattttatgtttctaaaatgtcctttaactttttaagatgaggtttcaggaaagagtcaaggccagtcgtgcttaactgaaggtctgctccccccacaccgatttcttattattagttttaaaatttaggtttttctaaaattaggaatttaaatacaaatatgttaaataaaggcagttttgtagctatgttggctataaaattaagcttgatagataggctccttcttattgatggttcccatagttgacaggggtttgatcacttgtacctattgcaatcccatactctcctccagccaacataagatggttcttttgtgctgagacatgttctctgctactgcagcagttttcatagcagtgagaacctgacccttctgtggggagtgattttgggagacagactattacctacaaattcccttagaagtctgttactcaaggtgtagttgaggtatttcctcctctctacaacttctctgaatgccctaggcagaactaattactccttctatgccttgacacttgtga

SEQ ID NO: 55755 - DNA, 1228 bp, Bovine  19866881555299
agaagccacaaaggcagcaagacaggctctattgaattctgcagtcgaccatgggttggtataccacagtactactgtattaaacatttaatattcttttcaaaatatacttagttcaggaagtctagagagcagtggaaagcacacagggacatggttctgttacctcatcctgcctcaacagcaaccagaaaagccccacattacctgccagaggtagtccctaagttaaaatttggggttctggctttttgcatatataatcacaataaagtagtattatatagaagattttttagcctctttaacctagttgaatagcaagcacaatttttaggtgttggtgtactttattaattttagtagaggtatatgcatttgattatgttactgctgtaattcacttatctgtaattggagattttgagttttgacaattttttattttataatgttgtgacaaagtcgttacttaaaaaagtagtataatttctgggtcctttgtttaccttacaagtagttctctagaaaaagatcgttaatttacagatccactggctgtgtaactgtctcctttccccgtgttcttgaaatttttgtttgcttgtgtctctgcttcggtagcttgccagcttggtggggaaaatagtattagtttgtttgtatttcttgattactgataaggtttaatttttttctatgactaaagaaccctgactggttgaggtaacagtatctattggcaaacactatttggataagttttggaaacgtaaagcaaagttgataactttggagaagcattttaagacctgacgtgaatttttttgcttggtttttttttggtttgtattttagttccgatgaagttaagttccgtcaagatttaatgaacattgcaggaacaacactatcctcaaaacttcttactcatcataaagaccactttactaagttagctgtggaagctgttctcagactaaaaggctctggtaacctggaggcaattcatgtcatcaaaaagctaggaggaagtctggcagattcctatttagatgaaggtatgtatatattgtatatgggaaaagacgtgttgactagatgttgaaagctaaatactgagtgaatccttatttatttagtcaggactagtgacactttacaaagcgagaaaacttgactttaagggaacaaatcatgttgcaatgatttttgtcatcttaatcca

SEQ ID NO: 55756 - DNA, 1061 bp, Bovine  19866881585322
attcttcttgaacccgaaggagtcaatttgtcttaggaccacaccagttcaaagcaattaatggaaaaagagaaactggaacaacttggaagagatcaaatcagtggaagtggtgcaaataacacagaatgggacactggctatgacagtgatgagcgaagagatgcgccctctgttaacaaactggtgtatgaaaatctaaatggcctatctctccccagtgcctcagggttcaggagaggtcgtctgccgtccaccagtacctcagatacccagaatatcaacaactcagctcagagaagaactgcattgttaaactacgaaaatctaccatctttgcctcctgtttgggaagcccgcaagctaagtagggatgaagatgacaacttaggaccaaagaccccatctctgaatggctaccataataatctagatccaatgcataactatgtaaatacagagaatgtaacagtgccggcgagtgctcacaaaatagagtattcaaggcgtcgggactgtacgccgacagtctttaactttgatatcagacgcccaagtttagaacacaggcagctcaattacatacaggttgacttggaaggtggcagtgactctgacaaccctcagactccaaaaacgcctaccactccccttccacagacccctaccaggcgcacagagctgtatgctgtgatagacatcgagagaactgctgctatgtccaatttgcagaaagcactgccgcgagatgatggtacatctaggaaaactagacacaatagtactgatctgccgatgtgagccctggaaagcatttacattatttgcacctttgtgaagttttttttttaaaaaatgaagacgcaagtgcttcatttttatttctgaacactaactccttttgtagactgatagaaaaaattttttctgaatatttcatgtgcttctttaaagggaattaatgtagagcaggtactcataaaagaacactaatttcattatatactactcattactgtacagcagcattcccattttcacagtgcctatttaaaatgaga

SEQ ID NO: 55757 - DNA, 2002 bp, Bovine  19866881601012
tgtggacatgtctattccctttactatttaaatgatctacatcttgagttgtacccaaataggctttgcagtgccactaggtgacaacaggtttggaaccccagcctaagaactaactactagtttgaatgaccaagaagataaaagttcttgagagtctggcaaatactcaaaatttcatttcactctgaaacctaatccttgacccatgatatgttcactttgaaaatggaggtggtgatatgagactaagaaataaaacctcttatcataaagtctcaagaaacgtgtaaagtataaatacagtgaaactttaaacaggtagccaaccaaacttttattggggttttattgcaatctactttcggcaataaggggaaagtaatcataagaactctgatcagattttattaaacaaagcagtttttcatgaatgcttaatgttagttgtatagtcaagctcagcttccagtatcaacttgagtaccttgtcatgggaatttatgccagaatgacaacagtaaggcattgcaagatcctaaatcatctaagatgaaaccatattttacatataatttttaggacagtatactaatactctacaataaataaggatttaaaaaatgtgttgcttagcccttgttgaactaaattcagttattagctcattctttacgtactccagttaataaaggcttgattgtacttccagaactctgactttcccaaagataaaaaattagttaaagacaaaaattaagcttaaaagcaacattcacacttgtctttaaaagcatgttcacatcatatacgagataatttcctcatgcctggaaacatggtttatgtggcagaaagtcatatacaaagcataactagagggcaatcctcccatctccatatcctccaaaaagccacacttggcctcagtgtaaaagttatattttattgccatgctacaaaatgtatgaagttggcactgacagggagaaatagagaacaagggtggggagggcaaaagatgttgttacatatacaacaaggtttaatcaacagtggtaaattttgccaatattaaaaatgcaaaccaaaatttaaaatgctgatatgaaacagcattaaaataccatttatgcatagtacagtatcacttatgtcttattagagaaatatggaatgtttagaaatgaaattaaccgtaaggggtaaaattcatatttcatgtacaatttggcaatggtagtcccactgttagacaatttttttataaaatacaaaatcaaaaatctaataagctacctttatacaaagttgctatatttatgcctttacgtaggaaaaaaacatttataatgcaaattaggacatacaataatcttacaatattatacaatgtaatgaaaataaaaacataacccaaaatttgtcctttataaaatgtatattttgcatttactaatgcaaatgtggcacactggtgactactgtactattaataccagtccgtttccatgctgttattatccaattgtcatagaattgcaattgtaatgatgctacaaaagactttttataccaaaaaaacgaggaagtagggatggggaagagggatgtaaagaagagcaaagacagggtgctggtttgggcagagtatattatggtatggtcataaaatatttgttagtttttcaagccaaaaacattttctatacattctgtgatttcgtaccaatgcctttattcaaatttggcaaacatcagggaaaaggtaatttagtaccatatacctcacatatcagagataagaaaaagatgccaatacattagttacttctgaatgttgtctctgatggtatgtctgtttcaaggagatatacatatatatatatgtatatgtgaatatacatatatatttatacacacacactatacattgcacaaacacttggacattatgggttaggaacagcacaaggggaaatgggcatgtattttttagcct

SEQ ID NO: 55758 - DNA, 887 bp, Bovine  19866881623640
tgccttcctcgctctcttccgggtgaacagtaaattgaagttctaagatctatgctcttacatcctgggcgattattgcaagcaccctgtgtactgttccagtccacccttatattttatagggattattccatacagcagagtaagctttttaaaatacaaataacataatgtcattctctttcttaaaaggccataaggcttcataatggatttagaataaaatccagaatttgtactcatattttatttgattattagaatgtcttcagagtgtaagctccttaagagttatcagcacctggaacggtagctgaggaagagatgttatgaataagtgtttgatgaataaatgttatatgaataaaggggaattaaatatctagagtttcatatgctgctgctgctaaatcgctttagtcgtgtcctactctgtgcgaccccatggacggcagcccaccaggttcccccgtccctgggattctccaggcaagaacactggagtgggttgccatttcctccaaagcatgaaagtgaaaagtgaaagtgaagtccctcagtcgtgtccgactcttagtgaccccatggactgcagcctaccaggctcctccgtccgtgggattttccaggcgacagtactcaagtggggtgccattgccttctccgagagtttcatatatttggtactaaaaaattaagatcttatgaaaggataaacccaacctttttcaattgctctgcacaaaatcaagatttaatatcgatttgtgagtatttttattggaagctctaaggcttctcagctgttactcctataaactacagcattactgatgtgttaatatttttgcttgtttctcctgtatgtctttgctgtgcatagtaat

SEQ ID NO: 55759 - DNA, 1477 bp, Bovine  19866881774603
atggatgattgagataacagtaagggatactctttagtaaggtaggctcctgtcttggatcatgcggttatttgtctcacatcactgtgaacatgcagttttaagaaagctccaagaagaacggcttaaagacttgcccttatacagatgctcctgctgacgctgggagcaacagtgacctggccatcccattccagtgttgcactgacgtctactgagtgacaagatgctaaaactgggtgcattttatgagacatggaggaaaaaattggaacagcataatattggtaacctgaaagggcaaagtgagtggacaaagacaacgtcattcctccgtgttaatgaataaaagatggacgattgagatgattaactggctaaatgtggtgggatggcatcggattaccaccttgtactgttattctaaagccgtggcagtgcgcttggctaccagatagccttctggcccagcctccagcctgcacagctcagattctgttacactgacttgagaaacgccaggttcatgcttcagcagccttggtgacactacttggtgcatttcattaggtcagatctccagtcatactccaggaacccatttagttacagaggacatgggagcagtggatccctaagattgccatgctggacgtgctctgggaaccgaggtgtgcctgacaacgtctctttataagacaggcctctgtcctccatgtgggagcttgactttttatttgggatttgttttccttaaagtgaaaatgttagtcacgcagtcatatctgactgtttgccaccccatggactgtagccccccaggctccactgtccgtgggatttcccaggcaagaattctggagtgggtttccattcccttctccaggggatcttcctgagcaaaggattgaactcagggcctcctgcattgctggcagattctttaccatctgagccaccagggaagcctatcttctttaactacttctttttttccccttaactatttccaagccacacaaccttgtaagaatgacaaaattttctaggaaaaaatgttaatattattacttcaaaacttcatgaaccctatagaaaaacctttctaattatgcactgatgtagtggatgtatatactcaactgaggtaaaggattaaggccttgggtcatacactggagaaaaccaaatcagttgcaaagagtaaatgccagaaaggtctgtgttcttgctgctgttctactgattatcccgctgacattgggcaggattacccatgaggtcctattgcaccttcctgcctctgagactgtggtatggacacatgagatttatccacatccctaactgaatgcattgagcatctaccacaaacacatttgttgccttaaactctatatcacagtaatctaaaaggaggaagaagacatgcttataaatagctaaattggggacaaatcacattaaaaaatattta

SEQ ID NO: 55760 - DNA, 1723 bp, Bovine  19866881956809
ggtatttatatttctttcaaaaaacattagtcttgttttttggtgcaaattctcatcctggattgaaagctaaaggactcatctgtcaagttcccagagagtggtttggcaattatatcaactacaagcaggtcctcttaggtcgatagacacctgaggctatttattttattggtgaaagcttggtgtgagagcatttttggtccagttcacgaaaacagcagtgttctaaccagcagctccaataaatcttacacattcttgagcccataagtcctggcctcctgcctctctacacatccattcatccaactaagaagaacctcttgttggagcacacaggggcacttgattagtatgagctatgggaaggagcacaatcttctttcctttctgccctggggataagactttagagcaaccaactttttactcaggacacacagactgtgatgagaaagactttatgcctctctccacatataccagatggtttatggcccactgtccagaaacagataaagttaacacacagagcccttcactgatatcatcttattccaaggcaagttgtgtttacttctgggactggcagttactacatggccatcagagtctatatagaaatagtaggctgagagatggttcattcaaaatgatgtgtttcctaaaataattttctgattccaatcttcctatgcctcttgctcatcatttgccccaataaatacactagcagtttcttatagctgagactatggcttatcaatttggctacaaagtatagtagttaagggcgtgaactctgaaaccagtctgtgtgggtcaagtcctagcattagtaccagccgtatgggcctgggaaacttatttaacctctttgtgcttttattttctggactattaaatactaatacagcctgaaattgttgtaaggataaaatgtgttgaaatatgcaaatcacttagtacaataccagatacataggaagtataattgacatacatatatgtgtgtgtgtaatacacataaaatatatctataaatatatgtataatataaatatatatttttaaatgtgtatatatgtatatgtacatatacatgtgtgtatagtaatttataatttagaagcactttgtgacttggcaaggtgacagaaattatcctagattgtctttcagtgtaacttttgcattggaatcaagaatgaaccagctgtttggtaaaaagactctaacaaaactgtaaggagaaaaatcagtgactctgtgtgtacacttcgagaacacatttttgccttccagcaggacggggccagtcccatgaaacaagctctccagcagacattctggaagggagacctcagggaactggggattttgtgtgacatcaccaaggagtgaaggaggagaagcagtggcaaagtttgggacacatttttaatttgcacccccttcctccaaaatgaatattaaatcttcacgatcatcatattcattcttgagtactgtaagcttagtgtttactcccatccatatgttgaagccctaagctcccagtttgattatacttggagatagggcttttaggagataattaaggttaaatgaggtcatagggttgggggtcctaatctgacagaatttggtggtcttataagaagagggcttcccaggtggctcagtggtaaagaatccacctgccaatgcaggaaatgca

SEQ ID NO: 55761 - DNA, 1707 bp, Bovine  19866880518651
tttgttgatgcagacacagtagtatatacttgataagatagactgaatctggactctctgcccaggtcaaagtcatactaatttgtttttccatctgcagactcaatttatacttcatttaggaatttcggtgctctcaatctaccactgaaagcaattaagaggatgaaattatttttaaagaccctagcagagagcggggggctcttccaggggattttctctgaactgttggaagactaaacttgcagaatgtgttagggaaatcagagaaggtcctctcacgtcccttgggaaatatttttcatctttaagtgtcctctttttaatagtattcccatcattcacatttccagctgagagaagtggttctgaaaaaagcctttttcttagacactatgctttccttctactttctcccttctaccccccaccccttttttagcagtaatgccctggtagatagggaagtaaggtctgttatttaaagaatgcagagatttgagcaaacccttccagaacctgattgttgatagagtcttaaagacttcaaaatccacatagagataccctcttttccagatattgggatacttcctgtctctcctaggcaagaggttgagaaagtcaaagtgtatgtgttttgtctgttggtacctcacaaaaggccattacttggtactggcatgtttccccttaagttagaaaaacaggactactttaagaaaataaactttaaacgttttgttacagtaaagcacataagagccttaattgttgactggcagcatttcagctttgtcttccctttgaaattttctccccctgaactgcagccagtgcactatgaagagaagaactggtgtcaggagcagtactccggaggctgctacactgcctacttccccccggggatcatgactcaatacggaaggtactacccaaacactgtaccaatggatacaagacgtgtgccaagcttaaagctagataagccaagctcagtggggattttagaaacaggaatcagcattcctatatgtaatgtcccagatagtttgtattctctaggtgtccataggaaaagaagtatgtccatatgtagaacagtgcctggcagcacatagaacaattgcagagcactggtgaggaattcaggagtcactggtacacgtgagaatcctgcaagctgcagtgtcctccaaggagccttcttgagctcaactaaacatttagtcttgcacgactaccctaggctcctgggcaccaatctacagaaaaggacatgggctaaagatgtcttgccagcagagcagcatcagacatcatggggaagcatctcactgtgtacggctaaggtgtgagcagttgacgtgcgcacaagatgggaaaattcaccttagcttagaaaccccttagctcacaggagcctttgtgtcttaaaacagcctcataggcagtatctaggatctccacaaaggatatgcccagttacaagaggcagcatgctcaagaaagcccaaacatttcccagatatttagactctttccagatatttgcaatttatgagttttcccagcctagatacaagttaccagtgaggggggtgggaggacaaccatttttaccataagcagcagttgcctggtaacatatatggcctcatgccttcatcaggtttctagagaaacagacctaaaatgtta

SEQ ID NO: 55762 - DNA, 1311 bp, Bovine  19866880671939
ctacaaaagaaagtgcatgaaacccagaagttttaaaatagccaaaaagaaaaataggaataacttaatccatgggctctaaggaaattacaggtttaatcttgctgaagatattagactacagcaaattgaaaaaaaaaattgctaagcatgatcttaatattaatccattgtaattaaataattagctctatcagacaaatttttcttctactcaacccaaattccagattttcttattcttttctttccctggaatggtgtgagaaagcaactttttgtataattaattctttaataattattttaatatattctgcatttctagcctcatcattttaaatgttaaaagaaaactgaagcaaacgaattgggagaaagtcctgtaggaactaaaagtaataaaatgtgaatatttctattcaaaaaagaaaggccccagagtgaaaataatcacatagcaccaacactgtagtcaaattgttcttttcagatgggagattggttctaatttatccttttggcctaagtttgactttgaagcaacccagaaaccaagaatgaataagtgcaacactagttttataatgcactttagaatttataaatcatttttgcatttttttcccatttgatcagcaagctaactctctgagagagatggtgtgggaattttggttctcttctggcagataaaggccttcttttctcaggaaatgttggcaaaatggttgagatagaactaacaggacattcaattgttccctgcattaggattctccagagaaacagaaccaataggaaataagagatacacctgtaactattgatacatagataaaaggagattgattataaagaattgacttgagattatggaggctgataaggccaaagagctacagttggtaagctggagacccaggagggctgatggcatagttcacttcaattcagttgtcattcagtcgtgtccaactctttgtgaccccatggactgcagcacaccaagcctccctgtccatcaccaactcctggagtttatgcaaactcatgtccattgagtcagtgatgccatccaaccatctcatcctctgttgtccccttcttctcctgccttaaatctttcccagcatcagggtcttttcaaatgagtcagtttttgcacatcaggtggccaaagtattggagattcagcttcaacatcagtccttccaatgaacattcaggactgatttcctttaggatggactggttggctctccttgcagttccaagggactcccaagagtcttctccaacatcacagtt

SEQ ID NO: 55763 - DNA, 3271 bp, Bovine  19866880792775
atagtacaggccaggagatgctgcttattgagttgcttgtgcatacttattgagaacttgtgttcttattgccactgatacttatttccttactgatgtcagaaaaaaaaatgtagaaagtgaaaaagatgaaaaagagttagagatggggattctgataagaacgtgtctgtacaaatctgagccaaagccgtgaaccatgtcagggaatcacagtttgcccatcaaatgtctgtccttttcttctctggacccactatccacccttttccactctcctgtttgcacagggcagtctagatcccatgctgtacagtttccacttgcatttcactaatagggaaccccaaaaagagatgaaaaagggaaggggagggaaattaggttattttccccttgttgccttctgcagaggttccctcagtctggctgtgtccctctaccaaagatcagactcaggctaagctggctctcctctctccatcttggttctggaaacactttcctcttgctgcgtcaggcttaggcctgctaatagccattgcacacccgggagtactgcctactgtctcgtggttctcccatacctgcccacagctctgtaagtattccctaaatttggctgttcttgaatcagccttatttgagtgcatcacaggcttcctgaccagcacacccagaaaatcagagccccaagaaggcaatcatcatgcagctttctttccacttcattttatgaatgatggaaatgaggccagagagaagtcagcttttcctaagaatgtaatctaatggtaatgactggtctaaaatctagacatgccgattgctactctttctagttctcacttcccatttgctttgaaataatataaatactatttttttttttccagttttcaaatgtaagacctgttgcttctctgccttttggctaagatcaagtgtagtatccaaatgtaagccttttaaaactgaggcaatgaacattccagcattctgcttttaaacttgtggaaataaatgaagaccactcaaatgagaacaaaggctgtttattcagagattgctgtagcaagggagtcagccaccatgacttctgtttggcagagattcagtgcaggcaggggtgtgggaaagctttataatggaaagaagttttaggtgtgttctgattgggggttgttggcaaagtggagctggagacaggagctaaatagacataagacatccaagattgatttgaaagcatatctggcttcctcttcttggttctgagttggaagcagaggcaaaaaaaatatagggaagctggtagtcactaagtcctgactatttggggtgataactacagagtttgtagatcagagttgtgttgccacatgtgaggagaaggaaatggcaagccactccagtattcttgcctagagaataccatggacagaggagcctggtgggctgctgtccatagggtctcacagagtctgacatgactgaagtgacttagcaggcatgcatgcattggagaaggaaatggcaacccactccagtattcttgcctggagaatcccagggacagaggagcctagtgggctgccatctatggggtcgcacagagtcagacacgattgaagagacttaggagcagcagtagcagcagacacatgtgaccagccattatcagttgtatggtcaggctcttaagcttgaaagcacttcatttgctctgcagcagtttttgctcatcatctgaatgaattttggcctctgagtagattaactatagagttctcagggtatataggaggagaaagtgtggccaaatggtggaagaaagaggcagatttggcatactttggaacaattctgttgacagtctgctagactggaacaaataggaactatgcttgcagtatttggggtcacacacatttatgccttaaaggtacatttttggcacagctgactttatgtagaagctttgtcaattattaatgtaattaggttgcatctttgcccattcttttattatatgggtggcagcaacatttctggtgagagccagcagagagagctttattctcctctgagaatctggagttggcatggcagccgcatgtgagtcaagtgttgagtgtagatgaaatcctaaattccttattctagtatagtttcctgacacttactcactacagctgatatggacttcaaccacacacttgaaaaaggccctgagcccacctcatcctcacccagattagcatacagaaatgcagctctcaaagatgtggtagcctggtggctaccattctcatgccttcatgactcttgctctacaggttttcacttgtgttgttgaatcgcttctttcacaaaatcttatatatttgcatgagattggctgcacagtgaagctatagagtcagcttcccccttaggttcactcctgttgcactgaagtccccacaggaactccactttgtttcatagacattttaagagaaatttcagacaggataagtcaaacaagaagtttcatttgggagataaggtggagggaagaggaacttctgaaggatattacagagattgggagcaaaaggagctgacacgtctctctcctgatacctatttggccttctggctgagattgcagggactagtcatacctctctaattagagttaccagcttttagaatgccagaggtagaaatcttccttgggacttaatattccatgtgaatttttgatttagcacagggctgactgtagccactcttgtccagcagttggcagaagtagagattctaagctgtcaaactggagtgatttcattccattcaatggtctgtgggctactaagggcaaaaaccgagtcttatttttacatacctagggactacctggggtttcccgggtggcccagggaaagaatccacctgccattgcaggagacacaagagacgaggtttgatgcctggatcagaaagatctcctggagtgggaaatgacaatctgctccagtattcttgcctgaaaaattccatggatggaggagcctgaagggctacagtccacagggttgcaaagagttggacgtgactaagcacaacacaacagcagagggactgcctaattcatcaacacgtaaagggttacctgttacggctgtgcttttttttttttaatgttaaaatgttgatgcatagtattgtctttcccttggaaataaagacttttcttttttcctcaactcatttccacatgtaa

SEQ ID NO: 55764 - DNA, 1181 bp, Bovine  19866880862480
gtgtaaatgtttttacactggtctcttccgcaggaactcatccagccggagtgttagggccttttaaaggatgctttggaacttggctaaggttttggcttccccgtgggtaactgggcttcccaggtggcactagtagtaaagaacccgcctgccaatgcaggagacataagagatgtacgtttgatccctgggtcctgaagatctcctggaggagggcatggcaatccactctagtattcttgcctggagaatcccatggacagaggagcctggcgggctacagtccatagagtcacaaaaagtctgacatgatggaaacaacttagcacccacgcacctgaagtaaccacttcttttctctccccagatggtactcctggcccggtgtgagggacactgcagccaggcgtcacggtctgagcccttggtctccttcagcactgtcctcaagcagcccttccgctcctcctgtcactgctgccggccccagacgtccaagctgaaggcactgcggctgcgctgctcagggggcatgcgactcacggccacctaccggtacatcctctcctgtcactgtgaggagtgcagctcctgaggcctgctattgagtggcttctggatgggacagacccctcccccttgctgaggcagttcaaccagccagggaaggactggcaagggaagagttaaggcaaaagaaaaaaaaaaaaaaatatatatatatatgtatgtatgtatgtatgtatgtatgtagcaattcccacgggattctgcatattctagtaataaagagtctacatgcttgttgacagagatactctgggaacttgttttccattcccatctcctttccttggtaccatttcttttggttccttttcagattcgggcatttccccctttagtgctgaatgccatctgggctccaaccattcagcattagtgggaaaagtgggctcccaggcaagagtggatcaggctgtcacagttttagtattgatgacggaagcatttgctttggaaagcaggaaagctgaattctttctgggacatcctctggctttttttttttttaagtcttgtgactgggtctaaggttgcccttgctgctaaatattaccaatttcaaattccgggcaccaagcataggatatgttagccaggttcattcacagcca

SEQ ID NO: 55765 - DNA, 2106 bp, Bovine  19866881108267
ggcccagttgagaagagagtttcagaggagcctgtttggtcaaggagagaatctttgccaccataaatctggcgggaacacttacatgcagcttaacttgctagaggctgagtgtggacaatgtaggggtagaaactcctggggcccctgcagtctcaggggagccccaaactttcatgggctttactcctcgaaccccagcaaatacacctggaaggcactggagttttgagcagaggagtcacccacactgggattatctctgcaaccagcaagctccaaagaaggtaaagcagacccctggtgatctaaagcgaagtcactcagtcacgtccaactctttgcaaccccatggactgtagcctacaaggctcccccatccatgggattttccaggcgagaatactggagtgggttgtcattttcttctccacctggtgatcgaacagaactggaaagaacttcctcaccaatactgaaaaacgtctgacttcctgtcttgcctgaaattctgccattaatttcctctctgggtccaaaagatttatctgagacccatcgccaaacgtaaggaccaccactgagcagcgccttgactgctgagcttacagattggggtggggatgtcagagggagctgagcacaggggtctgggaaggattttctggggtgaagactcggggacagagagtaggagagcaggagccaaggaaaagggagggacacacttggcaaccaccttctttctgatttattcccctgaagataaacaagatccagccctgccctctaggagcgcacagtctgagggaggaggcaacactgagaacagaggctcgcatgcggtaagagctgggcaatggaagagcacagagaagaggaagcggccagcctgggacaaggggtagtcagagatgctctcctgaggcggggacactggagcagactaggcgagttgatacggaactggaacagtgttccaagcagccagaacagcacgtgccaagacccagaggaatgagaatgcacagagcgaccagagcccagatggctggggggaagtggtgagagacggtcctgagtgccagctgtgggccctgggaggaccaggggcttgagggcagcaagcaggagtggaacgtgacctccaggagacctatctcccaagggtcctgacagctcctagtacgcaggaggggctccaccaacgtgaaatgaaggaatgaataaatgattgtgacagggtaataggaagacaaggaggacattgcagtggtccaggcgacagctaatgaggtcacacaaggtcatagcggtgggcacaaacaaagcaggtgacttgagagcaatctaagaggaaggcactgggtgggtggggtgtataccccgtggtggctcagacgataaagaatctgcctgcaatgcaagagacccaggttcaatccctcggtcaagaagattcccctggagaaggaaatggctacccactccagtattcttgcctggagaatcccatggacagaggagcctggtgggctacagtccatgaggtcacaaagagtcggacacaactgagcaactaacacacacatgattgctctccacacacttgctactcttccagtcatccccatctcagcaaaaggcatcaccatttatccacttgctaaggccaacactagagaaatcaactttaatttctctttccatcactctccctcccatccaatccattgggaaatcctattgtttctcaccacatcactccatcttcatcactaccaatttggcaacctctcttgccaaggttattgcaattatttcctccagactggttcctggacaaggttccatttgtcctcacctagtatctatttaccattcttgaagccaaaatctgtttattgcctttgcctctgtgatgctctttttaaagtgtaaatcaagtcacatcatccccctgcttaaaactcttcagtggcatcctttcaaaaccagaataagattcagatcttttaccacagccttcaaagtcctaagtggtctaacccattcctatgttttctattttatcccataccttctctccttattctaatttctcct

SEQ ID NO: 55766 - DNA, 1381 bp, Bovine  19866881344425
gatgcctgggagtgatgggaaaggagctgggggtacagacttgagactggagcttatcctcaaaaatgtgacttgggctaaaaataaagtggtttagtccacacgtcatagagtttcactaagcaaggtggtagtggatagagtaaatgtggtacctgagttaagtctgacatataccatttgtttgaagatgtccactagtgtagacacaacaggcactgggaaaattcatacaaaatccagagatgttcagagcttggaagggtgaaagatcttcaagttcccatgcctggttctaagccaaattcaggtgttacaaagagtttctcaaaggttgtcaattatgtcactaggtatctctatattacaagtgtggtgaaaggaagaggtgaatacaggcttcttggagctattgagtctacctgaagcagattctcaaggagacaacgcccaggtgaactgcccgaattccattcatagtcttgggttttgtccttactgttggtgggcatccagccattgtccagaccaaattgttttctcctgcttcagtaacagctagaagtccttgctgaaggctggcaagactgggggtatcccagaggtatagtttgataaagacctgtgaccttcacatgtgaagaatcaaaaacaaagggtgagtgggctatgctctgatcttggtgacacgatagaggttgaactctccattagccaaaccacggattaacaacccctgctgcaagttagcgttagcaaacctcatctggcttctagaagggaatctccttttgctatggactgggtcctgggaactaagtcagctctgcaggaatataaaacatagaggcaactcccttgtctctgtatttgaaatatttgtagagatggagcatttaaaatatgaatataaggagcaagatgttgtggaatacataaataggtctggtggcacagctgaaaaaatagtggctggatcttgtggtcacgctgatgaagcttgttgcttaaaggatcctagtgccaaaggctcggtaaagtcagtaaggtaagacactagtctgtttcacagggtggtcttgtgaaatatcaccccatccctggcaggagttacccatcaacaggtgcctttctttcattttctactggactgttgaaccaaggcttggttcacaaatctgtggattctctttgatagaccatcatgttggacaggagatgggtgtattcagcaacactgctcagagggatgaaatgagcatgggaaatgggagatacaatataagggcctgcttgtcagtgtctactattggcccaaggtacttcttaacagaaggggcaaaggctttctgagcctggggcatcacactgtagcagccca

SEQ ID NO: 55767 - DNA, 763 bp, Bovine  19866881494443
taggatctcttttaaatttctctggacaaaggagatgatgactagaaattaaattcatttttctgtctttgtgagggcagggtttcttggcaatcaggggctatgttcaggacactttgtttttctggaaatctttccgccgacactgtgttccttgtttgaaagagattgctcacagtcatcaactgtggcaaggatgttatacttgaatttttcagagtgatgaccaaatatgcttctttctttagctatttcatataatccacatgcagctaagaaaataattaagcactatctctgattttatacagaatacatatgctaacattggtcttcatgaaattcaaatgaatgttattgctttctaattattacaaaaggaaagcaggtttattgtaaaaatataagaagaaaacttgggtagaggaaaaacaattacaaaaccccttcaataatcttatgtagagaaaatcactctaaaatattcttttggtacatagattttcatgttcctgtattgctattttctgacctctgctggaggaaataagaaatatcagtacactttaaaatattgtatacatatgcatatgtgtatatgtttgatatacttactctttaattctcatcctgagacaattaaagcactaatgaatttatgaaacaaagatttcagttttcagtccactgaaaactggttgtatccagtgaagtgttacttgatgataaataataataaagattttagagctaaaaagtcctc

SEQ ID NO: 55768 - DNA, 878 bp, Bovine  19866880470840
atattccacaaggataaaacgaggaaatagtggggtcttaataagtatcattgaatgaatggctttgtccaataccccctttttttaactccttggctgcaccatgcagcaaatgcaatcttacttccccaaccagggatcaaacccgctccccctgcagtggaagctcagagtcctaagtgctggcctgccagggaagtacctccaacacctcttttttactagaggcagaaagtggtgttgagcatacagtttgtaaatgggttcaaattcttaaaaatgacatcctcgatttacaagaaaggagcatgatttatattttaaagtgatgctactggcaaagaacaattattactttgcaaaatcgaatttatttgcagcagttcatgttatgataaaaagctgactgctgctgttctgaatgagtgattaatatttctgctgatggccctgagaaatgtttgtgtcaggtgtagccagacttggaggtagaacaagtgaaatagtccatattgcaagaaacagcatgatcccaattgacttaaatttcgtgcaacatccagggaacctggggcgctgtacaataagatctgaattgtataaacagtgttccacttttgttcctctgctctgtctttttttctcgtgaagagatttcataaatttcataaataattctataatgtcatttagggctacaactgtcatattagggaatgcaggttatgtattatctctgcaaatgaataacaggtcgcatagctttagttctcttctgttttggcagccgagagcttactttatgtgctgtcagcaccagaatcagaatttaaagggaaagagggaagaaagcggggaagggggagcagaagagaggg

SEQ ID NO: 55769 - DNA, 2688 bp, Bovine  19866880540328
gttcttacggcaacccactccagtactcttgcctgaagaatcccatggacggaggagcctggtaggccgcagtccatggggttgctaagagtcggacacgactgagcgacttcactttcacttttcactttcatgccttggagaaggaaatggcaacccactccagtgttcttgcctggagaatccgagagacagcagagcctggtgggctgccatctatggggtcacacacagttggacacgactgaagtgacttagcagcagcagcagtgtggtaccctaaatggatagtgatattttgttgttcattcattagttaaaataatagttaatgaagacacatatgttaggcatggggtaagatgaagacatggcctgtgctctcaaagaataaaaaatatagtgagagtcaagctttaattttttttgttgggattttatttcttttatttttactttctggccataccttgtgacttgtggcatcttatttccctgaattattttacagggatagagcccatgtccttggcagtcatcatggagtcctaaccatcagaccatcagggaattcccataattttcagtcttatccatttaatggcaaatcttgagcattatctgtcattaaaatcttttgaaaaaaatttaccagtggcataatattgtgatatattttcatttatttagtcatttccctgttattatttaaaattcttttactattttaagcaatgctgtaattaacatccttaaatgaaatagttcttatttttagtgacttccttagaataaatacttgaagtgaatccaagagttatgtattttaaggctttggatagaatgcagcaaaaattctttctgtgaggacagattgattcttaatttggtagtaatttggaaatgatacagtattaacacagtgatttttatttttttattttttaggttcccctcttgtagtatctttaattggtgcacttttacgagattttcccaaccgctgggagtactacctcaggcaacttcagaataagcaatttaagaggataagaaaatcttcatcttatgactatgaggctctagatgaagccatgtctataagtgttgaaatgctcagagaagacatcaaagattattacacagatctttccatcttacagaaagatgttaaggtgcctacaaaggtaatagatggatcaacaatctttgtcatccccttacgtgtggcatgtaagttttggctttgtactgaggatattgttacagaggatattagcaagataaaacctgtgtgcctgaggaggtagggtagaggatgtagaaatcccgctactcttagtttccttcaaggatttggtgttgaactcagggtgagttgcctgtttctcagtgattttcatgaacctgaagaaacatttgacttcttcagaactttctcttttttatcttgctgcatatttgtacttcttatcaaatggagatattattcagggatttaaatacatgatttttttttgtgttactctctttatctgcaatcctggctcattgtacattgtggcacattaaatgcttaaaatgttcctaggtgttatgtatcctctgggacttggaaacggaagaagttgaagacatattacaggaatttgttaataagtctctcttgttctgtgaccggaatggaaaatcatttctttattatttacatgatctgcaagtagatttccttgctgaaaagaatcgcagccagcttcaggtacttgcatctctgtacattcctttttttttttaagtttttattttgaaacgattttatacttatagataagtcttatagaattttagtatagaaaatagtatagtttctgtgcacatacctttaccttgcttccctcaatgttaacatcttaataactgcaatacagttatcaaagccagaacattaacattgactaaatactgtgccttactttccctggagatgggaatggcaacctactccagtattctagcctgggaaattccacggacagaggagcctggcgggctgcagtccatggggtcgcacagaattggacatgactgagcgactaacaagaacaagaaaagaactgttaactgatactttatttgaatttcgccagctttcccattaatgtcctttttgtagatcagattcaattctgtttcccatattacatatattgtcctttccttagtttactcaaatttaggaaaatgcctcagcttgctttcttccctggtccctttggaagagtactcaccagttattttgtacagtgttccttagtttgggtttgtctcatgttttttcttgactagagcaaggttatatatttttggcagtaaaggtgctacagaggtgctgtgtgtccttgtcagtgcatcagacccagggtgttgataatggtttatcagtgatagtaacattgattacctggttaaagtttctccactgtaaagttactgttttttccttttgtaatatgtgtcttgtggggagattcactgtaccttttctttaatacgtagttttatttattttggtctttgtttgcacgggctttctcttgttgcagcaagtgggggctactctttattgcagtgcgtgggcctctcattacggaggtttctctagtagagtatgggttctaggtgtgcggc

SEQ ID NO: 55770 - DNA, 1407 bp, Bovine  19866880593762
ccattttgtgattaatgaggtttattaagtcagttccctactgatggtcatttgggattttgctgttaaaaacaattgatgcagtgaataatccacgcaagttattttgtatttttgctaatgtatttttgggctgtagtcatagaggtggaattgctggatcattcttgctgtttttaatattcttgatatattcaaaatgcttatgaatgtgatttcctatatattgtgtttattctgtagttgtggagtatggactcaggtttaaaagtagctgattgcagaggacatttaagttgggtccattgtgtgatgttttctcctgatggatcatcgtttttgacatcttctgatgaccagacaatcagggtgagaaataattgagattttcattttaaacatttaatgatggtaagcttaatctcctaccaattgagaaattgatgggcactattggggggaagtaaaacagaaactgctggattcacatttatccttgaaaagtgctggtatatggactatatcagtcacattcattcagtacatgtacattgagtgttaccatggcgcaggtgctggaaaaatccattgataaaactgcactttggttaatttaaatatatttcatcagaataacttttgactccctaccttaaattcccacatccaattacttgccagtactgttagattctttgactgctcctttccctgggtcctggtgggcacaaggttttgtttgcgccctccgagcatctctggcaggtatgatgtttgaatggattctacctttccattttctatcatttatttctacttttccatttcaagtttaggtactcattacctgttgtctttcttatattaatctctttgcaagtcttttctttcttggttttctgcatactgcttgtgagacattttcctcatgtacaatgcagatgtgtcatttttgctcaaaaagatagtgactgccttgcctaccatttggagtaaataaattgctgttaaaattctctgtggttaaggctattctataccagtctgtcttctgatttattccttcaaataacctacactggactgctcacatttccccagacaccttgtacttccctgcttctgtgtttcttatgtttggaataccctacttctctgtatctctccatgttgaaatcctaagaatcctgagagtcccctcaagctttcagtaaagcctttcctagtattctgttcagaggactgtcttttctccttcaatgccatgtaactgtatcattttcttagtgctgtcttgctaagtcacttcagtcgtgtccgactctgtgtgaccccatagacagcagcccaccaggctcctgcgtccctgggattctccaggcaagaacactggagtggagtgccatt

SEQ ID NO: 55771 - DNA, 1130 bp, Bovine  19866880614515
tagcccaccaggctcctctgtacctggggatcctccaagcaagaatactggagtgggctgccatgctctcctccaggggatcttcctgacccagggatcgaaccctcagtcccttatggctcctgtgttagcaggcaggttctttacccctagtgctgcctgggaagccctgatattgcttcttacttgggggcatctcagcttccctgatcacctgtcttactgacaggaggcaacaaggaggagaactgcagacctcccagggagcagcttttgggcatttgattgaggcaccaagacatccagaggacaactgagtattgacgatggatagctttgaatggcttttcttttttaaagatttatgtgtttttatttatttttggctgcactagatctccgttgctgtgcaggattttcactagttgcagtgcatggacttctcattgggtagcttctcttgttgccaagtgtgggctctaagtgcacaggctgcagtagttgtgtgctgtagagcgctagatcagttgctctgctgcatgtgggatcttcctggaccagggctcgaacccatgtcctctgcattggcaggcagattcttaaccactagaccaccagagaagcacctgaatggcttttattaccatgttgtgaactgactttggttcttaagagtggctccatgtcggttcactcttaatctcagtactgagacatcactccaagctttcctaaatggtaggacttgcaagatgcatgttagttagtgcctttgggcttgtgaagtaacagctccttggccatctgtagacctcagtggctgcactgccaccttcggctggggtaaccctcctggagccgtcaaatagagaatctctatttcaatctggtgtgtgtaagtctttacatcaccagtcattaatcatgcttggaaagttaaaatgcccatgtggcttttacaaacataggtctcctgggttttggagagaaaaacagaaactgtttggatgataatttgtagctatgattatttatgagtgacatacagagtacactgtgttgagctgggaataatcatctttgcactaccaactctaagtgaaatggagctgtggtgagtacagagtgag

SEQ ID NO: 55772 - DNA, 1082 bp, Bovine  19866880621249
ttgctgctgtttagtcatgtgtccaactctttagcaaccctatggattgtagcctgccagactcctctgtccatgggattttccaggcaagaatactggagtgggtagccatttccttctccaggggatcttcccgactcagggatcaaacccacgtctcctgtcctggcaggattctttaccactgagccaccagggaagccaattttgatgacagtaaagacttgatcaggctcctagagtagtaacttaagacggatcagctgtaactggtgtcttcataacatggaatggctcttccaagacacatggttatcagactgagtgttggaatgaattttttaaatgcaaaagagcttcccctgcagaatttcattatatttgttgttgttcagtcgcccagttgtgtccgactttgcaaccccacggactgcagcatgccaggcctctctgtccctcaccatctcccaaagtttgcccaagttcatatccattgcattggtgatgccatccagccatctcatcctctgactccctcttctccttcactatatttatgaagataacatttcagagtacaacatgtattgaagtactgagtgttcaaaagctttgagaaagaaaatactagtgataaaatttcagctggggcccaaattcctagaacagaagtgagttaaatctaagctttaattaaacactagaatatcctcatctgagaagattaataatagcactcggcctacttatttcaccaggttgttgtgcagctcatgctaagcttcacgcaaaagggaacttttccacagctaggtttctaggacctgaaatacagaagctgtcaaacgtattgactgagtgaatggaatcacagaatgtgttcagtatttcttggcaaatgatcaagcaccatggaagcattaattactctcctcgttataatttttagtcgatctactttgttgctgccacttgggccctcagtaaactacatcactgctaacacacttctggcaaaatgcatcagagattaaccttgcagacttcttgttagagacggtctcatcttttcctgataaagg

SEQ ID NO: 55773 - DNA, 1354 bp, Bovine  19866880790929
gttatgatgttctccagatgtcagtagttaagtctcactgggacttcacacatcaactgaatacgaccatctgtaccttggatgtttgcgcagcatcagaatgcggagacggtctttagcctcttcaatattaagtggaagcctctgggagaagctctcatcctgatccaatcgtgcacaaaggttctgtagtttcatcagaagcccggatttgtcctgtttcccaactgacacccaatgcacgcctcctgggaaacaatctggtgaggaaaaggaaaataaatttaaggtctttaaacaggagtccccctttgaaagattttactgataagcagcagtaaagatttgttccaatctttgatttcatcacatcttcaaacttctcttgattcagagtttatatttgtttgtagactgttattgagcttcagagcccaaatctaagaaaagttgaagatgtgaatcatctgaagtttggtgttaatctgctacgtatcagtaaaatcttactaaacaaactttcaaatctttgtcctgtgtcctcaatgattactgtacaacagtttctcaacagaagcactctggacattttgggccagataattctttgttgtgagggaaatgtcttgagcattacaggacatttagcagcctccctggcctctatccactagatgccagcagcacttcctctccccagttatgtcaaccaaaaatgtctccgaagtttgtcacataccccttgaggggggaaaaaatcacctctgactgagaaccactgatgtggttcctgggaacacataactcgttaattatcattctcatataaagacttcaagtaagaagttaggctcaagtctggctctactgcttactagctatgatacctttagcaaatcactaacttcaatttcatatacaatactagaataagactgtttacccctatttcagttattataagaaattaatgtatataatatgtgatttggctatgttaaaaggttataacagataagattattagtgatacggatgagactacctttcatataattaagctttgaactagtaagcagtataataagaacagacattattattactgctactgtcaactgacattgtcatcatttttgttaatcaagccacatgtgctaagtcactacgtccgactctgtgcaaccctatgggccaaaggctgccaagctcactgtccattggatttcccaggcaagaacactagagtgggttgccatttccttctccaggggatcttcccaacccagggactgaaaccatgtctcctgcacggcaggggattctttaccactgagccaccaaggaagcccaa

SEQ ID NO: 55774 - DNA, 1214 bp, Bovine  19866880973328
aaaatgatgctgctgcctgaccccaaaatacctgaagagcgagatctgtccctgttcggatctcttccatgattcgggtatggatgtctgggcctctcctgtccccaggtcactgctcaaaaatttaagtcagccatagccaaatagtggcactgtcgctaaagcactttccgacggcagcttgctctgcagtgtcaccctgagattcaaagctgtggatctgttgacgactattggcagaatcaactcttttcatcctcattctaggttcagactgatgtgttaagagacttctctctgcttcgcacacctaagatgagaatcttgaggtgaaaatttgagtgtaattgctttgccttggttgttaaatatttttctcatctgtttggtgagattctgttttttttttaaagcctttggtaaacattcaatgctgccgctcgtgaaagagaaatgtgaaaagaatgttctggaagccgtggctattctgcctacaaatgccctggagagaagggggtctgagatattgtgtctcctttcagcttgctcagtattgaattggtttcagggttctttgtgcagagaatagcagtgttgggattatggagaatcttttattgcagtgaggtggaaaacgtaggagagacaagaaaataataatcttccctctctctcttgttcagtattgtcttgtaatccttattactgttttcactgattatttttttaaataacgtatctaaaacttcccccccccaaaatgttcatatattttctgctatttgttagtatttggtggatcacatatgtgggtgaatttctctaatgacagcagagacatttgttttaaccttgaaccatgtagtctttatgtatgaatacaaactggatctttcctgaacccttacctaccctgctggataagggaggatcgttcattaaggagaattagccattattgaccgtgccaaattcagcaacagaatcacctggctgaactgctcatgcaatttatgaaatttctccacatagtgcgttttttttccaaagaggaaattaattactcttctgcctgagcgtgaaccctcagaggtaatctagcaattgctcccttatggtctttatgagattcacaagctaggggaagtattacttttttgaagagtcgagatctttttcttgtcgttccaatcagaatgcatccctttcaggaa

SEQ ID NO: 55775 - DNA, 1222 bp, Bovine  19866881369267
tgcctggagaattccatggacagaggagcctggcaggctatagtccatgaggttgcactcaccccactggatgtttcctggtcaatcagatgctcagaaacaccaaaagccaaactcagggtatagaatgccctctcaagatactcattctagtcctggtgatgagaaattacagagaaattttctttcacttccatgtggttaagtagttctgagggcctgacgtcaaaatgaatttacaatgaacatgagcgactcattttcctgaatcataactgaaacgaagatgtcccaagtcttgttctagtcacaatgtcatctgactcagcagtaagtccctgctgatgtcaagtgacttcaaagggctggtctctaacgagccccatgtgtgacacaaattcttctgctcctgccctgtagtcttgggcttccctggtagctcacatagtaaagaatctgcctgcaatgcaggagacccgggtttgatccctggactgggaagatccctgaagaagggaatgaacccactccaatattcttgcccagagaattccatggacagaggagcccagcaggccacagtccatggagtcacaaagagtcagacgtgactcaacgactaacactttcactttcatatctatagtctgaaggacaggggttacaagcaagggaatccattcaagtaccatcttcagagactaagagttcttagaaaaccatttctccttctctaaaagttggtaagtaaattataataacaacacagaacatatgttgaatagatcaccatacttgccaactgaaacactccaggggatatgtttattcattttatataatctggaagcaaatcttttttatcgaagtaaaattttacttttgcctaacgatgcttcacaatcaagtgccaaattaaaacaggaagataaagaaaatgctggtgatgtgatacatcttgacagccttgtgacatcctagtgcagagggagaacaaagaacgcactatgggcatgagggtatccgagaattccaatcactcagcaaagaggtgctcaggcaccaactgaagctgggcttccagcagactggaatgaaacacctggcagacctggcttttgtggagtttgtgatctaatgggggctccactaagcaaacagtacagggcaataaaatccatgacagagaaaagagggggctacaagaggacaggggagcctt

SEQ ID NO: 55776 - DNA, 747 bp, Bovine  19866880621547
tggtaacagttagtgttatagatgtaatttgtacattgagatccatgaataattgatgcacacatcctctttatgtcattttataaaatttagaacataatcttattttaaatgactgtagagattttagtatttgttagtttttaactttggatcattttgctgttgaattcatgatcagagaagccaggcctaatggtaacattattgctaaatgaaaaaaagatccatttcacattgatatccttaatggtgtaacttgcagcaatgtcttataaagaaatgtggagattccttataggaaatggataattggagagacaagttaatcctggaactaacaagtagagagcttccttcccaggtggctaagtgggaaagaacccacttgccaatgcaggagatgcaggagacatgggtttgatccctgggtctggaacctcccctggagaaggaaattgcaaaccacttcagtattcttgccacgaaaatcctatggacagaggaggttggtgggccccattccatgggattgcaaagagtcagacatgactgagcacacacacacaagtagttataataacccatgaggtgattagtaaaatcaagtattttttcttaactagagaagtctttattgcattcattttccatgtgtataaaaggtttctagaaaatatggtaacaattggacaaatgtaactcctgtcagagacagacaccttcaatctgtaaaaaataaaacat

SEQ ID NO: 55777 - DNA, 1134 bp, Bovine  19866880663937
tagtagagattgataccagcagtatgaaacagaggcccattagaaagtagtatgtatagtgtatttaattgaatttaaggaagtcctattttatattttatgggcaattagtgttaaaacactataaatgcaggattttttttttaatctaaatcataaaataattgaaacttgattttcatatctcttccttctatcaatagtttgcatacttactttttgctatttcctccctactcttaacttttacttggatctttcgtggtaagaatgaactatgctaaaattccagtgtaaccacattttgtttttcccttctcctcttcctcatcttacgtcagagatttttattccattttataacctcaaaattggaaaataggaaatgaaaacttttacatatctaagtaaatttgataattttaaatggagtgatagttctggatatttccagcactcttcagtgaactatggaaaggctactacgaagatttgttttcattaaacctttgtgaagtttgcttctatagtactatgaaataaaattgtcctacactgtataaaaaggcaaattaatatgggcagaatctcaggcttgtgtttccaatttttaaattagaaagaaaaaaaattcctcttgcatttgtaatgaatgcatacccttactcttcaagtcccatttctttcctcatttatcctaggacctctagagaatccctcagattctcacttttcctctttagctattgtaaaacagcatgccctgtttttttttttttttttttaaactttacactattgtattggttttgccaaatatcgaaatgaatccaccacaggtatatatggtgttccccatcctgaaccctcctccctcctccctccccataccatccctctgggtcgtcccagtgcaccagccccaagcatccctatcgtgcatggaacctggactggcgactctttccatatatgatattgtacgtatttcaatgccattctcccaaatcatcccaccctctccttctcccacagagtccaaaagactgttctatacatcagtgtcttttttgctgtcttgtatacaggggtattggtaccgtctttctaaattccatatatatgcattagtat

SEQ ID NO: 55778 - DNA, 1962 bp, Bovine  19866880812397
tggggcaaatgagatacattcatcagtctacaaacaatatgcttaggatataagtttattcattcattagttcagttcttactgattactgatgtagtagtgatgctgaaggccaaatcactgttcattcttgccatggtttcacatctactacagaagacaagatcagtaactatatattattttcatttatatttggtttatttttcttctgtgatgtgatactccacatttccaacaggagtctttatagttttgcatcaaaaaataacattccatctaatttaatgtagcttagacctgtcaagaagaaagggcaagaggccaacctgctgactgactaataattttaggcagggtctcttggggattcagtatctgtatgtggttaatataggccagacatttagctttgcagtttgctaaaatcaattccatcagctcatctcaagtgtgatcaaactctgggggaattatttggactggaaaaaccacaagagatgggcatgcaaaccagagtatcaatttatttgcatggttgatgtacttggcagagtaagcatcattgatcagggtaatgcactaaggaaactgaattagagatgaaaaacagttgctcgcatgctcagccttagaattatgcaagttaaggattctcaaaaagtggtccatccagctaaattaattgttaaaataatatttttaaacagctttactgagatacaggcttccctaatagttcagttggtaaagaatccacctttaatgtaggagaccctggttcgattcctgagttgggaagaagccctggagaagggatgggctacccactccagtattctggcctggagagtccagaatgtatagtccatggggttgcaaagagtcggacaagactgagtgacttttactatcacttactgagatataattcacatgtcatacaattcatccttttaaagtgtacaactgaatatttttattgtattcacctctaattttagaacatttccagcacctcagaaagaaatcctatacccgttaccagtcattacccattcattccctcttgccctcagccctacaccttgaggcaacaactaatctactttcttttctattgatttgtgtatcctggacattttatatcagtggcatcctgcaatatgtgtttctttgtgactggcttattcacttagcatgttttcttggttttcctatggtgtatcatatatcaatactttgttactttttatttctgaataaaatcatattttatgaatatactaaattttatttatctcttcatggctgatgtatatttgggttaatactaatttggggccaccatgaacaatgctgctatgaacactcacatacaagtttttgggtgaacatatgttttaatttctcttgggtatttcataggataactctgggctttcctggtagatcagatggtaaagaatctggctgaaatgcaggaaatcccagtttgattcttgggtagggaagttcctctggagaagccatggcaaaccaatccagtattcttacctagagaatccccatggacagaggagcctggcaggctatagtccatgtggtcacaaagagtcagacatgactgagcgactaagcacagcacagcacaggttaactttgtgcttaaatttgggggaggcctaccaaactcttcttcaaaggagttgtaccatacttaattcccatcagcaattataagcattccaattttctccacatcctcaccagcacttgttattttctattgtttgttagtagacatcctaatgggtatggggtagtatctcattgtggttttgatttgcatttctctaactaagatcatgacatccggtcccatcacttcatggcaaacagatggggaaacagtggaaacagtggctgactttatttttctgggttccaaaatcactgcag

SEQ ID NO: 55779 - DNA, 1499 bp, Bovine  19866880929823
taggccatgattcaagctgacattttgcttccaaaagacattcttttcccatttattgcttttgacagttcaccccttattccctgaaatttaattctctgaaagaaaagcatctgactgggaaagagcatttttctgtaaagaagaggtttccatcatcagctgaaggcttgtcaattgttgggggcatgctcctgaatctatctacaaaataatctaggatacaggttccatgtgcactgtgacatctattatgaaagtatatctccgtgtgattatctagtcaattctaaccaacacttctcttccaagtaaattccgccaatacattgattctatttaaaaaattgaaactgtccttgtggaaaaacctcattgcatctttgtcaattatttgttgctttgactctaaacctcatctttattctcatcacaaattctttagaaaaactgttcctcccattcccataatgaattaaatagatcatgcttaaggcagtgacaatgaaattttgttctgaattcaaaataagaatacagaataaatacatgaactcattgctctagctaacattgaaagttagcaccatataaggtgttgtatgtgttttcaagcttgatcctaagtaaaattatgagaatgataaaatttcctttatatggtcctctcctttcttagcaattgccaccttgcatttatatccacctcatgtcgctacatctaacaatcttatttcttcttcttttttttaatatcagaaagctatcttctggattttatttcttactttcatgtttttaattgaagtatagttgacttaaaatattatattagtttcaggtgtgccacaatgatttgatatttttataggttatgtgcttagtcacttagttgtgtccgactctttgtgaccccgtgaacagtagcccaccaggctcctctgttcatgggattctccaggcaagaatattggagtgggttgccatttccttctccattataggttatgtatattgtaaataatgtttccaggaatgcaggggtgcctgtaactttctgaattggtgtttttcactttctttggatatatacccaggagtgcaatggctggatcacatgatagctctgtttttaattatttgaagaccctccatactgtttttcatagttgtcaattaatgtttccctcaaccatatgcaacagttactttttctctgtatcctcaccaacacttgttatgtattgtttttttgatagtagccattctaacaggtgatatctcagtgaggcgctatcttgcggttttgatttgcatttctctaaatcatagtgatgctgagcatcttttcatgtgcctgttggcctcctgcatttcttctttggaaaaacatctattcatgtcctctgcctagtttttaatcagtttggtttttgatattgagttatatgagttctttgcatattttggattttaatccattatcagacatataattt

SEQ ID NO: 55780 - DNA, 684 bp, Bovine  19866880972914
atttttccggtgaaggaaataattttttaaaaaattagaaaacgctaatgtgctatgaataaattcttttttatcaacttgaatatggctggttctaagaccctgtgttcttggtcgctcacaaagatggtaccgttattaaattgaaacagctgtatgttttagatcaaggttctacttctggctcttcactgagccattatatatggttcagagtagagaatcagtttagatgtaaagtgagttttcccaccaagtctttttactcaattctgtctctttataacaaagattcaaccagcagatggcactatttatttcagtgagacatttgctgcagaaataagcaattaactgctaaaagggaaaatgagtggaatccttcacattttattgtgagtctccccttcagtttatttgtattcaaataccatgaaaagatgaaaatcaacacagatttccttgtttaaggatggagagatacttgtttctgggaatttgtgtttttcaaataatgatataaggaaagacatgataaatttaaaaatattaatttgaggactttgctatcagcctttaaaatgtgaaatgcatatatatatatatatataaatttatataaatttataaaatttaaaatataattcagtcatatgatacaatgtgaaaattggttcctcaatg

SEQ ID NO: 55781 - DNA, 1328 bp, Bovine  19866881069310
ctggatttaggaaccagagatcaaattgccaacattcgttggatcatcgaaaaagcaagagagttccagaaaaacatctatttctgctttattgactatgccaaagcctttgactatgtggatcacaacaagctgtggaaaattcttcaagagatgtgaataccagaccaccttagttgccttctgagaactctgtatgcaggtcaagaagcaacatttagaactggccatggaacaacagactggtaccaaatagggaaaggagtatgtcaggggtgtatattatcactctgcttatttaacttatatgcagagcacatcatgcgaaatgccaggctggatgaagcacaaactgggatcaagatggctgagagaattatcaataacctcagatatgcagatgacaccacctttatggcagagagccataacaggaactaaaaagcctcttgatgatagtgaaagaggagaatgaaaaagctgacttaaagctcaacattcaaaaaactaagatcatggcatctggtcccatcacttcatggcaaatagatggggaaacaatggaaacagtgacagactttattttcttgggctccaaaatcactgcagatggtgactgcagccatgaaattaaaagacacttgctccttggaaaaaaagctatgaaaaacctagatagcatattaaaacgcagagatgttactttgctgacaaaggtccatctaatcaaagctatggtttttccagtagtcatgcagggatgtgagagttggaccataaagaaagctgagcactgaagaattgatgcttctgaactgtggtgttgaagaagagtcaagcgtctcttggacaacaaggagatcaagccagttcatcctaaaggaaatcaatcctgaatattcattgcaaggactgatgctgaagctccaatactttagccacctgatgtgaagaactgactcattggaaaagatcctgataaagactgagggcaggaggagaaggggacaacagaggatgagatggttggacagcatcaccaacttgatggacatgagtgtgagccagttctgggagttggtgacggacaggaagcctggcatgtttgcagtccatagtgttgcaaagagttggacatgactgagcaactgaactgaactgaatctttagggaaagaaaaacctcagtcatctaaggacacaatcagctttaaaaaaagacagtgcttttttgggaagtatgtttgacattttccacatatttcaagaaggtcctatacagatctaaatttgtagcagatggagaagcagcaggtgtgaactcagcaa

SEQ ID NO: 55782 - DNA, 865 bp, Bovine  19866881073375
aattgggcatttgcattttatctggcagccctagttcttagtaaagcatggaagatggaaaggggtgatgtttttatggaaatattaattactggatggataaattggcactgaagtgttccatgctgtggttcattaaagatcaaatgagaccagtttatttttttcttatatagacacacataattaattcagaataacaggggaaggtcagtctgaaatggtaagatattttaaagtaaatgatacaatttaaggaaaggagtcttccagagtgaagttaaccaccaggaactcaaaaatatttattgaaagaattatgtgagataaattgttcattatcatacagttggcatgactgttaattaattacaattgaggctgatagagtaaatttattcccttgaagaaaacagataattgtcatttaaggtccccagagggttagacagcaacacagaaaggaagaaataataaagattattggacaaagattaaaggaaaaaactctcttcttgaaacaaacccacaagataatagcactttattggatgcttactattgttcatatgtttgggttgcacatttttgccaaacagtttacataaatcagctcattttctcttctaatccctacagtatatctctatgagaaagatactcctatggtctccattttctagataaggaaatcagggcttaagactgattaagaaaattacacaaaggcaggtcagagtccttaatccagattttactaatactgtaaaattccatactcctagccatgaagtgatatcaactccaacaagtcaaagaccaatctgatgtgtatttaaacataggaaatatgttagaatataat

SEQ ID NO: 55783 - DNA, 770 bp, Bovine  19866881318222
tgcaccagttacattcaattgaatgaaaaatattaagtaaaaaaccatttagataagagggcttccctggtagctcagttggtaaagaatccacctgcaatgcagaagaccctggtttgattcctgggttgggaagatgtgctgtagaagggataggctacctattccagttttcttgggcttcccttgtggctcagctggtaaagaatctgcctgcggtgtgggagacccgggttcgatccctgagttgggaagatcccctggagaacagaaaggctacccactccagtgttctggcctgaagaattccatggggtcacaaagaaaactattaagtaaaatattttgtaaatgaaaatattaagtgaaaaatcatttagataagaagtacataaaccagaaatcatgagagaggtacacaaatgtcgcaatctgtgcaggtggtatatgaaaccattgccctacgcagtgccctagggcaaatgtcattgccctaggcatctcagattctctctaggaatgagaaggctggtccagaaatccctaagatcaactctagctctaaagcccaattatttttaacaggcttgcatttttttctttatccttgggcccatttactgaattttaagtctttcagccttttccagatcttaaagacacccttcttaactgcccccctcctctgtcagcaccaagcactcatgcattcattcatttatgccgggtactcctgaaacaaatactctatggagaacgtacatcctagg

SEQ ID NO: 55784 - DNA, 918 bp, Bovine  19866880498054
tgcaaggagcccaggtggcccctggaacgggcagcccgtgacctctccaccagggacccaggccgcccggggccggccccttccccactgcctctgtcttccctgctgtccctctgagccagccggccctccactggggtttcctcgcactgtctctccccacctcccattctctgccctggctgatctgtttggaaagcccttgctgcctccatcctcaggggagctccatccgtcttcaaggcctggctccctgccacctcgagactcccgaggaccccaggcttcaaccatgtgggcgtgctgggccccccggccttgagtttgtcaactcccagagaacagctcccatgtgtatgttttacactggaagcaaatccccaagcttcatgacaacctgccaggggaaactgaggctcagactgggtaagcaacttgccacattagacctaacttccaagctcccctgttctggcccctcctggggaggccgctgaccaaggcttgatagtctctaaggccccccacccccattgcctgcaggacagcccggctaagtgacaagtgacaagactgccgtggctggttctatggaaacgtcttggagttggacacggtggtccacccaacccttgtcctgacgagggtgtgtggtggggggggggtctgggacctcctgtggacacacagagctgaaccattcgaggtggggacactgctgttcctccacttacgggctgaggagaggacaagggcgggccagagggcttccttatagggttgccagattcacaaaatgaaaatacaaggcactcagttacactgagtatcttaaatataagtttgtctcatatacttcatggacatacactaaaaaatcagttcaaggtttatcccaaattcagcttcactaaacat

SEQ ID NO: 55785 - DNA, 982 bp, Bovine  19866880517305
gtagtgaattcatgaataatcaatgaaccagcaaaggacaaaaagtgacatatggcagcctggtgtggattaagtgtgattgtcactttcccccttcccacctttttcctttctttgatttattgaaagaaacaaaggcagcctcacgtagccagaacacagtacctctggaaaaatccatgtagacaaagtgtttaccagcgagtttattcattaaatgtctcctcttctctttggttgttttaataggccagcccaagttgtttgtgttaattgaaattgtattcaaaatgaaagtttaaacgagtaaaccagtttctgtttttttaaaaattactactgtacagtattttcaaatcagtaacacgtaactagttacgctaatgttgcacagtgttctcatgcttttacctagtgtgtaaaccaggcgaggtagaaggcattcttggtttttccctttgtagcaaccaacagtttattggagtcaatgatgattttattatttttaacaaaaaaaaggaaaccccaacagatttcacgaaattccttggtaacaccaaggttttgcagaataataatctgaggggctgttaatgggaaggtgtttgttcacagcccaaataataaccatagcattttaaaacaatattcttcctggcagctattgaagggtgggattttagtccagtgagtcagtttgcaccttttgttcacctggctttgtgccagggatctgatcctgaaagatttaacattggagagtctctgaatagtctgattctccagtctcgaaattctgctctagtttttccaaaccccttgaaattgtcagaggaatcagtggtaagattaaaaaagagattatttgctttgaatggctcctcctgttcctctactttccaaaaagttctggaaacttactcttagacatgcagattcccatctgattatgaaatattttgttgatttatttgtaaataat

SEQ ID NO: 55786 - DNA, 835 bp, Bovine  19866880520080
tggagaaagggggacagctggtgaagctgccttcattatcttccaaggcttccagttctggaaagttctggctttgagagagaactcaaaaccaagagttgagtcgtgagaagcagcccatcacacaatctgggacttgggtttctgtcctctggtgttcagtcaggagtctggaatcagggcctgccttttgtttagcttagggaggattacattcaacacatgggaagaaaaaaaaaaaagaagataacttctcagaatgtgaacaacatctaatggaaacgatgctgaactgggaatgggagaaatagaaaagctttgtgaagaatgcagttcggtcagaaagtcagagtctggagattatgtccttctagttccagcattctgactgcgtgcagttcaatgtaaaacccagtttgaaagctagtcttgcccaacaatagattttcccgggaagagggctattttcatcctttgcatttgtaattaccatgtttgttttgtgtgtttgccatgcggggacaagaagatgcccaggtaggtgtgagtgctcacaatgatacaaaacaggaaagtgtgtaagaacgaggccaggaacacctgtcatagggtacccgctggggtgtctgtaccacgtcctttctgaacgcactgtttgcacacacacaaaagggttggggctggatatgcccagtacgcgtgccgagtgttggaaggatggggcccggcggtaacaagaatcaatatatatttacggcaggggcgggggagaggggtgcgcggaggctgcagggcggggcagcgttaatgagagcaagcccggctttgtggttgg

SEQ ID NO: 55787 - DNA, 1385 bp, Bovine  19866880535256
ttgccaagactgcgggcccaggagcagaccagaacattcatgcaccttctcatcacgacgttgtctataatcatgaataattagaccaaaaaaaacacttaaatgtctttcaaaggggaatagctaagtaaattatgaggttttttaaaattattttattgaggcatattttacatagtatataattcccaggcttcacagtgtgtaattcagtgggttttagtaagtttaccaagttgtacaaccatcacagtaaacccattttgaaacatttgtatgctttcagtagcatcctcatgcacattacacccccctgcccaggcagctatttctgtgctctctttctctataaatttgcctttggggatgtttcatatagaaactatggtttatctattcacaaggttgcagaaatgaaaaatcatgaggtgggtagattaaaaaaacccatcatggaaaaaacacataagccatgtttaaaaaaaagtaagaatcagtagaatgtgtcctgtgttaccatttatgtgttctttaaaaatgcatgaaactgatacttttgtatgcattttaagtgtggtttttaaaaacaaaactgcaaggatggagtatgcccacatgctaagagcatgcctccaggtgtggctcttggattggggaatggcttgtcaatggaaggtatttgctttattttcattatttgcattttttgcaaaaataatgtttttatgtattttgtaaccaaagattcttgaaatatttttacttgaaactttgttaatatattttaccattttaggtttagttcttaaagttcttaagctgtttttatttagctttggaaatgctaaaatgagctcatattaaagattttactgtttattttaaaaaatggatttcagcatgtaaatagacaaaagtttactacacacattcaaattaatagtctatctaaataagaattcctagtgtgtataaatattagaaacaaaaagactcaactattttcagtgagtccttttcctcttaaattgtgcttctcctcttttctagtgcggctggaggtgaaatctttgaccagtgtgttgcagatagagatgaagccttcacggaaaaagatgttcagagactcatgaggcagattttagaaggtgtttgcttcctacacgctcatgatgtcgttcatcttgatttgaaggtaagaaaactgaatcactttacagttttaaggctgctggaaaatcataccccagatgtgaagtgtttcacagtgatttattcaaacatttgtcaggtctgcatgtgtcattgggttacaaggaagtaagagttgaatctttattcttatcctctagccagtgtttcagggagaatatgcacacgtgtgt

SEQ ID NO: 55788 - DNA, 980 bp, Bovine  19866880578739
cgtgtccgactctatgtgacccaatagacggcagcccaccaggctcccctgtccctgggattctccaggcaagaacactggagtgggttgccatttccttctccagtgcatgaaagtaaaaagtgaaagtgaagtcgctcagtcgtgtccaaccctcagcaactccatggactgcagcctaccaggctcctccatccatgccatttccaggcaagaagtggggtgccattgccttctccggagctgaatccctaaagtcatatatttaatttcatgcaagaggagactctgattttcaatgagacaaagagtttgcttccatgcccagaattatatagaaaaattgaataaaacatgctgcttgcctggataactaaaacattctgagatctgctatatcctcatccaactgattaaaataggaaggtaaaggtttaaaaggccttgattatctgagctgcacagcccagagaataaatgaatagtggtatcactgtgctccaggcaaaactcacagtgccctattgaccccttaactgtcataccatttccttgtctatgcttcattatataatgcacagtattacatgaaaactgaatcaggttaaaaaaataatcaactggatataacttaagcaacttttaggtttttcatccatccatccatccattcaatcttctaacaaatccatgaaaatggtttcaataggccatttgtgacgcactgtctagttgctggggtccttagagtgcaacagacaagcgcgtacagcctagtgacattatggttcaggaaagtattagaattactgaacgactacctaagtctcagctaaagtgacattttgtactttctacatgactgtcgaaatagtaatggctctgacaaatcacatcctcatgctattctggaagtactggtgcaaccagataccgggaatacttgaagctatttatgtaatggctctaaattaattgta

SEQ ID NO: 55789 - DNA, 1884 bp, Bovine  19866880595961
atccagttaattagtgcctagcagagtgaagtaaagcttggccctggaagacatttttccttttcccatgtggaataaataagacacttttaaggtcagtttctttgccaaaaaacgatttctaaaggttactttaatatttgtaaggcggcttgtttttaacgttgtaatcactgttataagacctttttccaagaccctcaaacgaaggctgttgtaactgtcaggcccattccccattacaacatggtgagattttgcaaccttgataaatgtctgcaacagctgctaacacttatcaaatgctgtgtgccaggaccagtggtttgacctgtacagcccctgcaccttctggacacccccatgagggaggtactgtcactacactgactgattttatgggtgggaaacgtgaggctggggagactaagtcaccgtccaaaggcgcacagagcaagcagagtggggatctgagctcgggtctgaccccaaagccagtgcttctgacaatttcttcagaaattgtcttttttctctgttcttagagaaaaagtcggtccccagacctctactgttccctcgtcggtcagcagttaaaaaaaaaaaaaaaaggcaagcaagagagaaaaatccgcctgcacggagatgctggttcaatccctggtcgggaagatcccctgcagaaggcaatggcaaataccctactccagttttcttgcctgggaaatctcatggacaagaggagcctggtgggctacagtccatggggtcgcaaaagagtcggacatgactttacgactaaacaacaaaacctatcactctgtgacccctcttcaacgtacaagacgtaaagtatccaaacagccttcaccttttgcgattttaaaagcagaccaaattctaagcactccctacccctacaaaacaacaacgagatggggaagaaaagcaagggctgaatcacggcgtagaaagagtcagacaagggcccagagtccacaagtgaaaccgatctgaacttgaaaaagcacacggccctaaatatttcagaatgcaaacagcacaaaccccaagaaatcgcaactgaagtcagcagaaagcggctgacggaaactggcccagggctggtgcgaaagaagctgtcacgctcggggttctgcgctcctctgtcacagccacggagggagaagcaggaacccacaagcaaaaccaaagctgactccacacctgtgctgacttcagactcgctgccgcggggaaaggttcgcagcgcggttcccacgccgcctcgttaagttaccgcgcaagggaccacagaggctgagacgcccgcagcagagagagggaggggtcaaggttctggggggagcctttctcatggccgataccacggctttgggggacgccgcgcgtggactcgtggccagggggccccgccgccctaatcgccgcccgcacccacgtctgtacccggtcccggcgcgctatctgcccccgcgccgccagcctcccgcacttatctgcgcgcgcccgccggcctcacctgcccaactcccggccgggggtcagggtgtaggcgtcctgaaagggctcggtgcgcacggcggtgcggatctccgtcagcagcccgcgggcctgggtcgggggcggcggccggcgcggcgtgctcagaccccggccagctcgacccgagccggaggcgacggccggggaagagccgccgctgcccggcttctcgagaggaatcatggcgctcgggcgtgcttttcttgcctgccacccggctcgctcggagctccggcgggtaacggccccgcctccagctgcctcgagccggcgcgaggatgccacccgctctgcccggagctgcgcacagactgcggc

SEQ ID NO: 55790 - DNA, 847 bp, Bovine  19866880639014
ccccgggagggcccctcccctcccaggtccagccgctcggccagttcttctgcacttagggcgggctctgtgtcctctggcccaggggccagcagctccccagccccctcaggccccacagagactatgccatcatcatctcctgcctccgtggtacctgccgctgcctcaaccagactggtaagctccaggccctcgatctctggagggcccacagtgctgccctggctcggctgctcaggctttggggtccctgagggctctggtgcatcacacgggggctccccacagctgcttgccaccaggttattcatggggctgtcctgaatttccgcagactcaggctcggtactcagggaaatctcctcatcatctgtggacaagaagaaaatgtcacagcagtgttagtctactcccaaggatgtgtgagcatcttagggatttctgccttaggatattgcatggaggggttgatgagcatttcccatggaccaaagctctgctaaaacccattctgtaagaaatggttctccttatgcaatcacgatgtatttgacaattctgtttcaagggacttcagtttttggtcaaaatgcccaaatcctagtactacccctgttctgggcacaaagtaggtgctcaataatgtctgttattcggaagacctcagagatgagagggtggggtttacagttccttgttggcttcaggcagggctaattatactagtttagagtgttttctatggctgagtcccccagtgtggcagaatggggttcttaggtgaccagagagaaggaaagggggcaaccacagtcattcagggctcagagcggaagcctcccaa

SEQ ID NO: 55791 - DNA, 1343 bp, Bovine  19866880652692
taaatgcacccaaaggaactacttgatatttttaaaaggcttctcagtatatctttacatccaaagagaaaattcagaagtcccagcagggtataagcagatgagagtgccatgcattgggaaaaatgttcttttagcaaaagtcaagtgttccccaaatggggaagactaggggtgggagtaaccgggtgaacttcgagaaagcaactctgacagcacaacagactgggatgtgccataagaaaaggacatttaaagtcaccacactctgactgtccctggacatttagcagcacacaactaggtcccaatttaattcttcctgaatataatacacaaaatgctcattctctaaatgcattcctcaaaactcactcattaagaaagcacccctctgggtgctctggaagtggtgccctggggtgagatggaagagaagggctgagcttgaggcctgctcatcctgctacaggctgggcaccaccgggacacttaaggaacatcccccatgcattcttatcctcgctgaacggttatttcagggattagttgaatctgcacttgaatatgcttagtacatatgtgaggcactgtgcagatgtaacttttattatttgtaaacaaaagcctcatttcaagattggctgagtgcatgctcccagggcagcaccagggcccacggacaaggatgctagctcagaaagcctggatgcgtttgaatccctgctcctcacttacccactgggagacttagagcagtgactgagccctctttggcccagttctctagtacatcaatggtcatatctacctcttcagattgtcgtgagtggagaggaactgacacaagaaaagtgtgcaacacaaacgctgatgcaccatgcatatgtgcaaataagtaaatatgagctgcgatttttacaagccagggctgcgcccacaagtcataaaactgtgcaatcctagcagcagaggacttagagggacgtttgaggggatctgaaagaaggatcctttgggagagccaccagctgcttgaggtccactgcaatgagctggtaacctcccagtggctggttccactcagaatcagcaggagaaatcattgctctggtctccaggtgtgcttctccatgcccgtatcaactgcaaagtattcacccacaccccagcagagctccgagctgtcattccagaaggagcgtcagagagtgttcgcttccgggtacaaattcacttgtgacaaccgtacattcacatcacacaagaagaacgcaacatgcaaagaacatcatctcaaaatggagcacagtcaaatttggggtgagggggagatgcaggca

SEQ ID NO: 55792 - DNA, 907 bp, Bovine  19866880682888
aggaggatgctttaggtgaaaatcacgaggattcttttatcacatgagcatttggaagacacttgctttccatttttccccatcaatatctgagtgtcattaataagaaccataaagcattttcattggcagcatatttctctagttattcccacagaaagaaatcacattacaaggaagaacatattgtatataaatgtaccaaaagccatgggagtgtcctttcatggtgtttgcaactaaaaatgcagggaacacaacaagctcattttacatatagatcatgttcagatgccacaggcagaaatggcctcaagatctatcatgccagacagataagttgaacatatttaaagaaacagggagagtaccatcaggttgtatctatgagaggtccagttgaaacactaaaacaaaacataagcagaggtaaacaccttgactcatgacataaaaatacttggaagtttgttcacgatgttcagattgtataatataaaaatgaagccaaattcatccttaaccaggcctctagagaagtgtacaggctttggtgtataaagccctgtgccctccagtggagctgaacatgctgaaaaaggccagactttgatgaacatgaagctatatttgctgcatccatttggacagataaagaaatcgagcaatttgagaaggtgcttatttcttgtgaaaaatcctacctagggaaacttagataaccttgagataagtatccaggctcttcaatgcttattttagcctattgccctccagcacttacagtttttcagtgatttggcctgataacagcagccacacgaagtatactgtcagtctcgtatccgttgcggatgtgaccccccatagcgggcatttgtttgatgacctacagttataaggaaat

SEQ ID NO: 55793 - DNA, 1261 bp, Bovine  19866880729068
tccagatggaattgggcatggataagtggaaaagagcagatcaagatcccatgtctctatcaataaggaaatcactggaggtcagctttgcttgtttatactgcagtttgcaatgtaaattaccattaataaggaaggataacagaccacacaatgtttgtttctttcaccatcttatcttggtcaagtaagagaagtcattagtcatagaacatttctggaagggtacatataaaaatgcttaacagtaattgcctcaagtaaaggacaggagtctgacaggaaagagaaattgacttttcactctcaaagcagaagtcactgtgaatcatactttgcagtgagctgcttttatgacaaaagtcattgtatcaactctaatgacagaggtcatcatgctggaaactggcctttggggagggtaacttttgcacagcttcttaaaattgggaattttcctcttgattccatgtaacctatacttgattacaagtttctttggaagtttgtaaaatccagataacctatgaaagtacacttttgaattaaaagtggtatctaatgagtgtagaaaatataggcacagaaggaaaagaaatcaaaaggctggtataggcctccatctggagaaaattcctggtacacaatgaagtaaaacagctgacttgtattgtctatgtttttgtatcttcctttaccattatagcgcattgtagatagtttccaccattaaaattcttctgtactttattctatggattgccataatttaattcaaaactttctcttgtacattatgtttgttgcccactttttgccattagaaatatgttgaaaaacctcatagatcactcttatttctgtatagttctgcaaacgttgttaatgatctacttttagaatacaaaaagaatctagagatgaacataatttcattacttgggcttttcctctgaacttgcaatttttatcaccaggtctccagcatttttgagacagcattagctgatgatgaacccaaatttagtctaaaacctgcagttttcaatcacagattttttttaaaaaaaacaccagtttacatttccaaattgtaacacagaagagaagcttgttttccagttgctggaaacttattttctgagtatatctattctgttttgtctggaaagctaaatgtttgaaatttgtatatttgcaattatgattaaagctatctcaacatcaaaaggaaaagaaatctaaaaagcagtcaggtggg

SEQ ID NO: 55794 - DNA, 894 bp, Bovine  19866880763464
tatgctacacttgaccaatggtaataaatgtttacttccatttctatgatttaaggggaaatttgagcattaagtattccaagcttttctacacccatgtcttctgagcagaactaccatttttttttgtttttataatttctaacaaccaacttcagaataggagctgatcaactctttcttttcttcccattctaattttccctgggcatccaatccatccaaaaacagcagtggctaaaccgaaattttgatatattcaactcgtgatttgtatgtggcatcagccccatcagctggaactagcctagacatatggtgcaaatatcatactttccaaccaataataacagcaagaaaaacacctcctgctgatgcaatgcagggcatcccagtggttgtggggattatggttcgacttgagttcagagaagtttggggggtggggacacaccccctgtgaacacccaccacccaagaagcacaaacttgtgcacacgtccaagaaggagatcacattatgtagcataaacaatgaggcttctaccccctgatgttgtatagaagtgctgaagcaaacaggagaaagggggaaaggacatcaggacggtttagaaggacatattcagttgctctgaatacctgggttctgtactgttttattttgctttgtttgatcacaggtctctttcccagaggaaaaaaaaaatgtcttgataatatcatgacttccattcaagccaagtaattacttgtttggcaaacaaacttttatttcaactttgatagcatttttatttttcatgtttacttttcagtttttcttcaccatggtgttcaaattccttcacatctgattgtccgcagggaccacactaaatcagaagctgcaga

SEQ ID NO: 55795 - DNA, 950 bp, Bovine  19866880785599
tggctgttagggcaccaatatagtattcagaaaatagattagtaacaaataagcattcacctgcattttctcgacatatatttcagttgaagaaaggaaattcttctgaatagagaattccaactaatgaacacaaggagaatgacaggtttataaaatcacctggaacaagataagcagctggacatagagggtcagagctcaagagggcaatgatccctggaggtacacccttggaagtcattaggatatgatgtatgacaaaacccttgggaatctgtgggactccaggaaagactggaagaaaaccaagagtgtaattacctgtatgaaggaatgggtggaagaatcctctggaggaaggataactagtgagaataactgagttgaattaggcagggatgtatgaagagaaacacgcaagaacaaactagcgatacaaagtcaagtgggaagggaaaaccctttccctttaaggaaacgatttggaaattttatgagtcacctattcccaactgaaacttaatctcatgactacatctgggctgccaagaagactagataacatggtctgttctgggcagagtgtgcccagctaaaatttggggcaccaaaagcaggagaatggatattgaggttgatgagtggtttgtaccccagtattcaatttagagccagttatgattacggagcagacatctactccaaacaattaaaaaacagtggtagagaagtccaggttcccaatgcaagtgataggaggtagatgcgtttctcagtgtggctcaaatcaaaatctgagtttggaaagacagagtaaaagaagtgaacaaagtcatgaaactcgtgaagaatttaatactttactgcctcctgatatcctagaattgaagagcaaccttgaaacttaaaggtcagaattagagtaatgggtgagggtgaagggtgag

SEQ ID NO: 55796 - DNA, 1362 bp, Bovine  19866880814795
ttggctcttaccaatttatttgtaactctgaaagcacacttgtagcactttctgatcattggtggacttgagcagagtgtcaaaaaaattaacttgcccaactgtgcacgtttccagctgaggtccaacaagataatgctctgccttcttgttttatgtctcatactaaaagtatgaaaagaagtgtccttttcatgggaaattgaatgccatgtgttttgtatttttgtgctttttgttggtaattttgttgtttaaaatggtccccaagtacatgaagtgttgccttgtgttccttagcgcaaggcagctgtgaaatgccttatggagaaaatatgtgtgtgagataagctttgtttaggcacgagttacactggtgttgacttaaagatcactgttaatgaatctataatatatattgaacaaggtgtctttaaacagaaacacacagaaaacaaggttatgtattgactggttgacaaacgcattgtgaccagaggcttcctagtcctgtatttcctctaccagcagttgttcacaattcacaaattcagtgtttgcagtagcttaacagaacatactacaccaaatgaaagttgactatatttaaatacttgaaacatggtttagaatggcccaatctaaaataccagaaagagttaattttcttatgaataccattctcatgagtatggaccaagattgtcctaaaatttaacaatttattatacaggcctcaaacccattctgcctattttaaacattctgttgattccagaacaatcaactctcattccataaataaatgatgaactcgacaatatagcttgatgtggctcatatatatgaaggcattattgcttaagctattataattctcttggaaacaaaattctaagagtctatttttgtcgtttatttcttatgaagaaaaaaatgtgttcaaaaccacaccatcagtgtgacagcactgagttctcaagtgtagtgtatggcccacagttagctgtaggaagcatttttatatctaagaaacatctgaaaaaaattaaaggatatggaattagttactacttaatctttctgaggaataagaagaagtttattattgcattgcctaatgatctgagttgatttttataaggttattaatcctcccaaagatttcattgaattgccctaaaatacattcctttgcaatgaagagaaagaaatctcctaaacagccaactgaggtatatgctttctcctgggaagtggtagaaagaaaactgagctagaagtcacgagccccatatcctttcctgacgatcatatttagagtcattctgagttgtgtacatgcactcttgatatatattt

SEQ ID NO: 55797 - DNA, 1176 bp, Bovine  19866880823676
acttacattacagataaggaaggagatgcctgagacttgccttcccgtgatcacatctggccttttagcatttcccataataacagtaatactgatgcaagtaccatagtaggtaaatcttaaagcagtctttgaaaacacccatctttcaaagccagaagtgtgaaaggaaccaagtgatgctacatacacacatcacagcagctgcagtccctcaacactgatgcggtgataggctatttcagctcaggatgtggtctccttatccagtcaataacgtcacaatctgaacaaacttaggcaatttgcctctatgaaataactaccccagacaaaaacagcagtcattccacagagctgccaacttgtactagcctgggatcccagaattagtcagaacacagtttattaagcataaactctgaagtccaatatgcctgtaggtaggtctaggaattaaaacagtgctatattgtcccaatgccacactccggaggaggcagcaagcagaggaagggggcaacagggaattctacacattatatttctctaccaaacaggcacacacaccataccagggtagacatgtggactctaatcccttcttagtggaaaacacacattttcaaaatgaatccccaatctagaacgaattaccgtaatagccacagccggagcgagtccgctgaggagaaacgcagatctggccacctgctttgagacgccttggaccacgacactgccggggtctttaaaggctggccttttcgggtagggcatctgccctcctaaatcgccttaagattccaggaaaagagagaagatgcctctctcagtctttgaactatgctgctcttcctgtatccatttctgctgaacacagccttatcttttcaaagagaaaaaaagataaaaacaagaggagaattgcaccactgcagatcccaagagaagtaagcacaaaactacagcaacgtcaaataatatcttcagcaactaggaaaatccccacatgctgtctggtgtcagcccaatgcagactggggtgcgctgtgcccggaatcacaggaagccgggcagctctgcagcctgtgtccctgccagctccccccacgcgctgaaattcgccaggaagaacttatgatgcccagcttctgtatgcaagacaggcaggca

SEQ ID NO: 55798 - DNA, 1759 bp, Bovine  19866880853051
attttgtggaaaaacccgaacaaaccctttggccacccaatactatctgatgccctttccaggcaggaaggccaggagatggggccagctttgaagctggtacaggaagtatctctgatgctgagtcatgcagagagagattgatagcttacaggtcaagaaaaccctaaaagggtcaccggaacctggaaggagacactgtgggataattgttacagggcaaagattaatgccagaggttcaaaccagaaagaccacagcagaacctttcagacttgaatcgttgcctgggcgctgttttgagggtgttattccatttttatatcgctttcatataagaggattaacgagaagccttttaaaagggatttgctgcactatccaaaatgtccttccagagtaatttggtatttctataaaattttattgaagtatagctgatttatactgctgtgtaattaggccttttattttcttcacttggcaaaccatcctacttccccttccataaatctgatctgtgaacaagaaattcctctcccaaacatcctgaattctttgccattatgcaaactgcttttgtttaaacaatcagttgaaaagtacaccgtgaaatcatgacatcctacctcctgctaaaacatgtttccacacaaagttttgttagagagacagacggaggagagagaaagggagggagagacctgctagttcagcttctgggggtaaaacatgcatcacatccatccattgactcagtgacctcaaatctctgcagtttgatctttctgtacatctttctgaatagagacctactctagatataagaaatgtgaacaattcgcttcactgagcaaacttcaaatggtgcttaaaaaattttcagtaggtttgtactgaaaagtacaaagcaaaagtttgcagttctgcaacagcaggaatgtgccggctagtcctctggtccaatccatattctcatccttcagtcaggcctggatgtgtagtctagggtcctgagcctgggaaagggatcagacatgccatctctgaatgaatacccaggtaggctgactactagtgggaagtctttcagcagttgccctgtactgtagatgctattatgatcccatatgcagatgagtaaactgaggctcggggatggtaagcagcttccccaaagtcacacaggtcagaagtgttaaaccgagacagcctgataccagaactttcaactttgtcctcaccaccacactgcctttcttggattactggcaaactgcccaaagagtaatgaatcaacagtaattcactcaaggggagagtcatgtcttttctgggccttttaagccatgtgagaagatgtgctagaaatgtgtgaaactccattgcctttgaacactcactacagtgtacaaaactcagatggaagtgagataaacccttgccagtaacattggttgctttcagatctgttgccatgatctccctcagcgttgttaggaaagctcagagtggcccgcagttgcttatcagaggtaactcaagttcatctcccagacatctggtgaggtgctgatgagactgcttaaagaatgatatctgcccatttcaaagtttctcctgtggtcccagagttgactggctgtatgctgtccctgctctaatacctgtgagcagacgggtaaagatgaaaaccagttaggtgtccatcagaatgggaggggctaaaccaagcacaggacattcataaaaataaata

SEQ ID NO: 55799 - DNA, 2674 bp, Bovine  19866880886768
tttgtgtttcgtttcccacggtagggactcaggatgaagtagtattttgtggctgaccccttcatggaagacagcaatttgtattccttcttactgatgttgtcagtcaagatgaatatggccgaagagatttctgtcaagagcttgaactgcagccagtgagacccaatgtcacctctcaagtttaggaaggccatgggctctgggaaaatgtccaagtcctccctgccactgggaagaaaccaggaaatttctaccagcccgtctgctatctcccgagggttagtgcccaagttcagatcccgatgccagaaacagtcctgctgcctgtggccagggctgagcacgtcgttgagaagctgggatttagagttgctgctgacctccatgcgcacaaaggcgaaggcaggtgctcgggacaggaccatgctgtcttctctgaagcttcccatcacccttgggggctgtgacccccatgtccgcacagtccccctcatggcccacagcagaaatgtgtggtagtggttttctgggtcaggcaaaatgagagggagtgcaaactggcagagagacatttttgacacaatttcctgttgcaggaaactatcagaggaaagcagaagggcacagagaaggtccaagggattcacaggtgtgtcgggtgttggcagctcggagaaggaatagatgtctgctgagatgtcctcagccgtgtcccagtagatgatctcctcttccatttggctctccttctccacaggcctggtgtccaggggaaggtccaggaccatggtggtattcctggcttcagcattgagggcctgcagcttcctgaggaaattccagggcaagtctttgggagtctgaggagcccagttcttcatgctgtcactgctgatctgtaaggcgtcctggaggctgagtttctgtgtttggtatgtctctagtcccaaaaggaacagcatttcttgtagtctgctcctctcctctgtggagagaaatgaagatataattacatactctgcatgtcagaggatccaggttagaggtggggagggagagccgaactcagcaggtaggagatggcctccttcagagcaaaatgcaggcacccctaggccacctgagaacaagacaaaggtaacatcacccaccccagacccaagtgtggccagatacatgtgacattagagacgaaaaagaaagggacatccaggcgctacatttaagaattgggagattttatgtaaaaaattggctagagtgagcagctatgcacttgagatgtggaacacaggcctcattctctggccataccccgctcccttcaacatactcctgtgcttctggcccagcagtggattccctcacactgttaccaggaactttccacagtggtcacaatcactgatgcactgtggttttctggttgatgttcttttctgtctacaaacaagctggaaattttgtaaaggaaacagggagttactcttggtacagagtaatagcaatcacttttaaataacatttctccaaacttgaagctgctagtatggttctaaattttcactgtattaaaatatttggtagagatcataagtctgtacttatttgttcagattttcagccataacatccaatagagtatgaattcttacaagcactagatgctcagaacagtaatgtcacctgcaaaggtttcctccaccatccctgttcttggccacagcaccttaccaattttcattgcatataatttactgcatataatttgttcagtcgccaagtcatatccaactcttcgcgaccccatggactgcagcacaccaggcttccatgtccctcaccatctcctggagtttgcccaagttcatgtccattgcatcaatgatgtcatacaaccatcttatcctctgtcaccctcttctcctcctgccctcaatctttcccagaatcagagtcttttccaatgtgttggctgttcacatcaggtggccaaagaactggagcttcagcttcaacatcagtccttccaatgagtattcatggttgatttcctataagattgactggcttgatctctttgcttgagagtccaggggactctcaagagtcttctctagtgccacagttcaagcatcaattcttcagtgttctgccttctttatggtccagctctcacaaccgttcatgactactggaaagaccacagccttgactatacggacctttgtcagcaatgtgatgtttttggtttttaacacactgtctaggtttgtcatagctttcctgccaagaagcagttgtcttctaattttatggctgcagattttagagcccaagaagaggaaatctgtcactgcttccaccttttccccttctatttgccatgaagtgatggggccagatgccatgatcttagtttttttaatatgtagctttaagccagctttttcactctcctccttcaccctcatcaagaggttctttagttcctctgtgctttctaccattagagtactataagctatgctgtttcaaattaccttataaaatacttttgtaatacgatattttataatgaagattcattgagtgcaaccaaatgccaacactttagtaaagtatttaatcattttagttaatattgagttaatatttactcattttaggt

SEQ ID NO: 55800 - DNA, 1281 bp, Bovine  19866880887150
ccaacaatcatccccttgtaatcatgcttcaaagaagttagatgttttttttctttcttgaagagatacaccataaatctgggaagacttaaggattgatattttatcaatttcacttttttttgtttaaaattttgagatgcttttagagtcacatgtacttgtaaagaaattaataaagagtgatctggtataccttttagtcagtttcctctaatgggtgattaaaaaaagattaataaaaatactgcagatataacttttttctctctctgattataataatgtgaatccaaatcttcatcataacttgcttgctttcaggtaaaatataatgaaattgaccttttggtgtgggtactttttaaggagacaagagaaactttttggcttcaacaaagatacacaaaataggattaaacagagaaacgcactgtggtccaacctgtcagtatagatagagcaccgttgtggtaaatgttatttccaaaacccaggggtgctcatagtagcttctctgatgggggatttggaaattggaccaggtgaaagcccgggcaggggtgtgagaaccacacctcctccagcagccgctcctccttctgtgtctctgtgtccttgactacatgcgcccgagtgctgtcctcaaatcctgacaccacctaacagccctcttctctggaggactcttgtggaccctgctcctctggtttactgacttcagtcccatgaaggactgtcaaattgatgtgttctcccaatggcaatgtccctgggacaagtcactctgctaccccaacagacccatatctgggtatgcccctggtcttcctgcctggggaaaaagggagagaacattttaggggacactctttattcccaggattcctggggaaaagaagaccgaagagagtcaagtccacgagggcagcagggtgccttcctcaggcaggggaagaggcgtcccctgcagtagttctaccattgctccccacactcaaaccacatccacatgtcagaaatccaagcagagttttctgagagttttggtggctcttcaggggacatgacaccctctgtcatgtttgtgaaaatctcaggcagatctactagtctaaggggcctccaaatgcccctgggtccagcccaaaggcactggggcctaggtgtggggagatctctgaaggtgagaatgccatctgcctctcttgcctgcatcccatcaagaactctccagtgcaaagttcccatcagagctctagtcagtagagccacctgctt

SEQ ID NO: 55801 - DNA, 2603 bp, Bovine  19866880899837
ctgtgagctgcccatgttcctgccctgaaggaagacagaccaggccctctcacaagacccatgtttgactgactgtctgtagaggagttttttcctattaaatatggggttcgtggtattttgctatacgatcatctaattgtgatgtcttaggtccaaatgggtttctgtgaaatcatctctgatcagtaaataaatagaaaaaaatggctcatgtgtttcttaaagtcagtaacacaccttaaggtgatggcaaatcagaatgtcctagggagttttcatgtgacaccaagagggagctagaggaaaacactctcttcctccatcccccgccttgaggattactgatggagagaggcatcatttctgaccctccagggtgttgtattcttcaggtagttaggatggaggaaaggctgagccccaccatctagtaccaggggacggtcacagtgagacccagcctggtgtagctagcatgtggatttagacatgcctgggacgtgcagttgggggacagccttgtctcctcatgtcctccatgtcatgtgtgcgtgtatctgctgatttacctgatagctgaggcctgtccagtgaagagaagcggtatagtgcccatcactggaatcagaccctgtgggcacatcccacatgcttaggaaggagcgggggccaacaggaggcacactgcaagcagggcatctggggtttcagaagtgatgtgatccaagaaaagcagaagagccacccaacaagtggccagcagcactgaggttcagatgtgaatgcgtgggttaggtgccccttagccctccatgactttttcagcctcaggataaaaggagagagagtggccccgtaaaaccctcaggggcccagcaactctgccgtgaggcccctctgacccgagcaggtcgacacagaggaactattgccctactagccctatagaaatgagcccaggccactcggaagagcatgtcttgggcagcagcctgggggccggtggcagcggtgccagagcctgcagctcagtaaccatccttgggggtgtgctgagctcagtgtgccttcaggaatggcagcccataacaaaggaggatcgataccacaccaggagcaggactggcctgcagcctcagagaagacccccccatgggtcccctgagaggaaggggtggctacggccctgcaggttcacatggatggtggaaaggggctcttgaactggagaccctggggcctggataaataaaataacacatgccccccatgcactggggaggaggaggctgctccttctgtagggactcactttcatcgatccttagaactctttatttgtgcctagtcacttagatcaaaacagaaactttgggggtattttttgcttaaattatctggatagtttctctaataatcaatctaaagtctaaagaaaaggactttctttccatctcataattcctacacattaccaacctgtgttgacacgagacacaatcaatttcccgggaagtagttgtccaggctgggtgagacaaaggagatgtacaagccctgaaagatgttttcttgttcttgagattgtcaaggcaattcatcaacctggaatggtttgccattccaatctctgccttctaagctgttgtttggatttgaattgtacagtccccgcagtgtgctttatacaaacacgtcccagatcatagttcatcactgtggaatatattttactgtatatacttgactggctgcaagccatcctgtctgtgtttatataaagccaaaccacattatcatagattgcttgcacagctatgaaaaaatatcgaggacctactagttgcccccatcagcctgtgaaaccaatataattttgtctagaaattccatctatgcccaaccccattcaaagcagataaacaattctcattgggtggtctgtgttgcagccccctttgctaaaaacagccccatctgcctccctccatctgatcccagcccctggttgagaggcaagccatggtaatcctggctataaagtgctgaacatgatacccagatctgagctctcctcaccagaccctactttcaggtttggtccagggtgggcatccaacgtgagttggataatcaggaaattatgctggaaatctgaacctaggtcaatgaaagtcaagttggtcactctggaggcttgaactccaagctgaaaaacattagcagtgttggcagtgcgagagaagaaagaagcagatgtccacagaaaggaacaaaagggagacttcggatgagggtggagtcacctcagtatctgagctcaactgcattcctgaccctggatttcttgagacaccaccagaactttgtaacaaattcccccttctaatgatcataaggaggtgttggaagctaacataaaataataatagctatcacttgaagaatgctgttttccagaaaaggtaatgaagaataggtggttaactgttggcacaaggtcacacagtgggcagctcagcccctggaccagaggatgaattttgctgctctgtggcttctcaaaatgggcacaaaggaaaagacttggtctggcatca

SEQ ID NO: 55802 - DNA, 1491 bp, Bovine  19866881032886
aacacaatggaaaggcattgagaagggagggacatgatcagatccgtgctttaaaaagaatactctggttacaattaggtgtcatctcataatggtcagaaaggcaatgatgaaaaagtctacaaataacatgctggaaagggtgtggagaaaagggaaccctcttacattgttggtgggcatgtaacttggtagagtcactatggagaactgtatggatatttcttaaaaaactaaaaacagagttaccatatgatccagcaaccccattcctgggcatgtatctggatgaaagtataattcaaaaaggtgtatgtacccttatgtttaaaaagatacatgaatccttatgttcatagccacactatttataatcaccattacatggaaacaacctaaatgtccatcaataggtgaacagataaagaagatgtggtgcatacacaatagaacactactcagccacaaaagagaaagaaagaatgccatttgttgcaagctggatggacctagagagtatcacactaaatgaagtaagtcagaaagagaaagacaaataccatatgatatcacttaaatggagaatctaaaatacaacacaaatgaacttatcttggaaacagaaacagactcagacataagagaacagacttaatggttgccaagtgggagagtaggggaggagggatgggttgggaagttgggattagcagatgcaaactattatatatagaatggataaacaacaaggtcttattatattgcactgggaactatattcaatatcctaagataaaccataatggaaaagaatatgaaaaatatatatatacatgtataactgaatcactttattgtaaagtagacattagcacaacaatctaaatcaattatacttcaataaaataaactttaaataattaaagaaaaagaagaactcagagctgagagtgtttggagagagaagttggggctgtagctggcagccttagcagaggtgtgttgttctgatattatgaaatcaaattatggggatttgggctgtaagcccagtggccaggtgttaccccagaagctcccttcaccagaagccccatgacacatcatcagtaagttatgtcagataagaaccatgtcagcagtttccaggactcatttccctcctgatgacaggagctcctgtagtgaaatccggggtacttttcaagtcgcgtgtgggggtgacaaaacaggaaagtgcatgcatcctagttctcccatgcagttttctggagatttccacccatatctgaggaatctcagccacagaagtgcacagaattgaccgatactgatcttcttactcatttcagtttaagtggtaattgcctcaagatgagaggacatgttgcactttcaagtcagaaggatgctgagagatcatctaacccaacagccttattttaaagcaagatgcagaagctgatggccacagtacaaaagccatcagtc

SEQ ID NO: 55803 - DNA, 1268 bp, Bovine  19866881044070
ttgactcctggaagagacccttttggagaaggcttcagagtaaataatgaagaactaaggagaagagaggtttataaaagtaatgtggaaagtggctaaagcctacctaaggcttaattctgtgtagagagaagattgaattgtagttcactggcacctggatagtaaagaatttaattttgtccttaaaatatctggcttttgtccctagcctcaggaaggcgatgtctaaactaccctgcctgataggactgtctgtttaactgaaggccttgacccaaaccagcaatgtgagttaggtgggggcaggccacactagacagaccagccagctggtttaagatggaggttttggatcattgccagaggaactggagacatagatcagccatgtgaatagtccattaatccatcctgctaacctgatggagttccagtagaaactctgtacgctgagccaggggtgagcatccctgtaggcagtattctgtgtgttgtcacacatcaatgccaggactccagggaagaggacagttgaaggtctacgtttggactctgcctgttactttccccatgagctctttccttagctgacattgacctcagcctttcactgtgaataaatcagagctgtgagcacaacaatctttcatgagtctggagtccaattaaattacagaaacccttatagaagtggttggtgtcagaagtgagggcaggcttgtgtgtaaacagcaccctctgaacagagcagctcctctttggtggagagacgtgtttgctggagaggctcaccttcctgtctcttttttgtcttgcagtgttccactggcaagctaccatcatgggcccggtaggtagcagctgctgagcgcagcccttgctttgcctgttgtgcctcttgcacttgtactaatctgctttcggtgtctcatcctccagaatgacagtccttaccaaggaggcgttttcttcctgaccatccacttccctaccgattatcctttcaagcccccaaaggtgaggacaggggacagggacagtgtgtgatgaagtcactggtacagaaagctgcacctggggcttttcccaggggcccttatccaccaccaggagtacagctttccaggaattaaactctggactttcaggactcactcttcatgtgagcaagggctggcgtggtgagggcttcctactgaagccatgttttcaggggtgttccttgtcgggtggctgagttaagatgtgtctcaggctccagctcc

SEQ ID NO: 55804 - DNA, 762 bp, Bovine  19866881074529
tagggtgagctattgtattgtttctaacatatattaaagatctaaactttttttttttaagtttatagtgccaaactttaagggtaaaaagaggtagaaaaacccaggcaaacaaatggagtattgttttcaaaggtgactttgctaggggcaataatgtcaaaaggctcccatgtgacttgctatattgaattacagtgaaatcctgacagctgcctggctgttgttttagggtcacttgtatattccccagtggaaaagctagtttttcagttcacttgtcaaataaatatcacatagatattagcagtttgctatggtagaaagatcttagcaactgaaacgttcagttaagatctgatactcagtactttctttcccattctgatttttttcatttgtagtttgggacagcagtaatacctgctagagttggtaggatgagatgagataatttatgtcaagcacttaccacagtgcgtagttgctaaagaggtattagttcatagactattaattctttgagtaccctttgctcaagccagatatttgggaattgtccatgaatcttttctctcctttacctaccaaagatctattcatttcatcttcttaatgcactagaatgggagtaaggcatgacccacattttaaaacaattgggctttaagcaggaagtaactaaatcaatgcttcagtatatcaacttctcttgtacctttattagcagtaaccacatttagtttcttagaactctaaaag

SEQ ID NO: 55805 - DNA, 975 bp, Bovine  19866881111062
ctgcgccttcttccccacgcacttcctggcagctgtgctcttacccttcagaggtaggtggggctgcggttggccactgaactgtgtcttctttcacactagttagtggaactttctcccagattttagtaatatattactgtctgaagtagctctgctttctgtcttttcttgtgtgtgtctttataggtgttttaaatgggatttaaaaattcatgtcaggtcgcctggtgccctcttcagctacattttgttttcatcctatatttcattattaaaaaaaaaaaatgttaaggagctttctaggtggctcagtggtaaagaatccacctgccagtgcaggagacgcaggttcagtccctgggttaagaagatgcgttggagtaggaaatggcaacccactgcagtatccttgcctggaaaacttcatggacagaggagcctggcgggctgtagtccatggtgtcacaggtcagaaacaactgagcgactgagcgcagtcctttttattggcaccaggatctcttccaggtagtcactgttttcctggaatcactaccaggtacttggatctattatcaacactggacagccttttatcagcattcctaactcacctttacccgggggaaagttgcctcctgccaggttctttcctcatgattatcctgagttcggaacagaaagttttcttctagaaacacttggttattctaagacttcagagccaaaactggttagaaagcttaatttttaaaatgcttaccttcgtagtcttttaattcagggaaggggtttaaacaacaaaaatttatattgtcagagttctggaggctgggagaaccaagaccaaggtgtaggtggatggctccctctgaggccgctctccttggctcgcaggtggtccccttgctgcctcttcacgttgttttctctgcacacctgcatccctgatgtctcttcctcttcttatga

SEQ ID NO: 55806 - DNA, 1079 bp, Bovine  19866881345179
atttgaatgttaggaaaacacattacaaagttcatttgattaaaaggaaaaatcctatttatctatagacttattggaataactgccagattggagttgaaggttataaaaaagtcagaatgcatgtgttgtaattaaacagagacaaattgatgcctatgcttggattgacgtgggaggttctcctgtattctggggctggaccctctctggactcagtatggacttaattcattttccatcaggcataaggtttctcaagagacgtccccctgactctttcctcccatggcttctaaaacaccatgggcccacagcggcccttccccagctccactcccaactgcgtggctctctaaggacccaccagtgttgtgctcctcagcttctgtccccatgtgagtctgagaaatacagttcctagacaagcatcctgggaacctgtgatacgaacctaagctacctcaaaacactctggacattagaacatcactgttcagccctactgaaggtgaaaagggggttggaaagggattcactccttagcttttatgtccgtgcgtaattcttattttctttcccacatttatcctagggagaaaatccattacattcggactgagggtaatcatgggcttgaaaagttgtcctgtgatgcagatctagtcattttgctgaggtaaggggctgagcctgaaacagttctggaaaagcaactggagaaactgctctgggtggttctccacgacagcctggactaaaacacccactgtttgttctagaggagtctagtggctgtgactgaagtggggcacccgccttacacctgctgttcatttccttctttacgtgtacggctggggtatcctaagctacatgtgctccttgatggagaccttgctgtaggactaattagggtttaaaataatagggagagtttgcatgcaaggatgtgcccatctaagtgaatctaagcgcttttgttgtctcatgagaattgtacctactcttacagcaattcgtgaacattctctcatggacagagaactaacttaattgtttttctactttgcagtctc

SEQ ID NO: 55807 - DNA, 778 bp, Bovine  19866881522982
cacatgttatctgatattagggtttctatctcgtgtgcttcctttccatgataaaatctgtgcccttctccaagtacgtcttccctcagctgtccaggcacatgataaggtgtcattcctggtccccttgtgtttaggagggccactggaccaacgaccatgcagcacgtttaccacttcatgttgagctgtttaaatggctctgcagaacctttctgagctctccctccctctgagtggcaggtggcagccctggagatggtggctgtctatcactcagcacctatggtgactaccatgtgcagagcagaatcatggactagtaactgagtaagcaaacgtaatatttgtttaagtcactgagatttggaggggctgtttgttaccacaaataacccactgtaacctgacttactttctgtccactttgttttcccagtttctttattatatgaacgatataattttgcttctatgtgctcatgttttcatggtaaataagaaaaaatggagggatgaatttaatatactaagtcatttagtctaattacctttataaatttcatgaagggaaagcagacagtagatacattcatttcttaataatagtaaatatttcttactgaagacagatgtcctaagaaaagcaaagagcaaaattgttagatttatgcattttatcatgtctttgtattttatgagtggttaataatgaaaaagaaatgcaaagtatagagaaatatgagcttaaactttaaaaaatataatactagaaaga

SEQ ID NO: 55808 - DNA, 969 bp, Bovine  19866881621731
aatatatttcattgtcattattcttttgaaaatcactcaagcttatcaggatttaatcataccatgaagaaattctccctcccctttcccactatgactataaaatacatttcctcaccaatgagcatggttgcgtgaaggcaatatcagagtgaagaggattatttactttgaatccacttagctcagctgcttctctccccagaataattctgaagtgttgaatatctaccacagttaataatcttccctgcattagaagacaaagcaatacacaaaacactctaaggttcaagatatgctgcaggtctgctatcatattctatataaaaggtatcctggaaacttagcaatgaggtagcgttggctggaattttcagatgcatctgcttggagcctggttaattgcataaagtgttcgtgactttcactggtaaatagaaatggaatattgcctgccatatcagtaaacaaaggatgtcacaatcatcagcagttgcagcactccaacaggtgctgatgagccctgaaggaactcacgaaggaaaagaatacctgctatggagcagctttagacagcagccatcccccgaggtgagccctgaggaaactcaggatgtgaaaaacaaaggatactgggccctgagaagagctgaggtgcaggtgcacaccaaaggagtgatttcagcgagtccagagagtcatcttcccatatacagaaaactgctaacttccttaacttgggatatatggttttctttgattaacaataattttttgacattcagacctcctgcccattgttgcaaaacttttatataatctggttccccaccttgcctccttggaattctttcagggtttcttgagatgctgcctccagggcctgaagtcctaaaaattcctgtaatatggaactagccttgtaaaaccacaaactctatggaactagccttcttctccaatata

SEQ ID NO: 55809 - DNA, 712 bp, Bovine  19866881661901
ttttcttccaggagcaagcatcttttaatttcctggctgcagtcaccatctgcagtgattttggagcccccccaaaataaagtctgtcattgtttccatcgtttccccatctgtttgccatgaagtgatgggaccagatgccatgatcttagttttctgaatgttgagttttaagctagcttttcactctcttctttcactttcatcaagagggtctttagttcttcactttctgccataagggtggggtcatctccatatctgaggtttattgatatttcttccggaaatcttgattccagcttgtgcttcatccagcctggcatttcgcatggtgtaaaaacttttaattaaattgtaataagtaccttggttgtatgcagaaaggtgcattgaatgtctcctctcgtatatgcacttcccgttgttttgcttcctggaaaattcaccaagggatagagtgtgacttctgcatttgatcctagtgtgtcagagtgcaggattcacctttaagggtgtgatcttttatgagtgtctcaattaatgtctttacctcccattcctgtaatttgatgaacccagtcaagatataattgtagctttcctaacccaccctgttgtgagttttcccaagctctagatagtaaagccaagccctgggaatttgaaattttttggtagagagttgcaaaaatgtgtatgctaatataag

SEQ ID NO: 55810 - DNA, 1231 bp, Bovine  19866881901543
atcccattgggcacacattcagctctcagatgccctaatttttaataatatagagctgggattctaattgttaattcattgtattgattccctaggacattgtgtttcccattcttgacttgtaatcgaacttttccatacatgtctgcaataaagaagaagggagtgggttactgaatggagtgcacagagatgatacagggtagcccactgaggaaagtggtcccagagaaagtaactcaataccctcattttagtaacacctcagggtcttaggggtataagtgactttgatggagacaaatttaaacagctaacagttacaattggttctgtggttttcaaggaagtagagagtgactgtttctggcggagggagggccagtgttaaggaggagagaaatgatgatttaatggaagtagagctgacaggggcctggctcctcgcacactttcacacagcatgttccaaggtagctggaggtctgaacctttgctgaagaaaatggggaaggcaaggaagtttttattgagttcctgtgaatatgatgtcagcagatcgtatcctgacttaatgctgatatgtgtgctttctagtatattctgttgaactctttgacacaactttccagtgagagtgcatgagagaattcatgaaaaggtgcagatacatgtgctacaatataagattggtagaccatgtcatacttctaacaaatacctaaattgtgttatccttcacttatgctattttacttcactatactattttaccctgagtggtcattgattttcctgtgcaagaaggatcctctgtgactggtctcctcaggtttgaaaagacctgaagataagatgaaatttgagactgactcaggaaacaaagatatttcccggacaattgttaatctaacctttggagacttattaatagtcaatcaagattttccgggaaactcccccttaatatgagcttttggttgaaagacagaagtttttctacatagatcctgggcgcaaagacttgagccctcttccaggttgctcagggggcagctctaaggaagtcccttgcttcctcagttatcaaatgaaggcaatttcctgtgatagctctggtccacctcttaagattggagggaatgttgggggattttaaagcacttggaaaattgaaagtaataaacaaatagaaaacagtgttattgtaagtgtggagtaaagcttgatg

SEQ ID NO: 55811 - DNA, 1478 bp, Bovine  19866880357105
atccggtgaatggttttctggccccatagttttgcctttgcaagatggtcatatcaatggaaacatccccaatacctagtctttatttatctgccacgcagcagcttgcgggatctcaggttccccgagcaggcatccagcgcgggccccctgcagtggaagcacagagtcctgaccactggaccacagggcagtgcccaggatgtggttttgagtctctcgctgagcacagggcacctggctgtgtgtcgcggtagtgtgttccttctcatcgccgagcagctgtcccgtgcacggatgtaccgcgggtctatccgccgaccggatgagaagcatttggattgtttctggttttggcagtttcggatacaagctctgttaatgttcatgcacaagttttgtgcgaacataggttttccttttccctaggtaaacacctcacagtggggtggtggggtcacgtgctaatgtgtccttagttttctaggaaactgtgaaactttccaaagtgctggtatccactttgcattctcaccagcagagaacgagaggatccgtttgatccacatcacttccagcattttcctttttaaagtcattctagtgggcttgtggcgtcattttgtttagctcaaaaagtatgcaagcagtattcctgagtcatgtagtatacgatcatcagcctttgtctataatgttgctttcttcctgttttttaaacttgagttttctctgtacctataatctaaaatgtctattaagaacaattaatctccttgctatacacttaacacaagttaggcggtttatcaatatgatcatttccctggggacatatttcatggagccctccacccttttccctcctggacggacgtccttgaggtcggaggctcagctctcctgggaactccctccaccgtcatccttcggggtactcgttcgcgtgtggagcccgtgttatctcttgttttgagggcagcacaacctgcagttgtgctgaggggtagaccctgagatactcccgatgggtagtcctagatacgacctgtccgcaaaggtcttactgcttatttaactcagtgtgactaggtacaggattttagactagaaataattttctcacagattttaaagatcttcattttcttcttgcttcaaaggttggtggtgaaaagtctgatgaaacttaatagacttctttcttcatatctctaggagtttttcagttcttcttttcatcctatgtatttcaatatttagtaatgacatcatctggagtgggtctccttcatccattttcctggacactggcgattccttctcttccacaaactcggtcctgcatccttggaaaaattctcaataacacatgaatgatatttatttgggatctttcctgccaccccagtttgttgattctgttccttctttcagaaagatctatgatttagctgttggacctccgatctctctat

SEQ ID NO: 55812 - DNA, 2325 bp, Bovine  19866880402110
ctctttgctgaggtggccaagtactggagtttcagctttagcatcattccttccaaagaacacccagggctgatctccttcagaatggactggttggatctccttgcagtccaagggactctcaagagtcttctccaacaccacacttcaaaagcatcaattcttcggcgctcagctttcttcacagtcccactctcacatccatacatgaccactggaaaaaccatagccttgactagatggacatttgttggcaaagtaatgtctctgcttttcaatatgctatctaggttagtcataacttttcttccaaggagtaagcgtcttttaatttcatggctgcagtcaccatctgcagtgattttggagcccaaaaacataaagtctgacactgtttattactaacactcaaataaataaaaagtcttagtcaaggaacatagcatcatactgtggaacactaccacaaactaattttgctcaatacttttattaaccctactacagaatataaattttttacaggtgtgttgttcataattaaaataataataacaaaagtagctgatatgtatcaacggccaatatatacaggtactactctaagggtttttcttggattttcttatttaatcctcacaataactctctgaattagacccggctcatgccccactttcagatgaggaaaaaaggcacacaaaatggtcaagtaatctgcccaaagtgacaggaagtcatggggtctggacaacaatttataggcaagcccacacgtgtccttcaaaagcgttcttggtataaagacactgacttcttatttaaaaggggcaccttcctgttgatgagttcagtcaatgagaacatatgttgtgtttctgagataaagcagacaaaaatatatggtttctactctgctaactctagatccttatctcgtctagtttacagcaaccactctttataaacagattcacggaaatttgaaaatcaagaaaacagcaaagaaatcggcactggagaattcctggaacctttctcctccagtctttcttacattcatcagataccacctccaataaatggcttcctttcgtatttctctcaggctgtaaaaatactggctcccctccacctggactgaaagacatctaccatgttgtaaaactctgggactttctgtgccaccctgtcgaggctcatgaccatgctgcttaatagctgttcactctggaggtggcagtgggggccaggcagaacagtcacggagaagaggggagagtccatgctgacatgaccgccctttgcactggccaggttccacgccaacctgtgatcctcaccgaggtatcactttagcctgatgtgtcatccatctctagccagtcgcaataagtgctaagagtcataggggtgggaaacggcccctgagatgaagaaaaaaaggaaaaccccaatctccaaggacacccaaagggaaggaagggaaagggtctgtgctgggctttcttagcaagagttaagagctccaagtcacttagcagcaactacttagcagcttcatgagacacggagattgaggctcccaccaaaggacacagcaccaaccagcctccaactggagcctctggggagactcagaggtgagctcgaaggtggggagggggcatgctcagcttgcccagagctaccagctggagtttctgacccggtgcatgcttcctggctgggtcacaggtggcctgcggggtccgcccccaatcgcgggagcccccctcccctccagccctctctcaggtccccaggctcgcccctagttctctcaggaactcaagtgtccactctgcagccccctcaaagcccccttaaagccccctttgcctccccgtaagctcccaggccccatacgcccctgggacccccagatgctcccgcctcccgcccccaggacttcccaggtgtccacccagccttggacctaagcgtgcgccccctgcccccctctcccttgctgaagcggggagggcagcgcaccgacgggacccaggccaggcccagcctttgcggccgtacagtgcgacgtgtcacacaggccgggccggctcctcctccccgcggccgcggccactggcgccgtaggggccgcccgcgggatcccgcagggatgccaggcgagcctgaacactcctggcggccgttaccttgttggtgggcaccgagcggaggcgcttgaagatggtcaggatgtcttgcttgctggggtcccccatgatcacccaagaaccggggcgcagcggccccgccaaccgggaagggcagagctgc

SEQ ID NO: 55813 - DNA, 1252 bp, Bovine  19866880532984
tgaaaatgccgagtcctaaccactggccaccagggaattcctctggctctggtttacaggctatgaggaaaaagggttaacatatctggcctgcctgttctcctttggaagtcctgcttccaaagttgacccttagctcacgtttgggatcttggattctgggagggcgctcatcaccataactggtaagagtggcaacttgcaactaaattgtgccaacaatgtgcttcctgccaaacacttgatttccttctgtgtctggaattttggtatgtggcaggcagacggtgcatatgtgattagtccctgagaaaaactctggggactgagtctctaatgagcttccctggtctttacaactgactgctgggggagtaagtgcatcctgtgtgactcccctaggagaggactccagaagtttgagtctgctatcctctagcttttcctccacaagttgtctccctctgctgattttgctttgcatcctgtaatgcatctcagcctggacacaactctatgctaagccctgtgagtcctcttagacaatcagctaacctgggggtggtcttggggacccttggaacagaagtggcttgagatctgaaattctggcaggccacagtactcacaacaatgtcctcctcggtgactcgagggtgcagattattcacggtcatcttggtgccttccaaagggctgaggacaggctgccacagatagaagaacgttaccagaagttaccagagaacagaacgttaccagacaacagctgtgctcaaacggcagaactcatttcagcaaacgaccaggaaggcccagaggaaacctctatggagagtttcctaccacagctgggcccctctaatcatgtcccagtcaacttatgctaaggaatggaacttctcatgtttcccaaatattccaggcccttccaggcctgaacctctgcacagaatgccactcgtgtttcaagaaccatccggctcaaatggcactttctctttaaagccttcctgtatccccggtggaatgagaggctctttcatcggtgctcctggcagccctgtgctgtggcagacacagtgctctatctgcagctctgtttccctactggcttgcctgtgggctctctgagggcggggtctactggatcttggtttgctcatttgtaagacagaggtggcaacacctacctcccagaggcactatgaggacccaacgagatgcacactgcccacccagctcaggttaa

SEQ ID NO: 55814 - DNA, 2014 bp, Bovine  19866880547255
aacccacaatgaacaggaaccctgcagttggcatgggaggacatggtgggcctggaggcgggtgaatggctccaagtggagatacggctgtggagcctgcggtgagaatgtgggtttactcagtcatttctgggtggagagcacttgtcaaatttcaaggtcttttccagacttgaccccttctttcagcatgtgctgtggtggagaggcggggtttgacaccacctgaggctggatggcaggcgtgtgtggggggcgtggcgtgagagggggcgctattcttggtgctgttctctctgttagcaagtgtttcaacaggcccttcggggcggttcgctgaggggtggtgtgtgtgatcggatgggggttctggttggtaaccggtaaccctactgagccctggagctgggtctgggtgtagaaggaagggaagccaggggtgtgtgggaggctgggaccaccacggagcccctgagcacacccgtctgctggctctagtgaacagggtatggagcccaacaggagcagcctaggggagccagccaatctctcggggtgagcaccccatcctgcaaggtacgcagctgcagggaagggtctctggtcacgtcatccctgcacacttcctgatatcattttttataggaagcatctggctttcctgacctttggctatcaaacagaacaaacaaaccaatagatatccatctctagggtttaatttagaataagaaaaatttaagtatgggccccatttctgttttccagccattcccccacccccctgcttttggggggcaagcacttgcctctttcggtgtagctagtcacaacagcttgacttctcgatcccatcgttatgaaattggtgggaggacactgtctgtttctccataatggtgggggggggggtgttcagcgcttccccaggctaagtgaatcttgtagcagataggccaatgcgttgtaattttggcacaggtgaagtgaggcaaatttaatttccatttccttctggtttgctttgcccgttatccccagatgtcctgacgcaccaaataaagggaatgttttcccgcttggagctgtcttcgcgtcaggcatagctcaccagcagtcctggtcctcacaccatgcttctgtccctggcagatgggtttcatgttgtctccagctcagtctggggaggtgggtgagtgccagggggagcagggttctgttaggttaacatagcaatgtcagagcaccttcaggaaagcctggaccttttctcttttattcatcttactttctggccacactgcgcagcttgtgagagcctggtttcccgaccagggattgaacctgggcccacaagcagtgaaagcaccaaggccaaatcgctgggctgctagggaatttcctggggctttctcttttagattggaaattgagacttctgaattaggtatttttattaatttgcccgaccttgaagcaaagtatatagctgttctgtttacactgatggcaaggaagaacgtttttaatgccatgctaagtgaggtgcctcatagcctgtgcatagctccaactgttacactaatttattctatacaaggcagtgctgtccccagtacttgacatgacccctgaccagtggtcacttagcctttgtctcatgggactgggactggccagcagtcagctcactgaaaaagttagataaagcaagaatcgttaaaaacatacacagtttaggcattttatttctaacttaaaaaattatatttcatgtgctagtctttcactgaccctttcttttaccttgaatcttctgatctgaattgtcaattgttttcttccataaacatgcctgttatttgtgtttgatattcagtttttgcctgagaaggatacagaacttagatgcatgaagcaaccttgagttgctcaatcctagattttacaaattttcacacaatcctttacacttgtcttacctgtcttaacacacacctataatttagttatg

SEQ ID NO: 55815 - DNA, 1062 bp, Bovine  19866880574350
cttctattaatgcatgatggaaatacctggaacatgtctaatagttcggttatttttcaccaaagctgttgctttccaattaatgcagtgtgatatgcactaatttcagattacatttccctgatactgaaaacttagagattaagttcacctacaataaactcagaaagaacacgctaagagttcttgagtaaccaggactgacgtggctgctctgccctctgcctatgccgggacataaaccagcaaatccaaaagcatcaagagcagccttggccaggtgcacaggccaatgcgtttcccagccaccaagcggccaaaagtgaacagcacttttcgtttaaatagatctcattacacggaaagttctaggcacaatgtacacacaggattcatttttttcttaattaacctctaaagcagactacagggtaacacataccacctacagcagcctttgttggtacattaagaccttccacacttggtccttgctctggtacacctgaaagttaaaaatattggtatcagtgcagaaaacagattcatcaaatgtgcttttgaatatgtaacacatccaacttgttcagtagtacaaattttatccaggtagatcaatgattgtcttttctttttagctccatattttatcactctaagaattttaatttaaaagtccattaaaatagaagtgtattttgtatccagttgctttgttagtggtctccctaatcattataatctggaatcctaccttatggtctggtgttttaaagtaaaccgttctgagatacctagtacatatgtgtactataccccaacagatgttaacatttggcaagtctaatgtgaatcacatcaatgatagaaaacctaaattttcacttgccaagaaatctgctgagttttctagttgatctaaaacactgatcctggttaggaattccattaaggcttctcaggaccatcacctgatcttgaggttgctgactctatttagtccttcctgttacactaaattccttaaagcagttccaggcttgactctcacagaccagcacg

SEQ ID NO: 55816 - DNA, 2275 bp, Bovine  19866880582201
gcatggagacccggcagcagtgctggaggagacttaagaagaccatgtgggccaggccggggaggaaggctgcggggggtggcacagaccctgtgggacgaggcctcggacctggcctgggcagtcagagggcaaaatcctgcagtctctgcaggagctcctcgggcaactgagaccggtgtgcttgaggggtactgtgtgagagacgggggtctttaatctctcagagccacccccgcaatggatacacaacttcagacgcgacttagtagaggaagagtcaggccctcatcctgccaggagaatgcctacgcctcccacctacgttagagaccctcagcgggcccagggtgagggcttgccaagacagctccctttttgtcttgcaggggacgagctgaccaaaatagaggatgaagatgagcagggctggtgcaaggggcgcttggacagcggacaggtcggcctgtaccctgcgaattacgtcgaggcgatccagtgacgggctggtggggcttggcttggcggagggacggagttggaggtccagcagctctgttagccgttggccccgggcagcggcccctccagccagccatgcgggcatccactcctcttcctgcaaaagatgatggttccattgctgttggcttcatggtgtctcttgaaggcagacaagctggtcatttcacctggagctcggccccctttccacagtgcagatggagagagccgatcacaggaagctgcaggacaacaggaatcaccgccccccccgccccgccccccacgctgtgtgttggcttatcatggatccgtgtattcttgaccttgtctttcctcctctcctccacgtcaatggtaacggtgggttccactaatccttgctccactgattcctttctctgacaagtcccatcacctgctaaaacttaaatgaacaaacttacatgccattttgtgagtgaacactttgaggtttttaatttaaaggctgtgtacagttacttttttatattcccattcttgcattcatttatacttaaattatgacaaaggtcgatgtccaccagtggtcttgaggcagtgtctctgtttccatgctcttctgttaatcacccatgccactgcctggggcgagagccggcagcctggacagaccatgtttgaagcaagagattgcagtagaaagatgggaacacatggctgggtttccaaggtgaatgctctccgcgtttggggtgtccaaatgtgagttttgcaaataaccttatgtagtcctctctaaagccgccatatttaaaatctattttcactctatttgtgcttaaactttactcttgcaaattaacaattttatcagtgatttttgaaaagttaaaatataagactaacgtttcaagtgaatgcatctatagttaagatgctttatattagactgtcacgtcttggtgtatatctgtatatactatttgatattcagagaatctaaagagcttgtctactgtgttcatgagactgagcagcttttgacagtggcttcaatttgtaaactgcttgaagaccatccgggcatcagcctggctggttggctgggcccagtggagcctgccagagggacgtctgtcttcgctggccagccgggagtccagtgtcctcagcccagctagccttagtcccctgtagcagaacactgtacaaaactcccgcgtctttgcgagcagctgcagatctcactgtcatccgtgttcctcgtgagcaaagaaaagctgggtctcaccccacagcaccagggtctcctgagcaccctgtggccatcagggagccgacaggctggggcaggaagctgccctgtaaccacgggccggcgagggagggcaaacctttcctctgtgtaactcagacatgggagaaatggctgccgccaccacaagctatgcattctactcggtgtttccagtgagcttgatgtcttgcttggaaagtggatgtgtctgtctgtcctgaggatgcgtgtctatctgtcctggaaacttaccagcagaatcctcattcctttgctacagatgtaccaaaaattgtcaagtcttttcagtttaggagtttctttaaacatatagtattttagaaaaaaaaaaatcaataaacagttgatctcgtgattatgaccatctctgtgcccgtgcgtgtgcctcccacccacaccagctggtgggatgtgtcttcaccggcgtctggagccaggtaagaccccaggtgcaagagcactgcccag

SEQ ID NO: 55817 - DNA, 1430 bp, Bovine  19866880606757
cgagagcaaggttcttcccagcctcgtccttcgtgctgcagggccccgtggtgacagagtcttctgtgatggggcacctggtttgctgtctgtgcggcaagtgggccagttaccggaacatgggcgacctctttggaccctttttacccccaagattatgcagccactctccccaagaatccacctcccaagagggccgcggaaacgcagagcaaggtgaaggtccggcacaaaagcgcttcgaacggctccaagacggacactgaggaggaggaagagcagcagcagcagaaggagcagaggagcctggccgcgcaccccaggtttaagcggcgacaccgctcggaagactgtgccggaggcccccggtccctgtccagggggctcccttgtaaaaaagccaccaccgagggcagcagcgaaaagactgttttggactcaaagccctccgtgcccaccacttcagaaggtggccccgagttggagttacaaatccctgaactacctctcgacagcaatgaattttgggtccacgagggttgtattctctgggccaatggaatctacctggtctgtggccggctctatggcctgcaggaagcgctggaaatagccagagagatggtgagtacgagaaatccccccgccgcggctctcggttacttcctttgggttctttttcttccaccttcatttgtttcagccgtacttcttattcttacaaattgcacgttgcacggtaattcctccacagtaaagccccaagactaatggacagcacagggaatacagctagtgctttgtaataactctgaatggagtgtaacctttaaaaactgagtcactgtgttgtatacctgtaacttatacagtaagtacatcaataataataaagcccctaggcctaaatgatggacagaaaatgaagtaatttagacatttgtttagcttttattttcatcagtaatttgtgttcacaggttatgcagggtcatattagtctcctccggctcattaaaacaaacgtcagtgtttcacgccccttctcaaacctgacctctgccagattcctctgtttctgagcaaaataagcttttactgctgtttgagttatctgtggatcttttctttcatttttcaacatctgtctctgtaatattgatgaaattaatactgtggttataacttctttcttttaaaactttttacttccctagaattactcatttgtgtttttatttgctttttattttcttggaccacacgtttcggatgcagactttcaagggggggtttttgttcttcaggtctgtttttctggggcattctttatcgtcgcatcatctacttctttcctctgttgaatgctgttttcttacccatgtcttcaccttacttgatctgggccacatttaatggtgtgcatcatg

SEQ ID NO: 55818 - DNA, 1118 bp, Bovine  19866880758923
tgaggacggaggggtggggagtgcgcagcggtggtcctagggcccgaccaggcagcggacagtgggcgctgggtgaagccacaggccggaagaggaactgggccaagaagaggaggcggatccgagaggcttcctaagggaaggcgtctgttcagggcccaagaagagtttggattttctaaacagaggtcagagaggacaaaggccagcaggtggggggtttacagcatggtaacaggctggggattcagccggccagctcttaaattgtgtgagcctgagtcacgttaggaggaaaggtcttgagaatgggggagatgtctggttatgagcccttttaaatcaggagagttgtggttgagagaggcacagtgatctgcttcaaatctttggcctccacgaggccttgggcctccctgctgccctctatgaacctcagtttctccacctgtaaaataggatgctaacttgccctgctgactgtttagtgacacttgcatagccatagctgggtctgtgagtacgatggtctcatccaactggagagcctcaaaaccagtggatgtaacccctgggctcacaagactagataaagtccttgcagttgcttgctgctggagggggcccagaggtgcccagaggctaatgccaggaggctgggcccacagcctggcggggcctgggcttgccaaacaccctcgacctttggcctgcagttgcggcgccgtttcgggaacgtgttcagcctgcagcaggtctggacgccggtagtcgtgctcaacgggctggcggctgtgcgcgaggcgctggtgtaccgcagtcaggacactgccgaccgtccacctcaggcactctacaagcacttgggtttcgggccgcgcgccgaaggcaagtggagagggcaggccacgtccctgcaggcggaggcagggtcgtggattttcggtgcaggaaagagccaacgaatttgagggggcggcaggtggagaaaggagactgtgccaagcatttggggaggaaaaattggatgaggcagaaggcgggggccttactaagaccgttgcaatcccgaaggggacgtcggtgtgggcaggaaagaggacaatgtcggggtgggg

SEQ ID NO: 55819 - DNA, 938 bp, Bovine  19866880762671
gtggccaaaggattggagcttcagcttcagatcaatccttccaatgaatattcaggactgatttcctttaggatggactggttagatctcctggtccaggggactctcaagagtcttctccaacaccacagttcaaaagcatcaattcttcagcactcagccttctttatggtccaactctcacatccatacatgactactggaaaaaccatagttatgactagacagacctttgtcagcaaagtaatgtctctgctttttactatgctgtctaggttgatcacagcttttcttccaaggagccagtgtcttttaatttcatggctgcagtcaccatctgcagtgatactggagcccaagaaaataaagtctatcactgtttccccatctatctgccatgaagtgatgggaccagatgtcataatcttcgttttttgaatgtttagttttaagcccagtggtccttgagaaggcattcaaatgccagatatacaaaaggacatacacgaagataccgggcaagaaaagggcaacaacagacagttactgaattctccccacaaaaggatgctttgttttaagactaacaaggtcctgagattcctaaacgatagtactttttgattcaatgattcaggaaatcaagatgacaaaagactacaataaattcaagctttaaaatgaattgttattttattaatcataatcatagcatcatttttatacagtaacatataaatattttgtgtgtctgtctgtctttgtgtgtgtacaagggcagttaaaaaaaaaaacccatctacaaagtacagctggtgggtacagtcctctgtaaccatcctctaatgccctggagaaccagggtccctgttgggaaccaccaatgcactggagagagaactttaaggtggatctgggtctgaggagttactaagctt

SEQ ID NO: 55820 - DNA, 1031 bp, Bovine  19866880762950
ctgaaatcccagagtgggcagataaaagaggaagactttgaacagtccaagtcccaagctagtttcaacaacaagaaatcgggagaccactgccaccctgctagcatcaagcacgagtcttaccgaggcaatgccagccccggagcggcgacccatgattccatctcagactacggcccgcaggacagcagacccacaccaatgcggcgagtccccggcagagttggcagtcgggagggcatgaggggtcggtccccttctcagtatcatgacttttcagaaaagttgaagatgtcccctgggaggagcagaggcccagggggcgaccctcatcacatgagcccacacatgaccttctccgagagggccaacaggagttctttgcacgctcccttttctcccaattcagaaagcctggcctctgcttatcacacaaacacgcgtgctcatgcttatggggaccccagtgcaggtttgaattcccagctccattacaagagacagatgtaccaacagcagcaagaggaatataaggactggggtggcagttctgctcagggagtgatcgctgcggctcagcacaggcaggagggaccccgcaagagtccacgtcagcagcagtttctcgaccgagtccggagccccctgaagaatgacaaagatggcatgatgtatggcccaccgatggggacgtaccatgaccccagcggtcaggacggtgggcgctgcctcatgtctagtgatggtctttctaacaaaggcattgaactgaagcacggctcccagaagttacagcaagaatcttgttgggatctctctcggcagacttctccagccaaaagcagcggccccccaggaatgtccaatcagaaaaggtacggaccaccccatgagaccgatggacacgggctcgcagagtctacgcagtcatccaaaccgagtaacgttatgctgagacttccaggtcaagaggatcattcttctcaaaaccccttaatcatgaggaggcgtgtccgttcttttatctctcc

SEQ ID NO: 55821 - DNA, 574 bp, Bovine  19866880884453
cttgtgcggtttttacagttgctcggggaactgtaagtctgcgttgcctgactcctgtgtatttaaattctcagccatcacgttatattaactcattttttgcagtttcctgggaggccgtgtgtactttcctggggtggtggggggagtgggaacggccgtgtacgtgaacaaacacagctgtgagcgtggctggtcctgggccctgacagtggtgcctcatgagcccccatgagagggtgctctgccagccaggcgctcaccgtctggagtctgcccccccaaaagagcagatcgcgccgtgaggttgggggactcaggattcccgttagaagtggctctggagcccgggtgaggcccgtgggtcacgtgcccctcccgctttatgtccaggcgtgtccatcctctccttcatcccctgacacatgccgagcacctgttgcacacccggcctggagacacagcagacacacagctggcagtcctgtcttcccgaggtggtctgccgggtgatggatattgacctgacagacagatggtgctgggaactgagatggccttgagagcaaaggaa

SEQ ID NO: 55822 - DNA, 566 bp, Bovine  19866880909919
gagacctgctcctagcaggaacgtttacttgaaaagttcctgatgactaatgcctgccatataagcagtaccgctgcctgctgggatgaatagctgtcttctcacgcagggagaggagcagtgattagaaaaatcctgaacactgaaacccccctaaagctgctcatgaaaggagttgagaagtgatgtaaccagggaaccgaatatatgtaattgagggaaagtagcttatttaggctcctacatccacaactgtatcacctccctcctgaaaatttaccttttgtgctcttcaagtagataaaaatagcagcatgggccatcatggtggcatttcttgccagacaaggagtatggtgtatgggtctctggtgagcccaccatccttagtgtgtgtgtgttcaccctctggtcactagagggtgcactctgtccctggatgtaactggtgttctcattttttttcttagtttgaggacagtattcacccttccttaacttttctagtcttgttcgttgtttttgacccatgcttgatttattggtattttaactaggtgtggtgg

SEQ ID NO: 55823 - DNA, 1160 bp, Bovine  19866880987268
caggggatcttccccaaccgaaaggatcaaaccccatgtctcctgcatcgacaggcgggttctttaccactaatgccacctgggaaacacatgcatgcatgcattactaataatccccaatatctgcataatctccaccttttggctgtgccaatgctcacagactcagtttcctcttccacaaagcgggaaccctcgtcattattcttccccgagatggcaggacaggaatcacgcgtcccattttgcagatgaaggaactgaggctcagagaagtggcattcagtgcactgaagccacaactcgaacacaggtctgtgatgcttaatgtaggaggcgaaaggcgagaaaagatctggggtgggctgagattgtgaaccgagcacacttttatctgctggcagtctgccgatggtcacaaatgcggggtgattggcccgcccgggggccatcaggggcctgcagcctgccccgggcacagctgccaccctggcagacccccaaagagccccccgaagaatctctgcgctctcaagctttttttcccattccaaacatgccagagccccacggaccccagaggctgctacttagcgccagattaatcacaccgaattctccatccagatattgcgtgcaggccgaattcccaccgctaatcgccgtaatattctcctcggcgtgtgcaggcggccggggcgatgttccaggaatattaattctccaccgctggctcactcccgccacacgcatgcgccccctgcaccgccggctgatgttcagggatcagggggctgggcagggggacaggagaccagcaggaggcagagcccaggtgggaagcccttcctggggccagggcccccctgggtgggaagcactggccccaaggcctggctgacagtttaacctgagccagtgcagggctagaggtggctcatgcctgcggcgggggttgccccacttaccctgtctctccttccagttttgccccagagccccccgtccctggatctgcagtagtctcagggctcctgagaagtcacatggtacgagtcctctgatgtcctctcaacacagcagagctttgaggaaatgggcagccagggaccagctaatcccagccaaaaaaaaagcacacacacaaaaaggagtaaaat

SEQ ID NO: 55824 - DNA, 1064 bp, Bovine  19866881166502
acgctggctgcactgttgctgcggtggagtgacgagtgacaagccagcatctgctctgtgtgcaggaagctacaacctcaccagtgtgctgcccacagctcccgacatggcccagttcaagcagggagtgaggtcggttgccggaaagctctccgtctttgctaacggagtcatgacttccattcaggtcagtgagatggggactgcggtaactgagtttggtggtgggttcgtaatttcgaaaatgagatttggaccactctttaattgctagaaaattaggttttatattctcgatttatgtgtttgctacagtgtaacccaggacatcatgaaaaccagaacttgtaatttcatatttgtttaaattttctagtttatgactccagaggaattgttacaggaattgtcatgatcattactacttttctcttatgttaaaaaacaaaaataaataagaacaaagttaaaaattgcccataaccccacccacctcccaaggaaaacgttcattaatattttggtttattctaattctagatttctatgcatacctgtttaaaaacgttaaaggattatattgtatatgtgattttatatcctctttttcttcctgatgttttgttatgagcatttgcatgtaattcaaaattctttggaagctattcagtacattctgttgagcaaaaatgcatgtaatttatttaactattccccaagttgagcatttagattgtgtgtttcaatcttttaaacgaggcgagggtggaacacacttgtgtataacacttgaaggccagctctaattatctgaaggctattccgtgaaccttcctgcttacatcaagttattttaggacactcatgaacgggaaacgcagccacagagagcaggacctgataggcgtgaactgatgcctctaagggggggtcttccaggtggggaggcacccctgctatggaagcttcctccgccctgggccagcagctgctgtcggcacaagcttgggttagaattcccagagactcttacatgtcccttaggtcagccgggcccacctcag

SEQ ID NO: 55825 - DNA, 1847 bp, Bovine  19866881286575
ccctccagcccatggccaaaagcctaatgacatgagacagctgctgcaaagcgcacgggacgcccgtccacttacgaagatgttttgctgtcccgggaccactttttgatctgcgagagcttgttgatcaggaagatgccctttccctgggctttgccacagggtttcataatccaggtactcgaggggcttttccggaactcctccacaaacaggttgtagtcggcaggcagcatgtaggtgacaggaacaaagtctgaggacgggagaggggacagtgagtgagtcagcccaacagcggccacggacgggaagacaccgcgcctgcctttccagggcctgtgccgtaccctgcgcccctgcccagcgtctgatggagcaaggacttctgccgttcaatccgtgtgagacacgtacggcttgctctactgcgcttcacagataatgtgttttttcacaaaatgaaggtttgtggcaacccggcatgtagcaagtctgctggcgctatttttccaacaacattggctcaccttgtgtttctgtgttaccttttggtaattctcacactatttccaactttttcattatgatgtttgttattatgtttgatgaactatgataagtaatcttgatgttactgggtgggctgagacttacggaaaaacccaagggaaatttctggccaagccaatactactgcaaaaaaaaaaaaatgacaactcactgaaggttcagatgatggttagcatttctaggtaataaagtatctttaaatgaaggtatgtgcattgtttttttgagacataatgctattgcacactcgaaagactagagtttagtgtaatgataacttttacatgcagtgcaaaaccaaaacaatcatgtgacttgctttacagcaatattcgcttcatttattttttataggttttgttttttttatttatttttggtggcaccgcacggcttgtgggattttagttccctgacccgggattaaacccaggcccctggcagtggaagcatggagtcgtaaccactggaccgccagcgaattcccactgtggtatttgctttattgcggtgttcttgaactgaacccaccgtctctccaaggtctgcctgtaacgagttctcttttggctgcatgccagttactttttaaatctgtaccatttaatccccacagcaacctctgagctcggcattgttattattcccatttatcagataaggacactgaggcccagagaagtcacacatcgtcttccccaagtgtgcaaagggattctgaaactttccgccaggccagcttttctcacaggatgctgaatggacacaccactctctccgggccctcccagacacaggattcacccctcccggcagtctgcagcccacggaggggcccctgccctcctgagcacatttccaaggcactgatacaaactcaagattccaaagctgaagccctccccaccccctgccctgctcctccgtatcctgtaaacactaggaaagaaacaggtgctcacaactcgcacagacacactcatcccgcagagtcaacagctgccacccccatgccatgtgctgatgggggaaaaaacaccacggctatttatttaaaaggtgaagccggtggaaaggacacgaacccaggtagaggtacttcccgctttcgtccttctctgccagcgggctcccttccttctccagctccttcctgtatctcttgatgtttttcaccatcaggtccttccgcgtcagctcatagtggtttgggaaatggtgactattgatcatccgagagccggtagccagtttcgacactaaaaacattgcgg

SEQ ID NO: 55826 - DNA, 872 bp, Bovine  19866881332963
catttccctcctcacacacagatgtaaaaataaatggcatttggaaagcaaatctcagagtcacttagttaacagctttgcgtgttacatgcgtgctaagtcacctcagtcctgtctgactctttgcgaccccatggactgtggcccgccaggctcctctgtccatgggacagtctccaggcaagaatactggagtgggttgcatgccctcctccaggggatcttcctgacccagggatcctgcattggcaggcgggttctttacccctagtgccaccttgggaagcccagttaataactgtcgtcactagaatcgtattatgatttgatcacacttacatggattcttccttaggtgctgcccgggacagaaggtcttcctgtgcattcattttatcgacagcttgggcttgcttttcaatttcattaaaacacgtatttgatagtttctgggctcccaaacttccttttttggccccaagctggaggatacagtagaagattacgttttacccaaactgtttgaaaacatttgcaacgacagctggcagttactgagggttatcacttagtcctcacgcctctgtgaggccggcgcggtcatcgtctccaggtgacggaggaggacctgagctcttgtcagtaaagagacttgaccaaggtcacacagctggcaagtgacgaggtcaggattcagggctgacaaccctcccagcctcgctgcgtgacagagatcccagggagtctcggctgattttttttcagagttttaacgcagacagagaaatgtgaaacactgcagaaaattttcaccacgtataacgtcaccccattgaacaaaacgaactttttatcagagccacatttatcag

SEQ ID NO: 55827 - DNA, 1685 bp, Bovine  19866881345325
tggtgggcattcagttttggtctgtagtaaaaggtcctacagagtgcctcattcgcaaagcaggaaagcgacaggaagactcatcatcccagagatcatgtaacaatgtacctgcagggctcaatgaacctggcttaataaatgttcactgcttcagtagttcctattaccaaagttgctgtgaagattaaatgatactgtttctattccctttggggcagtggctctgcaggtggccaggactctgcactaagagccaggtctgacagggcttctatcctgatgcgtccactgaccagctgtgtaactgtgcacaaagattcacatctttgagacttagattctcctttgataaactgtggtaataactggggttgcatgaggaataaatattcagtgtctgcacacagcactagctcaactagtctgtcctctcctctcttccctctaccactatttcacctggaaagtcacttaatttctctggacaaatccccaccaccaccccacccattttcttttacacaaaactgagatgatatcttgcctccacatatagttactcttcaaacagttggggggactgtcattttgcttaaacacacctggtctctgcctgattccacagttgttactggtttcgaggagtttttggcaggagtctcaacctacctggatggttttagtgagcttcagagcaggggtcactgtcccaatgggtgggctcatgaaggcagcaggggaattccgcttcaagctgattttctcccgggcatcagcaacctggtggggcttctggggcactgtgctctgctgcttgcgcgagttcagcatctctctggcatcctgcactttccctttgatccggaaccgagcatctttctgcaaaagcttttcccgggcatccttgactcccagcttgaggcgggcatctgagaggccaattttctgccgggcatcaaacctctgctggaaggtggctgtgcgtgctggctggctaagaaggctctgttggatcccaacacgcgatcggacacctcccactcctggtctggcattgagcctgcaaataaaaactgcaatattaagaagatctggatatcaacagtagcctgtggtagtagtagagtcgtggtaatactgggaacaaaggaggtcctggagaaaccagaaagctgcttcctcttagaggaaacaattcagtctatacagagacttctttcacagttttatgccttttaagtctgcatggtaaacaaagggaggagggcctggtggtttctatcattaggcaagactgctttgcaccccagaccaggtgttttgagacactatcatggataataacctctaaacaataccaaatgaaataagaatatttcccagatatcgtaaacccacacagcgaaagactaactttagtttccaaaattctttcattccttgttctccatcagccctctcaacaccctgtgaagcaagcagtattatgcccattttacagtggaagacacaggcttagagaggttcaatgatcaacaaagggcgcccagctggcctatgacagtctcatgtctccagggcaggtagacacccccaatgggctgggaccaagaaagtcaacacatgggtctgtctcggagtcgaggtctaataaaaacataaagactggaagaaaagaaaaa

SEQ ID NO: 55828 - DNA, 3879 bp, Bovine  19866880201655
aagactcttgagagtcccttggactgcaaggagatccaaccagtccatcctaaaggagatcagtcctgggtgttcattggaaggactgatgctaaaactgaaactccaatactttggccacctgatgggaagagctgactcatttgaaaagaccctgatgctgggaaagattgagggcaggaggagaaggggacaacagaagatgagatagttggatggcatcaccaactcgatggacatgggtttgggtggactccaggagttgatgatggacagggaggcctggcgtgctgcggttcatggggtctcaaagagtcggacacgactgagcaactgaactgaactgaactgaattcatgcatcataagcatcaaatcttcaaaaatagttggtacagtgaaagtattagctgttcagtcatgtccaactcttcgtgacttgatagactatagagctcacgaggcttcctctgtccatggaattttccaggcaagaatactggaatggattgccatgctcttctccaggggatcttccagacccagagatcaaacccatgtctcccgcactgcaggcagattctttactatctaagccaccagcgaagcctccaaaatagttggtaggccctgatgcttcaagaaagctttgattccttaagcccttggtttgtaaaatagtgacaactttgatgaaattcttcacatttgtaagtaaaattctgaaacttttgagataaagggttatttcaaatctttcttatgaggatatacacacaaactgtctctgtttactcaaattctaaattagttgcagtgtgaactaatcatttcaaacattaaagttcggcctcaggatgaatttaaaggagaaacatttaggcagaaccactggagaattaccctcaaagtaagaatgctaaatccataaatattttcctgagggaaaaagtgacagtatcatcagtttctaattccaaacaggaaaaaaaaaaaaaaagtctgtggaccatagaaaacaaccttgtgttggaacactaaattatataatatttcctaatatttgcaacaaagaaatgtaaaatagaaacccgcattagagatctttgatttattaatatcaaccacaatagcccaagtaactgttctggtacacgggtattatttgggtagccatgccccaaatgcacaaaatccagcatggtaggtatttccagaaaactaaggaggcacccaaaacaatgagtttaacaggagcaatgtgagagggagagaatgaataaaaaacaggaggaaaggaagcagagggtaccactcacatctcttatcactcttttcagaaaaccttctctcctgtctttgacagagaacatgccccacttctgcctcccaggcttcgattcatccatcaacaagcaccgactgagctcagcctatgagctggacacagagctaggtccattctataaagatgagtcacacatggcctccatcctcaaggaaccacagacttgctaagaaatgggcacagaaacaaaaaatctggaaagagctctgagagagggattgccaaatgctgagtgacttcatcgtgggctgtaacaacttctttgctcacagatgctgtggggcaggggactgcgtggtgaggatggcttgtctctggatctccatgatgtcttggatctcaaccaggaaaacacaaagcctgactggcagactttgtgactgggagctggattcatctggtgcctggagcgaaaaggtttaggttcttctatgtcttacgtctgggtgaagggacctttaaaacaatctcctgctgctccatgtttctctgtttctcttttatttcttactgtattatctgactgtgaccataaaaaggcctccaatatgtgtcctacccagcccttttcagcttcagcttccataccttttccctaagtctgaagcagacagttgcttggagttgcccaaagacactcaattctttctcccctctcgcctttccactgaaggtttcctccaccttgaatcttccctgtgggcctagcaacctcctactttcctttccagaatcaaccctgctgtagtctggtctctgaaacctttgctgaggtcccagctagagttaatgccctcctcctctctgcccctcacacagtgcattctcttctggtctacatgttcagtactgttgtaataaactgtcttcacgtctagctctctcaccaccctgtaagccctgaacacctttaaaggctagagaaggagtcactcccatttgtcatctcttctgctctcaagcatctgggcacgtaagagatgtttagtcgatatggacttttcatggtgaccttcaaaatgaccctttgcagcccatgtgccacagctactgagtctgtgctctagagcccgggagccataactactgagcccatgtgcagcaagtactgaagctggtgtgccctagagcccacgctctcaccaagagaagccatgcaatgagaagcctgccacactgcaactagagagtagcccctgcttgccacaactagagaaagcctgcgcagccacgaagacccagcacagccataagtagataaataaaattattcttaaaaaaaaagatgacccttcacattctcgggcttcttgggcttcccaggtggcacagtggtaaagaatccacatgccaacgcaggagatacacctcagcttcaatttctgagttgggaagatcccctggaataggaaatagaaacccactccagtattcttgcctggaaaatcccaaggacagaggagcctggtaggctatattccacagggttgcaacgagttggacatgactgagcatgcccgtgagcgtgcgcatgcgcatgagcgcgcacccgcacttggagcatttatcaggcttacattaggaaagcccttttgacagccttcatcttctacacacaacagtcttgcaattattagccccatttagagaggagaaaacagaggctcagaaacatgtggtgatttgcccaaagtcacttagcaagaaagcggcagagcttgttcctggatggtctgtctgctgcactatagggaagtggcattgagctcaggtttagagatttgccttgaacccaggatccatcctgagcccagggccacgtctgctcctcggctcacttggtcccatcactttcactctgagcccccctgaggatagacctcctggaacccagagggaggagggcctgtgggaggtgactggggttggcctccagcaggctgactcaagttcaaattatggtcaagtcagcaaagctgaggctccagccaggactgcactgggaaagggaagggtgagaacttaaattatttctcctgcaactccatccctggcattactcttcgtggaaaatctacattagagtccctatcctacctaaatgaccagaaaatcagggccaaattaatgataccttcaaatacttatgaatggtcttcattttgatttacttaattttttgaacaggaaatacatttacagggtctgacgcaagaaagtagaccgcaaacgtggtccttcccacctttgtcctgacaccaatttcctcttccccaaagcgttacttcaatattcaagaaaatacactgatacacacacatacatattcttttttctcatttttacatggacaggcagcctatgtatgtactgttctacatcttgatttgttttaccttgacaatgtcttggaattccttctgtatcagcacacgaagaagggcctccctcttttttttacagctgtacagtatcccattgtctggctgtgtcaaaatttgcttaactggttcctgggtggggggggggggg

SEQ ID NO: 55829 - DNA, 878 bp, Bovine  19866880381459
catacgcatttcccaaacttattctctccaaaccactttttctgttgtaaatatgaccttcccaaggtttttagcttatgattaaccagatgaagccatcagtacatagacctccaatctaggttttgaattacaaaaggtactttgggggggggaaaatgctaactcaattgcgtcagttaaaacatcagcgttagcaacaccacggtgtcatgatgcaggaggttaaagatccatgggctcagggagtcacagcagggcttaactggggcagttctggttctgccattagaaccatgagcactccaatctcaatgaaagtgcataagacaccacaattatctccggatcatcgactcggtaaacccaaacagctccagtctatcgtgtcaacgtgtattctgggagtctttaatgcacggatcattggcaagctgcgccataaaagccctgtaagagctgtggccgtgtgtgcagtcaatgcacactcagggactcccccaggtccgcatcattggcagcacatcgtgtcaatgcatacttcaggagccctgtgcatgctaaggaaccatgtacaccaaaaatacttctgaaatagttgttacaggacatacacagcattcactcctctaaacggcatgtcagcaagtttagtgtgcaacaaataactcctaaaaggcactaaacactcctagaggcccaacttcacacacagatggttagtccaggggactgtggcatgactgtggtgggagcatgggtctctccttacagtgaacaaagggataggaacagccagtttatgcaatcgaagccactgcttctactcagtgctgtcaaggttttcagtataacactgactacttcctaattatctg

SEQ ID NO: 55830 - DNA, 1058 bp, Bovine  19866880387848
tggggttgggagaagtttggctgagcttatgatattaatatgacaatctcaaggtaccccttctacagaaattccagagggagcagtgggaggggagaaaagagggcttgcacctgagagagaccctgggttgcatcttcactgggagctggctctctgtaataaccgcctcccccacccccacccccgcaccacagttgaatctaatgcctgagtcccttctcctttcatggggttgggggtagagtgcatctcccgcccttgcttccaactcgggtcagttccaactgaccactctctggaacctgctctggggttcctcctctctatgttccgggtctcagtagtactgccagaaaactgggtttagataaggatggaatcttagtcatatttcacctgcacataatttccagatcttttccttgtcattcactctctccccacatgcccgccacacctggttggtggattcctcccaccattattattttaacacaaaaagactcatatgaaaattagggtggcacatccattaacatgggctgttctttggaacaacaaccacaaaaaggcatggacaaattaactatattttgagccacaagttgaccacatcccagcgggagatgttttgcttgtaggagattaagaggtacagtttccgtgtcaatcacaggtaggaaaccagccaatccagtgctgatctcagttcctttctgtctggggacatctgagcagccttaccattcttactgattgaggtaggaaagtctattcctaacacaggccagcttgtgttcaaaggagaagggcatgtttaggttttcccgactgctcctggggtttggtttcaaagactgccaattgtgcagcctctcacaggatttacaacagcagagatttggagcagtccacactgaaagaacaacggctggggcctgtgagagcctgggggcctcttattggttgaaagagaatttgcatcttgacccattacccacgggaagggctgaggtcttcagacaatgtattttcttagcacatcacagcactag

SEQ ID NO: 55831 - DNA, 1859 bp, Bovine  19866880433678
ttcctggtgtagatggatacttgaatcacagctgaatttagagcctttgaacccaaggtgttgctcagcccagcccaccaccacctccacccacttctacagggcaggtgggttcccccactctcccccagagttgacgcctgtgagttttctatcacaatcagcttccccaccctctttctctcctccttcctgccagactcacaatgctgcagtccaggtgcttctctcactcagtaaaagctccaaccacatatgttactgaactactgaagtctccagttcaccaggctgctctataaaaactgaattacactactaaaactgcatttcaagagagacagaaagatgcaagaaataaatgcttccattctgctggagggactgtgaattaccgtcctccttctttgcaatacagaagatatgacacataattataagttaatgaaactgatttttacatgtgaccagagaattatgaaattatagagctgaaagggtcctcaaagttagatcattcagctataagttactgcttgtttacaaatgcaaacacttttactagcagccatggcttcaaacttaaaaacagaaactcagtgatcttgatgcccttggatacagtcctgtccattgtctgatcctcggctttctgaatgatgagaagtgggcacagtaatagccaagcggctccctggtccctgggtcacagctagggcgctgtgttcctgaagtcaggtgttcctgtcacagttcagtggtcaccttcctgatggtggcacacaaggcagctctccagcaggccagtttggaactgtgttccctaaaccattcctgcagccaggagcctactgctctagcctttcattgatttctatgttcctaatttcatgcatcaaattccttttctgcttcagatactcagagtggttcttatttcctgacaagagctctgcctgatacacttgcactgattcatgtaacaaccctactattagagggggcagtattattattccctgcttacaatctgaggaaactgaggcataggaagctcattacgtttgaaagcagcagaactgggttttcaactcaatctagctccaaaaaccctgctctgaaggggacactgcctcctccatctgctagtttaagtagcaggacttaatggtgcctcactggacttgaatcaatttcctaatctaatgctatttcacttgtaattcaaatttgcagaagagtctgattggcccacttgggtctcagatcctgcctcccctatcttccatgattgacagttccaccaagactgcatttccagcgagagggagtctggtggtgagacagatcacttgaagtgatgaatgagcagcagaaccagtcactctggggtgaactataaccatgggggcaaccacccattaggaagcaccaaagaggaatccagccttgccatggcaaaagctcaattcatttgcttgaaagtaccaaaggaaggcctgcctgacttgctgtctgaaatttctcagctatgtgtgaccttgagcctgggcacttcccttctctgtattgggccataaagggaaacaagaaaatatattttccttttcatatcaagatttcaagaacaatttattttgttacctctttttaatttttaaataaaatattctaatgtaatgtgaatactaaaaagatacttggggaaaacccatcactttatcaaattgctctacccaagctaccttatccctcctttagttttgcaaagttaaaaccatagtggctatgtgcactgtctgtctgctctctttacttatcatttgtcgggggttgtctagtcactcagtcatgtccag

SEQ ID NO: 55832 - DNA, 1482 bp, Bovine  19866880518450
tgatgaagttcccagcattagggctgggatctgaactcagaccagccaaatcctctcctctcactgcacgagattccttaggagaattgtttttctgattggttgagactaacaagtcaactgaaagaacaatacaccagaatctggagttttggatctttcttccgcatgctctttctacaatatggaaaacaaagggttaatctccttcaaacacaaacctgtttttgaccacgacctcaaggtggtgcttctgtctttcattgttgctggtaaaaggaaaaaaaaaaaatactgctaacaagtttagaggaagtttgtaatccagccttggtgtatattaaaagcaaatgactgctttaaaacagtataacattttcatttaaaagttgatggtgacatggattcctttccatatcttcatagtatcatcaactctatagctggacaaataaatagatagacctataatatcaccattcaaatgattaaaaagaaataacacgatgccagatgtttatttggaataacccacagaacacattgaaaacaattcctatttctgcaactggaaattggaattgatcattactgggcattaaatgtgcgtatgtttttctgaagttcctaaatctatttaatttctatgttgacagagatattagacagctgttggaaaatctgtctctctttcatgagctatgcgcaagaaatctttatgttaaaccacgaaatgtcagtgagagctcttcagtgtactaatgagcctgggaatgggatgtatggggctggaagcagtaactgaacttacatcctcacggtcttgattgtcctgtgtgcacctcctaaagatgtggctgttgaaggcaataactccgaagggctgccatgcaagccggctctggagattagagtcaaagtgagttaggagaccagacatattctctggaaatggcttcactgtgcatgtaccctaggggaatgttcctgggacgctcctgaccctttgcccttattacctatctcaactccacacatgtcctccagatgggcttccatgggcaccaggtacaagaaaaaagacagctaactttattcttcaaattttgaaaggcaggctggcgaacttgctaattggcctcatcctagcatcactgagctcctttgaaaacatttccacagccccaacaaagaaaaacaaaaacctctgtacacatgtgttctttgtagtacgctttataaaaatgcaacaaaaattggattaagcctagatgtctctctctctctctctcacacacacacacacacacacgtctagatgtcttacactaaggaaatggtaactttagttcagttcagtcgctcagtcatgtctgactctgcgaccccatgaatcgcagcatgccaggtctccctgtcatcaccaactcccggagttcactcagattcacgtccattgagtcagtgatgccatccagccat

SEQ ID NO: 55833 - DNA, 1982 bp, Bovine  19866880733030
aatggggaatgtgcatttgctactgaagacaaatacttatgcactggttagacaaatgagaagtaatagaaattatcagaagtttaaaaaacattgatgagcacaagggagaccattgcaaattatgtgggggtaaatgaaagtaggcttcatgattttgaaattaaaaaaaaagagtgaatattcccagatgtatttttattaattcaggcacttgactttcccaaactacagcactttaaattttaaaatatataactttgcccttttcagccttaatatgaggtccatatacagagcttgtttgatttaggggtttactattttttgccttttaaaaattaagctaaaattttttgttgaagtatagttgatttataatgttgtgctactttctgctgcacagagttggacacgactgaagtgacttagcagcagcagcagcagcaattttctgctatacagcataatgactcacttatgcacatatatacattattttattatattcttttccattatggtttatcccagaaaactggatacagttccttgtactatgcagtagaaccttgtttctcctttctaaatgcaataatttgcatctattccaacctcaaattcccagtccctcctcctcttgcttgataaccacaagtctgttctttatgtgtatctgtttctgctttgtaggtagtttcatttgtgccttattttagattccacatataagtgatatcatatagtatttctttcttacttacttcactctgaacgataatctctagttgcatccatgctgttgcaactggcattatttcactcttctttatggctaatattccattgtatatatgtacaccttctttatcgattcacctgtcagtggatttttccatgtcttggcttttgtgaatagtgctgctgtgaacataggtgtgcatgtatctttttaaattctagttttgtgtgggtatatgtccaggagtgggattgctggatcatatggtagttctatttttagttttctgaggaactttcatagtgttttccatagtaactgtatcaacttacattcccaccaacagtgtaggagagttcccttttccccatacctattttagtttactcttttgaaagatccttttggaatttttgaatggtagcaacactatatttattacaagcccaaatttaaatccagtctccccccaccccctcgctctctatcactcccttcctcaaactgatgccaggccctcttataggggctagacacactatagtgaaaagacaagtacttgctcccatgacacttatattctagaaaacgacagttcagagttcttttctgccttcatttggtaacatccacctgtagtgagatcaatattctatttatccatgctagtataagaaaatataatttaagaagcctctcctattagggctctggtgctacaaagttgctgaggatggctttctctggagaaaaattggatttcagagtaaaactgagttttcctttgtattgccactctgtacagcaaaatgcaagaaagctacagtattccttctgcaaaatttacagattcttatccctttcagcacatcagagatacatttccagaactctgaaattcctggtgcagaggaattagatgtccatgaaagctaaataaagagaccagaggagtgaggtgtggtaggaaccttatggtgacactatttgctagaaagatgaattcacttaaaagtgagtccaccctgggatctatccagatagagttactgaaataccaaaaaggccttgtgaatgctgggagggattgggggcaggaggagaaggggacgacagaggatgagatggctggatggcatcagcgacttgatggacgtgagttttgagtgaactccgggagttagtgatggacagggaggcctgccgtgctgcaattcatggggttgcaaagagtcagaca

SEQ ID NO: 55834 - DNA, 1241 bp, Bovine  19866880747404
tttagacatacttcttttcctggtggcatttacattttaagatggacactagtgagaatacccaatcaggttgacctaaaaataaagcattgaataaaacagacattcagttgtgaaaccatgttcagtcaaccagaaaaaagaatatgccacatttaagaatcatgcctctggttgaatatattgaaagtcattgaatcgtacactttaagctggtgaattttatggtatgtaagttatatcaggagaaggcaatggcaccccactccagtactcttgcctggaaaatcccatggactgaggagcctggtgggctgcagtccatggggtcgctaagagtcagacacgactgagcgacttcactttgacttttcactttcatgcattgggggaggaactggcaacccactccagtgttcttgcctggagaatcccatggacagaggagcctggtgggctgccgtctatggggtcgcacggagtcggacacgactgaagcaacttagcaagttctatcaatagtttttaaagaaaaggctgggatatgagaaggctcaacaattttttaactttggcagactttcaggttttcaatagaaagttaaaaaataacccacttttttttttatcattcatttacgaattgatttttactgatttctccttgacccttcccccgacccaccaaatttcaaaacgaacatgcaaagcaatctctaacccaaagataaatcctacaataaagtattttttttaagttggcaaatttttagaataatttcacctaatgtgtcaaattattattaccaacttgttcctatgcaacaacaagccagcagtttaattctcaaacacaggaaacaaatatctttaggataacaggctttcctgatggttcagatgataaagaatctgcctgtactgcaagacaccagggtttgatccctagtttggaaagatctggagaaggataaggcaatccactccagtattcttgcctggagaattccatggacagaggagcctggtggactatagtccatgggattgcaaacagtcaaacacgactaagagactaacactttcactaggttatgaatcataaaagaatccttagatcttaactgaaattttcctgagaggcatcatacttaatgctcattgaaaggattcttgtaccaaattggtcaactaaattttagaagaatttttttttaaagttgtgtgattgtcatagtact

SEQ ID NO: 55835 - DNA, 1801 bp, Bovine  19866880872975
ttttcttgctggttgttatttccaaatagcaggagataacccgtatctgtagtgcaggcatggggttagttttgataaatcagcaattattttacacggaaagaagagaaggactgccttcttatcaggactttacacctcttcatagccacatgtcagctggggcaaggtctgccatatcatcccatgtcctgcaaagagctatagatgggggtcgcctccccttgctgatatggccatacatcactctttcaagctgtcaggggcagggtggacaagaagtgtgtgttcaggaagtagctttccagagtccttcctactgtgacatgtggaaaggaaacagaggcctgacttccggacctggacaggaaagcaggaacaggttggtgcaagaggtttgggtgtgcttttttcagaaaggaagtgaggacgaagtcattagatgtgagtcctctgttcctgcaaaatgcagctataaacaccatgtctgagcaaaaccttgaggacgacattcaatggcagtggaagtacatatgttttgttatcatgaagcttctgctaaaagcatgtcattttcttttttaaatttcagtgtaggtgtggaaactggacacatacagatattcttcccataaatatagtattttggtttaaagcaattgcatttttcaaaaatccttttaaagtaactctctcccaaatttttgcctttgagggaaggaaaaacaaatcagtttttcctcaaaggaatgcaataaggagatctagcttttcatgcaatagccataaagcactgcaataattcttatctttagtgacacgaaattcttttcaagcaacagttttaatgcttttgcatagcagtgacctttgctctccgcaggctgtcaaagatgtaacacctagaagtttgtttgctgtgcagggcaggtgagttgacaagggtattactatcttgctgagcatcacatgatgtgaacttctaaccttactcaagaatgttatatatttttcacattgactgatttttagtaaaaaaaaaaaaaaaaattttttttcagactaatgtgaaatatgtatgcaaaaacagaattaatcttatatttcttacaagttcttttcatgcttaagcttatagagcttgcatatatttttatatatatgaaaaaaagattccgtgtgatttttttgaactttgtataatatgcttatttctctaaaatagtttttaaacctttaacactactcaagaagacattcttcattatctatcattgtgtgtttcatctattgtcatcatgtttttaaaatcttttcatttttgcaaaactaaatatcttcaacatttagcttagtactttcgtaacagttctgtttttattgcccactgttctgtttttgctagtttaacttacaggtgcaagtacattgtttaaatctttcacaagctggctagtttagaatgttattttctttctttaccttcttttaaccatatatgcctctcaggacaagaaacataaggagatgattatttttggtaattttgaagatgtcggtcatgacgtggatagaataggaaaactaatttagaatataaaaattaatatatgcagtaaaaacaactaaacagatttaagttgtattcagaaagtaagcttattgatggcttatgacattgtactccattccattttttgttgttgtttgtaaaaacacatctcacatgggttattttttcagtgtataagtggtgttaacctttgtgaacccacagtgcttccaaggatatcgatgtgcg

SEQ ID NO: 55836 - DNA, 1354 bp, Bovine  19866880894372
accctcagggaggaagggcgcgctctctctctgtttatgaacaaggtaatgtgtgtcaaattgtcttggcttaaccaggcaatcgtgcacctttaaagggtactgggaaatgtttctctgtggtcagattggcccattatgcacatctgttctcttgaccaaactccagcaatctgcccccgcttagccgcaaactccacaacctgctcctggccagcagcccaggccctgcaggagtgtcaggacacagccagccagctggatttctggctgtccagaggctctggagggtggcagtcagaggaatcaaagttcatgggtccccatagcttcagggcatccccaggaaacctacagagatcttaggagggacccagaggaaaaggaggggagaagggatgatgatgtgcctagagagaaagaatgagtgttgcctttttatacagttcatggggttctcatggtaaatacactggagtgatttgccatttcctcccccagcagtcatgtatggatgtgagagctggaccataaagaaggcagagcactgaagaattgatgcttttgaactgtggtgctggagaagactcttgagagtcccttggacagcaaggagataaaaccagtcagtcttaaaggaaatcaaccctgactactcactggaaagactgatgttgaagctgaagctccaatttgctgaccacctaatgcaaacagccaactcattggaaaagaccctgatgctgggaaagactgagggcagaagaagagggtgacagaggatgagatagttggatggcatcaccgattcaatggacatgaacttgggcaaactcaaggagatggtgaggaacagagaagcctggagtgctgcagtccatggggttgccaagggtaggacatgacttggggactgaacaacaaggtgtatacactgctttgggggagtctagattggagaagactcttgagagtcccttggattgcaaggagatccaaccagtccatcctgaaggagattagtcctgagtgttcattggaaggactgatgttgaagctgaaactccaatactttggccacctgatgtgaagaactgactcaatggaaaataccctgatgctgggtctgattgaaggcaggaggagaaggggaccacagaggatgagatggttggatggcatcaccgactcaatggacatgagtttgagtgaactccgggagttggtgatggacagggaggcctgttgtgctgcagtccatagggttgcaaagaattggacacgactgagcaactgaactgaactgaactgagtggaaactaaaccaatatctgtaggtttttcctttaagaag

SEQ ID NO: 55837 - DNA, 1143 bp, Bovine  19866880937521
atcgttttctttttttccttcctcttcttcagggaaacgtctgttcatcaaggcaaacttgtgaattgcttcttctacagagtacttagtctgcccagaaacacatgcctcgatgtcttctgaatttagatgactttgcaggaagaggtgaaggctgctatctgaaagcagaagtgcattctgtagaaccctatgtaaaagaaaaaagaagacatgatcagtgcacagggagggacaattataggacgggagagagaaaaacattagaaatgtgccactgaagtgatttctctactatggcaaacttggcatcaattacagactctccctattaaaaggatgaaagcatatgttaacttttattcgattatttggaaatttaggtgagtaaaaacatgaagctaatagttaagaacatctgttaaaagaataacttcaaggacatttcttcaatttaaccatctgttatgaccatgtggattaattatggaaatattttgcttagatagtcagagaaatttattctgcctttaaaaaatttactgcctaccagcatgtcagttctgtgatctttattggttaggctgtcatgaaacatcaaaactttcaacaactattaaaaactatattaaaaagtcaggacatttctcagcatgtcttacattttcaaactttacaaagatgcttatatacaggttcacaagggctcaattgagagggagcattttttgaatacttaaggtttacctgaaatttctccagaatcttcagcatattttaaaatgagtcactaaataaaattgctcccagccagttttaccatatatgtaattaaagtatgataagtcagtaacaagtacatactagccttcccacattccaagatcaaaatttacaaagggaatacagatttcagctagtacatcatggagaatgaaaaagtgccctgtagccaaaggtacacatcctcaaattcgttttatcagttaatgtgtcttttctgaaatgcatatcaaagaacacccttatgtttaaataaaaattggttttctctttttagcaacgattttgacatatgataatttagtctctgttaatagttcaataatggcaacccactccagtattcttgcctggaaaacc

SEQ ID NO: 55838 - DNA, 1143 bp, Bovine  19866880985825
tggcaagaactatgggctcttggaatatacaagcccacatcccttcatcttgtgtttccctcactgttttccctggactcattccctagcttggtccattcctgaaacagttgaacttccaagtgttgggtatcatcattcatcaaaccatttaaatgaaaggtacattttccaccttctttcttaaaggctgaagaattattttctcaaacttctgtttctctattgaactaataaaacaaaacacttttaaacaagtaaaaatatagaaaaaaatgtgaccaaatagaacaggctgtgagatgccgagcaatttaaatttgtttgctatattgtattgattcttttcgaattcaggcaaacagtgcaactcagaagactgggtagctcataggcctcctgctttgggtgcacctcccaggtacatcctgttttggaaggaggctattttgaaacctgctcctggccatctttccagatctttagtgaattaatttggatttagggggagaaaaaaggacaaaaaacctcaccttctctgtatgtggtagaatttcactgggatgcaaagtgggagcaagaggaatatgaacactcagcttcacttaccttgcaagattttaggggctggatgaacatgcttcctagacagtgcaggtagggggagttagggaggccccaccggtgtgtgagaaagcaatggtctatcttgagtcctttgactgagagtaataaaagaataattgcatcatatgttggactaaaagttttcaacagatgacctgactttggtttttcaaaaaatatataaaattgcaagggaacccacaactcatcaatgagaggagcacatacttttgttcattggaggtgaattttatggaaagttgtactttgcagattcggaccaacccgccccatcctccccctcctactccttttctcacttggctctgaggaaacatgcttccaagtttgagacttcatcttttctgattaatgatgtgtacacagagatttcggtctcatcttcctactcttggtctttcttattccgttgtttgctatgcttcaaccctgcggatagatggttctgctgtgataaatgtacagtttgcataagccatgtaacagcaggacagc

SEQ ID NO: 55839 - DNA, 948 bp, Bovine  19866880989062
tgttaaatttcagtgatccatttctttttcatttgagtgaaattgcatttagcttcctattttcagacaataggaaagtaatgaaacagtagcatatgaatttgatcaaaataaaccttggccttgagaaccattaactggattattttgtcagataaataaggactgccaggtgcagtcaaactgtgtattcttttgacattccaaatggctccttctttggcttgatatttgcatacttgatgaccaaaaaacatagatacatggttactacaaagtaaaactaagaccaaattttataattaaaattacattttaaatgtactaggaggtgacttttaagaatacctgttactggatcctattttgtaggtggataaataatatttttgtgacagttgttctctctttttaaaattagcttattagatatttaaaaaaaaataaacctgtattatatagctacatttcataattaaatacaattaaagttgaactattgttttcttgaactgtatcaactggaattggtactggtatttgtaaaattatcctttgggtgataaaaaatacatgaaataaaagttagtgttgctattacatataaaatatttggattttatttactagtaacttctttagtttaaaaaattttcacaataaatttcttgctcttgctattcattgagcttttatatgatgtctctcatcatgaactattttttctgttgacatttttttactaagtttgaaatgcattttattgtatttttatgtatctttaaaggtataggaacccattgacctgtgtaagtgcagacacttctgtgaactagctgtattcctctgaggctatataaacattgctagtctgttatttaatacagaaatatgaagattgaacagctgtttatttcaaaattatatcaatggaatgtatcctcagaa

SEQ ID NO: 55840 - DNA, 1986 bp, Bovine  19866881005885
gcttctcctgtgatctctctccttggcttgcaggtggccactttctcgctgtgtcctttcatggtcatcccttggcttatgcttttttctgtgtgtctgctgttcctctctgtgtgccagaatttcatctttttataagaacaccatttatattggatgagggccaaccttaatgacctcatgttaacttaatcacctctttaaatatctgacatctaaatatgattgtgtggcttctcttgtggctcaactggtaaagaatccacccacaatgtagtagacctgggttcaatccctgggttgggaagatcccctggagaagggaaaggctacccactctagtattctgctgctgctgctgctaagtcacttcagtcatgtccaactctgtgcaaccccatagacggcagcccaccaggctcccccgcccctgggattctccaggcaagaacacaggagtgggttgccatttccttctccaatgcatgaaagtgaaaagtgaaaactgaaagtgaagtcgctcagtcgtgtcctactcagcgaccccaaggactgcagctaccaggctcctccatccatgggattttccaggcaagagtactggagtggggtgccatcgccttctccactctagtattctggcctagagaatttcatggattgtatagtccatgatatcatggatactagttgttgggaatccaacacatgagtttagggtgtgtgggaatgccattcagctcatgacatgcatcttctttattagtaggtaatgatgctgcccataaagaaattgttttacattttaataattaaaaaactttgttttcaggccatagacagacatgctaaaaaaataatttcttataagttagaggataaatttctgttagctcctttgttcattccttaataaagaaatagaatcccagttggcaaagggaaaatgattgactagaattcaaggaatttcaaaatggctcacctaatcctctcgttttgggcactcaataaaatgcattctgctatccaagcagagcttaaattaaatagcaaacttattgagatcaagacagtatgaagaatatccagagatataaaccccttcaaggaacttacaatttgtttgaggagacaaaagcataaatatatggaatattgatagcgaagcttgacagtaatccaagaaatgccacaaggcagaatgggatgaattgtggaaagtggaccccagaaagttgatgctgtgaattcagaaaaaggccagtcactggggaaagtgatccaggaaggcttcctggaagaggaagaagttatagtgctgagtaactggggagtgaattctcttagaagcatctctcagggatgcaagcacccctcctccccatctcccccagtgctagaagagtcaagacctgtccagtgaagctatgtatctgaaaggagctggcacgtagacaggaacctgggagggagggagtgggtaagtgtgggcaaaatctgcatcggggagtggggagaaaggaagtgtctagaataacagtcgtgaccagaaagagtctgtatgaatttggagattcagagtgatgaacctcttgggctgggtcagaggcatcaaccgctgtggcgctcagggcggccagcttggatgagaggcgagaccgagctgaagtctccacttgtgatggtgggagagacacaggaggaatccaaggatggataaaagactggagctggccgccggtggggatgagaccaaggatcacatttacagtcttcagtccctgagcttcagtggtagataaacaggtttcgttttggaggccatcgaaagggagaaaatgagacaggaaagttggcagaactttatcactgctgttccacttagcaggtcaaggtcaagtactctattctcttcaagggggaaggagtggacaccggggccctgtggcatgaaggacacagacggtgagaccctgcagggag

SEQ ID NO: 55841 - DNA, 1084 bp, Bovine  19866881071483
acttagtattgactttctttctctataccaactctccagagaaaatcttaaatgttcaatatatgtggcaaaatagcctcaaaatttatgttttctgaccaaggtaaaatgacttttatgattaacggtgtctaaagcacatactttaatatagctggttttgttgacggcacaatcaactattactgaaccaaaagacaaatacagtaaaagacactgtaatcacttttttcaaaaaccataaaaatatttaaatgaccactgtgactatcccctctagttacaaaatatcactactacgatttacacttcaccatgtagaactcagtggtcttctggcaaattacacagcataaaacaactttcacgtgaagagagagcctgaggtgaaatctcaatccttacaaaccagcacgcatataagctacattaatagctctgtattttgcgctatcagttaaggaagcctggaccactgtatttggttttcagttgactaggttaaataacatagaaacacagaaaattagccaccaagtgcatgtagttaaatttattaaatagaactacaacactcaacccatagttccatgaagtttctctccatgcatgatattatcccaacagttcagaaaacagtgataattcagagatttctttgcctgtatagctacttttaagattctgacatttttgaaaagacaaataaattctcaaagtagcttacgaaacacttaaaagatctattaaaacggtaacttggcatactggtatttgtacactcaagcatattttatttattccaaatacttgtcagttaactggccttttaaaacccaaatagagagactaaaatacatctacaacattacaaatcactaacaaaaggcaaaaactcattacttacctcattttccaaacttaccccgctgtccactatcgattacaaacaaagttattttataagcgtgcttagggtcaatgaaaatacccaggcagacccccttcgcttgagaccttatgcttatcaatgtaatcatcaaccatgattgcaaacataaacgagaaaagcaagtgacaaagt

SEQ ID NO: 55842 - DNA, 785 bp, Bovine  19866881161932
tcgtgcagttggatttggggtctgcaagtttaatctggatgatgattttcatatgtctgctgaatagtcattagaagaatataaattttactgaatatgtaagttttctcaaataaattgatcagaaacccattagacatcatagagtagtcctagttatatcagtggaaaatatctcataagatccatttgactttatattccagacttagtcaaatggcaaatcaaatcccaagttttctccactggatctcaactgtgtctcacaatctcttgcagagagtctccaagcagacaataccgattgatttgagtttgcattccatataaaatttaggtgctcctcctgttctagaacttttagctccctacttttgaaggagaggaatttacagaattttccatctttttctattgccaggatgattttcttttaaactagtagaattgtttatcaaagagtatgcaaatctatgaacccatctgactctggtgtatttttcaatgataaacctttaatcatctttcttttatggcatttggtctactcaagttttcatttcttcttggatgaattttgatagcctgtgctttgttgtttttgagtcactaaatcgtgtccaactcttttgcgactccattgactatagcctaccaggctcctctgtctatgagatttctcaggcaagagtattggagtgggttgccatttccttctccagggaatcttcctgacccagagatcaaatccacatctcctgtactggcaggtgaattcttcacca

SEQ ID NO: 55843 - DNA, 908 bp, Bovine  19866881314360
catcaggattagtggttccaaaggaaagagagagtttgctagagatccagatttgggagtgagaaatggaataatgttttgtagaaagcatctacttaaggcatctatactcttaaacccatcaatgaagtcatttatttctctcataaatctgtaatgatggcacagttgcacataatgatttgtaatttcccttggtcagcaaagagaaaaatgaaagaagtgaacaagcacttgagtctagtaatacgcacccagtatttcttaatagcccctgaggtggcaaacctacatggtcttgctttctgaaaatcatggcaatatttgaggggacgagtttccagtcatgagtgagacaaataatgagctaatttcttctgtcctgtataacctgaagcattagccacaattccctgcaactggtgggcaaacctgtaacagaaaactcattgtattcctattcttagtccatttcctattttcattgtgtaaaaatttattaacaggcttataaactaaaccatgtttattaactaaaaactgaagccaaaacattgactttgttccactaaactccatatcttgtcctttcatgataatttttctattcccctccctcagaactgaggagtttgtgttatatataataaataaataaactttacttgaaagtgtctgttttaaatcaagatgcatttttagatacatgttattaggaacagtaggtaaaaatatcaacttatctacctgaaagaattattttgtgaactggttactgggactaatgtataataaacacactatcatcttaagggtaaactctctttccctggagtggttaattaccagtcagatatttttttttacttcttatcaggtccatcatactatccccattacttgactgt

SEQ ID NO: 55844 - DNA, 909 bp, Bovine  19866881345766
gaaagaatactgaggctcagaaattcaaaataatttgccccgggttatccaacgccttggtggtgggaccagcatttactctccttcttattagaataatgcaacagtactgccccaaagcccacattcttcagattgcaccaagggctgcctctgtcctctccaaatgccctttggaaaatggcccataagtttccccaaaacaacagttgaagacaaactccagagactcagggttttctggaagggctgtctctcaaaaagcttctgccctgaactggaatcttatttgcatttgtccttccatggtagtttccaattcccaagcagaacacacatttaactgtaaaattcgccttaactaggcagctgtctgctgcagtcaggcacaaggctcaggtgcagctcccagtagggtctcctgaatcagcgtgccagcctccgtaaagcaatgtaagtcacctccgagaaatgagaggccgcttggaagagacagacgctgccgtgcccgcttgtcagaaccgtgcaggggatgccagtcatgactcaattactcccgggacttctctcctgaaggtttccctgtcatttatgagaaccagtgcagggaggactaccacatgtcctagaccaggaacctatctaggaatgaggagattacaggtttaattggcctctcctcaccacagtgtcaacaagccatcaagataagagctcttgacatccaatgggcaagataacaccattcaacaaatggcatctgagcctctattatattcaagaccttatgccaggggacacaaaggtgaatcgaaagcataatctcagcctgatatgaccctacaatttagacagctatataaagtgcctttagaaaggtataaccgggtgaagtacaaagatacagtg

SEQ ID NO: 55845 - DNA, 1167 bp, Bovine  19866881372120
tgccatttccttctcccaatgcatgcaagtgaaaagtgaaagggaagtccctcaggcgtgtctgactcttagtgaccccatggactgtagcccaccaggctcctccatccatgggattttccaggcaagagtactagagtggggtgccactgccttctccaactgatgacacagtgaccacaaattcagcaggagcctgtctcatgggtgtattcatatatcgaaaagtaatatcaaaacaaaacaaatcctagacatacttcacaaatgtaaaagattcaactcaattcagttaggttttttaaaaatatatgtcaccaaaattacataaaaatgtgtaaattagactttttatgcctctgcaagagatataaacaaatatcaattttttattggtgttcttgaaaatgaggaatataaactctaattttcttcctatatttaaagtccaacaactctttccagcaatcaattagctatttccaaagctcattcattataatcacacaatttaaattaatatccatgatttcctaaacccttatctgttggtaacaattgtctccattagtttggtaccaaatgaaatttccaataatttatcacttctgatctccaaaaacaataactttataggattcaggggagaaataaaacttcaaaattttgacaccaaagtggtagctcaattttcttagatacatagcatctattgtctttataactggcctgcaagtgtatcatttattgtaatgatacctttctaaccagaaaggttctgagtaaaatctacatcctactgtagcgcattcaagcataaacaaaatactgttaatatttaatatgaaatcagctgtcacaaatgtagccaacagtgaaaaagccatgatacaaataaaattactttgtgtgattctccctatttccagatgacaagttactatgaggtgatatcctctctcttaataacaaacaacttctgtcacataatgtttatgtcatgtaagttttgtaaatcaatagtggaaaaactggtttgactttctgggagagaaaatgattgatcggcacagggcataaaatacattatttaaattagaaagacttcatttgattggaatgccaaccccatttttaagtcataccctcatataaccacattaacct

SEQ ID NO: 55846 - DNA, 967 bp, Bovine  19866881397071
agatgtctacattgctagtcccctgggctacttgttgtcccctgttagtctctgaatggcagaagtctgttctgctcaagcacaaagtatacacagatgtctatattacattcttataggtttgacagcaactgcatgttgtatctataaactgtcctttagcagtgacacttcctcaatgatgataagctaatttatgcaactaaatctcctttgtgcagaaatgaaagctaattgagtcattacaaagtaattcaggaaggaataccttgtataaattggcttactttataaatccttctcaagtggttttcatgcatcctaaatgggtctaagcagcttatcagccataagagatccagacccaaggacccaactgcagggagctgaggacacatctttagagtagggagaaagtgatgaaaaggaaagtgaacaagaccaaaataagcttttcccaccagctcattacctgtggtgtggtgaacactgtcctgactcatcttcctttgtccctccactttcaccagagctccgtcctcctcctcttctgtaaataaacaacaaatggaacacttgaagtccagtacgaacaacgcagtactcaccccatcttaagagcaaaactaaaaatttataacacataaatattccttttcaaagaaggaaaccactcaacatccacattcctttttcaataatctaaagctgaataaatgaacctatagctatatccaaatagcaacctgaccagttgacttgataaaatttaaggtatgtactaacgtttcacatattttgttttaaatgctcttagaaattcatctggaacaatcttaaatccagaaaagccctaaaaatccagtaaaatgatacccagcattatatggattgaccacattatactgtggcatgaataccacacagaataaaatcactgtccctaaaacatcaacagaacagagaa

SEQ ID NO: 55847 - DNA, 990 bp, Bovine  19866881421497
atttaagaaacataataatgagatgcaatacactaacctaaatggatcctagtttgaacgaaaacactatcaacatttggaagacaaagggagaaatgagaatacggatgggttattagataattaataacccaaattaggttatttgggttttactgttaattttcttaggtgcaataatagtattgtggataggtaagaaatttccttacttttaggaagtgttgaatttatttagggttgaactaaatacttcatgatgtctgaaactatttgaaatggttcagataaatagataataggtaataaggcaaaacattaaaaatgagtgaatctaagaagagactatacattcttctatgtttttaaatttttgaaaatacaaacttaaaggaagctctttttcgtactttacttagacatgctgaaagggtgatctaggagaatacgtatgcagactgatgtacccttttgacctagaagagtatttttaaaaccaggttacttactgacttactgcccaagggttccatagctggggaatacacaatgagaaatcaagcccatcacaaaggtatcagtgatggttatcatcacttcagcaaactgccgtaccctcagtacacagtgccctcagccaccatctccagatcaatatggctatcaatgacggatggccaaagcagccccatccactcaggtcattcttagttcacatggtccaaaaggatttaggagtcttgtgtcactagacatctttagaaaacaacctagccattaaaggcggaagcagagtaatgttgtatgtcagacagcacactgttgacagtttaaatatactcagaaagcttaaaatgtgttgattttctgtgtgctacaattgcatttttactggcggagaatgtgtcattaaaatgtaaatgcatgttgaaagcaaagctataaaaagactttctgtcacaagccatttctagacacaccatagctaag

SEQ ID NO: 55848 - DNA, 774 bp, Bovine  19866881426418
aaaataataataataaagagaaaagaaaagcctaagaacatatcaggattcaaatgaatggcaaagaaaactcaagaaaaatgtatcctcatatctatataatcacatgaaggaatgaaagtaattaatgacttctaacattctgtaaattaagatcgtacgtttagaagcaaaaagcaacaatttttctggtttaccggggaggaaacttggggcagatgactattctgagcctcctaatctatccctttctacaatctcaggcaagtcttatctttctcgtgacattcaacatgtttaggcaaataaatcaatgagtctccatatctctatcccatatctcaaactctctcttaacatttctttgaataaatttctcaatactccttcaagtttaacagacttcatctttatagacggcattattatatggccttgagaaaagaatgtaaatgtcaggattcatctcaggtctaacaatgaaatccactgttggttcttccccatactgcctctgagtactttctctcccttgtcccttgcctctatcatcaaagtgaccaacaagcctctagttaggtctttcccaggcatgtactccccagaagggtatacactcctgtcccttcttctccactttccgccccgcccctcacaacaagccaaatttttatttgtcttctgagtacattatttacagcttccctgggggtcagtggtaaagaatccacgtgccaagtaggggacacggttctatcccgggtcaggaagatc

SEQ ID NO: 55849 - DNA, 974 bp, Bovine  19866881481422
aaggaaattcaaggtcctagaagtagaaaaggaggcccttttggttttagtgtttcttctaatgggggtggaaattttggacgagggccaggaactaaatttagaggagaagctgatggatatggaaatggtcccggatctagggatggctgtcatgggtatggaggaggacctggaggtgggaattttggaggttacccttgttatggaggtgggaattttggaggttacccttgttatggaggaggaggtggagaatatgctggtcgaggtcctgggtatggcaaccagtgggaattctctggaggtggttatggcaataattttggaaattacgaccagcaaccttctaattatggtccaatgaggaatggaatctttggtgttggcaggaacatagtggccccatacggtggaggaaattatggcccaggcggcaatggaggaagtgggggttatggaggcggaagtggatattgagcttcttcctgtttgccctgggcttcactgtctgaatagcagaggatgagagcccagacataacagaacagtttcaggttcttgaaataaggacattaagaaaactcttatctcagccatgaataaatatttagtgatgtgtcagaagacctcagagcagattcaaagagtcatttttgtgaatggactggattatttaagaacattaccttcctgtggaggaaaaattgtgaaaaaaactgactttgagacagtttcctagcttcttaattgtttatttctagtgagtgtagaagtattccttctttgataatgttaaatgtgtaagtttcaggtgacatgtgaaaccgttaaaatgtttttttctcaaagttttgaaactattagccagaataagcacaatagacagaatgttgttccttttattggaaaaataaaaatatattaaacttgaaaaaaaataaaaataaaactgtctgtagagttaagaagca

SEQ ID NO: 55850 - DNA, 1631 bp, Bovine  19866881601637
ttagagagggtgcattatgaaggactctgtaggcctttgagtgacatagggagtccctgccaggtcaaaagtagaggaggcagagcatctttcatagaagaatagcccatagcagaccagggtaagtgactgcaactatccaggagagaaaggatggtggctaaaggcagagtggtcgtttctcccctagtgcagtgcctgcccaatgttgttccaaaaataatagatggggtcagtcagagtcaaccaaagcaaattcttcatgatgagtcagcaccaggaaaccagtgctcgggaagacccaacacattgtcatgcatggcacaaatagcaacaaaatgaagaatcagtcactcagaaccacccagttatgaaaaacagcaccccaccacccagaccacactgcgcgtgaagctgtaacacctgcattattgaaacctcagtccctacgccctactgtggaagcaatctgctttgtcttcattgtcctggaatcttcccactgggatatatgggctgtgtccgagccttccccagatgatccctgccctcatacagcatgccttggttcccaggaaattgtattaatctggagaaattcactttgttctaacagattgctttaactacatacctaaagtataatctcactaaaccacatgggaagtattttgcatttgtactgtattttttgccaaagaagtcactgcaagtgtttctttgcattttcttgtttcttaaaacaatttcctcttgctgtattgtagttacagaacattttattaatttcaaagctcaattgttttgtgaaactggggtgcccttgtgttaaaatactgattgttaaaaaggggcattgcctggtaatgggaacatattagttttgaaagaaaagtccacttggttattgcttacatagatcacctacaacctacaaagctgagcatggagaatacacatgaaacattttaaatttgccacctgttttcttgctcaatgatttctcagtcttagattagtcagaattgatttgatttgaccatttctcgggagttaaagggcctatagtcctcttcttcttggctttagtggagaaggacggataatcctggcttttcaggatctctgctctatttcttgacccaacttcctgcccaggtgaagctggctgttgaccaggagtttggaaactcaacccttctaagctaacctggctctgcccagccatcgtcaaggacatcaccttatcaatgcaggttccagagagcttcctatgactcccaaaagccagccaataaactcccatttccagggagagcgtttaggtgagttctcacatgatggaaaagcaattcatcatttgatcaatatttattaagcatccactatatgcctggaacctgcctccaaggatcccctatccagcagctctgaaatgctgcagcagatcaaccctccctactgggcagaccatcaaagcctctctgcaaattgagttatggggctgccgtggacatgtggacccattcccacagtgctgcctacaggccagaaatgcccagcatgcaatgctgcatgacctcgggcaagccacctcacctccctgagcactggtctcctcatctgcaagg

SEQ ID NO: 55851 - DNA, 1121 bp, Bovine  19866881825225
aatcagaataagcccccagaagaataaaaaggaagaggaaaggaagacataataaataaccttaataccttacaatgttaactttcacataagtatattgtttctggagaaggcagtatgtggatgggagccaaaagctgaagtgataggtaaacacactgttaagttgaatcctgttatctgattgtgtttaaaatttgattatatttcacttgacaaaataattaattatggtgaactcccaattgttaacacggatctagaagaattccagttggcatttttccccagtgtcctcgatccaaatggataaaattcaccctttccaccctttacagttgtcatactggtgtatctgcttaccttgctaagaatgtaaatcacatcaccacgtttaaatgacaattcatcagaaagagctcctgtgcagtcccacaaaccctggtaaaaattagcataatcggtgcttttatctcctgggaagaagaaagagaaaacaagagttaattttcctgtaatgggccctcatttttaaatgaaccaatagtagttaaagggccaaaaccgtcttaaaaaaaaatctgtcctcattaaaagaacacttcattacatccacacaagaattctactccttgctctcatctaaggacccttttcaaaaagatctattttgaatgtctcttttttcctctctccctctcttgttcttacctaaaacttgcaactgcagtaagtttcttcaaacaaagttacttcccacttattttctataacaaacctaagcccacctgcaacatgttttgaaggtaagtcagcctccctgcataataagcaatatgcatgagatatgataaacaggctgtgaaataagcactggacagaactggtactgaaactgcagaaataagcactgggcataaaggagataagatataaacataaacaaacaagataacacacacaaaaaattttttaagttttttaaaatgcaaagctagttaaaggaagagaataaactgaaagtaatctaacagataattcccgctcttatctttgaggacttttgtatccaaagcctctcaaagtgtttccaaactattttagcaacttgaaatgccagg

SEQ ID NO: 55852 - DNA, 702 bp, Bovine  19866881935292
atgtggcaaatattcttaactgggtactccaaatggtctttgtacctcagatgtatttttctaagccattaacacattgaagcccatccccaaactccccaagcaaccattaattaacagtgtaagacgaaagagccaggcctcccattgtgatgtagctggaactaaacctttcagcagtgatggtgttcagaaccagtcactggatgaggtctcttattcacagcaaatatttctatcatgagaagaaggagactgcggaggaaggctattaaaacagtgcttttattcagagcactttttaaacatctgggggggggggggagtacaaatatgtttttgaaagattcaaggaatctcaaccttgtgaggaattttgaaatgaactccttagcctgaccctcaaacagctcccatatctgaggacccagtaggtgctaagccctacattaggtgtttcaagtattatcactgatgcttaccaattcctgcaaggtttctgttttatagatgaggaaaagaagcttagagaagagactctttccaaagtgtcatggcaatctagaagataaaacaaagatccatacaggtcagtctccaaaacataggcttctattgcacactgaccccctaaaacagcaatctagctccaagcttatatcctatgccagagggtagcttgttcaagcacatatctaagaa

SEQ ID NO: 55853 - DNA, 1342 bp, Bovine  19866882027946
atttacatgttcatgtgtaataatggtatccatgaaatgtaaactataaacaactatgaacagtcttctttcttctgctaagtcttagttaagtaggtgattttatcagaaaatttagagtccatgttaaattatgattatcatagataataagtgtgttactgttatagaaatataattttgtacagtattgtgaactgagatcaagattttacttctctgtgaagaaattttttctatttcataagaccaggagagggaggtttcaaatccttgtgacttcggttagttaagcttctcatttctaatttctgtaaaactcaatgaatactaatatctgcttccatcactcatagtcctaaatggtatatactgttaggtcaaagattagcaacagtcttccccaaatctaatataatttatccccaaatataatccccaggacctatttatatttatttcaaaagctaatactctaaattctagttatttgaggagaaagtgatagtgaaagtcactcagtcgtgtctgactctttgcaaccccatcactatatagtccatggaattctctaggccagaatactggagtgggtagcctttcccttctccaggggatcttcccaacccagggatcaaacccaggttagttaaattcccatttctattcttgttttttgaggcctgaggtaataatattctttttaatttgtattttaagtactttgtgatccatctagccactaccacagctttttaaaaactactattctctcattccctttttatgtggatctatgaaggtttggtttatatttccttaagctcttccctgtctgtcactatgaagcctcctgtttccactgagatttcagatctgtttttagcggttcgttggaattcttggccacttctggcttttagggacttgggaggtgggtatctatcttcagacagtttttaattacttgtttgacatgatcctaatttccttagtgttgttttcttcctaagaaaatgtatatgtcacatgaaatttttgtttttatatgtgacatcagatagctaatttgtacatcagtgtttactgtatgtttgaaccattaatctaaactttggaaagagctatttggatatatgagaactatgatcccccagctaagtaggatttagataaatggattacagaggtgcagaaaagttgataccacttactgggttaaactgtactttgttactctttgacagttacgtggttcacattttctaactcactgtgtgccaaaaaacattcggacccatcaagataatcatggcttagaaagactagttccagcctctag

SEQ ID NO: 55854 - DNA, 1656 bp, Bovine  19866880466640
ttctgacatctctttcctcttatttgtgcatgaggatggtatcagttcagttcagttcagtcgctcagtcgtgtccgactctttgcgaccccatgaatcgcagcataccaggcctccctgtccatcaccaactcctggagttcactcagactcacgtccatcaagtcagtgatgccaaccagccatctcatcctctgtcatccccttctcctcttgcccccaatccctcccagcatcagagccttttccaatgagtcaactcttcgcatgaggtggccacagtactggagtttcagctttagcatcattccttctaaagaaatcccagggctgatctcctttagaatggactggttggatctccttgcagtccaaaggactctcaagagtcgtatccaataccacagttcaaaagcatcaattcttcagcgctcagccttcttcacagtccaactctcacatccatacatgaccacaggaaaaaccatagccttgactagacggacctttgttggcaaagtaatgtttctgcttttcaatatactatctaggttggtcataactttccttccaaggaggatggtataggtgaactgtatttacttttacagtattcatactaattatcttcaccttttatgtggctgaaaaaaaatccctatctaattaaaaaaaaatagaaacttatctatatgaataattggagctttccagttggtgcaactggtaaagaatctgcctgctaatgcagtagacttaagagatgcaggttcgatccctgggttgggaagatcccctggaggagcgcacgacaacccactctagtattcttgcttggagaatcccatggacagaagaacctggctggctatggtccataatgtctcaaagagtcagacatgactgaagtgacttagcatgtatgaatgcattattagccatatgaatataggactttcataaattctctgtaaactaatatatatatatatatatgcctttttaattattgtggaagtctgccaaataatctatattctttttgtaaacaaactgcataattttatttcatcagttctttctgatacctatacttatagccactttatagcttaaggttctacagaaagatggaaccaatagctgaaggataacaagagggagaggaataaaaggagaaatgggaggagggagaggaatggtgagagagggagacagaaatggagatatacttatttttatgaattggctcacatgattatgagggatgacaaatcaggaagctgtaaccaggctggcaggaaactcattcaagaatttattctcatcttaaacaatcttgagatataattttctttcccctgggaaactttagtttttgctcttatgactttcaaatgatttaatgatgcccaatacattatcaagagaaatcttcttgacttaaagtcaactgattgtagatgctaatcacatctacaaaatagatgaggtttacattaacacagagattgctgtttagttaaataactgatattacagtctaaccagtatgacacataaaacaaaacatcataaccactgactataagaaaattatgcaatttcaagtacctatttcacctgtcataaattctcaatagcaatatactagat

SEQ ID NO: 55855 - DNA, 1122 bp, Bovine  19866880522092
tagttccctgaaattgttttgattcctttggatatagacacttaatatcccaatttttaaatttcttctactttatggcaatgcgttattcatgcatgcataaatatttttctgagttggctttaaatcaatctttttaatcctccaaatctctacatctgatatgaaggattaaccaataatgtatttgtatcacatcaaaattactttcaagttgtggaaaactaacttgaaattaattctgtaccatagtggatctacttaaggcacacagcaaaattcaaaatgaaattaaatgtatatataaatttttttctatatatgggttttaaaaatgtaaatttaagacgcacttatgtaagttgagaggcttcccgggtgtcttagcagtacaagttccacctgcaatgtaggagagacaagaggcgctagttcaatctctgagtagggaagatccccaggaggagagcatggcaacccactccagcatccatgcctggagaggcccatggacagagatacctagtgggctacagtccgtggggctgcagaggtggaagcaactgagcactcacagatctgagttgaatgtgtaagaggctatcaaatcgacaagacaagtttctcctcttctacacaaaactggacttcatttcttagcttctgttgctgttagatgtggccatatgactatcgggttgactataagtagaatgagggtgaaatgatgtatgtcagagttctgtctataaaatcccaacacatgggatccactgagatcctttctcttttaagatagctgaaatggagaccaagcctatggcacacttgggagacttttgctgaggatattagagccataatatggaataagcaagaattcttaaggagcttccccagtgactcagtggtaaagaatctgtctgcagtgcaggagatgcatggtttgatcctggggttgggaagattccctgaagaaggaaagtcaacccactcccatcttcttttttgagaaatcccatggacagaggtggctgagtccatgggggtctcaaaatagctgggcatgatttagcgactaaaacaacaaaaagaatttgtacacattcccttatttgaaga

SEQ ID NO: 55856 - DNA, 3781 bp, Bovine  19866880524208
atcctctgtatatatactgtgctgtgctcagttgctaagtcatgtctgactctttgtgaccccatggactgtgtaacccatcaggcttctctgtccatggggttttctaggcaagaatactggagtgggttactgtttcttctacagggggtcttcccaacccagggatctaaccagtgtctcctgctttggcaggcaaattctttaccactgagctaccagagaagccctgcaatgaacataagtgtgcatatatctttttgattttgtgtttctgttttcttctgataaatacctagaagtagaattgctagattgtatagtagttttagtcttaattattttgaagaaactccatactattttcataggcatatactaatttacatccccagcactagtacatgtggtctcttctctacatcctttgccagcacttgttatttgtggtcttttagatgatatgctgggaaagattgaaggcaggaggagaaggggacaacagaggatgagatggttggatggcatcaccaactctatttacatgagtttgtgtaagctctgggagttggtgatggacagtgaagcctggtgtgctgcagtccatggggtcacaaagagccagacatgactgagcaaatgaactgaactgaagtgagatgatatccattctagcaggtgtgaggtgatatctcattttggttttgatttgatttccttgatgattagtgatgttgagcatgttttcacatgcctgttggccacctgtatgtcttctttgaaaaagcatttatttatttcctctgccaactttttctatcaagttacttgtttttctgatttgagttgcttcagctctttgtgtattttgggtattaactctttatcagatgtgttgcttgcaaatatcatttttcattcaataggtggtcttttaattttgttgatactgtcctttgctgtgcaacaatttttaattaggtcccatttgtttaattttgcttttgttttccttaactgaggagatgtatccaactaagacccatgtcaaagaacatactgcccctgttttcttataggagttttatagtttcaggtctcacatgtaaacctttaatccattttgagtttgtttttgaatacgggagaaagtcatccagtttgattttttgcatgtagtgaccagttttcccaatgccattaatttcttaaggttaaatagaatagatgaatttctggttttcaaccaaagtagcctacttgccacagttactgaaaaagaagagaagtgacatttaccagaaatattaggaaaagtataggaaggaaagccttactgagggatagtgtttgtgagctctctggatattatctactatgtatgggtttttgcggggtttgggcagaatggtggagaatgaaaagcatctaattttgattagttacttcatttcaagataggtgaattagctgtctaatacagcttcattatcgcttccttatgacatcagtgctccattctcataccataatattgcccacaactcccacataccaattatataataaactgtgtcagaatcttccagtagccaatcttaaattagatacctttgaaagttatattaaaattttaactgaaaacataaacatcactttcagaaattgcttaattattctgcaaacactggggaaatctgactgaatacatcttaaataattggtgtcatgtattaagagtaaggtgagtgcaattttcaataaacaattattaagttatcatataacaaggcaagattatatttcccattagctgaggtataagctatccttattccaaatattgaatctacatattcagttacggtagacaaaaagagcgtgtacacatatagttgaactaaacatgagcttgcatcaaaaatgacaggcatttattagtgatctaatattgaatgtgatatgagtacttctaaagaatcataaaaacttttcagtgtttaagtaaaccatttacttagaggaattaatttaaattgatctttaggaagaatggtaagatgcaataagttgcatttgacatattcacaatatgaaagctgttgtttttccctaattatttctttaaagggattcttttcttacagaattagtttcaaagtgtggttcaaagattcttgggaatacctgagacatttcaagtgcctatgagatcaaaactataatgccaagatgctatttgactttttcactgtgttgaccttggcactgatgataaaagtcaatgatggataaaagcagttgattccttaacttaaatcaaggcagcggcaccaagatactcagtctaagccattatattctccagtgtcatatactcacaggggtaaaaaaaaaaaaaaaaaaagttaattttatttaaggatgctgaagcagtaagatgtaataattttattaattattaattattttatatctatagtcttgaggattattgtttgcttaatgtgggccaggttatgtgttcttcacactttcagtgaaacaaagaatctgtaagattgcagtaaagaatatgaaattctcttctccatactatattgttctaggacaaaggtttttaaagaaataaaatgtcaaaatttgatgcagtatgatgaaaaaactgttctaatgggcattggtttcagaaggcacagtgagtttctcaactccagagttatcctacaatatgacagatgacagcttgggggaattctacagactgtggtagaagggaagagtagcatgttacctgaattgggagaagtcattcccacatggaatttcagagcaacctgctttcccctgaagtctgaaaatctgagcataaacttgactgagtagaagctatgattctcagaattggttgaaaatttgggtatcttgatcaaaaataaacatacgaaaaaaaaaaagaacagaagaggcaagggaaggaagagagaagaaaaagagaaaaaccaaaggttatcacctctaggcattcaagtttgtgtttatgcccatatgaggtccaaattctctctggggttaagtccaccaaactcaccaactttattcaaggagacagtatgggagcttttcaggatctgtcatcctagaagctgaacataaagtaattcctgctttgtagtctacattctgattggcataaaataatttctaagtgcaaaattttgttttcatgattccttattctctgaatatgtggctgtgatccacctactttaggtcatcatctgtgtgaagcttggccttcaatttttccattttttttctcatctcacctatttttcatttgcttgtttgtttgtttttttctttctttagtcagtagttcttagactaggtattcttcatagcttattattcctgtcctactgaaatggtaaacagtggtcatggaattgtctcccataaccatttttacagatcaactcagcatctggattttctgagacttctgtttctttttatacttcaaaatattcccattttgccacatgtggcactccagtgtttgcccacttctaatcaaatgccttccctgtggtctttacctgaaagaaaagcccgatgcgagtcagaaacttggccagtttgtgcctcaggtacccgctttccacttattcagcatgcatcatgcaagccacagacggcttgcactttggtggtctctattaccttgcagggggcattccaggggcactagtataaaaaaatccacatgccaacacgg

SEQ ID NO: 55857 - DNA, 2206 bp, Bovine  19866880538008
atttagggggaaaatgagggtctttaaaatatacattttgttctttattgcctcccaaagaagcttcagtgctgtactgtaatgaataatgataacatacattcttaaaaactgatgttagctcagtcattacaccaaatagaatgagaggccctgctgtgtgaagcaatgagatgtcattagtaagcagcatctctgctaaaaggagaatgcatattgttacttgttaaacatattattaatattggtaaaggtaaatgacaattgactactttcataagcagctgattttgctgaaatattttaactaatccttgaaccctaagaaaagatactcaaatcaaaatttattgtgtgaaaaatttcaagtaagttgaaactgacactatataataaagatgcattcaggttaaactattcaaaaatgccaagctctaaaaatatacctaaatatttttcactgatgtaatgttttccccttggaaactcaaaacattttggaatatattacatggaaaatttttctaaattttctctacaataagttaaatatactcttaattcaagtatttttcccttgtgggaatacataatttatgcaagaattttaacagcattatataggttcacaatatatctaccttctttttttatttctatgaattttttacatttaaaatcatcaacatgtattcaaaaataagcttgcttttttggataaatttatcatacatcagtataattctgaattgctgttgttcagtcactcagtcatgtccaactctttgtgatcccatggactgcagcaagccaggcttcccctgtcttcactatcccctggagtttgctcaaactcatgtccattgagtcagtgatgcattccaactatctcatcctctgttgtcccattctcctcctgccttcaatcgttcccaggatcagggtcttttccaaaatgagtcagttcttgacatctggtgactaaagtactaacacttcagcttcactatcagtacttccaatgaacattcagagttgattttctttaggattgactggtttaatctccttgctgtccaagggactctcaagagtttcttcaacaccacactttaaaagcatcaattctttggagcttaatcttctttatgatctaaatctctcatccatgctttactcctggaaaaacctgactttgactagacagacctttattggcaatgtccctgctttttaatacattgtctaggtttgtcatagcttttcttccaaggagcaagcatctttcaacttcatggctacagtcattgtccacggtaatttttgagggagcccaagaaaatagtctgtcaccgtttccattgtttcctcatcaatttgttatgaagttatgggaccagatgccatgatcttagtttcttgaatgttgagtcttcagctagctttttcgctctcctcttttaccttcatcaagaggctctttaattcctctttgcttgctcccataagggtggtatcatatgtatatgtgaggttattgatatttctcttggcaatcttgattccagcttgtgtttcatccagcccagcattttgcatgatgtactctgcatataagttaaaaaagcatggtgataatatatagccttgatgtattcctttctcaattttgaaccagtctatagtctgctgttccctgtccagttctaattgctgcttctcgacctgcatacaggttactcaggaggcaggtaaggtggtctagtattcccacctctaagaattttccatagttcgctatgatccacataataaaaggatttagtgtagtcaatgaagcagaaataaatatttttctggaattctcttgctttttctgtgatccagcagatgttggcaatttgatcttttgttcctctgcctttttgaaatacagcttgtatatgtggaagttcttggttcacatactgttgaagtctagcttgaaggattttgagtatgacctttctagcatgtgaaatgaatgcagttgcacagtagtttgaacattctttggcactgcccttctttgagatgggaatgaaaactgaccttttccagtcctgtggccactgctgagtttttaaaatttgctggcatattgagtgcagtgctttaatagcatcaacttttaggatttgaaatagctcagctggaattccatcac

SEQ ID NO: 55858 - DNA, 1734 bp, Bovine  19866880677860
tttgttcttccttgaaaatattatatgagtcatattattatgcactgttaattaataacttgtttcttaacattgaaatagggttttaaaaatagatattataacttaaatccaagattttgtccttctaaattaaaaaatatataatttgattatacttcaagttatattgtgataaaagatctcacctttcactcagagcatatgtgacttggtggtacagttgttgaaaagatgattgtataaactaaccaatataaaaaataacacttgagtttctaggaaatttatgcttttgagagtttttgtagtatttggccacctcatgcaaagagttgactcattggaaaagattctgatgctgggagggattgggggcaggaggagaaggggaagacagaggatgagatggctggatggcatcactgactcgatggacgtgagtctgggtgaactccgggagttggtgatggacagggaggcctggcgtgctgtgattcatggggttgcaaagatttggacacaaccgagcgactgaaccgaactgaactgagaactggtaagtatacgagccaaggctaaactggattttaatacttcatacataatgttttcttaaatcaaattaaggttttcttgatactgttttctcaaccaaagcatactaacctttttggattatataagtaatattagttttgccttctaaaaagtatatatttatttgagactcaaagcaacactccattgaaaaggttggtacataaatactccagaaggtctgaattaaaatcccataatccgatatatttgcatttcttaagcaaattatatgaataattaaaccatgcgggattaatataggctaaaagtcacaccccttcccatcatatcaggttatattttgccaccaaatgagtttgccacaatctcaccaaagtactttaggaattactttggatcataatactatgagtgatggatcatggtggtagcattccatgagtcttgattaagcatggatagtgaatttgcctctggggagcaattttgacactggagagggtttgtgtatttccttgaattctgcttattgagctgtgtctaagtacaagggaattctgtttatatgatatataagtattatatcttatacctaggattttagttctttctatcagagcaaaaagttatttttaacacaagaaacatttgatttgcccttgcatctctagtgactctagtgcagagaagcaaagttcattattgcagtagagtgaaaagaagcctagaaagttcaagtaagttagacatgtttctattgattacaacactactgagaatagaaagggatagataaaagccagaaagttggaattagtttaaaattatctctctaaggactgagccctttggagaaagcactggataaattacaagtcacatttgaataaccttcaataacagaactatggatgcacagtatatgtgaattctaaaagaacataattgtagtgctatttatattcttctatttcttagaaatactttatagatcttctaaggaagattgcaagaaatgcctcacagttgccatagtagcagagtcaatattttttgaatgcagtaaattgaaaaggatgttgaaaagggaagaagatatgtaaccatggtatgcctgtggaacagtactgtccaagaaaactttctataatgatgcaaacaggctagccc

SEQ ID NO: 55859 - DNA, 1217 bp, Bovine  19866880702796
tttatagcgtaccctgttattttaggctctagaaattcttcaagttttcacaatatgttattgaaaaacccttttagatacaaattatagaaactaaacttaaactggggagactacactccgtgggttcagtcactactggattcatgaaatcaatgatgttgaggccatgattctttcattctcaaactctctattcatatagttgataaagagcctgcagagggaacaagactcacattctaacagcttctcagggacagtatgaaagggacgttgaataacaatgaaaacatgcccttggaagaactttgattggtctaattttgtcacagatatttgttgagtaaatgaacccctatctcttccctgtgtctttactgcagcttagggttgataaattctgacttgttgcacctttacagtggccccaaaaccatgaacagggagtgactgggtaagctccttatagagacaagtttcacaaaaataaatggctctgcttctagaataaaaaatggcagaatgggtgttgaatatctcaaaacaacagatgtcaaagctatcaataatagatttcctaggaccctataataatttacatgttggcatatccccattatcaagaattcaggaaatgaaacatcctaattgacaaggatctcatctatcaaacaggagaattggttcctataaagagagtcatgaaaatgttgatactttatgtaactatagaacaaataatctatcatataaatgctgcttttcagatagtcttacatgtatatatctaataccatagttttgttctttaaaaaattatagagtttataacattaattttagcagacaatcccctattcctttcatttctttacaattttatccattgaaggccactgactattcaatataaagaagctcccacagtctggattggctgttcttatatgctcagtgtagctcaaaatttggtttttcctttgccttttctggatattggcagatgaatatagagacctgaccagactcaggttcatttctttggcaaggttatgaatggtggtacattctttcatcaaggacagggagtggtaatgtctgattttctctcatttttatttgtatgcaatgtccacatccattacttcactggtatggctgctgctgctgctgctgcatcgcttcagtcgtgtccgactctatgcaaccccata

SEQ ID NO: 55860 - DNA, 1358 bp, Bovine  19866880728933
attgtggcttgggacactgtagcagtgagaagactaaaagaagaagaagaatcagaatcagtagtagctaggtaggactgtccagtgagtggaagcaaagctagggatgcagtgtcctgggagccaatcaagagtcgtgtgttaaggaagggtatatagccttaataagcaagaactatgctgcccctaacctccaaccccataacaattatgggaatcctgatttctaatcactgtgcagagctcttcctgaacaaatgaccgggccagaagatttagcagaggtacgatcttccaggtggtttattacctaccaaatgctcctgccattactcaaaagccctttcttctgtgcttctttcaagcatctgccttcatactttgctccttttctggagattttgctcctttgttatctcaagccccttagaggtaatttacatcaacatgtccaaaatgattgactgattttctgatgggctgaaaccaatcagaaaggaaaaagaaaccatttcagttttaaccatagatatgttctttttttaagctttcaaatttgtaatcaactacctgaaactggtagttcaatatcattctctctcccttagaatttaaaattgtgttcgaatcaaaaaacaaaacagaattactacttcacgttacattgtagcattcttcttttataccacttctgacctatatttcacagaaccctgggtaaaagtattggatggtaagcaatttaacaatgttattgtaaaattgattagcccttggcttcatcttcctcaggaactcctgcagaagttgtatagttatgtgtaattgcaatacataagaagaaatataggacaactaattagcatatcctttgtatcattacactgtcaaatacaaaaagaacaaatacttttttatgtgttttttctttttcttttttggtacgtgatggctctgcatatccctggctggaaaaaaagcattcttagtacttaaatttcagttagttcaaggatgagtctctgcatgtgggttttatttagtctatccagagggcatcttcaccttgtttttccccagtataattactgttactatcattaggggagaaataaattaattttgataaaagtccaattagtattgttacttggcatatagatataaattgtgcagactctacagaaacatttttatgactggtattcctaggctaacaactgaagaaaatgggatacaccattatcatttcattttaaaaaacaccctatggatttgcttaaggagtattagcaatttccaaagccaggagtattttaattaaacagttatattttgtataggcaataattattctg

SEQ ID NO: 55861 - DNA, 1114 bp, Bovine  19866880753495
tcatgagactaaactttctactatgaaggtcaagttggatttccattatactgatatgctcatgattgcagagcaacactgctgagcctttcaaatgatgtttagaggtagctacactactaatgctgaagctgaaactccaatactttgaccacctcatgcaaagagttgactcattggaaaagaccctgatgctgggagggattgggggcaggaggagaaggggacgacagaggatgagatggctggatggcatcaccgacttgatggattttagtttgggtaaactccaggagttggtgatggacagggaggcctggcgtgctgcaattcatggggtcacaaagagtcggacatgcctgagtgactcaactgaattgaactgaacactactccttatttgctctattcagaaatatgtatgtgatggatggtgtgttcttatgtggcatcactggcttccatgttacagatttttgcttaaatttcttcccttgaggagtatctaatgttttactggcttcaacatagcagaatatcttgaaagatccttcatgatgtttctctaatttctttattcccaatgtcaccagtgtcctttctggtattagcacttagagcaaatataatgaccatgtaactggatttcatggacctagattattttccatttctccatctgtttatagattcttctcaaaagtcttaatatatccctgctatctaagatataaagcttgttttataattaagctagcatttaccaacttccattagtgtctcacaacatttgactggcattgtaaatttacttctgctcaagtggatcactgcaactttgtgtctttgctaattctattatgcccatctagaacttatttcactcattcttccaaatgctgaaatttaaagaaggtaacgataaccctgtatgtgagacagcaaaagagacacagatgtattgaacagtcttttgaactctgtgggagagggtgagcgcaggatggtatgggagaatggcattgaaacatgtaaaatatcttatgtgaaacaaatcaccagtcttagtttgatgcatgatacggggtgctcggggctggtgcactgggatggg

SEQ ID NO: 55862 - DNA, 860 bp, Bovine  19866881051032
ttaatactaattctcttcctatatgtgtgtagaatgggttgaaggaagaaaggagaggattttctttttcttttttttcttcaacaagaatcaaagacataagccagaaagttaagcggaatttcttgtactggtataagaactgtgtagatgggcagaggtaggaaatcttttttacactttatgaagttacccacttttaaagatatgagactcactgcaacccagttctacaagttctgtgtttagattacctgtgcacacactgaaggacaccgaatttagttaagagcatcaaaatctcccctctttcccttactgaattttcttagaatgaattcatatttactcatttagaaatttctttcaagccaatatgcttgaggaataaaactttgttcctaactttggagaactcatcagctagtgaattttcctccttttttttaagaaaactttttggtccctgtgtattatccaaattctatgcttcccccttcaattcttgtactcttatatcctcttccttctttcctttcattcacaaaaagtatcaaagatgcttttgtttacatacactcagtaaacaatgtgcttagaggttccaaaccagccctgacagaaacatcaatgttaagtacaaaggtctggagtgggaggtgggatttgtaagaagcattagatatgccttcttttttatcataggttaagtaaatgtgaaggaagccctgggaaattaagtgctttttgacggtactttcttcagaagatggagagaggaaaaagaactaatgatgtagcttcttatgcaagaggcacttaagatcaaatctcttatatactcagcaagtctttccaat

SEQ ID NO: 55863 - DNA, 1870 bp, Bovine  19866881188532
cagtatttaaacctattattatattgttaacatataagaaaactagagagagtgagaagaaattaggatggcagaaagataattctggagaaaaaaaattgatacaaggatttcagttcagttcagtcccaatcatgtccgactctttgcaaccccatggactgcagcatgccaggcctccctgtccatcaccaactcccggagcttacgcaaactcatgtccattgaatcggtgatgccatccaaccatctcatctttagctgtccccttctcctcctgccttcaatcttcccagcatcagggtcttttccagtgagtcagttcttcgcatgaggtggccaaagtattggagtttcagcttcagcatcagtcgttctaatgaatattcaggactgatttcctttagtattgactggttggatctccttgcagtccaagggactctcaagagtcttctgcaacaccacagttcaaaagcatcaattcttgtacaaggatttggaatatagtaaaaagcattaaaattccttttacatttcctcacctaaatatgtatacaaaaataaatgtagtattaatacatatttgagactcatcatgtttgtaagtgtatttgaggtgaatataataaaatctgtttagaagtggcaatcttccaaatctgaaaaatgaatttctttcccagtccttactgagacagatattggggagtacccttactagtggcaaattaataatatgtaacccctatccacacatacaaataaatgcaaattttgccttgaactaacaggcagggctagccctcggtaatggcagagaaggagggcttcttcactgattcatcattttgagctgaactttagtgtcctccatgttccactaatgcagagatagggctgcagattttcttttcatttaaaatagcaggctgagtttgggaagaaaactgcataatttgagaagaggggtgaggagatagggaaggcagcattttattcactaaataagtgctgcttattcagctgtaacaagccagtgaagttggaggttgcaaatgagagaggagaatcactggggcctctattaaattcagcttctgttcttgattcagttttatcacttgctagacaaagcttggatttcagcgatttagggttcacaaattcagaccaagttctttctactcagtgagctgggtcagcttgtaaccagtctaacttaaaaattcataaatatgacttgtttaatctgtagtgtagattgagagtcactcaggattttaaatctccatttactttccattcctgcaatgctccagcatgagaaaaattcgactcacacacactgggaaactctaggctgattttgcctctgagatatattcagtgtatttgggttccttcattcatcatttcatactacccttgattgaaactgcacttgaacagaactctcccgagttactcagacctgcaaagcttaaatctagtcacagtttattgatggagacagtaacacataatgaaatgccattaattcacacatgtaatattggtttctaatttgaagcatcacatgtaattatcagtagattagttactcagattcatagcctggtgactatggggaaaatgtgcctatttctacaacctgaactgtaagaaattagaatgtctatttcttacgaggacaactacaaaatctctgaagccttcacattgttataggtttatggctcaatccataaagagagaattcaggaaaatcagctctgccgcttgttatttccctgcaactctcatcccagacagtgtttgcaaagagattcgtcaggaaaaaagcattttatttcagtaaacagttaga

SEQ ID NO: 55864 - DNA, 753 bp, Bovine  19866881234730
tgtctgaagctcctgaagcctcccctaccctctgttcctgggaaaattatctgccatgaaattggccccaggtgccaaaaggctggggaccactgcctgagacagtagcttggaggggtaccgcagaccctgtggtccagaggaaaacacaccctgcccaaaagtggaaaaagccctcttcatagtcatcccaacactgaatttcgaggccccttgctttctccacaaatgtcatcatatattgaatcaagtaaaaactaacagtctcacaactgaccaaacctacagtgtgtacgctgcataacaagctcaaaaataaatagtgaaaacaacagaaaaaagaaaaaccaaatggtcatttactctaagaatccaggcttgtgtttatgctccacatgaggtccgaattgaatctgggcttgaaatccaccaaactcacatgctttctcgaaggagacagggtgggagccattcaggatatcatcccgagcctgcaacacaagaggaagcaaaaagcatcaggagcttggggggaccaacacgatctctccagttccatgttcctggcacccaagcctaccctctctggggagatgaggggaagcgtgccagccaagccagagtgaggcattcattcgggacgctgtgagtgactgtagcgtcacagaactaatgcaaagggaaaacaagtccgtgcccaaattgcctatgggatggaaggcatcagcaatgcccagtatattaaaactaaag

SEQ ID NO: 55865 - DNA, 1019 bp, Bovine  19866881237438
attatattgttcacctcccaaacttatataagactatatatgaattatatctcaggaaaaacctaaaggaaaataaaagacctaccattaaaaatggcaagaatatcaagtgattttagaattaaggttagctaaccttaaccagggaataattccagtgccatttaaaatagtttgtgcgtacatgcacgctaagttgcttaagtcatgttcaactctgtgcaacactatagactgtagccccctaggcttctctggccatgggattctccaggcaagactgctggagtgggtttctgtgtcctcgtccaggggatcttccctacccagggaccgaacctgtgtctcttaggtctctcagcattggcagatggattctttaccacttgtaccacctgggaaacccaggctagtccatagtaatacaattatgacaacttacagtacattctgtgatgctaacataacctaaatagcatcacctgatatagcgagaaacaatatggacaatatataatagatataagaatagtgtgagtacactttggaataacatattttatagtcttcagagcttctctatcatgaaatacgttgaatggagcatactaatatgaaaaagtatattgtcagtcagctgcgatgtcttcacagagtgccacagatttagcactctaacataaattcaaaagtagctctattttccagagctctaaaataaatacacaacatcaatttcttctgcacagaggaatcatttttgcacttctgcacaaaaagtaagacctcttctctaactatttttctccagttgattaaaactcttaacatctgatgcaattgaaaactcagggacttaggattaaatgaaaattttttgtgaaaaatgtgcataaattttcttacacaagaaaagtgactgctaaacttaataaagaataagactcagacaaaaatcagcaaatgatacaaaactaaagtgacataattttaagcagcagaaggtcaaggacagaagt

SEQ ID NO: 55866 - DNA, 1043 bp, Bovine  19866881346009
tttcctgcattgcaggcagattttttaccagctgagctaccggcgaagccccacatcctcctcgcagcccttgaatttccacgaaggcatgagtatgtatgtcctgttgtgttaccatacctaacagtatcataataattgcttgtttaaagaattaaaaagtagatgactgagtaagcaaaagctttgaaccatgattgaaaattctatataatttcattagacttttcagttaccatgcaagcagccatagtccttactacaatcataagtaggatatataattcccaaagtactcataaaaagggaagccatgtagatctgaatgggaagatggtataattcttctattacacctagtcccataataaaaaaacaaaacaagcaaaaggtcaatggtggggatggattatatcatcaggaacagtagacgttgcttgaaattcaatgtgaatgggctaataagaaattagctaatactttgtagcataagatgtcctgtgatgaattatttaaattttattgctttaggtgatcagcttaaggaaatctaatgccactatctaaatactacacttcaataattaatagtcattcaattgctgttgtgaatgaaccattattaaattctgtttaaacaaccagctatttaattgatgcccattatcccttctttcctctaatccttctggaacatgttgtatcactacaacatgttcctaaattctgtgtatctttacgtctaaaggctgttaacctaaaacatataaacatccacacattctgactcatgtgaattaaatgcttccctttgtttttcacctccaatccccagcttctgacttttctcacttcagttgctttttaagattcttggaaaaaacttaatccacattttcacatctagtattattgagtctctacagaaaattaaactcagtccattttcttttttggtattttctttataattaaatcttattctttgccacatattttactacttttcttagtttttctttaacatctccaacaattctttt

SEQ ID NO: 55867 - DNA, 1362 bp, Bovine  19866881373215
tatgtgcatgagttgtttattgtttaatattgttattgcatattgtcctaacaagacctgaaaaggaagcatgcatactccatgcaatatgcactttaattcaaattgacaaatatatctgctcaaattaaaacagtcagcaggatgtgcttgaccatgatgatgcagttcataatttcagtgatttttaatcacatctatccatgaattaaatgtttgatgttttggctctatcatttacattatctatttttcaacaaaagtacgtggacacaattagtatgtactctgggctgaggttaatttgggcactgttttttttttttttttttctgttttcttctataatactcctttatatctcaagaagttatgcatcacctattgaataaatatatttagagactatacaggacatgtgtgaattaatgaaagaagaaggtcattgttaccctgtcagttaatctcaagtatagcatccttgtttcctggcagtggcaaacggcattcctgctgtctccctctctttatctccctgtccctctttagattagggaagtttttttacctaaagttttgtcagtttgggggatttaagaacattctctggtatgtggaagtctcagtttctttcctgtataaagggaaaaaatacttctttcttttcaggtttgccctgagtctaaaatgagaggatgcatataatgaatacaggatagacaaatgtaattctcctcctttctcattttgttgaacctagtaattaacagtcacaagagaatcccctaactataaatttaattcgagatgcaattacaaggatacgttggcctctgaaagagaaattgatacttgatgaaggtgattcttactgaaaagaatagaatcacatggaagattagagacttcaaaaccatgagtgtaaaatcaggacacaggtctccatagttgcagagactgattgtacggcatttagggattattatgtgccccaaattatagattaaatatatgttttagaaatgctttggaacaaactaattacagtttttaaaagatagagaaaaaagaaagagaatactgctttggggttgtaaatctgactaacaaactatggagtttgcagcatcattggcacaattaaggatacactaactttctcaaaagttacattgttttttagaagaaaagtccatcagtttacataattcagggctacaaatgttagcttgagtaaactgaaagaatgtctaatctagatacaactaagagacaaaggatcaatgatcaatttcagttaagacatcatgatcagagacagatcagtttcagtaagagtcaggtagggggcagtatcggact

SEQ ID NO: 55868 - DNA, 986 bp, Bovine  19866881500148
acttaacattaagtaaaacagaatacctttacataaccatgcttttatacatttcttcactgagaagcatcttgtgtaattgttcaaatatataagcaacctgtacgttctttattaatgtagattgattttttttagcactaggcagtgtgctgtgttcagttactcagtcatgtctgactctttgcaaccccatgggccatagcccaccaactcctctgtccttgggattttccaggtaaaaatgctgcagcaggttgctatttccttctccagaagatcatcctgagcaagggatcaaaactgtgtctcttccattgactccattggtgggcagattctttaccactagtgctgcctgtaaaggtttgtgtgcatactcagtcactcggccttgtccatctctttgtgatcctatggactatagcccacctggctcctctgaccatgggattctcaaggcaagaatactggagtgggttgccatgcctttctctagggtaccttcctgagccagtgatccgacctgtgtctcccatggccactgccttgcaggcagattctttactgctgagccactggggaagcccatataggaagttgtagattaatataaatgtgtgtgtgtatgtgtttacattctgtctgtccataggaagatggacacttaataaaagacatttttggaaaatggcattttcgtaaaagacattttccccaaggaaatacaagaagaaaaaaaaaaaaagataaccatttataatttgtttcaagataattctttatgtgaaatgaatttcctattaaagatttagttcatatattctaaggagagtgaacagtagaatgtaaatagctgtctacttttgatgaattatccaaatattctaagggtatttttccatcttaaagatcgaaggctggttgaaattatataccttttatcagtgaacagttgtttataaacattggctgatatttcttaa

SEQ ID NO: 55869 - DNA, 1182 bp, Bovine  19866881508022
atgatactgccttaaataatcccctctcacaataaataattcatctttttgtatattataaacattccatggtagattaaaattattatagctattaagcccttcaaagtgttatgcaaattctccttcaactataactgtatttcacacagttaggagcaatgaaagataagatagttttattttaaggaaagaacatatcattattattaatttttttacagataaatgaaaataagatgtgaatgccattctgttttgtagtcaaggttatcaggattatagtgagcactctatagggctgttcagttgacattattgcaaactaacaatattcatgagtgtcagctaatactaattaatttcactctaatgctgtgaaaaagcacacaagtgagcctttgttcccaaccagtacttgtctctgacttttaatataataacataaacggcaaacctttagattttccatctgaagtgaccagatgttcaaatgaatatgctttactatttttaggactatgaaatgtgcttttctcccatctgaaatgtcattatgatatgtattactctttcttgatatttagctgtaggaccacttatctaaaaattgatttgtgatctttatataacaattcagagtacatattatttcttcaggtgctattgaaatataaaatagcttctgtgaataagcctccatttatatatttattcttttatatcctatctctgttcctgttaagtttatttacaaaagtatgtgtttttatcccaaagtattccattttatttttatttctcttttatctaattccaacaaatttagtttgcatttgttcttggggtcaccattcaaaggaagattctctgtacacagtagttctgctcttatagtaaagcctagtcaaaatattggctatgcattgcaattaaaaagtttccacctagaaatggggacattctgttctcccagtaaatatttcaaagcactagaaataaaaaaggatattattgtagatttaaaaggagtaaatttgggctttactcagaaatatttaaataattaataataaacagaatttttctactttgtctgttgaggggagtgtagaattgtaaaaactaacttctcaatgtctgtgaccaagacctagtctctgtttaagggatcttattttt

SEQ ID NO: 55870 - DNA, 1081 bp, Bovine  19866881853955
aatttcttggaagttaatggttttcaatgggtcaggaaaggatgatgaaacacagagcaacaatttctcttatgaattcttctacagtgcatgcacagaaataaaatgattagacttatgtttgtctactcatctgaggaataatgtatgttatttggcatagaggtaatggcaatctgaagcttttcaattaaattgaaaatgctgacacaccaattctcttatctcatacatatcattagatagatttgtgtttgactgaatcacatggaggcatctttgtgtatcttgagaaatataccttcaattaatggcatactacacaatctattgaataattttcttgaaaactaataataattatttttacatgtgtgtttggtaaatgatattatacatgaactcagaccaaagcaattattaaacagaagaaagaattaatttgcccttttttaggattattgtataaaaattaaatgatatctagtcattaactagcaccagttgaaattcatataatgtcatctgtctgcctactgtatataatgtaaaggcttttctgtacataaagagtgtttcccagaagtgttttattctttaattttctttattaatttaaaaataattttgttcttttgtcatatgtcctacagagtagacacattttcttctagtgctaatttttcagtcacatttatgtgaatgttacattctaaattgatatattagagctaatcactaaaagttatttctgctgtctttgaacccaataagaaaattctgaaggtcaaagcttctcttgctctctcatgcatacactcattttatctctctctctttctattttgtcctttctccagttcgtttcatctttatatctctcattaatgttctaaatcattaatgtattctgaggcagtggaaaagagggatttttctgtgttagggataatagattggcaggaatatagggaagagaggctataattgtctaaacttacaatcagattaaatccgggttttcccccatggtctatgctgagaaactttattacttctgagttatagatatgaaaccaaa

SEQ ID NO: 55871 - DNA, 927 bp, Bovine  19866880411745
ttctgcttgagtactcccagtgacaggggagaaatgctgtaatatggagatgaaatataaactgttcatggataaatgattgcataataaaaacatgcctaatggccacgcttccctaatacgttcatttgctagttatgtttttatacgcaaactcatcttgatcaaattgtttcttaaaaaaaacttggagtgtaatttgtcttgagatgtctgcattttcctttcatacctccttattaatgggcttattttctgagaggaaagtgtaacaaagataacagagcaaaaacagtcatatttgctcctactgttgtttgggggttaaaagtgaatgctaacagtgtatgaatgatcttttcaatatttgcagttgatttcccacatagactttcaaaagctaccatgatactgtttcctcccactatttaaaaaatctatttgaaatgaactactggaaatgttaggacagaataaatccttctaagaatttatttgatatttaacccccaattataatggaaatatcaggggcagctgttcatttggtatgtttgtagtctgtgtttatgccccagcagaggaagaaaaactcaggatcgatcccttactttttaaaaagaatatatctttattattatttatttttctttaatttttttggctgcactgcacaacacgtgggatcttagtgccccaaacagggatcaaacccacacccccttcattggaagcacagagtcttaaccactggactgccagggaagtcctaggatcccatacttttcaaaggaagtcccaggaacccatgcttttgaagagatatctaaatgctatagttacagaaaacttacaaatatggtcttcatggaagacaatggtaccatcccatctaagactgtgggttctgaactggatggtctaagt

SEQ ID NO: 55872 - DNA, 2419 bp, Bovine  19866880436462
cacgtgctaaatgacacacccacaggctctatgacagttccaaggctgaccatcgaaggtcagaaagtgggtggtggcccaattcctgtaagtccctgcccttcccaccagtttttggaataatcctcccactcaatagcctatgaaactatccacccctataaaaactgacaaacccattcagtggggcctcttgccttctgagatggtccacactctgtctatgaagtgtgtagctccctgaacaaaccttttcccattttactatagcttgctcttgaattcttttcctgctttcatgaagccaggaacccatactctgcagccatcccagggactcgcctgagacctgaaatgtgaccatcctctcactccactctttttcctgccacaatttcacagactcatggtccacttggctgcatgcctccccgccactctttttttctatagtgataataatagctggtaactggagaaccagagaaagaagaaattaaaaaaggaagggtcttcaatacaatgggaccattttgtagtcttctctttccatattcctttcttctgcccttaagaaagtgttattttcctggattgacagaattatgcccccaacccttttccagagcctaaatattcatatacaatcctaacaggctgctcttgggtccagtgtgagttttattctcctctccagaaagcctttatatgctttcacttgaacactgaatctggtgatgacggggaggacgatatgggttattttccttcacagaggtgtcataaggataaatgaaatgatattcatacagcactttaggatgttcttacaaactgcacctttgtaaacatgacatattctaaaagaccagtgactgcaatttctgttttaaatagaaattgctgacaacaatttcaaccctggaaagtaaacacatcagcttgaaattgaagtgcactttgccaagtagcagcaagctgatcacctatctgggtccttaccgcaaataaagttaaatgttcacatagatcgttgtgtacaattcatcctgctctgctatttggaagtatcagaagctagtggcctggtcctgcattctttgtgatccaggaacatctggaagtatgtcttggtcttagaacctccaagggcattgctgtctatctcaagaaaactatgattagagacatcttgagaatactgaactgtagcagggtccaagctatgggagcacattaagagcaaaccagtcagtcttaaaggaaatcaatcctgaatattcattagaaggactcatgctgaagctgaagctccaatattttggtcacctgatatgaagagctgactcactgggaaagaccctgatgttgggaaagattgaaggcaaaggagaagggggcaacagaggatgagatggttccatggcatcactgactcaatggacatgagtttgagccagctctgggagatagggaaggactgagaagcctggcgtgctgcagttcatgggttgcaaagagtcggacacgaccgagcgactgaacaaaacaacaaaaccatcctactgaggttactctgaacccagataaaactctggaaaatcttcagtttggagacaggagcaaaaactctcatccttcaggtggccctggtctgagaatgaggccatgtcctggaacacatttggagatctttgtatgaaaacactaaatgtcacccaggtagagagtaccagaggatgttctaacactgtcccagggcactgatgtgttttatcctctattaagccaagggtggccgaggaccaccagacatcacgcagctagttagcatcccaggtacagagggcaataacctggcagcagtgaagcgcacgtgagttgacgtgaagcttcgctgacatgtcagagggccaagctagcaagtgcaacagggagaactgggaagagagtcagtcttgaagatcacatccctgggagagatctcaggtcactatgcaagtgggacctggctctcaagtaacatagagtaagtttcaccgactcagcaatggaaacacaggattttaagtaaaagaaagaggaagtgaaagtcaaagtgtcggtagctcagtcttgcccgactcttctcgaccccatggactatagcccaccgggctcctctgtccatggaattctccaggcaagaatactagagtgggttgccctgcccttctccaggggatcttcctgacccagggactgaacccgggtctcctgcacagcaggtggactccttaacatctgagccaccaatggcttcttcacaacaacagctttgcaagctgcatgtgcacttgcttgcttataggggcactctctgctctccgttggggggatgtcctcaggcccctgatttaaatctgtaatgagatatcta

SEQ ID NO: 55873 - DNA, 1828 bp, Bovine  19866880526900
ggaagcctaaataagaaggagcctcccccaaaggtagaacaatccaaagggataacattaaaacactgcagtctgacgctgagttaactaggtaaatagtttttcaaaggttggactctctccaagccccactataaattacaacataagagactatctaaacctagtcaacagttgaggaattactgttctcttgcaatctctgtaaggctctcagtttttgagagctgccatcacagttctgatagccctggcatcataaccaggctatatatccataagtagcaggatgaacggagaaggcaatggcaccccactccagtactcttgcctggaaaatccccatggatagaggagcctggtgggctgcagtccatggggtcgctcagagttggacaaattaaaccaggtatggtaaaatactcatagccctagagtttagaaaggcctggatctgcatcccagcttcacagttctaggcatgcattcagtcagcatatttatttagggcttcctgtgtgccagggacctttgtaggcactgcaaatataggcagaataggcaagatctccaccttggggaccttcaccggcgggtggagggtgagtgaatagtaagagtaacaaataatgggcaaataactaaatatcaatcaagcggtgttaacacaatgtacttagtgggtggtcagggaacatcttctaagagacatgaattaaggaaaggaggaagaagaaggtagaagaggagcaatattccacaaaccaaagaccaaagtgtttcaagaaggaggaagtcaagaataaaaaaaggaggaggaagtcagatgctgggagggctgtcagtagccatgtgacccctagactagttatgtaccttattgaagcaataatagtccgtgataactttctgaagtgaagtgagtgaagtgaagtcgctcagtcgtgtccgactcttttcgaccccatggactgtagcctattaggctcctccgtccgtgggattttccaggcaagaggtgcggactggattgccatttctgagcattgagataattctgtaaatcacctgtcacttagtagaccagtaactgaagatttttttttcacatttcatgtgtgtaataaaacacaaacttaaaaattcacagtgaaagatattttttaaatggtctccattccatttctcactgaatttgcagtatcttcaattaattgcacataagccaaaatacggaagtcaggaagttaaagcataatcatagtgggactgtagctttgtctcttttaacagactatgttagtaacaagcggttaactcgacgtgtcaagtcatgtgtttcgtatcacgtgtgtgaactgtcatgtgtttaaatatgtcggaatttttcactttcaaactggaagagatcacttgttaagagaataagagctaagaaaatcagatatttcagcatttataggaatctgtcttgctaaattacagcttctatgaatgatcagcaaattatttccattttaaatctaagaaataaggaaattgatttggttcctatctgtttcaggcattccctaatgacttagcattgatttttaaacatgctttcaattttatagaatggctgaataatatgacatttgatctaacctctacaggaatgacaaaatgagactgttacagactctttaaagtaatagaaaattatgatatctttgtctggctacttcaccatattgtcacctaaattatttttataaaatcaggcattaaaaattctaccaaaaagtgttgaagaacaaagatatacattcaagtgggtgcttttaaa

SEQ ID NO: 55874 - DNA, 1572 bp, Bovine  19866880576589
atctgtgcttcagttgtgtttaactctttgcgaccctctggactgtagcctgccaggctcctctgtccatgggactctccacgcaagattattggagtgggttgcagtgtccttctccgggggatcttccagacccaggggttgaatccgcgtctcttgcgtctcctgcgtcggcaggccggttctttaccactagcgccacctgggaaaaccccctgtgctctgtaaatccacttaagctaacacaaataaatgtctgtgccagaccctggaagctgtgggatgccacagtcagtgcctccaagctgtgacgttcctacttttccgtagacacatcccctatagtgagtgaagactgacagtctcacatctctaccaagggttgagtgttggtgctgctgtcagtccatatactgaatattcataatgcttatttccccttttgtgaagggggcgtgtcacacagcgcggcttatagaattttagttccctggccagggataaaacctgtgccccctgcagtggaagcacagcatcctaaccactggaccaccagggaagtccctcccttctttctaagatgatcaattttgaaaagttctaacattttcttctcataatgcaatgactacactgagaatcccaggaggggcaggctcacaccctactctggagaccttccaactggtagacagcctctcccctctcccctggcttccctggtggctcagtggtaaagaacccacctgtagtgcaggaaacataagagacagaggttcgatccctgggtggggaagatcccttggagggaggaaatggcagataaccagataaccattatgttgcaaatatactacatttttgtttgtttgtttggggggaccccttttgattaaattagcaaattaactctgtcctaatcctcaaggctcttgaagtcttaaacctgtgtgggttgactcactagacagatggattagagctctcctcccctccggggatcacttgggcagcacagaacatgaggcttctacttgttcatcattagcattgggagcttgatcaacagttttaatactaaatgccaaatatctgtgtttgtagatcaaacagatggtctgtgttgttcttttcttatttctcagactcaaaatgaaacactgccctctctaggatgtcacttattctgaggatgcccccttggctgtcttcaggggcctgagacccagttccttctcgcttcttcaaaggccagagagctttttgctgtgtaatgcgggtctctgatcaccccctggcctccagctgtgtccccagccctcttcactccatcaagtagtttttgtctggcctgagaatgtttgtatgacactcaattcaaattcagttagataagttgttttggtggtggtggtggtgagtttagttgctaagtcgtgtctgactctttgacagcccatgggctatttgcgagcccgccaggcacctctgcccatgggctttttcaggcaagaatgctggaacaggttgctatttcctcctccaggggatcttcccaacccatggactgaa

SEQ ID NO: 55875 - DNA, 994 bp, Bovine  19866880672989
cagcatgaaatgagcctcagaatttactgctcgtttcttgagtactgagatgctgaatctcgagggtcctagggaagggtaataaatataaagtatttttgctgggctgatttcttacagctagtttcacttaaaggctctcttgaaactgcaaccaaatattggctttaaggcaccaagaactgatggaaagaaaacctgtgacaatgacacataaagttagggcaaatcactctgacttacaaggaactctacttccctgttcccaaaatgcgggtaatgtttgctgctgctgctgctgctgctgctgctaagtcgcttcagtcgtgtccgactctgtgcgaccccatagacgtcagcccaccaggctcccccgtccctgggattctccaggcaagaacactggagtgggttgccatttccttctccagtgcatgaaagtgaaaagtgaaagtgaagtctctcagtcgtgtccgactcttagcgaccccacggactgcagcctaccaggcttctccacccctgggattttccaggcaagagtactggagtggggtgccatcgccttctccaaaatgagggtaatagccactggtaactctgcttcacaagttgaattaatggtataatagctatgaactcacctgagctctgctaagccaagagctcttaagaaaaagatgttagattaaataagtagtacattttaaggaagagagaatttgagagtgtcaaaacatatttatgaagtacctaccatgtgtcatgtactctataaagcattgcttcctaatatttaatttgctgaaataccttgttaatgaaaaaccatgtagttagacatttagggtcttttaaaataagcaaattctgcaggggaatatatattaatttacataagtttctgtgaagaaatgtctgtgggtaacattctagtttgactgaagcaaaatgtattggacattaccgatcttgaggtcctggacatgcaaag

SEQ ID NO: 55876 - DNA, 1220 bp, Bovine  19866880729580
tcataaaaagctgagaaaaaatagacgtaaaaggcacagaagacgatgagccaagctgcaaaacaagaatataagaggagctagaattactttcaatcagttatcaagaatactgtttattagtgtaataaatgaattctctcacatgtaccaaaaacttggtagctatagacaaaaagcaagtgaagttacttttattttcgaaatttagcacaagataaactgagtagcttaatatataattttgtattgtgagactaagattgaagaaaaataactactgttttgcaattaacgtatatggtttattacatgtctgactctttgcgaccctatggactgtaacctgccagtctcctctgttcatgggattccccaggcaagaatactggagtgggttgccatgccctcctccagggcatctttcccacccaaggatcgaaccttacatctcctgctttggcagctaggttctttaccaccagtgccacctgggaagccctgttattaaatacatttctgattgtaaagtcattctgtgtccacactgtctatattcacatggcatgatatttcatctgtaatcatagtttatgtgatttctattttacccatctgcagatacctaagccaaataagtatgtctcattattatcaagataacatttttatttatgtaaattaaatagtttgtaactcccctgatcctccaaaacaaaggcaatgaatctcatatccttaaaaatttattcttacacaaaaccttggaaatgggaaatcctgagacaacttatttttcaacttaaaatttcaatgtaccgctcctaaactggtatgcctgaacattgttcataattcttgttttgactccatcctcgttttctggttcctgctttgctaatgattgcagtctcagcttcataaacatgttactgccggaccataaggcagcgtttctctgtgaacacagtcacacgctcgcattaacctctactgccaagaattgctgccttcctattaactttctttttttaaaaaaagtctttattgaaccttttccaatactgcttctgttttacgtcttggttttttggccccaaggcatttgggagcttagctccccgatcagggattgaacctgcaccctgcattagaagagcagggtcttaaccactggactgacagggaagtccgcctgctaactttctcaaactttcaaa

SEQ ID NO: 55877 - DNA, 2880 bp, Bovine  19866880775569
aattgggctctgtactgaataaagacagcctaccaccaccccagtacggccctagctgcacaaaatgtgcacagcgtcctcccaagcaccgaggcttgctcttatttacacttatttacatatcgagccagatctccatggctgcctgcccggaagccctatttttaattgtttgacgccccagccacccctctgacccttcctggcacttttctgaggatttccggccactgctggcttgtgagggaaggcacccaaccaaaccagaggcccccagatttagcatctctaaagcctctttccaaggggattctccaggcaggccagggctgcccccctatggcgaggagggggtttggggtgagggggagcgggcagctacatcccctgtggacaaaacgaccggggagggaagcagctgcctgtgggttctccagctttcttctctagctgtgcttctggaagaatcaggaatagctccaggtgaagaaggcaaagggcttgctctgaaatttacactgggctgccggtgtcccccgcccccttcttttttaaaaacagcacttcctagactgagcaataaaatatataaatattttccaagagtgccctctagtggaaatctgaaggcaccggcacgtttgacaaatggcagtgacttggcctccaaacttcggaataaaaataaagcacctttcacccagaccttcttcacacgtgacttgaaaacagatccagtttcttccacgaggccataaaagtgtcacatggccctgactggaaatgcaggctgccttaagtctttaaaaggaaatagtgctccacttttagaactggaaatcacacaggttgttttaagaactttcaaggcagggaagtgtgtggaaggggacaaggggagcgagccatgggttgtattcctaggctgcgcctgggttgctggccgacggcttttattttggctggcgaagtgagccaaggctgcagtaacgtccagccccaaaggccacacacactgctgggtttttaccttggaggatgtgggacaatgagtcatttgtgcctcttcctggttcttcctggccaaggtcagctttcccactggaaccgagcagcctggcgcacagcccgagccgtctggagccttcccctggtgccgagcccaggagagggtgtggcccccgccggctccccccagaggccccagttcaggctccgagacagccctttgtccacgtcagaaaaccactcacgctgctcagtttagcaggaagggccccctggcggaggccctaggaatcgccggccctgaagaaaggttctcacgcagaactctgaggaggaaactcaacctgcttctgacctttctggtcagagccaaataacttttctcagtttggatggattccagttcatcttgcaaccactcctatcacgaatagtaataaaatagacgccgttccttcctttctcctgtgtgtgtgtgtgtgtgtgtgagtcgctcagccgtgtctgagcgaccccatggactgtaacccaccaggctcctctgtccatgcgggtctccaggtaagaatactggagtgggttaccattccctttgccagaggatcttcccaacccaagaatcgaacccaggtccccgtcatttccggtagattctttaccatctaagccaggaggaaagccccctttccccactagacaaatgtatttgagcacccactttttacccggcactgctctagattctgaccatccagacagaccaggtccgcatctcatggaaactgcaatctaattctgagataaatggtacacaagcagatatatcattctgaggctctgaaggaaaccaagagagtgtaatgaataacttgggaagtcctgagaggaggcgtttgggcagaatgctctgagaaggttacatttaagcatctattatgtgccagttgtttactgtgttagaggttaatgacccaaagataaaagccaatgcttggagtaggcaacccattccagcattcgtgcctgggaaatcccttggacagaggaagcctggcgggctacagtccatggggtcacgaaaaagttggacatgactgagtgactgagcacaaacaaataagccagggcccaccctaaatccaggatgatctcatctcaaaatccacaattacatgtgcaaagattatttttccacatagtcacctttgcaggttctggaggttacaacttggacatacctttggggtccaccattaaacctactcagtctggaaaggaaaaaaaaaataatgctgtctaagccttcaaagagctcagagcccaatattggaataataattgcataggattcaaaaaatagaggatttcataattgccctaagatctattgctcacgataaatcggtccagtaaattgcatcatcttcattttttaaacatgacaactgagtcaaaagacttgccagaagttttagggttcatcagtagtgacgtcaagtttgaaatagaggcccatcttgctccccaatattgtctttcttttcctacgccttgtttcttggtggaaacagggagataaacaatgtgatcctaacctctctcccagcccaaacgtttcacagggcgtcatgcacggtctgaagtgggctcacagtaacgccactctctcgcagcatctgctgaaggactctcaggaattagcggaaggaccacacactgctccaacatgtcgcttctgcagctcttgtcagtggtacacaagtctggcagctgatgtcagagtcccttggcttccatcccgcagacaggctgctgagacactcctccaccaaataactcagatccaagtccacacgcagggctcctccttcg

SEQ ID NO: 55878 - DNA, 1592 bp, Bovine  19866880783302
tttatttttttagtaatctttgaaattttaatgctttagtaatctttgaaattttaccatggttacttaacttgagaaagcttcaagctaatcaatatattaacccctcttctcccaaaatagaagtaccttagaacaattttgtttcaattgtccgctccccagattgtattgatttgtttttaacaggataactttggcttctgtgtggagaatggaggcaggaagagcaaacgtgaatatgatgagaccagtcaggaggcattggcactagtccaggcaaatgatgatggcagcttagattgatggattgggtgcagtaagacaattagctgcaattgcttcccagcgtaagatagaaccagagtactgtttcatgctatgtagctgacttcagtgttaccataaataatggctattaatattattaattgaaggtctctatgggccatggaataggactgaaaatgcatttctcctttaattctcacaagaatcctgtaagatagatttatttttttgctttacccagagacccaagattgcagactaagtgctcggccacattaggaaggcaagaagtcagaccacggtgtggacagctgagccaagggtctatgattcataacaggaataaaatcatctccttgagaaccagagatctaatatcaccttgcttttgtttgtttatgtttcggtagtgggtttgttgtttgattttgatttttttagctgcaccaggatcttagttctctgaccaaggattgaaccttggtcctcagcagtgagagcatagagccctaaccactggaccaccaaggcaagtccttgcttgtttgtgttatatttcaaagtaaggttaaatatccttgtctttccattcttgaaactacaaagcatgttatagaactggaataatggtaaaaatagagatttttctcttttggctatgttagggtagaaatataaatattcgatttttctgtgaatatactccattgttttataaacatatgcagtatctattttgcatttcattattacaactctaagttaatagctattgaagactcttctttgtattaaaagggtggaagatttgaaaggatgtcccacattaaacagtttttttttttgtcagtaaatattaagaatgatgaaaaatgttagtgaggcattgattatactgctgctaagtcatttcagtcgtgtccaactcttccagaccccatggactgcagcctaccaggctcctccttccatgggattttccaggcaagagtactggagtggggtgccattgccttctccagtattgattatggatagtcccaatttataaatagccagtgttcccaaaattagtttgaaatttcatttgcacatccatgtaaaacaataattatagtcaacatatataaagtgtctgctatgtattgggcggtttactagaaaatatgattttctagtctcccagaaaatattataaaggatgttagttactcccattttacagataaggaaactgaaactgaaagaggtcaaataacttgggtatggtcatgcagcttacaaatagcagagttgggatt

SEQ ID NO: 55879 - DNA, 1123 bp, Bovine  19866880826814
accgtaggatgatgtaaaacctgcttgttgactttttggctaatttcataacatctccctccagaagtagcaaagtataagaacatgagacacaccatgtgaatgtggctttttcatattctttataatggatgaagtcatcagtgaaaaataaaaaaaaggatagggtgagaaaatgtggcttgacattaaaccaagaaccacacttcaagccaacacaaaaccaaggctggaagacaaattcaagattttttattgttttcctttaagaatattaaatgatttataaaactaggatgatagttctggcactcaaggaaaccttcacatgcctttttgtagaaaacagtaagtatctttactgactagccagtgtgttcacctatttctatgctgaggatttgtatcctatttacctgacataatttacacttggttacagtaagaatgtgcatgaaggccacgatactggtatcatcagtgaagtgcccaaccatgtttgctttccaggtggcacctgctggtaaagaaccttcctgccaatgcagtaaacataagagactcgggtttgatctctgggtggggaagatcccctagaggagggcatggcgacccactccagtgttcttgcctagagaatcccatggacagaggagcctggtgggctacagtccattgggtcacacacagtcagatacgactaaggtgaaaggcaatggcaccccactcccgtactcttgcctggaaaatctcacggatggagaagtctggtgggctgcagtccatggggtcgctaagagtgggacacgactgagcaacttccctttcacatttcactttcatgcattggagaaggaaatggcaacccactctggggtcgcacagagttggacacgactgaagcgacttagcagtagcagcagcagcagcatgcacaatcacatttctaggttaacagttctattaagttggataaataaagcttgagcttctgtgtcactgctcctcatcggggtctgtgatctccaaaaggcaagatgaattagcttttcattaaaaaaaatttcatgatggtacagatactaattcggtaaggaaaataaactatattgggaaaaatcag

SEQ ID NO: 55880 - DNA, 1120 bp, Bovine  19866880851759
attaaaacactatgtgtctccttatagaggttatgttaatatattgatcatttaatgaggtcttttagattattattattttgtatcagtgggactgaggattttgaaaaggaagcatgacccagctggtcagaaagggaatgctaattaactgtggacatgtcatttattttgtacatttccctgtcaaagaagctactgtcttagatacttctgagaaatctatgtgaacatttgaaatgaggaaataactaacgagtcatttgcaagaaaatacagtgtttttgacatgtgaactataagttgtatataaaaagattaaaatagttcatttttcataagtagaactattgtaattataaggacaatcctaatttagcgttttttaatcattatctctgaaatagatgatatgacaaagacttggtttgtgttatggaagactgagaaagaagctgagttttctgtcagttgagggttttatttataccctccctaaaacttggctcaaaattcatgaaaacaaattagaatgctatatatttagatatatagctcactaatagggatggggtgcagtgatttacaaaaaattgagaatggaatcagtgaggtagataaactggttcatgagtctaggcaaaatatcagttacctctgtttaaaatgttctttatgtcactggttattttacgtttttaaatgtagttgaagctttaaaacatgttccgtggtgttaattctgcacggtgctgtgtaacttgtaatgtccccatgttacagagcttctagtggtgaccttctgcgaaatacatgcttagattctaccttatttttaaagaagtagtaatgttattctccatggtgtattcttattattgggttttagaagagagataatagtctatttaatgaaaatgatctctggagccacttattttagactcagtaatattttgtggtcattatttcacgtatccaagtattattttctgaatgttgtcacaattgataacatactgtctgtaagatatgtccttgttggaagccagttttttttaatatgggttgggttcatatatatccactaataaaacatggtttcttaagcctgggatcc

SEQ ID NO: 55881 - DNA, 2808 bp, Bovine  19866880890454
aaccagcccggggccagaagagaacttcacatgcatggtactagggaccacaggaggtagaaggtcagtcgtgtgctggaagcttctggaagtcagcttccgtctggagttcccttgcagctatgagaataggcctcacggttactgagctcctggctgatgtgaaatcacaggaacacccctgtgagaagcaggggagtccaaggtctgctgccccgggtgcactactgggaggaacccgaggggagagagtcccaaaaagactctggatcagagagctctttgcagcccaggtcctcttctgcttcatggagccaccatccccaggacgtcttgaagacctcagaggccttgaccccagcctgacacagagaactggaaacgcaggggacctggattgcagtaaagatcccacctcttgggaaagttacagcttctaggcatttcattcatacaggagagcccttgacagcacctggcatctagttaagcgcccactgcactcagaaacattattgtcatcattactgttatcttttcatcatgctacagtgagctgctgaggtcctttccattacgataccttgtgtatcttgcttattggagaggtagctctgcgactgtagctgtgaacttgctttggcttactgaagaacgacacagagcctgccgggtgtagccaagaaaatggaactcaggtgatttagcccagcagccatgggccttgaattttgagtaagaactccctgctctgatcacttttagaaacaaatacttccgtatttatatcatttgctccctttatgccctgctgttactccaccccaccctccaactcattcacatcatccttttgggccatataacctgagaatttccctggtggtccagtggttaagaatccaccttctaatgccagggacgcaagttcgatccctggctaggaaactaagatcctacatgcctcagcacgacaacaaagatccagagcagccaaaaaaaaaaaagtaatagtcttttctgaaaataggaagaatatatgtttagattttcttcgtttctcattgtaataactttctggaaccgtaatattggatgttgctaattcaaatccaataaatggagtaagcatattacattcaaaaacaaagctcctctgttctttatattagtgagaagacagaaactgtgcaagactaaacatttggagcgtggagagagacattgtttgggaagagttaagtgtttgcagtttatggcaatgatatgtgaggctatgaaaaagaaagcagccatgaaatacatttttgcataaaggtttgaaatttattagaaggtaaaaataattggaaaagcagagctttcctcaccgggttatgataaaacgttatttatgggccatcattgcatgtgtttaggagcttggttccttttcagtggctggtctcaaagaaacagaaagctcagctcttaaagctgttcagatgacagaactgatgtgcatacacagtcttctgatgactgggccacattaaagcaattggtgataacagtcaaatcaccggagtctgaattctgttatagaagcttaataggtacacctgctaggtaggtacttacaaactctgcatgctttgccatggtgcaatagagccgcagactcatttagaagtagtgtgcatttacctaagttccggtaagaccttcactgtggggtttaatcactcagcacagattttagaattttcatctgccatacacaatactgcttaaagcgctttgagcttcttggccaaaagagtgggcaaagcctttatgactgtctctttggctaaagtaccctcctctttatcttatcaaatcctttcagccccgaagtgaacttaggtgctttgaaatggtgtctagcaggcccccctaaagaccagtggagtgttttactactaagcaaatgatccatttttaacctctactggtacgcctcagtcttctcaaagcaactgtcttccacactgtcttctctcctctctttgttaggcagtgagagttacccgtgcccttgaattgaccccgttttcagttttaatctgttctagagcttacagctttacatagtaaaaggaagatggaaagatttggtgattcatttgagacattccgtttggttctgtgaatatccacaggagaaagatggtgcatgccaatgtccagttttaacggcccgtgtctagtttgacgacagactgaatttgcctctgggttttctgtcttctttgttcatcaggaatcccaatgctgaagatcgtgtttgcaggccacgagtacctctctttaatatccgtccccttgctcatctaccacccggtgcaaatcctcctgggaagcgtgctcgtgccgacgataaagtcctggatggtgtcaaggcagaaggtgagactctagaaggatcttctttggatccaagtcacattgaagtgctatttctgaatcttagccattcaaacgtgttagcatttgcacatataaccttgttctcaagtacacattttcttaactaaattcagtaataatgatgcattagtccatttcaatttgaacaagagagttgaggaccaattgttctacatcaatataaaagcacaatgatacttaaaatgcagtctttaaaactgtttttaatttgctcatgttgaagggcatattacagtggagtaaagggttcagtaaatatactcaaaatatacatgcccaccactcagatgcccaccgtctttgcctcgcctcttcattcacatgtgtcctgatttt

SEQ ID NO: 55882 - DNA, 1666 bp, Bovine  19866880908488
tgtctcttgcgttggtaatattgtattggcaaagatgaaattacataatctagacaacctcgtggcaaccacagaaatcttgtaccactctgatcaagggtcagatactgcaggagtagcatccgtcttttaccaacttcacagtggttgcgtggaagcaccagccaagtttctgaagcaaaaagtcagccacgcagctcacatgaaaagcactgcgacccaatctaagcattacgacagctggtttaattactaacaggagaaagcttattttttttttccctgtagagcccagaaagtgagtgaaaaggttacattttcatcaagctgtgtctgggtagggcacgcaaaaccagtccctgcttgcttaagaagaaacagaaattctgggtgtggacggactttcaagttcaggcgtggagaccagtgatgggattgccccagactgccttcatgaagcctttcctgggtgtacacaggggaacagtccccagccttcagggagatcctttggctgtcctcattcaccatgttccccactctatttacctaatatgtttcccagcaaaaacattagttaatacattcacacatgaaactcattatgatagaattaaaattttgcttgctcctttccacaaattgaattactgagactcagactgaattctaaaaaatctcttcttgagtcattctgtgaagaaaatgaattacatgtgttgcgagccttgagcgccatggtttccttatgtggccgcctcggcagggagctacatgctccgggggagtgggtaaccctgtgtaacagaaatcagaaaaggggagtgggaacttccgctgcatctttaaaatagcccctctggagcacagaatttcagagagtgacatgattgatcttgtagctgagatttagacagtcttaagtcaacccgtcatagactggtttagttgtgactcccttgagagattgtaatgtctgtcacgtcttggacactttgcaggttccaaatcataaaatagaatgtccagaatattctcaatggctctatttacatcatccattttaaccggcatgtcaacatttatgttgctggagaatagctttgggaactgttgccctgaatacaaattaacaatggaatgcactgacccaatagcacagggtaggggggaaaacgaaatactgttcccccaaactctagatgaactatgtgtgagagtgtgcttgtatgccagtaggcattaatcaactgatattggccaacacaattaaaactcacttcgtgggaagtgtctactacattaagatttttccccagtggtatttctgagcaggatgcttttatccaaagtacaatgaaacatgcagtgatgaaattctatagctcgtcactcttttcaagtacctagtaggttagatgcaccatgggaaatacaaaataatcaaccccagatctcaccttcagggtattaagaaattctaggtttttcccaataacggagaaaattaaaatacagccagttcccaccccccccatttgtggtcaaaaatagaaagaaagccatactctgctgaaacacattattatttgcttaaaaaattatataaacagatgccagcatagtaaacttaaagtatggtggacccggaagttcttcgttcata

SEQ ID NO: 55883 - DNA, 1425 bp, Bovine  19866880951619
ctgagcttttaagaatgttgttttatctattttttatgaccaccttacacttgttaagtgtaattctggctttatgtaacatgaaaaacctgtgatagggtgccctgtgaattaacaagattgggtggacaaaagacaagaaatcatttaaaaacaaatattcacattaaataccttggataggtaggccttctggggatttttctctaatgcaacaaaagcacactatttctgttttcagaaatagtttctctcagatccagagcttgtctaaagccatattacataagtaagggctttgtttggacattggcattttacatcttacaatcttactaaatccttttttgatcaatctgatattgaacagatctatattgatttcttgtatacttgtttatggtatttgttttgctatatctaggattaaaagccaaattaacaagtgtaatcaattttcttagtgataaagaaaagtcctctagtacccttagacacattcatctagggattaaaaaaaaactaaagtgaagatgttgtaataaatggatcgatttattcaatcactgggcggaagaacattagctctgggaaagggctttcctctaagagctttagttacccgagtttctcttgtgttgcaccagatgatttgcatttttagagaaatttcatgtctgcagcaagttccagtgaaaacatgaataaattgcttttctttctctctttttctgactttatgaagctgaatccttcaggggttgagtcaaagtataatgaaataaaggcagcaacacacccgctggaaaccctggcttacgttcctcattgcccaagccgttgtcctgttagtggtcttcagggagatcctggggcatgttgcaaattttttaaaccactactttagaaatcatctctagaagacaagaaaatagacaaacaacaattaggaacttgacagcctttccacagcaattcttctcaaggtcaaataaatcttcctctctgagcctaacacaatacagctacctaagaggctttcctgttactcaccttccttcttttgcattcactggagtgagggtgaatatggccttcccagctggtgctagtggtaaagaacgtgcctgccagtacaggagatgtgggttctattcctgggtcgggaagatcccatggagggaggcatagcaacccactccagtactcttgcttggagaatcccatggacagaggagcctggcgggctacagtccatggggtcacaaagagtcagacacagctgaagcaatttaacatgcatgaaatagaatacaaaaaaggatatatatctatgtattatggggggacacctgaattactttgctgtacaacagaaactaacacagccattggtcttcatctactcttcagtaaaatacaaaa

SEQ ID NO: 55884 - DNA, 819 bp, Bovine  19866880959390
gaaggatctccatggacatgctgtgtcatttgcttcagtccctgtctgagccaggatgggattggcacatcgccttgttgaaattggctccacaccttgttgaagtgggcatcccgccatactaattgatgggtatgagtgcagacatgtcagagaaccagaatgaacatcagatcgggataggaggaggatttcaggccagaaacatcaaaacagtcagttgtgctgagttcctgtgctggagaaagggaaaagatggtatcaatgtgacggcagcagtccagagttagatttatttctaaatgcccccaaatagctgacaaaacaatgaaagtgtgggcctgagaggcagcaggaaggggcaaggttattgactttcaaaagatacagctattactgggatactgccagctgggatgcaagaagggtttttttaaaggcaagcaggagttctcgatagcagctaactttctagctgagtactttggtcagctttaaggaatcagagccactgtatggagggtttctgggttgattgcagtgagaaccgctgcagatggatgcagataaccacctagggagtgactcttcctgcttgtctgtcctgtgggatccactgtctccccagcaagtaggtccagccagcgggccagccctcagagcatagccatgaatcctgtcctcgtgttaattgcatgtttgatacagaagggtccctccagtggaaaggcagctcagtaacaacccaattttagtatataaaagagaaactttccaagacttgggaaagtttctaaaggttaccgtttctctctacag

SEQ ID NO: 55885 - DNA, 1337 bp, Bovine  19866880980817
tgttgatgtactactgtattaatgttgatgtactgggcttaattccatggtgttaattctatatgatctgaatacatggggcaggggtagtgacttctccattttttggaaatcagtttctgagactctctactctcggcatgataaagagctatttctactaaaattgaatctatggctttaagtaaattgtgctgtgatgcaaaagtaaaatataagctcctcattaacaatgtcataatgctacaatcacccagaagatacgagcagttttcatacatggtatttattcttaatcattttcataaaacacaatctgaattttattttttaacaaaaccctttgagacattttgataaggtcaacagaaagcacagtcttttaacatgaggtgatcaactttttgccaatagcaggaccagcagacctaatggagtaatagctgcagggtccagctaaatataatatacgaacgtaatcaacctctatgatgactattcagaagtaatccctttagctttgaactgcaacacatatttcaacaaggaaaaaaccttatgaagaaattctctgcagaccacactgatacaatacagccttcatatcctgctcgatgtgtttgctgcttatagtgagttttaaatttaaggtaatgactgctgtatattcatgtgagcatacaacaatacttttgatttgttgtggaaaggttgaatccattaccaggggtctagtctataaactctgacacaacctttacatatgagttattatttacccttttctagtaaggccactaagatgttttgcatgacaaaatgataaaatttcattcaccttttcagccacagaactaccaggtaacatcttttccatttcaatttatactcacttccagatagcatttttaaaatctcatttgtgtatcatactgtattatatgaaaattatatgccattgtcttcatgtaaaggaatgggattgtaggtttattgcaattcagcattgttgacttattctattgctctttggtacaaggttaagctaaaagctagtgaaatcagatccttttcttgcccacttatgggaatctatgctttgagagtctttggctcagatgataaagaatctgcgtgcaatgcaggaagacccagttttgattcctgggtggggtagatcctatggagaagggaacggcaacccactccagtattgtcgcctggggaattccagggacagaggagcctggcgggctacaatccatggggtctcaaagagttggacacaactaacactttcactttcactattactaacaaggagatacctgtttctg

SEQ ID NO: 55886 - DNA, 1520 bp, Bovine  19866881008120
tagaatcaaatgtttatgctaagatgctaagaaagcattttcttatatccaaagctggaggtgaaaaatattatgaaggaagcctcaggaatctctaaagatctataatgccaacttgctaaagcaataatgttccatttacagcacaattcagtgaaggattccaaaagaattctggttgaaatttgtcaatgatcttctttaaccttaagcaattcactgaagacctgaacagcttctaaatgttctgagaacactgtatttgcctaccaaggcttcctcacaactcacagtccttctaacaatatctctaacacaactggaggccatattttcttcttggggtataaatagattatgaaaaagttatttaagaattctttaagtcttgtgatttaaccctcttccaagatcccataaaacctaatgctgaagtgtgtttatacataatgtcatttaacccagttttgcatatcacttgcagtggaatttagcagttatgagactaatgactttatcacaaacctacttttaaaaaatactatttaaattttcttgtttaatttttctgtcagacaggtgcaataaatctaacattaaaatattcacttagaaacatttagctctggctgttccatccacacaatgaagcttcctcatccaccatcaatgccataagaatgttaaaatgaatgtaaccttttgagagtacctattagtccagaagtaaagaaagagagaagcagctctgaaaatagcaataagttaaggagaaatttattccatggtaggcgctaacccaaagaccagtcttatacataacgatcacctaatcaaaagcatcttttctcacatgtaaaaattatttgcttacaaatatcttgcttctctatttgggcttagataattaggtatttctttaacttaacaaacatttgtttttaaatgcaaccatctgtaaagttatgcctattcacacattaaaatgggctggcttaatctggttgctttttccctaacatttaatggaccacagctgaatggagacacagtgagtctgagtaaataattttttgactcaagacctctctactccccagatgtactccatttctgaaacccccaacttgcccttagcattctgctctccttgagaattcagctatctgacctgcctatgtgcctatggcagaggccatatattctgagcaatagtcccctctagagagtggaagctttaaaaacatttcagtcaatattattgacagttgatttatatcctttgaatgtgcagtcctagatcaagattttttttttttatttccagccatagagtatcatcatcatttaaaatggtgaatctgggcaaatgccaaggtctgcctgtcttttgaaggctgcctgtctaatcgatttactcggtttgaagccacagtacaagccaaatcaactgcatttcggctgaaataagatgatgaatacctcgttatcgttgagagagtgtgtccttatatgcagag

SEQ ID NO: 55887 - DNA, 958 bp, Bovine  19866881108061
tcagtgatgccatccaaccatctcatcctctgtcgtcctcttctcctcctgcctgcaatctttcctagcatcagggtcttttctaatgagatggttcttctcagtagatagccaaagtactgaaaagggtaattgctttcaaatctgactttttgcatccatgcctcttcaggggcaacaaagctctcggaaccttcagtgaagcttacttttcacttttctacctggacaaaatccacatcagtgcctccttcagcacataaattattccctaatcacaagtgaaggaaaactagagttttatggatgccaactcacccacccccaaataacttaaaaatgattttctagaataactcagtgtgagcaaaattcaacagaacactcataaaaattcaaaagtcaagacagaaagagattctggaggaaaattgattgctctttcagaatagaaaggcagatgacttttgtattcttagggtgtatgcatgtgcttttaaaaataatattttcttagtctttactagctggagcgcaggaaggcttggcaaagctctgtgcatggcctttttccatctttgaagttccttcattcctaaacctctggcaacttgccattggcccaagagccctagcctaactttggggtatgattgacacagtaccagatcatggatttcatacaaactcgcaccatgtgtcatattagaaacagtgaaaccttttgcctagaagcagctgctggacaaaactcaagcagagattattttccttctttgaccatttgcaagacttatcccagaactaaagcttaatatttacatctgacatggatttgcaaggattgctaaaacggtggcaatgggttaagtaggctgccatagctcaccaccccttaatgtgagagggacacgggccggtcagatactgctccacagaacaagaacatccactggag

SEQ ID NO: 55888 - DNA, 745 bp, Bovine  19866881126363
taaaaaattaaattatcctttatggaattgtgcaaaaaaattctaaaagtatctcaaatattttttaaaaggctgctgttactgtggttatctgattcatatcataaatagctgtgcatctctaagtatgaaaaaaaaaatcttgggatagaagtgaagcacatacttaaaacaagatcttctgtccagtagctgtgtctgaacagaatagtgatgagccccaaataaacacccaacaataatcactgtatatacaccagtccctagtgagctgtatattaatgtctggcaattcatgacagaattcctaatttcatagcagctctgctgctgctaagtcacttcagtcgtgtccgattctgtgcaaccctatagacggcagcccaccaggctccgccgtccctgggattctccaggcaagaacactggagtgggttgccacttccttctccaatgcatgaaagtaaaaagtaaaagtgaagtcactcagtcgtgtccaactcctagcgaccccatggactgcagcctaccaggctcctctgctcatggcattttccaggcaagagtactggagtggggtgccattgccttctccccatagcagctctaggcatgaataaagatttattaaggtagtcagtaaatattcctaaacaccaaattgtttttttttttttaattttcctattctgctttaggagattaaagaaagcctgtattatgatactaaaagatactgattgaa

SEQ ID NO: 55889 - DNA, 830 bp, Bovine  19866881172493
agttgctgtggttcccagtttccctcctttccctcctcctgtcggtcaccagctgccaatctgcccctattttttttttttatttggagtttattgctcactgcagtgaaagcctttgtttaagaaagagggctcccagggtctcagctgcctgggtacagcctgctgcctacgatgagtagcaactgtcagtttattttatctcaaccttttcatcattctgctgaaactgatcgactgaaaccacctgagagaactgaggattccgtacctacaagtcattagctgggaccgcagcctcccagcacagggcaagtcaactgaacactcccggaaaggcagtccactttaaccccatgtttccccaggaacacagggattctctcacttttttgcatctgaagcagagtcgatgggagaggatgcctctgacgtacagacccgtaagtcgggacgctcggctttaggtaaaggttgcagataatgtcctctggactgactgctgtggtgaccccagcagtggggcacattgttccaccaacaaaagcgaatgtgaaatcatctcaaaccccattctttaccgatatcgaatgtgccagactgaagcctgatttcacatgcgtgtgacccacaggacagctgcttagctaaagacgaacttcccacacactttaataatacattgaaacctttttctagagaaaccttctaacctacctattgtatccagaatgcatcaaaacagaatgacatgacatggcctgagccacagtggtgggtaatgtttagtaaatatcaaggacatgcaaacctactggaaaatgatattt

SEQ ID NO: 55890 - DNA, 1256 bp, Bovine  19866881220189
ttctgtcatgaactatacaggaaaagaatctataaaagagtggatatatatatatatatgaatagctgaatcacttgtatagcagagactaacacaacattgtaaaccaattatactccaataaaagcaaacgaacaacaaacaaaaactcaggccacgtgtacacatgtgaaatgaatgggtttggcacagctcatccatttcttttggatgtgtctaaatgacagcacacgctgccactagatttagctgtgacgatcaataccaagtgtgaagatggacaaaatgaatggagacagctgcactccacttgccttgtctcatatatcaatggtctgatttactctagtttttataatacccctaagccagggccaagtggtcctgaactttatgactcagagaggcttcagccaggggaagaggcagaggaaccagtgacccctaataaaggctattcctcctgtgagtgtacttagtccacgaaccctcctgccatcaccaagacagaggctgtaggatcctatagtcaggctgaatttgggcagtctttttttcctaaccccaagccccaccattgatgtctattttaaacaggcttctcctcaataacacatttggatttattaaatacaagcaggtgggagaataaaaacatagaatgtgattctggggtcagaagaagacagaatctaactattgaacctctctagggcagtgctacccaaagtctgacaggattagtagaagcagagggaaaagtacagatgaggtgaggaggaacactgtctttaccaggttttaagaactggtaaacagactatgccaaagcctttgactgtgtggatcacaataaactgtggaaaatgcttaaagagctagaaataccagaccatctgacctgccttttgagaaatctgtatgcaggtcaggaagcaacagttagaactggacatggaacaacagactggttccaaatagggaaaggagtacgtcaaggctgtatattgtcatcctgctcatttaacttatatgcagagtccatcatgagaaattctgggctggaagaagcacaagctggaatcaagattgctgggagaaatatcaataacctcagatatacagatgacaccgcccttatggcagaaagtgaagaagaactaaagaacctcttgatgaaagtaaaagaggagagtggaaaaagttggcttaaagctcaacattcagaaaactaagatcatggcgtctggtcccat

SEQ ID NO: 55891 - DNA, 2201 bp, Bovine  19866881269212
ctcatccctaaacagtgatttctggagctatggtatcaggtgccgtcactaagaaggaataggcaatgttttcattaaaagatgtccgtaggtaccctttttgttgtttagtcgctgagtcgtgtctgactctttgtgaccccatggactgtagcccaccaggttcctctgttcatggaattttccaggtaaaaatactggagtgggttgccagttccttctccaggggatcttcctgtcccagggatcgaacctgtgtctcctgcattggcaggtggattatttaccacatcagatatttattttgatatgtactctgataatcatttcaatatctttgaaacttaaagtgccagagagcaagaagtgatcattaagtaaatcatgtcaataaatttaactaagagtctttaagaaaactggaaatctatgtcaatataatttttctagttccccagtagagggcaacttttatacattttaacggtcaaaaaaaaaaaatctatgcacactgcatcagtaagaaccactgtacatttaaataatacgatttatgtctatgaatggattttcactaacaggtagctataaaatgtcatgaaattttaagtatgtaattagaaattgaatatacttaataatgagtaattagcattttacgattaatataagtactattgcaggaagtagtaaccatttgggtaactttgaagtagcaaccatttaggtcactatgatagtatgaaatataaactgtaagtgatgagagttctgttctttagtaaacattttgattgaatttcattatgactgagttccaaatatagctaacatgaatacataaaatctaattaagaacagcaaaaaaagccataagcatctcaaaatataattaactacctttgtgattataaactttgaagcaataattatcaatgttcatgttttaaatggtgtcagatataactatgcaactaaacatgtgtatgtatatatttgtaaacagagtaaaattctactataacagctcattactattagacatttggacataatgtgttatgttcacattcattcactctttcagcatttatttactgagcacttactatgtcccatagaccattctagaagtcaaagatacagtgtgattaatctgacagaatttcttgccttcttggagcttatatccctgctcataaaaaaatatatcatgaagccttctgaaaagataagtttataagatagatacttacaatgtctcataacactagtttctttttctaattaaaaaattatactttgtttttaatttagaaaaatattacaaggaaaaattaaatgcttcatgatcttaatattcaaagaacccttattgaccttaaagtaatatataaatttgattagaaaaatattaattgtatggaaaagtgaaattttctagcactctactcttcccagagatgttaacagtttcttgtgactctttccagaaaaatataccagtatttatccatcctcttcccactcatccagtcttcttaaattattcaaacgtacacgtttgagacagtcatattttacacagtattctgtacatagctttgttttttcctgtttcactatgtttcttgaggtgctttccataaagtaatatatatgtgtatctccttttatttgactcattttattttttaatatagaagtattttataacattctatctccaaaatcctcaaaattctagttttaaaactggttacataattttgcctggaattgataagagctgtggaatatgtcattaattggtgtgttttaatttaggaagaccaggaatttacagatttcaaaaagaaacctggaaaaattacctttcctctagagcagtacatttaaaaaaaggaatcaccatctgctttggataaaaaacttatcaataacttcattagatcgcatacaatgtaagtgtgtctttggttgtgaattagaaatgatttttttttgtagtcaatttttataatggttttgtgttatataataatttttcatgttctactcaaaattcttcaagtaaacatgtaagaattactttatctcatcttatttataatactgctttaaaccatgtatttatttcagtgtcagatttgatattaaaatgtgatcataagaattttttactttatcaagatattatg

SEQ ID NO: 55892 - DNA, 692 bp, Bovine  19866881338637
tctctaattccttttttatcaaagtaacagcacctaaaatacagcattccataatgtaccacaattacttgagctttcgtgttcttctttaaagaactggtacaatatcatcatgccttttcaacttttcatactttctcataagaatccctgaaagtggtaaaaaaaaaaaatgtatcccaggttacaataaacaaatatttttgtgctcccacattttaggttaacattgataatatcctggggtagacatgcgctgatctaatttttaaaggaccctttatctttattctcttcctttatttcttcccttctaggtaccttcctttcctctcatagggcggtgattgcgtctgcacaggaatgatagtatatatagaaatgtagaagacatttctggttaactttcaagagtctcctttaaaggtgaaatatagggagtctttagacaaagaaatgacttccattaagttgaaaagttttaaatgccttccttctgaagttactttacccagatatttttttaaggaatgtattgtattaacattattactaattgatagttatctcttctccccctgccccctacatacataccacagaaattataaacagtgacctggagaataatgtggtcgtgtaattatttggagaaccttactttgttaaaaaaaagaaaagaaagaaagaaa

SEQ ID NO: 55893 - DNA, 1069 bp, Bovine  19866881353977
ctgacgcaaatgtagtggccccagggatcctggggactttgacacagccagttgatgcagtgggaccttcgtagcagacagagggaagttcttgatggtcttccatcagcatggggaaaatcgttttctccatttaaaagatgaacaaatgtgacctgtgtttcccctggagttcactcctgggagcacatacatcactctacacaaccaggagggagggtttgctggatttctcttccataagaaggtgagtgttgcacacaccacataatcaaggcaaactagttaattaaaaaagttactggggacttccctggtggtccagtgatttaagactccgagcttccactgcgacgggcacggcttccatccctggtgggggaactaagatcccacatgccacactgtgtggctcaaaacaaacaaaaccaaaaaacccacttaagattcttggttttgttggcatagaatttaggagatgaataattctcagatggcttaatatgagtttcattgagtaggagatgactttttcatggaagacgtgcaccagcttattaagttggagcccattttagggggctagaagggtttcccagcacaggaagattaattgtgttgccgaatgtcctccccatagggcaccgataccagtcggatcatctggtggttttctttccattacttctgcaaagaaaatgttagtaataaattgaggaatttaagactgaatattttcttttctggggagaaagacatttggcatgggaaaaaaaagaaaacgctagagggtgagggaaaataggtaggacgtcctttccttctttccaaatcagaaacagcttcagtctgccttttctctcatgagtcagaaaaataaagtgatacaaaatccagtctatgcctatgccttgaggcatgagtgtaactaaaccattaggggatgcaaattgaatcctctctgactaaaattcagtgtataacatactctttggccacatgtagaccccacccactcacaaacaggctttttctctgcacattcacaggcaggctctgctcaagcaag

SEQ ID NO: 55894 - DNA, 952 bp, Bovine  19866881354845
tggggccggggcagcccagccactcctgccctccacacctctgcccctccaggcccaccactgctgatggccagttagaggcatcaagaccctctgccagcttcctgcctcggtcaaagcacaaggagcgcggagtggaggagggcaatggagcggctggggtgggggaccccaggaagaccaacctaagacctgagctcgggcaggatggagccagggccccatgggggatccagctcaggactccgcagctgggtatcctgctctgcctcttggccgtgctgggcatggccgtggttgttggctttcgttacctgcacgcccagtcttgccgaaggcagatggaggtgtccttttgtgagcctgccggggatgcggttgccacggttgacggtggtgagaccgtgcacgtccggagaattggagacaacagttttgttttggtcgaaggggaatgcaactgggttgctccctctgtgggcagcaagaaaacagtcctctgagaaaatcgtggtcccaggcctctctgggttccccctgcatcctgtagagagtctcagccagaacagacctactgagaatagttgatgcgaacagcgattcactgtgcacccaccccccacccctgtcagggagcagttagtagaggaagcagcacaaggaccgttctatcatcagagggaattcttccccagctttgttgtcttaacatctgtaatttagctgcctttttttttcttctcgcaattagacgttctgtttgaagacttaaacccaacacaatgaatattgtataacctgctcattaactagactcccgtggccgccgagcttcctccgttgccttaaggaacctgcagaaatagaacttctgtccctcctcagcgttatcagcctcatccctctaactctttgaaaaaaatagcaacggcggagttgtgtctccttcagc

SEQ ID NO: 55895 - DNA, 1146 bp, Bovine  19866881366951
ctttcaaaaaatgagaatttacttcagttttgccttttgtgcaagtcttactcctgagagaagtgtagtcacagtggtgttgtttttgttgttatttgcagaggtaggggggttggcttgtattttaatgtggctcaatctcagtgtctcaggtttgacagtgttttggttttttgttttttctctcctttccactgaagtcattgaaatatattcaccctttcattcacatcagaggtgtaaatggattttctaaaggtttttcagagacaaagtcagtcgctttgtgacttgacttcttcaggtgttgcaaaaagaaagcttagcacaccactaagcacaccatctcaattgcaaggatgctaaaactatgtttgaccttgactctgcaaagagatgggcacaatcttttgctagaagtggcccattcaccacctctttgctttatccatctgtataggatttacttgggaaagagaaaagagaaggaatcagatatattcgagagaaaagagcatgtttatttgattttccagcttctaatgatggttacattcacagtttaaactttttagtttacccttttcaccattgatatttgcaaaatccaaacttaaaaatatatatatcagccatgtcacacaaaggcttatatctcgatttgtttcatgtcattaaaaagacatactgagtttgaagctcctttcaaatttattcttaaaatataaacccagggaaatagtgtaagactgcaaaggttttatttatagcattcaggatcacaggctttggagtcaggccaatttggagtcagagattcagtgcctgacattgccttttcctatttcactcagtgtctctgaggctcagttttcttccctagctgttgttcagtcactaagtcatgtctgactctttgcgaccccatggactgtagcctcccaggctcctctgtctgtgggatttcccaggcaagaatactagagtgggttgccatttccttctccaggagatgttccagatccagagatcaaacctgcatctcctgcattagcgagcgattctttaccactgaaccaccagagaagcttagtacctgcttcataggattgttgtgagggttccataagataacatacataactt

SEQ ID NO: 55896 - DNA, 1054 bp, Bovine  19866881373843
acacataatcaccatcaccaccaatcagaccatgtgaacagcacacactacaaccctggagtttgaaaaatcacatttaaaacaccggaatgaataaataacaatcacaaaatagaagctaaccaagtttctaatatttaaatgaaagtaatttaaaatttaaaagccacaaaataagactgtcaggtcagctataccctcaaacagtctcaatctaatacctcaagggtgtgctggcattctagcatacatgcactgctctgcacgcacaccgagttcccacggccactgcaatgcttatagttggctcactgaaacaacagtgatgtaggttatcaaagcagaaattgttccttaattttaacaaaaagtaataaggctattctcaccaaaggacaagacgtgagtttaagggaggcaataactttcaactcatgacaaaaccttttctgtaaccaccaatcttatggaaaaggcatttacaatgagaggtatataagtaacagaaaaaaattcctactaaattatataacaacttcacaaaatgaatgaacagaatcatttcaaatgacactactctatctgcatacatcccccaaatcattaaatacaaataggctacacagttacacattttaacccatgagttcagttcagttcagtcactcagtcgtgtccgactctttgcgaccccatgaatcgcagcacgccaggcctccctgtgcatcaccaactcccggagttcactcaaactcacgtccatcgagtcagtgatgccatccagccatctcatcctctgtcgtccccttctccacctgcctccaatccctcctagcagagtcttttccaaggagtcaacacttcacatgaggtagccaaagtactggagtttcagctttagcatcattccttccaaagaaatcccagggctgatctccttcagaatggactggttggatctccttgcagtccaagggactctcaagagtcttcttcaacaccacagttcaaaagcatcaattcttcggcattcagctttcttcatagtccaact

SEQ ID NO: 55897 - DNA, 969 bp, Bovine  19866881393217
aaaacggaatactcttaatgggaatgagatgtgagcagactgctaatgagaagttaaccaaggactgtgaatttgccaaaggagacgagttccttgttcccctcacacacacacacacacacacactttaacgctctcagagttggcttggaccttccttttccatcagcatatacactgagtgtcggtttatgcagcagaaatctcttgagcaataacaatagggaccttatcaaattgtgacgatcaggggcaccagatggtttgtctattaaccatcctcactgacaaatatttataggtgcctaagagattcgtgcttctgtaatagattttggttggacaattccatcccacaaggatttcacaaaccaatgaccctctaaagacagcatttgtttctgttccttgcttgtgatcactttttttttaaatatgtcattctttaaggactcattgtcatcctttttctttgtaccttatacattcattgtactcctcaccagaggagttgcgttccagtatttttttaaatgtgcgtattaatttttgtgttacctaaattagattttctttccagtatgaattttccaatgttccaaggctttagagcagttttccacgtataatcatgcagtaaacttttaatcatgcagtagacctttaaaaagatgttgggaggaaagatacagtgactccattctgatttacactgcatattcttctttattttgtttgagtcacatgggactgccctagagtgcttggctgatgtttggagacactgggaggaaatcaaaggagccttgcggaaagcaaacttcactgcctctttgcagagataaagggaattcttacaaaaggagagatttgcagacatacaactggaattcaatgaagtcatggctgaggcatctgctgagaagctaccaggaagtggagacctacagcccgtgtcaaatctttcca

SEQ ID NO: 55898 - DNA, 1990 bp, Bovine  19866881483005
actggttctaaataggaaaaggagtacatcaaggctgtatattgtcaccctgcttatttaacttatatgcagagtacatcatgtgacatgccaggctgaatgaggcacaacctggaatcaagactgcggggagaaatatcaataaactcatataatgcagatgataccaccgtaatggcagaaaatgaagaagaactaaagagtctcttgatgaaagtgaaagaggagagagaaaaagatggcttaaaattcaacattcaaaaaatgaagatctggcatctggtcccatcacatcatggcaaatagatggagaaacaatggaaacagcaagagactttattttcttgggctccaaaatcactgaggatggtgactgcaaccatgaaactcaaagacactttctccttggaagaaaagcaatgacaaacccagcaagcatattaaaaagcagagacattactttaccaacaaaggtctgtctagtcaaagctttggtttttccaatagtcatgtagagatgtgagacctggacaataaaaaaggctgaacactgaggaactgatgccttctaactgtggtgctggagaagactcttgagagtcccttggactgcaaggagatcaaaccagtcaatcctaaaggaaatcaaccctgaatattcattggaaggactgatgctgaagttgaagctccaatatttgggccacctgatgcaaagagccggctcattgaaaaagaccctgatgctgggaaagattgagggcaagaggagaagggggtgacaaaggatgagatggctagatagtatcactgactcagtggacatgaatctgagagatagtgaaagacagggaagcctaatgtgctgcaatccatgggatcacaaagagttggatacgacttagcgattgaacaacagcagagtaagtgtgaagggacttccatgatgatccagcggctaagacctctgcttccaaagtagaataagtgtggtgtggcagctctgccatgtgctagctagatgacctgtcgtctgctctaaataaatgacaacagtaaaccaatggtgtaattcttaacatcataatttctcacagttcctccttcatctttacccccaagttcaaacatgccaacaagacacaaggcccaatcccttcaggatttgtcctaaaccctggacctactgacacgaagcacgtcatgcatgaagaaacgtggcagaagatttgacaggccacgggagagacaataatgaggatcgcttcacttccaaccatctcactagcatctcttcctctgccctagggccccccccaaagactcacccccgccttaccacccacagtacagagtctctagaaggaatggcccagtccttgccaaacaaaacctcctagaagattctcataccagctgcaacagaagtaaccttttctatgtatcattagacctggtaacagacaatttttttttttctttcccaactgaataatcacttgaaccttgagtgccagggcaatacctaagaattatacaagtttgccctcagttaactttagaagatatctaaagcaggaattctataactcagacaaagtctaataatccaaagataatgaagtattcatgctcaattgcgatgaactttgtagagaccgaaaagaattacaactctaaaatcactaaaacttggagtttgaaggtccagattattgaaatgttatacctttgggcgtcaacaagcgtcctgagttacagcacagtcagaaagacattcctctcaaaccacagacattgccaactatttaaggctctaatttaccaagggaagaatcggtagttaatttcctgaagccaggggataatttccttctaagttcttttctatttcctcttggtttcttgaccttgtgaatctcttatctccattacttctttatcccaaggctattagactgtttccttttcccaccctttctaaagtttg

SEQ ID NO: 55899 - DNA, 1144 bp, Bovine  19866881576370
cgaagacttactgtttaccagacattgtgtactgtttcatttctggttattaagggggaaaaaacctacaaagtaggtatattttacagaccgtgaaaacagaggttcagtcacttgcccaatgagagtaacagggtgataagtggtaggcgtgggattccacccagggctctcttgtgtcttgtatcagccttcctaacagcttacactgtaccgccctcctgtaggctactggacataataaattataaacctctgtatgaagcaacagctatgttaactgaaaattagcttgctttaggataatcctgaaagtcttttctaatcaaattctaaaactattgtgttttggaatcatcatttcatgttctataagtggcacgtaattgcccctttgttggtggctcagatggtaaagcatctggctttaatgcaggagacccaggttcgatccctgggtcaggaagatgccctggagaaggaaatggcaacccattccagtactcttgcctggaagattccgtggatggaggagatagtccatggggttgcaaagagtcggacacaactgagcgacttcactttcactttcattttagtggttggaataaatcagcatcaacaagtttaactttctgtgagcatttgtctctgaagagaaaatgtgtgtgtgtgtgtgtgtgtgtggtgtgtgtgttggagagggggacccagactagcatttagtgatgctggaaaaagagtggccttcttggattacattatgatggggagaccatgtatcccagtgactcttaaaggcaaacatgggcttttaagctgagagattcacaaagaaggaagagatagaattcaaataacaatgtgtaggacatttgaagagtaaaattatggatgtttctaactaagaacaaagtgaacaaaagtgggaaatctccatgacaactagagagcaaagcaactggattccagattcgcctgcaactgtcttcaagactccttggaaagtctgagaaagcatttaaatggaaaacaagtcaagtgaattcagacgaatgaatctctgagagataggaaatgatccaggtgattggagtatactctctcttagggaagtgggatagtaagtgaaataagttcaaaa

SEQ ID NO: 55900 - DNA, 2084 bp, Bovine  19866880435555
ctgcagtactcttgcctggaaaatcccatggatggaggagcctggtaggctgcagtccatggggtcgagaagagtcggataggactgagtgacttcactttcacttttcactttcctgcattggagaaggcaatggcaacccactccagtgttcttgcctggagaatcccagggatgggggtgcctggtgggctaccgtctctggggttgcacagagtcagacgtgactgaagtgacttagcagcagcagtatatgatctagctctttctgacttaagagaacctttcatttaatcatcccattctttctctcaatgactacactcaagaaaaaagaataacttttctcatatcctgatctcttctccacatgaaggcctttgtttctctctctacctgtgttatggattaaatatttgtgtccctcaaaattcgtataagtcctaacttctgacataatggcatttggaggtggggacttcggggggtgattagatcatgaaacgtactagaccagtctgctgtatacttgctttagatttccacctcactaatcccttgacacccagatctccactcagataccgtatccttagaataacctcttttcactatcttccttctttcactatatctcttttaccatcactttctaccaaatttttcaacaaatgcaacactttacaaatctattttccattaaagaaaaaaattttaaataaattaatcacaaactaataatctctcaaagtttgttatttttgtctttttgattgtatcaaaatacatatataagggaaatattagcaactttataaaaaatatttcaatggctatccaataatttggtttaatttataatataattttttaaaaaatatgaatatatgtgcgttatatatttgttcgcaaagatgaactacataaatagaacaagaacattttggttttacagttttaaagaaaaatctactcctcgtgacgcagcagtaaagaacctgcctaccaacactggggacacgagagacatgtcttcaatccctgggtcaggaagatccaggaaggtccaaggaggaaatggcaaccctctacagtattcttgcctagggaatcccctggacagaggagcctggagggctacagtccatggggtctcagagttgtacatgattgagcacatatgcaagcactctcatttacagtaatatactaggcagtaggttgataagattctgcaactataaaacatatacaaaatagaatttaaaatgaataactgtattgcatgaaagagaagataagacaataaaggaaatcattaggagtcaaagatataaggaaagtgtaaatcaaagaagtaagcaagccccaaagcaggtggctgcctaaagggatatgataatcttcataataccagaatcaaagcaaatgcacaattgagaacaatgataaataatgatatataaacatgtggaccatgatgatgcagagaaaatgaaaaaactttggatttatacttgatcatagcagaattcagccctggagtttctttggaaggaatgatgctaaagctgaaactccagtactttggccacctcatgcaaagagttgactcattggaaaagactctgatgctgggagggattgggggcaggaggagaaggggacgacagaggatgagatggctggatggcatcaccgacttgatggacgtgagtctgggtgaaatccgggagttggttatggacagagaggcctggcgtgctgtgattcatggggtcgcaaagagtcagacacgactgagcgactgaactgaactgaactgatagcagaatttccctaaaacctttgaaggtgaaaaatcatttcacagaagaatcagtactatataattatttttatgcaagattcaaaatctcacgtaagtatatgtatagatacacagatacataagatacatatagataagatacataatagtcatccaatacacaaaatgtacacaaatgtatacacagactcacacttacacacaaaactctaaataaaaatgaagaaatagtaaacatgacacttaggatatt

SEQ ID NO: 55901 - DNA, 1276 bp, Bovine  19866880627371
tggttttggtctaaaaacagaaaattaaatgatagactattcctgctaacattatgcatagcatccctacagaacacattaccaaaatatagccacaccaagagatataagatatagaccctctctaactgtccaacgtcactataattcagccaaggtcttcagaaatcaaaagaacctcctaactgagagttatggaacatgggaatgatggttactctcctgtaagctaggcctttatcactttactgtgatctttaaattcttccatgacagaaatgcaagttcagtctttgtttcagagtcacacagtctgcctagagtcaaagcataagctcatacttttaagactgcagaggctgctaaccacttcatttcactagtgagcagggggaaatatcactaaactgaaccaaaggaaagaggacatttaaagaggaaagatttgtttcataagaccaagatccatgctccatggaccctattcagatggagggttgcagccaagcaaaatgtgagggttagatgctgtgcccttgataccactgaatcagcagggcagagtggctggctggcaagtttgaattgtgcatgcttcagcacatttgcaatgccatttacaaaataaatgattcccttgccatcatgtgaacattcaaggcacgttggtcattaatttccaggtcaaccaaaattaagagcgtaaatggcattgagaagtcttttgtcttctaccttgtggtggtaatacagggctttggggaaatattctgttaatgttccttctacccggttttatccagacatccaagctctttctttagtctcagtgtctttcttaaggtgtgcttttttatttgaatcctgaaccagaacatgcacatcacatgtatattttcacattcccaggagactgcaagttctatattttatatgtatgttagactgattgtcccttcaaatcctgaatagttcaatgtcttttgttctcagattttaatttatatgcttcaatatttttgttatgactaaatctaatcaaacccaggaaatgctcaataacaaagttgtttcacacacagctgaatcttttgagaagtcaagttatgaaatgtaaactatgattctcatttccagtgatgatttatatgcaaaatagtaaaagctgcagtgttagaggtttggtatcacaagagaaaatcaaaaatatataccaagatgtaaaatagaggctgttcagaaaataaaaaatgcatggtttggggaggaggacatt

SEQ ID NO: 55902 - DNA, 929 bp, Bovine  19866880632005
tacaaggttatttatgtatacacaagaagccctttgttccataggcatcttttccttccagcctgacttagttttttgcaatatcacagtttatcaccatagagataactataatgtgacaaacattgaaacaaatcaaatgggaagaacatgattagaaagcagtagtaactttgttttttgaatgaacagcctcactgtaaccagaatactccttaaagatctttatcaattcagttcagtctctcagttgtgtccgactctttgcaacctcatggactggagcacaccaggcttcaccaacttccggagcttgctcaaactcatgtccattgagttggtgatgccatccaaccatctcatcctctgtcagccccttctcccgccttaaatcttgcccagcatcagggtcttttccaatgagccagtttttcgcaccaggtggccaaagtattggagtttcaacttcagtatcagtccttccaatgactattcaggactgatatcctttaggatggactggtttgatcttcttgcagtctaaggaactctcaagagtcttctccaacaccacagttcaaaagcatcaattcttctgcactcagctttctttatagtccaattcttacatccatacatgactactggaaaaaccataattttgactagacacacgtttgttggcaaagtaatgtctctgctttttaatatgctgtctaggttggttgtagcttttctttcaaggagcaagcatcttttaatttcatggctacagtcaccatctgcagtgattttggagcccgagaaaatgaaatctatcactgtttccatgctttccccatgtatttgccatgaagtgatgggaccagaagccatgatcttagttttctgaatgttgagccttaagccaactttttcactctctttca

SEQ ID NO: 55903 - DNA, 1959 bp, Bovine  19866880670259
ttgattttctgtctgaatattctattcttgatgtaaatgggatattaaaattccctagtgtgttgctgtctgtcactttagatttgttaatatttgctttacatgtttaggtgctactaaactgaactgtactgaactgaaaatgactctagaaagatttatttctttcaaatagaaaagtttggaattaagaattttgcttctcatctggcaatcccatagcattaagtattcagagattcagtctctttgaatttcatttctctgaattccaagatgtagtctcctcctcataggctagactgggggctagagttatcatcaacatatatgtatttaaaaatatgaatatagaagggccaaaggaaaaaaccagtaataaacaatttcctgaacctgttatagaacacttctactttatgccattggttagtatatttttacctagaaaccatgaaaaactatgaaagtgagacttctattcctgatgacaacatagacagctgaagtccagttattttattaccaggggcaaagggaaggataatagtgggggacaatgtccaaaataggtcataaataaaaatggcttatcagttaagcaatttgtttacctgtattcttgcctggagaatcccatggacagaggtgcctggtgggctacagtctataggttcacaacgagttggacacaactgaagtgactgagcatgcacacacccaatcttgtaatagctaattataattaaactattcatctctttaataatttttattaagcatctaccatgtgatagatactgtgctttgcttcagggatacaaagttgtatttttcacaattattcccttgagaatactacattctagttctaattacgcttttatgaactgcataattacacagatcagtcttcatggattatttaaacttaatttttaattaaataaatgataaatgaaattactcaaactatttaagcacctgtttcttattttctcttttccttttcattctacattgtttgtatatgtttcaaaagaaaaagaaatgtttcatttccattattagatgattcctcttcatcatctgcctgctgaatacacacaatattctgccaagactcctctggaggttaaattcattatcttgatgaatttactaagcttcagatatggccctttgttttgctggctcagcacactgtttttatcaacacaccaagaaaacattaatatctcagaggtagacacatattaagcaacctcttaagacacttataaattcagaatgggaaatggttaattcactatgagaagtataactgtcatcggaacaacagcatgtgcacccttcatgatcagcccgttttgtctctccaggaattgtatttgatctcacatacctgtcgataatgagagctgccacagttttaaggactgggaaaatttctccttttatctaatgtggaaaagaaaaagaaaacaaaataaaaatatgacacctgtactcatcattgttcttcactaaaacagaaccaataaggagcatgtgtgtgtgtgtgtgtgtgtgcatgtgtatgtatgtgtatgagatttatggagttatgtcaccaaaatgatgacattggaaacccctgcctccagcctgccacaaagtgcattagacatctatccatgaataaaaattgttcattaaaaaactgggatactccagattccacttaagaaagtttagtgacacagtgcaacagaagaaaagaaggaagagcatcattttgcttgtaatcatcacatcccccaagctaactatgctgctgcttctgctgctaagtcacttcagtcgtgtccgactctgtgtgaccccatagatgggagcccaccaggctcccccgtcccttggattctcaaggcaagagcactggagtgggttgccatttccttcaccaatgcatgaaag

SEQ ID NO: 55904 - DNA, 851 bp, Bovine  19866880778864
atcttttaaaacctaatagctgtttctctatgatatcttgcttctggtctgatcatatttatagtttccctttactatcaccactgtctttaaaaaatgttttatgtgttatttggtctttaaaaccttgttttctttctgtaaacctcaacaactcatctaattccaatatctgggaccctagccatcctataaatttttcttcgatcaaatttatggcatgcagaaagtgagttgagtgttgaattctgaactgactgtaaataacttaagtcactacaaggagaggattggttactagggtagaagttaacggtgtccgacatccccaaccttctctctcttgcctctgcccttgaacattcctgccctcgagtcctttcagatgtttatggacagaactatgccagttgatcccagactcatttgcacaaggataacgatactttccaaagtggcctggggcttaaggagaggaattgcacgctatacaaaaagaaggaacattaaatgacattaattatgctggagcacaagtttctaggcccataattgctacaaaagaattataggcaactgcctttcaaatcttgtcatgcgattctgtggcagaaacctgccagaagaatcatttcttcaaggaaaccttctttgataatctatgggctatatactaggcatatttctgtcatattttccatgacaatatttaatacgttaaaagataaaatctgtagaaagcaaccaaatacagactgtgcttcaatctgaaagaggtgatgttttaaggactgcttttataaatatagtgtcatgattgaatggaaaaaccattatttatggacaagcga

SEQ ID NO: 55905 - DNA, 1395 bp, Bovine  19866880800471
tggttatggaaaagggtaatttgtttaataatatattcacccagctacgcataatgtgatttaatcagtacattatatgcaggcttcaaatgtaaagtagctcaaatgatcaaactgaatgggggaggggtaagatggaaattcatcttccctctttataaatcttttacctttcagaaatttctaaagacatattctgaagaccacctgccataccaaacaacagaataattgctctgctggaggtagacaaaatcgaagctatttttgagatttgacattggtttgttcatattataagttcatgtcatttgatggttatataccagtatggtcttattcagaccaaaactcttcttcccttgtatcccatattgagtctgttgtatatccttcagcactacctacaaaatatttttactgctgttaccctggtccaagccatcattatttctcacttggactcctgctatagatatctctttcatcttcctgcttctgacctcacctctcttaagcatattctagttcagaagtcaaaatgatgctatttaaattaaagtcatttcttgccattcctcttaaaaaattctccagtggctcttaatttgagagcaaataccaaagacttagaatgatctaaaatatttgctagtcatttggttcccaactaattttctgatttgaccccatattactctccacatcattcatattgatccagtcccactggcattccctcagttgagtcaacacaccaggcatctttctttagacctcagatagaatttgcatcttgataagctacctttctctcagatatccaaagcttcactacctcatatcttgtagatatttaccaaacatcatctccatcaaggcctttttgacattttctctaatggtcttagcccaaattttatgccttgatccttccctgttccactatgctttatttttcttcttcagttcagttaagtcgctcagtcatgtcccactctttgcgaccccatgaatcacagcacgccaggcctccccgtccatcaccaactcccggagttcactcagactcacgtccatcgagtcagtgatgccatccagccatctcatcctctgtcgtccccttctcctcctgaccccaatccctcccagcatcaagtcttttccaatgagtcaactcttcgcatgaggtggccaaagtactggagtttcagctttagcatcattccttccaaagaaatcccagagctgatctccttcagaatggactggttggatctccttgcagtccaagggactctcaagagtcttctccaaaagcatcaattcttcggtgctcagccttcttcacagtccaactctcacatccgtacatgaccacaggaaaaaccatag

SEQ ID NO: 55906 - DNA, 872 bp, Bovine  19866880821308
tttgtttaagagaagcctatactaccactaagattgtatgtgagctgctataagagctactatctcaaattgtgtagaggtttaataaatttttagtgaaagtgaagtctctcagttgtgtccgactctttgcgaccccatggactgtagtctaccaggctcctccgtccatgggattttccgggcaagagtactggagtgggttgctatttccttctccaggggatctttttgacccagggatcaaacccgggtttaccgcattgtagccagatgctttaccatctgagccaccagggaagtcaccaataaatttttaaacatttaaataaaggaatttatctgtcacagagtggtagaaaataaaccgaattatttagccatatcctttggagagtcattatagagcttctcatttcttgagagagcaaaccagaaattcaacatttaggttgtattcagtatgcattccttcttacttactgagcatacttcatccactctaactcccctatgtcattatgtttcatgaatctagaaaacctatataaaaccaacaccagggatgcattttgagtggcttggggaaatatttttagaatctcgtattaaaaggcacgaaatagaatagtgttactccgtgtggagtggcaaatcacttgtattttgtgcacacaaaaatgttggcataagcttggtagaatactttttagctatctgggaataagagggactcttaatacattagatagcatttgtctcccaaccccacctcgtgcctaattacactgtatagaaagttaagtaggcccgaactaagagatgggaatcacaggcagcataatcctattgtattttccccagcacggcat

SEQ ID NO: 55907 - DNA, 1402 bp, Bovine  19866880944150
taaataaattcaatacaacgaggtgaggtccttgtatagattctcagatgcacaatgagggagaaaggagagaggagccacttgcttcttattcctgtaatctttgctcttaaagctagaattggcttttgactctcatatattacaactgctaaagtaaactgactttgcacattaatctgatcacaccttcctagtttaaattatattaacagtctcccatcatataaattagaacatctgaccaagatagaagtctgtataaattctgatccttcactacctttcatttctctttacactaaaataaataccatcagttttgccatatcacaaaaatatcttaaaggctattcctctttcttctagctaactcctagttaaattttctgatgactcttttttactaatatcctcttaattttagctcaagatttgcattctctaggaattcttcctgaccctagagcatgatttcagtgcacataacttgtgctcccaaagccgcatgattataaggctaacactaaattgttgaattagttttctatgctgcatagtaaattaccacaaacttagcagtttaaaacaatttaaaacaatttcacatttatctaacatttcctgtggattaggattctgggcacagctaagttgcaggaatacaatctggatgtcagtagtcagtaagtactgggttctcactgggaagctcaatggggacttcaaatgcttacatctatacttcaggcaaaaatgataccttttaagcgatcagagagtttacattctgaacttgcttttacagtacaataaagaggttcaagtttgaaatgtagttacagggagataatgtcagtagagtagatgcagtcaacacaagtaattaattgatttgggctaaaaatgtgtacaatagtagctatgacatcagctgacttaaatctacacccaggaagcaggactgaataccttggctccagggatttcattcacagctggtgagaccacttgaaaaactttcatagagctgaatgcatcaaatcattgactataattcatgatagataccctaggttctctcctctcatgactgacccaatggatgcagccacgacacagcagtgatgccaccatttcttcaggtgaagctcatacaggcacgcagcacaaagtagtccgggaccaagcaagtaccctgtgatgcacatgtgcagtgctgtaaatgatctcagctgttacatagccattatttacagaacgtggggtaagagcatctgaacacgccatcttatctacagttgttctttctctacaggtggctgctgctgctgctaagtcgcttcagtcgtgttcgattctgtgcgaccccatagacggcagcccaccaagctccccaatc

SEQ ID NO: 55908 - DNA, 1174 bp, Bovine  19866881079047
tgatttaagcacatgagcagatgtagcagggaggagtctagactggaataagttccagatggggtgcttatgtcaataaacccctatgaagagttagtggcaagtgaaatccaaccctttgagactcaacactttcaattactctactaataaaatatagttgacaggctctaagattttgaccagcttgggatataattattattatttctaaaaaaatttcaacaaagaaaaaagcattagaaaattcaatattggccaaagaggaaagaatgcaagattattagagtttaagaaattttaaaaattaaccagtaatgtaaaataatttttaaaataactaaagaaatgtggaaactatgtgatttcactacatcaaactataacttagttggcaaaacaagcctagaaattattgtcagttaaatggtgaagattaagtgttctagattcattttagacaaataatgcacacaaataattaattttgatactaatcttttactctttgatttacttactacacctatactgtatttcagaatgaaataatataatattagtacactaatttcttcatcactagtcatttactttgttccgggagttggtgatggacagggaggcctggtgtgctgcgattcatggggttgcaaagagtcggacacgactgagcgactgaactgaactgaactgaagctttatttcaaacattttgatttatttcatacaccatggacctcagtataattaacttgtccaaaaaccatagcattgaagtatctattaactatttttactttgaaaatgatataaataagcatttttgcttttatgaaattggtgatttcagattttactttacagtactattcagtttatcaaaaaaatcaactgcaatgagttgggagaatgaatttttcatttctgactccaaatatatcacaaaacttttccagttttacagatttggctgcagcctttgaagctcacaagcacacatacattatacacacacacacacacacagacacacaccacacacatacacaaagccaaacctttcccttgggggcttgacatttttacgcagaaatgtttgcctggactgtggctttgtcttcatgtggtgcactctataatgagcatgtatgccctgagaaggatgcccatg

SEQ ID NO: 55909 - DNA, 823 bp, Bovine  19866881079799
ttcatgatactagcatccttccaaaagcatttgtagttgttaatcactaaattttgtttggctcttttgtgactctatggactgtacccctttcaggctctgcatcccttgggatttcctaggcaagaatactggagtgggttgccatttcctcctccagcagatctcccccaaaccagggatcaaatccagggtcatctgctgggcaggtggattttttaccactaggccaccatggaaacccatataagcccattgacaaattttaatggattagttcagtgctgggctaaactagaagttcctgcatttagaaagaaatggtgtctaaaattaaattaatttgtataaaaatcataaatagcatcaaaccaccagttgatgatagtatccagtgtaatatttttatagatgaaaaaaaccagaattttatgaaattgtaaaatgcaaaagtcctgaagtttaattcatgtgagagaaacttggctttcaaaataataatttgggaaatggaccttaaaagataaaaatcaaataaaaaatgatatgaactctaagttcttgactagtttcctatctttagccaatcttcattgcctatgaatttgatcagacatcttgcctatctgaatattccagtcatttcatagtgatttcttcctaattaatggaattttattgcatgccttttttattttttagacttctcttccaaatcccaacagagccactgaggaaagatgctgattccttagaggtaaaatttgtggttttaataccaggagttttaagtaaccaggaataagaattttgtcatcacaag

SEQ ID NO: 55910 - DNA, 687 bp, Bovine  19866881121693
ttttaaatcaatttgctttaggcaacatagcatagcaaaatcaactgtaaatgaaaagatattatgtggaattgttttaggttcaatttttcccccatttcagtgtagtatatacatctttaaggacagcattgctacttgtgatttaatcagttatttgaaattgaatctacttgtgatccaaatgtgaagtgcttgactgattgtccatttggccaatgatatggtcaattttggcagtgaaataaatttcaaatatcagatacacatatttctctacagttggagcactaaacagcatggcacattttctgactagtaataaagtttaagatacattcaaaactccatctggatataaagcaggaagagagtacccacatttcccagttaacacagggcgtgctcagtcactcagtcatgtgaccccatagactttgcaaccccataaactgtagcccaccaggaactactgtccatgggattcttcagataagaatactggaatagattgccatttcctcctgcaggggatctttccaacccaagcattgaatctaggtttcttggtagattcttggcagattcttggtaaattacatttattttcatgtaaacaaataaaaatagaattgcaatatataatacaatcatatagaagtatattcctgggtatgtctgttatga

SEQ ID NO: 55911 - DNA, 3188 bp, Bovine  19866881263974
tatctttattatccctgaacttttgtttactacatatacaaccctccctgtttccatttggcatatcaaaaaacaacaaacaaaaaacaatataatagagaaaaggcaaaaaaaaaaaaaaaaaaaaaaaacccaagtcaggaaacgatgataatgtgatagaaagagaccttcacgaggagttaagcagagctgaatctaaagcctgggtgctcccaattccactccagaagtctcccatcacttaataaattttggtttcaagttctcctgaaggccatggccaatgccatgcgccacacccaacagtagcagcagcagtagcttgtgtggcataaattcactaaaaaaacatttttcagagaaacacactagccagtgaaaaccccttcaaactcataattgatatcctaaaaaagaaaaagcaagtggagttgtatatcaaataaaagaaatgtactgaaaagcatctgggagacacttttgtacactgctcccacttattttttacctgtttctaaacaagggtccaagacattttgtcaagttgaagatttgttgctgttattcagttgctaagctgtgtccgcctcattgtgacccccatggagtgcagcacgccaggcttccctgtcctttgccatctcccagagcttgctcaaatgtccagtgagtcaaagatgccatccaaccatctcatcctctatcatccccttctcctcctgccctcaatcttttccagcatcagggtctttttctgatgagtcaccttttcacatcaggtggccaaattattggagctttagtttcagcatcagtcttctcaatgaatactcagggttgatttcctttaggattgactggtttgatctccttgcagtccaagggactctcaagagtcttctccagcaccacaatttaaaaacatcaaatctttggtgctcagacttctttatggtccaagacaaaaacaaaagtaaaaaacatgggcaagcaacctattcaaagagaagtttgtggccaagaagacagtgcctggaaaaagatgaacatccgggtctcagtgaggaggatgctctgtgagctgagaacacaggcagcacataacctcagggctacctatgcaccggcagcacagtatggtgagagggaatccatttcactcagtctttaggttagaggttcagcatttgggcttcttcctgccacttgcttcaactaaatcatctaatcagtaactattgctagcttcctagaatgggttaaaatatggcaggatggccaagaagattgcttaccatagtgcatataaatgttaatgtctcgttagcattaggtctagcgttagagcattaagtcactaatgaattaggatcactagcaaatcggagttaatgataatgtcaactatcatcgactgatagctactggtttccagggactatgcttaatgttttatgtaattatcccaatgaaaacactattttgcaggaaagaaaagtgagttagatagacattacacttttgcctacagccatacagatggcgattagaagacccaggataggaaccaggaagttgggctgtagagttggaactcctgactgttggactaagtagctgttcctcctcacaaaacatttactatgtgtaaggaactatgccaagcacattattgtattctatccctatatttattatcatttccattttccatgtgataaaacagaagcttcaagaagaattaaattatgcacgtcacatataactggatagtagtgaagcccagataaaatctatgtttgcttcacttgtttgtctctcgagtctagtacccatccaagcatgtgtgcaatctgccactttgcctctggttggcgagcagcaacacaaagtaacaaaaaataaaatgtaagatctcgcccctttcttgttcaaatgaggctcaagatgaatagggacttactcaagataagagaactatttaccacaaagctgtgacaaaaatttcatttatccaaaaatcatcctagaaggctatgttttctctcgaataaaatatgctttctgatcttttcccattaggatatatccattgtgggatatattcactttaaagttcagctaagttcagtagctcagtcatgtctgactgtttacgagcccatggactgcagcatgccaggcctccctgtccatcaccattttccagagtttgttcaaattcatgtccatcaaatcagtgatgccatccagccatctcctcctctgttgtccccttatcctcctgccttcaatctttcccagcatctgggtcttcttcaaagagtcagttattcgcatcaactggccagagtattggagtttcagcttcaacatcaatctttccaatgaatattcaggactgatttcctttaggatagactggttggatctccttgcagtccaagggactctcaagagtcttctccagcaccacagttcaaaaccatcaattcttcggagctcagcttaaaattatatggtgtcatttatggttatttgttatcattttgtgtttaaagagaaaatttttttctaaggagaaatttttttcacttgtattattcttttaatcctctggggtggggggggggggcgggaatagaaacagatgatggggaagacagttcattttattcttagacctaggttcagcttctacgactaatttaaaagatggagtctgtcaatttacttaattcaccatctaaccaagccagtgaattcccggaaaatgtttggacagatttatgtacacttaagttcatgccaaagatttaatgccacatcaaggtttgctccttatgagaatgtctgaaaggaactttccctaggtatatatgtgagtaaacgtgcacaagtttggatggcagtcagggggcctcagaccttaagagagctgtggagatggcaccgtccttttagggaaggatagagtgaccgtcaagataccttgtttaatatatacaataaaaataaatcaaggatggatgatatggaggctgaggacattacagttttcccaatttcctggtgtgagtcagtttatagtgtgaactcgttcgtgaagtatatctgactcttttgtaaccccgtggactgtagcctgccaagcttctctgtccatgggatttcccaggcaagaa

SEQ ID NO: 55912 - DNA, 750 bp, Bovine  19866881347540
agaaaggtttagtgtggaagacgatatttgcgctatagccagttttggaacaattaattttgctttctctgcctagttccacccagggcaccgtgaggacagacctgccgcagccaccggggaatgtgagaatacaatgttcattatgctctagacacgagacacagccctgccctatgttgtgcaccccaactgacatcctgaggaattttgatttggtccagatatgagcacagaattgtatcttcttaataaaacattcagcataaaaggctgaaatgggtggatgatgagaaacctgttcagccacggatgttacactattcttggaaacccagggaactggtccttctgaaactagctctgcactctcttcagtatcatttggtaatgtgcactgacgctgaaagatttctcccaaaatggggttgtatggctttttggttaatcgatcctttcctttctgcatgaaaggttgagaaatacaatttcacaacctgaatcattcggtctctggcatccttctggtcactaatactcacaaacaggtcccggatgtgtaaaaaactctgcctatgtttctaaaagagatcttttttcaagaataactgttggaagaactacctttgtaagatccaagtctaacctgtgacaacagatgcatgataacgcttttgtgctcttccgctgaccttgcctccccttcgtcatttccatcatcatgtgaatcgaaaaggtcagcatcacttg

SEQ ID NO: 55913 - DNA, 1197 bp, Bovine  19866881366531
tatttttatgatgggaaaacttgaccatgtcaccttgaccagtgaccgaatgtaacatcaccagccatgggacagatagtgtaacacacgcccccgacacgtgcggtcaaggcacaacatcacttccatggttggtattcctgctaaaaatgcataaaatgaatctaatcatgagaaaattatagacagacctaaattagggaacattctatgaactgtgtttatctcttcaaaaatatcaaggtcatgaaagacaacaagtgaccaaagtatgtttccagctataaggagactaaggatctataaccattaaatgcaatactattttttatataaaggaaattaatgggttgtcaaaaattgaatactatctgtagggtggaatattgaactatatcaattacactgtactaaccttgatgttcagtggttatataaaagaatgtattttgcaattaaaatatgtagggagaaagggcatgatgtctacagcttggactcaaggtttcttactttgggtatctctctctctatttttcgtactttctctcctgaaaaaactaatgtggtagaatattaacatggggagaatgtgaatgaggtatatgtgaaactttttattactacttaagattgtttcaaaataaaagtaaaatatatatatatatatatatttcatacctcttgtaacagaatctgttgtcatccctccctatattccaaagggagtttacatgtaaatgtaaaagggaaagcagtaacattatataaaaaaaaaagagagtgatttgctataaaagataagataattatgacctatggagatacaaggggtagtaatttggattcaaaagaggggagttctgaagtcagaagatctctgtttcttgtccaaggaggtgtgtacatggatgtttaatttgtggtgattatttgttctacatgtttttgctcagcatgaatttttgtttgtgttctgtaattcacatttgaaattaaataaacaacaacaaaaaagaagataaagacagcatttagcatttgatgccagcagtactgaagccatggatggttcagaagcagtcactaatactgcattcttaccgtccacattcatccagatgaatgctcacatctgaaagcaacatgagctgagcccaagagcaaatgtttagggtagcatgcaacagggctatg

SEQ ID NO: 55914 - DNA, 860 bp, Bovine  19866881366994
taaggaagcccaaggtctaatcatatctcattattagtcatgagagaaacagacgctatcatttttggaatcctcaaagtgttgtgattattatggatttgtaagattatacattaaaagaacaatacatatctttctaagttcgtgaattcataggtatgataaatatattttcatttaaaattggtagaaagaaaaaatgtgagtgtgtttaaatgttacatatcttttccaaatgaattttaagacaaaaactgttttcatgtggagatgacttatgtcaagacttgatttcaaaggctggtttgtattcaaagaaaacgttcatagcaagaattcagaattcttgctttagttataaaacaaattacactagttgttgagaaaatggtagatcatttcaaggaacctcatctgtagaattagataaattatttaaggttgcttcctaattaggcctaataacatcaataattaacaattccccaaactcacagcacaagtgctttattcttttcaaagggttttttttttttttttccttattagatactcacatcagttctctgaggtaactgagaaaatgttaccctcatttattgggtgagaaaactgaatattggagatgtctgcagatagtttatcatatgagtacagtcatcacagattacaatggaattggtgttgtattgtaggctcagtgcctatttcatagtctgtgaaacatcgtaacattttattatagtcaccctgcttctttctgagtccatacagcctataataacttgtgaaatcaagcttacaaatgtaccatgattaaatttaaacaacaacaaaaaaagaaataagaaaacagcaaa

SEQ ID NO: 55915 - DNA, 1304 bp, Bovine  19866882035304
tgggagctaccctttagtaacttaggctgctttagctgtagaggttataatagtgtccatactatatcaatcatcttgataaatatatgcatatatgaattagaggatataaaaataggtaagtgtatcttacctgtggttgtctatctatatagcaacaaaagacagaaaactacaatctaacttcgaaactagaaaatggtaagataagatgatttttggttgattataacaaacatatatatgcacataaaaaggtactatgaggcttggaagtatttttcttaaatcactcttatataaaagtacttcaagataaaggggaaataatttacctatgtttcagagcatctgaaagtgacaaattagaaaaactagcattggatatacatattcatttgtcctaataaaggtgacccaaattattacatatttttcttagcctcaatgttttttcttatgaccagcaaaataactcagctctatagctcacaattccacaacaagttaatgactcattaagattttatcaaattggtgacatgttattgaacctggcctcctcaggaggctgcctaatgattacaagaataactagcaaatgtttaatcacctactttattatcttcccattaataataaatacctggaggtaatgtatctagttacattgctagtttaagagtggcataagaagttaaagtttgcaatattggaacactaatttaatctgaacagcatcactttggtacttgggacaacagctaggtaaaagtataacaatataaatacccctatttcaaatctggaaaactcattgcaagattccattcatggaatacagaacgcttataaacagtatttctttaaataagctgttgtacaattttatctctcaagtgatttgtgaccttaggtatttgagaagatattaaaatgtctgactcctttatggcagatatatagggacctcaaacaagggtcgtccctctgaaatgataaatctacctgcttagttatctcagtcttctgattataaatgtagatagtaataagacagaattttgaataaatattcatggttctttctacagtctttgacacaataaggccatattatatttatctttcttccaacaaaaagcattcccacctataatttgtttaagcaccaaggattctgttatcaaggagcatcccagcctgttggtcaggtatccttttggtcaaacaataagtattttccagagtatcttctatgtgttaggtactagtctttaacacaaagattttcagcttttata

SEQ ID NO: 55916 - DNA, 872 bp, Bovine  19866882170773
ctctttcctggaaaatacatggatggaggagcctggtagtctacagtccatgggggtcacaaagagtcggacacgactgagcaacttcactttctttctttctagctgatctaaatttacaaatataacacagtcaggagtatgagggatatactggaaagttctaagattaaaggtccaagctataattttatataatactatacatctaaacccagagaaggcgatggcaccccactccagtactcttgcctggaaaatcccgtggatggaggaacctggtaggctgaagtccatggggttgcacagagtcagacacgactgaagcgacttagcagcagcagcagcagcatacatctaaaccaacataataaataatctaggtgcacatggggagtgccacagatagttttgaagattccatttcgtgatttttgagtttagtttcttgatgatgtaaacctcttcgggtcctagttaactgaaacattaagatggaaaatgggatagtttcatatcttaaaacacttctttgtgtgtgatttattttgtttcaagtctctcttttgattcacatgggaataaaacatcatcaaaatgaaaccaacaactgttttgctacaatttttattggcactttgtactcggagtacaggtcatttcaaactgtcaaatacttcactgattctttcctttaatttacaattttcatttttgacctgcattggaataactgctagttgcctgctgggagatgacacaattcatggattaagcacccgctaatgtctcagggattcaaagattttctttggcccagatcagttaactcttcatctttttccctgatcttaaaaatataaacagaaata

SEQ ID NO: 55917 - DNA, 1873 bp, Bovine  19866880123433
ccatttccatcattctgatattttcacattagcatttgcaaccacctaatagttgccaacaaaggtccgtctagtcaaggctatggtttttcctgtggtcatgtatgaatgtgagagttggactgtgaagaaggctgagcgccaaagaattgatgcttttgaactgtggtgttggagaagactcttgagagtcccttggactgcaaggagatccaaccagtccattctgaaggagatcagccctgagatttctttggaaggaatgatgctaaagctgaaactccagtattttggccacctcatgcgaagagttgactcattggaaaagactctgatgctggaagggattgggggcaagaggagaaggggacgacagaggatgagatggctggatggcatcactgactcgatggacgtgagtctgagtgaactccgtgagttggtgatggacagggaggcctggcgtgctgcgattcatggggttgcaaagagtcggacatgactgagcgactgatctgatctgatctgatctgatctgaatagtttattatttttaccttcctatctatcatctctctaatctaagctagctactagtttatggtataatttatggggtaatttgaatagtggctagctgtgaactaattcactaagcatttctgcaagtgttagactgtaatacacaggagtaaggattttgaatcgatcctcagatcctgaaacagtgctcagtacatagtagtcattcagtaaatatttgttgaataaatgaaacagccgaagtgagtaatcaaaaaaagtagaggatagactcatctttattttctgagcatatgaaatgcatcttacctgtcacacatatttaaaatgttttagtgttttctaggaaacactagtttcctgggagactagtgtttcccaggtaatgtgcaagtgctcttctagtgcctcttttaatacttaacagcagccatctgagttacatactatattatttccattttatagatggggaaactgaggcttaaagagattaagtgaaagtgaagttgctcagtagtgtccgactctttgcaaccccccaatggactgtagcctaccaggctcctcagtccatgggattttccaggcaagaacactggagtgggttgccatttccttttccaggggatctttccgacccagggattgaacctggtctcccgcattgtagccagacactttaccgtctgagctactgctattttaagtcaaagagcagcatctttgatcacttgatgttatctagtaatctgtgactatggtttcattccagtaaagtgatttttaaagttataattttttaaataaaaatttatgtcttatagcaataaaaataatcataattatagaataataaatggtcaaaagcatcttttcttgcttctttcctgttctgggttgaagtactaccttttggcagaaacagttatcaacaaatgaccagattataaatatcaaatatgggaacaggactctgtctgctccattatatattgttttttcagctttcaggaaaggaagaaatacagtgaaataatctcaagttaaagggtatgataaagagacctaaaatacttactaatcccttcctgtccagtaggaaaaacacttaaaaaaaaaattctgggccccttttggaggcagtttggaggcagtgtgggccccttttggagcacctaactccacagggtgctgggctcccaggagcagcctgctttggaaggcagccccgcagccagctttcagtaggcctggcatttgtctccttgtgtccatcccactgggttccatgaaaacagatgggagttgattcctaatcgacctgctg

SEQ ID NO: 55918 - DNA, 1925 bp, Bovine  19866880365107
agaaggaaatggcaacccactccagtgttcttgcctggagaatcccagggacaggggatcctggtgggctgccatctatggggtcgcacagagtcggacacgactgaagcgacttcgccagcagcagccaaattctttatttgtagtttaggcaaaagaacactaggtggggtaattctttctaatcattctgttcttttaatcattttaatcggtaccagatggatgaattactgccaattaaggagccatactctggagaagggcatggcaacccactccacaattcttgcctggagaaccccatggacagaggagcctggcaggctacagtccatggggttgcacggagtcggacacgactgaagcgacttagcatagcatatcctaaggagccatactgaacaacagtactcaaaactcttcagccttttagtgctcctcaaatgatctaacaaactcccattatatacctgaccaccatggaacttgtgtaccagagaatggcctggacttcattcccaaatccctttcacagaatcaatgggctccaggaagcacccccttctccccacccctaggtatgtctccaacatcactcaccgttgatctctgcttttgctctctgacacagatccttcaggttcatcttgccaaagatactgagagccacctcccaggcttgctctcctggataatacttgctcatcaagtcagccaaatccttccgcttggctttcttcacttcagaccagggtatcctgcaggacctgggttccagggtctcattctttagaaatgacttgaatctaattaattcctctttgtttagctcctccaaatacaatagcagcccaaaatcagaaaagaaggaggaagacgacaaatgcgtcatcttgtctatggattaatattcaagcttcagtggggaagataatccaaagaacatgggataactgggacctgtggaaaagtaagattagagaatgaaatacctctaaaaacacagactaattcaacaaacttattgaagcccactgtttcaggctcagtactaacctcctgtctactgtaatatattttctatcataaaagcatttctctaattatgtttctttcaccttccccagagtttctcccagccccatgcttatgagctgtaagaaatcaaggaaggcaatccatctctcattactcttctgcaaagcaaggacatcagaaccaatttcagaggaccatggtctggattaaatgaggcagagttcatgtatcacctggctcagaacaggctcctactaagtactggcaaatttcttcattcactctctcccctaccaacacccagcatacatctcaaactataaaatgttattattgtacctccaccattactcttaaagcatgacatgcaattggcatatgtcatctttttcctagtctggtcatgtcaactctagtcataaatccataccagctcctgataatctgtgttcccgagctcacaagctcctttcacatctattcaataccaaaattattataggtgaattcaaatgtaaagcccttccaaaagagcattctcacccatccctgacctcgactctcatgacctcattccactccagcacttcactccaatgttctcactcagactttatcatcaacaactactcaaactctgtagaatcttttaaactcttaaactaatactttctagttaactgaacagtttcatcccctcactcccatgacagttcttcagatgctattaaatcttagtcttctgagccctgtgttttccttatttatcagccatcttaagagccttattcaatttctcatttagcacaggaactccagttaatcatttaaatcttaagttcaagttccccattacctcttcaggattgcctaaagagacagag

SEQ ID NO: 55919 - DNA, 1607 bp, Bovine  19866880369572
aatgatcgatagaaatgtattacttaatttatgttcaaccaagaaggaaaacatctccctgcctggggagagggagtgataacagatgccaggagacatccagtagaggcaggagctatgccagaagatagagttgggcaggtagcccagtcctcacagtggaggataagtggaatctagaaattcaaggcttttgatcttggtgtccattcctggtgaagtcctaagctaatttagcagatggttggtgagcacctagaaaaggtgccccataattggcttattaaaaccaagtcatgggaaacttcctgtgcttctattattggtaggatcactcttgatttagcaagacgtttcatgagattgcttatgataaccagcaaagtcctttttttcccactggaaacaaagaaatctagttggtgaaagggtcagtgggggtgaggttcatgtcaactgaagagagaagtcaaggaggcaggaagatacctccaagcttgatggagtaggttagagtcagcttaaaagaaaggagtggggagcttagatgttcacttttgaagcatctggtaatactgcatttttcaaactaaaccgtgatcaatctgcctttagaggtaggtggttgtttgttggtggtgggtggtgttatttagttgctaacttgtgggtgttcctatctatcagggctaactctcagggcttccctgatagctcagttggtaaagaatccacctgcaatacaggagaccgaggttggattcctggattgggaagatccgctggacaagggataggtatcaactccaatattcttgggcgtcccttgtggctcagctggtaaagaatccgcctgcaatgcaggagacctggatttgatccctgggttgggaagatcccctggagaagggaaagtaatactacccactcgagtattttggcctggagaattccatagactgtttagtccatggggtcccaaagagatggacatgactgagcaactttcattcatttgtgagtgtttatttagaatgtagatacctgagccccacccagaatcagtatctcgggaggcaccctagaaatctatagctttaacaagcttccctaacaattatcagcacatgtatatttcagaactgttgctttaaagataagattatctgctgtaaagagtgttacctagttagagaagtatagaagttctctagttttataaacagttcaatgttttttatatgattgtggcccagaaatttctgatcttcctgtatctgcccagggtcaagcccaactctgttgccatctgctgacagccacttatgctgtaaaagcggaacttaaaaggcagatcttttgagcttaaaatgataattttgcatcaggtcaataccttatgtaaagaacagtgaggcatattgcaagaagcttaattctgtacagtttcttaagaaagttagtctccatggtgcctggattgaggacagcagcttactgctacctgtgtgataacagttctccagagttaaaaatgtgtgaataaatataaatgcacgagcttattataaattttactgttacaaaggatgtgtattatataattc

SEQ ID NO: 55920 - DNA, 1444 bp, Bovine  19866880841700
tgccttggtagggcagccttagtgtgaaggtggtgtccaccgcagacaccagaatgccactggtccatgatcctacagccagctggatgcacaccctccaagtcatggtgctagggtaatgcagagggttgcagatagccacatatcgatcacaggacatcaccgccaaaagggcacactgggtacaccccaaaaatgaggaagagtagaagctgagctgcacaacgtgtgaatgaaatcactttctttctggatagcaggtggactagggcttgaggaacaatgttggtagagaaacagaggtcagccagagataaattgcaaagaaaaaaatacatgggtgtgtgaagctgagagtcaacctgaataaggaacatgagaagcagatttccaagcacagtgaccaggtagacacctaggaataaggtgaaaagcagtttctgggtgtgttggtcatcagagagtcccagaaggaggaattctgtcacctgcgtttgattggtctgtctcatggttttatcagtgtgaagtcactatacagtatatataggtgggtatagcctatacgattatacaattcagaactggaaggcttagaaattgccccaagtcataccaactattttaagaattccctttattaggctgttagaagatgactatactgcttttttggaatgttttcaatgttgtaaaatttaatacttcataagaaggtacattcatttctagtgtcatctgacaagcatatcatagatcaaaagaatcatcttcatcatcttctctatctgaacatcatacttgtaatgataaaaacaataggttgaattcacctgtaaagtcatgaaatttaatttctctttattatcagcaaaaatatgtgagtcttattttgctcttgtgacacctcccccatctcatgatggtgtagatattttttttagtttttcaaacactcaaatcttcctattgtttcttccctgaaaaacaaaacaaaacaaaacagtcacccaccaaggtataagtaaaagaaccaaagtaccttgtagaattgatttttttttttcttggacaaaatagcctattttgaaagagctaggaaaccaaggggtaactctgcacggtgtgctataatctttctgacagtcctgtcccccacttcaactggagctcctgaatataaatcttagccatcagtgaactttcaaaacaccattataacataatttccattttaagccagcaccctgtctggttttgttcagactaagcagcactaatctaccacttccagcccatcatctctcgcttattattgcattatcgtctgtcttgtattatctgtctactcttctcagagactaaaaactcctttgataactgtgtctatgttttttcatttttgtgttctttaaaagacatagcatcagactgtattcaataa

SEQ ID NO: 55921 - DNA, 1467 bp, Bovine  19866880889578
taagattccctttaagaacctgggaagaaggttgcacactgagttttaaattattttttttaaatgatggtttgcattagagatatgtaaagtcacaaaacagagacagaataagctcttatcaagacaggatggggaacacgtgtacacccgtggtggatgcatgttgatgtatggcaaaaccaatacaatattgtaaagtaaaaaaaaaaaataataataataaaaaaaaagttgaaaaaaaagattggaacaaaactatattattaaatatactaacacatacagggtaaaaacatgacaattttaaagagattaattggcaaagtaaattcagcaaagggaaagtcagacattggtagtgttttatttcatggtcagcagagagggtgtcctggcccagtatgatgaccagccaggtgctatagcaggtatgaccatgtgcacttggcaattttcagggctctatgataccaggcattaagatctccaattggctgctctttttctaaactgcaggctcactaagcagccttctagctataattaacttttccatttccattgatctccagaaaaggcatttacattatctacctaatggttacacgtttttaaaaaaaagttgtggtacaattaatgtacaatattatgtaagtttcaggtataaaacacagtggttcacgacatttgtagctactataaaaatataggttatattccctatataatagtgtgttgtacaatatatccttatagcctgtttgttttatataatttgtaccttttaatcccttaccctacttgccccttcccttcttccctctcccgactgatgatcactataaactgactttaaattaattaatcagcattttatattttagtcattggcctctataagccttcttaaagggagtccctttgagaaagagatctagctctcaccacaccgacaatcatgtttccaagctgatagtttgagagcctggcttgggttttgaattttccaaggaaatgcctatccaaagggatctatctgaatagaaaaccaaattcccaatgggataccaagttttactctaagtgattctgtgttaaacctgcagcaatttacatggaaagcctacctctacctgacactgaagagctgcctctctccttccctgctggagaagacagaagaaagaatcagtgaacttgaagaaagaacaataaaatcaaattggaaaaaaaagaaaaaataaactaaaagacaaaacaaaccagaaacctctggtgtccccagaagagaggagaaagaaggagtaactgaaaaaagtaccaaagaagtaatagatatcttcctaaattgagccattaacttacagaattaagaagctgagtaaatctcatacaagataaacccctaaactcacccaaacttaaataaataaacttctgaaaatcaaaaataagggaaaatca

SEQ ID NO: 55922 - DNA, 902 bp, Bovine  19866880897426
tactaagaaaaattaattcaaggacagatggaatatctgaaggataatagaacatagaagacttaaattaagcactatttacttaatatatgcctggagaatcccagggacaggggagccttgtgggctgctgtctttggggtcacacacgactgaagcgacttagcagcataccgtgtccaaagcactaagggggacacaaagaaatgtgaagtgtggcttctatactaataacatgtaatacaccgatttatatatatgaaattcagattttcatttttgagaataatttaccttctagccccattaatttttcatcctctctgcatatctaaatttcttctaggtatacaagccaccaaataggtatcattttcctaaggaaaaccaaactcacccaagcctctgaatattgcagtttggatgtctcaaagcctcaaacagaaatttcactccatcatcccgcaagtcattgttcccgaggtccaggctctgcaagtttgggttgttcaaaatagcagaagccagatccaggcagcatgcactagtgagaacacagcccatcaatctgtgagaaataaaaaagagaagtgagattttcagttgtgaggctttattagtttattcctggaaggcacgcccaggggagcctttttttccctaagccttttctatctataacctaggatgcacacaggaaggtctaatgttataccactaaaaacagatgggattgcttagtaagcaagaaaaaaccaacaggtaaaactgctttctcccacaaataggctattttctagtaagcttcccaagtcaagggtataaacacttatttctacctctgccaaaaaaaaaaaaaggatcggatataacttccctgaggaatccacagatctctatgt

SEQ ID NO: 55923 - DNA, 1637 bp, Bovine  19866880920260
tgagtggttagcccacctgctctaaacaagcaagaggactctgaaggctgtatcactggcattgatactagcttgctaagaccccacttttgccagaagtttaattttgaacagtcatcccaagtttcctggatgcagctttccatccagcatctactatgggaaagaccacccaacatatctttcctcctactttcttcacagggctgcatgctttggcatgatcctgacttcatggctctctagtcaaatggaagtgtgagtgccccttttttctcccagggggaaacatctgccctccctgagtgcggccatactgtgaaaagagagattacagagtactgctttatagccgcttcttcagtagctcatcaccaggcaaaatgtcacagcagctggtgctcatcaattcaccctctgtgatttcaaataccaattaaaactgtgaactcctaattgcctcatttctagccacattttagagtaattaataagtaattgagtaatgggttaataatagctttaatcatttttctaatgatcagttcctacatatagtcacctttatgacccatggggaatgctgcactcaggtcatatctggctaatagcccccaagtcgatcctgcaaggaaatgatttcttaccagggaaatttgctttcattcccccaaagcagttaaaaaaaaattcaactttcacctgtgaattgtcagacatcttaaaaaattttttttccttctcttacatgtcctgtccctttactctcattcagtttattctcccactgaaactcagagggaggtgtcaacatccaggagtgatttctaattgcagtgaagccttatcgcatgcccactcctgaacacaggcttccttccttggtaaaaaacatttacctggacttccagttctgtttcatcataattacagcataaatcagctgttagatatgaagggagttattaacctttgggttttgagtcaagggaaaggattgccactgcaaaagtactcggaccatcaggaaagctgtaaacaagaagtacagagtcataaacagatctcccaaagaggatgaaacttgccaggctcatgatgaccccagcagttaaggactaggatgaccaggtcatttagaaatgggtcagaaaaacactgggtagataaaatgggtgaagggggtcaaaacgtatgaacttccaagtggtaaaataaatgagtcagaaggatgtattttatagcataattaataatactgtattgcatatttgaaaattgctaagagaacagatcttaaaagtcctcaacataagaaaaaaaatttttaactatgtatggtgacagatgttaactagatattgtggtgatcattttgcagtgtatacaaatactgagtaattatgatgtgcacctaaaactaatatagtgatatatgttagctgtgcttcaatttaaaaaagccataaaatatggcaacacacgctaagtcacttcagtcgtgtccgactctgtgaccctacggaccgtactccaccaggctcctctgtccagggattctccaggcaagaatactggagtttccatgccctactccaaaggatcttcccaacccaggaatcaaacccgcatctctg

SEQ ID NO: 55924 - DNA, 1640 bp, Bovine  19866881144910
aacggcaacccagtccaatattcccgcctggagaatcccagggagggggaacctgttcagctgccgtctatggggttgcacagagtcagagacgactgaagtgacttagcagcagtctacccacatcccaggcacaggtttgtgaaagacccagaactaatgaggttttaactttgttctctcttgctcttcattcaaggcacaattcaatcacgaagacaactcaacctgtcaaacccagacttcaatatccaacaacttcaaaaacaggaacagttgactggcattggtcgaattaaaccagagttatataagcagaggtcattggataacgatgacgggagaaggagtaacagtaaatcctgtgggaaactgaacttcattttaaaatatgactgtgacttagagcagctcatagtgaagatccactaaagctgtcaacttgcccgccaaggacttttctgggacttcagatccttacgtcaagatctatttgcttcctgatcggaagacaaaacaccaggactaaagttcacagaaagaccctgaacccggtgtttgatgaggtgtttttatttccagttccctacaatgaccttgcagccaggaagcttcacttctctgtctatgactttgacaggttctctcgccatgacttaattggccaagtggtggtggatcacttcttagacttggctgattttcccagggagtgcatcctgtggaaggatatcgaatatgtcaccaacgtgagtctaacatttcttcatttgggatgagggtggggaggggggagcttcttggtcagcatgcaaacagattacttataccttattttatttgaagggtagagtacaaaatttatctcactgtacttaaaactattgcttcaaatctccttcagttaagtttagtcactcagtcgtgtccagttctttgcgaccccgttgactgcagcgtgccagacttccctgtccttcaccagctcctggagctcaaaatcatgtccattgagtcggtgatgccatctaaccatcccatcctctgttgtccccttcttcctcctgccttcaatctttcccagcatcagagccttttctaatgagtcagttctcatcaggtggccaaagtattggagtttcagcttcagcatcagtccttccgatgagtattcaggactgatttcctttatgattgactggattgatctccttgcagtccaagggactcttaggagtcttctccaacaccacagttcaaaagcatcaattcttttgtgctcagctttctttatgatccaactctcacatccatacacaactactggaaacaccatagctttgactagatggacctttgttgacgaagtaatgtctctgctttataaatatgctgtctaggttggtcataacttttcttccaaggagtgtcttttaatttcacacctgcagtcaccatctgcagtgattttggagcccaagaaaataaagtctgtcactctttccattgtttccccatctatttgccatgaagggatgggaccagatgccatgatcttagttttttgaatattgagctttaagccaactttttcactctcctctttcactttcatcaagaggctctttagttcttctttg

SEQ ID NO: 55925 - DNA, 707 bp, Bovine  19866881192677
aaatgccattggtagaagcatccattgatcctaactccatgctgctgctttagaggccatttgtgtgtggattactggaggcttctctgggaggaatctaatccccataggtttggtttgagaggatccactctgcagctgataaagattaaaattgcagctcttttccattacattggttttttgatcttttaatttttgtattattttacacttcagtggctcaatcacagctgtctttcccagtgtctcagtatgtgggaactgggaagttaaattggacagattcacaaaacaaaggttttatagcatatgctagtacagtaaaaggtgatgttttaaggtatgggcagtcatcagatttaatccagggaagcacatggagaggagtaggtattaaatagtgcccttacaataatgcgacttagagcacagtggaatgtcagagaagggtcagaattggctgttatactgtttgattcttttaaagaaaatttaaaaaaattattgatgtatagttgattaacaatattgtcttagtttctggtgtacagcaaagggattcagttatatatgtgtgtgtgtatgtgtgtacacgtatatatacacacccacatgggcttccctggtggctcagtggtaaagaatccacctgtgatgcaggagacacaggagaccccggtttaatccctgggtgaggaagatcc

SEQ ID NO: 55926 - DNA, 1134 bp, Bovine  19866881309159
tatatatatatttctgaaaatatatatttcagaatgctgcctctagattttgttattcattgaaatgttaaggaaatttcctcccttgcttattttctaagaagactttcttaaggaatagatattaaattttgttgaataattttatagcatctgcaggaacaattatgttgcttttctcctctgacctattactaatggacaatattaataaatttactattaataagtgaatcttatattctcagattaaaaactacatactattttgggaatattatgtttctaataaagtagtgtattgttttcattggtttatttaagattttttacatttatctctgaagtgtcattgtggtaatggtgacagggacccacgttccctatattctagggtcctcttaccaggaatcgtttttttaatgggattggctagcatgttatgatgtaagttctataagagcagagagccttgttttgttttttgttttgttttattttaattgaaatgtagttgatctacaatgttgtgttaattttgctgtacaggaaaatgattcagttgtacatatatatgtaatcttttttactttctttttcattatggtttatcacaggatattgaatatagttccctgtatatacagtaggagcttgctgcttatccattctgtatttactagtttgcacctgcaaaccccagattcccactccttccctttcccacccacctccccttggcccccacaagtctgttctctctgtctgtgagtctgtttctgtttcatagatgagttcatttgtgtcatattttagattccacataggagtgatatcatatggtatttgcctttctctttttgacttgcttcacttaatacggttatctctatttatatcaatgttgctgcaaatggtattatttcattcttttttatggctgagcagtattccattgcttatatgtggcacatcttctttatccattcatccattgatggacttttaggttgtttccatatcttggctattgtgaatggttttgctatgaacatgagggtgcatgtatgtctttgaattatacttttgccagttatatgcccaggagtgggattgctgcatcatatggtaatc

SEQ ID NO: 55927 - DNA, 1643 bp, Bovine  19866881346256
taagtgctattattatctctatcttaaaagtaaggaggctgaagcctggagagattaagtcacttgcccaaagtgacacagccagtaagcaggagaaatggcactcaaacccaggcagtctagaacctagagtttgctttgcaaactgcaaaaccacatcatctgactgaccaggccctgttgcaggcagattctagaaatagacttgtaatgtgaatattatataaaatcacagattaaaaatagactagaacactgcaattatgtatttgaagactgattaatttttaggattataacatgacaaatataaggatggaaaacattgagagtaccttgtaacagcctatggctataataaaaaaaagtactgatcagagcaaggaggcttcagtgctttctgtctctattcttttatgctatcaacttgatatctctggatacattgctccaccatctgtctacatatgccatcagctatgttgaatcctggaaactgaattccctaaaagtatgcagaaagagacttattaatgaggagaccactgtatggggttggaagggggaggagtgcaaggacagtggctcttctgcagctgttggcaggtgaaagccctggactgctaggcattctcatttaaggccccctctgtactctgattagtggctttccttgggatctactggatttttgaccaatattcctatgtaactttgtgttttcatgggatgtcattgggaggggaggaaagacaagtcaggggttgtctcactaggctccaccaaagcctttgtctcttctaaaacatatttatatacatatcttaagaagccagtggaatcatggaaatggatggtttgttataatatcccatggcttactgctctgtatgatgatgcatccttgaacatatcgttgtatttcctaactctgacttgattaaacatttgattccatgcagaatcccaaatcaatctttgcccaaacaatcaactatttgtgacacacatttgattatttttctaactgaattaattatctgtcgttgcataacaaattaccctccaaactcaccaacttacaacacacatttagtttttcacagtctctatggttcaggaatccaggtattagttaggttctggcataagacttctcatgaagttgtagtcaagccataaatcagggttacgttctcatctgaaagcttaacggaagaatctccttccaagcacactcatgttgctgtttgcacacttcagttccttgtaagctgttgaactgagagccttagtttcttgttgactattggctggagacctccctcaattccttgccaggtgggtctccccactgggcagtttacaacactgcagcttgcctgcctcaggatgagtaacagagaatgcctaaaatgaaatccacagtcctttcataacctaatcttggatgtgacattccatcaccttctagctgcattttattcactagaagttaaccactaagttaagcccacaatcaaggggagggatgatacaaggaagtggggtcaccggggccctcctagaggctgttcactgtacctattaggacagatgagaatcatttgtagtcaagtacttgtaaactgatgctctccaaa

SEQ ID NO: 55928 - DNA, 892 bp, Bovine  19866881370160
attgtaggcatcactttgaactttgcaacaagtgtttagttctatgctctctacttctttgcatcaaaacacaaagatatttgcttaccatttaattttccctgagatctagtcacatgattgatacagttgcactaatttctattctgggaaggatgtgtggcagagaaataagttaagtctaaaggacccaaactgaactatatcctggagactaagaacctatgaagtaataacttccactaaatgggtaacaattccaaaagtatctatcttaacatagcttgtgttctcaaatcttgtttttatatcagctgttttgacaacagactatatttccctttagaagcaattctatatcagtttgatgtaaggaattgttaggtgatacagactaacttggcccagtgcattcattcattaaaccacgatatgctgtgaatctatgttctagggacgactatggcactagagatgaaacacggctatagtttggtccctcctatctgagggcctctgctttgggtcttctatctgtatcccctttactaagcatgcgcttggccaataatgctcagaaatcaggtaattgaatattgcaagagtgttgaatgctcaaggaaaacaatgctatctctgtgtagcaagccggcttgcctgttaatagagagactacgctgagcaaaatccaatgaggtttaaaaatgcagtgtgtcctgggtatgtggcaggaaaaatagctagaaaagtgacttggggtcggataaggaagccataaatcaagcagagatgagattgttcttattaatgttttatttggtcatttattatttcaatggtgaattgaaatctttcatcatattgacccatctagaaccatccagaaaactaa

SEQ ID NO: 55929 - DNA, 2712 bp, Bovine  19866881576446
tttgtattaaaattatactatatccttagaatatatagttgcagaactttgagaaaaatgtaatcttttcatatcagtatcttagaaatacaattctgataaaatgaaaaaagaattgcaaataggtaaacaaaataggaaactattaacaataacctaagtaaaaataataattactgaactaaagaattagcagggataatgaatattaaagagagaagtacaagaactgatgtctctgcagatgtggtagagagagagaggaggaattcaggtaattccttggtttctaggaggtgaatgtattgagtttaagatgcctaagcaattatcttgaggaggatttcaagtggctggttgggatgcacagctatagcgcacaggatatttacaaagtgaaaaacacagctgttatttgcctgaatatacataaaacttgaaactgtaattgcataggtatgactgcccaggaacatcttgcaaagaaagcagttcaagaaaggccatattcttgggatacaaaaaataatatgagagggcagagaaagaagacccttcttccttcaaaatagaggtcggtgctacagaagaaccaaaatatggtgtaattacagaaaccaagtgtgagagcttcaaaaattgaataaaacagaaaatgtgctatagacaagtgcaataagataacgactagaaaataactggtgttaaactttcttctggcttctagttttctttaacagtttctgttcccaaattgggtagaattattctcagtgaattattaaaaagtaaaatgcatacttataagtgatgattatcctatgccttaaattcacaaaataatatataacagacttatttctgctataagcatttgactattttgtttttatatgtttataccatacaatacacacttgtttaagaatttatgtataaatttactccttttttttttttttttttttactaggaagcatcttgggtctgtacccactacagtattttgcctattgtgatttcttatcaaatatttattggatttatttaattaaatctaagacataatttggagcacctaaaagataatcaacagatgtttactgaatgaaaaaaatcagtgaattaattagcttaacattttaatccacagagactgaatacttcactttcctcctttcaaagacatagtgctgtaccatatagccggggaacactgctgaagctagaagcaaagtggcatgattgaatgaagtgataaacgttaacaatcactctgtgctagtcactgggacaagcatgttacaaacacctctccatctactagaatctgcacctttattcattctcttctttctctcacatagatgagtatttcctatgcttatctaaggccatctgctccccttacagaaaaagcacctatacatgctacatacagttcttctctttctattcttcctcaaactcagactctgcctctaccactccactaaaattactctttccaagatcaataatgacttcattgttgctaaatgcagtaatacaaagtttaattccatattttaaatccatttgatccgaatttaactctacatcctcatgttacttgactgacctcagcagtattggacacttggcttccaatgctactttggtctcctggtttctctccagcactactgactactgcttaacatcctatgttgattcttcctccagtcttaacttcataatgctggagtacttcagggctcagaccagactgcttttctctatttacactctctcccttggtgacttgtctcatggctttaaatatcatctataaaaggacaactcctaaatttatgtctctcccttgaactccagactcatatatccaattgctttctcaacatctacacttgactgttgaataagcacctcaaatttattgtgtctaaaactgagcttctgcctttgcccagacacattctgcttcactgtactctttctagccattccagctaatggcctctttctcattacttaagccaaaaacttctcagtcatcatttatcctccttttccctctcatatttcacatctttcaccaagaagtcctttgagctctgtgttaaagatgtatctggactttgaccacttctctccacattcacttttataatcctctctcatatggatgagttttctaactgttctcactgcttctacctttgttcccccattgttcattctcaacttaatagccaatgtatacctattaaaatttagatgagatcatgtcaccctccacacaaaaaatctccaatggtctttcatctcattcaaattaaagtgaagagccttacaagggctaacatcacccacatgatctaggccttggctagctctctaatttcatctcctaccttccctcctatccactcctttccagccacaccagtttccttgccattcctggaatatgcttcgggttccttgaccttaagagcattgtaaaggctggttcccatacctggcgcattctccctgcaggtgtttgtctggtttagcccagtgcatttcccagactctgctgaaacattcctttctccaccttacaactcacagtctctctcaaccttctctgtgtctccacagcacttctagtgtactgcaatcattactgttcactagaaatgcaagtttctttagggcagggag

SEQ ID NO: 55930 - DNA, 815 bp, Bovine  19866881949451
agttcagagaaggctttccataaaacgggagtaagccaagtcctacttataacctctttctcttacacaaaggcagaacccaggtcacttggcatgtggtcaagacttcacccaggaggaagggaaagccagggcttctgcatatggcctccaagctgcatagggcataacttgcccaattgtacatggaggccctgggaaagactggcatgttccaaggcctctcaggccagctttgccaccatttatattttgtgaccctgggtaagtcattgctcctgtatggtcttcctcatctgtcataaagggtctgctgggcaaagtccttatatcctgtggttcttgtggacttgccaaatgaccttgagctcacagcaatgtttctctagagctaaagccattgtaataattcctattagtgaccagaagtcaattgttgctctctacctggaagctatgttttagggccattcctggttttcattcttggagctgacatgaggttgtcttagctcatggaaaaacattgcctcctaatgcaaactgccctgggtcgggaatatccccaggagtagggcatggcaactcactctaatactcttgccaggagaatcccacggacagaggagcctggagggctacagtccatagggtcataaaaagtcagacacaactgaagtgacttatcatgtattcagtgcaaactgcaaggattattaaggggtattaacttgggtctgcagggaccataccattattaaggtactgagccaggtaaacagatcactccaaggcctaactctaagaagtccatc

SEQ ID NO: 55931 - DNA, 3549 bp, Bovine  19866880144006
cctccctgtcctaccactcccggagttacccagactcgtgtccatcaagtcggtgatgccatccagccatctcatcctctgtcgtccccttctcctcctgcccccaatccctcccagcatcagggtcttttccaatgagtcaactcttcacatgaggtggccaaagtactggagtttcagctttagcatcagtccttccaatgaacacccaggactgatctccttgcagtccaagggactctcaagaatcttctccacaccacagtgcaaaagcatcagttcctcagcgctcagctttcttcactgtccaactctcacatccatacatgaccactggaaaaaccacagccttgactagacggacctttgttggcaaagtaatgtctctgcttttgaatatgccatctaggttggtcataactttccttccaaggagtaagcgtcttttaatttcatggctgcagtcaccatctgcagtgattttggagcccaaaaaataaagtctgacactatttccactgttttccccatctatttgccatgaagtgatgggaccagatgccatgatcttacttttctgaaggttgagctttaagccaactttttcactctcctctttcactttcatcaagaggctttttagttcctcttcactttctgccacaagggtggtgccatctgcatatctgagttacatttacacaatactgaagtctattaagtgtgcaatagcattatgtctaaaaaaacaaatatatgcaccttaattaaaagtatttaattgcaggcttccctcatggctcagtggtaaagaatccaccagtcagtgcaggagacacaggtttgcctcctgatccaggaagttcccatatgctgtggagcaaccaagcctgtgtgcataactattgagcctgtgctctagagcccgggaggcaaaattctgagtgcatgtgctgcagctactgaagtctacatgccctggagcctgtgctctgcctcagcagaagccacctcaatgagcagcctgccaagcacagagaagagtagtccctgctgccacaactggagaaaagctcacacagcaatgaaacccagcagagccataaataaataagtaaaatttaagaaaatatttaaatagttttatataaaatattaaaaatattttattgctacaaaatgctgtcacctgagctttcagtgagtcgtaatctttttgctggtggagagtttgaaatactgtaagaattacaatactaactgcaattagtatctacatattaattacagctattacacagatgtgtttttccagagcttacagcctttttcccaggctctcttctctgcctgggagtccttccatatttccccacttggagagctcctaaacgctcagggccctttaacaagcaaactccaaggcacatggtgaacaaacgctgttggaataatggtgtcaacagacttgctcaatgcagggttgccacaaacctccagtttgtaaaaaatgcaatatctgggaagcacaataaagtaaggtatgcccgtatgtgacaggcatgatgctaagagtttaaatacattatagcatttcaccgtcataactacataatgaagacagtattcatatcgagttttatagatggggaagcagaatcaacaaggtcagctagttaggcctactttccacagtaagctgggggcaggcccaggttcccttccaggtctttgccctacaccctggagggcagtgcaccactcaaactgctcttgtgcaagcctggcatccatctctcaggcaaagtcaggacttgggagcatgacccaagaatggcaaaaaaaaaaaatacagactctgcagacaaatgtaatactgacattgttacccctcatgcagtcattccctatttgctagaaacacaggacagtttagctaaggtacactgtagctgagaccttgatcaatatattgatattgtgtaacattaaaggcaaaaccgatatgtggaaaggagttaaccgaaagcctcaaacctgacactggcatcagaacaccaatactgagcacattgcgagtgtactgacgggatcactacaaagaactttatttttgctctgcaaaagcaggtgtactttaagatgctgacacttattacataggcactggaaatgtgtctggagttctccttagcccagagaccaagttctagaacccaaggctctgtgctgctagggaaagatgagcatccatgagcaggccaaccagcctctctggccaccagttactcttctctgcgctgccggtggctcacgtgggactcctccttaatagtcttctagtgccacatgccggagaaggcaatggcaccccactccagttttcttgcttggaaaatcccatggatggaggagcctggtaggccgaagtccatggggtcgctgagggtcggacacgactgagaggcttcactttcacttttcactttcatgcattggagaaggaaatggcaacccactccagtgttcttgcctggagaatcccagggacaggagagcctggtgggctgccatctatggggtcgcatagagtcggacacgactgaagccacttggcagcagcagcagcagcagtagtgtgcagctggggaggagggtttcgtatgtgcttttatatccctcttcgaggacccacacctgtcccagttgctgagttccaccaccgagttcctattctgggaacacttgagcacatcagaaaaatgagtggttccattctggctcacatcacatcactgatgcaccccttaaagcatgtccctgagttcattgcagaaaattgttcctccttgtaccttccacagcaaggttagaactgttcccctcaggggaaaaaacagtgagaagcaccaacttaataacctcctctgacccctactccacctttaccataagtagatccaaatccttctagaaaatcagaaagacagatccccgtgtatcagcggtataaatagaaccgctctgcagactctggtggacggtgactctccaaggtggattgggaatcagctggccttggctgggcatcaccctctaaatataacgatgagtttgttcagcctttgcagaagggaaaggttttgcccatcctagagcgcgatgcccttgtcctctttacagggaggagagacggttgaggcttcatctagtaagagcacctctcagttcccaccctagggctatgacacttgcctttcctccccaggactgggaagtcggtgagccccgccaaggatgcgggagtagggtgctcagctcggcctgccatactccagagccggccagttagtcactcaacttcactcccttcatgagctcccgagcccacaacacgtccccgagacgggcagctctgggtgtcctggctcagtgccagaggctgcgagagccgctgcggggcctgtgccgggagcccagcgcctcctccccggactctccacagttgtcctcgcgacagctgcgcgcccgccggccgccggtgaccct

SEQ ID NO: 55932 - DNA, 1619 bp, Bovine  19866880554205
cctcagggcctttgcacatgttctttcctctgcctgaaatgctcttgtcccagacatctcccctgcttatacctccaagaaccttccatgtttctgcttatatgtcacctcactttcaggccctcactttcagatataaaaagtgattcctccccctccccagtccttcacacagctcctactttgccccctgccacaactgcagcatttaccctgtgcatgaattattagtattaatatagtgtctgctgtcctctaggctgtaaactctgtaaaggaaggggatgtattcatcttatttcctgttctatcctcatacctagaatagtagtggtcacatagcttcaataattaaaaagctgttgaatgaggaatgactggaataaaactcagaagctctttattaatttggattaatttaatataatgaacttaattttaaacttgttcatttatgggaaatttaaaagtcagtgttttatatgccaccatgtaattatggaaagattgcaagaaagccatttgaaagtatcatctaatactatttattgaggacttaagcatcagatgtagtgctaagtgctttacatgtattataaagcccaatcctcacaacaaactcataaggtaggtatcatcgcattttgcaggtcaggaattaaaggtccaaatggatatatattttgccccagttctcactgccagtatgtagcaatgttgggatttttcttgaaagccaaactaaactagacatgtcttccttttatctataatctgggtaagaggaaaaaatgcagtataaaagccatcaaaaacacagaagcatgacttgaaaaggcattaaattgtttcaagtaggggaacctaagaaaacaatgctccatgtggggggctgtctgtctcttctcttgacccccacaacacctgcccaggtagctcttgtcaccctcctttgcagccaaggatgtgccaatccaggtttgcttgggcaacaccatgttgaatgtatggagatgtgagagggagagagtttatgggagcacttctgattgtgagacagaataggcactgaagactgagctcaaggctttggactttccctaaaagcacgcagacttgttgacctgaccaggatatacggcaaatgctctatatgagtacacatggacagtgttcagttgaggatggagctgtgggtacaattcagtgacgtggtcattccccaccttcatcttttaatttgacacttacaagtgaatcttccattagttctaatggtagtgcttttctgcttatttctgtatttaataacacttatattcagggattattcatgaattcttctaattttttttttcagaagaagattttctggttcctctttttattatattttctgtatcagattaactatgtgcctgaactacagaacttttttttctttccatttttctgattaaaataccatggaattatacttattctatttttctatttcttttctgtgtgtgcgtgtgtgtgtgtgtgtgtgtgttgttggttaggggcttccctggtggctctagcgataaagaacctgcctgccaatgcaggagacataagaaatacaggttccatcc

SEQ ID NO: 55933 - DNA, 2188 bp, Bovine  19866880593318
cttttgtgtaattaagttttattaaagtataaaggagatagagaaagcttctgacataggcatcagaagggggcagaaagagtacccgcttgctagtgttaacaatgaagttatataatccaaagaatgtctggaggttgtaaagacctcatcagacctactcccataatgtacattttaagataacactgtcctcaggcaggatacatccttgtaaagaccaggtctactcccataatttacattttaagataacagaaggcttaatccagagactgtccttgggcaggatacattattgttatataatcctaagggcctggcgtgctgcaattcatggggtcgcaaagagtcaggacacgactgagagactgatctgatgtgatctgaatcctaaggaatgtggagaaataaaaaaagtttgtccttccttcctccttgagaattccagacccctctctccttgggaacccctagacttcttatcaacctgcctaggaactgactttctcaagggtgagctgcagattttgaggagaaagttctcctcctattaggatgtggggggtccttggaggaaggatccaaatctagattgaggcaaagaaagtgatattaaagatggtcttaggagccagtgggcatgactgctcggggtctgataggaagatagagttgcaggggtggaaaaagagtttctatcaccccagggtcctgcctctctgagcacatggtctgggaatgtggctgacctgacataaagtgccagtggcccttttggagctcccattggaatgccggtgctgggagggtgagagccctgctggcttgttttctgttgtgtccccagagcccagcccagagactggcacctggtgagtccttctcaaattattgaataaatgagagtattacttgaggaaatagtgtaatgccacatgatcacaaattcagttttgtttttttttttaatttaaggacttgcattttataatcacaatagcatgtagatttatctggaatatttttgggtgaacatgtgtaggctagttccagaggccaccctacttacaaaaggttcggtctcaaaggctgtctgtaggtctctttgtccaaaatgggattacacaagcaacagtggtggtggagatgatgcatttttgctgatattaacatgtaacaaatttggtgttcttaccacataccagcattcacgctggtgctttatatgtgttacttcctccaacccaacaacagtcagaaggcgctgtaataacacccattttacagctaagaaaactgaagctcggggaggtaagtggtgcagccacttatctgctggtaagcccacagggtcagaattggaatagcagcagctagtctggagacttaatcactacacactgctttcgtttatcatttcagtttctgaactgaaaagctgtgatggaatatttcccattttgatttgtttattggccatgcttggtgctcagatggggcctgtgtgtagatacagtttgtcctagcttaacccccaaaacacagtccttgtggctgtttattcattttcaatccaacatgtgaagcaaacttatctacaagtccattagaatggaacttcccccaacctgggcttcaggacagcatttagggtcaagtttcctaattagagctcctcttccaaatttctctgctcaaactagagctcagaatgtaagctcccacacctggggcctagggtacccttctctgtgggtctatatagaacccccataataaatagtttccaaatgcacaacaggtcaagcacattggaagtttatttcaccttcaaatagttaagcccagtggtggttttggttgttagggggttctgctcctatagttattcagggattctgactcctttaagtttgtggttccaccactatctaggatgtgatcactgtctatacttggaagaagaggatcaagaaaagggaggagtaactgccatatcctaaaagccactcagattcccacggattagaatttgttcagttcagttcagttcagttcagttgctcagttgtgtctgacgctttgcgactccatgaatcgcagcatgccaggcctccctgtccatcaccaattcctggagttcactcagactcacgtccatcgagtcagtgatgccatccagcca

SEQ ID NO: 55934 - DNA, 1400 bp, Bovine  19866880678861
cttaggacattggttttaaatgctctaacagaacgtgttaaatgagttaacagaagactgaattttacccattaacaaggtgacaccattccctgagagaggctgacagagtgaaacagaacacgtgaccaaggccccccagtcagcccatacccagagcagaccctggccctgctctgccctggccatggcccaggaggcctctcttcctacaaagcccaaggacatctgtgggtgtgagcataccacggcccccgctcgccaccgcagcctcccatcagggcacagagaggtcggtgtgcactgagggctgggctaggctggcggcccccgcccctcctcagacgatcctaaccagcccccacctcaggaacaagcaaacgagaagccaacaggtctacggcaactgggacagtgctgccctgatgagatcacgttagggatggactctggtctgctgacctctgacctggggacagcagggagtgaattctgcatgaagacactggccgggtttttggtcctgattagctggcctgcaaggctgacatccagctaaaacactgcaatgacatcatgggctgagccgctgtccaatcaggactcagggccccacaatggccaggaccacagagacctgggggacaacatccgccctcacggaatttcatgaggttccctataaattaagtcacctgcaattttaaaaggttggcaggtttaatctttcttaagtccactggtggtgctgaagatctgatactggagagcctacaaatagggatgaagctgtctacgttgacttctggggccaagacagaaagactcaatcagagaagagtgattcaaaactataaactagaacgacctccaaaataagtaaagaactaaagcatgaaacaatacatctagaagcctgctatttgtgtaaaaagcagggaaacaattgtgagtaactgctcacatgcacaaagggagacactagaaatgaacaccagggagggcttctaccagctcctggtgtagtaccctctgaaatgcatgcctgtttcaaaaaagggggtgggcagaaagtcacctggctgccacccagtgacctttcaccaaaagctctacagtacacaagtagctcaagagaaaacgtctcacctgcaaggacttttctcacagaatgaaacacggaggtacacacagaatccttctgaggatgtagttctgggaccaaaaagaacagagttaaaaactgcacggctgcctggaaaagatgggggatctcccactagggctggcaatttccaacaggatcttgagcatagatggtctgggtaaagggtggtgcaggcggacagccgctttgtctgtccctttcgaaacatctgtccattttgcctggagcgtag

SEQ ID NO: 55935 - DNA, 1362 bp, Bovine  19866880681303
aaataagtttctcttttttaattactcaaaagctcagttaaaacattcccacttaatttttacctcatggatattatagtgatgattttcctacttcgggttaccataattttctaaaattgaagttagattatggagtaaaacaaatttcaaatgcagaaagaatcaaaaagtaatcctacaggcctgtgctgagtaattttttgtaataatagaacttgatgtttcagataatctcagggatcctgggatccctcatttccggcatgtgataacacatttcgttttccaggacatgctccaagctgctagtcactatcgacaaaatagaaactccttgtatagaagagaagagtcaggagaaaaagaacctgagtatattccatggacaggtgagattgcaagcattgatcccaattttcagattcattagcagttgctcaaattatatatttttttcttttttgggggttgtgccggttctttgttgcacacaaggacacacgggcttttctctggttgtggctgcaggggccactctccgttgccatttactggctgctcgttgcagtggcttctcttgtcgtggagcacaggctctaggcacacaagcttctgtaggtgcagcatgtgggcttagtagttgtggtacatgggctgtcgctctgtggcatgtggaatcttcctagaccagggattgaacctgtgtccctccattagcaggtgaattcttaaccactaggatgtcccaaaatatatttctaatggtcagttatttttggaagtcatattattctcctagtacaagtttgtaaatgaaataaaaaataacataagtgacatctccaaaatgagcagatcttatgaaaaatcactttattcccttgaaataatttgcagctgtctctatagcttaattttttaactgatacttgtgcatctactaggttttagtatgtatagttattcatagaagcaggccctgaaagtagtgactatattttatgttgatttaacacacagaagtaagtggagtagcattaaaggaatttagaaggaagaagagtccggtttacttgattctgctgaggccatctccatagagaagatggttttgagcagtacatagacaagtgtctactgaccccctgtttgatttctttttccatcaaaggtgacaggatgtaatttttaggcagttggtcttccctgtagccattatggaacccttacttgtcctattattttgtgtgatttcacagcaaccagcggtcctgctggcatccgaacagcaataatgcgccagcataggactgtccgaagaggtttatcctcaggcagacagcaacctccgaaacgttc

SEQ ID NO: 55936 - DNA, 980 bp, Bovine  19866880830007
ctttcccagtgagccacgaccaatgtagtcctcttcaaagagccagggcagctgctggcggagaagagctgtctccctctgcgcagcggcacacaggatgctgccgcagcgtgcggtcaagcccaggaagaacgcagagtggagggactgcatttcggggaagagagggctgtggaggacggcctgggagatctttccaagtgtgatatctggttcctcctccactaagccttcctgggctttgctcactggtaaagttctcagcaggatgctggccaggtactgtaggtcatctggaccaagatatgatattaaaatcatgatattggacatgaccaagtgccagtgggcaatggggtaggtgtgcacactcactgtcccgacctggccatcccaggaagccgacatcccccgggtcacactcgctctcccagagcccaggatgtaggcggcatcacgcctcagagcacagagggcttcttcagactggaaactggcttgcagtaaggtgttcttcattctctgcaggtggagctgctccaagcagtaccgactgagggagtcggactgaaccgtgaactcctctatctcctcccaatgcttggcctcgacgccagggagtagcggaagggggcctgagggctctggggtggcgcccgccaaggtcccgggctcagagcggtatgggctgcagctcaagcgcagcacggtgtccacctgggcccaggtgtgggcaagcagaagcgcagagtcgccaaccttctgctgccagagctcaggcgttgagggccagggcttgcgaagaaggtccagcaggggcttcacgaggccctgcagcatcccgtccatggcctgccgcatgcgcctgaccacaggcaggggtgagccagcatccaggctccgcgcgttgaccatgacacagcacagcagcgagctcagcgacagggacttcagggccatgtcctcgtcacccctcaagc

SEQ ID NO: 55937 - DNA, 1093 bp, Bovine  19866880990194
gaaatagcaacccactcaagtattcttgcctgggaaatcccaaggacagaggagcctggcaggctaaagtctgtggggtcacaaagagtcagacatgactgagcaagcactcaagcccacatataggggacttttccagaaatcttcaagacaagtagatagataatggcaatgctctggagatgggacattttgaggaacctcaaacctagtctggttcctctggtggctacaaggttggtgggtttcacaaccactgggattgtcaggctctagttatcaaggctgacatggaactggacatggtgggaggggatttcaaatgccacaagtctgttgcttttaccttcagcaatgtatcttggataaattctccttgaattgttgtaagcctttcattaatttacagaatctgaaagtttattttcccattgtttttgtggaggtccttgctatgctgtctgtaaatcctgcccctcttctatcattagacaggagccactgtattcgactgcactagaaagccctatctagacatgtttctcccccaaaaggtattttggaaaaatagctgaccaattaggtctttcagtttagttcagttcagtcgctcagtcatgtccaactctttgtgaccccatggactgcggcataccaggcttccctgtccgtcaccaactgctggtgaggtctttagtaaaaaatattctatggtcaaacaaattcagaactatcttttgctttcattcttggagagccccaatgtatgccagcattttcaaggtcgtgagaagtactactctaagaaacctgcttaattttgtttacaaagggttttctaaacccatttccctgcataacacctttgtttttaattacttcttagtgatcctcagactacaccatgcatgtgtatgcgtatgtgtgtgctaagtcgtttcagtcatgtctgaaccaatcttaaatatgaattccaaacttagtttctggcactattttttggaactaatgcagttgggtgtctaatgagagtggccaaatacttacaaaatacaacagggacattttgggccttaatttctgctttttaata

SEQ ID NO: 55938 - DNA, 647 bp, Bovine  19866881044751
tttatatttgcagaaatacctggttataaggacaaaattctattttgtctgctaagagaataatatattaagcatgtagttatgagttgaataattgtgattatcttctaaatatggcttcatgttttgtttgatgttgattttagagctgatgtttctggaaacgagtgcactaacaggggagaacgtggaagaggcctttgtacagtgtgcaagaaaaatacttaacaaaattgaatcaggtaagaacttcccattaataaactttcctttagcacattctcctctctagctcagtagtgtcacttttcagtatttccaggagtgatttggtcatggagtttcctctctctacctgccgacctgcagtggcctcttaggggtttgaaggtcttgtctgcactggaggtggaagcccaggcctccttcgcagggacttcttcagctgtgtggtggcagggaagcagctgtgtgacgggaaatgagttatgggcacctcgcttaatgctgctggttacagatcaggcatcgtggaaaatttgtttctgaagctgactgagcatgtcacagtaataacctgtctcattattgttctacttgttgcttcagtaaaaataagtttaaaacaaccctactataggcagcga

SEQ ID NO: 55939 - DNA, 2766 bp, Bovine  19866881077767
cctagtgtccagcagcagagggcacttcttgaggcacgaaggtcctaaagacagacattctgtcctttgtgtggcttatgatttaattggagagaagagagaacacacgtgtgacatatatggacagggcagtgttggcccaggtcagggagtcctagactctgaggaagaagttcaagggcacagcagtcaggacaagcgcaggtgagaagatgccagagctactggggtcctgggaatgcatcctgcctggccactccatcaactcaagtcgtccactgcctcttagtttcagcttttgatgagaaaataatacactgcgtccctggaaaaaggggatgcttaaaacacataatactctcaccgtgacttggtattccacagcatgtttccattggtgtcagcacatgctctgagttgggctggatggggagacacactttccaaagggggatgtgtggggagagagcaaattagccaagatggcgttttcaggctctcttcccccatgttttgtaaataatgactatgcagcagatcatttatagcactgcacattgcatcacgaggtactctcttggacacgggctacttttgtgacatgagctccacccagaaaacagcagcacttactgcagcatcacagctgtgatgggtcagccacgagaggaaagcacatagggtgtctactgctacagctgctgtgtcagccaggaaagaataaatgtgtctgcagttcctacagctccttgagtcttcttccagcctcctagttggtgcctggcctaacctgggttcagtgaacagtgtgaacagcaaaacaattggcgtcaggagcaggagcagcaagacaggatggctgtggtttagagtgatgtacagttcccggactcctgggcatgtccgtcacaccacatcgcaactggttctgcatctgaccagccctgggtcctcagcagccccgagatgccgagtggtggaactcaccatggtatccctgagaaggtgggtggagtgaggtttctgggccagagcaccccctccatctttacctcaggggcattctagaagaccaatcagaattcttggagaacttaaaacatgtctccctcatacctgctgtgccagctcctccctcccgaaggagaaggaacgttcctctgaaaaacactagcaacccttggcaggagcagcccagaggaggcagctcacggccatcagtcgtcatcatcattcttacaacccttactccatcatctcgaggaaaaggtctgtatgttttgtaccatctgactggcggatccatttaaaacaactgtcgaaacaagactaaaaggaaaatgctcattttattttaacagaatcagaaaaccacagacttctcaagtttgaaatgagctgggctgctgattttaatattaaaatttggactgccaagagttgggtagggctggcatctgctgtgatactgaggggcccccagtgggtctgcccaggggttgtaatgatgtgacaggagtttctgactttattctcacacaaccaactacctttgacttctcacaccaagcatttgggttaatggtggttaagggaagcagcgtgacctaaattagacacacccaggccagcacacctggagaaggcaatggtaccccactccagtacttttgcctggaaaatcccatggacagaggagcctggtaggctgcagtccatggggtcgtgaagagtcagacacgaccgagtgacttcactttcaattttcactttcatgcattggagaaagaaatggcaacccactccagtattcttgcctggagaatcccagggatgggggagcctggtgggctgccatctatggggtcgcacagagtcggacacgactgaagcaacttagcagcagcagcaggccagaacaacaacggacaggaaatcagaacagttaggaagaaagggggagattacaagtaatgcaatgagttcttcatgatccaacactaaattttctcagcaacttttattccaaggaatcagggtagaagtcttcaaaacaagtggaggttccacttcagagcagtgaaacggcaaaaccaaggcacggagagggtagagctgtgttcaaagccacaaagaaagatgcatttgggtgggtcttacattgggtgggaccctctttggtaatttcagtaactcgctcattggaggattatcagtctgggttgttgcagagatttatcacaggttcctgggtaactcacagaacccctaggagggtcagagaatcatgccacagggccacacacaacagtgtccacttcaaaagtgaaaagtcccttttgaacctttaagggaataaaagtagattgaactttgaaggcaggcaatgcaaccttctaaaacattgccaatataaactcttccagggaaatcagactagacacctgagcccctggttgccctccttgtgggaactctgagtaacaagctcttgctccaatggcaatctgctctggattttcatgactcaagttttccattcatacactgtgttttcaaacacctgcagcttgaattctggatggagagatgaatcaggagtatatgaagataactaagaataaagggaaatgaggacttcgttgtggtccaatggttaagaatccgagttccaatgcaggggatttgtgtttgatccctggtagaggaaccaagatcccacatgctgtgaggcaaccaaaccagcacatcccaactagacaaagc

SEQ ID NO: 55940 - DNA, 1395 bp, Bovine  19866881248565
catagtcattgtggaatagtgtccaggcatctgtcccttcccaggactcagcagccaggccaggcctgggcaccggggtgcctctgtgcccaccagggcagtgcagtcccaatttcaaaaactaactctccttgtagagtcatggcattaattgccccagtaaacataaacatgccctagtgttaccagggaaagaaagcagtgaagcctccatcagccatgaactagtttatagaacagaaaccagctcctgggaggcagtgggtgcgggtggggatggctgagcatctggagctcagagacaggtggcagaacagcaagaaaaggcgctgatagctcccgaggccccttctcaatctgccagcaggagctggtcagcctgtcctctcaagtgggctggaggacccccgacaaagtgcaagttccgggacacgttcccttcacagacaggctgggccccaccctccgaggatcgcccaggactgcaggagtcctgagacctaataatacacacaaatcagaacacgggctgcgggccctggccatgcaaggacagagggaaagctgacgcccagcctggcctgctggccttgccctaaagcagcagggcacccggccttggaaccaggcccccggctgtgccagcagcccctatatcgagagaatgagcctgctggggggaatggcaggcatgcggcccagctgtcactgaggcggcccagaaagccagctccccccacaccctccttcctgtccccaagctgcagcccagactgaacggtaatgaacttgtgaaatggcaaagcaggagcacagagtgcagagaggccacttagaagaggggaaaacagcaaacccattaaaggaaatggtagctttgtcctcaaagccgactctgactgaggggacgcaggagggtcatgcccctttaatccttcctcataaggaccctgactgtttccagggctgtcccaggcttgtgcaccatcctcaccaccacattcccccatgcatcccaggaaaaataaccagcttctatacacaacagcagcctgagactgtatcatcacctctcaaccttgactttccaatctgcaaaatggaaaacttctagctttcctctggggctggcagctccttgacacaggggcagggggcagggaagacctcccaaccacaggtcactatgggaagcgacccagcgctgggccagcggcccccaagagccagccccctaggaggagtggcagggctctgggggctcggccccgactcccgtggagtgcctgagattaacgagaccgtggccaggcacctgaagccaaggacagcctccaaggagctcaagacccgactgcctctccctgggggccatgccttgcccactgactgggg

SEQ ID NO: 55941 - DNA, 1160 bp, Bovine  19866881316858
acacacacacacaccgcccacctccccccctccccaccaggatttcatacctgggtctctgaaaaaaggtgacagtgccattagaaataggtcaaaagaaaaatgagttttgtaagtcaataggagagaagagaacatgagcaatttttttctagatatgttaaggcttaggttcaaagaccatttaaagaagcagataatgatagcaatctgaaatcagagggaaaagcacagtttaataaaggatgtggtaccacagtatttaacagggctaatgcaaagggacctgctgcatagcacagggaactctgctcagtgttacgtggcagcctggttgcagggggagtctaggggagaacggatacatgtgtatgtatggctgagtccctttactgtccacctgaaattgccatagcactgttactcagctatactcctataaaataaaatgtttaaaaaaagctggggtcaggggaatgtgctcttagttcacacagatgtgtgggcatgcatctgtcgctgagcagctttgaactttgggcaattttggtaacctcactgaggccatttcctcaattatttaacacaaatgcgacatgaagctctatacattacagatcacaataattacaggagatcacacacacagggcacctggcagagcagatgcccccacatgttagttcccagcatcgtcactcactactccagagtctgaggcagagcccagcagacatcatccacacacacagctggaggctcgggggtggaaacacacttttggttacgtctagaaagcaaaactaatccttaaacacatgcataactttacatcatagttttaattcaaaaaatgaacttatgagataatctataaaacttaagaataattaatgttacagaggatgcaagagggtcagtatgaactcatctaatcatcataataagaatgcttcactgaaagatcaaagttttcatctcacggacaccactgctcatacagtggcaacgctaacttcataggagactgccaacttactgatttcactaagaaacaagctagtaaaacaaggttattttatcaacttacaatgagatcactactaggagataaaattcccagaagagaagaaaccttccgaccaattcctaaagcacac

SEQ ID NO: 55942 - DNA, 1608 bp, Bovine  19866881370661
cctagtttctgtattgctgacaatgggtaagacagaactcaggggaatggctcttctggagaaacttttattcacagaagtcctgaatatggtgagactgacttgcctctgccctgctgcaggtgacctggaggaagcttcattgtgaatattctggaaaattagtgccaaagccacttgagtgactgttcattcattctgactccccttagatccatgaatcagcattgcgagccaagagcagaaggcaggtggagaagaggaggctggcggctcagaggcagcgggctcactctgctgatgtggagaaaaataggcgggtcaagcctgcctcctcagagaacccatggatgacagagtatatgagatgctactctgccagagcttgagggaaggaacagttgcttggacaacctctttttaaaagtgtaaatgaaagaaaagaacaagacaaaaactatcaaaagcaattggacacaggtttaagaaaccaactgattatgcaagatttttcttggggaatttccaaaagattgtctcttttgatgaatcctggtcacctacctcagcagtagggtgacaactgaagccatagaaatttggttatttatgaggagaattccctaaatctttgatattcttataagggttttgttttaaagcatcttaatcttttaagatactgacaccaaatgcctttaaatggctgacagatgcttaacttcagtatctatgctcagtttaggtgaagcctgttttcctcctgttctgaacagcttctcagattccatagctggtaaggtcacgccagcttgccacagaagattccctttccttatgtgtagtttgctttgaacatcaagttaaaagtgagtttcaacactacttttgattccatgtatagtgcaagtattgtagaacattggtagttcctaaacaattaaatgttttttgcgtttcagttcaagtaccacttcatgtggactgtgatatttaagaactatccgggctgggtgagggtcatcttttctctttaaattgtcatctaggcacttatattaatagtttagttcaagtgcattccagtaaatgaagtgtttagaagtagtactgaagtttcttttgagtcaaagagtcactttttaattgagattttttaaggacacttaatggggtaccagtcacttgctacagtctcgccttttggcagtcacccactgtggacttctgcctcttctagaagagtttagcaatgatacttacaatttaaaatctgaacttttacttagtaaattgagattgtcttgcttaccgggggtgggggacagattttaagctacctatgagagatgtgggtcacccctactttcctcctccacggaattaccaataacaaagccttgatgatgcacattgttcagacttttggttgaaatacatgcctcacaggttcctagctgataggttttgtgtagaagctaatgtgaggggatgccgctgtgtgtatgggcatagatgtgagcatttcaatgaagtgtttccttctctccagtacattgcttttggggtagaaagggttttagaaacatttttttccattcagcagag

SEQ ID NO: 55943 - DNA, 1654 bp, Bovine  19866881414979
cccccgttacaaaggtctcgcaaataggaccgtgtgtaggtttcccagtacagcaggatggccagtgctgtgattctgtggccagatggtctcgactctggctatgacctctcaaacgctgtgtgaccctgggtaagatacataaccctcctgagcctcagtttccccagctgtgaaatggggctgataatagcacttcttattttcaagtgtaggtttttaccctttttccagtatgatgaggccagtagatcaggaaacaacttagcattggatagtttgttattcacagctcccaaaaggagggggcacattgtcccatgcaggggctcatggggaggcaccagggtcagtcaagagccagaaggagcaggaagagaatataggcaagagccattattgcggtttccccaggaaggaatggatgaggcagggtaagcagatttaagattggctgctttgactaacttcagtgggcacagagtctgagagctgtcttaagtaggacaggagggtaccagacctgaacgtgagagcttgatagagaagatgggggacagagctttggattggttagtttgcatatgaaaatcacccacttacagatcagccctttactgtctctagaaattggctggccctgagaggggcaaaccctccagggtcagctagaccccagatatcaaagcatcagaataaaaaggcttgcttaatacagcccctctgtaatcataataaatacaaagggcttagattagtgtccagcacagagtgaaaactcagtaagtgttattgtttatgatgacgatgactagacccatccagcaccttaacttgagaacttcctggcatctgactcaacagcccaacacctgggcatcaccacccctgcctgacccagatggatgaggttagcaggggagggagtatgctgagaggcaggcccctggaaatagctggtttgatacagtcttctattggctcagttagtaaagaatctacctgcaatgctgaagaccctggttcaatgcctgggtcaggaagatgccctggagaaggaaaaggctacccactccagtattctggtctggggaattccatggactgtatagcccatagggttgcaaagagtcagacatgactttcacttttcatcattaaaaaggatgaccaagtgctccgtattctttaaagcaaatgtacataaattaccttaggttagaggaaagatcatttcctagcgttgttacagatatttcctgagttggggaatcttctcagtgagttgagacctgtccccatggtccaactcagtgatagcccagcatcctctgacacccctacggcatccgccatggtcctcagtgccgcccacacctctcccagcatcccttcagcgtcagcccatctccccatccagcccatatgtgctgctcacaagcagtggtttcttcagtcattaccatatcatgatgtatgaaacagagatgataacatagttgatccctctagaataatcccagccttgagttgttctgatattcagcctcccagataaacattcttccactgcagttttatcatcattctcatttggcaggtaaggaaacctggattcagaagggaagcaacccacccagtgacatactcctag

SEQ ID NO: 55944 - DNA, 753 bp, Bovine  19866881516603
actggtgtgtgttgcattttttgtagatgcaatgatgtgcttaataatgtacctttcattgaacatttgagttattttcatttttctccttaaagataaggttgctataaacatcctgggatacatcactctttattttttcttagctatgtccttaggcatatgcctgaagactcccttctataggtcccttcctcacatccaccctgtcactctactgtgacatgccatcagtgtgacaaatgtgatgagttggttttccttctgtatagttgatagcgtgcaactcaggctggcgtatacacagaagagaccttattggctcatacaactgaaagtccaagggcggggctggccacagtacttcaatgcagaggctcagagcacatcagctggccgtttttctaatctctttgttctgcattctccagcagttgattttgtcctctgctacatactccatggaactgtgaaggcaacagcagctgctaagctcacaccttcataaaatacagtagaagaaaatgtacctttcccacaagccccagcaaacatctttattcgtctcattggctccaaatgagttatataccatctctgaaccaattactgtggctcggggattgaggtggttggtgaaatacagtgatagaattaaattaagggtggctgggtgagtggtcaatctattcacatggtggaattggaagatgtttcctaaagaagatttggacttttgttgtcagaaagaag

SEQ ID NO: 55945 - DNA, 1366 bp, Bovine  19866881527360
ctgaatccatggccgtctccctgtgggctgcctctgcaggcccctcatccagggtttatctcaccttctctaaagacttgttttaagaggatgatgaacaggaaggcgctgcacaacagccccagagctcgagggggtcagaggtcagttctatccgggggtgaccctgctcttgactgggagaagtggctccatctctcccagttgcctcattcctaccggtctatcacagtggaggacgctggcattcactactgccctggggccaatgagtagccgacagtgatcgctgcttcttccactgagcctgactgctcggcccaggccacagctgccccaagcacgggcttccagtgaagcagctcatgaaggagatggttcgaagccaattagcatcagcgtcctccacccaatccccaaagccaagcaactcagaggcttttctatgcatgaaccctcttccttttctccctgcccccaaatgtcaaaatcactaaggaagacaattctggtggcctggccaggcccttcctgtctgcactcctgagcggcacacacttcctcctgctgtgtgtggtaacacatcacctgcagggagggaaacagtgggggcacattgtgtggtcaggtccccacctccagggacaccctggggcccccagcagcacccaataggaatctgtcctcactgcccaccctctgatggccccatccgtccctgtcatggtaaagatggtgtctagttcatgctcatccttcccaggtagggcaggaagctggtctcactgtcctaaatcacacatgtttaatcccagcaaagaaaagcaaacgcagttcagacccaccattgaaaggaagctcaggttctctctcgaggagctcccagaggcggcttccggcacccagtcccttcattagctctgagtagaaggagctgagacctgaggatgagaagcaaaggcacacatccatcatcggccaataaatggccctctgctaccccaatccctctgggcacagtggcaacagcctgcctttaacacaaaatctgtcactttcaggagaaggcagtggcgacccctccagtactcttcctggaaactcccatggacggaggagcctggtaggctacagtccatgggtccgtcagaattccctctgtctcatacccttgttttccttcagcttctcctcctccaatttcattatctctcataaggctttggtctgatcaggggatttacaaatatatatagtcatactagttaaccactgaattaaaatcacaatgttacagaaaagactgcttcgtcaaaagcaataaaaataaaatataatgctatctcatattaaaaaggaatacaag

SEQ ID NO: 55946 - DNA, 1549 bp, Bovine  19866881532639
actgaaaagaaatctggcaattttagatacactaacaacctctgcttaaaagtcatctttgaactatgatttaaaaccccacgttcactggtccatgtcaactgccagaacatatactttgtaacactttccctcagtaagggtgctaaaaaaatgcaattcaaatatcctagagtatattgatatttgtgtaagatagagtggactaaaaccttcaggttaaattaaggatgcatcgggcagaaacagagccacataaatatagtcaatgacccttcaatagttgagcaaacgcaattcaatggagaaagggtagacttttcaacaaacggtgctgcaacaactagacttccgtgtgcaaaaaacagatcaggacacaggccttacatctttcacaaattaactcaaaatgatctaaacacaaaatgcaaaaccataaagctcctcgaagacagcataagagaaaaacctacatgaccttgggttcagagatgactttttaagtatgttaaaagcacactccatcaaagaatatgttgttaagttaaagttcattaaaatggaaaacttctaagaaagatcaagtcaaatgtggcagaaagcacaagactgggggccaggaggaaagctgacgatggctaagtgtgaaacgggcacagaaaggtcacagagagggcaggtggtggccagcagatctgttcggagcggggaacatgaccacacggtatgcaaccctatagcccgtcagacccaaccccagggatgcaaagaaagaagcaagactatcatcgctccagcatcctgaactggtctgtctcgcaagtcactcggcaccagaaacatcttggatcagatttttcttcaagaccagccagcagaagtaaaatgttattttaaatagatctctggaactctcagtccagaaaatatccttacttgcctgcagatgtctaaggaaaagcctctcctttaaccaggagaaaactctggaaccctgaaaacaaaaagttgaggtgaccctgtgggatacctgagctcctttaaccagacttgaggctgttgatctaacctttccatcttggttttcaaagaaaggaaggaaaacaaaaagcaggaaatcatttgctccaggttggctggggctttgcagactccacacagttctgcctccaaggagcttgcttcccttcactcaggggtggacaaggaaagcagggctctgagagactctttacaaaagcaagcaactgtgtctcatggactttatcacttctatttcggattgttcactagttttgaacatggttggcttctccccaccagcaacctgccaatcatgaaagcatcggggttcctgcacataccatccttcctccccagcatccatgctacaatgaaagggaacaggttgccctgcatgctggctgggaacagatccactgagaccctgtgctctgtgagcttgggggggcagggggcctgcaaaaatctaacacctctcaacccagggaggatcacactcgtctttattctgtccttcaaagtcagg

SEQ ID NO: 55947 - DNA, 981 bp, Bovine  19866881571971
tcttaaatctccgtagctgtgacaggtcaaggccacttgccattttcctgagcaaatcgggaggcctccaggaaagtgacttcccgatcggtgtccaagtccttcttgttcccgcagaggatgatgacgatgttctggctcgcgagcattcgggcatctgttaaccaattagtaagcgcattgtaggtttctcggctgcgtaatataagattgtgagaacagtacatgtattttataaagctagcaactctttccagtcactcacaccactcagaccgcctctacacacgcagggcagtgcccacaaccttcaaagcgctcagaggacctgggtgccccaagagcataccacatgctaagggtgtgttccgccttgtttccagggcgatgccacagcgagtcagcttgccacctgttgtttccccaagcagggtgcagtatttactggggtcttggttcacacaacatgcgagcaagacctaaggctaactgctgtcactcgacgaatccgtgcaacatgatggtcctttgtttcacaggaatttatcacactgattctttgtgacacactcttatcatctcccatttacacgagaaacctgaggcccagagagactagttaagttgcccaaagtcacacacgcagagccaggacttgaccaggtctgtctgcctccaggactgtgttcagctcttatctaagggcaaaatcctcgtatgttctaaggaccgaccaaggaactgaatttttaattaaatttaattgtgaaaccaaggtgacagctacatgcaggacagtgcactcagatccttaagatgggccaagagctttataggaactaatttaaccacccaacagcctcacgagtattatgtggtcatcatgactcagtggaacagacaaggaaactacagtccagagggctcacactgctttgggacaggaaccaggattgaactcaggccatcgcagcatagagc

SEQ ID NO: 55948 - DNA, 929 bp, Bovine  19866881654062
ccaggtaggaaagtgggagtgagaattaggaaagggggcagggtcatcctggcaaatgtctttccttttctgtgattacagagaaccaggattttttattattgttattataattattactgagaagaggaaacctagcactggcagagggggccttctctgctctcatctttcaggttttactcctggcactggctgtgatacttggaattttgaggttcagggaattcagagaacttggtcatacagtgtattgggagaaagggaaaattcctgggtgacagttggatcactccagctgacatgtttctagaagtgggtgggcacatttgactgagaaagtcttgggctcttgcagcaatggtgggaaagaaagattctttttgtggctgcacttctgttaacaattctctcccccgaaaggacggattgtggtaaagaaatgaaagtaattagaagtggaaagtctaaaagtgaaagaattaaaaaatgttgaatttccaaatgattccgaggtgtggcttttccagcatcttttcctcctgagatcatccctcccacctgctttgcaatagcagtttaataaacagtctgtgaaaaggattaaatatttctgttttctgaaaagagttattttgtattttgttttctattaaaatgtgtttagtttccaaaaaacagtgttggcatctcttttaacaggcgggtgtgtgggccgttctggaaggcacagggcacctgtctttggagtgacagccagttgtgcagactggactccccagctgccctcctgtctccccttgtattctgttcagctggcctcaaattgtgtttcttcttggcattcacagggattattgaaagcatttaacacttttttacacatccaagcttgccagttgcgaccagagatacatatatttttttat

SEQ ID NO: 55949 - DNA, 884 bp, Bovine  19866881768590
ggcctccttccggagccgctccttccctgctaatattttcccttgtcccctaggctgtgttgtcggctgcaacattggttaagttactcctgaactgtccatgcagtgaagagaaggccagtttattctggcgcacatgcccgcagatggtcacggctctgatggtgagtacctctcggttgtgcatacccctgtccctgcctttcagtcgcttctgcttctgtcatgctctggttttcttatgcagagcgtgtttctggggctgtgtcctgaagtcagctgtgagcactgtgctcacagcttgtgcttacgtcattatcagctccgagtctaacttgtgctacatgagcatagccctggattagcacattctctgggcatagggtctaagccttctctctgatcttctgttttgttgctttgttgtttcactgggaacctgcattagtgggcaaagcccatttgtacttaggtatggttagagggagcatcaggaggaagagggtaggggtgtggatggagattagggtgggacctggtcagtgctggagtctggactttcttacctctgtcacttggggtttggggctatttccctggagatttgccttcattttctgtcccttgttccttgccctgtagctgcagacccgagaggcttgtcaggagcagccctcagccctggctctggtggggcctgtcttggacgtcctggctgcgctgctgcggcagggggaaggggccatcagcaacccgcaccacgtcagcctggccttcagcatcctgctgaccgtgcccttggaccacctgaagccccttgagtatgggcatatcttctcgagggcacacaacgtgctcttttcaatcctgcagtgtcacccgaa

SEQ ID NO: 55950 - DNA, 637 bp, Bovine  19866880463270
attctccaggcaagaacactggagtgggtggccatttccttctccaatgcatgaaagtgaaaagtcaaagtgaagtcgctcagtcgtgtccaaccctcagcgaccccatggactgcagccttccaggctcctctatccatgggattttccaggcaagagtactggagtggggtgccattgccttctccgatctaaatgccttagtcttatttaaatttctatgttaagagcaactctaccaactcaatgttaaggactgtcctaggcctttacggtcatgtgttgtttgaatcctcaggaccgagtagcctcaggaggtaatatcacaccgttttacagatgaggaaactgaagttcagagagggatttcaagaaattgataatacaaagtatacactcagtacctaaaacactatgttaaggaaaagttcacactgacttaagaccttttactccccaagtctaaaatgattatgattaagcacatcatttttcatcttggaagtgatgtcaaggatactattaaaaccaaaatgcacattattcaatagagtctaaagcctgactaatgatgatatcactgtctccaagagcttcatattttcccaaaatagtttctcaccagccgtattcatca

SEQ ID NO: 55951 - DNA, 737 bp, Bovine  19866880483338
cataggccgggagaggtaagcaacaaagaacacatcactcagctaataaggttttatgaccaaccaagcgcacccggggagcaggccggaggttctcagggttcccttacacactctgtaactcatcagtgcttctcaaggtcatgctctttacccaatggtcaagggagcacagcccaggaccggcgcacttcttctcccctttaaattgacccccaacttggcttcaaaactctcagactttaagatctcatactagtgcactgggcaggaatccaaagcatttctttcgggcatatatgacacacacatccaagcccgcaatctgttcaagttacctgtttttctggttttgactgacaaagttctatatgatttgaatcttgattattctaaaaggaacaggacgaaaaggtagagaggggaactgtaatgcctttagcaggtgattctgcacttaaatttcaaaaggatgtttaccataaactcacttcattatcagatcagactcaacttcttgtgtgttacctggcattctctatttagatgactggtaaatttacccacagtccaggaacagagaaccaggctccacggcccagcagactaccactccctttgcacaggggacctagaagtgagaagctgaaaataagaggccaggccctaaaagtttaaaaataaaaaggattgggggcaagctaagtctgttctgtcagtgctttccaaagtaagtg

SEQ ID NO: 55952 - DNA, 791 bp, Bovine  19866880494674
cctggagaattccatgggctgtatagaccctggggtcgcaaagaataggacacaacttaagcgacatttacttaatatgtaattctttacccccaataatactgcgatgatacaaatttgtttataactaaagtaattccctaatcatgaagccgtctttttttatagtggccttcctgtagaaaggtaagagctagtgtccttcaaacactggttcagaccccaccatcattaggttctgcactttacgattttaatttctaagctctaagaacatcactgtaattggcttcaaagataagaatactactttcctcaaacaggtttatagattgaaaaagaaagcctgtagcatacctacccagtgaccgatgcaaatagactctcagtaatagttagcattatttttctttctacacacatcagattaaactatattttacttcagtggcaactagtgataagccgggtaaaaagaactgatgttaagtttatcttataatcatatttaatattttcatattgcttgctcaataaaaattcccaaagagggtatagacatttgcaaagaagatttcacaaaactccttttgaaaaattgtaacatcaatgaattctatgttcagcctacaaaaaagagacgatagagacaagatatagtactaattttgatgtctgagttcagatatagtcacataatttatagttgcataagaggaaattagatatagttaggagttagatatagagttatcatatagagttacttatcatatagagtctttacagta

SEQ ID NO: 55953 - DNA, 3542 bp, Bovine  19866880553197
acccttcctgatgattgaacctgcatctcttgcatctcctgaattgccaggcagaatttttttttttttaaccactagtgccacctgggaagccctacttcttttaataaaattattttaatataaaaatcgacttattctctgcatagttcttcttactaacccaaatatataagcacacaaagtagagaagcacatagccagtcctgtataagcctttgtggatttctaggtggaaataacacatcattaggttaattttatgtgtttccaaggaggctcagttgtaaagcatctgcctgccaatgcaggctggcaaagtaatgctcaaaattctccaagccacgcttcagcagtacttgaaatgtaaacttccagatgttcaagctggttttagaaaaggcagaggaaccagaaatcaaattgccaacatgccctggatcatggaaaaagcaagagagttccagaaaaacatttatttctgctctattgactattccaaaacctttgactgtgtgggtcacaataaactgtggaagattctgaaagagataggaataccagaccacctgacctgcctcttaggaaacctatatgcaggtcaggaagcaccagttagaactggacatggaacaacagactggttccaaataggaaaaggagtacgtcaaggctgtatattgtcaccctgcttatttatttatttatttttaaaattcaaataaaaattttattttttattttatttttttaaattttattttatttttaatctttacaatattgtattggttttgccaagtatcgtaatgaatccaccacaggtatacatatgttccccatccttgaaccctcctccctcctccctccccataccatccctcttatttaacttatatgcagagtacatcagagaaacactgggctggaagaagcacaagctggaatcaagattgctgagagaaatagcaataacctcagatatgcagatgacactacccttatagcagaaagtgaagaggaactaaaacgcctcttgatgaaagtgaaagaggagagtgaaaaagttggcttaaaactcaacattcagaaaacgaagatcatggcatctggtcccatcactctgtggcaaatagatggggaaacagtgaaaacattgtcatactttattttggggggcttcaaaatcactgcagatggtgattgaagccatgaaattaaaagacacttgctccctggaaaatcccatgaatggaggagcctggtaggctgcagtccattgggtcattaagagtcagacacaactgagcgacttcactttcacttttcactttcatgctttggagatggaaatggcaacccactccagtgcttttgcctatacaatcccagggatggctcagcctggtgggttgttgtctatgtggtcgcatagagtcggacacaactgaagcgacttactagcagcagcagtagcagcagcatgcaatattgttctttacagcatcagattttactttcaccactagacacattgtggacatatattatttctgctttggcccagttgctttaaattagtaattgccctcagctcttacccagtacgacagttgacactttatgacctgggtggctcatctatctgtgtcataactttttaccttttcatactggattaggaaatggcaaaccactccagtattcttggtgggagcaaaccatgaacagtatttatgtatgtatgtatatatcatctatattttttatctatccattaaattgtaaccatatatttatatttattttaatactttgaaggataatacccatctataatcaatttgtatgataatgtttgttatctgaaaatatgttaataaacaaatttcagatcagatcagttactcagtcgtgtccgactctttgcgactccattaatcacagcactccaggcctccctgtccatcaccaactcctggagtttactcaaactcacgtccatcaagtcagtgatgccatccagccatctcatcctctgtcgtccccttcccctcttgcccccaatccttcccagcatcagtcttttccaatgagtcaactcttcgcatgaggtggccaaagtactggagtttcagctttagcatcattccttccaaagaaatcccaggactgatctcctttaggatggactggttggatctccttgcagtccgagggactaaaaaacttattgcaagatatatataccaaaacagatatttttcaaactataataaattctctttgaataaatttttcagaatttagttctatttaactaactggtctggaaattttgttgtatatattatgcaatctcaaagaataaatggaaattcattctaaattaaatgttacaaagtaatactcaaagttttgtgattccaaaggtttaagttcattattataaataccaattattatatgatgaccttacttatcaaatctctggatgagtaatatgaataacataaaattcaacctctactaacgtcaattttttggtttctacctcagaattaggaagtgtaaaagattcgtaagcagataaaagtggtaccacgtaacaaatctaccatggtgaatatactttattcatcagagagttcctctattctacttattttgcacataattgtaattagctaggttattagcttgccaagctcaagattagagacacaaaattagaggcagtagagtatgacacaagattcaagcttcttcactgtatattatttacctagtaaaatcattaatttcactgttactttgttctatcatgaaaggtttttatcaatattaaatatgaaacatgcataactgcaatccaatgtgcgtgtgtgtgtgtgtgtgtgtgtgtgtgtgtgcacgcgcacgcgcgtgtcggggggtggggtggcgggataggtgggcttcatctttgtcactctttccagacctatggggcacactgaaagctagtttagaccttttatgatattacttttttctccttttcttatctgaccaaaatcaaagattaactcttggttgatttaaatatctcttaaccaaaaaagagaaaaaaatttaaaatattaaaaagaaaaggtgaattttccctatcactctatgaactgagtatctatctttacaaatcacccaaaatttccagaccaaatattcagattttaggagtaaagtttttaagaaaaacttccaaaatggatattattttctgagacataaatatcaagtagataatatatgtcagtggcgtctcaactccagggcagagatctgttgtacttcaagattacctaggaaacactggacctgcggcacgtctggtttctagaccagggtacttgcactcttcttgaggaaacctaccagaaccaaacatttcctgacccgtgaagggaatccaaaaccagacactgagctttaggagatgctactcttgcagacctggagtttctacagagtgactcgtaaaagtacaacttttatatcat

SEQ ID NO: 55954 - DNA, 1298 bp, Bovine  19866880626685
gttaatttattttgatgtattaagactggttataaaacattgatgcaggtataatcagataggacaagatgttctcagtggagcctccataaaaaatctcaagtaaaattaatctatcctataatgactgatgtgaggcaggagaaaaaaaatatattctttgcaatggcataaaatagtcatgaatttgaatttgcatatggaaaagcaatttcatagtaaccaaagtaatgagactgttctccctttatgaaaggtagcattttgttggagaagagacttagcataaaacaaacaggcatgattcaggacctccatcctgactgtatccctggtcctgtgtgcccttaaaaaccccatacattttggtggaaatctcagagtactactctcagcctctgtatttcacagataagaccaaggtccagaggtctgcaaatggctttccccagtacctgatgagtgatctgagcaacagagacagaaccagaagagggtctttctaactcaatccccgaaacccctaatacagaaagtaatgttctgtggagggtccagggtcacccagagaaggtcactgccttctaaaagctttccagcacacctcagggctttgtcctctgacacatctagcaaatcacctcagtcaaaagcatgttaaaccactccattaggaagtcgagggcccccattctctgaggcttttctgttgaatggcaagggagacttcagcaacttctttaaaaagggggggtgggtagcaagggaaagaaagctaaactcaacacctattgtttctctttccacaggatcatgtgtttttactgccagtattgagaaattcatggaagttgtcagcaggaagtaaaaatttacagagaagggtgtatgtgtttgccgcttccacacattaatggcatgatttttttttttttaacgcaaaaagaaaaaggaaaaaaaaccacccacattttaatttagcatgagccaatttacagagcatggaaattcactttcattcccaggattggcacgtatgcaattagcaatgcagtgtatatacaagaagccatgctgttaacagtttatctcaagtaatttggtgtcatttataaaaggaagaaatttctgccgccagaagggacagaaggagaaggagatggaacgatcaaatcacggagaaacactaaaattactgaatccacaacagctcgccttatttttcttggacccaaactgtcagggtataaacactatttgtttcttttttaaaacatctatagttttgctgtaaataa

SEQ ID NO: 55955 - DNA, 1041 bp, Bovine  19866880690114
aaaaatccccaaactctgcatacattatctttgcacactagtttaattatcttaagataaattttaggaagtataaactatattatatactatatgcttattcaggtacaatcaagaatatttcctatgaatagattattttgtatattttatcatttcagaactgtattgactgccatgctgagctaaaatctgtatcaagagaccaaatgatcatcactatttaagtgtgtacaaacatttttggaaagcggggagtctatggttccaaacaagaatatttctatcacatgtgagccaggagtgctttggcaaaaagctccccacagtatcttaatgaacaccagtggtcagggctgtggttttgcatttcgtcaaggggatgcccacggaccaggatggcacagcaggtggaagggagatttcctcattcagcattctccatttacctccagcagctggcttcgggcaacgtccagaggagccacatgcctacagcttcattcattcttccggcaggcctccctgggcactgtgaatggtcctgcggcccttgttcagggagcatgctctgttgagctgatgacaaccgcaggacccagtgggacagggaaaccttctccttgagaaattcaggggagagtccacagaaggcacattgcattacagctgatcttgggaggatggatcggttgggctaactcgggtggtggtagacctgttgcctggtactttactggtcctcctgttcttgttttgctgcctccacagtagaaacagctgctcccttttcagcctgccttggacctagaggtttctggaagaggcggttttggccagtgagacagatgtgcttaggggtttctggaaaggaattttctttttttaataaaggtactgaagtagctagccctgtccttcacttcttttgtccctcaatgcagatttgacgcatggagctaggcaggtaaggagcaaaggccagtatcattaaacctctgaactacattcaccagcagttgtctaccctcagattacttg

SEQ ID NO: 55956 - DNA, 2714 bp, Bovine  19866880776427
aattggactgcaaagaaagctgagcgccaaagaattgatgcttttgcactgtggtgttggagaagatccctgagagtcccttggacagcaaggagatccaaccagtccatcctaaaggaaatcagtcctgaatattcattggaaggactgatgctaaagctgaaactccaatactttggtcacctgatgcaaagaactgactcattggaaaagaccccgatgctgggaaagattgaaggcaagaggagaaggggatgacagaggatgagatggttggatggcatcaccaactctatggacatgagtttgagcaagctctgggagttggtgatggacagggaagcctggcatgctgcattggggtcagaaagagtcagatgtgactgagtgactgaactgagaatagccagaatattagtgaggacagaagcccaaattaaactggcttaaaacctcagggggtgggggcagattgagattaatgtactggtttatataatgggaaagtctgggtggtgcaacatcaggcatgactggatctagctactgcccaaaagatggtaggaatcgttcaccttcatgctccgtctctagccttctttgggtttatatcacctttccatttagcaaccccgaaggctgcacaaactctcattagactggctgagattttatatttcaccctgatgtagtctttgtaatttaggacaaggaatcctctgaatagccaaaatcgaggcccatccttggaggagagaagagggaggaactcagccccttctaaatgacaccagttggtgccagtggtaaagaacccgtctgccaatgcaggagacataagagacgtgggtttgatccctggatcaggaagataccctgcaggagggcatggcaacccactgcagtattcttgcctggagaattccatggacagaggagcctggcagtcgataggatcgtaaagagtcgaatgcgactgaagtgacagcacccagcacacatgagttaaggtacaggcgtaggagcatcagatgctggcactgcatctaaagagagggggctggggattctaagtgctttctgctctcattccatctttgaataactaccagaaatcacactgatttgaatgtttctgcctacagtacacatcgcgacaacttttagggtcattcaaaggaagtgtaattaactgggtagccttcacaatatttttagaccactattactttctgcttcatatctgtgtaaaggtcaactatttccattcctttaatgatgacttctaagccctaatttttagtataatcattttctccataattttcataacttgttgctgaatataaactggaaatgttgtcagttccttttaaagcacattcaataagaacttattactagaattagaaacataataaagaacatgtgtctaaatataatcttccatgccaaaaaaaaagcgaatgcagaggatggcaccacacccatgttaagaatactaacaagtctgagatctggagggcagaggataatggtcttagctgactcccttcccacatggagcagtggagactgagagtggagtagtgttaaatatatatgtatagtcgagtcactctgctgtacagaagaaattaaagcaacactgtaaatcaactagacttcaataaaacttcctttaaataaagaaggcaaagagaaggcaacatggggccctatggctagtgactctgccatttatcaactgtgtcccctggggtgagttgcttcagctgcttgtacctcagtttcttcatctttctgaatttcttttacttgttctttttaaattaatttttattagagcatagttgctttacagtgttgtgttagtttctgctgatagcaaaatgaatcagctatggctttacctaatcccttcttttttggatttccttcccatttaggccaccactttgtgtgactcttgattgcaaagtgaagggaacgtaaaggaatgtagagttcctggataacccagtattacagtacaaaagagtccactcttgatatccataggggggattaaagtggtttatggactcatcatgactaagacccagcagggcatggggatggcttcattctcccaactctgctcctcagcactggcctccacacctgccctcaaatctgcacaggtttcaggaacctggggtggcaggcctgtgctaaccatcctgggtctcaactccactttaactgtagttaatgtgcaaactgattaatcaacagccgggataataaagaggtagctgtgcttgtatgggtgagctctaccattgcaaaaaaaaaaaaaaaaattcatggtgagttaatttttattcatttgtcagctttccttgtcaaagcaattttaactgggcaatgatagggcagttttacatctgacactaaatcatatatcactgctttaggagttataaatatttaagatttcttgcgtgctttcagacaaaatcaacaccgtggagaaactccgttttaaaattttacacatgcagattttgagacatgatagacataaactaatattttttgtcacttaattctaacaaagtacttaaatgcacttctgaagtaaatgcttctcatgagtcgtgcccagtgtaactagactctttcctctgaaataaagcctgtcttttgaggaattagtctttttttctctt

SEQ ID NO: 55957 - DNA, 1325 bp, Bovine  19866880937059
cacattgaagtcttcatattctgaaattttgtttgttctttgaaatttttaaacctagtaataacttagaggtgaaatttaatataaatgggaagagttagaagagggtatcagattccctctcaacatttaattaatttataatttgttttcagtttcaaccatatcaaggagctaaactaaacgaatcatcatctctaactatgcagaaaactttgattgataccatccacttattctgtcactcagtggtaaccacgcccgacagtttttaagaaaaagagagaaaggggagaggttggagatcagtaatcaactgccctttatatatttaaatgaaatgaaaagtctgctgtttattacagcacagcaaataacatagtaacatagcaaatggagctgaattcactttggggagttgcagaaacgatcttgctttggtgactattttgtaaaggagcttggctcctattcagcttggttttgcagtgagaattgaggcgagaagagataagccagcaattccaccgtttcccagcagaggcagctgttttgtgcaggtccctgtttctcaatatggcactcacatgtttccattgggtcctatcacatatcaagttaaatgctacctgtgtctctatcagctacggcacccctgcctctctttcgctgctgagctcagccacaggccttctaaagtttcacagatttagcccacacttctgtaacacttttgcatccatcctaagaactgctggttttagcaccttcctgaaatggcagcccactccagtgttcttgcctggagaatcccagggatggcggagcctggtgggctgccatctgtggggtcgcacagagtcggacacgactggagcgactgagcagcagcagcagagtcacccacaggttcagatctgcgtgtcttttctacccaaactatttcataatgtcttggtgagatgcagtcatctcatgtatttttaaatgtctctatgataatgtaataggtgacacttgtgtttaataaatgccaagcaccattcttaagactgtgcttattaactaacttagtgctcatgatgattctatagtatagatatcaatattatcattacctaattttgcagatacaggaaaattaaatacactttcctaagcttatgcagctggtatggagcaggcctgggatatgaatctatatctggctaatgaatgagtctggctatagaatattagctctcagctcctgaatatcctgaccacaatacactccatcttcttagtacactggggaggtactccagaaaagcgctgatagtaag

SEQ ID NO: 55958 - DNA, 1926 bp, Bovine  19866880937071
aaatgcagtgcacacatttgtatctcgtgattggacatgtgaccaagtgatttgtgttgacagaatggttatacgccactgcacatcgctgccaaaaagaaccagatggacatagcgacgactctgctggaatatggtgctgatgcaaatgcagttacccggcaaggaattgcttctgtccatcttgcagctcaggaaggacatgtggacatggtgtcactgctcctcagcagaaatgctaatgtgaacttgagcaataaggtaacctttttttttttctctgcaaagcataccatgcaatgaaacctcacctccagaaagatcactaagaaatcatgaaaaattcaagtcaagtagaatgtggaaagtgtagtatgcacaaagatatttaccaaaatgttatttatcatagaaaaacttgaaaaaaatgtctttaaacaataagagaatgctgtcagtaattgcaaagtcatataggtgagcatatatgctatagccataaaaaatgaggtccataaaatttttctaataatgtgaagttttgttataatgttaaatcaaagggcaacattctgacctcaccagaatacagtaaataagaagcgataagctgtaaattacaagttgtaaggtgaaacatttgaggggtacctactccttgcttgtcctagttttaagtcttaggttacaaaaagaaattaggagcaggtctgccttcagaaagttcattttagtaacagaaatttagagtagctcttttattcagtagatcgaaaagttagtctttgtaggtaaattggcagttccaggcaaccctttaagtctctgttcctcaaagtctttagattccccacccttgcatttgactctccttggttagtaaaaaggtttgtgaaaagtccagcccacagttagcaggaatgaggttacagcctctcactgtgttatcagagaatttggttatgttgacctgcttattaatacctgagtctgagatttacccagaattccagactcatgttcctaagtcttcagatagaacagaaatctgcaagagtttcctcaaatacccgataatccaaactccctgacatttagcttttcctctacaggatggtgacgtcacacctgtgacatttctcagccatagctcagatattggaggagagtttcaacataacagtagttttatggcaatgagttataaggagttttaatattttactatatgtggcctatactttgtaatcgtggaggctttaaatctcctgggtatgaatcctaaatctgacttctgcttgatgtataacttgattggacaagtcatgtgacgtctccgagccttagttctgtcctctaataaacgtgtccacaatatttacttcctagaaatgtcatgaaggtgaactgagataacatttagtaccttcttctaagtagaaaaagaataattgtcttaattttagactttttacagtttgggggaaaggttacacactaatcttaatcaccaaggcgatttaacaaattctataaatgaaaagacatacataagtaaatggaaaccttttctcacttttcgtatcttaaaaatacttcgtgatcattgcagaacaaacacaattttctttttttttttttctctcctggtttactgattttcttttcttatatctttcttttcaaacctttcttttgggatgtgtgtcctagcattaatgggaatcacaaagcaatttcaaatagtcattataatcagtgttggtttgagctgttgaatttctaaggttcatctactaacgtacaaaccagatttataatagtctgttgtaaaattctacttgtcttagtgagatggaggacctggtgttctcagattgaagtgccttctggcttccattagtatatgttttcttagaagcccag

SEQ ID NO: 55959 - DNA, 797 bp, Bovine  19866880961677
tttgatatagaaaagaggatttagagaaagaaaccagaaaaagaaaaaaagaataattggaacttatacaatacaaagagaatttctatttgagaatatgatccaaatctggcccacagatccgtcacaatctttccaagccacacggacggttcagaaacaactcagagggcagtgggagctgctggatcacgggtcggctagtctactacaattaaccctcatatttatgtcattggtttcttctagtgtgatagcatttttcacttgacaaacattctttcaataatcaactgcagaagatttaggccgttggttatcaactgatatcaaccgggaagtggaaatgccacttccagactcttctgaaaccaccctctgccaagtgggatggatgggtcagggtagaagatcttatatccctatttttagttttgatctgttgccatctggaaaccccagctgacctgagaagcatttggccctctgctcagacacaccctaaagagatcgtcttcagagccgaacgcagagctctggactgagcccaactctacagtgagtgacaggaaggggtgagctgttttactaccctccccatccctgaagaaaagggaagattcacaaagcagtgctaggaaacttgattagtcaagactctaacactagctaactagagtggtaagcacagataaagtcagggtccagcttccaaccatgcatcttatctctttttgcttttgctactgacataaccttctagttcagcttcacctctactggcgattgtgacaatc

SEQ ID NO: 55960 - DNA, 787 bp, Bovine  19866881310588
ttccaaaattcacccccctgtgattctttagactcttcagtagagatgaaagttcctggatcttacttaacatgtgagaaaaaaagagtaatgagtgatgacattttgagtgctccagctcttccaccatgccagctgcccctgtctctgaatggctatagtcccatgaggtcaaatatgttgctcaccctctagtccctgccttgtgcttggagccctagtggtgcatggtgactaactggctgatactcagatccttgtaggaactggaagtaagggagaggagctactcacctctcggcatccaactcacatatttattgggatagaaccatgtgttatgattcagttcatctgcagtcgctgaggtgtgagaacttctgactcctacatacaaggaccaggtcatatcttcagacatgtattaatatatacatgcagaaatagaaaaaagggtgaagagaggctctcttctggtgatgtgagattatgagaggttcagacttgccctggatttttccaaaccttccaaatccaaactgggcttggaccctgcaacctattcttcccacaaggtgaaatccccaaatggcccttgaataagccccagctccatctttccaaattcatccgtgtcagatacctgaggagtgccaagattagtatctcgttgtggctgagccagcagagagagaaagattaaatatcctgctcatcttcgttgaaaagggagactgtctcactgttgtctaccagtccttgatccttaaatataggctgcactgat

SEQ ID NO: 55961 - DNA, 1687 bp, Bovine  19866881369819
tactctggggctataataaaaagaaaatatagcaaataaatatttgcattaagataacaagagttggcaaatatattttgttttataactgaaaaggccttaacattataaagagaatgactattcaaaaaagacatgacagattttaaattctcttttgttcaaattaatattgattaaacttggttattgcacagatttataactgagaagaggtagtatctgtatattgtcacacaaaagaaaataaatttagctgataagtaaatatcatactaactatataacaaagttttcacttcagtacaagaaactaaagggttggcaaaagagtttcctttttttcataaaatcttgtacatagatagtctcagcagtaaactgataagttttgtgatttctgttttaagctagattatataaaattttctattttctcccaacttcttagagtgaaaatcattaacaataaaattagggagtctcctaacagataaacatgtatttattaatggattattaaaccaaatctacaaaatcaaacacatctgagttggaagatagaaagtaataacaagaatttctatctggtattatcataaaatacctttataggatttaaaagtaattcacagctattgaaagatcttattattaactgcctctaaattgtacattaaaattatattaaatttgagctttgctcaatattattagagtctagattttttttttttggcatgagcattatttaaaagttcaactttaagacttgatttttcatcaaggcttaatggtaaaattagttccataaaggcttgattattagcaacccatgagaatttctagcattggcaaaggtatacatatgtttatatttttaaaaggtttgtgctgcaaatctttcacaataagaagctgtaaaatcactggaagtttcttccataacacaactaagcagtcctgtagaaaaatctctaaagaactctacagaaaccccaagccaaacagaaggagcaagaggtttaatgatcatttgggaaaatgtaattatctacaataccctctctgcaaggattttatccatagttcagctcatgcagacgaactgttcagtcttcaagccagagttgaaaccaggagatgaagaatccttattcattgtccaaccaagcccagtccagcaagagtacatgctactctattgtgacgcgactcctgtgtgatctgtatcgggtcagtacccttccagagtcactgcttaagggcaggataatttcaaattcagtctgtcgttttactacatgctttttcaaacagcatgcccaccaaaacagaaaaatgctgcacatatgggctgagatcaaatgctttcaccattcagttgatatattctgacacaaggcagaaacaagatggtctgcttttattcattttttcctttcagatctcagatctttcctttttaaattaatttattactttgtaaaaggccaaagtttttatatgctttaatatctgtcatatttgcgcttggctcaaaacttcctagcaattaatatttctcaaagtcaagtctcactaggtaatcagcaaagtgtcattgtattctaaaattttcagctctacaactaattgaacagaagtgcagtatctaaaagtcaaccttcaatagagctcataattt

SEQ ID NO: 55962 - DNA, 1417 bp, Bovine  19866881371257
ttgggaactgcctaccgggtgtcagatgctccaaaatacccagaaggaatgtaagggcttctccagcaggattgcacttgactggtgttcagcttggccttggctggttgcggcagggaattcagagcagagagaactggccttccctctccagcactttgcagcccagagagttgtgaggtgcggaaataaccaacatacaagtggaagccagaaaggcggtccaggctgacaggtgccaaggttccagggagggctggcttaccttccaccttccaaaataaagttcatctcttatggtgaatacctttaagggaaacaatgtgtcgtattcactcacagtttaattagcttagagtttattttgtaaggcagcgatggagagaactgttgctcaatttgtctgtatccaggtggcaccgaaaggctttttgtttgtttttaattttcttttaatgtggtgatgattgaaaagaaatgtcagtgatgtttttaatttcataatttacatctgcccatagacagaaattatctgggtggttttttcatctattcctattacactccggggcccacccactttccttacacagacattattggatagaccaaatttcttaactctttaatggtaactgtgaaaacaaagccttcttaaggttaaaatggattagagatactagtttatgggcagttgcaaactccggttttgtaaaaaagcagtgttgatggatgggataatcttgcacacgcatctgctccagatcagaccagcctccatgggtgccaggtgtgtgtcccgagtgagcgggttaacaccctccggggcatctcaggccacttgggatcagatgaggccattcggtactgagtagcagagctgggatatttagccagacagatgtagctcataattcaaaaaagttttccatagaaggaaggaggaaagtgagagaaggaaaacagcatgggctaagggtgaggctgaggaaagttcttagaaatctactacctgcattaaacccttcccatgtttatttcactagtgagctgagtcttgggcagtcaaggattttgagaatgaattagaagggctaaaatagtcctgagaggatggggaacacatgtatacctgtggtggattcattttgatatttggcaaaactaatacaattatgtaaagtttaaaaataaaataaaattagaaaaaaaaaaatagtcctgagagaaaaattacttggtgttttaattatagaaagagcttctcaacgtatgaaattatttgcatataaacaatgttttttttttcccagttatcttaatacactaactcaaataataacttattctattgagatttttttgtttgggtttttttttggttcttcactaggcaggccttaatttatctaaacaa

SEQ ID NO: 55963 - DNA, 998 bp, Bovine  19866881392778
ggaagggagtccggaggcctagagagaggagaacagtggaacaatgcagtgacagaggctccttctcagctgcctctagccccttgcagccaagacctccccagccaacccaagctccctccgcctctcgccttctccagggactcctcagggaaggaggaccagttagtgactttgatcccatcagagagatgaaagagttggtgcaggagataaaacagagcctccactccatttcccctgcttgtctcacttctcctttcctcccactcgagagagaaacagcagtgatgagtgctttctccagcactgcttggagagctcttgctgcttctctctgccccacagtttcccaacctcaacccgagggcaggccctccctccccctctctctctctctttttttcccctccttccacctgacagggaccataaataacccaggctcctggtgtttccagctgagaacaaaaagttataaagtttgcctggagctctctgccactccctgccggggccacttctttgttttcttctcctgtttttcctctctacctgctttggccgtttctctcttcaggttggagaagagtcgcctccccattaagtgcagtggctcgcttgctggctctccctagatttcaggctgtctcggctacccggattaggcaccgggcactggtatcaaattaccgaaagtctactctggagcagtcctcatatttacatacaaataagtctggggctcgcatttatgtcaccattcggttctgctagaggcttgccagaggagttgttaatccaatcagaaggagttttaaaaggatgtcttcggagtgatcaaaaaggatcttgatctcaatgaaatgtggccagatttgggggggatttttttttttttttttccatctgaaaagctgaaagtctgttaacactgatgaataggaaaagatgtgtaattcttcacttgccggcgaggagacgaagatgctgagagg

SEQ ID NO: 55964 - DNA, 674 bp, Bovine  19866881817510
tttgtctttctctactggctgagtagtgattatcctgaatgcaggaattcccatgacaaggcagggacttcagcactgaatgctttagatccgagcatgagtattgatcatcccctactgatactctaatgcaggggagcaaataggaggaatattctgggtcactggtgtttaattacagcctcagagtgcttaccttttgggggctgtgcccttaaatatgaatcctagataccgatttggaaagtgaggcccgaaatcacttttcttccatgacagttcataaaaattgactaaaactctgtgatctgaatatggaagtcaggtcataaagcatttttatgtctctttgtgagaattcccaagggaaagatcatcttaatttgctctgagcagtgatccacatgccttgcaaatgacatgcagatttcatccaccacatgtaccttccttcaggagtaatcatgaatattttcagggcctttgctgttttcttccaagtaaaggtctagagaaacctctttgccttttgttactggcagactttctgagactgagttcagagagttgtggtggttctgccacatgacattaaatataggtgtttcctgcttcagggttcttgcaaaaaaacttcttgaacatattttcacagaagtacagacttaagttag

SEQ ID NO: 55965 - DNA, 1344 bp, Bovine  19866880446343
cagatgagatcctcataagggttcctctgccttcaaccctgacgggcctctggaggagctttttcctcccttcccgaaacaccctgagaatgagcagtcaacccaaggaggaagagatttcggtactcacgtggagggaggagctggggggttgggggccagggaggagggcaggtgcaataagccaaggagagccttggacttcccttcaggcctgacaggtacacttccagggaaattgaatatgtacatttcagcttcatttgcagttaacgcatctggttagcagtgtgcgggaggcttttgatgtttgcgtcttggtgcccaaacctttttaagcctcttttctttgaagccagggagatttgtgtttctgccaaggagtagacagacttgcatatcctccagtgcctcagtctttggagacctggctccttaagggccctgggaggctggggaccctagtttttcattcaggacttagtatgtgaaaacttttggaaaattgcctttgatagaaggggatggggagaaacctggtagatttcagaatgggactcaccaggctcacctttctaagaagccaggcaaagaggctgccttccttcaaagcttctggagtggtttttgtggacttccctggtggtccagtggctaagactacacattcccagtgcaggaggcccaggtttgatccctggtcagggaactagatcccacatactgcgactaagagtttgcatgctgcagctattaataaaaaataccacgtgccacaactaaaaaaggaaaagaacctgcatgctgcaacaaaaaccaaagattttgcatgcctgcaaagaagacccagtatagccaaataaataaataaaaattttaaaaaaatgggggaaattgtatgggaagggaaagttggcatacaggagttctctacgctttctgttcaagttttctgtaaacttaaagctgctccgaaaataaagaccattaacttaaaaaaagttgcatctcctcctaactccttcttgtaaacccagagttctttggagaacatcatgcctacttgagatgggatctggaaagacaacatcctgctcttgaatcctgggagctccaagaggaagtcgcatcagaatctcattaacactggaaacgaggaaaatttggatctgtgtgattcagagtgaaagagaagcaagtgactcagaatgccagatagggaaaaaagtctatttacatactcaatgaatttctattgagtgccagctatatgtcagaaactgatctaaaggcttaagagacaatagtaaacaaattaattccctgtcttcatggggcttgtgt

SEQ ID NO: 55966 - DNA, 750 bp, Bovine  19866880535063
cgcggctttcttcctccccaacagtcctgcaacagcagcagcagctccagcataaaaatcccaggttaggcgcaaatgaataatttctttcgcaaatgaaagggaaaatccaagcaactttaatccatctagagaaggaaaagtttccgtgcagtgctgagaccggcggcgcgggtcgccacgaccctagacaacgcccgcactgagggccccggggtgggcggccagcggctggtcccttcgccgagctcccttgcttggctctctctccagtctcgaccagggcccgggctccacacgggcaggctcagcgccgcctgcccgggcagcggcaccgcggctggggcgagggtggggcggccggaacgagctgccccatgaagatggggtttggagaagctacggagcgggaaggcgggctacatcgcccgagcccagcctttcctgcccccgagcgccgactccagcctcctggccgcgagcgtagtgggatggagaggggttcggccagctcgcggcaacccctggtccgcctccctgtcctcccgggtctcgctgtctcagccgaggggcgcgctgctccgccgcgctcctcgccttccccgggggagcctgcacaaaccttgaacttttccggggttcagagtctccgacgcctccttctccccgccgcccccgccctgcccccggacgcccgaggtctcggtgcagccgggcatccgcttgtgctctctcttcctctcgcggagt

SEQ ID NO: 55967 - DNA, 1302 bp, Bovine  19866880568651
cccatatttactgaaaatgagaatttgcatttagcaagatcttccaggagactggtgtgcatattaactgttgagaagcactgggccagaggacagagctgtaggaggcttgtctattcctttaagaagatagtcagattccttttgtattatgggaaaggccttggaggggttttaatgcaagaccttctggaatggagagaggatgccttgggaggagactaaaagtgatgattgtcatcatgtcatcatcttcaccagtttattgagccttgactacatgcagaacactacacttgacattcgtgatctcgttatgtctctacattgatccaaccaaggatctgtcatccttattcccatctaagagatgagaaaacccaggctggagggacaacacaactgacccagatgacacaggaagatctgagttctgactctacttcgactttggccaaaatacttgggtctcctggctaggctgctctctgccttcaaaccagagagaacaaagcccagagcctcctaggaagcaggtgagagaagaatagcaaatatgcaagaccgcaaggtccttcgaagccgagatgtcctatttctaacgcaacagaatcatttaactgataaacatggatgctgtgtcaagttggcaataaattgccttgctatcaagctaggcctttgtgttgtgttcaaaagaaactaattaaaggaatttttctttaaagtatatttgacccagacatttccacatcggcctaggaagccaattcagtttgaaaacttggtgtgaagcttgaattattaacgcacacatgaaaaatgatactgcatatttgctttagaacattttggggatggaagaggattaaatgtatctctggagggtttggccagggctgggggtgggggaggggaaaagcagagaaggatgtgagtgtgggcaaatgcttgtaaaacatacatcataaaacttggcgttttatcggaactcccgcattcagatgactgagacaaattttaaagaaaatttttcacagctaatacataaaacatgatccttgcagtctccctctttaaacagctttgttaaatagtcagttgaatgacatctcccttgcagctgtgaatgcattagggaattgtatttatttagggaatttcacctgatcgccttgaactgtttggaaaacattagtccgttcaccctcttggcacctagtgggagctgtggtaatgcttctggcttatttctcctcccttggtgctggagcggctctgtgaaaagtggacttggcagaa

SEQ ID NO: 55968 - DNA, 1850 bp, Bovine  19866880653570
ccatggtgatgagggcctcaaaaagtccttccccataggccaccttgccgagggccgctggccccgcacggcccctgccaggccacctgagcggctattccccatcacacaagggccaggaaagaagttggcggtaaggccgtaggcagaagaggcacccgtgcaggcagagaaaagaaaatgggatttggaagcaaaagagccaagcttgagcttcaccctttccttcctgtgtaatcttgagcatgtcacttcacacctttgagactcaatggctttggaagtggggcttccctggaggctcagctggtagaggatctgcctgcaatgcaggaaacccaggatcaatccgagttgggaagatcccctggaaaagggaatggcaagctaccccagtattctcgcctggagaattccatggacagaggaggctggcgggctttcaaagtaaaatgggaatgttagcacccaccgccgagggcccctgggagggacagatgagccaggggacaggaacttggtttggaaagtgacttaggaccccctcccccgcatctgcccacgctgccacgtctccacccactgactgcaattccactaatgcaaggaggtaaaaaaatgtgtcagggctttaaagatgcctgttcatcttgctttgcatgcatttgcatattgagttcaagaggctcgtcctaattctgaggatggaaaataaaataaattaacgaacgtgagattaacaaatgggactcctgctgcagttgtctctccggctgctccaggcttgacacctgggagacaatgttctcagggcaatcaacatttaatcctctctggaccctgcccctctgacccccagccagaggtcagtactgggggagctggaggtggggagcttgaaaagtgggggccaggcccaggccccggggcaaggagttcccctcagcttgctccgttgtgaatctgcagtgcaggtatggtgttcaagatcatgccccccggaccacgctgcctaggtctgaatcccagctctgccacatccagctctacggctttgggaaagtcacgaaacctcttggtttttcaaaacccttgagagtcaaacaggaaaaattgtgacacctaacgcattgagtttggtgtgagggctgaatgagttatgtatatagtacttagagctgagccctgaataggcaacttcttggtaagtgtcctggtgtttatttatctattttcatcatcaccatcacctcaacatcaccatcaaagccatcaccatcatcagcatgtagtagaaaatgtctacaggactaggaaccagagacccaattcttgttctcactttgcccttcatccactgtgtggctttggggaaataccctggcccttctggccttcgttccccaaagggaccgacccaggcccccttcaagctgtgacacaacacatcgagctgagaaagctcccagcttgctccaaggctgcctgagaacagactctggggcatcttgtcatatgcaaaacacatgtaaaacacatacaaattaccatctccattgcactccaggctcctacagctcctacacctgagaagggccctcggggccatccttgtgcaggcccagaagctgggacactgcctagccaccagctccgtcttctttcttccacccctgcccacattgcccccctcccctccgccactctgttctccttactgaatccctcaccacctgggagatggcagatcacatatcaccaagatgtacatctgccctatgctgggcccttcacccatttttttttttcacaattctctctcatcgcgggagggtgggtgtcaagacccc

SEQ ID NO: 55969 - DNA, 1852 bp, Bovine  19866880723347
caggaaggggttgcccattttggcagcaggctgaagaactgaacagtgaagggcctcaaagcctgcctggggcatggagtgcatgcccacctccttcctgctttttttttttttttttaattattcatttggctgtgctgggtcttagttgggatacacaggaacttcaatctttttttttttttttttttaggaacttcaatctttgttgtggcatgtgggatctagttccctgaccagggatcgaacccaggccacaagcattaggagcaacgagtcttagccactggactatcagggaaggcccaaccaccttctttttaatccatgacgtcccctgacagaacatttagactggatcttagtagggtccatcaacgccactgataagaatccagccagcattgtggccaataactctattatataacctcaaccatctgagaaggtgacccccaaaactacttgcaaaagcataattatctccttaatgtgtaaagatctttcattctcaaatacagaaaagtttgaaagactcaaccccacgggatgaatatttttagatgctgaagtgaagagtctgtgcatattggtatttcaatatttgtaatgttggagaatttggcttatttgagtagcaagccagcctttgatgccaatctaaattgtaaaaattgagttagatatgtgattttaagttgaaaacaaatcatcaaactcatatacagtcttggaacatttaagataatttcatattctcttggatttataagaattacttaaaattacttgggaaggtttatgagtcagataataaagcatactacttaaatttctcaaaaagcattttacatatgtgaaggtgtttgaataggttggtaaacgaaacaaacatcatcctaaagccccttaggaaaaaaaaaaaaaaaaagaaaatttataagctaaatctcaaaacttaaggaagaattagatttttatgaaatttataactttaataaattaaataatccttttaaaacccaaagtacagcagaaaccaacagaatactgtaaagcatttaatcctccaattaaaaataaaatttaaaaaaacaccaaaatatcttctggatatttttttctgtgcatacaaactgtcttttgaggattgaaagaaatctcacgctgacatagagtgcttcctacatgctcagagctaatgctttaaatgaatgatctcatttagtccttacgacagcgctataaaagtaggtactatcattatctccatctccgggcagagaatgtgggagccaggattctgaactggggcagttgaaatttcagagccatttgtcttaatccctgtgccacaagttcctgtgtaagaaaagaaacctgtctcagggctggctcagaaacaccattaaacagcctggtagctggcctcttcatcctacattcattagtgcctgagtcacagctcctgtcctcagctctggacttatctctatagctctgcttctcactgtgtgttccaagaaccagccgcctgggcatcacctgagagactgttaaaaattcagtgtctcgggctccacctcagtctttctgaatgagacctcgtattcacaggctgtccccgggatgtagctgcccacccagttagagaagcctggctctatagtattatgaaaacttaggatcagcctcgctctacctggcaaaacaagttgctgctccactgtccccttccccagagaaccccacctcctgtggtcaagcagtgttaataggagggatgcaaagccacttggcccagccgtttagaggctgcgaggctcttccaccatcaaagttccgccagcca

SEQ ID NO: 55970 - DNA, 796 bp, Bovine  19866880768391
ctcagcagagtccttgacagtacagaattgagcttgatgacaaatcacagtgaacaatgaccgcagtctcattccttctgggactttctcagcatttctcagttgcttagtccaagagtcagctggcatagccctgtgtctactcattgcctgggccaggatggagccaagtgtcttgttggacaaatagcctgtgggcctgaatctggctcctctccataccttggagataaatcttgatgtgaggttgaggaacaggtttgggccatatgcttgcctggcaggtgcttcacaaaagctcaggatgcataaagtaaggctttaaaagcagtgagcttcagaggctctttcccgttgctcctcctacctccctggagctgcgtacaagagccagtttgccgtgctgtgtttgttagtggcagtgctgttgacatctgggaggcactgtttattgtggtattgttctctccactgtggaatgttgcacattcttggcacctgggcactaagggctggtatacccccattcattgtgacagccaagaatgcccctgcatttctagaggtcctctggaagatggtcccactaaaggaagcttgaactgtctatgatccgctcacttgtgtatcattgcttgtatgctttgtcttcactaaacttcagcctcagttagtgctcttttgacctcacccccagtcccagtcagaggatgtgacaggctatcctgtggggaggatggtgttggaaaccccaggtcatggtgttgtctttgtgaagcggggttgtgcttggcag

SEQ ID NO: 55971 - DNA, 1886 bp, Bovine  19866880779298
cattatgatttatcacaggatattgaacatagcttcctgtcctatacaggaggaccttgtgatgtatccattctgtatataatagtttgcatctgctctttggaaaatttccccaacttctctctccctccccgcccctcccccatggcaaccacaggtctgttctgtctgtctgtgagtctttttgtggtttgtgagtaagttcatctgagtcctattttcagttctacatataaatgatatcatatggcatttgtctttctctgacttcacttagtgtgataatctctaggctcatccaagttgctgaaaatggcattatttcattcttctttatggctggataatattccactgtatacatgtaccacatcttctttatccattcatctgtcagtggacatttaggttacttccgcgtcttggctatcgcagagtgctgttatgaacataggggtgtgtgtgactttttgaatgattgttttgttctgatatatgcccaggagtgggattgctagatcatagggaagctctgtttctaggtttttgaggaacctccatcctgttttcctctgcggctgtatcagtttacattctttagcggcattttaagcaacatcaacaggaatcaatcttttgatttttttttttttgtctctactagtttccgccaatgtcatgtccctgggcagtgacaaagtcatagaagagaatttggagtgggatttacagaacatcacaagatttaggagaatcaccattttgaataagcaagtggactttgactcctcttttttctttttcacaactattaacttgaaagtgacacaataaatttttttcagtaagaatatagctgctcatggccagaacattattcaggacatctgaccttaaggctacaaggaaaacaagacagtgggaaggaaattatggaaggcattatgctgaattctgcattttgtaacatctgccttatcttagtcactcaagatcttattccatttgaaatttctaggggatctctagaccagtgcgacaaactacagcataaatcttggatgtgccttgcaataaatcacaagattcttaatcagaacatgattcttagattgaaaaaatgcaatcattttataaaaatgctgcagtgtactgtttagctatatttttataatatgaataaatctatctgaggtttccagcctcctccccctcaaaaaagaccctgggtgatggaatgaaaagcaaaggtctcaatcacagccttgtggttgatacaataataaaacagccagcttcccagggcaggagtatccagctctgcctgcagagatcagggaagccttcccagaggaggtgactttggactgagtcccgaagggtcaataggagattggaagcccaccaagggagagagagtgacaggacttccaggcagatggaaagacagaacccagtgcaccagatgccttctatttgccccttagaaatactctttttgctctgctctgggtcccctggctggactgagtttagctaaggggatgctgaagatgccaatgtgttacccacgtcagctaggattgaccttctgcctgaacttatgtggaatccttatatggccgacagagagagaaagggagagaaagagagaggtcatctgccatgtgtctcttttttaagggcactatcctcatctttagggccccactcccatgacatgattatctctccaaggccccacctcctaatatcattacattggggattagggcttcaatgtgtgaatgtggggttgatggggacacaaacattcagcctatagcagcaggttataaacaaagagccccatccagcctgctcatcagagctcttaattattccag

SEQ ID NO: 55972 - DNA, 1346 bp, Bovine  19866880869902
tggagcgaagtgcagagggaggggctgctgtaattggtgatgaccagcagccgctggagcaggaaaccttgggtccccagcagaggctggtttgtagggggctctttacgtcccccatttgacccttcccctgccgtgtaagctccttatcctcgggttggggctctctcatactgtgctgagattgtgcaaaattattcaactaaaatcgtccagctggaaaggcaactgagcaatcacggtttactgctgagaagccctaaccttaacgtaggctgggaagcaggagctcagcggggctgacaagctggctggtttcagtcttaggagccccagcacctctcccccagcacgtgtggtcagcagtgagtcccgggagtccagtgaccaggcaatctgagcccctctcctcggcatcaggccttgcaggtgacttcagccagggcccctgttttgccggctggagtggctggtacgagcaaaggagtttggagctgaccgccattgttctcgggcttggagaagcgttttcccttctgcgtctggagggtaatggggaagggagacagaggaggaagtgagggtcaagggtgggagagcaggaagcgggaggggagtaggggtgcaggaagagagccaggaatgaaagcagcaccctatcagggtgtgtccaggttccttctgacccctgccccgcacccctgcacgcacacgctcatccaggggaaattgctcctgttgagttaggattctcgactgctgtggctgaatggcttcaatcctctattttcagatgaagaaactgaggctccagagggggcggggggaactggaaacatgcctcttgccttccagttgagtgtcttcattctcttaaattcctagatgagtgagcttagtacagaacaggaggaaaaaaaaaaaaaaaggcaaacgctcccatcagggtcaggatgtggttcccctgagcgggaagtgagaagacgcctgtgaggatggagacttctggcaaagtcctaggtcctgggtccgggagatggtttcctgggtgttcactttagataactcgttaagctctacaggtatgggttattcactttagggtacttgtgctatgtttcacaataaaaaaggtttaaaaaccctaataaatcttgctgaaatcaattacacatacaaaagaaagctaaagaggcctcgggaggcctgaggaggtccctgtccacgtttccagccctggcaggtgctctgtgctgcagctgcctcccctgggaaatgggtaccgacatccccacccctcccttctgcagggaagtgagtctggggttgcggaggggcagaacatc

SEQ ID NO: 55973 - DNA, 2112 bp, Bovine  19866880924138
caccccccttcactccccttaccgtggaaacccagcaatgccgagagctggaatttggatgttttcccagcattggggctgttaattaaaactaataaatctgtcacttggagttgggttgaagaggagaaagggtgagacgggagagggagggggaccaggctcctcacacacacccctgcgagcctctgtcccttttagtcctgcctcctgaattatcttctcttttggccacttcctcattccacgcctgagcctcccagctgccagccgcagcctcttcccaggcacactctgcttcatagaatggaggaaggaagaaagactggcttctaaggcaagggctgactggccaccccctgccactccatgggatggagcaaaaagcattcaaaccacctggacaaacccgggttcaaatcccagcattctagtcatgtgaacctctgggtgtcatattttcctctccaaggttccctttcttcaaatctaaaatgcagattatatttcctcctttgaaagaatattgcaaagatgacatgcaaaagtacacaaaataacctgtcaccaacagaacggtcgctctctttcctggtctctgtgatctcccgttctgatctccacttccttctttcccatctcccctgactcccagtctcacaaacactatcagtcatgttagtaagaatagaaataatgccaccttagatctgcagagtgtgtgtagtcactcagttgtctctgaccctgcaactgtagcccgccaggctcctctgtccatgggatttcccagacaagaatactggagtgggttgccacgtcctcctccaggggatcttcccgacccaggaatcaaacctgggtcctctacattgcaggcagattctttaccgtctgagccaagatacacaggaagtgctcagttaatgtgccttggatggatgaatgaagtgctttcacagctgcgggggacatccattccacttgtctgcccaatactctgtcccctttatctagtaatggcttctccttcacttagagaactgcaccccccactccaatcccactgagttttccttcctcttcctgctgtgcagatggtcatgtgaccaggctggtccaatcagagcctttcccaggatttttctctgggggactggaagggactctttcctcttcactcaggaggtcagagcgtgggtggcccagcaccagcttttctcactgacaagggtgaagttatatgcacagaaagacagagatgagagttgaaaagaggttgcccaggtccactggttctcctatgactgggttatgtggaaaaatgaaattcccgtgttttcattaaacagtaaagctgagattctgccattcacagccatcaactcacaaaacatctattatctcatctaatcttctcagtaacatccccagccaagcccggagggattgtccacattttatagatgagaaaatcaagtctggagaaagtgaattcatttcctgaaatcacacagctggtaatgatggaactagatccggtaaccaggagtggtcttttatccagagtgataggtgctgtgattaggggcccctatatatttaattccatattatcaataacccagtgacatcacctgctatcaatatctgccctcacacagatggggaaactggttggagaagtaaattacccaacgtcaccaaactggtcttggcctagttctgtctgcccagagccagtgccactagtcacctgctgcactgcctctaagtccagtctctgaggtcacctttctgggacaggagcatctcgagccagtgaaagagcacggggagataatgaaggaccagggacacgtatggttctgtgcaaggactctggggatgcagagacggcaaaccatgctactcacctcaaggaaccccaagacatgtctataaattccatgctgcagactgtgagggtcctaaaagatgctcaggtggcgtgctctgcagcccaggggaaggagaggtgactccagcttggggagggaaaggaccaggaaagcgtgatggggcaaagagcactgaaacagggccttaatataggtaagatctgtccatgtg

SEQ ID NO: 55974 - DNA, 1632 bp, Bovine  19866881202667
ctctctaaactctaggcaccaagcaaaatgtccaggaatgctgtggatggcctagatccagtcttcctactgttatcatcttgcaccattgccttcagtcaagggcctttcttatctggacctcaattttctctgctgtacaatgggcgctaggacttgaagcttcatttttatttttttaaagtttttttatatatagaccatttgttaaaagtcttaattgaatttgttacaatattgcttctgtagtttgtgttttggtttctttggctgtgaggcgtgtagaatcctagattcctgaccagggagtgaatcctcaccccttgcactggaaggggaagtcttaacctttgtacagccaggaaagtcctaggactagaagctttagaaaggcccctttagccctggcactccagggttttaggccagccgaggggtagggttgcaaccctccatagcaagctgagttggtgtatccactgattttctgtatcaaaagaatggaaaggatggcaatgagatgagcttctccgggggccaccaacccaggcctgggttaactggggcaggagagagtttaaaagccacagatgacatgggcttaaattaagagcagcctctccatggtgcctgtggagctgtttgccaagctctgtagcatatttgcaaacactccagaatacacatattaggaagctaacaagttgcctggcattgaaaccatattacacacagtgtcagatatatttaatatgcatttgcaatggttctttttttctcccccgacttgcagcagcaaattttgcttacttttttgaagagtttatttcccatgatgctacaatcagccggtggttatgaactcggcaacttggccaggcttggagcagtaccatgtacaccaatagcaggcaatggatgcttctgggggcaaatcacactctcagcagggctggccttgggctctctggtcacctagagccgccaaggactacagctgcactttaaatttctctcccttggagaatgcggtaagaaccttggctttattagctctggaaacatgacttcatccactcagagaacttcttgtttcttggcaagtcactcctggaaccgtcctagcccagcctgaagccctaagtgttggatttctcaaatccagagaaataggaacgctgcagctctggctttcccccttattagctgcaggaatgtctttcatgcttctaagccccagatttctgggttgtgaaaggaaggtgttatcggccatttttggagttgctgtgaggatttcatgggcttgtaggcagggaaggcatttgtattcccttatttagacatgcacacattcctgtgacacacactaagtggatgacccttatatgccaagcgctgtgcttgaatgtagtgcacagacactgcagataaggtggctgtgggggcccacggaagtgatgggatgaggtagtggttgggggcaggggggagcgggaggaaccggcttgggagataggtctcaggaaggggggaagtagggggacgtataagataaagaccaggagtccagcatgcacaccggggaatactagggaccacacagaggccgggaatacaggaaaggagcag

SEQ ID NO: 55975 - DNA, 1646 bp, Bovine  19866881270409
tgtcagatttctaaaatatgcatacattggaatacacatgtatgtgcacatatatgtttttgtgtatatacaaacacgtatttcccagttctgtctgctcaaagggcccagaagcaaggatatctcatgcacccagggcacagagcgtcaacatttttgtctctaatgtcatttcccccactaacaggaacaaggactcttcagagaaatggctgatttcacggctgagataggtaatcctaagagtgagcatactgttaggccagaaagcaagggggtactttaaaacaatttttaaaaagtgatctggacatcaaggacaaaaactagctcaaaggggttcccaactgaccaaatatgggacaatttagcaccaaattaataaagtacaggacaatgataagccaccaggaaaaagtagcaatctgagtccatacagaaaataagttgagagagaaaagggagtagtgtaggtactcttttcttcaaaaatgtcaatgtcataaaagaaaacaaagacctcagagatgttccagattaaaggaggccagactcgacaactcagtgcaatacctgattttgtatcaggattccatactgaagggagaggaaaagttataaattatctgatcaactgacaaaactagaatacagacggtagattaaagcattatatcaaagataaatttactggttgatagctgtattacagtcatgatatcctattcttaagatatacacattgaagtatttaaaggcaaaggaccatgatgcatgcccaaatggttctgggggaaaaaaagtcacctgtgtggaaggagagagtaacaaagagagcgaaagagtgagcacaaacatgaacacaaatgatcaagcggagagcaaaatgttaacaggtaaatctgagggaattccctggaggtccaggggttagaactctgcactctcactgctgaggacctgggtttaatccctggtcagagaactaaaatcccacaagcctcacagcacagccagaaaaaaaaaaaaaaaaaaggtgaacatgagcattctttgtactatgtactatttttattcttgcaacattcctgagtttgaagttatttctgaacaataaacttaaagataggatgaaagaaattgagctctactctcatctcgtggcctctcagagccagtaagatgagaaagcagtattctccagcccacctgcaatgtgctgacttatctgctctttctcgttctcttccagctcttcccagccttccagctcggtgaggtcctcaattttttttgtggtggcccgggcccgctccagtttctcaaacatgcatttaatgtggtaccactctttcatatcgccccccgactctgaaaagggattgggcaccactttgccgattcggcatacgcccttgacaatcttttccttgcattttttgcagccagccgtgccacgcttggcgtagtccacacagaagcgttgctctgccatctcacaggggccactgcagagtcccacatgcgaccctggcaagtaaacaaggcaggtggcacgtggttttaggttgctttcctggaaggacggaacaggctttcttctctggaggaggtggtgtccacaaaaaactgtctcgaccaccggc

SEQ ID NO: 55976 - DNA, 1804 bp, Bovine  19866881283034
ataaaatgtaaacactttttccataagtttgagattgttttaaatatgaagcactgaaagagtacttttataaattacatatctacacttatatttagtggcattgatgtgggtaattactttttttggacaatcctattaataggaaaggatcgttacttttactttgtataacttactttatagttttatgttgttgtgttagggcctgcaccctagaataatagctgaaggctttgaaattgcaaaaataaaggcacttgaagttttggaacaagttaaaattaaaaaagagatgaaaagagaaatccttttagatgtggctagaacatctctacaaactaaggttcatcctcaactggctgatgtgttaacagaggtatgtagttaaacttttgcagaatgagtacagactaacacatggtgacatttttctttttcttataagataatcaactattcgtgtgtgcttgtgtgtgtctgtgtgtgtgcacgtgcgcgcacgctcagttgtgtcctactctttgcaacaccatggactctttgcttctctgcccatggaattttccaggcaagaatagtggagtgggttgccatttccttctccaggggatcttcccaacccggggatggaacctgcatctcttatgtcccctgcattggtaggtagattctttaccactgtgccacctgggaagcccccagtcagctatgacatgtggtccttttgaacatacaataaaatatagaagacagatatttatttataggcttacttatagaatagatttgattggtcagaacagtatgtataatttttcaaaagtgtcatgttaaaccttttgttattaagttgggcttggctacctgtggatcaccccctctggacaccactggaattatatactggtctcctaaagctagaggtccatatttattatgcaaggttggggacatagttttgacagtgtaccttgtaattgagattaccactttaatgaacatgagggagttgatagataatattcaaatctgggaaatgtatacatgtttacttataaaggtagaatatatataaatatataaggttgggaattctgggaaagtttttttttttatcagatacctatagtttgatgatgtcatcattgttcctccgctttactgtttttgaaacgagtgtgttagtgtatcaggaatgaagagatcataagacattgacatatacatcagaattgtatcttactaatttactttggaaattagaaactgaactgaactgaatttactttgagaaatacaaataccagatggaccgaaacacctgagttctttctactcagttcttcagttcagttcagtcgctcagtcatgtccgactctttgcaaccccatgcactgcagcacaataggcttctctgtccatcaccaactcctgaagcttactcaaacttatgtccatcaagcgagtgatgccatccaactatctcattctatcgtccccttctcctctcattttcaatctctcccagccttagggtcttttccgatgagtcaattctttgcctcaggtgaccaaaggattggagtttcagcttcagcatcagtccttccaatgcatattcaggactgatttcctttaggatggactagttggatctccttgcagtataagggactctcaagagtcttctccaacaccacagttcagaagcatcaattcttcggtgctcagctttcctttatagtccaactctcacatccatacatgactactggaaaaaccatagctttgactagacgg

SEQ ID NO: 55977 - DNA, 1497 bp, Bovine  19866881337526
ctcgtgatcagggcctgcctggtatccccatttgggaagcccttcctctgggataaaggttcctctggggaggtttcttgttcccatagctgtccccctccttgctgctgtggagctcgatccttacctgcctaggactcctcatctcgttgttcttgctccttctggtctgcttgggctcctcctcccacagaggctgtgatgatgcttgctctctcgtcacagccatctatggcctggcctacaagattctgacccagagccagtgcagcaaagccaaatccccaggaaactttatgaatgtctgaacttctaagtcccagggtgaggcagcaggaagacatgaactgatgtttcaggagtccagggaatcctttccttcctgtgagctgaggcccagggtgtggtcatcccggtgagcagtcacacacatcgtctgatggcttgatccctccctgggagggggtgggggaaatgggcagtgtcttggggtctggagtcaggctggagtctctgagctgctcgttttggggacatgggcaaagggtagcaggcattcctggtccttccccgcctccctccccctctgccccttgctggccctgctggcgggtgaagtggaaaataacccagctcttaggggagtgtgtgtctcggctcctttccctggctgctaatggaaccagcagctgtcctcagccatgtgtggctgccctgaccctcggagactgagggtggagaccagctggggggaaaagggctgtgctgggttcgtttcctgtggggcacagagctgacatcaggcagggagcgtggagaaacagagcagtcgattgggaggtggagacttgagcgtaatcattccaacttccatttactgagcgcctcctgtgagtcgggcaaaacacaagtcgttctagttgcattatctcatttaatcctcaatcccgggagacaaggtcggaattgttaacgctcttcctctgtggcaactgatactcagagaggtgaagtacttgccttgagtcacacagctagagggtggcagctggaacctgaactgggactgcttgactctgaagttctttcctggggatgcgggagggttccaagagggtacagaggtgtgtaactcctgttgcacagggctggatacctgattccaccttggaagggaagaaagacaggcgggggtgggggtggtgagagaggggttttccaagggagcccgagagaccgttaggtcctggttgaaggtgcacccggccttacacaggaactcaggaatgtgtgtcctatcttttgaattgtcattaaagtcactcttgccttttactatggtcacactatgggtttccccgatggctcaggtggtgaagaatctgcctgccagtacaggaaacaaagtttcaatccctgatctggaagatcccctggaggaggaaatggcaacccactccagtattctgtctggaaatcccaggacagaagagcctg

SEQ ID NO: 55978 - DNA, 2418 bp, Bovine  19866881372273
acgctctagagcccgtgctgcgaaacaagagaagtccccgcaatgagaagcctgcgcactgcaataaagagtagctcctgctcactgcaagtagagaaagcccaagggcagcaacaaaggcccggtgcaaccaaaaaaaagatactaaactttatagaacctcaatttcatctgtaaaatgtgtgtggttaacgatacctttcagaattaatatgatacaaatgatttctctaaatctctaacctcaggtcggcatacaataggtgcttaagcactttgtccacttttttttttttttgaagatgacttttatttatgtatttatttattttggccatgccgcacatcttgtgaactcttagttccccggccagggatcgaacgcatgccctctgcattggacgtacaacgggaagtcctgccagggatgtccctctctgtgttttctatcatcctccccaagcccctgtgaggtagggagtgttatcacgccgcccctcttcagaggaggaaactgaggcactgagtgaagttacttgtctaaggccaagtagcagaggttgaacagccctggctccactgtgcaccactctctccttctaggtgggggtgtccttccgcgcacacgctgccctcattcagactacgctgctggcggcttccatctccagcagctctgtctttgcctacatggtccgcactctgaggtctgtctccacagctgcccgcttcacaaaacctttcctgatttgtgactagaacggaatttctctccctgcgccgagcctgtgtctttcttggattttaaatgtaaagattgggacccttgtggtccagtggttaagaacctgccttgaaatgcagggcacgtgggtttgatccctagttggggaactaagaggcttctctggtggctcagatggtgaagaatctgcccacaatgcgtgttccatctgcgggttgggaagatcccctggagaagggaatggcaacccactccagtattcctgcctgaagaattccatggacagaggagcctggcgggctaaagtccatggggtcgcaaagagtcagacacgactgagcggctacgacgcacacgtgcatgtggggaactaagatcccattggccacaaagccactaagcccaagtgcctaactagagtccgtgcaccgtaatgaaggatcctgcaggccacaacaaaaacgctgcatgccacaacgaaggcctgacccggacaagtgtaaaaacaaacaaatacataattcaaacaataaatgcaaggatttgggctcaagccctacgtctgctgcttaactgcagggagtgaccatgggtcactggttcaaacgctgccctcacctttgccttggctgtgtggccctgggtggtttgagtgagtctctatttctttctgttgttatgagtggagatagcctgtgctcagcactaggacaagtggcgccgggattccagcgccagagtgcttgggctcaaagcccagcctggtcactcggtatccacgcgaacttggcaaagttacttaacctttcaatgcctcagtttttccatctgtggcatggagatgctgtaatgatacctaccgcatcatgctgttgtgaggattaaatgagataatgcctggggacatttagaactgtgcccagcacttaataagagcacagtaagcctcggttgctgtaacttctgaggcttgcttggggattaatggagactgtgaaagtactttgtaaatttccaagctctggacccgcacgcagtatcgattgttctccttctgccttggacctgggccatttgtgtctggcctcgttcccctcaaggggcagggatcaagccccaccatctgcgtccctccagaggctctgccttaagccccatgttctgtacatgggattcagggaccctgcttgagcaagcagccctgcctcagtttccctgaggaccccagctgcggccacactgggagctgatcggccagccacctggcatgggcccagcctgctgcttggggctcccggtcagcacttcctgcagagccccagtcagcatctctgccgatgccccgcagtgcgccattctgacccagggtccaccgcagggggtgagcccactgcaggggcgaggcctgcctggagggaggcaggaggcagaactcctaaaacccttcctgctctgactttccaggaatccagcctttggaagttccagagatgctcctgtattccaccccctccagcctggggctctggtggggactcctggccgggggcaggtggggggcattgtggcaggccctttgctgaatcagcaggaccagtggcaggcaagggagagagggttttcccctcttctgcagtttgcatttacttttccaacaggtcagtgcgctgccg

SEQ ID NO: 55979 - DNA, 1294 bp, Bovine  19866881372726
ctttggagcagtctctcagtagtctatctagggtgctctatccgggctatagtcctcattttgcccccaaataaaacctgactcataactcacgttgtcctttgttgttttttttaaagctgacagcactgtgctagttctcaggagcttgcttgcacctccatataccaggaacctacactggcatatttggacaccccccaccattgtaaccttaaacaaacacatccagctaatgcaccccaaaactgcaaaacagaaccaaggctaggtctggaacaatgataactgcaatcgtttgcacttgctctgaccttccagactgccttccagccatctcatgggtaaggtgacctgggtttcttacgagtcattgtaagaattatctgcaacgatcattctgaatcacaagatacttccatctggttctgaccggcgactgagatagggggaaagtgtagcgcctccattgattaatacgatcacctctgctcttggatcaatactgtctgaactggctgaaaaatacaatttttatctatttaggcagcattgatcaggccctactaaattgattcagaatgatgatacggaataatttatgaaacaaaaatgtcagtgtgcagaatagccaagagaaagaaaccgagcttagtcacgggggcctgtgctcagcgcagcccagctctgcaggagctgatgagcttggggagtgagatatcatatgtgatggtatctcctgctggaatgagaggaaagtgacttaagaaagatcccagggaggctgaagcataaacatcctagacccttaaacaggagggatatgcacgtggaaaaggctggaaatataattaaaagatgcttgctccttggaaggaaggttatgatcaacctagacagcatattaaaaagcagaaacattactttgccaacaaaggtccatctagtcaaggatatggtttttccagtggtcatgtatggatgtgagagttggactataaagaaagctaagcgctgaagaattgatgcttttgaactgtggtgttggagaagactcttgagagtcccttagactgcaaggagatccaaccagtccatcgttaaggagaccagtcctgggtgttcactggagagactgatattgaagctgaaactccaatcctttggccacctgatgcagagagctgactcatttgaaaagaccctgatgctgggaaagactgaggtccggaggagaaggggacaacagaggatgagatggctggatggcaccaccgactcaatggacatgggt

SEQ ID NO: 55980 - DNA, 1080 bp, Bovine  19866880410163
tatataaaatatgttgttacttgtaagtatggcaaatatcttttagtttatggctaactttttaccttcttaatcatatctttttgcggagaaggcaatggcaacccactctagtactcttgcctggaaaatcccataggctgcagtccatggggtcgctaagagtcagacatgacttgagcgactttcactttcactttttcactttcatgtattggagaaggaaatggcaacccactccagtgttcttgcctggagaatcccagggatgggggagcctggtgggctgctgtctatgcggttgcacagagtccgacacgactgaagtgacttagcagcagcaatcatatctttttgatgaacagaagtttttaatttcaatgaggtctaatttattaactttccttttagagttagagctttttgcattctgcttaagaaatctttgcctaccccttggtcaagaagatttcatactatgttttcttctagaagctttattgttttaccttttcattcctaggcctgcaattcattttgaattacattttgtgtttaatgtgatgtagggctcaaaattctttatattcattccctatggaaacccaactgttccagttcaaattagtgaaaagtctgtattttccacccagggtaggaggggtgcacttaacctatagatctagtctttaaaagggatctggacccgtagagtgttaaaatctgagagggtctctgaactagggagagggtctctgaactgtgcctcagaagaaagagatgaacgggcaaggagtctagatgctctgagctgggatagtatggagccatcaactctaagatggatgggacatgtaagggaaaaagtttggttctttccatttctaaaattctgtctccataatgcttagaaggatattgcaccaggccagactttttaggtgtttctggcaaaacaagatttccaagaaattacccttggagaaaagaacctggctttgcattttacaatgttttcattactcttcatattgcccaggctaaatatttgcttccggagaacacgaaagactttaaaca

SEQ ID NO: 55981 - DNA, 4726 bp, Bovine  19866880596961
cagtgatgctgccctcactccacaaaggttaagtaatggggacaagatcccacaaatagtaagagccttcaggcaaggtttgaacccaggtctgtatgttagtcactcagttgtgtcctactctttgtgactcagtggactgtagcccgccaggctcctctgtctatggagttctccaggcaagaatactggagtgggttgccatttctttctccaggatatgattccaaagctctcccctaaattaggttatgataaaaatttgactgctgcccacgtatgattccaaaacactcccccaaattaggttataataaatatttgactgctgcccaccagttgttgacagtaaggttctaagcacacaggttagagaaatgctactcctctccagcttagtgttttcagcaccacggacagcgcccagttctttgaaatagttgctgtgggaatgaatgagtgagtgaatgaatgaatactgaattgtgacagcctcttccctccgtgtggagcaagctcccagagacactcacattgtccttggctttcagccctcagattacaacaagtggaagttcaccaacagccccacatttctggaggtgctggaggagttcccgtccctgcgggtgtctgccagcttcctgctctcccagctccctattctgaagccccggtactactccatcagctcctccagggacctcacacccacggagatccacctcactgtggccgtgctcacgtaccgcacccgaggtgaggctggggcagtgactgcggagcagcccaagtctgctacttactggacagccattcaacacctctgagctttgatctcctcatcattacacacccatcttccagccctgttaacagcagtgggaggagtatgggagagatcactatgaactgggcaccaagctaacttctttgtagatgtgacctgagaagcacattcacatggtttctgaaaaccaggcagagaccctctttgctctgctaaagaacatttgcaggagacctgggttccatccctgggttggaaagatcctctggaaaaggcaatggctacccactccagtattcttgcctggagaattccatggacaaaggagccttgcaggttacaattacagtccatggggttgcaaagagtcaaacgtgactgagcgactttcactcaaagaacatctgaaaaggccagggctcagtccttggggaggggaggcaggtgcacatcctgtgaaagcaggattccaccttgagggaaaccaacaggacttcttggtaggagcactggagtaggagttaggaaagctgagttgtgacctgattctaccgttacctgaggggccttgtacaagtcaccttccctctctgagactcagcttctgcagtgagatagccttgcccgctctgagtccctttcagcttttgccaactctgggcacatagagagtagagctcagaaccgggaggaaaagcagccctctgattaaaccctgttgagcgcctgagcgggcagttcagggaggagccactgaaagcgttcatgcacgggtggcggggaccacgttggtcagtttgtgctgtccttgcagatggccaaggtcccctgcaccatggtgtctgcagcacgtggctcagcagcttgaagccccaagacccggtgccctgctttgtgcgaaggtaggcactcctccactgtgtctattgtgggaccacgggccccggggaatactgggttgaaagggaggcttctggggtttagatgccacttggggtctattggcctataaagaaggcactggggtcatcacactgggtgtctcctcacactgggtatctcccctagcgatagagcacagccaggtctctagcagggaggttgacagcagtggtgggctcagaaaacgaggctcagcctttttcccaaaggaccccagggtgaggtgatggtgaatgtagttcacctggatgggggacatgaaatagcctactggacttgggaaatcaaatttgagctcgttgtctccactgcaaccccctgcccctcaacactgctgcctccaccacaccctcagttcccgtgcccctgtcctgtgtgcatgcatcggacccagagtctctgaggacaggacctctttccttctgtcccctcagtgccagtggcttccagcttcccgaggaccgcttcccgtccttgcatcctcattgggcccggcacgggcatcgcccccttccgcagtttctggcagcagcggctccatgaggctgagcacaaaggtataaccggaaggctcccggggatggggaggggtggtgcccagcgcctgcctgggagtaaaactgtaactgtaaccatcccacagacatttcctggcccctctcccaagtttacctcagcatgtgtggaaaaatgatatgaatgccctgggcctcagtttcctcatctgtaaaatagggacagtactattttagataggatgtggtggtgaaatgggattccagttgggtgcccagctcagccagccttgcaacatgatccgcctgccctctgctggccaccctggtaactgcacacctgctctgggtcttgcagggctccagggcggccgcatgaccctggttttcgggtgccgccgcccagaagaggaccacctctactgggaggagatgctggagatggcccgcaagggggtgctgcacgaggtgcacaccgcctattcccgcctgcctgaccagcccaaggtaaatgccacaactgtgcgtgtagaaagggcggagcatttaaagaacagactatggtgggtgtctggctccccacaagctccttacttctgtgagccttcacctcctcagctccaaaatagaggcaagggacttgcctggtgttctaggggctgagactccatgctcccaatgcaggggaccgagttcaatccctggtcaggcatcaagcaactaaagatcctgcatgccgaaacaaagacccagtgcagccaaataaatatttaaaaataaaatggaagccatggtgcagtcaccagagcagtgctgtgaagctactgatgtacgttcactcttccaggagaagagacaggtcctgagatggtcagggctaagtcagggtcatgtatgggttcatccccagtgcccagcctgctgaaggctcccccctctggatgtacaactgttgggtgggtggtggtccaggcaccgcaaggctggagggtggctgctgttccctgaatggcctgctgactcactctgctaccccagtgggcactttgccccaagagcctgggcaggcagaacagtctcttggctcagcctttgtgaacttgtcccattgggcccctcccatgctggtactccgtgcctggtggcatctccatgcctggtggcatcacttgtgtgaagcaagagcagggagtccccgattgactccaggacttctgaatatctggggaaccctgctctgaattacaaggagggtcccctggacagtctgcactgagaggctccgttttctggggtgtaagcagatgggcctcagatccctgggcagggcaagtggcttgattgatgcctctttgaagtgtgataaattcagagcaagtgtgctaaatctgggagctccactgaaggtcagcttctcaaggacagggctgtggccggtgttcacctctccagccccaactcaggcctgggccaggcagggcaccagtgcacctcctcatctcgaccttgattgtccccatgcaaggccctggctgggagggtgctcaccccatggccccttgtgccccctccccacctccccatggccaggaggcctgactgcagcctttgccctcaatggcgggggcctggacccaccatctcctctggtttcaggtctatgttcaagacatcctgcggcagcggctggcgggcgaggtgcttcgcgtgctccatgaggagcaaggtcacctctatgtctgtggggatgtgcgcatggcccgggacgtggcccgcaccctgaagcagctgatggctactgcgctgagcctgaacgaggaacaggtggaggactatttcttccagctcaaggtagggccgctggtggtgtgtgggctcgggatgcaggtcacaggcatgggcctgggagctggaaccagggaactcaggctcagactgaactcaaaggaatcctagagagggcaggaggtcagagctggtgagctgttagaaggcctgactctccatcctgatctggttgctcagttggacaaaggcaaacatgttgattttctgcaagacactcagagtccctaacatgctgctgtgcatcaaagagcttgaagactgggagaaagtgcacagcatttcccaaccatatttatctcagagcccacagtgcctggagccctgtgggacaagcacagggcaggctcagtcgtgtccgactctttgcgacccggtggactgcagcacaccaggcttttctgtccttcaccatctcatgttcactgagtcaacgatgccatgcagtcatctcgtcctccatcatccccttctcctcctgccttctatctttaccggcatcagggtcttttccaatgaacagcctttaatggccatcataaagcttggggagatgttttgtggttcacaccagagtgggtactcatgggagctaaagagttttaagtgagattcaaatctaatctaagcattg

SEQ ID NO: 55982 - DNA, 1252 bp, Bovine  19866880209063
actggaaaaaccatagccttgactagacgaacctttgttggcaaagtaatgtctctgcttttgaatatgctgtctaggttggtcataactttccttccaaggaataagtgtcttttaatttcatggctgcaatcacaatctgtagtgattttggagccccaaaaaataaagtcggacactgtttccactgtttccccatctatttgccatgaagtgatgggaccagatgccatgatcttcgttttctgaatgttgagctttaagccaactttttcactctccactttcactttcatcaagaggctctttagttcttcttcactttctgcgataagggtggtgtcatctgcatatctgaggttattgatatttctcctggcaatctggattcccgcttatgcttcatccagctcggcgtttctcatgatgtactctgcatataagttaaacaagcagggtgacaatatacagcctgacgtactccttttcctacttggaaacagtctgttgttccatgtccagttctaactgttgcttcctgacctgcatataggtttctcaagaggcaggtcaggcgctctggtattcccatctctttcagaattttccacagtttattgtgatccacagagtcaaaggctttggcatagtcaataaagcagaaatagatgtttttcttagtttcaggaaatagggtatctagttagggagagcttgctctacctgggtgaggaaatctgttcccctggccctggcccattgacctgttgtttccattgccagacttaataggctctttaaaaaagacctggcagatctttatctataaaccattagctaaagctacaccaaacctatgaaattcagtcccagcctacatgagattttaattttatgggcccaagagtcaataatgaatactatccctcaatgtgacaagaggtgcaaaggctgctcacttccttgactatctggattatttcaaagtatttactctcttgttggcaatcccaaacaatagcgaaggcaactaagccatttttaagacatcaagttgttgatttgtctagaatgactcagctgagctttcttttgtttgctttgttgcttgaattaaattttttttcactcctccaaagggatttgctaacctattctttcatattagagaaaacagtacatatctaacatcacatctattatattttttcttttgacttggataattctaccttccttagtagaagaaaaa

SEQ ID NO: 55983 - DNA, 1313 bp, Bovine  19866880220860
acatcaggaaatattttataaagacagttttctaaagaatatgtgcaattgttctcagagatgaaataaatagtaaatgtgtttcttgtattggctaaactgctgctgctgctgctgctgctgctaagtcgcttcagtcgtgtccgactctgtgcgaccccgtagacggcagcccaccaggcttccctgtccctgggattctccaggcaagaacactggagtgggttgccatttccttctccaatgcatgaaagtgaaaagtgaaagtgaagtcactcagtcgtgtccgaacctcagcaaccccatggactgcagccttccaggctcctccatccatgggattttccaggcaaaagtactggagtggggtgccattgccttctccattggctaaactggtatttctaaattttaaaccaaggtaggtggttttggtttatactgttaattgatagcctgggatatattataattttaagtttatttgagcaaaaagtgacacacattaggaatcattcaatctaccagataaaaaggagttccaaaagagtttaataggcagaagaaagtagaataaaaggaagtaatactaggcaaaaaggtggactgataattgcaaagttatttccctttggggattacaggctactatcaagcagattatctaactagtgctaatcaggcaatttgtgatcaaccagtttaaaattccatttctggaagagctgaaagtcttggtttggtgatatggggtttagtataaggaactccattttgggcctattatctagtttttaacaacatttaaggcaatttccatggtgtgtgctcaggggtatttttagccatttaaaaaatacagctcagggtttccatctagatttcacatccccctattcctcagactagagcttagtcctaaagggactggtgctcagaaagtatggctcatttcccacaatatttaaggtttcaactacacagttaagaatgaaaaatgaataaacaaattggacttgccagagcttgtattaccagtcagaaaagcagagaaggagaacaaagagaaaaaaagcttatgtgtctttgtcccattttaagcaatgttaacacacacagtttaggaaaaatctctttgcctccatttacccaacatggagattgatattgcagttctaagtcatgcaggaagcacatactcacacaaggaatgcaacagtgaatgacttctacaaaaatatcccttgcttcactctattttcctctaacgcaggatcacatagagattgctgacaatgttaattcactttgtg

SEQ ID NO: 55984 - DNA, 845 bp, Bovine  19866880372469
caaattggagaatcaaagctacaattagccatgtagacacaactacttaattcaaagagcagagtaaataagatggaatggaatagaagagtgtttgatttgattagcctcattagtgtaggattggtgctctcaccttttcactctgcagtatcagtggtttcatttccctaataatctacttctgtaagaaaaattgctgacattttatcattttcaagatgaagacagactttttcatagaaattttgaatcatttacataaatttacttctttttataactttcaagtaagttttacccttaaagtcagttgactaaaaaaaaaaataaaagcaaaaaaattaaattttttttgtagtcttcagtttgttgcttagcctgacaatttttatttttacataaaactggccgcttttcactgaaaatttgacctcttaaagcacatatgattcttcatattatactcttcctaggcaaaatgttattcttcaattaatttaagaaatatttattcatcatttgttactaccttgtaccctttcagtcactgccagtgactcacgaagcttaaaatctacttacatgatacatacattaatattcaaataaataagataatttccaaaagtggtaagtgtcatgacaaatataaaatagggtaatccgggaccttgagggaaatgacagactttggatacggtgctcagaatagtttctatctagctcaggcttctctggtgaccctaggttaaaaaattcacctgcaatgcaagagccacaaaagactcaggttcaatctctggggtggggaagatatccctggatgagggcatggcaaccca

SEQ ID NO: 55985 - DNA, 713 bp, Bovine  19866880408355
ggccccttagagatttagatatggaatgttaatgaatgtgttatctaaatcacttagatggttatgttttagtattattgccacaagattcctagctccactttacattatgggaaacatctcatcaagaagtcttttctttactgtaggagacctggagagcacaattgtgagtttctttaccctttacacaatagaattgggagattatcatcaactttctattcatattttgtggaggttatctaatttatgtgtgtatatatttatttatttatttattctgacaaatctttgtctgccaaagctccctgttcaagccagattgctctgatgatttcccctgcaaaggtttgagagagaaatgttctatttctttgtcaataaagattgatggcattttgagaggtgcagaatatcctttgattgctccatgaaacagactggaaaagatgttcgtgggtagtggggggtgggctcactcatcagctttcctttgtgcagttgctgcagttgcacacaccctcatcacaagcatctttgtgtgtcggtcccttttctccttcacctgtccaaatgaaattttccattgtactcctaacacaccagtgttctcaagagaggctaatgtgtgcactgtagttctcactcaaacactgtagacagatggctgtgaaccaccctctcattatactttagcaaaggttgaattg

SEQ ID NO: 55986 - DNA, 1634 bp, Bovine  19866880447386
agaagatcccctggagaagggaaagggctacccactccagtattctgacctagagaattccatggactgtttagtccatggggttgcaaagagttgagcacaactaacgactttcactccatttcacttccagatagtaatatttgaacaccaaggaaagtggatgaggacactatttaaagattcctgaggttggcaggggtaacagaatttttccttcatttcctacaatttcttaaaatatttcttagaaattttatgcatcacttttcccaagattttgaaaatttccattggtaaaatttgcagaacagtctccttgtgactaaaaaatttctcttaaagaaataaagaaatgaaaacaataaaataaaaaagtatgttaaaaagcatatatgtgaggagccactgctttcctactaaataaattacaagtaaaaaactcacatgtctggatcaagagaatactaaccatgctatggttcttccctctgattgacctcttgtcaatatgattacaaatgagaggagtgaatcttgtagtgtccacactctctcagagaggtaaacctaaaatggattacttctgctccttaagcaactgatcaataaagctgtggattgcagtgagaacggaaatgtctgtgggttgtagcagttatcctttgtgtctctttagaaattaattaaaaatcaatgaagtgtgcagcctattaatacagcaacctctagatcaacagatagaaactgagcctttctctgagcatacatattgtgcgaatactctcgaacactataggggaggtggcttggatgtctgatgccttagttatcattgaacacaaacagatcgttcctaacattctctattttcacagagtcacatgcgactggttggaaaccatcaagttcaatgtgtgggaatatgtatgctatagtttccttcttaagacgagtatataaatttttatgagttatccttatacaaagaaagactttggctgcaatataaaactaaagacttactataacttttattttgtgatttatttacatatgagtctaggcagttgatttataactactgaatatttttaaataagcatcttcctatgaaaaaaaaaagtaaaattcctagatgctaaaagtcctcatatgatataagcaaattttggtgtctacatgtaatacatgtcattcaattcagttcttcctctgttctatttggatgccaatggacctggtccatctatgcaaatgcttacccagcacattgaaatttgaaattaaaatttgaaatagtggtcctaaaacacccccttctgcaagtcatccagctacttcccaatgcttgctctgactgctttcctcttgcttagggtccttcctcctcaaaatcttcagaaggatctgaactatagcttccagttttcatcccaatcccttgcacttgatttggaagcccattttgatatatttccttatttgaaactttatactctccctctgccagaatgctaggactttagtccctgagtaagggcataggagaaagacacatctgctttataccttgtctcattttctatcctgacattactataaaaggagcagatatcatcacaaaactataa

SEQ ID NO: 55987 - DNA, 2879 bp, Bovine  19866880525141
aacagcttttaattaaattagaaaaaaaaataccgccacaggcaacacttaaactgacaaggaatgcattttgttaatctttgcagagaggcactgtactctgcacttaatttaattagatagagaaaaggcctgtttagtcctagggggtttaccaatgtccttttaaattgaggacacagcatttatataaagtcattttaatatcaggcaatacatttctaaacagtaatttaaaaatattacttgctattattaaatgataccttgttgtaacttctcacttcatgaaacgactttcatttcacagagaaatttcacccaccaacaggctttttgcttccctccaataatttattgacttttaaagtgttaaataattaggattaggttccctggaaaacaactgcactagggaaatgcatgtcaaaactatattacaatggataatgtatttggattatctttctcttctgggccatggtagtgaatgataactaacttttatattaaaaactatattacagttaagaagtaggttatattctgatgccactcctggtactacagacagagaagagaaatctttaggatgatttattcatctttttatttcaaatcatactctccaacactttaaaattttcacttaatatttatttctacctctttcaaccaccctaagaagctagatgggttatcattatattacattaaattataataaaaatcatccagtatcatattaagtaactaagtataagcaactacagttcaaaaagcaagttatacactaagaaatgttctgtttcatgagattttgtttttaaatacagaaatgtagagaacactgttgctctatatatttgggagaaatatatatatatatatatatatatatatatatatatatatatatatatggaatcccctggtggttcagtagtaaagaatccacctgcagtgttagagactcaggttcagttcctgggttgggaagattcccagaagaaagaaatggcaacctactccagtattcttgtctgagaaatcccatgacagaggagcctggcgggctacagtccatggggtttctaaagagttgagtcaacttagcagctaaacaataacatttatatgtgtatatatgtacatatatacctgtattttaattccttggactttatttgctaatttactcttcatgtcagtagttgagagtagacactagcctaggtgatagtgatctgaactagttaaacatggcctatgatagcataaaacttagaatcctactgcctgggggattgtttctgtctgtggtttcaggtttaggtgaaggttggagcaatttttgagcaataaactactgaacaagagattgattggaggtatgttaatctctcttttggttatctatccttacaacatgttttgcaattacaaggatgatatatgttgacgaaattagtccacagcaagtgggacaaattcactttcagtaatagctcgtcagcatgtaatttttcagttctgatctgaaaacctagcagacctctgatttaaaattattgtttggggacaaattaagaagtttgttttcaagaagaatgtttcctggcatttatttgcacagagacttatataactagtccaaattcatgccccacttatgtaataataatccattgttaactctttagcacaaaagtaaggaccaaagggacaaatgctgagcatcataacaacttgggagacactgtatcaaggttagcaaaatgggcttgttactatgtggacctgtacgtgaatctcagtcctgtcatctgggcttccctgatagcttagttggtaaagaatctgccagcaatgcaggagactcaggttcaattcctgggtcaggaagacttgctggagaagggatagactacccacttcagtattcttgggcttcccttgtggctcagctggtaaagaatctgcctgcaatgtgggagacctgggtttgagccatgggttggaaagatccccaggagaagggaaaggctacccactccagtattctggcttggagaattccctagactgtatagtccagggggtcacaaagaatcggactttcactttcactttctgtcatctattatctgaattattttaggcttattccttaaactctggaggctcagattctctgtgcttaaaataatagtaacaaccatgcataaatgttgcttaagaattaaatttttaaatgtaccccaaatattatagggcttcccttgtgactcagatgataaagaatctgcctgtaatgcaggagatcagggttcaatccctgggttgggaagatccctcagagaagggaatggcaacccactccagcattctttcctggagaattccatggacagaggagcctggtgggctatagtcaatggggtcgcagagtaggacacgattgagtgactaacacttccactttcacttttcaaatacttattactaaactttcatgtatgttgctaataatgttggatgttattgtgttcgttggcagtaactaggactttaaaattgttctacatcccttgatgatttagagtaaatgcttttgtcacagttaacagaaaattgtacttgattttaaaaacaggcaaaatatatcattttaactaaaatgaatctagagtagaataaaagttgttatcatagatttatcttcagtaacccaggttctctccatatgtgtgtgtatatatatatattttttttttttttttttctctgcccacacatgtgttgacttttttgtcctcggatttgaatcttcatgatcgtcaagtgcttgctacagcctgctctcacaatttcacagg

SEQ ID NO: 55988 - DNA, 1749 bp, Bovine  19866880598203
tataatgtcggtgttggacaaagaggtcttaacaataaccaacaatgctgagtgtttcccattgaccaggtgcttttctaggagttttacaaggactaacatttaattctcataacaactttgtgaggaaagtactattaatatccccattcaatgacgactgctactgctaagtctcttcaatcgtgtccgactctgtgcaaccccatagacggcagcccaccaggctcccccatccctgggattctccaggcaagaacactggagtgggttgccatttccttctccaatgcatgaaagtgaaaagtgaaagtgaagtcactcagtcctgtccgaccctcagcgaccccatggactgcaaccttccaggctcctccatccacaggattttccaggcaagagtactggagtggggtgccattgccttctccgattcaatgacaatgagactggcaaattgagaacctcactaatatggttaaggtcacagaggtgtgtttactgagtgattgagctaatattgaagcctgtaaagttttgttctgaagagaacagtcatcattatatttcactctctaattgtcaaagatgaacaggaatgcattgcagataatcctttagaacatagtttgtgtgatatgtatgttcaactttcttctatgtgagatattaactgcctaaatctgtgaactaaaaaaaagcacaaataaagatagaaactttcaaattccattttggcaatgggcatgagcagcactctgattttttgtagaagaatagatagcatttagtgcaaaacccccaaggttcctgaaagtaaagatattactaagcaatttgcaacacatgtaagtaaggttgaatatctgcagataatttaacatctaaaatttttaaaagaaagcaaaaagcaattattctacaattaacaaataaaaaaaaacaaagggacattataataaaaatcattataaacaatgcaaatttaattccaataatattaaacatatattatcctttttgtctttctttgcttgtaattgtaaaatgatatgtatgtgagtatatttattattgctttgagttccttctctcctaatctggtgattcagtggcaatagaaagagtatggatgaatagatggagtagagagaaaaggtaatcaatcagtcgactattatttactgactgtctaaaatgtgatgaaattggtaaatgggaggagagtcaaactgaattatgtcatctcagcaggagtacaccattcacagctccaagagttcatagtccttaagggtttgcagcaaaagaatgaaaggcagtcagattaaatctttagcttttagattttgaacaagccaaaacatagctttttatttctactcctctctttggtacttaattatcttaaaaaaatagttttataaactaatcatgtcagtagatgagtgcttatttgggaatcatggttttgaggttttcttctacctttcgcctgaaattgataacattgtataagatgttgtgtagtatttctaaagcttagcatagaagttgcagcctaataaaatataagtggcatgttctttctgttttataaaggaactttgatttagccatacaaaagaaagttgttttatcaaaattgattatctcagggctaagtttaagataaatggatagtcagggactactatggcagtcgactcagggggcgtgggtttgatctcggttaggaactaagatcct

SEQ ID NO: 55989 - DNA, 1286 bp, Bovine  19866880763667
tcttaaaagggtgcaatgcacagcacaaagccttctactccagaattatcttctgttacttcagcttttctagcctattactcatcagtgcacccttactcacacacacacacacacacacacatatatatatatacacacacataaatgtaaatacagagagacagaggcagagagagagaaagcaagagacagagagatacagggagacagaaagatttgctgttggttttctataaatatttaaagtgtatattagagggggaaaaagacagacataaactgtagtgtttagggatgctaacttgtgctgaaaaactgtaaaggaagcaaagtgattatcataaacatcaaatgactgattacctatgaagtgagaaggacacctgtgtttgagatggggcaactgaaaggggcttccagagtgtctgacaaaattttatttcttgacctgggtgatgatagcaagggtatttgtcctgtgaaaatgtactgggctgtgcatattttggggtagttttttctatatttgttttagattttataataaaaaggaaaagagtctagagaagaagctaactcaaatcagagaataattgccttggaaaccataaattcactgagggttttaagtattaaagttcaaaagcaacatttactgtataacatttcccttagcctctgtggaacaactgacattatttaactgacctattggaataaaagaatgctattgtaacagttaaataactttttgcataatagttgtcactgaagttcaaaagactgtttggagatgagaaagcagctcatcattggtagggttagaagtagtaaatccactaagccgtggtctcttgagcagtctaagctacaacacccttggctagtgaattcttggcacttaaagccaacaggaagccagatcagctgtccagtttctgcaggtgcacacttagccaaataaaaagatgccaaccacattcatgggatcactgaaaaatagtttataaaagctaaagggtgatctttgggaaatgatattacctatactagaaccattgtctataccagcattggacaatagctctgggtaaggaaaaataatttactgaaccctaaggattcttaaattaatatatgagtagctggagcggggttggtggtgtcaaggaaagaatgagtacacagcttaatgctccaatattaacagacaaaactgaattcccagatatgcactggctatgtctacttgaatgtgtcataaacacctgaagtatatatgt

SEQ ID NO: 55990 - DNA, 1244 bp, Bovine  19866880765162
ttgcaggtggattctttactgtcatcatttccttctatctctagacaaatatccccagtccaaagacatgaggacacttgcttttgctctaaatgtttatactatcaaatttctatgtttcttataacacttaacacagcccatttttcatgtagtctggtgctagaatttaatatttcctatagactcgagtcggacaagactgagagactgaactgagctgacagactgtatactctctgaggcagtactcatgtttacaatttttaaatcacagttccacagtgcaaagaaagatgtctttatgagacagaaaatgttttctcattagtaaataaatctgaaagaggacataatgatgctaccacagataaccactggcagataaactgcaaaaggtaatataaagccccattttggtgcaaagcttggttttcactttgcatgtgtctgtaccctggtgggctacagtacctggggtcgcaaagagttggacatgactgagcgactaatacacaccacacacacacacacacacacacacacacacacacaccttgccaatgaattctgggactcctgccgtgttcccatctgttggaaccaatcacgatatttgggggcaaaatattggggcaaaatatttaagcatccagttaaagaattttatcatctgacataaaagaacacagcatttgctgttcaaatatcacatatttcacgtgctttctctttttcttcagaggaaggggaaatttcatagcaaagtgatcttgaatgagaagactcttggtctcagggggaatgtagaacaaggtggcaggtgatgggtatgctgaagtgtggcgtaactgactgccaaagaatacttgaacaagcagctgatccatctgccatcagtggagctggcttaatcctttctttttcttcttttttttaagtcacaatcaaccactatgtaaggcatttgatcttcatgtttttcctcttgctgtctttagagaaatggcatgtcatcctaaaagactggtcagggaatgaggagtcctgtgttctagttttgctgctgcccctgtatagctgaaatattttatctcatgagacttttcagtccttatccatcaaatgacagggaaggggtatgttccatttgtttctgtaacttcataaatctattccttttctcatgagagaagtaacctgcatggtactggaacatggtactgatacttgtacatgggaca

SEQ ID NO: 55991 - DNA, 1065 bp, Bovine  19866880782826
actcctttgatagtttatattaaaatgctacattagaatgaactctgactctatatttgcttctcttgaaattattcaaaatatctagaattcatggatttctttcatatgacacattatcttaaaactggcaaatatttttagttatgtctgccaatctctgtggctaataaaagtcatttcacagatttacactcatttcattatttcaatattgtagtattgcttcagtggcttattattttctttgagaaatttcaagatcagaaatactaataacattttctcagttttaaaagaaaatgataatctagtttacctttttttcctgatatagcatatatattgctatattacatttacatcttaaaccaaatattcaagaattatcttaaggtaatacattgtaaactattttaaaaattcatgctttaaattttaaaccttgatgttaaagcaccatcacattagaaaaaacaaacaaaccaaccaaaggatcaaaatgcttattggactagttaccaccaatttaataaactccaagctaattttcaaatcaatgtattattagattaaaactgcctagttgagaacttgccaaaatagaatacactaaaatttaaatgagacatttaaaaacctctttaagtactgggggatgtatattaccctttttatatcctcaacattgtctagcattgtattttccacttggcaaaagctttaaaaatacattaagctaattgtaggtgacatgatctaatagcaatgtcaaaggttttagttattattgttgtgttctgtagcatgattatgtacatgttcttgaataaatacaagtagaaatgttgcacaaaagcaatgcagggattctaagaagcgatatgaaaatgaaaatggaccatgagtattactgaaagagaataattggatggaaaatttctgtgatgttatactctgagaaagcaaaacttgagccatattgaccataataagaaatgacaaagcttgaaaagctatctataaaatgtctttcaagcagtagcttttcagataagcaaaatt

SEQ ID NO: 55992 - DNA, 875 bp, Bovine  19866880803283
attaatatttgattaaataaaaaaattacacagctgtcatttagtaggaatataattatattcagttctttaaagaataaggtctccgaagtcctgagctcatcttaaaagaatattaaacataccaaaatagtagatattacttggggctactacatagcactattccagagagtgctattcacataaaaatgtttggtttatttaatttcaccatatttgcacctcctctttaaatttccctgatgttcctcttatactctaacactcttcaatatctttactaattaattatcatttaaaagagagaggagaaaactaggaaaattgaaaagtatgtgaaaattgatagtgaacgatgaattctgactgcatccactcgatgtattttcaaatggaaagctccaaggttttcctaactgcttttcatggcaatagagagtttcagatcttaacttcatagacatgtgttataaatcaatgctattacctcattcacaaggaaatagaagagaagcagacatggatcccaggacagtagctgtactttgttttgcatcaggctaactaacactggaaatgtgtctgtggcaactaaaccatctgttcacttgctattttgcagggttgtttgtctgctttaatgtacctgtacatcccatttcacaaaatgcattagcattgtttcagagaactgtctaggaaaaaaaataggaagccactcaatttcaatattagttgtaggaacagtgataatacagaaactgcacatattttcataagggaaaaaagcccaatagtcaagtatataaatcctaattttatttagagtacaaatgtctctaagtatctttttttaaaagattgcaagtaaa

SEQ ID NO: 55993 - DNA, 1695 bp, Bovine  19866880830309
accttgggcatcttatgtgaagattgactgactggaaaaaaccctggagctgggaaagattgaaggcaggaggagaaggggacagcaaaagatgagatggttggatggcatcactgacttaatggacatgagtctgagcaagctctgggagttggtgatgaacagggaagcctggcacgctgcattccatggggttgcaaagagttggacactctgagtgactgaactgaactgaaaccataacaaataatcttgccactgaacataatatgaactcactgtcataaaacttgcttcagaaactaggccatgtcattctaatcaccatgttaccctcctcaaccatggtgttatcaagaggaaacactaaatattccttgaagtaaaccaattataacttggaatgcctgttatctctgaagaagaatggctgtgttaaatgtgtctgtgtttccatttattaattaaattagaagtcttcaacttttctagtgtaatattaaagaacacaaaaactggaatttcagacataaaatttttgatcctcacccagtttgtgcagatccaagtgtgaaatcctaggaaattcagttaagttctctaataggaaattcatttcctcatcagtaaattagaacaattattctaaagtacttatcacaggaactgtacaaattaagcactcagtaagtggtagctatcatttttatatgaaattagctctgtaggatattgacgagtaagtcagtatatattccaatatgtgtttgattcaagaagaaagctgttgatttaattacaaagttatttcatgctaagataaacacaaatgcttacaactgagatatttggtaattatgtatagattattctaggtttgtttctaaagaaagctgaaactaagtgataaaagaattaattctgtatttcttttagtagtttagcacatgataatgcaattttaaaaagagtaaaaacatttactctgacccttaagaattaaagaattcttaattatttaattcaatcattatattttaaatgttggatctgtatttaattttattgggaaaataatttgtcagtatattatgtgagttgaataacattaataactaccacttgccccaatctgccaaagtttatgaaatgctaacctacttcagattggctaagttgtctgagattgtggtttcagtctgtctgccctctgatgccctctctcagtgcctaccctcttacctgggtttctcttaccttggacttggggtatctcttcacgctgctccagcaaagcgcagccgctgctccttaccttggacgtggggtagctcctttcggccgctcttgggctgtgcagttgctgcttctttcaaatcctaaaagatgatgctgtgaaagtgctgcactcaatatgccagcaaatttggaaaactcagcagtggccacaggactgggaaagttcagttttcattccaatcccaaagaaaggcaatgcaaagaatgttcaaactaccacacaattccactcatctcacacgctagtaaagtaatgctcaaaattctccaaactaggctttagcaattcgtgaaccgtgaacttccagatgttcaagctggttttagaaaaggcagaggaaccagagatctaatttccactatcctttgaatcatcaaaaaagcaagagagttcca

SEQ ID NO: 55994 - DNA, 2235 bp, Bovine  19866880887103
agaggtatgctgctatgcaattacactaggtcctctaatgaattttttaagtaggcacataggatatatttgggagttctgttactctaaaggaaggacttttaggatggttactaacacggacattggaatccagtctgttgcatatttctagaacccagccatatatattatatcatccattatgggaaaaaaagccactattttttaattcaagaaagacgtcctgaggtaccttataatattgtacttttacacatttaataaaggaaaattatctgtatttatttaaatgctgatgagagacggtgagaaagagggggaaagtgacatattgccatttatactgtggaaattttacttcaatacaacactgtacttacttttgagcattatcatttagaggtcctcatagattcctgagaattgctctacttttgttcaatgactttgtatagaatgagtttttaggggagaaaaataagtttttttcccctctgagggtccctagctaagaccccagtaataaaagacaaattaacaacaacaacaaaaaaaacaaaacagaggtatatccacatgtatacatcatatgtacataggagatacccagcaaaaaatgaataattgccccgtgaggcttagcattcaagattaaatacgatcttgatagggtaaggggagggtctgtaggcctcctttgttgttgttagttgctcagtcacatctgactctttatgatcccatggactgtagcccaccaggctcctctatctatgtatgggatttcccaggcaagaatactgggagtggtttgccatttccttttccaggggatcttcctgacctaaggatcaaacctgcgtctcttgcattgtagatggattctttaccactgagccaccaggaaagccctataggccttgtagggggagaggaaataatttttaggaaagatggggtgggccctatgggagaggaaatgggaattatgatggtttgtgacaaagtctgtgtgtggcgttgatatctagtctcatctcctgtgacaacagttactcttccccagttgatgcagctcctgaggaggggcctgataatgatgagtttatttggggagagttatctttaggtagataagaggagttcagagaaagtgttttgctgcatttgctattttccaagtgctttacagctcaaaatagcctaatgcctaagtggcatatttaggggtgtctcattctgctacccttcagttacctcaaaaacctttaaaccctagtatttcccctcacttttttcttctacttacagaattcactgagcttccatgaaaaatttaaaagcactggatagtgacaggtgtgtcttttttccccctgaaccatggaacattttagaaatagtgcattcagttttcttatattttgaaattttgttggagctcagatctgtcacatataagccagtaccaaagaaactattctggcaggctgtcctagattcaacaaaaatttactcctctgagtcttgaattccttgacaataacaaggatgttaaccacaaatttggaaaaggaaacttattcatatttcactccatcatcaaatatgttccttggcttaaaaaaaaaataccagaaaatgaaaacatggtacttccttgtagtaggaagacaccttgtacctcacacggaaaggcttctgaaccttagtgctcagaaagtgaaagctattgtgctaaacaacaatgccaactctgaggatacagattttaagtaaaaggttagcaatatctcttttaaaaatgtcagagctcttttgagtcaagaacatttctcacagaatgacaataaaaatgccctgtgacttcctgtactttcattgagacttcactaccttgcttccacccttttgccaattgctagacaaagtgcttctaaataggaccctactaacacaaagcaaaagggtctgacctttgattatctgaacttagctttagaaccaattaagaccccagttgacattccatcaatgtgacattcaccaaggtgcagatccccactggtaaatctggaagttgctgggggatttgctccctttgagaagcgctaatcattaacaataggctcctgccaagaggtaatcactctaagttacagaagaaaaattcaaaattgttctgtagttggttggctactctcagtggcaagtcttagaaaaatcaggaag

SEQ ID NO: 55995 - DNA, 958 bp, Bovine  19866881040695
tccagcatttgatttactgaaaacaaaacaaaacaataatatagtgtttaactgaaaagaaaaggtctggtcactgaaatatatcagaatgagccttcatcatttttgtatgtcacaacaatatcaagaagtcccaagagaaattatttctgtggaaacattgacttttcttttctttgttaaacattgtgttaccatcgcaatcaacatataaaagaacagttgtgatcagaagcttctctcgtaaacaactggcatacaaaccatgtccatgtttgtcagccatattttattgactttatcattgtcaagtcaaaagccttaagggagtaggaatcacaaccatatgggagctcagtaattttagtgatgtaggaaatgctagctgcaaaggatacccaaagacaaactttcaagcatcaacaggcatttttttgtaacgaaactggaactaaaactgacaaagtttagctttgcaaaggccattattttcttcacatatattctagagagcaattaaattctaagcagcattagagctctttctcacatcagtgataaaaaggctggaaaaaaatcctatcatctgatttgcttctaagtgaggagataaaagtaaactgcaaaatgagaacctcacctgagactcctgatagaaataagacttttctgaatgaagatcaggaaatcatcttttactaagaaagcaacctgaattccactcagggaatttaatccaggaaacagctgtaaggaagatccattagcatgtaaagaagcccttttgagtcagaatgcagaatgtcaccaaagattgctatatgctcctgtgagctttggtgatgaaaagaatttaccaataaactagggtaacacagtgatctcctcaaatacaccctgaaacattagccaacctcacactcacaatgctacaaagactggctatttttccatctct

SEQ ID NO: 55996 - DNA, 834 bp, Bovine  19866881072299
acagtaaaagaatctgcccacaattcaggcaacctgggttcgatccctgggttgggaagattcactgagaagagaatggctacccactccagtattcttgcctggagaattccatacacataggagcctggtcagctctgtgcatggggtcacaaagagtcagacaagaccaagcaattatgactttcactttctttaactattacagaatatcgcacttataaagaaatagtttctactttctccaactatctatccattagtttatattaataacatttttatgatgtctccttgacaaactgtagatcgagcttcacagtctaatacataggtcatttgatgttgtgatggcaaattaaaaatgccagttatctgggatgaaatggaattatattattattctatgtaaagtgttatatagtaatcaacaccctgagaaacaaaaatatgatttgagagtcagcttatataaatatagtgggtcatgtatttcttcaaaacaattgagcttctacctatttttgtttgtttgtttcatgtttcttttttgtttcatatgagactgattttgttcttactaacaggtaaattttatcttgaaattacgccattgctgctaagtcacttcagtcgtgtccgactctgtgcaaccccatagacggcagcccaccaggctcccccgtccctgggattctccaggcaggaacactggagtgggttgccatttccctctccaatgcatgacagtgaaaagtgaaagtgaagtcgctcagttgtgtccgaccctcagcgatcccatgaactgcagcctaccagactcctgagtccaag

SEQ ID NO: 55997 - DNA, 787 bp, Bovine  19866881093336
aaaacaagctcagtagcctaccccaatcatctacttctgaccttgaccccattaacatgaatgtctgagtaatcgagctaaacaaatatgcaaaattgtacagtgttaaaaacatatccattctgcttcaaatgagaaattttcacattttttgaactatttacaaaagtttgtaaacagatgatataatttggttactttagaaaatattttataatctattagaaattatattagtaatggttgagaaaagtcatggatatgatcttatttcagtttcagagaaactaaaaattgtgataaaacatccagatccttgcacaattttgataatgttcagcccacaaaaccctaatacttacttgtagaggctttttgagaaaagatctaaatcctaggtagagaccccaagactatgttcaaatataaaattctttcagaatctggccctctcaatcccaggactgcaattttatgagaagaaactattggcaaatagacaagataaatgcaacagaatgaatctcagctaaagcaggctcaggggttattcatgacagccttctagaacacaaattgtaaccatgcccaaggcagtagcttttcattcccacttaggacccaacaggaagaaacgggcttagatgcaagaagttcatggctagatataaaattaaataagtataaaatcagagagtaattcaagacattaaggtaatttaatgagttttgtggcagtctctttaagaatagattaagcagaagattaggacaatcttttactcat

SEQ ID NO: 55998 - DNA, 1078 bp, Bovine  19866881098160
caaacccatcccttttaaatcattaatttatagaatcatttgtgatcagtatcaatactgtatgatacctcacagagcagttttgagcttgctttatcataattttttatgtaaaccatcagttgaaaaaaatcccgccaaagcagatggtaaaaatatcttcccacttgattctgaaaaatgtgatatagaccctgatgataaggcaataaaaaattttccatgaagacagtaaaaagtgttattcatgatggaatcttctctgttatgggcgtgatgatgagacacaactacagaaaaatgtcatgctcctcagcctgtgtgtgcacgctcagttgctcagttgcaccagtcctcaagttctggaggagggcaagtgactttaacctgccgtgatgcatgtgtttggaaaggaaagagtgcagaatggcttaaagacttggctcaggcaggcatcagagttacctgattcagaatccaggtatctcagtctactgctgtgtcctttaggacttaagttgttccatcttcctcatctataaactgggagaataatgggccatacatgctagagtttcaataaatattatatactacaaagtatataaagcacccagtagatgcctgttgcataacatatgctttgtccacatgaatttaaccaataccagtgttattcaccataaagttccttcactctaaattcatacacttttcagattctgccaagtggtcttttaaaaaccgcttgcccaacttgttagcaacaactctgaaagaaagaattctcacaattatcttctatcctggattcataaagccccaggaaggcatatggtattatacaaacattaaataataatatgttctgctctgcttaccaaattaaatcaagttctaaaggcagcacatgcagagtgaaaatggctactgataagaagcaatctgatgtttatttattttttatcataatatttactgaaaacttactttagcatctcctaaaaaaaaaaaaaaaaacttttctaaatccttctgtggtttatagtagtaatattttcacataaagaaactgagt

SEQ ID NO: 55999 - DNA, 860 bp, Bovine  19866881220372
tcaaggcctaggaattgaagtgcagtccaaacttagaattcagcaattagaacaggttgaaaggcacaacatcccaaaagaggttgatgtggcattgagcatctaagagagatgactttaaattctctctaaccaggaaaatgatccatccagaagtaaatccaggggtaaatctgactctatactcagacactcaatagaataagcaatgagtaaaagaattttaggtgtaaaaagtaagacagtagaaagcaagacaatgtggatggaatttcatctgtatcagaaaataagtaagagtttataatcactctaggaggatgaaacttgtcatctttgaatataaagcaccaggcaacacatggcatttccttttatgacataacagaatgctgtattgcattactaaattaataacgtgtatctagaaagtgaattttgttaaattcctttaatttcagcaatcattccgtccacaattccttggtgtggctgaacaattacacaatgaaggcttcaaggtatgtgatattatttttcttaattgctttctgtcggcaatctatccacaaaaaagaatattgaagaatattggggaataaaatcatgcaagatatgacctctccatatgaaaactatgactaactttataatttcaaagctttgatgaaataaactaattagaaagactagttttaagttttagcacaattaccacaaacttactaaatttgctggctaaaaacctagagagttttcctaacacataactgggataaactttcaatgcatttccatatattttcccttttcctgtttccatatgaagtcatagtttccaacagttacaggcgaaactt

SEQ ID NO: 56000 - DNA, 755 bp, Bovine  19866881258844
aaatgcttaaatctattttgtggacaaaaggatttttaagttaattcattttgtggagagaataatttaaccaagttagcatttagttgacagaattatgatgaaattcattttgtctacctaattgattggacagctagcagaatgcatttctccctagaatgaagaatatgcagagcctgtcaaatggcatttcctccttggtctcaaatcattctgtcaacaaaataaatacaacatcctttcgtctacagtatcgatgtgggtgttaattatggcggaagagaatgcaaagtcaaaatcttctctgttaagtattgataaaaaatatttataccatccattaaccagatatccatcttgtaaaaggatttttctgggaaaagcttatatgtaaactgtgtaacagggtaggtgtgtgggtttggtgttcttcacattcagtgttatagacatgaaataaacacattggctaaaaatgtaaattcagtgactagagtgataacatcaggaaaccaatgaacaaagccaatctactaataactggttgtggtgaaaaacgtgcattgttgattgcaagtttcccaatgggggcaaagcaaagaaaatgaacagatcatgctcaaaagactagaactacctgaaggctttaagagaacttttttagagagggatgagggaaagcgtcacagggtatgtgatctgctcatggacattcttttgattggctggtgataaggtacctatagtatatg

SEQ ID NO: 56001 - DNA, 1103 bp, Bovine  19866881346471
ctttgatgtatactggaaaccaaccacaattttataaatcaactataattttaaaaaagagggggaaagataatgtagctcttttactgtaaaaatctatttgagactgggcaaaattcatgatataataatataagatggtggacacaataagcccaagtgtctgaattaagtcttgagaagtaaacagtcatttgatgaaattggtttaactacttatcatcccagtcctttcatgagggctggatgagtcttctaatgttctgataactggattttccaaaagatcttgaagaatcaaataaagttatttgtattttcattttcctgtacaagagaattctgggatagtcaagtcatgttattgtacacagttggctgaaagaatccagatgatttctggtctcacttgcagagatccgaagaaatcagtttccagacgttagaatttgaaagtgtgtctgagagttactacgtttattccctctgaaacttttattccctctgaaacttttggataagctcaggaaagggcttaaatttaacctggtacaaagcaaaacaaaacaaacataatatcaagagggaaggaaaagaaaccactaagctatgaaaactcttcaaaggcttgcatcatttgttcacagagcactcaaggctatatggcattattcgttcctgactctgcagacaaggaaaatataacaagatgtgttctgaggaagcagcttgttccaaggtaagactgagtttaataaccaacattgttcatggcccaaatgtcaaaagctttgtgttcctcttcactgtagttgaaccagtactgagacacataaagagggataaaaaagagactttggaaacaaacacacatttttgcttgaataaaatttaacttaaaaaaaagaaaagaaaactcttgaaaatcacagttcatttctgggaagactcactataaatacaaccaatgataacacagaattcatttgaacacagcttctctttcctaaaagatttaattattgaggctattacaagtactttataataataaagttttaattgcaatagagtcatatgaaataattaatcttaagtataat

SEQ ID NO: 56002 - DNA, 1268 bp, Bovine  19866880406679
tgatgacaaaaccccagctaggtatgtagttcatttcttatcagcaccaccctgcctatttccctttgtttttcgtctctcaattgtgtttgataagaccctgatgctggaaaaggttgacggcagggggagaagggggagacaggatgaggtgattggatggcatcaccgacacatggactggagttgaagcggactctgggagatgggtgaaggacagggaagcctggcgtgctgcagtccttggggtcacaaagagtcagacacaactgagcgactgaacaacaaatgtgaattttatttgataggattacccaaagtggcagaatccacctggtggtttaaatccttttttcaatctgtacctgtgctttcaaatgtgaaaggtgaagaccagtctgcttgtgggtaagttttagtttttttccgataagaatatttccttttcagatgaaagcagtgcgtgtcacaattatcacatcaaccggcagggataaaacacggtcctctctggaaggtgaagtcttttatgtaacctgtacttgagggcagaggtggggacacagtttcttttagttaatcattagtcagatctgagcattctatctccaaagagaaatggaaaacttatatgccgttattattatggtttagggggaatggaccaggaagcagaagcaaggtaccttcaggaacaaataaccactctctactccaacaagaggaatcacaggtccttggagaaatggctgattctggaacagtaaacagattccggaacagtcaaacagtaaaagacaagcccggaccatttcatggtgcccccaaagatacaaattccccccaatgatggggatatatcaaaatgacacaggaatgaattgggcacgtctgggactatttcagcaatatttttccagtttacctggactgtgaagacaacctagcttacaaatgagcatttctcagctgatgatctttgttttgcggtttggagggcagtgttgtaacagttactacactatgtaaagtattacccgttgtttgcaactctatgtaatagccacccgctgaggccctgcaggtgtgacccccggatcctttagcacctgagctactcctggtgatctcctctataggaagatgaaaatcttctggatatctcacaagacaagaccactgcagccacacagacggcaaaagtttaggcatttgcttcaatggttgagagtattcttgccacggtgtcagctacatggaaaacactg

SEQ ID NO: 56003 - DNA, 1588 bp, Bovine  19866880544546
ttcagcagcgttggttcatcagcacacatgtggggtcagacgcagcgagactgagcagtcttggcagtgaaagtgaaagtctctcagttgtgtctgactctgcgaccccatggactttacagtccatggaattctccaggccagaatactggagtgggttgcctttctcttctccaggggatcttcccaacccagggatcgaacccaggtctcctgtattacaggcagattcttaaccaactgagccacaaaagtgtgaagttggaggtctgacaatgctgggtgctgggatctgctgtgatctcttcccttcgagaggcacccctgccccccacccaccctgggaaccacaggctgaacttcctgggctgtgccctgcacaggggaagaaagcccaagagaggccaacctggctgccctaagcgctgtcccccgttggtggccagtggctctctgggcggggctggcacctggaaaccggaggacggccaggcgggtgcggccgggacttctgtctgggaggacacagcaacgggtgtgactgcaccattcgggctctggacagagcagagagaggagtgcgtggccggcaggcgctcaggaccaaacaggaaggaaggatgtgcttgtcagccccccttgcagtatggactgcatccgtgcgtctgagctgggagctgacaaacagcccattgtgccaggatggggttaagtcacccgggcagctgactcggcttcagcttggaaatggcatttctcacctcctccacactggtcttttcagttgcttgccaagttgaagggggaaaaaaatcccttaattctggttagaagtgtttcaaacgttacataaagaggcacttggctggttaactggctcagttctgcctgggtttcgtctcaggaagcatttaagctcgctccccaggactgtacccctagtaaacaccctgctttaagggccctccgcacacgtaggctcattgttcctcctgagaaccaccagtttataaaaatcacaaacacattgtgtttgctggaatatcctggtctatgtttgaaaaggtgtaatacattccagtttgaaaactcaagttctctaagatgcttcttttcctgtaggttctgcactttggcctcaagagaggctcagtcatgtgggcacgtggagagccagtttgcccacgtggtgtggcactctgcatctgatacattaggggttttcattcatcagtgaaattaggaaatgccgtgacactttctaatgttctcactagctcactttttttttttttgctgcatatttataatcaagtagacaggacaagttccagtctccactaaccacctagagaggatgttgagattttaagctgtagaagttgctcttggtttagccaggttcttgcagtcagaagaagtgctgtgtgccctgttctgatgggctcagggggtgccatggccatgggtctctgtgcttggtggtgggaacacagctccacacctggtctcagagcacaggtgaagacgttctccccgtcatgggggtaatccctggggacaaggtgctggggtgaagccggccgtg

SEQ ID NO: 56004 - DNA, 949 bp, Bovine  19866880718707
gacccaggtgctggggctcagaggggcatgtgtggtcaagaggggacgtggaagactgctgcagggagttgggtggacagctggagggacaaggcaggctcacgggtccctgtggacccagtggtcaaccagatgccggggggcagcagggcccacacagagggagtgtcctgtgtgagagggaaagggggacagtatcagaagagcatctggagtcgtgagactgacgatgagcctggagggcacggaagggcccagtgcatggagctcggagcttggcctttgtcttgaaggtcatgaggatctgttgaaaggtgttaggcaggtggagtgatgtgatacatgaatattgccatactcccaccccagtgtctcatctgtatctccagctgggctcgtgtcttatttgaccttgtcccttccccacccccaggtctccctccagcatctctgctgccaccacagcctggctgtgccatgatgagccctctgggatccccagggtgcccgccctcctgcagccccgctgcggtgagctgagcccctggttctggcctgtgaagcaacccctggttctggcgctaagcctgtgggcaggggcccctgggagccaggtctcgccctcctggtggtccctgaaccagcactgggctggagcagagtcagcacctgagaatgagcacacagcccatctcaggcccccacctcatgctcctcatcgctgccaggctcttcggacgtcaggcagacacacagaacgctttttgttagtctgtactaatttgagcaccttcattttacagagccagagtgaatttgaagcccaagtattcaaagatccaaatgaattcaatgaggtgtgaattcctaaatgtcatctcaagtgagtaaaaagggaggctcacccatactgcgtgttcttcctgcttagcctggacggggcgggcga

SEQ ID NO: 56005 - DNA, 1222 bp, Bovine  19866880780806
tgtacactgcggtgatctgatacacgtgtgcaccatgaaaagatttcccgcacatggttaaccaacatccgtctcctcacgtttatcttcatgtgtgaggacatttaagttcttctctcttagcaaatttcagtgatacaaacagtgatcaacagttgtcaccacacttttatattcaatcctcagaaattatcctgcctgtaagctggaaatttataccctctaccagcctctccctgttcccctggtccctggcaaccgccactctagctctgtttctacgataaactcaagtctaagatggaaaggaaataacccacaaaatgtaaacaacttaaatgctcgtcttaagacaaagtatctacaagaagcagttatattgagactttgttattaataaaatagaaaattctctctattaataatacactaatccaactttatgtgtttttttcataagcagcctttatttgatactccaacccctgtaaatttgggatgggctggtaaatgcaatccatcaactaaaactgaattttaataatgtcaacatctcattgtgtttagaagtggtagaagcagaatttgaacctggatctcatcccccagcctctcctgattccaacagaaccagttgtctttcttagttgacatgttgaaacaaattgatatactcaagttacagcatttaaactatgcatttccttggtgcactgccctgagatactggtgggttaccctggggaccctggtaggttacccggggaccctgttggtccctggtccctgcccagctcagccccaccaagcacctgcccaccaggcacagagagtccaggcagcaagtcctcaccctgctgctctcagagtgaaattttctccaggcacgttcttacctcccagcggtctgtgtaaagacctactggcacacaaccttctaaaggaaatcaagatcaactgaaaggcacgtttaatgcttattgtcagctttacattttgccaatactgtatatgaaatatattgtaaaaaattaaaaatagcactaccatatgatccagcaatcccactcctgggcatataattggagaaaaccattattcaagaatatacaggcactccattgctcagtgcagcactatttacaatagccaagacatggaaacaacctaaatctccacgacagaggataaagaagatgtggtgcatacatacaacagaata

SEQ ID NO: 56006 - DNA, 1494 bp, Bovine  19866881348309
aaaaaatgttggattttataagtgtttctacttcatctgtaaaggctctgctggtaggtgtatttaagttgcaattcctataacttctgaatgggttgacaacttctataataaaatttccttttatctctagtaacacctgagtctcttgtgtgatagtcatgtagccactctagtttttgatgggtgttgtttgcatcatgcatttttttttcatctccttcatttcaaactatggagattcccgccccccccgcaaaaagcactaactcaaatttcccctctctgattataacccttaatcacctcaacttgttaccctcgattccctagacttcttaaatctcaaaagacttcagtgtatggagtcctcttgttttctttccatcagccttgtcttttcattactcttctttttaataaattggtttattgtatcaataatatatttgctgttagtttatagtatagtagatttagcttgatgtattaaaagtaaaaacaaccccatagatgtctatttctaactagtaaaaaaaaaaaaaaaaaagacagctgtgagttacttaaaaaaagaaacctgtcaacatggaatttgttgaataagtacagaactaatatatatatagtcacatttcctaaagccccacacacctcctcacatagaatgtataaactccagctttgagaataagagcaaagcagaaattaaatctatctccctaatttattgcagtgtaacaaactctatcccagcaatactcagggctgtaacaccttcatacttacaactccagtcccaagaaataggaccaatacttgtatcacagactcaccgtcttcatcgagactttggcagccatccttgttatgtttggaagactctgcctgaccggcaatatacccagatctgtggatgagtcatgtcgtaacaaggatccactgtgctgctcaggtttggtaggggaatggcagaggtctcaatagcttactttggctcagctccactgccttcttgggcagcagtgaaaacaccaacctgaggacccagggcagtaagggtggagacaggaccttatttcaaagaagccccagagttgcttctaccccggactgtcagaagatgcttcaaaacaaaacaaaaagtaaccgagggtcacctggcaccaagaatcctggcaccgaaaggccaacaattgctttcctaaagcaaaactgctgctggatttgccaagggtcagcatgaaagtcacagtgtcagtcactcagtcgtgtctgactcagtgcgaccccatgcattgtaacccgccaggctcctctgtccctagaattctctgggcaagaatattgaagtgggttgccattcccttctccagggattcttcccaacccagggatcaaaccctggatctcccgcactgcaggcagatctttcacagtctgaaccaccccagagctcctattaaaaatgtttttataacaacaacaacaaca

SEQ ID NO: 56007 - DNA, 1287 bp, Bovine  19866880569249
atacagccttgacgaactctttttcctatttggaaccaatgtgttgttccatgtccaattctaactgttgcttcctgacctgcatacacatttctcaagaggcagatcaggtggtctggtattcccatctctttcagacttttccacagtttattgtgatccacacagtcaaaggctttggcatagtcagtaaagcagaaatagatgcctttctggaactgtcttgctttttccatgatcccgtggatgttggcaatttgatctctggttcctctgccttttctaaaaccagcttagctagaaaaggacctactaaataggatcctttctttctattgctttagtacaaaccacagagaaggcaatggcaccccactccagtactcttgcctggaaactcccatggatgggggagcctggtaggctgcagtccatggggtcgcaaagagtcggacaccactgagtgacttcactttcacttttcactttcatgcattggagaaggaaatggcaacccactcctgtgttcttgcctggagaatcccagggatgggggagcctagtgggctgccatctatggggtcccacagagttggacatgactgaagcaacttagcagcagcagcagcagtacaaaccaacattggtctccaacgtcaatttggatgttaatgttttcgaggtgaactttttggggagatggagtagacttatgtcaggcacatggtgtgtaattggcaactatccaggagagcctaagccaagagacaaccgcatgccagaaaccccaagaggcaaggcagccccacgtggcagacacgagcactgatctttgagccccttgtggggccagtgccattggcttcagcttctagggctgttggtatgaaaagtttggtcagtcagacaattatctttcccgccttagcttttttctcttttcctcaaattgccatgtgcagagaagaggctgggacagtgcccagcgatagactgaacatttgctacctcttctcttacaggcgggtgacaaacattaccacccgagttgtgcacgatgcagcagatgcaaccagatgttcacagaaggagaggaaatgtatctgcaaggtaaggtggtctggagtggggagagaaaactgggctatgtttgtttgttttgaagagaaggaggcatttcattagctgcaaggctacccagatcccaaatgaatgtagccaaatgtgacctcatcagttagtattaatcagccaagcaattgacatgctggcagtgagcccctgagg

SEQ ID NO: 56008 - DNA, 2035 bp, Bovine  19866880855882
atttttagtctgatagtgggctgtaggcaacccagagctgacccatctctaaaagaggtgataacgcagagccatggtttcagtggaaataacttgttaggatcaccgaagaccccaaagcaaggaaagggctatgtacaagaccctgtgtcttttctgactcttgtgaagtcctttatgagttatgttaaactagaaatatcaaggaaggaaaaagaatgagatgggatggaaaaatgtttgtaattgctggagaagggtaaaaaccacagaactggaattttctttagagatagcaacttgatgaagaaaagcagctgacaaactagaatcttatggagttggaagacatttcctctacactgtataacaagcttaaatatttttaattttaaaaagctctgctttctatatgtttcctataagttacaaagtcattactcaggtaataaataaatgggagctgcatgctgtttcccatcccctttctcctgagcatgcacttgtgctgtttggctgtcaggacatgtattgatcgttgctttccctggagcatcaggcagtgatgagacccttggattgctgttattgtgcatttctgactccaacatgctcttgggttggtaaggagaccaggaatgagatcatgagcaataagaaaccgtaagtgtttgcccttgcacaagagataattatccaattgggattaactttcaagaatgttgaacttgacggcaaatatttatctcctggtgttaagaaaggaaaaggtgtcaaacctttgaccttgactatacaatggtgtctgtattcgaaaaacaggttgcattaaagcagaaacatgaagagtttcttattgttccttccctggagttatgataatagtttttaccacctgcaaagcaacactgacctggcattctactcaatgttcacaggaatatctctttggattcccagagtctgtctgtctcgggtccacggcctagaatcagctggggttttgcaatctagttcgttgtctccctgtatcatattattcaaagtgaatttattgtaattaacatctcttttacctacatagcagtcctgtacactaggcagaatcagtgcttctccaccattttaacatactagaacatacaagccttttcagaaagtgcataggattgggggaatgaacagttaggtcccagtgcatccaatcattctgatagttcagtggagggttcaactgaacagatttctcaaagatccacctttcaccaggcctgacattgcacattcaggaactggggcaacccaatgtctaaaacaagccagtggaccctacccagctgacttctgatgaaaccccaggaacggaagatccttttcttgtctacagtttctacaattattgcccaaagtgagttattgttgtacaaaagatagtcttcagagattcccttggatctttcctgggtggttagctgctgcactccctcatgagaatttatggaagagggaaagacaatgcttattatttttaagctgtccaagtcaccaaagtaatttccactctttctgacccttgacgtgtagctggatgtgggggaaagggagaatggacttaattaaaactctagattgaaccctagttctataaccttgaagacttttcttagcccatagataggcagaagtgtgcccccacatcactggggggattaaacgggaaggtactaacattcaattacaaagcaaatgcaaaagataacagtaaaaacagttgctatgaaatgtttaagctcaatcacgagaggaaaagtgaaatcttttagtggccaccaaagttctcaactttccaatcccaattcttttttgaccttttccagtggaccttggtcctaactagaagtcacttttgaagcttcatgacaaagatttaggcagagagatccaggcagtgtcagccatcgcctgctgattctgagtcaattttcagaattaaacatgaggactatttgcatttcatccacgtctctccatcagt

SEQ ID NO: 56009 - DNA, 1888 bp, Bovine  19866880874329
caaaacgcaccaaattttttttgttgcttcaattatacagttacctacacagacacaggaaatcaatccaactagcagaaagtttgaaacttacattacaaatccacaagttttcctttaactttttaaccttttagttaactttaaaaggtctttacttttaaactagtgaagttactacttaagtgttgttttctggtcctgggtcaatgcctcactttacaggaatttaaggcgctttcttggatggtaccagtatcacagaactaagcaaaacacttatatccaatagaaagctcttttcttataagaattcaatgcctgcctatgcaatttttttttgcctaggtatacaatgtatgtaattcatggctaaggtctacatgtaagtcctacgttcacacaagaatacgttcaaacgtgggaatggtggaagaatttgaagagggacttaaaaagacttcaacaaatagttactaagttgaaaacagtttttttttgcctaaatttgtaaatttattctggctacatttaaattgttaagagagtcatgaggttgtctgtgcaggacaatgtcaatgatataaacttaatatgagtctctgtatgaatattttatgttttacatttcaatgttgaactctttctctcctgaaaagctatcaaattaaaataactcttgaattattttacaccactgagctaaaaatactattaaattgatgacagtgtaaatacattttatatcagaataatactttaatccctatttagcagtcatttctatcttgcttaacccagggccaaaaaatcaaaccaaagccagacagacacatagtccattcagcactggcttttactctgaggctggcttcaaagcacagaaatcctcttaatgtggagagccgggggggaggtagggtgggcagcagggctggaagcggagcagggtgcactgcagaggttctactgagtggacatcctggcccagaaccctgggggcgcacaaggcattgaactgtcctccagaggtcacacacacagggaatgcaagccagagagaacatgagatgctggggaagatgaagctgctcattgttcaaggatgtgctgagagcacaggcaaagaacaccagagcccaactccatcaaagattcacgatgctcaaatgcggaacatagcccaaattcccagcgttgtttatctatagtatgaatgtgctgtacttgtgtacagcctgaaatcaccctctttactcagcttgcagaactctatgaacatacagaggtgcacccagagccctgagtctcagttcttagcagacactcttggggtgatgtacactcttgggtctttgatggtgagtgcggtgactgacacattagatctaaaacagagcctggagaccaactgaagaataaatctgctccatgctgaacatgtaaagtgacacctgtctactgctcccaaggattcacagtttgtcctggggggaaacgtgtcatataaagcccatatgagaccacagatttggggcttgtcacttgccttcatcaggccctttaaaattcagcgagattttccactgtaattttttcagagaaatcattctaaagctaaaaaggatgtctgggttgtcaatttctcatacagctagcgttctttaaggggagagcagccaaagctttgatctagtactcaagaatcgtttctggagacttttcttagtttcataaaaacaaaaatcaagagcaaagcaaaccattcattaaaactacacatagtgttatgtgcagagatgaagaaatgacatgcaaaggccaatgagaaccagtaattagcaaactgaacaagcaatagctcttatattcttgctaattttactga

SEQ ID NO: 56010 - DNA, 1302 bp, Bovine  19866881004481
ggtggggcacagagatcagcttcttttgttttgtaagcactgacataagtccatgcagatccccatgaactggggaaacctgatggtagacgaggaagccaaaggcagtaacaaggacgttgcttccctggcaggtgtacgggtggggagagcggcagaaccacactagttcctggtactgctcctgaagaaaggcaaggtggggctaactcaggcttctttgcatttgctgctttttcccttgaagtgggagaggtttccaatgcaaccggactagcttgatctcgaagttaccactcacctgttccggaaggctgattcagcattctgattgggcaggataatgagggtgtgccttggcccagagtttggatcctgggcaagatgaataaatcagtctgcccaggcagcttgcacgaagcccagagggctctccataagtctgcaaagccagtctgcacagagactagcatgctgctgccccactccctcaccaactacaaccccaacagtggcccctgctccaaatatcagggagagggttccccagaaaagatgcacaaaatggtgtgaagagatatccacaagtgcactccaatgctctggttccctttgaccagctcaaaatataaaaggacaaaaaaggctgcaatattccagtggaaacgcatattggccttttgcaagtgattactgctgtctttatctccttctagatatctccttcaaggagataaaaccagtcaatcctaaaggaaatcagtcctgaatatttattggaaggactgatactgaagctgaatctctaatactttggccacctgatgccaagaactgactcactggaaaagaccttgatgctggataagattgaaggcaggaggagaagtggacgaccaaggatgacatggttggatggcatcactgatttgatggatatgagtttgagtaagctctgggagctggatggacagagaagtctggtatactgtggtctatgggattgcaaagagttggacacaaccgagtgactgaactgaactgaactgaactatctccttctaaggaactcagtacaaaaatttctaagtagtctttgcagtttaacagtacaagataaggagaaggcaatggcaccccactccagtactcttgcctggaaaatcccgtgggcggaggagcctggtaggctgaagtccatggggtcgctaggagtcagacacgactgagcgacttcactttcatgcattggagaaggaaatggcagcccactccagtattcttgcctggagaatcccaggg

SEQ ID NO: 56011 - DNA, 839 bp, Bovine  19866881074541
acagaggaacctggtgggctacaatccatagggttgtaaacagttggacacaattgagccacacacacacacatgcgacttggaaagaggaggacacaatgctgagtcttccaaagccctgattcctactgatggtttgaagtagtgtttcaatttcattcttgaaaagggtggtgaagtcccattttaaattcattctgcttacatttctgattgatttctctttgtctagaggctctgggatttgccaagtctccgtggataaactagagaggatttaagaagaggcaattaaagggctggagctgggtggtggtgggggaatggggagagggagcaggcatgagagatatggagccccccgaagctttctgagaggatggtgccattaccggaagtgctaacagagccggccaccaggggactggctggggtgaagccctgttagagccctgggaaagccaggcaggggtgtgacagcacaggatttggaaccaggaaacatgaattttgaatctgagttctgaaagagattacctcacttggtgacttgggtgaggcccccaaatcctctccattcataggatggaaacacttgaattctaccttttgtacttaatgacctcagttagagtcagcctcacccctctgggagggtcagcagtgacaaaggcctgactgaggaggggggctggaccctgtaacctactggtcccagctgatggctggagttgaaatctggtcaggcatgaccagccaccagacttgaggctggtctcaaattgccaggctgcacaaccagattcccctggagaacttaaaggaaaccggggacccag

SEQ ID NO: 56012 - DNA, 742 bp, Bovine  19866881236120
tttattttgattagattagcaagctttcctgtttcctcccacagccagattaatccaggcaacataggaaaacagtaattatcttacttttccaaccattcagacagattcctcctttctaccccagctccttctttccaggaagcttaaaatttgtacattatctgctatattatactgaaataagtaacttcatagctgcagtaaccctttttatggatccattcttataaaacttttttggaccattttctaagagacagaagacaaggaaacattagaaacccatcccttaaaagaaaaaataaagcatgctttttaataaatttattgaaagtagagggcagggtgatagtgtggtgacaaatctaaatattcagaaaaagggaaaactataagattttcaaactcctcacaagaaagtgactatcttacctatttgatgatagctagatgaatttgggttcctctgtgtttgaacactgaccccagggacatcaaaataataactatcgatgtccctcccacctattatggacactctggccagtggcccatgggatgacatagacccaatcataatcgcaatccaggttctaagtgagcagatcagatttgttccaggccaaaattcgcaccttactgaatcacacaatgcactggcttgtcaaatagggctccctgtctcaagcagccaggcagggatgctgaactggtggcaggctttttttttttttttttt

SEQ ID NO: 56013 - DNA, 1581 bp, Bovine  19866881359359
ccgcatctctccctggctatggaagaaatgggcttcaccgggtaagatttctcaatgactcgtttctgagtttcttccctcttcagtcctggttgaaatgttgacgtactgtctgaatatatctgacaatatgatctcagcgttggaatataatgaaaattgtaatctctctggtctcctggtaaatcactttgagttacaggcaaaataaaatatttcttttgagagaaagggaaattgactttagataaaacaattgcctatacaaattattctttttgatggtttattaagttattggccaattttaagtatgtttggaacaacttatgaatgtgaatctatgtttttaactttgtgttttatgagataagtatatcccatgacaatttaacatctgaattaagatatgctgtaaggacaaaacattagaagtacagaaaccttcttacaagtaaatctcaccaatagtttttatattgattgcatgttagaatgataatattttggaagccttggtttcaggaaaatatattaaaaatttaaaaaatagcctatagaagcttgtgggaaaactggattgtgtggcaaatttctacaatcaagtaaaaagtaattatatactggagcccctatctctgctgtaaaatgatacaggaaagtttgtctcaacctcgctccccacaaagcatagaacaagtgtaattgtgtagctctgatgcggagaaatgtgtttttatttatcagcaagagatacttgcttaccgagggtgtgagcagtagcattgaacatatacaacagagcccaaggatttcatagaagaaatatgtaggggaagtaatggcagtccagcaactcaacttggaaggaattctcaggatttttaaatccattcttcccttccacctgaccccaaaatgaggactgtgaagcgggttttctcatggcgtgtttcccctcctttcagcccgtttctacagacttcgctcagtacaacaagctaacggggacgtcagcgggggagcgcgaggtgaggccccagcgcggtgccgctgaccgcgccccggtggggtggggccgtgctgccgcaggcgcacgggctggactctgtgacatcctgcagtcagaccccgtctgtccgagagccaacatgtcagtatctctacagacatgagacgacacctttttctaagggaaaaaggaaagctacacacattccttccttgtaggaaggaattcactggccctactatgtgctgagcactggaagtaaagtgataagcaagccgtgggtctgtcttcagaatgcatgttgcagagacagagagagatagagaaactctgagatagatgctatgactggacatgcaaagaaaagggagccacatcttcagggtatcaacttccacgagaaagggtatttaaattgatagctaaaactgggacaggcatttcttggctttagggagcaaccgggcagtatgggcagagacccagagctgggggagagcatggctcacgggggcatgtttggagaattgcaatcggatgtaatctctggttatggtttccggattttt

SEQ ID NO: 56014 - DNA, 3807 bp, Bovine  19866880257263
cccacatatacatgttggccattttcttagagaaagtgtagcatcctatttgttgtttagtctctaagttgtgtccgactctttgagactccatggactgtagtccaccagtctcctctatccatgggatttcccaggcaagaatactggagtgggttgccatttccttctctaggggctcttccccatctagagatcgaaactgcatctcctgcatcagcaggcagattctttaccactgagcaatacttctttttttatatcatattttaaatattaaaatttatttttacatagtgatacgtaatgtttttaaattactgcttactatgccattgtatggacataccacctaatagccaccagttgattgcccactattcactgggcactcttgcaacctctttgtatttattcaatatgtatttattgagaacctatgatgtaccacacactgttgtagatactacagatactagcaactattatctcaggcttcacttcaaccttaagaattagctactgttattatcccagttttacagaggagaaaactaaggtttaagtaacttgtccaaggtcacaggattagtaaatagtggcaccagaatccataagcaggcagagctggtctccagtgcttctgctcttagcccctccattagcatccctccccaagtcagctttgataggcagtcagactacatgtggagaaggcgatggcaccccactccagtactcttgcctggaaaatcccatggacggaggagcctggtaggctgcagtccatggggtttcgaagagtcggacacgactgagtgacttcactttgacttttcactttcatgcattagagaaggaaatggcaacccactccagtgttcttgcctggagaatcccagggacgggggagcctggtgggctgccgtctatggggttgcacagagtcggacacgactgaatcgacagcagcagcagcagactacatgcagctggcagctgttataaacaacgctgcagtgaacatcttttctcaggcatctttgggttctgtctcctcacttttaaaaagcactgggaaaaggatacaggtgagttcattatattgttaagaatacctgttaacagtcccaggccatcactcagatcattttaaaaggtgcctttcttcaaaattggggatttaaggaatcaaaagatactacattccattcttaatatgaaaatcttgggttaagcctttaaaatacttccatgcaggccctgcgtgttggatgcatatttgcagatagggtaatacctggattaccattcccagcgtctctggtgggaagtggaatgtttttattaaaatttctcttgtttgtgtttcaggggagaaaaaatgaaagcagatctacaagccaggtctggttttaatcagagcataatctttatgagacaacgccaggctgagaatttttcaatctgatattttgaaagaaaaatccttgtttcataatgatacaagccaatcagccttagaaggatggaaaaaagaaatctcttgcatgaaagagaggcaggaaattccagagaagtttcacagggaggagggagaaacccacagtctgtatcactatttgtgagcttatttcttcatataggataatacttggttttgttgaacaaccaaaattcagttcagaggaagtagtggacttctttctccctgaagtgggaacataacgatttactgaacatattacaaacccacaatgtgtcccatgatccactggccctttaaacaaatattttgtcctcttcagggactcttcccatcatggtcatagatccatctcatattagatgatttaatgcctgagtaatttggagtgtctctgtagatattgctgaaatttttatatttccgtgtgatggtacattccactgatggggaggggggagtaatttggcaaacttcagggtgagttgttgagatttataagcattttcatataatgctcagctagagtgggaatagtaaaatctcagtctttcaataagctgcaaaactattaatgggtttctaggtcatgttgttcagggttaacactcggtggaatatatttttcattaaatatgaaagtgctccaagtgtgttttatacaggtgtgctaacttcactgtttcctggagtgtctataatttcaaaactaatcgagtcttcttttatatgcttttgcatgaattctggctttcttttgaacagtcataatgactcaatgaaggagactaaaaactggcaagaaaaaaccaataaaagcataaagtccagagtttcagagaaaggagatttacgaaatgatttacagtatagttccttcgaccagagctttcaacgttacatttattcgaaaatacctcatttagtgtttatttgtgccagttccataacatgaatcaaatcctgaaggttcaatgagcaaatcaagcaccattttaaaattcatcctcagaggacaggagtgtctcttctctttatcccattgtcttatctctttccaaaacaagaaatttaaatttttatctgactaaaatcattacatgtccaaatatcataggactgaaaactccatctgcttacacatttcagtttcctaagtccactgcaaaaagaaaaagaacactggataaattaaaatatctcatgtgttcctattattattctccatttagtcctctttgccacatattatatgtgggtacttagataaatacgattgtcttttcttctgttgcttaaatctctctgtctatgtgaagtggaaagagctcatccattatttgttactttttctataactgttaatacatacatggacccgagcaaagaggttgatagagtgaaggtctgcacagatgttctgcctgatttcaaatcccatttgaactctgtatagatgtgtaatagtgaaaacacattgccagaaataccaggtcttaatgctatgatgatggtgtatcagccgtccccagccttatttgcaccagggattggtttcctggaagataatttttccatggaagggggatggttttgggatggttcaagagtatttcatttattgtgcactttatttcttttattattacatcagctccacctcagatcatcaggcattagatcacagagtttggggaccgctggtgtaaatggtactgtaagaggaagaaatactcaaatattttcagcaaaaggatattctcctggtttaaaagatgcctcttagtctctgaatcctccagggcccacagtagaaagtcagtttcatcccactttgctaagtgtgcatcaagctgatgtttatcgagtgccctggatttttcagtataaagattgggagtttgagctttccttcaggttacgagtccagcctcactcggacaatgcctgggttcttctaacttcagtttcctgagtctgactcttgagtttgtcatggccccagtggctgtctctgtgaagggaggaagtggaatggaagggaattttaggggagcacttcacaggaattcagggcaaaaacttgggaggaaaacagtgtcaggctcttgcccaacaggcctccactgctgaacctgcatctatgtatttgtttaatatctgaattgatgtactttcagagaagatttacttcattctgaaatgttgccttattatgttgttcagtctctaagtcatgtccgactcttcacaaccccatgaactgcaacaccccaggcttccctgtccttcacgatctcccggagttttctcaaacacat

SEQ ID NO: 56015 - DNA, 5785 bp, Bovine  19866880468674
ctcctggaaatcgggagcagacagtcaggttacagaattcatttgcatcccggggactccatgtgcaaccccgtggcccgtcggggacgcattctggaggagcgaatgcatttaaatggagcgggtgattctgaaagaaaatgtgccatttcaccgcgaatatctcatcatttctccctggaacttaatataataccctcctggaaaaatcatctaaagattgggcttttgcccgtgtcctatagcaaaccctctccctgctgctctgcatgctgagacaatttagttgaaaaggagccaccttagaatttgccatatttctgtttgacaaagaggcagtttactcactggttacatgctttcttgctgagacatgaacattaggttggcagatattgaaaatactattttgatacttaacgcactttcttgggaatttattttagaagcagagtaataagagaaatcttcctgacttagaaatataaatatgatgctaccacttggggttatttatttccaaggcaatcaatgaggaagcgttagaaaatatattcagagtgatttcaaacctgatttcagtcaagtgagtaatctttccattttctttccatatgttacatgatttaaaaaaaaaaaaagatgaaatggtaaagaattaaaaggcactctggaactaagaccataaatatgaatataagactgtctatttttttaaggaatgaaatggctttaattatgctgaaacaaatgttgatagtgaagctaaatactgttcagcaaaatgattttgtacatatatatgcattctttttatattcttttccattatggcttatcacaggatattgaatataatttcctgtgctatacggaaggaccttgttgtttatccatcctatatatattagcttacgtctgctaacccccacctcccactctatccctcctccacccccaccgccttggcacacagaatcacaacgtctgtgattctgtttctgagtcatagatgagttcatttgcgtcatattttaaatcctacatataagtgacatcacacggtatttgtctttctgattgacgtcccttagtatgatcatctctaggtccatccatgttgctgcacacggcattattttattcgttctattccatttatacatttatacaattccattgtatatataccacatcttctttacccattcatctactgatggacatttaggttgcttccgtgtaaataaattataaataaaatacttactaaaataggctattataaatagaacaggcacaatattttgaatacagctggtggctccaggactttaggaaactcttgcagttgttttccaagctgaagggtcaaccagctgggatccgtctcttcagcctggccgcaggtctagatcaagtccagccccagttattatagggctcaatacttgagtttccattgtacttacacaccatgggctttgcctgtatttgttggcaaaagggttcagaagtgattatgagaaggggttacatgtgggtccttcacactagggccatgaaggagagcagacttgtggaggtgctcgaccagttaagtcaggcacagagagtgagaaatcacagggcagagaaaccctctttctggtaagatcctcttcctggactatgttaaaggttatttcggctggggttggggggaacttggtggaatgggtcaggtgggtggatcaagagcagatgctacctagagacccaggttggccatgggcctgtggatacctgcccttgaaggtattcatcaggagcaaaggtttggaaaccaatggccatgtccttgtgtctataaccaggtacgtgggactgggtctcctgatcgagtcagctcctttgggctctgcggggggtgggatggcttgcaaagttcagggtgaactggacgcaaacttagttttgtgtgctattgaccttggtgtggagacaggcaccttcccatccatggagcgtccttgtctgcaggcctgctttgctgatgatagactcatccactgataagcccggcaaggcgtagcctaggtgacactgccctcatttccctgcgtggccctttggtgccctcctagatggcagtggtagtggtttagtcactaagttgtgtctgactcttgcaaccccatggacagtagcctgccaggttcctctgtccatgggatttcctcttcttttttctgggacccaaggaccctcctgctctcaacccctccttgcccctccccaccaccaattgcctacaaagcttaacctcaggcaagaatctgcatatcattataatcttcgtgggttgttttccatcttctcctcttggcagagtccttggttcagatggtagaattgaaaattttgtttcccatttgagggtttcaggcagcaaactggcagaggaggacatgtaaggaacatgtctgcatgcagatggcagctcagctttggccctactgtatccacaccctgggcatacacacttggcaatatttggaaacatgagaccacaagatagaaatgtacttattcttagaaaagacatttggatgtgaaaagccagttcatctgtgcatatctgggtgaattatatggcttgagccacagcacatgacgttcagtagctgaagacaaacggagataattctgaagtcactctgagcagagacgaggtatctgtcgcactgtgggtaacagacaccttcaaatgcactcagcctggttctcttccagttctgtttcaacctactttcccagccccagtcgacacggctctcgcggctgtagcctgagaaaggaagtgaccctctgagatgagagggtttccctagtgacatccatccagctggccacagtgggggctcgtctggggcccacacagtcaggccatcagaatgtgccaagatcagcaataataaggtctttgcacagaattccttcatcatgaggggaaagcaggctggactgagacagacctgaacccagccctcgcttctaacatcttcagccaacggaaccgaactacactcagagaatactctgactgaagagacagaaggagagacaaaaagaagagataaaccaaggtcatggctgaaaaacttcagatacttttgcaaatcagaccgaaacagctatatcagctaaaaggtcaaagcatcttataggtaaagtcccagtggctttggtgctggaaagtatgactcctgccagaaagctccattcagatctacagaatgatggcttttatctatttagtcctacacctcccaaactttatcatcattgtcttctaattggtcttgatgccaggctcaagggcctaatgaaatcagcaagcacaactctgaacggaaagaagaaaaccaacttgtgtttggcatttgataaaatgcctgtcctagagaagattcttgacagccccttggactgcaaggagatcaaaccagtcaatcctaaaggaaattaaacctgaatattcattggaaggacagatgctgaagctgaagctccaatactttagccacctgatgcaaagagccgattcattggaaaagaccctgatgctggggaagattgaaggcaggaggagatagggaagacagaggatgggatggttggatggcatcattgactcaatggacatgaatatgagcaatctccgggagatagtgaaagacagggaagcctggcatgctacagtctatggggtcacaaaaagttggacacaacttggcgattgaacaacagggattggatatggagctctagacctgctattgctggatttttcccacaatggatggctctgcagctgggagggagaaattaccatctgatacccatgggggctccctgggttcctccaaaacagacagagaaggtctgaatatactgaccttggagaagtgactctccacctccatttcaaactgtcctctacttgattagcttcaagaaacacatgcttaccaaagattaggccaggcatcagggctgtagctagacagaatccctacactgtctagagcagaggtccctgacttttttggcaccagggatcagttttgtggaagttactttttccacggaccagaagaggagtggtggcttcaaggtgcttcaagcacattacatttattgcgcactatatctctatggttattatattgtgatatataatgaagtaattatacaacccaccaaaacgcagagtcaggaggaagccctgagcttgttttcctggaaccagatggtcccatcgtggggtgatgggagacagtgacagtagggtttgcacccctgatagtctaatgccaccaccagtctgataggagtcggagctcaggaggtaatgcgagtgttgggaagcagctgtaaacgcacatgaggcttctgtcgcttgcccaccacttgcttcctgctgtgcaacctggttcctaacaggccatgggtcagtaccagtccatgacctgggagttggggacccccagtctagatagtaaatactgtattatgataaatgcttcattatagtgtgataaatggtcttgtggatggatgcacagaatagggatacccaagggcacacagcagagagaactaatgcttgtcaagggttgaagatagcaggggcttataaactaagagaaggcaagttccctcaaaaagtgggacagtcatcttgaaaactatgaacgaatccattttcgagaggcattgcaggatcagtattaggaatatgggttttgaaatctggatgagtctgactctgtcacttgttgactgatgaatttcaaagcccctaacgtccttctactcccctttacaacgtgactttgcaactcctccagtcgagaggtaagagtctgcttctttactccttgcatctgattttgccatgtcgttttctttgtgacacaagcagaagcttgagcactgggctgtcctctccttgggttcctgggaccaccacaggcatgtcccagcagcctgttgttggatcagagactattagatgcggcagagcgctcaggtttttttgtgagcccagcaagactcacggtagaatctcccagctcagtccacccagttgcttgcccacagacttctgagctgaataaatgattgctgctggttatagaataaaaaggaattggtacaacaacaaaagagacttatgcttgtcctacctttggaaggggaaatatttgatggggttggagaagtgggaaaagatgtctgctcatttagggagatgggctgtgctttttgttattattactgagggtagggtaatggctcctctggctgggggactaccctggctgcccagagatgcttgccgatactcctcgaccatttccgttgtcacatggaccctccaccaacttgtgctacaagctgattgtcctgactttatattctcagtctccctactggtgccctggaccacttgtgtataggacacactctgtgtgttcattaaacaaaacgacaacaacaaaaatacagcttgcctctcttaaaactctgctataccaaataggaaggagttgaagcttactttagctttcacagcagatgtttttgcattcattttccccccggggaggagaggaaatgcaaattgttcatttgagcaatttctatcccttttggatggccccatcctctctatgaaatgtgcgtcgctcctcaaccaaattgtatgggatcatctttccaaaaggagaaaacctag

SEQ ID NO: 56016 - DNA, 1170 bp, Bovine  19866881035357
ctttcatgagaaataaaatgccaagatagatgcatggatggaaacttacacagagaggaggcaaaaagtattttttgtggattgtgtcttcatatcttggcaacacacattgtgtgggtctgtcaacaaagccataagaaagagggcagagagtggaagaatcagcctgatgaatgcatcttttttctgtgcaccatccagcttaactttcgacaaactttttacaatgaagcccccccgataactaactgcaaacacagatggggttgtcagcatgccctataggtcaggaagcttgggctttgcaggactgacagcaggaattggtccaaaatcaactgttctccactgagaattccctgtcagctgttgaagaaggctggctctgctgaattcagccctcaaagagtgcagagaggagggaagacctctcagagacaaaaagcagactccgcaggattttagggcttaagaccaataccttcccctgcactcagaggcatgaaagaagccagcgcatctggagcccagatgttccaagagagtctccctctgagcagaggctgtcccagtccaccctggagctcagagcaagtcaccaaagaaggtggccttgccccacactggaaagtggaagagcacttctggttgcagtctttatccaggctggagccttgagttcaaagtttctgtgcctctatttcctctccttggaaggcaaggctattctggtctcctggtggagtgaggataaagcaggacaaaagatgggaagagcaatgattgtctggagatagatatagatatagatatagatatagatatagatatataaaactccccctgggggaaaccctgttaaggactcagacaaacatatttcccagactcctttgcagctaggtgggggtcatatgtctcagtcctggccagtgggttggaggcagaagagacatgcatcatttccatgctaagcccagaaaacccacctcaaccatctccaccatcctgctgccctgtctcctggtcacatgcagaggatccaatagatgatcccaaagccagagagaatgggggaaccccagtggatggacctcagattcctgatcaacttcatagaagcctgccttcctaagtgtctcagaattggatagaataaaaacgaaactc

SEQ ID NO: 56017 - DNA, 2464 bp, Bovine  19866881046990
actctttattaagatgtacattatgtgactaaacagggctatcttggctcaaactgtgagagacatgtgttcccacttctacccccactgctcgcttctggggccttttcccttacaagcatcacacccagttcccccatcacaacctggctgcccagggcccactgggaattccctcccagagaagtttgcttccctgaattcccaagtcagtccattccttgcctccatccttcatcccttagcatagagatcacagcggggaggaatgaggattactaaatggactctcactcgggtttatatatatgtccagagttagctctcttagccttaatctttcaagagacacttattttaaatgagatgcttgtttactccaaagagtgactttctaatggaatttggtatcagctagctagatctttaggcatgggattgagagggtgtctctagaaagaaatctccacatttagtgcccaaatctccaaagtggtctcaaaaatatcatttacatggaattttgggcaggagaagtttctttctgtataattatgtttatatctgtttctatataactgctacaaactctgcacaggaaataatggaatcaaacatgcacatttttttctattggatacactgggtctttcattgttatgggatggatttttctagatgcagcaagcaaaggctactctttgttgaggtgggcgggcttctcgttgtcgtaacttctcttgttgcagagcacgggctctaggcatgcaagctcagtagttgtggctcacgggcttagttgcctctcgccatgtgggatcctcccagaccagggattgaacccatatcccctgcattgtcaggccgtttcttaacctttggactaccagggaagtccagacttcttttttaaacacacaaatcatcagattcagatgatttgtgttttctttttaaaaaatattgatttaatttatttatgcactgggtcttttttgctacagtcaggcattctctagttttggagagtggaggctggtctagttggggtgtacagacttctcattgctgtggcttctcttgtggtggagcacaggctctaggcgcgagggcttcagtagttgttgcatgtgggctcggtagttgtggcacatggactcagttgccctgaggcatgtgggatcttcctggaccagggattgaactggtgtcccttgcagtgtgaagtggattcttaacctctggaccaccaggaaagcctatccggactttttttagtatatgaaactgatacacggattgaaggctgctgccacacctggtacattgttcagatgctgctagtgcctgaagttcaagaaatctccacatttagtgcccaaatctccaaagtggtctcaaaaatgtcatttacatggaattttgggcaggagaagtttctttctatataattatgtttctatctgtttctatctgtttctatataactgttacaaacttttaggtagttccagtaatttagctcaatatacttgtcaatgacctagaggatgaagtgaacgatagtgtgaaagaatctcctgatgactcaaaagtgtttagcttggtaagagccaaggaagatcttaagatggttctaacaaactggatgactgaacaaatgcgactgatgacactttacagagaaagtcaaaaggtaatagatattgaaacaaataacttaagctccacataatttaagctgtacacactgatggacttagaatttatgttagtttcaaaggaaaaaagacttgctgtaggaatcaaattaataaagacaatttccataaagctatctaatctgcaatggtccagaaaaggccaaaagagtctagaagtatacccagaaaatgaaggggaaaatacaagaaaacatgcagtggacaggacaggatgctggcctaacaagttctctttggctaatttggtcctgatgttttcctccagttgtccctagccctagaaaatgaatcaagatctgtctaaaccaacaaaagtatgattccctggaccagcagcagtgggatgacctggaaacgtattaaaaatgcaaatttattaggctccattctgaatatagtaaatcagaaactttggcccaggaacacagcaatttatattttaataaggcccccaggagattccagttcatgctgaagtttgagcaccactggtctaaaccaattatgataatcccattccactttgccaatgattatgttaaggataagcgtgaactccctttaggccaatgagatacaagtaaaagtctgctgggggattctaagcaatatatttcctgaaaagaggaaagacctttcaccctttggccttagttctgtgagaatgtgatgactggagctgcagcatccatcttgtggctatgaggaggcacagttgaggactgcagagcaaaatatat

SEQ ID NO: 56018 - DNA, 1601 bp, Bovine  19866881089443
tgttgtacaaataatactgttttgcattttcatctcaagttttaaaattcaattatcttttccaagtgtgatgaagaacatcaacaaatattctcttctacacactttgagagaaataaccataaacctcatacaagaataatgcaaaggttttattagaaaaattttgcacattgacatcagaatcataatttccaaatttgcctttaaggcttattttttaaaagtcagcatggatgctacttctagagtctgtttcataaatgaagtttgttaatcatgaaattttttttcctatatcaggcaaaatatgatctttccttcaaaaagtgcttgggcaaactaaatttcagtattagttatttagagtagcattttcacagttcactgtgcacttgtactaactttttatttgcagggtgtttgcaatcatttatttataccatagctatgagatagatacaagattaatcaggaaagatagaacagctgtgtttatttcctaccttgctctccttagagttcttcaaaataaaatgtgtttaagggcaaatctgaagtaaagacttcagtgtgtgtacctcttaccattagggtgatattaagtggaatggtaaacacttaacaaaggtaaatcaactagacctaagagctacataaagagcattccactcaccacgagcaaggtacacattcttcccaatgcatatggctccatctcctcgatagactacccattcggccataaaacaagcctcagtaaatgtaaaaacgatcagaatcataaaagtatgttctctgactaaagtagaatgcagttaggaataaatagcagaaggaaatttgggaaattcacaggtatgtggaaattgaacagcacactcctaagtagccagtgagtcaaagaagacatcacagggaaaattagaaataccttgatgtaaagtaacttaacacattattgactgggggatttttgcagaaactaaagcccttggctggcagtttgttaaccctaagtgacttttgaaacacttcagtcaaaggctgctgctgctgctgctaagttgcttcagtcgtgtccaactctgtgtgaccccatagacgacaagcccaccaggctcccccgtccctgatattctccaggcaggaacactggagtgggttgccatttccttctccaatgcatgaaaatgaaaagtgaaagtgaattcgctcagccgtgtctgactcttagcgacctcatggactgcaggcctaccaggctcctccgtccataggattttccaggcaagagtactggagtgggttgccattgccttctccgtcagtcaaaggcactcagtaacaaaagatgcattaatacctctctggccaataagttgttacagtgtaacccaccagaatttataggatgcaactaaagaaaacagtgtttagaggaaaatttatagccataagtgcctatattttttcaaagaccacatgtcacatgattttatttatatgaaatttccaaaataagcaaatctacagagacagaagatagatcagtgatttctagggacaggcagtggggcagaggatagaatatttggcat

SEQ ID NO: 56019 - DNA, 794 bp, Bovine  19866881253130
cagtttcaaggtatttatggatttttcatatcaacatttcctgcaaaagtttgtgagtaattttcattaaatgaactcacccagaaaataaatgttgaactctgtagctctaacatggtcctaaattcttagcttaaagtgaaaagggcttaccccaatccttaactttttataagtattcagacattcctttggatgccaaataataaatttataatgctaggtgcccagcaagatgacagtccagttgcctatgtacagtacttaaataaaccgattgcaattccacaaccttattgcttcatttatcaaaagaagtgccagagttctgaaatcttttgtaaggagagcaactttgcttgtgtgaattctcacaggaattaccaagaatattatgccaattcaatcctaagtattgaagttagagttctaaatgacatttaatagtatgatttattttctatcttaaactttataggtcacaaaaacaagatcctatcctttcatattgctttttattgttaaagtggctgagtgatgataaaaatctaagcttaagaactgtcagatgatttatgatatttcatttatttttcaaaggattgaggtgtcaccagtaagcccattagaattgtaggtttaaagttcctcaattttaaaaaagaccagctgcataaacaagtgtgttagctttgtaatttaattctgtgtgattttttttaatacttcaaagttccaaaggaggcagcttttcttaggtcataaatacttatttatgtcattatgatctctaa

SEQ ID NO: 56020 - DNA, 1533 bp, Bovine  19866881273891
ccagctcaaatagtgagcgagcactctgttgggggcaccaggagataacagtgtgctttggttgtcactctgccattgttccttggtgataccacatacaagatcaaacctcatgggcgggggactgactgacagagacttgggacattgctggttctctcgagataataccatcccagccatcaaatcctccctgctctgacctctaagctctgacgattacctgtcccggacctgggtcagttactcccaccaggaggagactctgcacatggactgagagtccattagataccagttactgctcttactatgggctctgcccctgcagcaggcctctaagtggaatcctgtgaagtgggtaccactgtgcctgggtctccatcaccacatgcttggtctaggctgattcctgccctccacctccagcccctctgggaccctggcctgccacctggctctctgttgaccatctactccctggatccacaccccgcttcgccccagcccctgcttttccttctccagtttgcctgtgctgctcacattctgtcttgttttctctgggtggtgtttcacctagcatcttgccggcatggctaaaagaaaacttagtgagtgttcaagacaccctggacccaagcagaacacaagagctgctggccagcagggggttcaatgaaggtcaggtacgaggtgaactgtggacctggccaaccctggagcctcctgtccttagaggaaggctggggggcattgccagcatctcctgtgttcttgcagtgcctgtgccacttgctgggaatcagaggaaggcaagacagatgtgatccttagcctccaggacctcaatccaatggtggggacagacaaccatcacaaaccaagtgaatgaaacagcccagtgtggagagcgctgtccaggcatggccgggtgctggagatggaggccaggcagccagcctggaggcccacttagacctgatgctggggacgccctctctgaatgccttaattgcactttcaacatgaacttccatcacatctcatacagatttagaaagacttcatcagcttctcttacatttttgccagtttgctagtcacaaaattttaaaaaactaaaaacacaatcaccaggtggtgagcagagaaacctgtaaaagtgagcatccctggccccaggcacagccccctctttgttgccctttgacaccttttacttgattgcacagaagcctggattaatttttcctggcccgaggcccatgctaatttgcatggctattctatataagagtcaggtccaggaagacagcaggccagcctgaattcacaaacaaagtcacatccatcaagtagccacgagctcaatatacttactgagaagaatggcgggtaatgagaaatcctactgcggcctgaaagcgtgactcaccagggctgctctgtggtcaagctgatgggtaaagcactccatcatccttatgttcccttgtcaaacacttgtgggcttccattttgggctttaga

SEQ ID NO: 56021 - DNA, 1241 bp, Bovine  19866880450165
tagcatattcaaaagcagagacattattttgccaaaaaggtccgtctagtcaaggctatggtttttccagtggtcatgtatggatgtgagagttggactgtgaggaaggctgagcgccgaagaattgatgcttttgaactgtggtgttggagaagactcttgggagtcccttggactgcaaggagatccaaccagtccattctgaaggagatcagccctgggatttctttggaaggaatgatgctaaagctgaaactccagtactttggccaccgcgtgagaagagttgactcattggaaaagactctgatgctgggagggattggggcaggaggagaaggggacgaaagaggatgagatggctggatggcatcactgactcgatggacgtgagtctgagtgaactccgggagttggtgatggacagggaggcctggtgtgctgcgattcacagggtcgcaaagagtcggacacgactgagcaactgatctgatctgatctaatgaaaaagaattaggtatgtgttaacaatcactctactgaacaggagaaattaacagaacattgtaaatcaactatatgtcaacaaaataacaattttaaaaactgtattccgttcaatgacctatgtgttttctcgtagtactaatctacagttttagtctacaatacataataccgtagcctatcagggaacagattcctacatcattcaaatccatagcctcctaaagggggtgatgcctgagctgaatctagatggatgcactgaaattagtcaaacagaaaacgaaagagatgtccccaacaggcagaggcagtgtggtgcagtcaggggatgaaaagccattagcagttgctggaatacaaaataaagagggtaggggggaaaaaaagagggcagggacacgtttaggagaatcttaaaggttctgctaaggcctgactcttatcctgtgggcctgcagaaccccaagtggcttcacacacagagtgtaaattgaggaacctcaccctgcagcaaaaaatagaacgaacttaggggatgcaagattggaggaagggtgcgttaccaggacagaggtctggtaaaagagacagactgaacgtacgtgtggcttgcagcccctggctttctcaccagttaaaattacagttctgatccctagtttagtgaatgccaatttaatctcaagggtttctgaacagaagaggaacactagatcaaagcagcgtgtaaa

SEQ ID NO: 56022 - DNA, 2451 bp, Bovine  19866880600010
agccctgctggacatgcagcaacctccccggctcaaactcggaggaggccaaagggctaaggtgggggctaggggctctgtcccgggcctaggctgaataactgcaatcttctcctaggtgggactcaggatattcaaaatagagcagctactatcagcacacaccctaccccaagaccaagagacaccagaaggggccagggccccaagagtttccaaagacacggaacacgtcacagatttcaggggagctgcccacagcctctggccaagccctgggagcaaccagggatgagtatatgggggaggagcgggcacatccattactcgactcctttctctcagagagaagacagcagagagccagctggaacagctggtgggaagtcatctaggttcagacagggtgctgctgctaagtcacttcagtcgtgtctgactctgcgaaaccccacagaaggcggcccatcaggctccaccgtctctgggattctccaggcaagaacactggagtgggttgccatttccttctccaatgcatgaaagtgaaagtgaaagtgaagtcgcgtccaaccctcagcaaccccatggactgcagcctaccaggatcctccgtccatgggattttccaggcaagaatactggagtggggtgccactgccttctccgtcacacagggtggggaagcctcaagtgagtcctcagtcctcgcctctctacctggcaaagcttcatgaccttgaggccagcaggcaagaggtagaggttgggaagcaaagaatcccaacaaatggcctttcccgcttttgtcctcttcctccccctcctcagaggataggtgtgccaactcaggaagtgaggcccatgggatccccagagtgccgtgcccttcaactcacctgtgtccatgtgcagacaacaagccttggcttagggagacagggttcccccgctcaaccatgcaaagccagagccccagcagcctgccccagggcccagttgctccatcctccctgccccggggttcagtgcagacaccccagcatctttcccggggaccaaagctggtcttgccaaggacatacctgggtttctgggatggctccttggcttctctcaagccaaaccagctacttttggccttttcctccccactggacgagtggtggggggaggctcccagagtggggctccccttctcccccagagagcctcggcgccccatctcgctccgactcagcccctggtggtgatggtggaaaaggcccatccggggcttccgctcgtccttccgggctccctccttctccaccgcagtcctcagaggaggccaccatgggggtggtgacctgcaccggcctcccctccgagggccgggccccctcctcctctccagagcggcgggcccccacggccaacactctgggctgtgagctcagctcctcctgtccaggcactgcctcggagctgctggggcggcggctacctcgggcccaggagtcatccgcagaccgcggcccctcctcggagggccgggaagagccagcgtgcagggagctggagggtggaaacgggcccgagatggaactgcggtgccgtgggggcgccgggggctcctcgttgtatatgtggctcccgttgacacagagagaggagcgcgaggccccatcgaggtggccctgaaggtcaagaagggcccggggaggcgctgcccgcatctggctggcctcgtcactgtaggtccgtttgtgggtgagcaacttgggggactgtgcaaagtcccggcctggaagggaagcacacgttgggtgagatgcctgctcccctccggccttccctacagccgaggggacagcccgccctccactgccctcgctcacccccttctgaagacagccagctgctgcggctgggcgagcgggtgaggagctcggcgccggggccctggtaggccaggctcccactggccgaggacagagtgctgtccgagcccagcgaggtgttggactgggtcagcgaggacttccgcagcttgttgcggaggaagaagcctttggctttgcccatcttgcccaggctgcccagctcggggtcctccagggcactgctggggaggatggcagaggcagattccaggtcaaacttcttcttgcccttcatcttgtccttaatcttactgaagggggaccgcggcttgtccttcacagacaggtcgaacatgctggcgctgaggttgttgcgcgtgaactggatggtcacctggatctccccgcgctccttctccttcttgcccgccttcgagtgcagcttgtaccacctatgaggaagaagggggtgtcagggctccggtcacagggacctcccagagcccctccctgtccctgagggtcatgacagccactgctacagcctcccacaggcctggaggaacccttacaaccccaggcccca

SEQ ID NO: 56023 - DNA, 605 bp, Bovine  19866880779076
taattgcctgcttgacatctcactctgatatctaataggaagctaaaatttaacatggctgaaacataacctttaagacacgactatgtctccaatctttcttcccagtgctttctgtttcccaaaatgcaccaccattcccagggtattagctttctattgctacataacaatattaccacaaacttaatatcttaaaataatacacatttacaaaaaaaaacccaaaaaactctccaggaagcaggcatagaaggaacacacctcaacataataaaggctatatatgacaaaccatatatgccaaagaatgctcaaactactgcacaactgcactcatctcacacgctagcaaaataatgctcaaaattctccaagctacgtgaactgtgaatttccagatcttcaagctggttttagaaaaggcagagggaccagagatcaaattgccaacatccgctggatcatggaaaagcaagagagttccagaaaaatatctatttctgctttattgactatgccaaagcctttcactgtggtggatcacaataaactggggggaaattcttcaagagatgggaataccagccccacctgacctgcct

SEQ ID NO: 56024 - DNA, 1566 bp, Bovine  19866880785571
atgctttaactttagaccattaatactgactgcagatatctggcctctagaacactaaaaggaacacatgtgtgctattttaaatcaccagtgttatggtaatttgttgtaaatggcaataggaaattaatataatgtccaatctcaaacatatttgatttatattttataaattttgaattcattgaaaacacataaaaactttaaaatctcatactctgaacattgttaaattggaaaattaggcagtacaaattttccccatcaatatgcagaacttaactgcagtttacccgtttcccaaatccattccccacccaagaacaccctcggcgtactttccgcatctggatggaaagcctcacgaaacagccccacagctgtgctttggcactgccagtgggggcccttgggatatccattcttcccctggggtctccattctgaagaggagattggcctagaatactctggctgccttcctggctctcctcccaatttcctctgggtaactgttttgagcaggatatacccacacccttgccaaaacacattggctctggagactgcctggtctgaatcacacttgttgaaaagcaatattttcctaatccacagttttgcattgccgttagtggaaaatcccaaattcttaaagtggcccacaccagccttttgttaatgtcgtaaatgctcccagcaattccttatcttggacttttgcacaagcccttctttttcatttttctgctgcgccccatgacatgtggaattttagttccccaaccagagaccatcgattgaacccaagccctctgagttggaagttttagagtcttaacccacaggactgccagggaaattccaagtcctttcctttttatgcaaactgttctgggattcctttcactggtctcacctaacgtaatctcttctgggaaaccatccctgaccaactgaaatgaatctccctatattccctataacatagtcccctatatataagccccataatacaggctcccgtaatccttcacagtgcttactgaactttgtagttttatcttttttgcggttaaatatttagtatccattccctggtggctcagatggtaaacaatctgcctgcaacacagaagaaatggattccatctctgggttgtgaagataccctggagaagggaatggaacccactctagtagacttgcctggagaattccgaatccctggtggctcatgtggtaaagaatccgcctgcaatacaggagacccaggttcaattccttggtcaggaagatcccctggagaaggaaatggcaactcactccagtattcttgcctaagaaatcccatggacagaggaagctggcgggctacagtccatggggtcgcaaagagttggacacgactcagcgattcacacacagacatacacacatccattccttcacaagagttcctcccctcatgaagggagcttcttgagaggctgtgtctgttcctcatttgttgaatcaatacacaaatgaacgggaaccatttacaaagacacgttccccctccat

SEQ ID NO: 56025 - DNA, 1844 bp, Bovine  19866880888204
acttcactctaggtccgcagcccaggagcagtgccccccaccccccactccatggcctcaccgggtactccgggcatactcctctttgctctccttcttgcctcgctgccggggcttcaggttctgcagtgtcagcgagtgggcctgggtgcaccactgagccagcattgccagaaactgcagggagagaggagttatctgggcataatgggatgtgagtctggttggcaggagatgaaccagctccaggataggaggcctcaggagaacatttcagggagccaggttgaaactggggtgtggtaagcgttgcaaggacaagaccttgcagggctagactctgccagggaaaagatggggtcacagcaagggtgactgggagagcaggacagcagagaggtacaggcaccttggaacagacgcgggcgttctcgagcagcacccgggtccagacggcggggtggcgggccacgaagcgccagtcccggcagacctcggcagcgtgtagcagagtgcgcgtgtccaggtaggtaaagatgcagaacagggcagctcgcatcttgaggatctccgggctgatgacctcattggagcgggaggggctgcccctctcagctcgccgaccccgcccactgcctccctcggggcgggctgcacaataccacagggtcagaggtcagtgtggggggtacacagatggggagctggggtagggccggaactgcaggaggaatgggcatgacagaaccatgctgggggaccagaaactggggaggagggacaaagggcctctgcttccccctccactgcattagtcccctccctaattttgcaaattagaaaaaggtggcccttcctcaagtgaactttctttttaaggtcgtatatcatgacactgtgcaaagtcatcccctagaggaggcaactgagcgattggaggagggaaaaggtttggatagaaaccgtgcatctgtgaacagaaggcaggtgaggttgcccagagcagtcaccaggcacagccgtgcaacctgacgtgagctttctgcccccggacccacccacgtacacatgtggccctgtatggatatgggagaggacttgccccactggcccctggcttcactttgaactcccaactcctctcctatgaatgtcacatgaatggatacctgtgtcccagcagctcctgccctaagcctgcagggccctgtacatgtgggaagtctggggcaaggggagaggcggtgcaggagcccaggagatttactgcctcagccctgcgtgccctgagagcagtcagcaccacggaaaacccagtctcttagtacccaccccctcaggactcaccagagagccggcagctgctcaccggcccagccatagcaggcccggggcgggggacctccgaggggccctcagcctcggactcggtggttcgggagcccacgtcggagacgtcaccttcctccccttctgtgctgtgtcgacggggtctgcgctgccagttctggatggcctggcgccgcagtccagagctgcgagggggctgggcccgctccgagccaccattggcagcctggacccgcgtgcctaagcccccggggccgctgtcctcgggggccccctcttctggccggggcaactccagactgtcactgtcataacaacctgagctctgagatgcagctgggatgcgactggaggccctggggtggggggtggaccagacagtgaggagcaaagggtcctaggcctgcccagactctccataccacctaccacggccaagggcaatccacccaccctactgtccaaaagtcccctctgagtgggaaaggcagaca

SEQ ID NO: 56026 - DNA, 1788 bp, Bovine  19866880938992
tgcagcctggtattctcgagacggtggtccactgcctcagggacagatggttttccaaggaccgctgctcccgccttttctccctccctcaagagctctgaagagcagcgtggaccgtgccctccctcgccaccaggtggcagggcacacctccttccaccagctcatctcaacacccagaagtcatcctgtattctaagggagtaccctcaacagaggcccaccaggaaatgtgaagtgctagagaaattagctctggaaatgttggtggcagactccacaagcggaggctataacatacacttattggagagaaacggagtggttcccgggaaggaatggaagccatgagaactcgttgtgaaggggttggggtaataatacagcagagttcaaggcaaaatgccagttttggcaaaggcacagttaaatctctttactcgaaataaagatggctagggggtcaagttgagtagctagagggaaaaagatggtgttcaggatagcatgtctgctccaagggggcagctgggcctgagttccttctatgactggtaacagttcagacaaaactaaaaaacttcaggaaattctgtgagaggcagtgggctaaatggtctatccgtccttctttgctctcaattccaccatttccagtggggaagagtctgcaatgcccagatgctgattcaaggaggccgtatctcctctacagccaggtcaggcaaagattactctctggagaggctggggctgaggtattactcccacaggtgaaggagacctataagccttagtagttactgcacacttagtgttgagcctggcacactcttaagtgttttacagacatcatctcagccctgggaggtcaaagttatcaacatacccattctacaggtgggggaaaaaaccctcagaaattcagtaacttggccaaggacatagctgaaggccaaagtctgtacctgtgactatttgcattattacaactcccaggggtcaatacagaaaaagagggctcctgctttacagttcagattctcctgatgccatttgacctgacaagctcttcattaagaattggaacaaggagatctgatgggtgcttccaggaagaactagcccagcctggactgagcctttgttgcagtcctcagctgtccattcctgactccgcatcttctctctggatgctggtgtcagagctgctggagggctcgtctggagaggcagccatggcagatgcagctggcagtttcagcctttgctgcttttgatatttgacccttcggttttggaaccagaccctcacctataattgaggcagtgagaagagataagaatgtgactaacagttcccactgcatcccccattcccacagtgcccactcctctctgaaaatttactcttcattctaagggaagcacacccttccctctaattccagtaccactcattcacccaagtatttactgagctcctgatctgaactctggagaaggaaatggcaacccactccagtattcttgcctggaaaaatcccatggacagaggagcctggtgggctacagtccatgggattgcaaagagtcggacacaactgagcacttgtgtattggcttcactttagacatccacatctgaggcagtgctggcccttcccaggtgatggtgataatagtgaagtacgagctccaccctcacagagctcacagtctagtggagggagaccaaaaacaaatatataaatacaaatgagggtacaaataggagtttgagcctcc

SEQ ID NO: 56027 - DNA, 1948 bp, Bovine  19866880987955
tgatactgtgcctgccctgacctcaggggcagcagcacagtgttgcctagtgggctgggctgtcttttctcattcccaggttgcccatacttgttgagtactgtgggaaataacagagggatttcaagactcgattcctactctcaagccacttagtctagtagggaaggatgagatacagatccaagatacaaatggttcttcatggccagctagactctccacagctaggaaaagtctgtttcttgtggtttaatatgattgaggaactgactgctacagataatgcagtgtccagaaggcatgagccaaccctgcacttcaccataagcctgaggagactcaaagttggccagtggggagggaagttcctaaggtcaaaaccaaacatttctactgccctcttgggcaaaacaggcagctctccctctgtccttcccatagtcctccccctagcctggctcactgaccagataattcagctgggaatctgctagtctattctgcatgagtgtgtttattatccctgctggcgccttgctctacagttggtggtactcttgcttaagggaaagtccttgtacctgatggttattaagcatctctgaaactccccttccccatcccagttctcttcctgccctggaattgcacccagaagagatcttctgttggccagaggaagagaaggctgccagggctcttaagcccctgctgttttaactcttacagcaataggatatttgagtctctgcttgagccctctcagcactgaggacttagcaatgaatcccaaagtcacaacttctgtcctgtggaccccacagaagacaaggcagatactcaaaaccatgctgctgctgcagtcatgtccaactctgtgcgaccccatagatggcaggctcccccatcaggctcccccgtccctggggttctccaggcaagaacactggagtgggttgccatttccttctccaacgcatgaaagtgaaaagtgaaagtgaagtcgcttagtcgtgtcttgactcttagcgaccccgtggactgaagcccaccaggctcctgcatccatggaattttccaggcaagagcactggagtggggtgccattgccttctccgactcaaaaccataaataattataaatgcaacggctgcgaaaggaaagtgctggctgataggaacatgtaagattttgcccaagcagggcgaggatcgggaaacgcaatattcaggctgaagccagagagagtctgcgttaggccaaggccaaaagttaatatcttctgggtcaatggcgacgagcgcccagaatgctccaggagctgaatcagggtgactggagagcaagagccaagggacagtgtggtgacagaaggacctgcatgaagattctgcagtgtgatatttcgtaaaaaagctttccaagatttccctactacgtctggagtccttgcccatctggtccaagggtcgggcccatatcagtagtgtccttctgggctgcagctccaggggcgacgcccactggttcaactcaaaattctaggggcagtaccagcgaggggtcgcccgactgacccctattgagatcttaagagacgtacacgcgccctcttctcggactgccgacgcctgcaaaattagcggcaggaacccagacccagtctgagtcattggaactctccgcagtctagggttgtcaagctccgagacaagaaaaactacactccccacaaccctttgcgccttcggcttgctgcggtagcttatggccaatcgggacaggcagctgtggcgggggccgaggagggacattttaaaagggccggagattgcaggcgtcagtggccatggcggatacagcgactacagcatcggcggcggcggctagtgccgctaatgcctcgaccgatgcaccgccctttcagctgggcaaaccccgctt

SEQ ID NO: 56028 - DNA, 777 bp, Bovine  19866881136043
cccagaacacaggctgtgtccccgtctcctctcctactctctccccttcccagctctgcctccaggcccggcctcaaacaaaaggaagttggacctttgtcttaacacagacttagcccaacagcccttggcaaagagcagcaatggcctgggaacttgccaaaggagtaggggaattatccatgactaagaaggagaaggaatgctgtggcagagggaagaacagcagagggatggagaacctggggctggccaatctggcccgacggggcaacctggggagccttggacaccggcctagtcaaacttcccccctcctcctccctcccaggcagcaagatgccagcaaggactagagacatgtgtgccccgtgtgtctggtacgggctcacctggctttggcaatgcatttggattaggattcaaatcacggtctgaaatagagtataaaagaaatggtggcctgtgtgcctaatccttacagacaagtgctgagcttctgcatttcctacatggaaacacatgtgctgctaacatggaactatgtctatggcatttgttaggtcattctggacgcacgtgagttccaggcatgagaaaatgaatgcaagtgtgtcggcatgtgttttttgggtgattatatgatgccatattctgtgaacacactttagcactgttgtggaatggggatgaagatatatctcacagtctttgtagaacaaaaaccaaaatctaccttctaatccatactaggcacttaaggaataaatactggaa

SEQ ID NO: 56029 - DNA, 924 bp, Bovine  19866881194037
agggctttgactggctggttgtgaagatctcaacagctcagttgaggtactttagacctcagttctagagtactctcagtgggtagaaaatacaccagttccctgaattagggctgtttgccctggtacttgcacttcctctctgctcactgcttcttcctctgcctttgcccattcctaaacctggggagcccccatgggtccatactagctagcccttctctcttctctcaaagcactttctttctgcataatctccccctcttcttgccttggctggctttcctctctttggaagtatccgcagaagaaagcctcctccgagaagacgtcccagttctttgaagctataactaatctctgtccttcatactcacatggaatctgctcttgtagtttgacggttgcatcacttagctgtgactctcccctaccgtgagactgggagttcccagtgggaacaaatggtagtcctcatttctttgtagccctcgtaaacccagcacataaaataggtctcaagcaaatagatgtttgttgactccagtctaattaaagagcatagaatttcagagaaagtcttaaaagcagcatgcataagaaaaagctgggaaacagtaggtaagtgcaaagtgcaacgcgtgttagcaatgtgtgcccctctgtgtcgctgcgcgttcctgggagaggaacaaacaacttgtttgctcttggcctgtcaggggcaagggggttcgggaggggcagaggagcggggaagcaggtgtgggagggagctgaggcagctggacaggaggtgtggggcttccctcgaggtagccctcaggctctctcttcctgtaggctgggctggacttgagccctgatatgtgagggccctgcatttcagctgcaatgaccttcatattccccagtagctccttt

SEQ ID NO: 56030 - DNA, 1430 bp, Bovine  19866881207275
cggccgagggcagaagcagcgtgcgctgcacttgccgccccggcgccccttgcgtcgcgccttggctggggggaacggggccggcggcgggacaggaggttcgggcacagcgctgctcccggggatgtccgccaccagaggtttcgggaagtccgccgtggcgctgcgaaggcccagcggggaaagctcaggctgcgtaccatctagaaactctccgccttcgccgctactccctccctccccactaggaggggtcaggagccccgggaggctctcggctccttctcctaagtcacccggggccagcgggaaagcatcgtaggtccccatggtgtagagtctgctggcagggccacccggcagctctgcggggcagctgatggacagcaggtcttcaatcttggcccccgtcgtggggaaacgggcctccggggcggcctggtagcctccttgtgacccacagctccctggagccccggctgagagcagctcccatggagaatacggacctttgaaggccgaggcagtgtccagagcaggggaagccggaggagcccggaggcctggcttgacgtcgggtgcggagagatgaggctcatacaggcactgtgagggggcgcctgccgagggcgaggcctcccagaacgcctccgggaaagcagcagcgcccggatccggggagaaaaggtctggcggacctggcagcaaggcgtcggagcctgcgggaaaagaggcgtccagaggagaccgggatgctgccgcctcagcgccggggaaaggtgtcaggcctaggatgcccgacatgaggttgaagagtgcttctggatcgtgcgggtgttcgggtactgcctggatgaagaagctaccactgtagccgaggccagggggaggcgtgggcgcaggcccctccaggaggcaggagtcggttaagtactccccggcgccacagctgctcaaggcccagctcaagaaatcacctgctgaggagggagcaggaatcagctccgcgcacatcaaagccggagcctcggagcccgaagcccctacccaagaagccctcggtgctcgctgacacacgcaaagtgccttttgcacattccgatccagcaggagccggcatacgccccaagacatacatacaaacatgcacacacaaaacacacgtgcaaaagcaaaaggacgcctcgatacacgcacaggttcctgcggaggcgctccaggcccggtgtgggtgggactggggatgcgcaccacaagaccccgaatctccttccgcccctatccctaccgctcgagcgtccccatccctccctgttctcagccaccttgcgtccccgcggtgcgccgccgtctgagcacccctggcctcgctccttacctgccggatagccggggctgcgggtgggtcccggcgggcagccgggttaggt

SEQ ID NO: 56031 - DNA, 997 bp, Bovine  19866881243687
agggaagaggaggggtacaaagaaggaccctgatggtgggtcacttgcctcggggacagatactggactccttctggcctagtggtcagtgaggcataggggcactgcagggtcccggggaggggcgctacgtactgcagaaactgcagttggacacaaacttcatctctcctgcagcctcagtggccttgctctgtgttagtcgggcgtctggatcttgcctctgcccctgcttttaaataaaccctctcgggagaataatgagaggcagcggaaggggagatgggagagaagaaaggaaagggagagtgggtagagaagagaggaagagaggagagagaaacgctgtgtgcctgcatctccacggccccaggaagtgggacgtggagctgctcctcggcattctgtgccaggagtcgccatggagactgagcgctggcctcttcatgattaatactctgaggcagctgtcttcttggagtcttttaaaatatacactattatttgaatacaatgatatttagagcagaaaaatcaaggtggggagtggggtaggagacagtagcattaccagaatgatggcagggtctgggcccttcccagaagagagaaaagggaggcttacttctctgatccctctccctccaccctccctggatccagagcttccaatctcactgcctgagacatcagcatccgcatctgaagggcctgtgcagcgcctggcacagggctgtattcaatgaacatttgatgaatgaatttgttcattcattaattcattcagtaattgtctattcaatgcttgtctagaaagcaaactctccttccatcaccttttcccacggaagccagaaatttcctctcgctttccccacaatcacagctagatcatcaccaccacctttcacactggctcccaagagccttgcacgccgtcctcctcagcatgtgtcgaaagacccaccatgttcctaaggcagtcactccagagaat

SEQ ID NO: 56032 - DNA, 881 bp, Bovine  19866880230029
tttcagtttctacagatcctgccgatccctactgcctcacactaatccagaccatctatttgtgttaatgctcaagcccttggttacctagatcctctgacaactttcataaggcgggctttgccccaaattccccagagtttagatgactttcacttttcctcttctagtctaaccctccgcttctgactcacttgtgttacgggttggaatctgtgctgtgctcccatcttgccttcagcttacactgcttctccccctgtcagtccactgacatttaactaccctccagggtgtgattcaaatatcacctaaggcttgaactcctttatccctgtcaccagtgaaatgtgtctttaccttccgctgaaactcagtggcacaggcgttttatttcttgggtccctttccatattctcataattaacatgctgtttgcatacgctcctcccctacaatatatgtgcctttgaggaggtcacagccttgtttataactctcatgctttctaatcagtgttcaatagacattttatgaccagaaagagtaaaaatccagctattggcataagttattcttccttcctgttgcccatgcctccctcttttgtgtgtgtgtttaaggagagacgtggcacacatacattacataattttctctaacaagggcatgctgaactgggcaaatgttaattaattagtaaactctccagtaatctgggtctactttatagtgcttttgtgattgatttaaatctagtgcctttctgttagtagttttattgaaagaaagacaaaacgaaagagagagaaaaagaacggaagaaagagaaagagagaaagagagggaggaaggaagggaaaaaaagaaaaattcagtct

SEQ ID NO: 56033 - DNA, 2452 bp, Bovine  19866880517773
aaaccattttgtgtttccactttcaaagtcattccactatttttgcttgtttgattgtttatatgttacttggaatatgttttctttagaccacacactgatcttttgatgatgatataacctgatgattttgtacatctaatgctgactccttgacaagttgataattgatgtcatcattaaactcattggtaatgaaattatttcatttaacatttttatttcattctagacccatcaattataagacacaaaatttatatgaaaagatagatgggcatataaaatgtttctaatatagaagaacaagtcatagtgatttatatttcagtgtggagattctcttattcatccatctatccattcatttgtcaaatatctattgagtgctaactctatgctggatgtggctaatgtactagggatataaaatcaaaaagacatggtcctaaccctccaagatctctcagtcagccgggcctaatcaaattcctatttctgctgctgtctataatgtgagacagcaatgagaataaggaagccttcacagcaaaacttctatttagtgaagtcaagaaataaaattaagtcaaaagtcagagatgattagaatttttaatcttttttttcttaacattttttatggatgtggaccatattaagaatctttggaatttattaaaatattgtttgtattttctgttttggtttttggccacaaggtatgtggaatcttagctcccagaccagggatggaacctgcaccctctgcattgaaatgtgaagtcttaaccactggatccagggaagtgataataatctttttttctttttaaagaaaaatcgtggcaagagtatctcaactcatacacacacacacacacacacacacacacaaaactgctctgagaatctactgccaagctaaagagccccttttaaaaatctagttggatagacaagaagaaaagcaaaaaatgatgacccagacattatgatttggggtaaattagtaaaaaggtctacattaaaatttaactagaaaatttatgttgcattaaaaagtaattgtatttaagaattaatgaaaaagtatccagttgtgtctaagccttacttctctgaacaattgtttgaagtatttttttaaacataattagcaataggtgaagttccaattgctaaatatatatttttaagagtgctttactgtgcagagatgagctctgaaaaatcaaagaaaatagatagctgcagtttaacctctggtcatcaagtgcagcagcaaggcaagcattctggcgatgcagagaggaggcacatagactattcagcctttgtcttatgtgattatatattattctaaaacaagtaaagctaaactaggggaagatagcttctacccgctctttgcttctttgtattcctcttattgtggctcagatggtaaagaatctgcttgcaatgtggaagacccaggttccatccctgggtcaggaagatcccctggagaagggaatggtgacccactccaatattcttgcctggagaattccatggatagtggggcctggtgagctacagttcatgggtttgctaagagtcagacaagtctgagcaactaacacacacacacacacacacacacacacacacacacattccttttaaattatagaacatcaagaagagttgtatattactccaggccatggcattcacatttggtagcagagggatttagtatgtttcagtcatatgcagaatagttgtatcatatgaggcacaagtatgatcttcttaaaaaaaaaaaaaatatatatatatatatataatttctttttggctgcattggatgttatttgccacacatgggctctttgtggtggcatgcaggcttctcttcagtggtggtgcacgggcttcagaacatggactcagtagttgcaatgcattggcttagttgcttcctagcatgcggaatcttatttctcccaccagggattggacccacatccctgtattgtaagatgggttcttaaccacaggaccaacacggaagtcccatgtatgacctttattgtccttatttgaagattaagtagtgtttaagtagatgtgtggggcttcccaggtggcttggtgctaaagaatccgcctgccaaacaggagacttgggttcaatccctgggttgggaagattccctggagaaggaaatgccaacctgctccgatacccttgcctgggaaatctcacagacagaggaggctggtgggctgcagtcagtggagtagcagagtcagacatgacttagtgacttaacaacaccgataaaggagatgtgtaatggataggatatgcaacagcactactactgttaagttatagtgaggatagcagtcctgcttagcttgcccaactgaagggaaggcttcaggagaatatagatgt

SEQ ID NO: 56034 - DNA, 2879 bp, Bovine  19866880535664
atgaattaagtcaaagagttaaggtgctttatagttagcttttgcttcatttgacaagaaaatattagtattgtgctgtttttaaatagcacacataattatcccctcattaatgatgtcaaatattagtatttaacacattgctccaattaattatgttttttaaattaaacagctaatctctaacaagatatgtttaaataattatatctaatgctaatgggatagggaatgcattccagcatcttctttataaacacaaaatgaaattaaggctggtttagtttccttggctgagcagctcctaacttcatgtcccaccattagctacacacagtttatgcttccatgcacgtgggcatgctaagttgcttcagttcagttcagttcagtcactcagtcatgtccgactctttgcaaccccatgaatcacagcatgctaggcctccctgtccatcaccaactcccagagtccacccaaacccatgtccgttgagtcggtgatgccatccaaccatctcatcctctgttgtccccttctcttcctgccctcaatctttgccagcatcaggggcttttcaaatgagtcatttcttcacatcaggtggccaaagtattggagtttcagtttcaatatcagtccttccaatggacacccagggctgatctcctttaggatggactggttagatctccttgcaatccaagggactctcagaagtcttctccaacaccacagttcaaaagcatcaattcttccgtgctcagctttctttatagtccaactctcacatccatacgtgaccactggaaaaaccacagccttcactagacggacctttgttggcaaattaatgtctctgcttttgaatatgctatctaggttggtcataactttccttctgaatggatagatagatagaaaaataaggtatttattcctctgcctactactcataaagaaaagtttccatcttcactcacctccatttagacagatgttattccactcacagttcagactgtgcaagtgaaaagtaaaaacaaataacatgtacaaatatataacttacactgttaaaaaatattcataatggtaagttctgaggatctaacatatggcataatgctgctgctgctgctaagtcgcttcagtcgtgtccgactctgtgtgaccccatagacagtagcccaccaggctcccccgtccctgggattctccaggcaagaacactggagtgggttgccatttccttctccaatgcatgaaagtgaaaagtgaaagtgaagtcactcagttgcgtccgacccttagtgaccccatggactgcagtccacgaggctcctccgtccatgggattttccaggcaagagtactggagtgggttgccatttccttctccagttgctaaaagagtagatcttaaatgttcttaccacaaaaactggttactgtatgacatgatggtggtgttagctatggtgataatcattttgcagtaaataagtcagtcaaaccaacacattgtgcatccttaacacaatgtgatgtgtcagtcctatctcaataaagctggaaaaaaaatatatttactaggagatctgaaccaagaagctacctcctaaaagaatctaagagcaagagtcattgtaataatgccttctacttatttattacttattatagccaattccttgacattcattaacatatttaatttccagagtagtcaaatgaggcaattactaatgtcaactccattttacaaaagtggaaactcagattgacagagggtaaaccttccccgatatttcaaatctcataattgggatccagggttggtacccagctgccctgttccatctgtttctctctccacccatgtactacagcatagaagttgttgggaactgtggtaaaacttggacaatcaacataaaaggtatgtgaaatatattcattgtttatgctacttcaccctttttgaccctctcaaccttcctatgtggtaataatattatcaccctcactttgcagacaagggagaaaacaagcagcaagagataggtacatgttttgagactgaggaccctacccattgtcagggtaattgtcatcatcacatcatgtaatcctgttgcttgcttgctgtatttaagtaaaaaacaaattaccctggttctctgtgaaagaaatgattaaacattaattacataatacacaacctctctactccctatgttcctctttgtacaggaaagaatgttggagtatgtggctttccagctaccctcaagtgaatcactttaaaaataataaaaaaagattacccctcccttacaatagccaaaaagtccatgaaaatcagtgtaagaaaatctatctctaagtgtgttttgtggcagggtgggtggcaaagaaaacagatattccccatctttaagcaaatcctctgatttgacatgactacttctgttttctctaaaggtgtattttctgacctcctttgtcatcttttgagaccctactagctaagatacactctgaaagatctaagaggtatcgttctccccaacctgcacccttccccttgtttagggaaaaatatcagagaagtgatagtgattcaactccccaaatgactctgctccctgctgattgacctcctttggggagagagcagcgttctctctcacctcagatgctttctttaatgtagcattggctctgcccttggcctttggcagtttgagtacagagcctcagaggctgaggcttgaggtggtaaaaacatattccacaaagggctggccctttctgaattatcactcatccttccccagcatggtccccgttttttttttttttttttttctaa

SEQ ID NO: 56035 - DNA, 1330 bp, Bovine  19866880635371
tagatgcacagagccactcctggcatctggaaaatcccacacacatgaatgtcactgctattgtcctttgggtctgtgtcatacaatcctgtattaagaaggtcctttatagacgtctctggttaattgaatagaagcgtctgtaatgaggtgccagagggcatggtatccccagtaactgagtctgcttgccttttttgaatctccctatagatcactctggggtttctctggtgcctcaacagtaaagaatccacctgcagtgcaggagatgcaggttcaatccctgggtcgggaaaatcccctggagaaggggatgtcaacccactccaatatttgtgcctgggaaattccatggacagaggagccatgaggtcgcaaagagtcagacaccgctaagcgactaagcaacaacaaaacaacactgtaagaactccgaagatctttacaaactgaaaatttattttatttcttagatacatgcatctatactagttcttatagatgttaaagttttatttctttctactgcaaaaaaaaaaatgctctcatgacaaggcatgtttctgaaattaccctccttctcacccccaccaacacagtaattgttatattcacatattggatgaagagcctaagataagggtctaatttggattaataggataattactgtgtgacaaacgaatgccaactaacacgaggaactgctttgtgagagagttcttagtttgacaaaggtttgttttcaggtatgcagcctgaattgccagcttcagacttatttctcaggcttctgatgaaatttatatttaaacaatacaaccctaccattttctcagatatttttaagagtcaagtttgaagtctctcgtggcgtctttctatccttcctcaggcattgctgaggcagctgaaggctgaattgtcacttcaacctttttgatacccccaaggagagctccctgaaaatgaggcagtatcttgaacctgcaggtgggagaaacgcagcctgcctccagagctcacgcctgtgtcccccagggcatcctgcatgctcccaggtgactgtcggcttatgcgtttctcatccttacaaagctgtgcactccatcagtgtcatgggctgtgcaggaatactctgaaaatcaggacagaacatcttcaacaactacccacttttgagccgctaggatgccacaggtgctatactagcaactattagtcacatttcaggacgagagaatgtgaagggaaaaggtaaagatacttgccaaagagggacttcctggtggttcagggttaagaatccaccttctaatgcgcggga

SEQ ID NO: 56036 - DNA, 2859 bp, Bovine  19866880719475
cttgtcaaaatgcagatttgagtttagcagatctgcaatgaagcctgagattcattatctgtaaagcactccaaggaccaggaagtatatacttcctattacttatgttgtcaaagggtccccaaggatggagaattagattctaccacgagttttcagcacagagtcagagcagacgtttcaaactggagcctctcctcaaacttatggtgaatagaaccaaggtcatctaaagaagctccaaagtcttctagaacaagagggccatgcctttgaacatggacatagctcccaggatgttgaatacaatactcacctttagctcactcagaagcaatctgccagaatgttcatattcagagaggtatccctaaagttacttgctactatccctaaagttactctgagaggtgacagtggaggcagcaacagcatacccaagaatttgatctaaaaatgacttctcagaatttatatagagcttcccaggtgacaccagtgataaagaacctgccagttcaggagacctaagagatgtgggttcaatccctgggtcaggaagatcccctggaggagggcatggcagcaaactccatagagtggaagtgcaatagaatcctatgaacagagaagcctggcaggctacagtccatagggtttcaaagaggcagacacaactgaagtgacttagtacacatgcatatatatgggcttcccttgtggtcagacggtaaagaaactgcttgtgatgtgggagacccaggtttgatccctggcttgggaagatcccctggggaaggaaacagcaaccactcccagtattcttgcctggaaaattccatggacagaggagcctggtgggctacagtccatggggttgcagagtcagatgtgactgtgagactaacagagacagatatatatatgtacatacacacacacatatagatatgtatacacattggaatattgctcagcaataaaaaagtgaaataattttttcaataattcatgttgtcatttgcagcaacatggacggacctagagatgatcacactatgtgaagtaagccaaacaaagacaaatgtcatataatatcgcttacatgagaactctgaaaaaatggtattaatgaacttatttacaagagagaaatagacacacagacatagaaaacaaatttatggttactaaaggtgagatggggggaaagagggataaattagaaatttagagttaatatatacacactactatacataaaatagataaacaaggacctactgtatagtataggcaactatattcaatgtcttttaataactataatgaaaaataatatgaaaaaatgtgtgtatatgtatgtatatacatataaatgtgtctatacatgtgtatatatatatatatatatatatatatatatatatatatataggcttctctgatggctcagagagtaaagagtctgcctgcagggagggagacctgggttcaatccctgggtcagaaagatcccctggagaagggaatggcaacccacagcagtattcttgcctgaaaaattccatgcccagacaagcctggtgggctagtcatttatatatataaactgaatatataaactttgctgtacacttgaaactaacacaacattgtaaattagctatacttcaatttaaaaattaaaattaaacaaatagttcaaaacatagagtaccaggggtcactgcctatacttagagcacaaatattacagcagctttatttcaattgcaatttctccatatgcagcttaccctgctagcatgtaaaacatatgtaatttttatttttctgttttgttcatgctgtttgccctctgtctgcaagaaccacccagactctctgtttgcttagttgtttgtattttttaatcttcaagtccagcccctcatcccttgagttgtgtctcttgccaagggagtgttgatacaggggccgtgttgtaatttttgtttgtttgtttccttttacatcatattaggagctctttacataaatcatttttctcctttctcgccacctattacagtgcatcatctaaggaagataacagtaaccacttgaatgaatgagtgactttcaatttcaaatcctgccaagaatagatcaaggatctgttcctccactaggttcctccaccggggtctgaagaagagtcagagatcatcgtgaaattgggttttgtcactgatgagagtaattaagcgctaggactatctacacagaatgatgcactttgtacctcaagtgctcagagtctggcaactacagagaggtaaaggcaaacgtgtttctgctgcccaaggcttccaggggaaactcactgcatcctacagatcgcaaggggaggcccagagtgattattaccttttgaggatggtggattcatctctgcaaaagccagtttcaggtttgttcctattaatcccctgcttgataagaacggcggggcgcactgctaatggtttctggttgcttgtgggctgatgtgaaatgcatgtgataattagctaactaaattacttctgttctcattattttttatataaagcagttttataaggatggctttttacagtgatttctggtctaatttctcattatcaccattggcaaaaagagataatattttctccccattctctgcaatctctcccactcaccacacttgacaccttccatattcacccatgtataatctactgcatgttaagcatgaaaccctggggttgcctcagtcttctcttttggatcactgcactatcatgactgttggatttcctcctggatattcagatgagtgcagggtttttt

SEQ ID NO: 56037 - DNA, 1370 bp, Bovine  19866880801280
ctgcaactaagactagatgtagccaaatagataaataagagggggtggagtagaagggcaatttttgatataagggtcaatgcaacaaaggcaggaggtaagagaaaaagatatatgtgaagaccagcaaagggtgagccttggctggagaacaggggagatgaagctggaaacacattacaggaaacatcacaaatgaaccaaggtcttggacttcaagtagcatatattctcctagtagaaaccacaagaccaaaaaatgaacatatcttatacaagatagaactgtagtttgtgtttctgttgctagaacccataatcaaattcacgaggataagtggagaataagaggtaacttcatctttacactggcctgtaagcacatttgaataaacaacatcataatactccttgatgaattgcatacactggaaataagcaaggctctttttgatcatgagggaaaaggcagtgttataagtatgatgataaatatcaagaatctgaatgtgatagaggaagagaaaatatctttagaagagaagaggaaaacagtcttcccagaggaggtgaaatccagttgggtcttcaaggatgaagagatgctcaagaagtcaaggcaggttaagggctttctagcaacagaccagcccacgtggagtcatagacatgagaagcggcaatggagaactgaaggatgaaatgtaagctgggaacctttgatcctgagacttgaaaatgtgtgtgtttgcagaaagggtgaaggataaagatgagagatctaactttgtcagtgctggagatcccctgaaggatttggaaccaggaaaagataagatatagagactttctagaagaactaaatcagttctttaagctaagaaaagttaattaggaaatgtgagaaaattgcctctataatgtccttaatcctgtatgtagttgctgtcagaaattttgttgaaatgcagttttgcatacaaaagatataatccaaatttttttgtatgaaaagagatgcatggtggacataactttgatctttctagcctggttgatgtgccctaagttgtttcttcaggacagggtttagcaaaaagtggatcttgggtatgatctgttaacataaggccagtcattcatgctacatgctctttgtggacttttcaaatcagaagatcaaagacagtgtcagattcttacctctggccctaaagaggcttccaggagggcagaaaacctggatgggaccatattcatttctgtgctttggatgacaggatctatggctggaaagtattacaaagcagttgtttagggggcctctactgatttcaccacatttatattggttagtcctaattccagtt

SEQ ID NO: 56038 - DNA, 854 bp, Bovine  19866880891576
catttaaaaaattggtaaattgaacacttgcctcagagcaagcaattagggctattttcttccatatttattttcctgattgagacaatatttgttaagtcttaagcacactgaatacatttttgaatcatttttttctttcaatggcagtctagatgctaaaacttcatgttgctcccacccattctctgttcaattacagagggtactaacaagtagaaaagatttactaattccacagttactagtattgaaatctctggggaagtttataaaatcagcttaatatttaacaaatctaggtgaagattggttaaatctctttaacctctattaaatgcaatgagaaatgtgttaaagggaccctgtcgtatagaagcaaaccttaaaagaatagcgtaatttttttttccccaaatctcattaaactgacgtatatgggttttggatttcctttatttccttttaaattattgctagctattacttacatatttatatgtaaaaagtagctttcttcctcttaagtctcatctccctccgggctgattgggtttctgaaggccttatacaaaccctaggaaattgcagtacattctcccagttgggcttcagacaaatctgaatgttcccaatctgagtttctgccctttgtttccaaatcctgatgaaaatgaacaattcatcccattctgatgtataaatctcttattctggtacatcaagataaaggtcatagactacattaataatggttccttacttgtgttactaataacatcttacattgttaaccctgaaactattttaaaaatctaatttactttctcctaggatgccaggccagatacgca

SEQ ID NO: 56039 - DNA, 1500 bp, Bovine  19866880927843
tggacagacattatcaggaatagatatggaaatgtgcttggcccccaaatggaggtgatgaacacgagagaaatacatttgtaaattgcccatcaaacatgtaaaaagatacaagatattctacaaatacctattttaaaaaaataaatggtttcttattttattaacaatttaggaaatgttaagtaaaaattaaaaacaaaccatcaaacatgttctacaacaaatttcagcatactggagtatgctgatgcaaataaatatcttgccagtacaattcattttgtgcaggcattagattaagctttttttgggtacctgtatatatatttgattcttttgcacaggagctgtggatttatctttttttccttttaaatgtaggcattcgtgttcaatcatgggaactagtgcaagcaaattcaatcacacatcccaccagtgctagtattatgttgtaaatagttctaatgtttttcttggtagctttgggtgatatatattataagggattcaactgtggaacaaaatgtcctggtacacttaatactcaggaaaaaaatgcagtataaaaatacaaaaactgttattgtttgtaacgattgatctgtgagaatcaggattttctagatttagtgaatctaataaaaaagagtatagaaataaattacgctatatctgatgtaacagctccttccccagtccagtctaaaactaaacattttgttttcctgaaatttgtcttattgttccattggtttatttttaagcagtgattttgataatgtagagtttaaaatatatctatgctgaacatataagctttttcaaatatacaatgagattctacagtagaaatgttcttttttttttttttttttgataaagaagtttgtgattaaaagatatttgaaaggtattgatttagagacagagaagctgaggtcttagctctgaaccttggtatccccaggccatgaaaaaatagagagagaggtaagggtgcaaacacacaaagaacagagttagcaaaggatagaatttattggccttaagtttcagcagctttgattttccatggttatccttttgataaagcattaagagagctagagtatcccaaaattggataattaatccctttataattgctagatgactcatgctttagtgtaaaacaaaagtctttctcaaaattagcatgtgttttctgggagtagccccaatttggctgtggtcaaaggcagtgcattacatctaaatttggatgcccttgttgctcagggatgctcagtagccgctgctggctgagaagagtcagtgatgcagagatgtgggaggacctgagccatgagccctggggagagggagtagaagtaacccagtagaggtttctgggtgatgctgaaggctgagagagcccttggagctagctgtcatggaacaacattttgaagaaaacagtttctcatctccagttactcaggggagggaaatcag

SEQ ID NO: 56040 - DNA, 1661 bp, Bovine  19866880953463
tgtgcttgtagagaaatgacagacacatgtgaagcatcaaacctccataaaagagataaatggccaatcagtggagcatgaaatgatatggataattatgtaataaatggtttaaggggtcatagatggaggaacagagcgaacaggagttataggagaagatattcagatgaggggcaatttaaactggcccttgaagggagggaggaagagcaagacaaggtgataacatgcaggataaacttaggagatggtgaatagcccattttggctaaaaagctggctctggggccacgtgtatttgaagataagcctagaaaggcaggctggagtggactaagaaacctctgaatgtcaagctaatgcatcatatggacaactgaaggagacccgtcgtttcaattcattttaatctgtcctaaacccacataattcaatagatctagttatcccttctccctatttatcatgttttcaaagttaccttgtataagagggaaacaggggcaggagataagatatgggcatatcaccggatgactgatgttgagctctgatgatgctatggctttgttcctcacccctcaggcctgcagcctgtggcttcttcctgctgcaatgttctggggaggaatccttttgcattttttgtgtttttacttttcatatgctttggtcacatttccccagtgagatcagaacggcttttttcctcccaggtcttttatcatagctctaataataaactcgttcgtatttcttgggcttctctggtgggtcagatggtaaagaatctgcctgcaacacaggagacccaggttcaatccctggggggaatggcagcccactccagtattcttgcctagagaattccgtggacagaggaacctggcaggcttcttcttaccattcctaaatcagtcctctatctcaactctttattccgaacttcagcttttgcatttgtaattcttctcattggtaatgactcccgagaaatttttactcattacctcttttccacgctagattgtttcattatgaatattttatttagttttatataatgaataaaaatagctagattccctttttgatcctggtagatattctgtgtcacttagtggcataatttatagcatttacatttataactacaattattaaatgttgtcagtcttgtttctgtttagttctttttactgtttaatttcttggctttgttttcttgttatgctttttgttatatgaactgaacacttttactgtagttttattggtggatttccaatgttaatactattacttatgatattaagacattctaaaataaaatacttttattaaaatcagcattattttatatttattaaactttgtctttactgaatttctgattataagctaactttgcctttaaggatttatcttatttcctaactaaccaaaaaatgtaatccaaaaagtggaaggttgaaaactataaaattagcttaatacctccttgtgactgagtataggtgctttcaaataagcctatatggagacttcactgaagagcctcttgatgaaagtgaaagaggagagtgaaaaagttggtttaaagctcaacactcagaagactaagatcatggcatcggtcccaccacttcaggcaaata

SEQ ID NO: 56041 - DNA, 1541 bp, Bovine  19866881047893
gatggacttccctagtgatccggtggctaagactatgtgcttccaatgcaaggggcttaatccctggtcaagtaaggcccacatgacatgtgtccaaaaacaaaaaaataatgaaatagagcaaaaaataaatccaaaagaaaaggcttgttttctcagagattctctgtgctaccagttggctgatcctcagcaataatgatgacctggacttgaaactcaggatagaattttctgcatttctcactttatggtgtatgtgaatgttttcattctgttttgcacagggacaggaagaaccagcttctaaatttcctagagaggcagcccaaagccttaggttatccatcttcacttttattcgcctgtctttatctttctccctccttttatttttcacttttgtcttttccttatagaagacaccagtatgaaaatccatccacacataaatattctcccagtcctctgtctcttcctcaagtccatggatgatacaatttcccatggcatcattttgcagtgaaaggcttctgataaatctcaaacttagtgtcctagtcttcttcttctctttgtgctaggaaggctccaaatgagccattgggaagaaaataaaatcaaaaggctgaaagagggacaaaaaggatctaagagagaggggagagaagaaggggaaggagggagggtcatcacagccaggcaaaaacaaggacggattgggttttttgatggaacttacaaagtgggcaaattgaaaggtcagcactgctgggaggataaaaggatgagaacaaagaaaccactttatgcagcgatattagtgctaccaggagcaataaaactgcacggccacaatcgaacattggagtggaggatgatgctggggagaggcccagccgatgccttcaggatgcatggggcagtcactgggagggatgtggacttcaaagccctgcaggaagctcaaggaggagccctttggacccaagaacggacacaagagagttgaaatgcatgccttctttctgccactgcccacagagatccctccatccttgagccactacagagtaaagaggaaacccagacctcagcacacacctggtgacaatgccattaaccaataggtattgtctgagcatcacttacattccttggagccctggggtttcaaaaaacatgtgattcgtgggattttttccctcaaggatcttgcaatctaactgtggaagctagcatttgctgctgtccagtcactaagtcatgtccgactctgcgactccatggactacagcaggccaggttttcctgtccttcactatctcccagagcttgctcaaactcatgtccgtagtgtcaatgatgccacacatatgtgaaaaaaatagatgggattattaattaaggtggcttctctaagttgaaataaacacaaattcccctcaaagacaaatgtcctcttgaagctgttgaattcatttaaaaaataatagtgtttcaatctgcagacagaaacattatattatatttaaagacag

SEQ ID NO: 56042 - DNA, 1906 bp, Bovine  19866881277215
tgcacagagtcggacatgactgaagcgacttagcagcagcagcagtagcagagtgactaacactttttagcaattgaacagcaatgaaacatctttctaaatatacgaatccttaaggagggtttgttattagacccatcatacaaatattatagaggctctgtacatttcaatgacctgaactaggtaacacaaatggaagatattaagtgaagcatattttatttagggctatatgacccaaagtctattcttttaagcatcattctctacacaggaagagacatcaataaatggactatagaaggagctttggagaatcagaaactacccctctgaggaagctcagtcatttctggacctttagtagacaactatttggatggacaacttgttccaagtgagagggcacagaaagcttagtattttcatgtaaatactatggtcctggtcagatttcagaaattgtccttgattccctttcccttctacccattttttcttagcaaaaattgtatgtatacacatatcccctcttttttggacttccttcccatttaggtcaccacagagcattgagtagagttccctgcgctatacaggaggtccttgttgagttgtctattttatacatgcctgtatgcaagctcagtcactttagtcatgtccaactctgcaaccccatgggttgtagctcaccatacccctctgtccatgggatttcccaggcaagaatactggagtgggttgccacttccttccccaggggatcttcctggcccaaagatcaaacccacatctcttacatctccttcactaccaggtggattcttaccaccaccaccaccaaggaggtccatttttatatatggtagtgtatatatggcaatcctaaccacccagtgcatcccatcccctccagacttgtatttaaatatcatttttataagtgagattacacatcttttctcgctaatatggtagacatatatcttggaatgctgccttaaaatcagttagaaacaataccttaagaaaaaagcaaatcataaatacaggcttccacagatttcttcaaataaagctgttgtttttaattacaggtcctataattttgcacatgcttatttcacattaaagaactgataattcgatttatggaccactcttacatatttatctataataatctttcctaagcaacacattattacccttggttcaatgtgtgatatatgaaataaattaactttcatctcttgctattctgtgaatcacacttccttcccagtggccttagtgaggagctgatgtaccataggtggacattctggaaacttctccaatctctgtgtatggcattgccatgatggaaaccaaaaagctaaatgaagcctcaagagtttgtagcacttaatgcattaactcagacctctggtcccatcaccttatctattccagttttcctgggtttctgcttatccatctttccagtctcattggaaccagtatgtgtagcctgtggatttgtgctatgctcgctgctgaagcaaaacagacgcgtttctgaaatacatcttcatctgtctaggtttataggacaaggtcattcatcttgtgtctggtaagagggctctccaggcgtttccccgggtaatgggtctgattcacatgatgtgatgaaaggagaggtagatggattcttcacttatcactaccttgcaggatcccatgctctagggagaaggaagagtttagcaccccaagtcctcctcccagtttcaggactcagagaccaggcataaagggtccctgtgccctctttactgttataacttcccatgtggcacctggggtaaagagcctgtctgctaatgcaggagacataagaaactttgggttcaat

SEQ ID NO: 56043 - DNA, 1326 bp, Bovine  19866881350517
tgcgtgtgtgttctctctgtaaagttaattcatgctttcctttttaatctttttaatctttatctgtttcttaccaaagtaatcaaacctcccccaccacaaataaataaataaaaataaaaaacacctttttccaagtacttatatactaaacactcatcacagtccaccaggtcttcctaattttggaccatcctcagcccctctgatctcgccataacagctaatgaagactgacatgctgaatgggttccttaaatcctgttatttccatggatattcatgaaagatggcctcttcataatccattttcgacagagacatctaaatcagtttagtttccccctgcctccctatctccacttcccagtggagaaatagagttaaaaattctgcaagggtcttaaatcctaaagcctgtcatttttgcataaccttggcttatcaaaatctcttgttgaaacacaactttcttaaataggaaagagactaataacacaggtctcatagtgtagtgattataataaccttcaacatatgtaacatatataaagctcccagcagagaatcttacaacagcattgaggttaattccctctggtcaactcttatctcttctcatcttcctctctcttaggaatatttccactaaatgagacccaaatagcccattctgttctccagtcacaaatttagctgagtgtaaattcataatccattcataggaagcattatttaaaattaaaaaaaaaaaaaaaaactaagatggccattatgagaaagacagactcagaactggcttgggtatgagccctgacctggattttaatcaacacagccagtgttttcaagtcagggccaaattcttgtgacacataatacaaaatttatgaacttactgaaactgatttataaactgataaaggataatataaccatatagagctggttgcaaaataactagagggcaaaattgaagttttattaaaatgacctcagtcgtttttatctcatacctgtgctggataaatagtcatttttgtaggatccataaacaccaaggaactcccaccccatttctaatgcacgaagtaccagagttagaagaaagtcatcccaggaaataaagctcatataaacatgaattcaataaacttttagtaagtgcctagtctatgccaggctctggcaaaggcaaacatcaaaaacacatttactatcagggggccctcagtctattggagaaggcaaacctgtcaaccaaaagaggggggtaggtacagggtattgataggtcagaagaagctttactgggaaaagtaaatt

SEQ ID NO: 56044 - DNA, 1491 bp, Bovine  19866880349802
actggtaatgcgcctttttaatatttgcttatatgaatgtgactcttttctataagagaaagaaatccttcctactttctccattatctgtagtgtaaaatccaaactccttagctgaacatgatgcctctggcctctggaacacttccgtatcatcttttgctttgctacctcatgcatatttcagagctatttgcaacctcttcacttgcacatcagcctggaaatccccatcagcctggaaatcccctccagttacgcacatcagcctggaaatccacagatttgtgctaattcaaatcatcctccaggtcaagcgttagttcctccagaatgtctcccctgtccttcccaccccaggcaggttatggtccctcctcattctctcagagtgccatgtgtgtgcaccgcccatatcacttaccacacactgccatggctgttggcttgctctctgatttttctacttaactgtgcatcttggggctaggaactgacatagacttcttaactgtcaagtttccagaactcagcacggtgcctggcataaggcagatactcaacataaatgctggactccatatacagtccatgggtcgaaataaggctcagacatgacttagcaactaaataatgacaacaatatgaatgatgaattggatctatttctttgacaattaaccaggaatagtaactctatataacattttgctggaataccccaaattatagcaatgaaacagtgtttagattttgatttagaagtcagattagccaggaaattataccccatacatctgagttgtgattgcatgatatcagaagttatctgagaaacttttgtagtaacctgctgtaatttgatgtatctaatttgttatcatgacctttcagatccaaagagacttaaggtggtttgtaaagataacacaaaattccagaagatgattatgttggtctctactgattgtgagttttctactctttctaaatcaaacacgaattttgtccatgtggcaaccggcccaggaaagcgaattcatttcccagtgttccttccatctagggttggtcatatgataaagttttggctgatgaaaataagcagaaatggtatgtgccgtttatatttgtgtttcttcttcatttttggagtgaggattcagtgctggagaagaatagccaccttgagtgtacacaactgtggaaaggaaaaactccatatctcctaaaggaaagattcatggttatatgagcaaaataaaactctccttgtttggtcatctatttaaggagtttctcaagttcacagccaaatctaattcttaattgataggatgttgttgttgtttaggcactaagtcatgtctgactcttttgtgatgcaatgaactgtagcctgccaggctcctctgtctatgggatttcccaggcaagaatactggagtgggttgtcatttcctcctccagggcatcttccgacccagggat

SEQ ID NO: 56045 - DNA, 5695 bp, Bovine  19866880369579
ggctagggccttgccttgcaaagagctcagctaaaacattcttgtagataggaacccattatctggtgatgcataagcctgtgtcatcttaaaaaatgaaaataacttcttcccagccccacattcatttttagtctcttccacctatttctgctttgtttacaattgaacatcttgaaagatgctctagtgctttgcctctaagtgctggtaaatcatgcagaactggagttaggcagagaaggcaagtagagaccaggaaaataaagtatgatagagccctgaacactcccctaaacacagagtgttccagattcacaactttcataaaatactctaccatttgtttttcaacccacagcattctgaccttgcattcctgtcctttcactgaatattcttgggcatatgtacttgctgaacttctcacaatgaaatttaccaacggactttcaagtattaagttgatccttctacaggctttaacactacggaccttctattcctctgctggcttatccaacaccacctcctcctggatccctcctcttccctactctagtatctttgttgctttgaccatctaataaatgtcaacttctatcttagttcctttagattctcactgtacactggtgcaatctcacacatcctcaagatttgggctgtcatccatacagtttcccgtgggaagttcccatgaagtgtgggtccatacaggggtgaggtagggatgagataaaaaaggtcaagcttagatagcttcttggtaaagaagatggcagttcttttcttgggactgaggggcagatgtgcagtaacagagcaaggggtaaaaatacaccaatgagatgaaggagaattgaagcatctgccctgggatggcttcccaggtggagcagaggtaaagaactcacctgccaatgcaggaaacgcaagaaaagcaggtgcaatccctgggttgggaagatcccctagagtgggaaatggcaacccattctagtatttctgcctggaaaatcccaaggacagaggagcctggcaggtcacaggccaaggagtcacaaagattcagacactactgagtgactaagcacatgcccaggggtctgtaccattaagtactactcaagcatgaggagtgagacgtccacttggctgggagagttttctttgtcagttcctgggagctggtggggctttgtttgaagagaagcaagagctggattcgtcaagactggaggtttatatgccaggttttgagagaaaacaagggaaaaggaaaatggcagtgcagaggagaggataagtgaggatacagaatatacagcattagctgcagaggtggaaagaggagccaggaaggctctagaagacaggagaaaattaatgaccaaggaatgtccaactcctatcaacctgaaggctgcccttgaaggatttatctccataaataaagaaaaaggaagaggtacaaattcacttccctttctgaatttagcttgttctctcttcttgcatgtcctccttaccctgtaagcactgactattgaatcatatatacaagctctcctaattaccatgggactgggcaagttctttaacttctttaagtctaaatctcagctggaaacaatgttaataagagtctttcatgcataaggtagatgtgaggatatagtgggttgatacataataaagtgcagcaaggtatctggtaaatggtcaattaaagttatctcctagtgtataactaacatgtggagaaattaatatttgctaaggattaccttcagaacataaaaagttttagacaatatttttgttacaagttgtagattttaaggaggattttctaccttgagagtgtgtcctttgcttaatttgcagaatatttgaattggccatgaatcattgccccagaataggtctgaaatctgtaatgcccaactggacttttacctcaatgttggagtatagaaagcttgagatttacaagctaatatggagacaggcagcagtattctgaaagcatacttccttccccaggggtgacaatgtacactcctcatttgtcaaattaatgtccctggcctcctggcatcacttcagtgtgccttaaattggagttttagatggataagaattgtcttgagctaactgtttttgtcaatcactggaaccaagcaatttctgaatttgccacatcagcatgacattgtattcggttgtcattcttcataaccccatgagcatgaagacagttaccaggttgggtttgggagtcaggcagagctagtgtctaattctggctatgccacttactggattgtgatttcaagcaatttacctcatctctgtaagcttcagggtactcatctgtaaaatgggatgataataatgagtgatacttattagaattctggtgactattaatatagaatgagataaagtacacacacaatgcctggcacttagtactcaatatatgttcactattactgctgctgctactgctaagtcgcttcagtcgtgtccgactctgtgtgaccccatagacagcagcccaccaggctcccccgtccctgggattctccaggcaagaacactggagtgggttgcaatttcccccctccaatgcatgaaagtgaaaagtcaaagtgaagtcgctcagtcgtgtctgactcttagcgaccccacagactgcagcccaccaggctcctccgtccatgggattttccaggcaagagtactggagtggggtgccatgcttattaattttcatcaatctcattcatgttgttttatccatctaagtgaaacagtgactgaaaaaaaacacaatcagttgagttacatgattagtcttacaaaaaaagaagcatgggcatcaatattagctcttatgcaaaagacttcggtagtttctagtgaatcatcaaaatagaacattattttagaaccgagtatgaataaaatgtaaaggctgcattttacatggctttacacgaatgaggcggtgccatttccatgagtgggttccacagtctttgttgtggttgtggttgttgctgctgtggtatcagaattgctgttgatgttccatgtctgcaccaccatcttcaggaagatagaacaagagtcctgagactgagtggggagccagaaaacaagtcaattctgtctccgtgctgggggacaacaatctttttctggtcattttggtttggcaaagattcctgggtctctggggaccaagactgagtaggccaacactgactgatgagtgctccagcactgaagctgttcttttgggagcagagtgacaggcttgctgtccatcttcccagcctgggcctgggaacttatccaactttaaaatatgaaagggatattcccaaacagccgtgctggctgcttaatagctctcaaggacaggctcttctgccttgtaattaatgataatctctcttcttggggattaaactgctttcctttgttctttcttccagtagagatgaaggacagaaatctgggagggcataaaggagactgtggaagggtagcatatcttaatgacagtccattacttgtattttatactcctagaaattctcagatcataaagcctttttccaaaatataaatccctgggtttttaagaattattttttaaaaacaattacattttatgtaacaaccctaaagttactcttttgaaaaattatacacaaaatatattcagtataattgggaaaatggttacttataaaaagagctatggatctcacctagctatgagattctatgtattattctaaaagattaatcaaaattagtcttagatgagcctaaataattgtttaacttcactggtattaaatttatagtcaaaatttaatggaccaaatcacatttgattgcaacagttaaaaaaaaaaaaaggcattctaagaatctgttattatctcagctaaataaaatatttatgtaggctggtttctgcagagcacaacatttccattgatggctgctccctgtttcttcaagctcagtaatactctaagtgagactactcaacacaagccaaagttccattcatcatgcacatttatttagttctatggatttaatttcacatttacattggcttactataacgaagtagcagaagttcaccaaaaattactaagacttggaaaaatgcttcaactcataaactaatatttgggcaaaatctaggcaatgcttttctaaatagaagcaatgggaatctttttaacgacaccacaaaactcaatcatccttattacaagacttgggaaaattctagactggaagcacagagagaagcaatctaccttggagttcaaacacatcctttccacatccctcttccggaagagtaaatttagtcccaacagcactcactgagagagctgggcctcccaaggtcaaggtagaacatctgcttgactactaatgggctatcattcatcctgttcattctgtgtttatcacatttttgcaaactttcaagtgagactgacacttaaaagaaaggggatttcatgattttcctccggaaaactcactgaagttttgaacaaactttattgtaccagagattcttctttggttcaaaatcatttcagcaacagtttaaaccatttctaataagtcacagtgatatccctgaagacaaataagccatatccctcctgttagataacacctctcctttgcctttttttcttaagttcaatttagtttaggaaataagtgctacagtttcctcttctatcgggaagacgtgataagtagaccggaaactggagccaacattgctgtgcagattacacattgccaaggggcatgatcaccacctaaaaatgtttttgcaaaaacaaacataaaaaaaaaaatttaagaggtatatgcacacacattccaatttctccagagaaacatttatcagtctctcgttctcttatccaaacatgagtcataggtgtggcagattgttgtatttgaaagtagtcgcaatgacatcttccattcccctgcttttctgcttgtgtccttgtcactaccccattgcactttcttgaatcagggctggcctggggggctcactgatagtcagtagaatgaggcagaagtgatgctacataatttctactgctagacttcaacaggtcattcaaacacacctggttctctgggaattctcatccttcagatgctccctcagaagttgcccctcttaaccaccatgcaagaacaagcccaagctccgtgttaagaccacacgtagaacctgtgtctaattgtactggctgagcccacccttttagtccttccatcccatgtaccaggaatctgcgtggagactccaagtaactccagaatcatttgatccagtcactcccaaccattcaagttttccaaagtaagaaccctaatattgtggagcaaagacaagttgtcccagctcagactgcttaattcctggccagaagaatctgtggccatattaaaatgattgctattttatatttttaggatatttgctactgagcagtcgataactggagtaaaatacatttgtcctatttcttagctataattataaaagatgtgtgattttaatgttgataatgtaggggactatacatgtaggaggcaaggggta

SEQ ID NO: 56046 - DNA, 3230 bp, Bovine  19866880443345
aaatgatgtcttcagtttttgaacttccttttccagagaatgaaaagatatattgtgagttttctttttccagttacctttgctttttaaaatttctgtttgctttctcttgtctgtccactggcctaagaagtcaaatcaacttgaagaggaaaaggtcttaaatagaaagctaagggtttagaaagcttttcttgaataggcagaatctactccaagctctaataagaaagatgttaatacttttagactttcttgcttcttattagtgattttgttgatggatgaaaatatataggaaataaattagaatgcactctaaatttaataaattaaaaatattatcaaaaatgcctttttgtaaatgtggcaaagagtactgcacaagcaagctagtaaaaaggtcaaaggacttaataatgataataacaatacaaagaaatatgatcatccacaaaaagagcatcaaaatataagataaatcagaaacagttgtgttctgaagtaaccgaaaataaggaatgtctcatgttgttttatattaccaaaaacagatggagcattctactgaccaaaagtacatcaataacaaggattaaggcgttctcctttacagtacgtgtgtaccttctgtaaaatccatcatctcattctgccacaaaatcacacaggtaataaatattacatgttatgccaatatgttttaatggcttctctttcactcagctgtagaacaaaaccaacaaagtaaaacagagtttgtgagtcaccattgcttaaactgagaaaaaagaaaatattgggatttttacactatctgctgctgcggctactgctaagtcgcctcagtcgtgtccgactctgtgcgaccccatagagggcagcccactaggctcctccgtccctgggattctccaggcaagaacactggagtgggttgccacttccttctccaatgcatgaaagtgaaaagtgaaagtgaagtcgctcagtcgtgcccgactcttagcgaccccatggactgcagcctaccaggctccaatccttccttatttttcattatttttcctcttagcagagcatttaagtttgtattatcgctgagtacagggtcgcaatattttctacttagtagaattctatttggtttcagagaatacattgttccacattatatcaatgtctatgagcaaagaaactctggggacatgatggcattgttggttgtaagctacaatctcatgcattcttctgactcttagatttaaggtaatgtttattcttatacttcattatgtattgccatgtgctatttctctatgtttgtattatggccaaaagtagatgggaagtttcttgaggataagaaccattttcctaattagttttatagtatgatgtcagactctgacacatcacccaggcatagttttggctttaactctgtgttcacacagagttttgagttcggttttgtactatcggtatcaataatctcttcctttgctatcaatcataatgtccacagaattgtagaactaaaacatgcattccagataatcaagctctttatttcacagacaagaaaacccagactcagagccattaaatatttggcccaaagtcaaaaggagattcatagctttcaaacataggaaaagagttcatcttatatttgagtaaactctggcccagacacctgctgtttcttggcagcctgccgtaacaaggatcataactgatgaatggacatttacagtttattcaaattaagataaatttctctcatcagttggaataaggtaaattaatccctaagcataatttttagaaaccaaatgctttggtgcaaataaggaagcaagctcagtagcctaggtgaagatgccaagttttcctacaaagtctccctataaggatttagcaaactacctaagaatcacttaattgctttattcactcatgcatggacatatgtgaatacagcaatacatctgacagcctcctttctaaagagtttaaaaagagtcatcaaattctctaaaacatgctgtcgggattttctaggttagaaggatttgattgaaatgacactgaatatttttcagaaataattgcttttccttggtgttgaataaaaactacttgcagaattgattgatgtatgaattagtaaaaggactttggctaaaagcttcctgaactttaaataaacaaatattagaacaagattaagggcagaggaggagattcataatggataccaggtatctttctttttctaggttgctctggttgccctgtggcaaatcaccaagtttcttaacattcctctgggtaagggtagaagcaaaacttgagcctggaattcttttctaaatgactttccaagagaagccaaaggggttaaaaagttaggagcataaattaagctgacaattaatagtgctcttatgaaatagtcctttctagttttacttctatagtacatataaagaatacatatgctccatgttttttttgaaaatccaaagttttatcttgatatggattgagaccaattctctaatcaatttctttgtactttctattttcaaaaatcataatttgatatcaacatcaacaagcaggattctcaacactgcacccatcagataattagttctaattatctctatatagaaaaagagaatacttgaaaatggatttgactttctgtcaaactgtcaagataacagagggctgcatttttcttttttaataaaccaagaatatttttcctcttaatcttactccattttattgagatatgatttacatataaggaaaagcacgtatttatttaattgcataattaaatgatgttggaaaaaatcacatctgtgcaacccataatttggaaaggcccttattttttagtgcaatcacacatttgttttatttagaactttaagtaaatgagattgcacagtaagcactcatttgctgtctgacttttgcccagcgtaatgcttttgtgatttttccatgccattccagacatcagaaaatcattctttttcaatgctgagtggcattccattagataaatatgccacaatttgcttatccatcccaattttgatggtcaatgagtcgtttccaatttcgggaaattatttttaaaaatctattatcaacattcttgtacataactttttataaaatagtttgtgtcttagggtcatgat

SEQ ID NO: 56047 - DNA, 2649 bp, Bovine  19866880584182
agacagtgttgaatatataagtattaatttttttttctttaatatattgagaattttgagcatttcacaaaatattctttaaaaacaagatctattaatatgattataacatgttttaatggatacactataaattatttcagaatattcaggttgtgtctaaatttttattattacaaatggcaccatgataaatatcctttcactaagactgtcttcagggccataaattaccttccctctgctcagcactgaattctgagtcccagtgctctgatgccaaagctggaaaccttgtaccactgtcaggaccagaaagtttctctcttgacaccacagagggaaaggagaaccccatatttactatgaagtagggagtgttaagggtggaaaaataaaccagaaaagaacaacctacaaaccataagtctatttacagtaccatgagaagagatatataagatagtgaaaagtgtgaaagtgttagttgctcagtcatgtctgactctttgcaaccctatagactgcatcctgccaggctcctctgtccatggaattctccaggcaagaatactggagagggtagccattctctgctccaggggatcttcccaacccagggatcgaacttgggtttcccacattgcaggcagattctttaccacccgagccacagacagtacccaggaacattttccctgttctcagggatacctagaaaaaagtatctctaagtggagaggggataggaaagttgagttacactaccatctgttttctgttttaaattaaaccagtaaggtatactaaaatgtccaaataattttacctcccatttcaatttcccttccattacaaatctcatggtaagtatttcagaggacagatgaatctgagcaagatctaaagttgaacttttaccttcaatatagttacatgttttcaaacatttacaactaaattaaaatacttaacaaagtctacgaatactattgagaaaatgcaaaaagaaaaacccaaaaaaacaaaaaaccttcctctccaaaagcaaagctcagtaaacctggttaaattgctcttaaaccatttgttttatctagcaataataaataagttccactttacagtcttaatgtttgatcttgaacctggtaaaactgtctctgaaatcaagtgacagaaacaaactgttctaaggcctaattaagataccctgcgttcttgggacttccctggcaatccagtggttaggatgtcatgtttcccctgcagggggcatgggtttgatccctggtcgggctggggaactaagattccacatgccacatgccaaaaaaaggatgccctgagttctgagcggctattttactactgtcatttatagaaatttgtcttaaatatctgaccatttctccttgaagaaaacgacttctattaatgcttggcatagtatcatggaatgttgggagtcaaaatcttcttctgaaagtggttaaaaggtacaaacttccagttatgagataaataagtcctggggatgtaatatgcagatagcatggtgattacagttaacaacattgaaagttactaagagagtagatcattcaaagttctcagtcacaggaaaaaaaaaaaaaaaactaactatgcgtggtgatgaatgtttttattgtgataatcattttgcaatatatatacatatatatatcaaattcttatattgtatacttcaatgtaataaataagacatttgtatctcaattttcaaaagtcatctggaaactatgttcctatacatgttttcaacatataaatagacatcccttatagttactgaaagatacaaaatgtataaggtaaaaaaatccaaccaaagagattattttttaaacccatcacattcatagtcaacagtgccagctgcctatttacttcaatgctcacacaatgcttcctcttaagattgtgaaatcagtattagagcagaaatggagcatattcttaggtgtcagacacttcccccacctggaagcatctgcaccatttgttcacactggagtccttagtgggcacacaccaagttatcactgcagagggaacctttaaggaaaaattttatgttcttacgaccctattacaatccaaactggagatttttcagttgatatattaaaatatgattatctcctaagaacttgagtaagggatctaggaagccatcctggcaccaaacacatctcatggaaacttactgaccgaaccaaactaagatccctggagattttgtcattacacaccacacagtctattattgtctagattaaaaatgctcacttcagtcaaatgctatattcgaggagcgacaaaacacagctcttatttatgctgcttgctgctactgttgagtcgtgtcccactcttttgcaaccccatggactatagcccgccaggctcctctgtatatgggatttcccaggcaagaatactggagtgggatttctagaggcaagaatttctttctcccggggatctcccctacccaaggattgaacccgtgtctcctgcattggcaggcggattctttacccctaacccttttcctactagggttaggaatttctctttttgggaattttaggcaagacagat

SEQ ID NO: 56048 - DNA, 1693 bp, Bovine  19866880645914
cagcaaaaagattatgactcactgaaggcttagataatggttagcatttttttagcaatgaagtgtttttaaaataaggtatgtaacattggtttttttagacatatcacacatttcatagactactgtatagtataaatataacctttatatatattcattatataaatgaataaataaatgaataaaatgaatattcattttattgtggtggtctggagccaaatctgcagtgtctccaagtttgtttcttctccaagtgtctccaagcatgtataatagtttatttcttcagttgtcagggatccactaaataataggcctgtgctatcaaatatgggtagccgctaactgcctgtgattgtttcaatttaaatttaagttagttaaaataaaaacttcagttcctcagtcaaccctcagctatatttcaagagctcaccaggtgccattttggacagtaaacatgtggaacattttcatcattacagaagattctaatggatggcactattacagactattttctaacccatttgctgctgttttttttcctgctatctatctccctcaaaggcttcctcttccatgcttgtttgtttcgggtacacagtgggaaaaaagagatcaaactcatgtccagtgtttctgtgttttagtagtgctgatgaaagagttggtaactggatgggctgtaactattgactagaataagatttcggaaatatctttgaatttaatttatatgtatcacccaaaatagtggtgtagaggtggctgtgtttagtttttaaatggactagactcacgtcttctttgttaaacacatctcttgagctagtgattacacttctcctattgagtattgtttcattatctctaaaaattttgtttattacaaactcctttagtaagtgaaaattaggccaccatgctctaggctttttctcagtttaaacaaatttctgatccaagatgtgtttggatcttgatatatgccaattaaaatattgactttaaacaaagaggtcataaaaaatatgtgattaaaatgattaggagttgagtccttatcacataacccaaagtaaacgcagattgcacaattccgtacttaagtggtgcagctctgttgtacaggcatgtttctggatattctagattgcttctaaattatagtgctgtgtgttgagagattgatattaaaatatacttgggaattaaaattcacttttgatgaatagttgtttaaaaagctgtaagatagcactgtggagacatggtgtaaaaaaagaagtcttcaaaaccaactcacatttctttggatcagaaccagaaaaatttgtgtaagcagtatatttaccaaatgaatttccagtaatggaagcccatttttcaccttaacattgatgctatttatgcaaagccaggcaacaaaattatatcttcatgtcacttaatgtttgctacatggaccaaatttcagtcattttttaattgtgaagctaaaaataatgtttgctgccgaaaacttgaattctgtaaccagacttgttttactttcttaactttatatccaagccagtgagaataggttctttcccaggagattcagccagttcactaggagcatgaacctcagaagagacgatagttcatagctcctctcgttggacttacatggtatgaactg

SEQ ID NO: 56049 - DNA, 1433 bp, Bovine  19866880652468
aaaacacagtgaaagcgctaccactgtttctgtagctctgtttagaatagactgaagtctggatttccaagggaggcattccaatgctcaagaaaacacaaaaggatgaggtcaggagaaaaggagaagctaatgagctaagggttggaaataaattttaacaagtgaggattaggccaatctgtttgcctgaaaagcttggctgttggcaccaatcacccagactgagcgtctgttttatccatgctctaatcggacaaacgcgagtgcctaaatatattaacaaaataattctagctgtcacatgatttttaaatttccagtttgaaaatgcttaagcttgtaatatttatttgatgctataaactttttgtggagggtgggaggcagagccattttttctgttatatcttccaggaagacctagtgttaacaatcatttaggtttagcatttcagcacatggtgcttccctagacacaatcccaaccatgtggggacaattggattcagaagcactttctaaaattctattttgtagggtgatgaggaagagagaatattaaggatgaccagtctgcaactttcatgtgggctcccaatttcagagggctatggtctgtattccagtcattcgaaagaagcaccttaagcagaaatttagctgcaatgccgatccttatttgggatggaattaacaaaattatagatgtaatatgcaaaatctgcttccaagtcatattaaatgcttggattcctggcagtgtgggtataatttgcaaatgtataatgccatacattttcctacaacgtaaaaaagtaatttccaaaaatgcttccatggcaaaagcatctttactgtggagtatgctggctttcttttggcataacggtaaataacatgttcattatgtatcaagaggaaaattgtgaaatcttaaaggtttttaaaaagtgaatatatagtactactaatactatatattatacactcaaggaaaatagtacctaaagtcaagaacttttcaaattatttctctatagttaaataattattaaacaaagtttttgttcagacccaactcaactggacaaattctatgagagaacatataatttgcaataaagtaataacgcatcttttaaattttaaacaaaagcacaaaagagatttataattttaaaagtatatcataaatatataaatctttgaaatgataccacggtgactaaagaatggttccagcaatatgacagaataagtcagagctttattgttcaatcacaaacacatatattaataaatgatgcatatgtgagatagcataacgtttacttttacaaacctgggttagaaagcaagaaaatgacagatataagggggatattgaaaatcagattggtcaattcaggaactgctactccagcaaccaa

SEQ ID NO: 56050 - DNA, 767 bp, Bovine  19866880794245
ctctaaatatctgtcagagagcttaacctggcccattgtgtgcagttttattgcattttcccttgagttctcttcaggagcaagtacgatataaattataaataaaacaaacttaaaaaacaaacccttctgctccagggttgacaacactattagatatccctgaatcaaaaagaaaatatgccttgtattttcttcactctgtttaacaaggcaagaacctattgtctattttagaaagatttttatccacaatcttaccttaaaatgtaaaggtgttggcataagaaagagttgtcttcagttatctggaaaatgtgtttacgtggaacacttcattcccctgcaatgtcaaccaaacaatgtttgttacaagaagcatggatgaataacatcaaagacagttgggcccaccacttttcatcacctttctgctagcattccagaagaccttctcattctgccttcttaccattgctgcaagagtcaagtgaaatatccagagttatccctgacaattatataaagaatattttgatttttgaatctccattaaactccaggagatagcaaaggacagggaagcctgtgctgcagatcatggggctgcaaacagttggacacaacttaacgactgaacaacattagaaattaatgcctagctatgtgacaagggaaaaggaagcaataatgtgaaaagcttaggcacatcgaactttatcattttctacaagggttcttacattttaaaatagagagcaagagtc

SEQ ID NO: 56051 - DNA, 1444 bp, Bovine  19866880824312
cagcttctttctattacttggaactgtgatggaataaggcttgattttgacagtgagtagagaaatacccaggttggaaggaaaagaggaggctgacccaggtaaaaacagagaatgctcctcaacagccaggttagaaattaggttaaatatacttcaaatttttttagaaatctgttattaacgctaatatgcaacctattatgaagatgcatgtgggcacacacattctcactctctcacgctcatacatattttattaccaagcagaacttaagcaggtcataaacggacacccaactacattgaaatgatgtaatatctgatggatgtttaagagtccttctttaattttattgttatcaataaattacagtaagatgaagatcccaagtttgatgttaatgtagctgaagtttctactcaagtactgtgttagtattattttatctgttatttccttattaggaaaaatccataatggctgcatcttagctaactgtttacattcttttctggccttgcccaatgccactacacagctgtttcataaatatttgcttaaaacaaatataacatgcttatgcatgcaacccgtgtgctctttcactttccctgttataatactttcaagtaaatataagagtatataaatgggtctcacagattctctaggggtttcattatttaaacatgtgtacagatatttttgaaggtgggagtcactaaataacacagcatcctctcactggaaccccaggaggattctcccaggtcttgggaccaggcatagttacggcatttctgcttcttgggttttcttctacactgagattactgaatcatgggagtaggtacgttatttttggtttggcaaccaggaaacgcagggccatttctgtagtaataggaagcttcctgttcttgcccctgtttttcctttggtctgatttgtcctcacccattttgtgtgcgtttgtgttttctggtcttatatgcaactctgtaaacactgagcacaatcaatcctttgtaagtttttcctggtcctgaactggcatgtacactagagctgaaaagcatttaaacaccttttgttggctaaaaactggcaaaagttgaaatgtaggagagcaactgaataataaatttttaaatttaataactacagcaacatgttattcagagcaatgtttccttcagcttaattttgtcttctggagaaaggcccccaaatatgttttgtgaccaaaaaatgtactatgacctctaaggtctctaattttcaggtatgaaattctttgatcgtttcaatctctaaaaattagtatacaatacaagcacttttcatttatactaatctttttttttccatttatactaatattcttaagcattacctatattcatccacccaccccaccttcccaagttatttataaca

SEQ ID NO: 56052 - DNA, 1078 bp, Bovine  19866880882786
atttcttttttttaatctaatgcagctgagcattcacaattttctcagagcttaaaattataaatggtcttgagtgggttttcttttcatcttaggttatatttttaaattgattcttctagtgtagccattcaggtcatttaagtgtgtattagcaacataaaaacatgtcttaggcccagataagcgtatatttgcagcctatagtaaaacaagtttattcatgtcattctgtgtttctgttaagaagctaacaatgactttcaggggacttacacaaacagaaacaagatttaaattgcccaagagatcaaggaagctcagattttgtaccttatatacactaagaactatttttatgatcaaagaaaggaggagaaaattaatatcccactctgttaccagagtatatgtcaacacacacacacacaaaccccacagtcacactcatcaaaaaaagagtcagaactctaattaggggaaaaaatatgctaaccatgaaaactcaactggtatttaaaacttagaaaagcttattatttttcagtatgggatttgggatttctcttgcagtctaacacttcctgttgtggctaaaacaagagtacttggaaaaccaaaataataaaacaagtaaactagcttttcatctcctagggaagaataaatttccctagaggtaggcggatgggagatgaacagacaatctatgtgaagatgtgagttatgtgcccatcttccatccaccctacagtgaatgatttcaatcaactccatggcttctctgaggcagtgtacatccgccacaactcagggacatctctctatctacagtcacatagttccagctaacagtcagcaagataaattgcttcagagtcctcatctcacttggaaggcctctgtctcaaatctttctttctatagcaccgattttccatttatctggaattctctttctcacctgcctcacactgacattatcctcttgtacctgggcatgcacaggacctgtgggtaaaggaagaaaagcattcctatctgtcttcctttgctctcttcgttggaaaaaaattct

SEQ ID NO: 56053 - DNA, 1281 bp, Bovine  19866880912662
ctgtaaatgtctacagtgcatacactgaaattaatatgcacaatctttcatttgcctgagaatatgcttacttgtccctattagaggttgcaaagttcaaatagttaagaaagaagactatcctttaaaatcagatacaggaattgttaattagggaaaatgcactgcagcagatctcagtgaatttcagataggcaagaaaagaaacaaatcttaagttcaaaatcattagagagggattaaatgagtgagtgctacaccgagcagatgagcagatcaaagtagcagcggaagaaacttaacaacccagagataaaagacaatgagtgacggctcagagaaagaagtgaaaagaacctagaagctgagggaggctgtgaatgctactttacaacttcagttttagggcatttaaacacttctctttgttattcagagctacttttatgcttttagacagaaccacctttgctatattgcttatgttgaccaatccattattttaaaaaagcagaatggatatactcttaccagccagttaatcctggatgtaaagtgtaaaggacaataatgataatcatagctaacatttattgagtgctaatcataggccaggtactgggttgagctctttacacagataatctcctttagttgttatcataagcctatgagatagaaactattattatccccattttaaagatgaggaaactgaggcttatagatgtgaaattacacatgtattagatattacccctaccaccaaatccagggttacaatatgtaattcaattgttttaaagacaagaatacacaaaagtttagtcacacaggatctcaacagttaacaaaagtgtattcctatgtctgtaactgactccgttggtgttcttgtctgggccaaggtggtgaccttgtgagaggcactccaaaatgggagaagaaatacatgtacaaccaggattcatggagaacaggagctacccctccaataaaaccacatcagtataaccacaaggtgctgaaggagatcttggttctaagttggaagtgtaaggtaaagcctcttcaaaaaataacctaaatgggaagccgcctctccttttttggcctcaagtctcattgcattgctcatttcatgttacctgatagagacacatcttcatttattagcatatttgcttgctcttttggttagttttctgctgacaaattaacaaaggaacagtgcagatctattctgtattttacctaacggcaattctcttccagtttcaa

SEQ ID NO: 56054 - DNA, 3137 bp, Bovine  19866880916771
cttccatagagcagaggtagatttacagagaaggtaataaagctgagacttcaaagtcccacacaagtgtgggccccttgtaagagagagcacctggaagggaccctacgatgtgttcacatagccatgtagattttttcaactttgcaaaagtaaaacatattaactacaattattgaagactgctatctcttcccaagtcaagttcctctccatcatactctctttcatttgagacaactttggagtgactatggcatttggaggatttatctaagggaaagttgaattggacatccatttaacacggatttacaggatatgtttatgtggttttaggcacttctgtgtatagttagagtgtgttagttattccaatgtagaaggggcagtccattgtatcaactaccacccagtgtataaattaaatggacaaaagtcaaacagtagtatggttttgagtaccaggaataataaataatggagaaaagacaagttaatctatgaaaaattgttccaatcagcaggattataaatagaaagcaaaagatttggttcccatcaatgtctgatcaaaatggaaattctgtctcgtcagaaacatccatgataatgtaatctgtgcaattttaaatacactgtacatgtacatatttttatgtgaattgcacaaaatagaataaaagtcagaatttctgtgtgtgtggatacaaacacatacacatagcaagtgtgtttgtgtgaagtcacatgatttaggtatcccaatggatcagactgtcttcaaggcgaaatgttctaaaacaaatggctttagtgttaaaatccatatatgtagaaaataagacaaaatatgtggtataggtctttatttagagactgaaagaaaatttagacagacatttaaagaaacatgaaatgaaagtgataacaatgacaactgacattggtagaaattattctgagataaagaagcaacttgaaacaagcaattttcaggttatattaaggcaataattcactgcgagagaaaaaaaaattttaatagaaataatgactttttgaagagaatcctgtgaacacaatggaaaaaaatttaatttctgactgctttacataaaatattgatattgtaaagataatatgaaattcataattgccaccacaatgcagacaatgatgacaagtgagttaatgaatatcatcaatttaaaaattttaaagactagtcattacacaagacaccttgaaatgctctgaaatttctcaccttatgatgaaagaaatataacagaagcctacccacatttgccagcaatcttaatttacatgacatcagccatgaatcgtgaagctgaaagaagcacctaagctatcactattttttcaaatattcaatcaagctgttgtttagtcgctcagttcagttcagttcagtccagtcactcagtcgtgtccgactctttgcgaccccaagaatcgcaccatgccaggcctccctgtccatcactaactcccggagttcacccaaactcatgtgcattgaggtggtgatgccatccagccatctcatcctctgtcatccccttctcctcctgccctcaatctttcccagcatcagggtcttttccaatgagtcaactcttagcatgaggtggccaaagtattggagtttcagcctcagcatcagtccttccaatgaacagccaggactggtctcctttatgatggactggttggagctccttgaagtccaagggacttgtagtcactcagtcgtgtccaactcctttgtgagccaagggactgtagcctgccaggctcctctgttcatggaatttcccaggcaagaatactggaatgagttaccatttctttctctagaagatcttcctgactcaggggtcaaactgtgtcccctgcattgcaggtggattctttaccactgagccacctgggaagtcctcagtcaagctagaggaattattttcctagtctctgtacagaaatgatattatatgaagaggcaaagtctattgcaaaagaatataggagaaaaggtcttatacagtgaattaataaaaactgttattttcccagattttgtgacatttgtggaatttgtcagttttttcaaatgtactgtttatcataaatatttctcattatagtcactttcatactaaatttggattcctgatttggtattcttttcattcaagagagttccatattgcaaaatcttcaggctctacaaaatttgtgtccatccctactcaagacatcctgaaacggacaggcttgggactcacaaggaaacgaggactgagcagaggagtagctgaaagtctgcacacctgactgtaccagcctctgccagccgcccctcagggaagctgcaagtcttatccacagatgtggtgttccagctagctctttaaggccatgattaacaagggggcaaaagaaaaaatatataatagagaattgaagagaatacaatgaacattcaaaccaggcttctcaaatatattaacatttcccttattctcttgtatacatgtttttaaagacacataatatcacacttatgttgaaggcccctttgaagcctctttctctcttatcccacatgttaattttaagagatcatgttggattcgctcctcaactatatccccaatacagtcactgcttacagctccactgctatcaccacagtcgcctttcacagaatccagagcaacaaacagcttcccaactagtatttttgcttcttctcttacagttttcatactttcatgatcttttaaaaacttaaattggactacttcatgaccttattttaaaaccttccagtgattctctgttgccatgaagaactctaatctctgagtcttcatgatgtaaggccaggagcaggcctctcaccacttcttccccaggtgccagcattcgaggttgcttccatgtgaccctggttccagctccagacccattagccactgtcccgggtttcagcctagatgccacctccctggtaccacttcctcccaacttccatcagaaagcagcatgtgcactcccactccttcataccatcttgttttcttcatagattttttataatttgtaat

SEQ ID NO: 56055 - DNA, 897 bp, Bovine  19866880916985
aatttatttatggttagtatggggaaatggagggccaacatttttattaagaaattgagctctttttctttttctaaagaacattattgaaaagaattaggtgaaaaatacctgaatgacaaatatactatttattttaataatatttaaaataatttctaaataaaactgtaattctaagaaatcataacatttaagaccacttgtgtggtgggctgctgtccatggggtcacatagagtcggacacgactgatgcgacttagcatgcatgcacgcattggagaaggaaatggcaacccactccagcgttcttgcctggagaatcccagggacaggggagcctggtgggctgccgtctatggggtcgcacagagtcggacacgactgaagcaacttagctgtagatgtgcatttcttacagcaatttaaaatgctttatttttttttttttaaataaatgctgctaactggtaaacacggctgtttccaccacctattgtctgtcgggagaaccatcactcccttagctgtgtattcactgtgagaagtcctcacgtgacactatctggataatgaagttttaaccctagtccctattttagaacttgataaccgtgtcaagatgctgcacatgtaactactctcgtattttgcgtgatgacacagccccacagaagtttcaagaaaggacttacaagtctcacctctccttctctgtgccagggccgtccatttgggatgtatttgtttgggttctgtctcttcttctgtccgccatccgcaaatttacacaataacggttctgtaggagctgaataaacagggaaaaataacaggaaaccagaattgtatgtgtctacaagtggcaaaatgtaacgaattctttttttttttaa

SEQ ID NO: 56056 - DNA, 773 bp, Bovine  19866880926611
ttaaggaatacctaaactgcaaccagtctttgtaattatgaaaaattgtaaatagcataattactggttaaacaagttgtggtgtattcctataatagaatgcaatgaaggcattagaaagaatatctgaatatattgaaggaaatacaatatacatatacatcttatgttatacaactgagaaattcagaaagcaatatacccaaaaaggaggaaatgacttaaaaacaaattcgatgatagacaatatgcacgtaggtgggttccagggcttcaagtgataaatccagaatttctcctggtcagtgttctcgtctgagggtgtcttggtcccccaggagatatttgacagtgactgaagacattgctgattttcacaacttgaagagggaggaggtgcttccggcatctagagtctaccctctagagtctacagtacccaggacagcttccgcacacaaaaacaattatcccactgccaatagtgctgggaaaccctgggtgaggggatgctgtgtcgctgtctgttactagtcaatgtctgcttggggacttgagctacatggaatggtgggtcagtttcaggtctttactttttaaaaactgcccacatccagcagccatccagactgatagaaactgatatatttatcactagctattagaatggccaggattttcctatgtcattcagcctgagcaatttcctaatttttagtagttttctgcatggttcagactagagacatatttctcaaatattttaggaggca

SEQ ID NO: 56057 - DNA, 1192 bp, Bovine  19866881126398
tatttcttttgtcctagagttgcccaaattttctgttttttaacagagtaaatgaagcttaagccaaacatgcaggaaacgaaatgggcagtaaaagcccttgaaagatgtccagcctttttactagatttgtaatttttcctctaaacattaccttttctgccttctggcactgaacaaggcccaaataattttacctatatatggaacattccagaacatggataaaagcagttttcaagccctgccgggcatatacccaaactgaaaagtcaaggtaacacagaaagcagatggaaaacaagctggggtctttggatggagtcagccagcagtcacacatgcacttcactggagctccatcgcctgcacaggagaagcttcaggcaatgcagaatgaagaagcttcaggcaatgcggcagaatgaagccagcgtgaggctgggaatctaacaagcaagtgcatatccagtgactaggcactttttttcttaaaaaaaaaaaaaaacaaaaaaaaactctctgccccgaccacactaggtcgtcttcacattccattaacgtcacgggagaggtccagaaggagagacatgatcatactgccttctgcagcactggatatgcgtgtggcctttgtccatggggtgcgtgttgtgcgaagacagagggtgcagggcaagcagccctaggagaattccagctaacatgccgtatgcatttgcactctcttccaggaaggtactggaagaacattttccagacaaatctctgaatcatgaccatgagtgacagtgtctttgccttgggcacatctcctaatttggacctcagttctgcccatctcttgttgctaacattctgtgtgggaaagcaccactgtactatttctccataatggaatttttatcaacccaataggacatactgcttttaaatgtctatggaattcacctagattgtctcacaaagaagtcactgtctcacaaagaagttcttttatcctcgtggtcctttcaagtaaatgtgactaagtgcaaaccagctagcactcaaaaccaaggtaaatccaaacaaaagaaaatgcttcagcattttcagagaaaagtgagagcctgagtgcggagaaggaaagaaggcaaggcattctgagaaatttctttttcaacataaattataatgaatgctcaaagaa

SEQ ID NO: 56058 - DNA, 1083 bp, Bovine  19866881233377
ctctggataattatcaatttctctaaactactgaggtgacttagcacacaccacacatgcacacatatttatttaattttaaaaaatactggtaaaggaaagtccaaaggctatggaatgattaaaattaactccttctttttcattctttagagagtaaggaaactctcccttcaaccattcacggaagtgtggtggtgtttagtcgctaagacgtgtccaaaacttttgtgacgcccatagattttccaagcaaaattattgagtgggtttccatttccttcttcaggagattttcccaagccagggatagaactcatgtcttctgcattgacaggtggattccttaccactgagccaccaaggaagcactgaagatgtggtagagatgtaaataattttcatctagtgacaaaagataattccaaaggttacagtttattaacttgtatgacattaccagttttgtatataaccaatcttattctaagactcccttattgattaagttacttataagcacttacttctccagttcttaattgaaccaggtttaacaccacctatgaatggatgaactggttccttcattaattaatgagttaaatacaatctttgacatgtatttattatgtagttggagtgttctctaaacttttaaaaattgtgctttaacatgagaaataaatcactgtagaagttatggaggagtgaagagaaactttgtgacgtcttccctaacttcattggagtgcacggtgtttccttttctctgttcccatgacacttcacacgtgcagaacacacctctcatgtgtgtttatcgcatagctgcaaaggcttcctcaaggcaggggctgttagtgggctctgcttattttttgtgtttgtttaatggtgggtgctttttgtttcactgaagattattaagttgactggttctcttagtgaatgatgatccattacaggacttaacactgaatgaaagtcaagatccagtcacatttttgcacttctcactgtacactgttccaaacagatttactgaaacagggccaaggtggggaaaattgtaaaaagttg

SEQ ID NO: 56059 - DNA, 1436 bp, Bovine  19866881268942
agttggacatgggtgagtgactaacacattcccttgcttcactggccagtggaccttggaaactggaaagaagaaatatgacagaggtatttcgtgggctcccttagctatgtcgcctgaaggcagccttctgtaacccataggactttcctttttcctgattcttatcctaccgtgactcacacttcttatccttttgggcccggatgtggtaacagctcctctgaccttactcaccgtggagaactattctgctcccttcaccctgtttgccctttcagaatagccatttgtaaataaactcttctccaatctaatgtaagtacaccatttgctttctctaggaatcttgactgaaacagatatatctagtattattttatagggtttccttggtggttcagatggtaaagaatccacctgcaatgcaggagacctgggttcgattcctgggttgggaagatgccctggaggagggcatggcaacccactccagtattcttgtctggagaatcccatggacagaggagcctggtggacccacagtcttttgcaaattgattttattttttgatctttacaacaaaatatgatgtaagtaaaactgactttccttttaaattgcccttttatgagtgagaaaactgtggctaagagaagttaagtatttgttaaaaatgcatcctgctaatcagtgggagaaccagagagtaagtctggttaactgactgaatttagagctctttgcatgacatcagctgctagacccctactttcactaccacacgtcgtatcgtctgataccattacctgatacaaatgcaatggaaatgacatcttttgggtaacaatgaaagaaagaattcagtataacccatgtataattttaattaaggctgagatgcaggcatccaaatagaggcagaggaattttccaagaggagataggcttctccatatttgtacatgtggtcatgtgcagccaggtttgagacaacctaggctctgaggcttttctatgcaacagtgacttaaccaccccttcctggggcaccctctatattctgagccagacctctcccagtgtctccaacattttttctctgtatgtagctctttcttcagattggcagctcccttgtggcaggagtctatttatttcattggttactgtatctccttcttgcccagttctgggaatacagtcagtgctcagtaatacttgttacctgaataaaagagcagatatctgttcagtgcatcgatattctggcattattatgaaatcttggagtcactttctcccctagtctttttatcctctaattcagcccattgccaattttggctgattctacttttagaaacttttttagatctatttcttccttttcattccaatgtcactatctggttcagcttctcaagcttttttt

SEQ ID NO: 56060 - DNA, 1352 bp, Bovine  19866881273893
ccgcgtaggacggaccgaaaccttaggagcccggatcgctttgtgttgggggtggagtgtgggggtagactggagggacccagcttaagaactgcggagtggacaccttgtttgctttcatgagttttatctcctttaggagaggggaggggaggaaaggggagaaagaggaagaaatctgattaatctctcacttacccccacccagtgattttttttccccacaagagaagaaaaatgatttagtgcccaaccacaaagctgcagtgaggacacctgggttcggttcccccatccctcctcccaggcctaattttctagttgaccttgggagggttagtgtccttcggtttggttttcccagatgtgagaagtgaaaccctgccctctgcacaggaggaggcaaaacgcgcggggggttggggggcggggggttcgcgcgcgcgagtacacacacacacacacacacacacatacacacacacaccgtcacaccaatatacggatccttctgagggggagatgtcgcaaagaggcagaatgttattattagaggacacaatatagacatcagcttttctctgcctgtttctaatgctgccagacagtctgtcaactcccactcaggagcaaggaaactcccctgagtttggaatattttaaggccattttgaaagtcacgctggcatattgttgcagtgtgcttcggtgacatattaaaatcaatctctccttttctgcctctccatctcctgattgtcacagctccaaacagccccagacagctgtggttcagtgcactacgtaactggatacaatttaatggagttaattggtccctgaagctccctgtagaagactttttacattctagctcaacaagagataataccaaaatgtacaaataggataagtaagaaatcacgttcaagttgaagttgttgctcatctaataaagggtaatgaaaaattaatttgctattaaatagaccttgattactctgttttgtcattctggatttccaagagtctgttttcataatagcccaaaggtaaatcaagctgaaatgaaatgcttgattttgtcaaagttacatttttgtctgattacatttcaaacagtttagtaagatactttaaaaacaatgcaatagtgaagtgaagcctttattatctttataatatctttattatctttatattgtgatttagacaaatgtctacgttaaacattttgaaaaaaacaatataagttcatatgagaatattttggatatgccaggaggcaaatcacactctcataaaaaaataataataataacagttaacccatgtgaaaccctatagggaaa

SEQ ID NO: 56061 - DNA, 1435 bp, Bovine  19866881329501
acagaggctaccacacaaaaatgagtaatgggtatccttactgctaccatcttgctgctttctggcgattattggggagggggtgaaaatgaggtccttgagggctaaaaaatttcaggtctctatgcggaagagtgtcattttacctacagggacacatgcagaacgatgatgtaggtacataacatggaccacacacactgtaagaaagaaaggcttatcgaagttgagtcagagattctctgcaccaggcctgaattgccctctgccagcaagcagggcatgataacaaccttccagagaaagttcagaggctgtacccacacttgattcttttgtaatctggaagggcaccaggagtccagataggagatgctaacagctgacgacattttttgcatccaactttcgccctcccaaactggaaaaaagcttccaaagcagcgaaaccctcacttttcatggacccaataattttttaaaatgagttcagaaggcatcaaattcttatagtaaaaataagatagttccactaacaacgtacccagggtccctagaaagccaggcgcaatttgtatgactacatgtcatctgctgtgttacttaagtatgtaccaaagccacttctgagaaagcaccactgaaaatcgatctgtaggtaaacatatcaggtagcatttttcaaaactaaatacgaagtcacttctttctctgcatcgaaatctgcccattgtccctcctttgcagaagctacagggaagattaaagggaaaagggacatcaatgaacgctgagtgaactttggccactttcctacccaaaacaccagcgtaaaagtagaaatcagtaaccaggtgaagtgccacagcgcacaaagatcaaggcgaggggcgggcgcgcagggccggaggcggggagggaaaagtcccgtcccccgctggagccccagtcatcgcgcgcgcgggagactgaggggcgtccccggggggcgggaggttcggcgccactccgagggaagccgagagttaccgctcgccgggcgaggcccaggagaaggggtcgaagatctgcgccgccagcgggacccgcggccgagcagcctacgctcggcgaggggcgccgctcggcccgcgaccctccccgcctcccgggccaggaaggggccggcggctctttcctgtctagtctttccccccgaggctttctgtaacccgatccccgcactcagttccgcgggcagcagccgcccagcgcgccgcccggctgcgcccaggccagcgctatagttagcaaccttccatcaactccaccgggggcggcgggagctcgccgctcgcccctcccggacccgagcagcgtgcgccccgggcgccccccatccccggcgcccctttaccttcgcttgaagatactgggggtagtagtaggtggcgta

SEQ ID NO: 56062 - DNA, 1451 bp, Bovine  19866881351785
gatgttctttttgatttctcttgaatgcatcccaaagtactactgtttctcctttatagtctttttttttttcctttatagtctttagtttcctttctaggcttcgtttatttgatgacatgtcatccagtcaccttgtcttatataagcatgagtatcatttgaaaattagttgtgtttggagaattttttgacatcccctgtgattttatttttttagtattacctggatattgtgaaaacaaaggctggaaatagctctgcttagatactaacttctgagcaataggatatgctgctctatgggcctctgctccttcgaactctttcttagatgttctgaaaatctcatatgtatttttttcatgctttatatttaaggtttttaagctttgattactgccatcttcagccagccaaaaacaactacatagaactttcagagcttattagttctggctaggttagcttgggttgagtaggaggttgaatagacgacttctgaagtccctttcaactctaaattttatgattctgggaatttataacatccaagaatcacacagtcttagaactggaaggaactttaagatagtctggtccaagccactcactttaccaatgaggaatctacccaaagtgaagagacaggagtagagttccagagctgggggaagtggggtagagggatgggggggtggagtggcaggagggccagacctcacatgactggtccgtgctgtgacctaacggagggaaggaaagaagaaggcaggccacacacagccttagcaattaattattccaggaaacctatcagaggttggactgggctgtactggggccggagtcaccagctggttttgggttggaaactagtagcggtcaccctgtcagaggtcaccccagcaggtggggctggccaggcttgtgcactgccttccccgggcacggccgcttctgctggtttgccagaacggtgtccaaatcagattctgctttgtcgtcctgtttctaaccataaagatgctctgggtaccgctcccataactgggccctgcttatcctccatggcttctggcctcttcacagccttgttctccttctggattcttcctttaccacattcctaagagtctttgtttttacagtcatgggtctggggccaaaaccctctcccttttttagcacgcctgaagctttcccacactagcaggatacactccagactacttgattcttactaaactttctctgtcctgccatcactacctgctgtacctgctgtaacctgtttggtcaccaaacagcaacacaacccagggaggctctgattaagcaccccctgtatttgttaaagccaaaccccctcattcaccactctaatgggaaccactttcttctcaatgctgagcactccactttgggctttagtatttcttttatttatt

SEQ ID NO: 56063 - DNA, 1570 bp, Bovine  19866881423731
aaaaaaatatatataaagtatcaggttgtctgatgccctgtgttagaaaggggaatgagccctcttgcagcagcagccctcggacccccttctcctggtatctcgccagcctgtgacctgtggccaaaccccagtgaccttaacccagactcaggctctgtgaactgcagtatctttatcaatgagttgtcctttatggagccttggctgttgatcaccttatatcctggtgatatgctgagtgatgaagggccccatctctggtcaccaatttctcctcctagccctctcattttctgcctcttggagtcattaagtggcttcaacttctttctgcacagaaaagctaatgcgtcctcaaagtgatgattggaagcaggacattcgctttggttgccttgcctcagttcaaggatggaacagttggggcaggtcagggtcatcaactgcttcagggagattctgccttctttgggtccagatatttgttttaacttatctacaaggttaatggatttaattgtgtgttagattgtaattaaggattcgtcccaattaatgatgctggtgtaggagaagccataaattctcccatggctcagcaaacttaggcttgaaataaaatagtgttttggggcaagttcccttctcctaatatatgcttttgtgcacattgagttcaatcagtattgacgaactagtctcttagaaagaagataagtgctttagactttatcatctctatccggtgagtcagtgactccaagttagtatcaggcactcttctgaaactttacttttaaagtaatggaaaagtggaatacattatttattgagaactttggtcatgaaatgccctgatttcttgggcttcccaggtggcgttagtagtaaagaacctgcctgccaacgcaggagatgtaagagatgtgggttcagttcctgggttgggaagatcccctggaggaagaaatggcaacccacttcagtattcttccctggagactcccatgagcagaggagcctggtgggctacagtccatagggttgaaaggagtcagacacaactgaagcgacctagcacgcacactcatgaagcaataaggttaactatataacagtataacatgtgaaataatatacaagttggttcacagttaataatgattaatgagtagaagaaagaggagaatgttgtaaaataggtcagaaatgtaatgcttatgttgggtcgtatttttgtttgaaaattttaaaatctgcaaatatatcattttcaattatttgaaatatgccattaagaattatggatttaaggtttcccataaatgcatttaatcttttaagcatttgtgctattacaaaaaccgtggaggatcaagtgaaagcatgttaaatggaaatcttataagaaggaaggatggcagcactttgagtattgtactatatatttttctaagatgaaattaaatgtcatgtatttggggagcccactaccatttttttcttagggagacaacaacttcataaccctataggaggctggatacttatggtaagttgaaataaa

SEQ ID NO: 56064 - DNA, 831 bp, Bovine  19866881618462
acccttgatccccttctactctggtcttgaacatcatccaaacataggttaactagatcatattctttacatttaacttcctaacaccaatcttacccacatgctcaatatattccagctacatacatcatcttattatttactgaaaatactatattttttcatacaactcagtctgtgtttccggtatgttcttctggtctttggaactcttctgcttaaagatcacccccctcagtggtgccttccctgacactcccaggcagaattaattgctatctgttgtgggtttcatatcatttttatatatgacttttggaacagtcaccacatggaactgtaattatttccatgtctaccctcttagccagaataagaacttgaggacaaggatagtctttaatcatcagtatcccaaattcctaagactagattggctggaagatagcgggcaataatttaatgtgagatgaatgaataaaaattactcattaaagtcacggtccttgtctccccaatacactgattttcacaggaaacaaatttgtctcctgttatttctgtgggacctagttttttttttttttttaattaaaagtcctttattttagcttaccttaacaggtggttggtatgtgtcatccccaattctgacatgattggctcactggtttcttctgctcacatatcttaaatttcagctaggtattttaatcactagcttagctcagactgacagtaatcagatggccttctgccaccacagaaaccatgaaacagcttagtgtctaatttgatgtgctatctcccaggcatagccctacttctaga

SEQ ID NO: 56065 - DNA, 2088 bp, Bovine  19866881646010
attcccagggagttacattatgtctgtcaatcatacctttaaaaacaaaagttcctagaaaaaaaaaagtataaaaataaaagtttctaatcattttcttttataaactaaattcactcaaattatatagtagtacgttctagggagtctgagaatataacttaatgtaaacaaaaaatactacttatttgcaatcaatgctttgccaaatctgcattaaggaggaaaagttctaaacaagttatctatgtgaaaaatgagatactgaagcagatatcagactaattttaagatttttaaatttgctaattggattagtgaggcctcggcttttgtttttatctgatttctcaaatgttaacacagtagccaaaagtgcaaatttcaaatgtcagggcctacacctatgataaaatcagatgcagcatctgctttagtcaaattctatgtatgtgctgaatctctaatgtgaatgaatcacttacatgagcctaagaaaactttaaaaaaacctatatgaagctctgccctcaagtgaaatgatgaacataccctggctttgaagtctgacataggtttcaaattctggctcacctccttacctacagtatggccttgggcagatgcttcacctctgtgaacctcagtcttctcttatgtaaaatgggataatactaattatctgctacaagctgttgtcaggattaaataaaataatttcatagcatacctgataacaataggcaatcaataaatattaactctcctcctcctgtctcttttcccaaagaggaagagaatcacccaagagaaaagcattaagaaagagctggcaacactcatgaaggataaaatgaatagtatgctaacaagtggagattacaatttgggaggatgttctagtacgcatacatgatagcaaagaggcaagaatcaattgttagagaaatacaaaacagatgcaacagaccagtaagtttgtaaagcagaaacttagccataaatctaaagaaagagtaggtagtgagaactaatgagaaacatgaagacttttgattaaaatacttcttgaattctagactggaacacgtaagtgccatctcacagtgaaccttaagcacagcaaggagccatgaggcagtcactacagtgagacttggtttcccaaaccccaaacaggcttagcagaattaacaccattacttgtcatccaccattagctcataccgtgagatctacgaaagtttcataaccatcctctacacaaaatcaggtttctggtcccactggcagccaatcaggagagcctctgtctgggctttcaagtgccctggatcagctggtaactgcaacctgaacaatattgtatttcatcacatctaagataccatccacaacaggatacaccactattctatgtaccgcttggaaatacaaaatgagggatctgatagaagaactctagagaaaatagggagagcaaggggttccactatttggaaaagagcaaacaagaagcaaactgactgcaataaaacacacagcaaggaaatgtgtgtgtttgtgactgggtgaagaaaagaaaaaaatctccgccgagctggcactagatctgtataaccagtgtggcacgacaaaacttcaagcagatttcatttcaagtgggttcagactggtagtgtccccaggtgactattacaagtaaacaaaaatccacaaatcccctccagaagaactggactttgaagcaggctgacagtcccttaaatatgccaccaaccaggcgatgcactctgatttcagggaaggtaaagtatgggggcgggggataggaatttgtgcacttagaataggaaatgcagtggttgttttcttaaaaagaatgggatgacattatgtatggatctaggtcactcgacaagtatttattcgtatgtatccactatgcgcataatagaggtttcaaagcaatttgaaggcacgacccttgcttacaaatgtctttctaatagtctctctgggaacacagattcatgttcctatctgatttacttttggactattttgccaacatggttatagtgctgt

SEQ ID NO: 56066 - DNA, 1001 bp, Bovine  19866882038383
tattattattagaaaattacttgacaaagctaggaattattcctactggaaaggtagtcttaacttcggggaatgttgaatatcaattcttttctatttttttctttttgtgcaatacccaaatactaaggcagaaggcaaaagtcaactgcaacttattaagtcaaaaccttgtcgttctgtgttgtcatcaggaaggtggctctgatatgagggaacttccctttcattgaaacaagtgaaaagcagtgggaacaattttgagttctaatcagttattttttaggagagcatttttaggaaacaatttactgatttttttttttttactgtgacttttctctcttttccccaaacatcatctctgcttctagatattaaaaaaaaaaagtagtccattttttgtgtgtgtgtgtgtggcttgtgaaattacaattgcaaattccttatagaaatactgataaaatattttctcttttgaaattaataatccaaagtagttgcaacatattttcaatttgttcagcagtgtaaaatgataaactatttgctgcacaggataaggaaagcatgtttcacattttgaaaatgtaattttctgccataaaaattaatggacaacatctaatggatgaacataactgtatgagtcagataatttgtatatgttacaaacttgaaatataaaatatgaataaattataattgactacaaaaagtgaactttgatagaaataaacactgactacagccttgtccatttgtcttgaaaaagatgttacatgccacaatatactggctatgagatgctttactattgttaatgaaccagtgaaattagtgttagattccccatttgcttgaccaactgtttcttggcttaagtattattaaatttcatgataatattaccagatttgatgaataactttacttatgcaaatttaggaggaaattctggtgattttactgggtaagtaaacatttactgtatctatatg

SEQ ID NO: 56067 - DNA, 1096 bp, Bovine  19866880359633
tggagataaaatgtttaaatattaattaatttagtattatcagaactgcatagttattaggcatttccaaatttggaagaattttcattacacagtaactgggtaatgaaaaaagaaaaccaaaagtcctcctcaagtccttatagagaggacagatcaaatgaaattttctaatgatctggggatgtttcataattgaacacttagtagtcatttccaaaatagcaaatataaagcttcattattgactaggaattttcagagtacacccacatctgtctctataccaaataggttttcattactcaagcagcatatggcagtaaatgaaccaaaaagaacatgttgcattatttttctgcattaagtgccgacattatctttgccacactgtatgtgtggttttgtgtaataagaatccttttagagacagttcggaggtacacattctattctaactgttaactttttgaagaagcccattttcaaagtaacatacagtgtgtgaattatgcccaatctaattatcaggcagtactttgggaatttactcctaaatggctgctattaacataaacaagtcaatttacatgtcacagtaaggttcaggttaaaagaaaatgtataatggatttcagtatatttgtgatctactgtaactatgcttttatttaaaaaaaaaaaaacagaataatagatgtactgatttttctccatataaactttgcttttataatagtcatatgaatactcaatcatagttttcaccatcagccacatatgtttattgttgttgttatttagtcgataagtcatttccatctcttttgtgaccccatggactggagccctccaggcttctctgtccatgggctatcccaggcaagaatactggagttagttggcattccctcctccaggggatcttcccaacccagggatggaagctgtggctcctgctgtgtcacgtgcattgcaggcaaaggccgtcaaagcagatagatctctactctgacaactattctgaattaattttgcctcaaatcttcacagtaacaagcgtagagatctagaggaaaaagcagtaccatcaaag

SEQ ID NO: 56068 - DNA, 1469 bp, Bovine  19866880696798
tatatacatgtccgccttagtacatggtaagtactttacaagaggtgtctattttaattacctacattccaaacattgagagaaggctttgcatactgtatttctctactctttactatcaacttacaaaagttactgatgttgaaaacaaaaatcctgaagtttcatttttaaaatcgtgagtagaagactgggatttgaactcaatccattgcaaatgtctctctgcctttaatatacttcttattgtaccatttctactgagctggtgatggacagggaggcctggcatgctgctgtccacagggtcgcaaagagctggacacgactgagcagctgaactgaacagaaccattcattgatgtaactgtttcaccttacccacagagaaatgactcagagaaagtatgaaatacatcctatatcttgcattgggtaggtgagaaccacagcactcagtaccaaatccccaggctctcggttcagtgcttttgttgatataattactctgactttattaatctacaaataaaattacctacatttcaaggcccctgaaggtaagaatggcatgacacaacatggcaaaataaaatgttttaaaaatgacatttttatttgacagcaatagaatttggagacttattttaaaaattaaagcataattttagacagtacagagttgaaaaagtatttctagtttagttggtttttaggaaaagataagattcaataacatcagctggaacacaaggaatattttattaaaattattttttgatgtgatagtttattaattagttaattcaaattaatttcatcattaatataaagtgaaaaatttgaacagtaattaaatgtattctgcatgttattttatataatctcacataaaagaaaagtatctaatttggctatttaggcctgcccaacaaaagaaatatttccttttattcaacatagcctaatgatcaggataatctacaaaaactggtttatccaaacaccactttttaagcacaatatttcatatttatagtttgcaactaataaaaagaagatatacttgaagtccagacttgaatgtccattgtatccaatagccttgaccacaaacaactgcaggattgggcatagtctgtactttcaatcagcatcatcagcaggcagtaatcctggggaaaaaaaggtaaattccacaaataaacagaccaatcttcctttaagaggaaagctaattcttttcaatctactttttttattacactattttcccctctatctacttagctagaataaggataaatttccaaagctacccagttggaaaataaataggttcactgtttgtctagcattccaatctttgcaaatgtaaatcagcccaactgctcctcatttaaaccttcaacttcacaaaacattaaagtgggctttcacgacacaatttaatctatccactaagattt

SEQ ID NO: 56069 - DNA, 1546 bp, Bovine  19866881161261
gagtatttgtcttacttgactgagttccctgaggaagacaaacttaattgtgaatgcaactttttatttcaatggtgaaataaaattgatatacgatttgtaaatagcattaacaacctacaattactttgcatcataatagaatttaggctgggcttagcatttgaatgatgttttaattttctgtgtagaacatggataaaataggtaagtctgccttaatagaaaaatggatgaaaggaataaacaggcagtttcttaatagaaaaaatatcaaagggccactagtaatcaaataaatgctaattaaaaatgataataagatgtcatctttcaccctcaaggtgacaaggatatctttaaaaataataattcccagtgttagaacttctataaaggaatgcattattttttcatttctggagtaaggataattggtataatttttctggagagcattttggcactatataacataaaccttaaactgttatatgctttgtctgattaaccatgtgcttgcgaatttagcttgacacagatttgagtatttgtttataaagtccatattaaattgatgatactgataatacaaaaaccagaagataaaacctacacatctgatgataaaagactgatttaacaatatatgaggctctatccataaagctgaacacaagaaagttaaactatcataaaataatttttaaaggcaggtaaaaaggctcactatattaatgaaaaagtacaagtatcaaatattaggattcttccttgctactttcctttaagatgtttaagtgtgggtataatataaagcatatgttatgtatcacttgtcatatgtacatagaaaaatgtatgacaggctacacaccaaacattgaaataatttctttcagagtagtgagacacgggacaatgttattttacatctttattttctaaattttccattattaatctataacattctataagtagaaaagcagtaaatattagagctatagaaagatacctctattgttagtaaatgtttagtggatcaatttgataagtaaacaaaaaaattctaaatttagtattaatacacctttaagatatacatatgcaaggtaatgaatctgtaaggatgtgcgggtatttgtatttttgtattcctatctttataataaaaatatgtacatatgccaatttatttttggctaaatgtcactatagactgaatcaacctactatgattccaaacatctactgggaagaatcaagatgctgcagggtaacttcttgaattatttcctgggtcaattatacatggtgaagtatatcaggcaacattctgaacatctacatttagcaagagatatcttgtgtaaaaaccaagttagtgaaatattattatggttaaaaataaatcatagatatcaaggtaaaaactaatttttgagaacctattatattactcgtatttgtaagtttttttctttaatttttaaaatctgcaggataggcgttatttgtctgcattttaaggatgcacaaacca

SEQ ID NO: 56070 - DNA, 1556 bp, Bovine  19866881185444
cagaataaggcaaaatattaataaaacgcaagaacttcaagattcattgttcagcaataaaagtgttttttgtgttctcttttggaaggagaagttaactaggaagttaaataaacttggcaaaaagtatttcactcttctctagatgtgaacaattatctggcccaagataatatctataacctataatttactggtgcaggtaagctactttttctttatcatttcccacgttcttacttagatgcctggaaagttagaccaagaaatacaaatctgtaaagtatgtatggcttgtttgtgcctcaaagatatcacataatatccaaaaatcaatctaaactactttttaataggatttaaagtggttaagcagtggctgtgcaaaataacaagaaagcaatgtgctgaacacagaaggaaatgagaaaagttattttcaaagcttgggaaaatagccacagaatattacttgttcactgatcatattgcagattttatgtaattaataaatagtaacaacttgaggtgcacctccctttttcccttagttaatttttgtctaacttaaaatcatgtctctcacagagcaggcataagcattttgaatgcctgtttatacacattcgaagaaattaatttgtacataaaatctgcttgaatgtattagacataaggaatcagattattttaatttgccaatcagagacatatgcttttaaacacagaatttcattgtgctatgcactttccacataaaactaataccacatctgcagcataatctataacacataacacgatgttttacacccataccatttacccatttcacttctgcagtttttaagtgttgatgaactacttcttgccaaagaagccacgttatatacaacaaaaccttcagtttaaataagggataagcttgctgttaacaacttagtttgaaatgttaacaacccttaggctgttaacataacaactggccattaatgtggtaatgaccaatttgagaggaaattgcactctgagaaatgaatatattggcaatctggactagggtttaaatttgaaagagttaggattaaaaaaaaaaaagtaactagattaaaagtttgagcttatcagaaatcaactaaaagttgtatcacacaaagcagcaaatagactcttttagagataaagatttctgagatgaaaactattttgataaaatcccttcaacaacacacttacttgagactatcaaatacgagttgaacaacttatttttactaccataaggaagacagacgacagcaatacaaggttactttctctgctctcaactttgttgacaaccgcaaaagagactatcaaatacgagttgaacaacttatttttactaccataaggaagacagacgacagcaatacaaggttactttctctgctctcaactttgttgacaaccgcaaaagagtttcactcaggacacaggtatttcattggcaaatttgtatttttgagttaaaaatagccagagatttcaaaagactggaaatttgacataatttt

SEQ ID NO: 56071 - DNA, 1026 bp, Bovine  19866881309058
tactggagtagattgccattcccttctccagaggaacttcccaacccagggattgaaccctggtctcctgcatcacaggcatgggataaaagtgcttattatgaaaggaataatctgtaagtctcctttaaccagaagatatatctagttactttaaaatacgatcaacttttgagacttctgtggccatccagtggttaagactcagcgcttccactgcaggcggcatggcttctggttgagaagctaagatccctcatgccacactgcgcagccaaaaacaaaacaaaaaatatggtcaacttttatagcttttttttagcttaactttagaaaaattcaaagtcatctccatgtagcaatgtattctaaaaatatatgttaagcagcctaactgtgtaacaattagaagcatagttcaaactaatgttaaacatttcttgtttcctttgatgtattttcagatgttcagtgtttccttttttgcttcttttctctcccacattatctttatctctgtgtcagtggtatgccttctttgacccaataggagagagaacaatagattgaactctcttcagcctgtcatgggtgcgaatttttttttccattttaaataaaagaattgaatgtttaaagtgttttcattttctatcactacattccttagtttaaaagagtgaaatagaaaagaagatgaggagtatacttgtaatagacaaaaaagcaattgcccttctcaatttgtgaaaatgttctattctttcccacagaacatactcaataaaacttccccattcggcagtcataagttaaagatcttttcaactgatcacaatttcatatccttagaaaacgaaacttcctctgttcactctagttattctgaagaggggtggggtttaacaggataactacactgtcttatcctcaatattttaaaaaatatttatcattcattaaattcatgtgtattcaagctgcttgaatattagaagacttacttgatcttgttcagaattaaag

SEQ ID NO: 56072 - DNA, 1013 bp, Bovine  19866881436824
aatgattcatcaggtgtgactatctctgccctagatgaggggagcctggaggattacaaagcagaggatgacatgatcagatgtacatttcaggaagttcagtctagtgatcctgtgaaaggtgaagtggaggctgccgagactacaggctgggagcccagctgatgcagttgaagagaatgatttaaaagcaatagagcagaactggggagaaggtacacttcaaagacacttaggagacagtcaatacaggagtgggtggtagtttgttggggaagaagatgagttttagacacattgcttttgaatggccttggaatagaacttggaaatacaggtatttacactttaaaagttcacaatgaggaacctgaagaaattggattttgtgccactgggtggtaaatgtactactctgtactctttaaattgtgttacttcaccaacccactgaaatcgtaagacatatcttactcttttgagtataaaatctcaattaaatgttaaatgttatctgaatctgttgagatatgcaagggttaatggagtaaagaaattagagagacagattacttgttaccctcatccacctcattcatttgcataaggcatcatttcagggttgttttttagcaccaaaacagaatgaccagtttctgttagtagtcctccatgatcccaaggactattttctaatggctttacttctctcagaaccatttcttctacttgtccttcaagaagacttttatagttagaactagatggaatttatgattctgaaattgtgggttttatttatccacctgtttaaaaaaaaaaaaaaaaagttaaaaagaattgtttgaccagttatgctccagagctctggagcatagagatggtgaaagaagcagaaagccatcaaaaaatagttgtcatataaatactatttattcctcaaatgtgtatagaattctctagtttccagatattttcatgtctcattgatcttcacaaaaaccaaacagaaa

SEQ ID NO: 56073 - DNA, 971 bp, Bovine  19866881568271
atgatagtgaattagtaagttaacttttctgctgacagaggaacccaaagtacttggaatctggacagagcaaagctaaggattagtgtggatgctagttaagaaatggggaggttttatttaagggacataagattgaaatgagatttttggatttacaataaaaaacaccccaaattaatggatttcacaaatttatatatccacatttaaatacatctatatatttttaatagggaaaacagaatgaagtggataactgtttatttcaccaagtaaggtaataaagaacaaaacctattatctaccatcaccatatttccataaaggaaaggctatctgtacaacccctcaaagtgggaaaggtaaacatcagattgaaaaagtatttttgagtaaatatagtcatgtaaaacatatgtaaatatgtctttttttcccttttttaaatttcatcggtcaagactgatcttcagacagaattttaggagaggtagaaaaactttcaaaacttcctttgtatccaaagcagggatctgacattatctcctcaaggtgaaataaccctgaatggcctgacatttgcacaatggctttcttttgatctgtctgtagttctaattatttaaaaataccttccctctttccctgcatccttctacccataatattttgtggcagtctaataagaactcaggcttatccactgaccatatgtaaaattagataaattgtaatattccaccagaaatgctaactttatgtcaaaaattcagggtagagttttgggaatatgaactgtggtcacctgatgtgaagagccaacttgctggaaaagactctgatgctgggaaagattgaaggcaaaggaaggaggagggggcagaaaatgagaatgtgaggtagcatcacgtactcaatgaacatgaatttgagcagacttcagcagataggaaggacagggaagccgg

SEQ ID NO: 56074 - DNA, 1671 bp, Bovine  19866881576202
cgttaagaattctccttctttgagagacaaatgataatgggattaacggatacaaagtactatatccataaaacattatagaagggcaacaaggatttaccatatagcacaggaaactaggggcttccctgatggctcgttaggtaaatgaatttatctgcagtgcagcaggagtgggttcgatccctgagttggaaagatcccctggaggaggaaatggcacccactcctgtgttcttgcctaagaaatcccatgaacagaagatcctggcaggctacagtccaaggagtcccaaagagtcggacatgactgagagactaagcacacacacagggaactagattcagtatctgtaataacctccaaaagagtacaatctgaacaacaacaacaacaacaaaaacagaatcacttcactgtacacctgaagttaacacaatattgtaaatcaactctaattttaaaaagatactgtaagattttacaagttgaagaaaagaattctccttgtctatttgtaatttctaaaaaaatacatctaaataagaatctaaataagcctgtatagcttggcttcagtgctgtttgttttcaaaattaggtcctctagttagaaggaatcacagactctatcacacccagctcctatctaccatcatttggaggaggacattgagaggatggagccaatctctttgcatatatttagtgataaaaacatggatggcaacttcctcccagaattgctgctgaaagccctaccattctctgcctctctttcccgagccccatcagacattactttttcatatgagttatattgaatgtgcccttttatgacatgcctaagagatgcttaaagacatttctttattcacttcccaagtcttcactgttgcaagcacaggaaatttatcacctcctgggcaaagaccatgctcttacttttagtgaagctctaatcttgctatgagacatttgatatatgcccagtgctggaaaagttccttcattcaaaaatgagggggcagggaggtaccttcaaaactatacctgtctgttctattgcacatgcacggaaaaatatcctgctcaggtccacggtggtgagtcgcttccttcagcttcatgatagaaaatgagccagctgactgggtctgtcttgtgtcgacacaaccatctggaacaccatatcagggggtaagaagacatgtttcctgggccttcactgcctccatcaactggcctcactgggggacttctctctcatttgccaggagatatatctgcagacaatctcgtttttcagtctgagtgtttgcacacttagtaagagggcaggttctataaaactcttctttctgtatatatttgttttgctgtcaagttccctgtagtttttgtttgttcaggggctgagtttgtagcaggtgtttggaacaattaacagaagcagggataccagtcgtgggcaaagggtggaagaatataaaacaaaagcttgacattttaaacaacaaaggcccttaaaaaatgcacttaagaactgcagaggagagcacaccagtagtgtcgtttaatctattataattaaactatgcatgtgtgccttggccataacatattagactcagtataaaatatcacatatatgaatatattttatatga

SEQ ID NO: 56075 - DNA, 2099 bp, Bovine  19866880367459
ttcagggagcaggcagaccggagtgccatgagttcaggtttagaccagcttagactggggcctggaactaatcacaatttgtatgttacatatttttatgattatttgactggtttggctttcttcacaattaaaagtctcatgaggacaggaactgtcttgttttcttcattctgaacttccagagcccagcatagtatacttgacacataacaggtattcagtgaatatctgtgtgaatgattcaggtgaacacgttcagcaggcagctgagtgtacagtttggatctcagtcgaggacaggaaatatagatttgggagttatcagtgtagggctatgtagtggacatagtggctaaggaactgttatgaaagttcagatactgtgtagacctgaaattttcatgtccaggtaatgaaattatgccttttttctttgccatgccaaatattatcagtaattatctactgacaatcctgctaattagttttttaaatttcgtgactaaaattagatttgtgataggtagggaaataaaggtgataaagacagattctgtttccgtttaagaataactgactcataggatgaaaccttggatatgatttcagatcactcctgtaagctctcacaaaagatgtttataaaaacacttggaacaatacagattgtactaagaaaatgtgctttgatcaactctggagatacaaagcagggaacttaataaatcaagtcctatttgtgaatggaaaggactggaagttcaccttaaaagtaagaactgagttcacagcaagacctaaattttgtattctgaatagcagatgttaacttattttcatcttttatatattaaaaaaaagaattgcaggtttcagattttggcatcttgaaatctgactcctgattcctatctcttaatagcttttggaacactagtctagaaatggaatttgactttggttttttaccctttaattttgaggtgaatgtgctgccagctctgtctttcctctatattcaagaaaaccaaatcacaggtagcttggatatggtataatttttattatttaaatattagaaaaatagggtcttgtttatgtaaagtagtaatgttacgttgacacttgggaaagatggttttttggtttttgtgctttttttcattttagtgcataaatagaattgtattacttttagggctaaacgctctcatcctaccaccttgccatatgacaagatattatagtaaattgcatgtattttaagtgtctttgtttattgcctagattcctttcttaccctcctagtagaaatgtgagccatatttgtttgtttaattttttgccaaagaactttaactaaatttgcctgactccccagtgcaggcaagtgtcttttagcaagttaatttaaaggagcatttctaaaaattcaaattgcatagattatagcattccagctttttaaattactgttaagatatatgtttaaaatatgacacagatgattttcttttggtttatagattaatgcttattctttcaaataggttcaacacatatctgatagactaagactttgtgccttctgaattttaccaaggctccttcaagactgggaaagagaatacatttcagttcttaatgataaagtcaaaattatgagtttgactcctgcgtaagctagttaagttataaatgggaaaatctccatgctgagaccccagaccccagcaaactgtatcctttttgaaatcagttagagctgaaatgaaagaaggttgatttctggaggctcctggagaaaaaaaaaactttaaatacctctaatatagtttagcttattctgtattctgaaatgattttcatcaagagcttcttaccttcattcttttctagttaatttttcagaggtagaatcattcaaaatagaaaagttcacagcctagatgtcagaggggttcgtcagcagcccttacggatggtggtgcacagtggcccttgggaagaggcctgactcgctcgtgccgctgggcccggggctcatcagggccactcctctgttgcatcgctttcacatatgccgatctccactc

SEQ ID NO: 56076 - DNA, 1552 bp, Bovine  19866880417893
ccggggaatatgagtaaggaccgataacatcatatgcttgtctactagtatggcgctagtggtaaagaacccatctgccaatgcaagagacccaagagataagggttcgatccctgagttgggaagactgaggaaacagcacccccactctaatattcttgcctggagaatcccatggacagaggagcctggcaggctgtagtccatagggtcacaaagagtcaggcacaactgaagtgacccacacacgtatgcgctgctggtcaaagtagaaactccttgaggagaaagtaccccaggcagaaagagctttatcaagacctcatcgagggacttccctgctggtctggtggctaagactccatgcttccaatgcaaggggcccaggttcaatcctgggtcagggaactagatcccacatgccatgaccaagtaagcatagtcaagtaaataaacaaacaaaaagaccccatctaaacggcttagcatcaggagagatgcagtaacctggggaccctctcactctcactcctttcccagcatggcctccttttcctctccaataataacagctcatgttactaagggcctctttctgccaggcgctatgctaaacccttggcattcatcattgtgtgtcactgtgccaacaacctgggagttagggaccattactattccatcttacaaatgaggaaatgaggcttggagaaggttctaggacttgccccagctggtaactggcagaaccaccaaacccagaccccaagctctcaacccaagctatacatttccctcttttcatctcctttctttcgcctctgtttatgcccaaagcttttaagaccctctccctcaccccaaatcagatcccgtatcttctaaagggtttcaggctacacaggaggctgacctctgaagaataaggcccctcaggtggagggttactgtttctgagatttctcaagaacaggaaacttcccgtactgcctgcaataaatccaagccttccttcctttgtgatttcaccccgggagcaacactccaggatgactcatctcaagaccggcaggagatctcctcaggagactggcggtgaccttggctgggcactcacatcctgtgcctgtttgtctaatgggcagccccagcctccctgccaggcttgttgtggagtatcagggcaaacacaaagcatgtggaaaatcattttaaaaagagaatgcaaaataccaacaataatccaacccccacctacatcccacataccaaacccttatctaaatcccctccaatctgaattctagcttcaaaagttcatccgcatccctgccttctccttgtgtacaggcaagctgtgattcctagaaaaacaaaacgtgacagggataataatcctttttttccccaaacagaataagtcactccttcagcttcccattactctattacaagcacacataatacttggaacagttaacagtcacagagccctaattaagtgtgtattgtatatatttttttccctcacttaatcagtttaaatcaggaa

SEQ ID NO: 56077 - DNA, 2631 bp, Bovine  19866880446305
aataatagtaatatgggctaataaatatttggggctttgtgacaagttttctgtcacagctaactccactttgccattgtatcatgaacacagtcatagacaatactggacaaattggtgtggctacattccaataaagctttgttgacggacatcgaaatttgaatttcttattattttcacatgaaatacaagatattcttcttttgcttttttttcaactatttaaaaatgtaaaacctattcttaatgcaagtcatataaaagcaggtggtggactggatttaacaatcaggcagttgtccaatccctagcttacagtagaacaaaaaaaagtttctgtgctaagaacttgagtaggaagtttaaaatcacagagtaatgcagaagacctaatggggaagaaagggaaagagtgaagaggatgggaattcataaaaagcttttaaaaagtaaatgtcttatgcaaaaaagtaagtcagaagaaaagggttagtcaagtaggaatctaacatgagatatactcctgattccttagtttaccttccggccactagaatgcaactggttgattcattcaacaaatattaatttagcactaatatgggcaactactgaggctttctgcctagaacttgaaactataaaagaatagtttttaatttattctctaaaatgatattaagaaatgctgctgctgctgcttctaagtcgtttcaatcgtgtcctactctgcgcgaccccacagacagcagcccactagactcctctgtccctgggattctccagacaagaatacctaagtgggttgccatttccttctccaatacctgaaagtgaaaagtgaaagtgaaggtgctcagtcgtgtccaactcttagcaacccccatgggacccgtagcctaccaggcttctccatccctgggattctccaggcaagaatactggcatgggttgccatttccttttccataagaaatgctaagagtggttatttacttattttagttaacagctaataagttttggtatgttctggctttattttcgttcatctctaaggattttctaatttctcttgtgatttcttggactcattggttacttagaaatgtgtggtttaattccttataattgtgcatttcccaaatttctttctgttattgattgctgatttcactccactgtagttgaagaatatactttaccttatttctgtccttttaaatgtattgagatttgcttaatgctgtggcacatggtctatcctggagaatgttccatgtttatttgaatgtatattctgctggtggtggggggagtgttctacaggtgtcaggtctagttggcttacagttaattcagaccctctatttccatgttaatcttctgcctagttgttctagctattattagaagtggattactgaagttttcaaatattattgctgaattgtctctcttttcagttgtgtcagttttgcttcgtatatttcagtgccttattgttaggtacataaatatttacagtattcacttattttttacagtcttgatctaaaaaggatttaagtggttatggtatagcaagaactcatagattagagtagatgagaaagaaaaagcaagacaagagtagcaacatgaaatagaatttgccttcttgttctctgatgtctctgtgtgaacagagcctgatgcatagtaggcccttgtaggattgaaataacatcaagaacgaggatgtcccaaaaatgaagtaatacacattttataggtgaaccattaatttggcatccaattatagtgaagatttcattgcttatacaattgatagtaaacctgagataaacaaacaaaagatattgaaaccaatggaaaaattctcccaagagccttcactaatatttaattacaaagatgctaaactggtctacccctctgtcctgaacagaatatatgctttaagtttggggaatcctccctgctatgaatgatgctacagctggtcccatgtatttactgtcatactcgactgtgcaaattgtgcactgccccacttcaggaatggccatcccattgtattctatgcaattgacaccctcaccctgcatttgggcaatatacagtctgtgcaaccataggaggtgaccccacaaaatctttgagtgatccctcccctggcaaatggctcacaatttatttaggggcattgtgggtggcaaaggaatgaggaacagcaaagcgtccacaaggaaatcaagtgactgatcctcatcttacagtgtaccaatgaattgcatgaactagttccttgaagaagagaataaggtgattagggaaatgcttaaatctctaaccctcaggctgattgggagggtaagaaaagggcttctcacatttcccaggctagttgtttccttactgtgtttagggagtatcataagaaacaccattacacaaggggaatactaaagctcatatttatgcctgtggtgtgtcaggggagaaacagtgtgtgctaattatgacaaaaaagagaagcgacctgcggcggcgggggagggggggtggccctctggaagacactgatgttggtttaaactcagcagcagcttgtgggcgtgcatg

SEQ ID NO: 56078 - DNA, 895 bp, Bovine  19866880452744
ctttaagaaagaagaagctgaagttggaaatatttgactttttgtatgttgatacatggtttaaataacgttgttgttgttcagtcactaagttgtgtctgactctttgtgaccccatggactatatatatagcccaccaggctcctctgtcctctacaatctcccaaagtttgacacccctgaaaatgtgtcattacttttactttcttttctctttcctccctctctcccttttctcccttcctttctccttgtgttgagagttcagttcagttactcagttgtgtccaactctttgtgaccccatggactgcagcacaccaggcttccctgtgcatcaccaactcctggttctattaattctgattctgaatttacaggtttgaatatagccagcttgtctttcatatatttgtctgtctaaatatgtcagtggacaattaacaaaaatttagaaaccacttatcttcatttggagagggaattagagaaatgtacttacctttgagagcataagatcatttggtttcagggccagctcatcttgaccctaggaaaggaggggatggaattcaggctctccatgactcaaaccctcgctatctgtctccattcttagtaacagatggggaaggggagcggtaatgggtgcctgtttctgagagctgttggttttctccctgattatacagggctgtgaaatgtgaaagacatcagggactctgagcaccattcccctaaatgccccaatgcctgcagggaaccagccaaaggctggggttggcttcagatggctggacaggtggccttgtaattaaaacctttcccttctaactgtaggccttgttttgccaggaatctgaggtgaagagaatgttctagttagatgcctgt

SEQ ID NO: 56079 - DNA, 1175 bp, Bovine  19866880529402
caataaataaaaggcagtaaaagtatccatgacttgctaataaaacttgatatgtttttaatgacaatttttagtatactgtttttggatggatctggcactatttgaaaataagcacccaacaaggacacaattgagattggcaccaaaagtaaaaacacaataatttgtcctaggtacagtgtgtatactcagagaatttaaatgtctccccctaaaagatcaaattgcactttaaaatggtcaacatacttcaaccagtgagcaacttgtataaaaatgccaccataaaacacattagtctttttttttttccttaaactacagcctaatgaatttagttcatcacacgcttacataaatcctacagtggagggggggaaagagtctttgaaatttcaaacattttcttctccctttctttctcttttaaagaaaatctctcaagaaggtatccaaccacttcttggagacataatcatatgtaaaaaaaaaaaaaaaaactcaaataagagagaaatttttaaaaaaaattttagtcactctttaactttattcttcaatttagaccaatcctcttttatagggggctcccagcaattagttggcaatcttatcctgtgagtttgaaggattaaagcagaagcaaagaacaaaaggaatggatttgctacactcttctgcaggtctcctctcttaacaaatcagacttcatttcctccagggccctccctacccacctaatcttttctttctttcttcctcccatggtcctttaggaaaaggagtcttaaaggtaacatcatggaatgccatcttaactaaaatccttcagaatatgcaaaggttgaaaatgaatttggaaactagagtgtgcttttttgagtcctcattttgggattctgacaaagtacaattttttgattactggatcttaaactgtagcagcaggtaaaaagccacccaacttaggtttcccagaagtttgaacacactcccttccttcttgcaggctatttaggacagtgttcacagaaggtcacgacattaaagacagcatagcctgggaacagcagacgtgacatctgtcgaacttactcttccatctgtcacggacatgggccacaaaaaaactactagagttctcagggacttcaggggcctgctaatccatt

SEQ ID NO: 56080 - DNA, 1338 bp, Bovine  19866880544082
atttttatgcagtcaaagatgcagcagagagccaactttgtaagtcccaagttcaataggatttcttttccttgtatgggatgtttttgatactgtattttagggtaccacattaaattgattagcctttcaaaataatggaacagaagatccaattgttttattatttaaaagcacaaattacaaaaacaaaaccaataatttataaagctgtttttgtaggctaagtacttcatttctagttaatcctcacaacatccctcttgagttgatactcaccgtattttacaggggagtggtggggcttacagagattaagtcacttgcccatgtcattcggcctaggcagcctgactctagatccatcacactaagcctcattttgtgaaagagaaaacacacaactgttattgaacacttttcagtttcagttcactatctcagaaaatcatatcgtctgtcacatttatgtctgtgtttcagattttattggcattgcagttctttttaaaatttctttataaataagtcacatatggtttcccagggtgtcacagtagtaaagaatccacctgccaattgaggagactcaagagacgtggattcgatccctgggtcggggagatcccctagagtaggaaatggcagctcaactccaatgtttttgcctggaaaattccacggacagaggaacctggcgggctacaggctatgggttgcaaagaatgggacacaactgagcatgcacgcatgctaaacacatatacttatttataaatttggtttagtagtcatgtaagaactataagcataagagtttatacctagttttatatatttgtgcatatttaagtaattttataataaaaatggcttaagtcaacactggcagtccacagtattaagtcattaacaccctcaacacattaacactgtttactttaaataaaatcccttaatagcctaagagactggacatattttgatggactgggagtgaatgctcataacacaaggtgctgtgtagaaatgactctgccactggttatgaggtaccagtagggagcaggttggtatttttttctttcagcactttgaagaccagattctactcttctctgccacttctgtgctgaaaagtctgctgccagtctaaaagccactttatgggtaatggctctttcctccctctgtttttgagatattctctatggcattctccatattcacagctagatgtggatatagttttctttatatgtatcctaaatctttggatgcacatctttcatcaaaactggaaaattctcagtgaaaatctctccggataccctcagt

SEQ ID NO: 56081 - DNA, 4473 bp, Bovine  19866880632048
caaagcatcagcagaactgggggtgggggaatggtatgaaaaaaaccatctgtaatgcaccagagtgaagatgacttgcaaagatcacaagcaggaaacggtgacaatcctagaagactcagccacctgacggggccaggtggggtcactctgggtgacatcaatgcagcactgcttcacacagacttctgactaacatgtctcagaagtctctggcactgaaaatgctttattttattcataatgagttattcatgacaactgctgagtctaccgagccagctgtgctttcctatcaccaaggtgccttgatagtatggcaatctatctattatctatctatctacagtttttaaattctccaggcaaagagacttttgctttgtccaattctaattctgccagggaggtatttgggattctgccagtgatttggggtggttggttcaggtaaaactgaaactaaccttattttaccacttgctaactgtgtgtcctggggcatgtcacctaactatcctaagcctatgaaatggagataataatacccaacccatcagttcagttcagttcagttactcagtcgtgtccgactctttgcaaccccgtggactgcagcacaccaggcttccctgtccatcaccaactcccggagctttctcaaacttatatccatcgaatcagtgatgccatccaaccatcccatcctctgttgtcctcttctcctcctgccttcagtctttcccagcatcagggtcttttccaatgagctagttcttcacatcaggtggccaaagtattggagcttcagcttcagtccttccaatgaatattcaggactgatttcctttaggatggactggtttgatctccttgcagtccaagggactctcaagagtcttctccaacaccacagttcaaaagaatcaattcttcggcactcagcattctttatggtccaactctcacatcctcacatgactactagaaaaaccatagctttgactagaggttgttggaatgatcaactgggatgatttatatctataggaaaacacatggtctgctcccactcatgtatttaaacacacatctaatatgtgaatctgcaaagagagatgtctgggaagatgtttaccaaaatgctaatcttggtttcttctggggttgagatttctttttctttctttttaacatttatttatttggttgcaccagattttagctgcggcatgtgggatctttagtagcagcatgtgggatctagttccctgaccagagatcaaaccccagcaccctacattgggagtgtggagtcttagccacttgaccaacagggaagtcctgggatgggatttcttaagatttttttccccttatttttctccatactgcttgggccgctttgttttggggatttaaggggcttttttggtgtgtgttactttgttttttacaacgattaagaatatttattaaaaaacatatctcataaaatgagataatgcatttaaaaatcacatacagtaagtgcttctgctgctcctgctaagtcactttagtcgtgtctgactctgtgtgaccccatagacggcaacgcaccaggctcccctgtctctgggattctccaggcaagaacactggagtgggttgccatttccttctccaatgcgtgaaagtgaagtcactcagtcatgtccgactcttcgagaccccatggactgcagcctaccaggctcctccgtccatgggattctccaggcgagagtactggagtggggtgccgtcgccttctccgacagtaagtgcttaatcaatgataaatgttttactgtgaaaatctatcttgaaaagatagctttttcaattccagaaaaatcacaatttaactatatttaaatctcagaaagcctaatttttaggaaattaggaattagtcagtgctgggtttaaatcttagttctatgtctgtttttcctcctttcaatctttttagatgatatatcttaagcaaaacactttgccacttataaccttggtttctccatctgtgaaataaaatgcttttcccctaatccaatcacccaaaattctacacaaacttcagaacattttgtgtttccatttaccttgaacacacagaatacctagagtaagtgtgactgtcactcttcagagcctataataatagaaccttgccatgccaacacagctaattcactacataatatctacttccctttctgtttaccaacagaacttggattttatccagggcagcaatgcgcccagttaaaaatgctcacctcagacttcactggtggtctagtggttgagagtccatctgccaatgcaagggacatgggttcaatccctggtccaggaatattccacatgctgtgggaactacggcaaagcaccactactactgaaacccgtgtgccctagagcccgtgctctgcaacaagagaagcgacctcaatgagaagcccatgcatggcaactagagagtagcccccactcattgaaaccagagaaagcctgtgcacagcaatgaagacccagcacagccaaaaaaactcacttctcagatttccttgcagttaggggtagccatgtgacccagtttgaccgaagagatataagcagtactcttatgtttcttgtatattacaaggaacttctaagaaaatttgcatatacctgatcaaaagggagatactcatctgatatacattctctgcccttgaatattccctctgttcccacctaaagcatggaaatgacatttagaggagcagtagccatctttccagctacaagagccacacattaagaatgacagagccagaaagcagaaaaaaccagatccttgctgacttcatagagatgctgtcctaaccctggacctcatactctaaatttcatgttgcattagaaaaacaaatctttagtgggttaggccaccattgttgggatttaggtatatgcaaccaaatgtagtctcaagtaaatatactatcttatggggttactatgagaagtcagacaagatactgtttgtcaagtactcagcccagtgcctgaaacatgggcataacttaatattatttgacaagttccaatcttcttcctaaagagagggaactggaaatctttcagagagcatgaattcataacagaaagctaagaactttatttgttcatctgtaaagttcttagtgggcttccctggtggctcagtggtaaagaatccacctgccaagcaggagatgaaagttcagtctctgggttgggaatatcccctggagaaggaaatggcaaccgactcccatcttcttgtctgagaaatcccatggagagaggagcctggcgtcgcaaaagagacagacatgttagcgactaaaacaaagctcttagaatgatgcctggcacgtaagaagcactttataaatatttgatcaaaaaatacaatcctaaaaaatgaatactgaacgcctgcaatgtaccaggcactgttctagacacttggaaatacagacatgaagacaacgttcctgctgttaaggtatcttcattttagaaggagcagcaggagaggaacaatatagaagaaatggtcatgaaaataaagaggatgatgcgctagagctaccagatctcctcaggtggcgtatacagggaaggcctcttgcaggtggtgaccttggaagtaaaatctgatgtgtaaggagccaactctttggagatctgggaggggtgggatgggaaacattgctgatagagggaggtttatcaaaagaaagctctgaggtagttagttatgagtctggcactatggagaaaaagtcaaatgaacttatctatgaaacagattcaggctcacatagagaacagacaagtggctgcgaaggagagagggagggatggagctgaagactggttattagcagatacaaacgattatacatagaatgggtagactacaagatcttactgtatggtacagggaattatattcaatatcctgggataaaccataacagaaaaataacattaagaaaaaaatgtacatatgtataactgacccactctgctgtagagcagtaattaacataacactgtaaatcaactacattgcaataaaaaacaataaaattaaattttaagaaaaagtagattgaagtataacttattcagattcttttggtagtcagaagcctactgagttagaaggagtgaaaaaagttgacatttatgctaagaatccaggatgacaggacccaaggatgaacatccagctggaccaaatctgtactgcatccagagacttaaacactagtaggactccccatgcttcatctacctctctaacatggacatgtgtttcattcttatcttcctcctggaagatcagctccatctgatcttatgaaccatagggcagaaaaccatgaccaatcatgttagatg

SEQ ID NO: 56082 - DNA, 1814 bp, Bovine  19866880756345
taagcagagtaggtgatagtgtcaggaagaaaaagcaagcaagtggcaatctggatatctgcctgcaaataaaagagatgactgccgtcttctccactggctcccgtcttgccctataaatctcagttcactaatccaagtgttttcatatcactgtataatacagcgtgctgtgtcgggccccgtcatagggaaattaaaaccaaggaaggggctggagggattcaggctaccccattcttccatttctcttgtttacactaatctgacggtgtttttccatcttctgccataaacacaacacgggatgttttcagcatcaaacagattaccttcttccacccataaaatggaacttcagaccctgagctcaacccccagaaccatgcaactcagaggccaggagctaccctggctattgttgacacttactccctacaaaatctaagaaccaggtcatggagagttccctggtggtccagtggttaggactcttggcactttcactgccatggcccaggttcaatccctggtataagaaccaagattttgcatgcacagagaagggggaaaaaaaaaattttttttttaaaaagcaggtcataaaggaagtaccagatccataagaagagtccctgagtgggaggcaacatgatggttaagaggagcattttaatttcatctccactacctactagctgcatggtattggacaaatcacttaacctctctgaaccttggcttcctctctgaacctcagcttcttcaaataaaattcagcgataacagaattaaatgtagaacataaggcacttagcacagtacctaacacactctaagtgctatgaaacctactcccaactcccagccttcactgcgctgttcctactgctaaagcaaacttccaaaaagctgcatagctcagcccttcccctcatctcaaaccttaaacatcaccttatcaacgagccttccctcactaccttaaataaaataaaatactactcccccatctcatacacacaccctgcatcccctcttcatcttggtccacagcacaaaacactacttgacattttacatacacacacacacacagtttgaacaatgtgggtttgaattgtgcagatccatttatacacaaatttttcattatagtatctgtatttttcttttagagacctttaactaagtgtggggcaagtttgtgttcaattagagatcataacatatggaattcaaagaactagggtttgagtcctgattctatccaaactgtttcaggttcttgtgcttggatgagtcatttatcaaactgtttttgaggcaaagatagtagtatgtgggttttctactgagtgggggtaagggctcctaacccctgggtaaagggtcaaatgtacatgtatttcttttaaatatatataaataagtgtatataattttttgtatcctaaaagataaactccaagaagccagagctttggttctgttaactgctgtatctgcagcacctataaaagaggttcttggcatacagtgggcatttaataaatattaactgaatgaataaacagaagttgtttttctgatgacgatgacgagaagggccacaagagaccatacaggccagagttcttcacagggtaggaaactgaagctgagagacaccagatgacctgccctctggttctagcctccctagaactgtgtggtggtggaggctgggagccctgactcctggtgccttgctctgcctcgagccagcctgctcagaccaacgactcagcttcttggtacccagtgctcctcat

SEQ ID NO: 56083 - DNA, 1588 bp, Bovine  19866880777316
ggtacagcccgcgcagctgaaccgctgcagcagtcgccgccgccctccattcataaaggaaaaaaaaaaaaagcaacaacaacctccacccctctttgtaaaagagcgacggcccctggaggagcgagagccaaccccagcaatcacgggttaagtccttttccggccccccattcataaaaaaaggaacgcggcgcatgcgcgcgcggggtctcttgtgcccacccattcatagaatcgcgagcggcgcgcgtgcgcactggagctcccttccctcccattcataaaaaagccattttcccaggcagtggttgcaacatcgccgcggaggcagtgagagaagctgacagcgcggagctggcgctgcggagcgcagggagccgagccggttcctccggccggcgtctgcgaggatagcggcgtccgatccgctcgggttcgggggtttacacagacgtggagcaatgcttgtgactctgcggctcctcaaagtaagtcctcgaccggtttcgggatgtgaagctacccttctctgagtcgcaacgcgactccccctcgggctggggcagatgctgcgctatttctatacgcgcctcaatgttctttccctctccctgcgcctcctggagcagctgcggtgcgccgcagctccctgacgccctcggctgggccagttaggcgccgggggtgctcacagcctggcaccggcgtttccgacccccgggcattgccaagccgggctttcccactctaccactcagaagcaccgtgcgtgtcccgggagtttgcttctggcctggcccctttccgcctaccactacccacctcgggtgctggaacaggcgattttgggctccgtgaggagccacctcttgggtccggcgggcgccttcaccctgggcggctcgcccaccctgggctctctgcccacggtgccagtctgccgtagatctccccagcccgccgcagaggcctatgctcgacgtaggttttagtttacccttcggagccgtgatggactaggtttctttccttctgcctacccctcgatggtcagcgcagggctggcccgggactgggcatttctgctctctctttggtgaggcggttcctcgccgtctgacctttgctctgctgccgcattttatgctgtgcaactgccttgcagttgccttcctttccccggcctctgcaggggccaaggctcctcggcctcctcgtgtccccctatactctggcaccgaattgtgccaggccccgaggctcccggccgctctggggctgtggtgggggctgaaggtgcgtttacataacgccaggcgtgtgggagctggaggaagaggttgcgtgcgtaggagagataagtctcccgccttccctccttccttcttggtggtaccaggcttgacatcaccgagaagaaagaaggacagagacggtacgttatgaaaattctgaatcgccaaggcttgggaggcaatgaaggggggtaagggcaggtttggccagccaggacagctggagcttggctccatcactggggccaaggctagggccagggctgtgcccagtttcccctccctgcaga

SEQ ID NO: 56084 - DNA, 877 bp, Bovine  19866880819777
caaagcgaagagaaagcagaccccctttggagagatacatttattatctttgggtaggctgagctgaagtatagctgagcaaccagtattttgacatttatctgttttcctaatgctttatgggttctatctaaaacccatctaatgaccttcctaccaaggctgaacaatttgctgatggagctgcaggttgctgtgggccttttgtgtgtgtgtgtttgagtggctttaatttcatttctggaataaaggaagtgcaaagacattaactctgaatccatcagagaaagaactctgtaattgcaacttggcagcaaaatgtgcttgtgctgtgtgcactctaaaagccagtgatgattaatcctgcacatttatctgagttcaagagcagacacgcaatcatgacaaccgcagaaggcaagagaagattgtgcttgatcattatagccttgggcctgccggatggacatgggtagcagcatccaccagatctcagccaagaaatctggacctgcatgtccacctgtgctagccaccagccaggtgtggctgtttagcacttgtggctgatgtgaattgagacgtgcctcaattgtaaaataggccctggattcaaagacttagtatgttaaaaagaatgtaaatatctttgtattatgtatgttaaagtaatcatatttgggggtgtgttggattaagtcattatattatttaaattaatctcatccgcttctttgtacttctttaatgtgtctgctagaaaatgttacatagcctgtgtggtttacctttgtgtctgatactgtatttgtcttgggcactgctgctctacaggttaggcagacgcctcttgggtttgtccctggctcacagtgat

SEQ ID NO: 56085 - DNA, 1683 bp, Bovine  19866880872713
catgttttcatggatctaacaaggaaaattcgatggggcacattaccctgcagtaactggcttcttaaagacctatcatcaaatagcaaccccacagaaagaaaatagaaaccaaagagaaagagaagagagacagaatagattattttcggtctccagattctgtaagaacatgactgattacaataaccattcagaattgatctccctcctttctctagaaggcatggagacctgccttgctgacaaccaagatagttctcactgctatggagaggggactgtagcagatactggagaaaggaaagaggagggggttcaggaagctactgcctggctggggaacgtggtatagaaacaaatcatgagaaggtcacacgggacagcactgacagaaacatgtgcaggggccacagaggcccgggtgggaggaaaggctcttcccaacggagatggagaaagcttacccgaggaggtgctgtgcaagagatgggcaggtgtctaccaggtggcaaagtgggaaaggaaagcaagaccatggagtctcacctcgtccttggatcaggcagtggagagtcagcctgtaacaagtcacacagtcaaaggcaaccctgaaaagcctgcagggagatggatataccatctctcggaaatctttgggaggggttcaggcagctatgtcataggaatgttgtgagtaagcaagcactctcgtcacactggcaaggcgcccccaggacaatgtgggtaacagcagagccgtgccaccctttctcccctgggatcacacacgcgtggagaagacaggcaggcagatcgcccatgctattcatctttctctttctgtctctctccccacccccaaatctctctctcctgggcgagtaaagttgatttcctttaagtaaactaggcctgtgtcatgccgctttcctgccaaatacaggatatcagcttggtattaccaaactctgctattaagaatgggacttccctaagcctgggtttctacatccctaatacaaggagaacataaaaaccttcttcataaagttaaggattaaagaactcacctgtgcagactacatagggctctgcttggtacagagtaggtggttaacagctgtgcactgcaattattattaactgcaatcagagaaaagacagcatgtgttcagacacagacgtgcaaaggagaatggtatgtttaaaggatggtgtacagcaagactaacaagaggtaaggctggtaaggtaggctctaaggaatttgttaaagttctttattgcaggactaagttcagtctccacctgtcggcaagaaggaagcatcagagtctttacacaggtaagtcataactctacatttaaactgagatagctctggttataatacggaagagaagatgggaaaacaagccaggaagctactataagagcttggccttgagataatgagaaccagaattgatggtggtggtggtagtgctgatgatcggctgtcttagtgtgggttccaccaaggttgggagcagatcccaagaaccacaagtaagggaaggaaagtaaaagaggaaggggaggaaggtcaacaacggcgcatcactgatcacatctgctgtggaacagagggtgggggtgggggactcggtttcccctgggagcctctcaaggattacggag

SEQ ID NO: 56086 - DNA, 4670 bp, Bovine  19866880897864
aaactgaggaatgctactctgcatcctaagaccacaacaaatcttcaaaattgaaaactccactcttagcatatgattacttacaaaaactatgaaataacccaacagcaaatacaggctcacatggaatcagccttgtgttgagccaatatgtgactgggtttaaagggctgctctgtgagttccactgcaaatgagcttagtgctcaagatatttgagaatgctctcagcttgacttttcagccttaatcctcaacactcctttatgttacaaactgcttcttttgagccagctgcatacttccctacctctcttcctcttcaacactgcctcaggtgactctaaaaggcttccccacccaacgttttccgtattatactttctaggtttatctcaaggtttatctcaactgttacaaccttcacaaatccttgcctatgtctcaactagcctggctctacctgtcctcaacagtcttaaggaacaaagaatcagttccaaggaggcccatcagaccttgttactagagacctctctctggtgtactctttctcaagattccctgtctcctcctttttgcagctggtgatgcaagatggagccagcctctggggaaacccatgggggaaccaaacagccttggcaaggcttagtcctcctgttctaggcagggaaaaggcccttttctccccttcctttctttccttgggtttgaccctcccatcagaatggtaacatcaggatgtgaacctgaagaaaatgcccaggaaagtccctcattgattttaggagatggaagccttggtaggcttgtcagtagccaaaaggagttcctcaagtactgtggactctcccagctctggatttaggggccccaccaaacagagcttagtgattaggcctgaaaggttccttctcactacttacctctggaactagtacaacccaaacagtggcttcaggattcatgattcaaagattaaggaccctgagtcctagtcaaatctcttctgcattgtccaaacatgagataatgtctcctctggtagtttttataacttgccttttaagatagttttttcatagaaacactccttactaaactagaaactaaaaggcaaagactatgccttccttactgtctctatatcccctaccacaggttgttaatattctactctaaatgtgaacagtaatctacccatgcatcacatgattacactgggactggaataaagtttttttctttaatacctttaataaataaagagaactctggtcctggggagatttgagaaattttctggcatcttccgaacttttgcataattgataaatcctctgagaaacaggagaaagcctaatttaaaaaagaaaagtcaagaatgagtttataattcgcatattaagcccagtccccagaaatatccctcctgataccaaatacttcatttttctgttatcagaaaagctatcaaaacataatttcctctaaaaatttcaaaggatttgattttacaccaagttttctatttctcaatgagaacatacaatctcaagagccaaaaaaaagtctcttttgcgcattcagaatctaatttgtgtaaaagaaaacaaaaaataagatggggccaaacatttacatcatttacttttggaagtctcactgagaagcatcatcaaaacctactctccctacccaccccaggatcttagttcctcaaccagggaccaagcctaagcagtgaaagtgcagagtcctaaccaatggacagccaggagtgccaaaaccttctgagctcccaaaaagtattccaagataattaacacgaaaaacagagaggttataaacagtgtttttctcaaataaaaaaatgtcatcctttcttgttatggcttctttttttttctgtcaacagtacacaatgctgtccactagatgtcaggctgtccttacctttacaagaattctgtctcaactctaaattctatttctctattcttaatttaggagtcagcagggaagatgatgagctccctccagtggtagctcacacactgctggccctcctcctccagagatggcccctggtcttaagacacatttttttcaaatggctttacagagctataatttacatatcacaaagcttacccatttaatgtgtacaattcactggctttttagtagttaaaactataatccaattttcagaattctttatcgtccctaaaattatctgtacccattaggtagccactccccatttcctaccctcctcccatctcaccggctctgagcaataactttcttttggatatattttaaaatatactcaagcagtggaagatgctttgcactcagtcagaaatgatttctggcagcaaccaagagtcatcagcactgagcacagtgaaaactaccctgtttggcatcaaaatcatcgacaatacaacctaactccagtcaaaggatgggtgccatgtgggaatataggtcagttttgctagatatttcaattttaaaaaggtaaaaaaattcagatattttatgtgaaagttcttggtttttatatgatgtgtgtgttaagtgtgtgtgttaaatcactccagtcttgcctaactctgcaaccctatgcactgcagcccatcaggctcctctgtgcatgggattttctaggcaagaatactagagtgggttgccatgccctcctccaggagattttcctgaccagggatcgaacccacatctcatgtcttctgcattgacaggcaggttttttttaccacttgtgccaccagggaagcccttttataatgataactaaaaaaataacttctgaaagtaactacggaacatacaagtcacaactacaggctagatgtagcttatgagctaccagctcatagacctggtctttgcaggaaaccatccccccttaaaaaaaaaaccaaaaacagtaacaacaacaacaacaaaagattctctctgcaaggagttccaaaaatgactcaaacattggatccaaatgtatgaagtacatctgaagtctcaccattttctgcttaccactaagcagtaagacagcaagaatgatcaattacaaagtactataaactcatctcccatgaaactttaatataggaaggaaataagcctattagatttttttaaattatctatgttgtcaacaatcaacctaaaattatgcttaatggctcttctttggcttattcaggatttgcttagactttaggcttgggagaagatgaggagtcagactttctcttaaagatacagtctggagaataagcaagtcaaggaactacttctctaaagtgactcccctgtaggttgtttttttaaattattaagtttctcagtaatcaagacaagaagtaaaaatcactatgtctctttccttggaatgctgtgactaagagtagaataaaatgatgctactggggaggtaggggatggcatcatgaatgacttgtattctctaagtaaaatttagagtcatcagtgcatgactctgttacccaaggcaaagcaggtaggccctgaatatatgaagcagcttttggtcatgggctctacactgtgctagccagacccattagcaaccctgggaaccaaagatccaaactgaggagataacaaaaagacctgagacagaagaaatgttaggataggagaaaatgacgccacagaagcagagtgagacaattataccacccttaacagccacaagatgccccttctattttcttgtagaatgatagcaatgatgatggtctgctattgtatcatacaaattttctctacaaagaatgaggaagccaacagtattcaccacactgctcatttctttaagatgtcttggaaaaaagttacactaataagtacaatcttaagaccaactacctgaaatggccggtatgtttaaaaaaaaaaaaaaaatcttattctcatcaagagcaaactaaagaattctggacagccaatggtggttcttccagaagttatgcaagacaatatattttctgttttctactgatatattcaactgaagataggccacatacactcatgagtagttcagtaggtaacagtatacctataagcagtttggggttgagcttgtgaaccctttgaggcaataactcacaaggcgggaaaaaatctaaggactataaaaagtcatcttattggtacacccctctggctacatggaaaatgtgacaagtgtgtatggatgggttaggaaaaatttatcaccactaagagacattctataaatatgtatgttactctgatggtgataacagcctaacctttgacatatttttaaaattatacttattatcactaatatattactgtatagtagtaagtgagatgaaggtttactaaaagtaattttacttctaaaatttaacataatcttttctctcctttgtcttttttaaaagcacttacctagaaccaggaacacccaccagagccagtactgaccatcaaaatatccagggaagtaagtggaaaactgaaaaataaagcaaaatactttagagaacctctgcagatattatttcacattttagcttaagagtttacaaaacacaagattttaccttgtacacaaatgctgttgctcatttagt

SEQ ID NO: 56087 - DNA, 853 bp, Bovine  19866880931054
acaggtgaaatgaagcttaaagaacttaagttcttgaataaatcaaagtgaattgagctgataaagaaggtcatggtagatgttgaatttgagatgtttccaattttagattttttgttcttctgtggatctaccacatgttcatttgatgttgatgttgcttggcttgtcaagttcaacttccaccattagatagataggcttatgttgattaaaactttttttaatcatttaattttttaaatatttccacgttcatctattttgagatgcagaggccgccttcatagaagagggtgtattttcagaaccaaaatgttcctggttcatagatggaaccaagtaggtcagtattttatgatgccttttgacttccaaattcaatcccagctggacaagtcagcagggagtgccacttcctgaaatgtgtccttatgctgattgttaataaagaaggagcagtggcaggaggtgtgtgttccaggtcagagaggttggggaaatggctcagcagagggaaccaggcttcttaacccctggacctctcagctcttgcactgcacgcactattgtattaattccaggagggaccatcataaatagtagtattagtcaaacggatttttttaaattgaagtatagtcgctgtgtagtattctatgttacagatgcatgatacagtcattcacagtttttaaaggttatcctccatttagagttattataaaatattgactttattccttgtattgtcctctatatccttatagttattttatacatagtagtttgtaaatcttttcccctagtccctgtaacgccccttccccctcccctctcctcacggaaacca

SEQ ID NO: 56088 - DNA, 897 bp, Bovine  19866881158404
cgagaggaggtaaaggctaccttcacgccactgcggacctgggttggaaccgtccgtgttgctgggggcggggtggtggtggggaaacactgcgacctcaggatcctgggctaagagctgggtgggggaggacacacctagatccagggatttctacccgccgcagtcagagggcggggaacgggaggacccctgctaggggccttctctttctctagagtaggggcgtcgggggggaagggtcttgaagctgtgtttaccaaaaattttaagaaaatgtcaaaggtccatatcaaagaagggcggagttgggggttactgagtgaatctggttcccttcctgaggctgagtctcccttgaataagtgcagagcacccctcccccacctcttgggtgtggacaggactgggccgagccttttccggccctagtaccccccggagtggactggctactcagctagagatctggctctcgcctggcagcgccccacttcctcccaccccagtgtaatgtccgcagtgctccggcgtccgcccgtcctctgctgccccggctagtgctcccctccactcccgcgtgtttcgcaaccctcacgggacgcaggcctaaaggccacagcctttgctgctgtaggcgcctctctccaaccgccctgactagtgcccctcgggagaagcaggagcggtgcagaactggccaggtggatgggtggagccgtctgcgccaaagatgctgctggggtggccgcgggattaaataacaacagggctcttgagccgcagaggaaatggaaatggccgggatcttttctttgcagttaatgatggggcgggtggggcgagggggggaggtgggaagagcctcagcctcggcgggtaaaagaaaagcccccg

SEQ ID NO: 56089 - DNA, 1562 bp, Bovine  19866881325670
ttaattgtgtgaaaagttaaggtaatagaattgtgagcaaaagcctttgttgacaaataaagcctttggaaatagctgcccattccatttgagttaagtgataaagcagtagaaaccagattgatgagtattaagcagaaaagttggtagaaaggacttttcctttatctgttggtggtaaattttattcactggcttttttcttatatatgcagaattgaaccattggtctttgcccttaaatcaaaggtgcttttgtttagtttggcaggtcttgttattaaatggtgaatgatgctgacttagtagaaaatcagtgtctgtttcaacctctgtgtcatttgataagtcagcctttaaactgtactactagttgtactagttgcacaaaaatatcaacattaataagttaaaatcaaaggaaaaaggtaagctattattctgtcacatttaagaagtccagcttttctacttggagaattcctgtctgttctttgtctttcatgcatgtgtaatttttacctagttacaacctaaatatattttttgctggcttctgtaatgagtattttaattgagttgtagccatcctaattataagttttaataactaaatattatgtcattaagtggttccacacataattattcccttggacatttaatttgtttgccattgttatatgcttctctttgcatataattttactttggattaattccttatgataaaatccaaggaataacattattgaatggtcaaaggttacgatcatttttaatggtttttaatgagcttaacaagttgtataaaagttaattttccatttcaccttctagagaaattaatggacttacgaaatgagtacctgcaagcagatgaggccaataaaagatttttggaacagaggtatggtaagagggtgattcagaaggcactggaagagatggaaagtaaggagtggctagaaaagaactcaaagagctgcccatgttgtggaactcccattgaggtaaagtttggggacagacttggaggtctccctacttgcaagcatgttatgatttcctcaagaagccttttaattttgaactaattaagaaaacatatattggtatttattaaaccttcttggaagattcaaatttactactaattattgttattggtattaaatatatgtagatgtcccttttcatacagtgcttccatacagtgatggtttttctcagcttgtatctacctcaaaattgaatgagttatgaggaggccatgttagaactatagtcaactcaactcatctatattatttttttttttaaaaaaggctgacttctcaaaactatttatcctggaatttaacacatctttttaacaagttcctgcttatgaaatacagatataagtcaaaatagataaatctattgcttcttgacaaaaccttaatatgttttaaaatcaaaatacatgtctttgcatttgattctgttgttccaatccattatatctgagctaacctggatgatgatgccccaattactccattaaggaaactggcctt

SEQ ID NO: 56090 - DNA, 2475 bp, Bovine  19866881353052
gtctgtctggggaaacggagcactcaggagaggccaagtagcactttagagaggccagggtttaggccgagaatagaacacctacgttggaaatatggacttggatctcagaaggagggagaaataccaatatgtggtgttagctgtcagagctggaaggaactttatagatccccttgttcaatggctaatttgtatctgactgcaaccccacggactgcagcacgtcaggcttccctgcccttcactatctcccagtttgctcaaattcatgttcattgagtcaatgatgccatccaaccatctcctcctctgccaccccctttctcctcctggcctcaatctttcccagcaccccagggtctcttccagtgagttggctctttgtatcaggtggccaaagtactggcgcttcagatcccctagaccactgtttcttaaaccttagaagtatgtgaatttcacctcagttaaaaaaaagaataaatgacccccaaagtatatcagtaattgaggatcctcttaaaatgtaaattctgagtcagaaggtctggggtcaggcctgcgattctgcatttctaacaagctgtcagggaacactgatgctgctggtccagggaccacactttgaacagcgaaggatcaaaccagtatttacccaagtatgatatgtacatgtctgacggcacatacagagattttaggtgagtcataaacattctattttaagatctacacagattttcacttaccttcgtgatgtgaagcttcccttaaatgcatttcaggattaaaaagttaacttgaagaaaacagtaataaataacaagagaggaggcatgcataagcggtaaaaattaggcagggggcctgcaattactgaagtcttgaggaatgcttgtaggaagcatctgagggtgcttgaacttgtaggaagagaaagaaattccagtttagaatcaacagtggcaatgcaagagggagaagcattgcttgatggagcaaggtgactaacagcgaaggtgactgagcccatgagcccagcactgacctggagcatgccatatactctgcacaacagcccagtgaggtcactgtcagggttatccctggtgtccagatgaggacaccgtgactcagggaggctgtccaatgtcaaacagctagtaagttctagagccaggacttgaatccagggccggaggactcctttctctccatcacaccacagcccaatccagcaggctggctgcttctacaacatgctcctccttccaatgctgctgctgctcattttcttctttaaaaaatgctacatggcatgcagggtcttagtttccagagcaggaaccaaacctgcgttctctgcagtggaagtactagacatgcaagagtcttcaccactgaaccgccaagaagtcccactgctcattttctactgatgcagctcagtgtaaccttgttgcattaatgccagcaagaatgatgtgatttccaattcactgaattctttttagaaatcacggactgtcattcccattttcaagaagacagaccgaggctaacaagggtcacactgacagaactcagaacttaggtctccctgactctagattcaaagctcttccaacaaacctaccccaaaactccacttcttctgggtgtaactgtcgttaaaaagaagacttccttcccctgactggagtggctccctagcatttgccaaacacatgtcctccacattactctctgtcgtggtggacacatgacaccatttaaaccaattcaaactttaacctataatcttggtgtcagttggtggctaatagctgccttgtaactttaatcggtgcaccagatctccggcaggtgcagacaagccacaaagaaacccactttggatctttgcatgctggaaccatccctagattataaaccaaaccacatgcagtatcaggcccttagttctattgagaatgctactaagatttgtttttttaaaccaacctttgttttagctgttacagaaaggaaagatactttaaatagctcttatagagtggctagtaaataattattctaacccaagatctattcatacagcatctcaacccaaacctggaacactgttagttttcgaggagaaggcattctaaaagcaaggatataagtgtgagacaaataacatctactctagattctggccttaattccctctaatttatgttaaatatggtattttaaacaatcactagttttctcttcaaaggacttccatctagaagccagactttctgactttgctttcttgtcaattcctacaactgccccttcccaccccgctttcttttccctgttgtctggttcaatgctactttatccaaatgctttcatctcttgcattctgttcagggcaccatgatgcaagcacaaactcttcctgtctccttcaatccagaccccattcacccagat

SEQ ID NO: 56091 - DNA, 931 bp, Bovine  19866881520633
ttcaagtttgacatgtcagtggcctaatgagtaacagcaggaatttgcttcatcctattttctctttttcaatagcactttcttctctaaaagcaggtggttattcctctgtgttctgcatctcgattcacttcctgcagatgttctcttgtttcttgagagaggaatcataaacgcaggaaggcctctgccagaaaatgtcttcgctaaataaagagaactctgtcctgcagaaatttgagtttttatatcttccaaacttttgcataattaacaaatcctctgagaaacaggagaaaacctaaaaccagaaacacccaccagagacaattctgaccatcaaaatatccagggaaataggtggaaaacctgacaacaaggatctgcttgattagagagaggccaaatcctgaaatggcctcatactttcctgcagttgaagtggccaggaaagcagacaggaaatacccaatctagttttaaagaagaatgccataaaaaagttcacatgaaaatcctgttgttgcctaaactaagttggtcagcattatcgaagtcatcctgacccacaaaatactcatctcttccagaaactgaagggatagtagtttcatgcttgattctcttgccttcatcataactgggtagtgttgttcagttcagtcactcagtcgtgtccaactcattgcgaccccatgaaccgcggcacgccaggcctccccatccatcaccaactcccagagtccactgaaacccatgttcattgagtcgatgatgccatctaaccatctcatcctctgtcgtccccttctccccctgtccccaatctttccgaacatcagggtcttttccaatgagtcagctctttgcatcaggtggccaaagtattggagtttcagcttcagcaacagtccttccaggaatattcagg

SEQ ID NO: 56092 - DNA, 886 bp, Bovine  19866882004152
ggatgtgctcttctgattggctgaaaggctttctgagataattattctttttttcattacccttagacgtttcacctcctcctggaagccttggcccagacagtggaagagaaatggtgattctattggcatactgcccttctccactccatcttcactcccccaccccagtgcatttaatgagttcacttagtgcattattgcatcttatgtaaacactccaggtacttggactttgtttaatcactgtcccttcagagttatcttgtaaagatggactcgtgatgcattacatttttaggtgctttacagcttgcaaatcttaccctcatccgtgatgtcagtgaactggtgccttgtcacttcaaagccctatgtacaacagctttttcagagttaaccaagcagaggcctagaagaggggctgatgaggaaaacgagggctatcaaaaatttaatccccatttaaaaatccccagtatttaaatattgatttgtgaactgtgacccaacagagagaatatagaaaaatagctctacttactgggtgaggtcaacaagcatcctgtgtttccatgtgctttcttattttaattctcaaagccaatttagggaataattttttatctcccattatttccataaggaagctgaagcccagggagtttacatgaagtcctcatagttaatacacagtggacatgtgggcaatggatttctcacccaggcctgtctgtctgcaaagtgagttgctgagcctctcaacagaggaataacagagaaaaaaagtatcactcagataccacctccctaacacactgttggcaatttaggtttatttcctttgtttatctacctaaacaaaactaaattagaaaaacaccaa

SEQ ID NO: 56093 - DNA, 2394 bp, Bovine  19866880463630
atttttcttatagaagttaaatatatttgctatatttatctggcaattgataaatatattttacctcagaactctgtaataaacagaggcttcaccatcatcattataaaaaagctttttggaatatttttttttaattgatgtttatttcctaccagacaaggctgtcagatttgcatttttgatgaaaacttcagttactccaagagccttcaaaacatcttttaaatcaatttcctgttccactgtgaacctggagaacatagagcggaagaagtatttagttacagcatattgttacctgggacaagaataaaatgttagatatgttgattttttaagagtctattttatagaggataaattatgctaaaactggcttttgactgcatgtagcatttggttattattgtaaaaagagggagtattaaaaagaataacataacagaatagtattacattaataaatagggagccatgttggtcttaatatggaatctcttccaaatcaatgcattgtatcaccaatatttccagtgaaaaatatggaccaaatatgactgtattaataaacaaccacagtttttaaaagcaaaggctttttattaattttttttataaaatgtgaaaacagctggttagtactatttccttttaaaaatattgttgccttctaatcaaaacagatcataaatatacaagtttttaggtaatgggctgtgtccttaaaaagctaagtttgtaatagtcactaaacgttatactagcatcatttctgattttctggttttaagaagaatgacaagagaatggttgctataaacaggagtaataatcaggagaaaaccaacagacgagtaaatgtatagcaaacatattaaactaagtactaaatgttgtctatatccaacagtttaacttgcacttaaacattgtttactttgataccacaaaaagcagatagtgactgtgaaaataaaaagtgggatgagtaggaaaatatactgcagaatatattcaatggcttgagtgaaattttaaagtgttttctgtgtatgctttgtcatttatttatttgttcatttacttattggtcacagatggagcttactatacaatagaaacttttccaacagtataaaatagatcaataaaaacagattaatttaaatatcactacagccctttgaggtagctcttattatctgcagttaatattagaggaaactgaagggcagagaaatgaaataacttgattaagttgtgatggtggtggtttagttaataagtcgtatctgactcttttagtcctatggaatgtagactactcagctcctctgtccatggaacttcccaagcaagaatactggtgtgggttgccatttccttctccaggggatcttcctgatccagggatcaaaccaaggtctcctgcattgcagattctttactgctgagccaccaagggagctccaccttggatcatagctaataagtggcagagctgagatatgatccaggtagtatgtatatcctgatctgcctaaaatagggacgtgaaggaaggtgtcagtaaggaatcctttttacttcttaaaaccagcttcatttgtttcacacttctgaggctattcagatgaagatggtatttgatagagattgatttggggcaagttccctaatttctgagcctcgattttgggatgcggaaaatggcaataataatgcctacttcacagtatcattgaggagattaaataaggtttccaaatgtcttaggacagtgctatcatgcaggaggcatgaaataaagggcagatactgttaaagtacatactatattgcagctatgtgtaacattcacactgagtgtttaccaagtcccagtgcagtgcagtgctaagtcgctttagtcatttctgattttttgtgaccctatggactgtagctcaccaggctcttctctctgtggggttttccaggcaagaatactggagtgggttttcatttccttctccagaatatcttccctacttagggatcagatccacatctcttacatctcctccattggcaggagagttttttaccattagcgctagtgccaccatgtcctgggcactgtgcaaattcttttttacttagaatctcatttaatcatccctgtgataatctcacacagtcctatgagataggtattattatctctgttccacagaagaactaactgaagttcaacaacactaagctgctgctaagtcacttcagtcgtgtccaactctgtgcgaccccatagacggtagcccaccaggctcccctgtccctggggattctccaggcaaaaacactggagtgggttgccatttccttctccaacgcatgaaagtgaaaagt

SEQ ID NO: 56094 - DNA, 4066 bp, Bovine  19866880484297
tgggcttctgtgtgggctctggggtgcagggcttcgtagcttcgtgtgtggactcagtagttgctgctctcaggctttagaatgcgggctcagctgttgtggtgcatgggctcaactgctcagtggcatgtgggatcttcctagaccagggatcaaatcagtgttccctgcattgcaaggcagactcaaccactgaccaccaaagaagccctaaaaacataatcttatagctgatcatataaataataatgttctatattagaaaacagaaacagaagaacctgtaattcaattatccagaaatagtcactgtgacttttctttccatttagtcttttttttgaaaagcatgtatatatttccttacaaaataatgtggacatctgtattttttgagttttttcacctgatattgtgagcctttctttcctccatgttataaacattactctaaacaaattgtttagaagttgcatatctttccatcataaggatattattaaatttatttaaccaatgatctttgttggagttttatgatcatgaataacactgttacttcagtggatgactttaagctggttaatcctacattgattaaaaaagcattaaaagagaatctaaataaaccagtagtctcattatgcattttcactaaacattttaaacttggtaaaataaccaaggctttattattcctctttcatactgtcagattttataagtgtgccggtataacagtatgaaggatttttaatctgaagccctcgatatacataatgttttatttctagaaatagctgcaatagattataagttctataggaacagagactgttatctttttgcatccttcttaagtggatgaaataatattagacataattcctgctgcagtgagcatttggtctttacaaaatatcaagtatcttggctaatttacatctgtatttgtagacttgcagatacattgtctatcatacaattgtaatattgatataagcaaagttgctataggtatattcatctgcccatttccacctctcaattgcattactttacccactaatgcttttcttcgttcactcaaactcaaatgacaaaggtgattaaaataacatctttttataaaactgtgagttaaatatgctcttatggtttaactctaccatatctatttgcagctaagcattcactgcttatataataaaacattattgtatgcaataatttaattatatattatattaatatattttataataataaaatgttattagatagtactattaaaggtaaattatactttcctttggagaccttagaatatttttctaggagcaacaaattatgggaaattagtgacatgtacacacttctatatttaaagtaaataaccaataaagacctactttaaagaaattttaatgaaaaaaaaaaaacaataaaaaataaattatggggaattaggaaggaaggaaggagatcagaggccatgaggccatgtatgtcacaggtacagagttcatcaacaaaagaaagagaaagggttacataaggagctaaagaaggcagagtttagtaagctcttaaacttcagtgtgtgcacaagttacctggaagtgtgtggaaaacacggattcccaggccctatgcctgaagcatctgatgtagttagtatgcagtggggccctggaatctgaatttattaaaattattataggcgattctgttgcaggtgatctgagatccctactatgggaaaaactggttgagggggcttggagagaggcaggaaaggaatacatttgaataggaagtgaaacactgggaacagaatgtaagcgtattggcatttatgcaggtgtatgtggaaggaggttgttgataattgtggcagccaccatgaggcaaaataaattgcatttggagtgacaggtggagagttgagatttagagagaactgcaaaactgaagaaactggaggagatgacaggagaataaaaatctaggagtaaactgaaaaggagcatgtgtaaagagtccagctgtctccctccttctctgatctaagcaggcaagtcatgtgctgaggtcatcactcagcaaaatcagccctcatgaagatcccagtggtcattcatgcagaggatagcatcgctctccagagataaggcacattttgcttccattaggccattaacaacacccaatctctcacaagtgactggtcgtaaaaggaatggaacatgatctaggggataggaaccagtgaaaaatcccatcaactcaagccatgaagaaaacagatgtcccttgttcattgccctaaattttgcttaagtgtttttttgtgtgagatggagaacaagtacatttcaaaagcattctaagaatgccccctctttctagattagatcctgaaacacccatcaaaattactgcagttgatcttagttgccccagttgtacattcaggaagagttcccaagaaaagaaaggttagctggtgtgtgataaacagcaatttcccagggctttggttgccagatagagactgacttacctcctcccaattaaatgaagccaaagagcatattgttggcagaattacctgtggcggattcatttcgatatttggcaaaactaacacaatactgtaaagtttaaaaataaaataacattaaaaaaaaaaaaaaagaatagattcttcctgtttgaaaatcctccagcaagttaattcagtcactgctgttaggagttagaaatccgatgaagggacaaagaacaagctcagagatggcaggtgaaagccaacatctctgggctgtcagatattccagatttcagttctcagctgctgagatatatcttcaattaccaagcaggtctgagggtttttttttaataaaaagaatccaatttaatacatctcctcacagtggaagtgacctttggcttctaacttcaaagaaatctttgcaagctgctttaaaaagaaataattgaaagagcagaagatcaatagatatcaaacaaaaaatacagggcagagtttaataactctggtatagctattgcacaaagaaagctaccaaatttggtgtgggggagagggtgtaaataaagacaataaaacctgaggtctcctcagtcaatgagttgactggtccagtttttccagttctataagctttaattccaatcatcctaatcaatgaagaaggtgatttcctagtacaaggatatttaatttgtaaagtagctgggatactaccaccttccggctatgtaatttcctgagtggcaacattacagcttgttatgagagaaatgcctgaaagcgcaggttagattcttggcttccacctgtgtctgatgaaagaactgatgtttttgtcaaaataatgaagcattggcctcttgctcttattgccttccataaatccatctcaaatggactcattatcacccatcagagtccagacagacttgccacaaaaagcaaagtttgttcttgaaccttcaatatcgtttctgtgttcttttcacctttgaaaccgtgcattccagaaaaaatggagtgaggagaagtgggtacaaatggtgccaggtctgactcttagaatacaagatgttagagttgggagcaaattaaaatcaaacccggtggctcggcagtaaagactctgcctgccaatgcagatgtgggattgatccctgggtggagaagatcccctggagaaggaaatgacaacccacttcagtattcttgcctgggaaatcccatggacagaggagcctagtgggctacagtccatggggtctcaaaagagtcagacatgactcagggactaaacaacaaagtttagggtagatttcaggggcctgattggcatcaggagagagtgaagtgtgcctgtggcagcatgataggagtgtcagggtctatgacaataagaaaacctatgttggtctaaaagtattagaaataattttataaattagaaatttataaaatctttataaaatattgtgaacttcaaacataatttctcaccaaatt

SEQ ID NO: 56095 - DNA, 1688 bp, Bovine  19866880506791
tttttttgtttgggtcattttaggtatatttgggggattttcaaacatttgaggaacttcgaatcatcttgttattatgaaatgatagattaattctcctgtgtatagagaatatgttcttcatgacttcagttcttcaagatttgttaagtcttgatttatattccagcatatggtcaattttggtttaaaaaaatctatatttacttgaaatataattatatttatatttttaaatatttatatcaagtatataatttacttgatatacttacagttgccaggtgctatgttttctgtacgtatatatgaatatatgattatgtgtgtatgttagctgctcagtcgtgtctgactctttgtgaccccatagactatacctcactgggctcctctgtttatggaattttccaggcaagaatactagagtgggttgccattcccttctccagagggtcttcccaaaccagggatcgaacccaggtctcccacattgcaggcagattcagatatttcaaatatgtatgacacttacacatttaggaaaaatgtataatgaggtcaagtttattcatcacgcttctcatatctttgtatccttatgaacttttaatgtttgtcaatatatcagttagtgagaggcatagtaaattctctctgatttcacatttgtgttttataatagcaatttttggtttacttattttgaagccctattatgagtggcaaacaagtttagaatttccacatcttccaacagattaaacctttgctattgtaaaatgttcctctttagctccagctacatttttttaattaaaatataggtattagaaaatatggtcctgtctaagacatgcctaagacactttgtccatgccaaaaaattcttgatatttggtcttgtacaaaaactccattagacatcttgtccataagaaaactggttcacaccaaaaggtcccagatacttggccttgtcgaaaaacattttattttctaaattttacttttaaatttttgtgtatttgctaaattgagaaattatattcatgtatctttgtatgtgttattttaatataactaatatctttaaactatagtactatatcattgacttttaatgtaattactcacatatttggattaaatttaccatttattttcttatttttctaaatttccatatattttacattacttttactctctatatccttttaaacttattatttttagtgttttatatgcgctctttattaggttgtcagttaaatattactttattatccttttagtggttactgtagatattacaatatctattattaaagtctaatataaattagtattttaatcacttccctgacaatcctaggaactttaacatctttatgcttttcctgctttttatattatttttattatgtttttgaatttcagatatttagaaggcataaggatttattgtttctattttacatagtcaatagtaatttagctttatacacgtatttgccttttctgatatttatcattgcttcttttacctatatgcttctttttggaataattttcccactgtctgaaaactgcttttagtgtttctcttcctacggatttgctggcaatgctatttttccagattttgttaggaaatgacattttttcacttaatttttaaataa

SEQ ID NO: 56096 - DNA, 916 bp, Bovine  19866880549383
atcctcacattttcttctctatcttctaacttccaagatctctgctcccatccttacttccacaaagcaaacagaaagaaatttcctcagggtcccatcatccattcatccacttactctcatcttcctgcctatttctcatgctttctcctcatttacaggtatgacatcagcacttctattttcatttgtggactagagcctatcccttcatctctactcaagaccattgatccagaaattcttctgcatcatcaatttctcctcttcactgcatcattcccacaaatgtataaacatgctgtgattttccccatttaaagcagaaaccaaacaaaaatgccctggatccatttctcaatccagcttcatcccattgcttcacatccattacagtgtggggaaagctttgcaagtgttgtctatgcttgctgcatccagttctcttcccatccctcttgaactcattcaggtgttgttttcactctactacttcactagaactacatttggcaaggccactaatgaccttcaagtcactaaattcagtggttggttcctagttctcatttccttgatctagccactgtatttgaaacatcgagttactctcttccctgaagtactttcttcatttggcttctaggaccccacactccactggttttctttctactttataatctcttttgctgttccctactcatccaactaatgtcttaatactaatgtgtccaaaatctcagtctttagacttctttctctcttaactcactccattaatgatcctatccagtctcatggttttaaaaacaatttctatgctaatgactccaatatttataactccatcctaaaccccccttctctctcttgaattccaggcctatatatttacctgcctacttgacattcc

SEQ ID NO: 56097 - DNA, 4310 bp, Bovine  19866880568344
ctgtgcctctcgtgtggtgaacagaagacaacagtgaataagtgaattactttctggaaggtgaacatccatataaagaccgcttcatcttttaatttggggcatagagtgaaatggttagaatggtgtccttaaattagactgtatgaatttttagtgtgttctgcagattttcttttagtgacttgggaagagttatttatactcttgaccttaatttcttcatctataaaatggaaaaagagttcatacctgataagattattgaataattgaataaaagcatctatataaattgcttgatatagttcctgactacagcaagcacccagtaaatgctactatcatcatcgttatcatcatcgtctcattgccatcatcactgatttggcagaaaggtagctggcctgcagcatctggcagccagccacattctttgtttgcctttatgtgaaagggaccagtctgtcttcgagtccgtataaataaagcaactgttgttgcacttatgctttaaacatattccttagttcagaaaaattttacttcctcactaataatgtcaaatactaattaaaaggattctattaagtgcatttggggtactcttatggtgccatcacaatttaaaaatcggatggatttgaaatatctgaactgtggcagattattaagtcagttgaagcctatttcttttgcatggttcgttcagatgatgtgaagcactttgatatcattttagtgggtacatttcagtgtttgacaagctaactttttgtgttgtgaactatgtcttgtttatatattccagagttgatttttcatgagtggtaaatggttggttaacatgagagcttgaaagtgaaatatgaaactacacctatggattgaatgtaatgtgtgttagatcaaatggttagacacgagtaagtaatgcattagcaccagttctgtatcttcatgatccatctgcattcctttgcatgagtagtattcatagtagttttaattcatagtattctttagctctcagttttgtttaatctgagaaggctagtgaagttaattatgttgtctagaaatggaaaaagaaacccaccaacaaccactaagattgctgctaatgttgatatgattgaattcatagtagaggcagctggatttaattatcagcttgcagtgttgtggtttcagcagcaattgctgaggaatggataatgcaagtagccttcaaagccacttacattagagataaaaaccttgtcattcaggcagacagctgactgaacaagtattaaaatgaacaaagatttcccaagggaggttgcagactaaggtttggttttgtctccttggcttcgattcaaatatgtcagcgacacaggatcttattctttctaacttaaaatgttagccattctttagcatgagaggtgaattgggggagagttagagggtgggggcattgtggcagctacagaaatttttagttagctaatgactccatcccttattcggctcatttatgggagaaatgtagaaaagaatccttgggttctaattatcttagtagcattgtctaagtaccaacttaaattctgtcacagatgtgacagagctggctaagagcaacagtggcttggtggtagcagaaatccaatattttccctctaaatcagggtttttcaacagcagcactattgacattttggggccagataattctttgttgttggggactgtcctatgccttgtagatgtttagcagcatccctggttcctatgcacggaatgccggcagccacctcccccagttgtcagaccaaaaatgtctccaaatattgccaaaagtgccctggaaagcaaaatcacccccattatgaatcactgccatacgtctatgagagggatattggtaaattacttttggatggtattacaagtttttacacacacaaacatacccacatctcagacctctatacattagctctgtttgcttttataagtaacatccttacaatactctagacagagctttcagaagcataatgtctatcaacataaattctatagctggtgttgcttctctgcacagcagtccttcatattctcagaagcagccctttagctacataagatatgaaacagcaggatgcaataaggaatgaatgaatctttaatgaatagtttttaatagaagtcacattgttttaataatagggatgataacatgttattagtgctggcaattaattaaggagtccttgccaagataattggtaatcattttcttaatttctttctgtgattcaataaatacatttttttaaagtgtgataacattagctgactgaatcacagttccctttgcatgtagcttagttaccagattgaggttcaaaaatattgagggagtttgtcctgcattgtgtggatgaataaatcaaaagaatgattgcaataaaatgattgcctgttttttaaaagtatgattcaaaagaaaggccctcttaagccccacatggatgttttttgtttgcttttggtcatatgtgtaatccctacttatttcaaagcccttacctaaagaacataggttcgggacagtttgaatgcaggagaaagaacccagaaatctgagcactgatcttgagcacctgtcttatctttagcattctgtggtttactgtttctattttcttaggtctaaaggaagataactccttcttgcctcagccaactggtgcataaatcttgttagaattaattagaaaattcaccatgaagtgttttgaaagcctggaagaaaagtactctaacaccagaagaaaaacttggggtttttcttcctcttcctctctctgccaggtggctctgcttcccgtctattctcatccatcctttctgctgctgggggttgatgaaactgttactcacactctttcccaacatgcattcaaggaacggtattagattcattttgttgagagatttaaaccctaccttgtctgacagactctgaattcacctcttaaatgcattcctacaggccccagtgacagtatcaacaaagttgaaaataccaactttattttttagtcaccttgaataaaaatgatgccatttattttttaacaagtttggaatattctcttacaaacactatcagttctgatgtacttcagtgatgggaatagtatctgtgctattttttgtgtggaaaacttatttctaacagtttccctttttttttttttggtaaatctaattgcttttggttcaccaggaattcatgggcaattgcttttctcactattacaaatatattgcaagtggagcttttatattcagggttgctgacctgaatctgttttcttctcagtaatcttgtgctgtttccaagtttaggaaaactgacagagtttgaaaagacaatatgcgtcagtcagactaggggtgctactgttgcatcctttatacataattgtcaaaaaatcctataatacccaagtgcaggccaatgcatgaaaatctaattgaaacattgcagagatgattcagagacaaacaggaaccttcatttccgaccccaatttactgctgtcccacacagatttcatgttctccatttctgaagaaattatctatatcagacatgtagacttatgatccagaggttataggaaacgtcactttatattaaaaaagggcccacctcatgcctggctttgtgctttactccttgcattaataatgatgtctttccagctttaattctacttctcagtcctgggggacacatattttaattttttattggttgtggtacattttcagcagattcataggaaggccttcccatatgcttcctgacctattcaacctgcagaaagatgtaaatgcttccaagtgtgtgtgtttccgtgtgcttgtgtatgtgtttgatgagaaagaaggaagtggtaaaagttgctttcacctgaaggagcacctttgtgtccctatttaaaatggatataaatcagaattttttatgcacttagtcattttttcccctcctagtaggcctcagcctttaaatttgatagcaaatagattaggaagataaaaataataaagaagtcagcttatccatgatttaatcaatatggtaatccactgaaattctaaaatttataaggtcaaactttagtagaaatttatgattccttatgtagtcagctggtttcccccctttatctgatggcctggactgatagcatttggaaggtagggcactgtgtatgcataggcataatttttactcc

SEQ ID NO: 56098 - DNA, 1255 bp, Bovine  19866880638156
aaatgatgagttgatatttatacaaagcatacccttaattaaaatattatgagcaattaaacccagtgttcacggaattattgtacatttatgtgtaatagagtaaaaacattgcaagggactgttaagctttttgtgtgaatctaattaactttgacaggctccgggcttttctcccccttatttttagaagtgttggtgaataaatggtcttgcatctggaaaacttcaaacagttttgatcagcaattcagatctgatttaaaatgtacgtatcgagacgctgttttaaatacagacttgataggcgtgcagggctcggcttcttgtggcaggaaggcagatgtggaaggcagaacagctgcggactggtgccgtcagcgggtattgttttcgtcacaatttagtcaggccactaaggctgtgaggaggcctttgtatattaggctctggttaatgaaaaggtgaactcactggcttgattccctggagggcgattaggagggagatggttctccttgcctttacgtagtcctgagggaacagaggaaccaggagcaaatccaagttcccatggagccaagggacttcctgttttgtaagtaagggaaagatgccctcctgcaaacagtgaattagaacattgaggataatgcagtttttgttctcctgttgattctctaaaatcccactaagaaactaggaatttccttgtggttccaggtaataacagtaacaacggttatattttattcagcaccagttgtgtagcaactgattggcaaacattatttttattttttaagattttatcgaagtatggttgatttacactttgtacagcaaagtgattcaatatatgtatatatatgtatattattttatatttgtttccattatggtttatcatgggatattaaatagagttccctgtgtgtatagtaggaccttattatttatccatcctatgtataatagtttaactcatcccttttaactcatcccaaacttccaattcttccttccccaaccgccctcccccttgacagccacaagtcttgcaaacataatgtgatttaatctttacccatctctttgaagaagatactagttccaatttactgattcagaaactgagacccagggtgtgtgtcatccttgtaaaggcacataactgcaaagtgtaagtgctattaaaatgcaagattaaagtatacataaacatagcactgaatattgaaatagatacaagtta

SEQ ID NO: 56099 - DNA, 2238 bp, Bovine  19866880661202
tactttttgaaattttgagttttgaggtatataaaataggctgtagtactcattttacagttatttgttgtgaggcttatgcacagtcatgtaaatattattaattattatgaggtacctttaaagagatatagttttggcacgtatctgtacaaagaaaaaaattaatgcatatatatatatatatatgtgtattctgagagaaggtctgtcttgtctgccttaagaaaccaataaaatctttttccaagagtcacagccaagtcaaaaattgttcttttatgcaccacaagcattttcacagttttatttacaacattaatttcttaaagattttgttgtaaatacctttttcttaacacttcaacctagtctagatcaaaccatcacctgcagagatattcatatatatgttttcttgtttttcaaaatgcagtaatagatcaatggtgcttgctttaaagctgggcggcatgtggtttattcactattcaagaaactttgataaatctatggcaaatctagggagcagacactgaactactctgccacaatccgtattttacaggcactgtgaaatctctgtttctatattaaagccttctgtatacgtaaatccttctatggcagatgccatctggtcagcgtgtggttgtggggcagctgtagaagtcatgctttgttgacctaaatggaagctctgtcttcagaagaagtagaaaaattggctgtttctgtgggttataaagttccaaaccgttgcttgccacctgaagagcattaatttccttttattgcttgtttccatagttaaggagtggcttgtcaaagggctaactgtcccctgtctcttctccaagccattaggtaataaattggatatcatatgtaatttttcaggttgtcttttttttttttttttgtaaagtgaaagttactatgttaaactctgtgccctcaaatgctctttaacctcatataatcttaccttttccaacctgtgaaaactgcaaaaactcttcagttttcaggagaaactcactaggtttgtcactaaatttgttttctccttttaagaatgtttaactttgggggaatcccatgtagggttgttgacttgattagatgtatattttattaaatctgcccttgagacctttaactcctaaatagctgttcaaattttaatgaattctaagaaatcaggaattttgcttaaactttatattgccaagctaataacttttttgatggacatccattataatcttgaagtttaacattgtaaaccataaacacattaactgaaacatcaaatatgaacgtaaaatatttaagatatatgttaaaacattttatattttccagcatgttataacctgtaaacacattcagttatattatttcacttatttattattattatttgtctaagtatggaaattgaactacttgtttcatctgtgaattgagcagattgaagtgagaaggttgatttgatcaatgaaaggtcatatgactagtcattggcaaaagaaaaacaactagaccatgctgctgctgctgctgctaagtcacttcagtcgtgtccgactctgtgcgaccccatagatggcagcccaccaggctcccccgtccctgggattctccaggcaagaacactggagtgggttgccatttccttctccaatgcatgaaaataaaaagtgaaagtgaagtcgctcagtcgtgtccgaccctcagcgaccccatggactgcagcctaccaggctcttccatccatgggattttccaggcaagagtactggagtggggtgctattgccttctccggtagtcatgtatagatgtgagagttcaactataaagaaagctgagagctgaagaactgatgcttttgaactgtggtgttggagaagactcttgagagtcccttggactgcaaggagatccaaccaatccatcttaaaggaaatcagtcctgaatattcattggaaggattgatgctgaatctgaaactccaataatttggccatctgatgtgaagaactgactcatttgaaaagaccccgatcctgggaaagattgaaggcaggaggtgaaggggacaacagaggaagagatggttggatggcatcaccgactcagtggacatgagtttgagtatactcttggagttggtgatggacagggaggcctggtgtgctgcagaccatggggtcacaaagagtcagacag

SEQ ID NO: 56100 - DNA, 1241 bp, Bovine  19866880677155
attttgcttgcctacactactttatgttaattaatgaaaaccataaattcagagcctttgcaaattgtgctgcttcattgcatttagtgctcttgtaattcctactcttaattaaataatgagcctccagagcacattcctagctgtgagctatatctactgtgttgtagatatagctgggattcccactagccagtcaggccagtatgtcttttctaacaggtagaagagtttatttttcagtttcagtgcctgatgtggggagagacatgttacggcaaaatccacctttgttttgaacaggttgccaggattgggttttcatttgctctttcctgttgagggcacccatactggaagtggtgaattcttttctttctttgtgattggggcaagccacattattctggagacagagcaattagcgtacgtgtgctcttttctttctttgaagacatctcttttgtaattcattcaggagtcaacaaatatgaattgtgcaaccaagtagtaccctggggggtgggtagatacagcagtgaataagactgttcctttgagaaaacagttacatctcccatttacatcaattccaaattctgaaccttttcaatgggaaaacctgtacagtattttgagagtctctgcatacaaaggaattttaaaaacacaatattcataagaagttgccatagtaaaaatgcataatagaggaagaataatttaaactgtaagatcttacaactaatgacaggcttgggttttgcctatgtttatggcattaatccactttcccctcatttcctaaatatatctcctgactggtttgtcatattttacttttttacttgcagtgtctttcattttttatggggttgtttagcacagagtgagataaggcatattttgttctttttatggcataagttattcagctttactgttaggaactaaacatcagttacagtttatttttaatgagcgaccgaatcatttttcatatataagttttactgcagaacagaagcaagtgatccatccaccagtgataagataactcaaggaccaaaataaccaaaaatatcaggagttactaaatgactgcacttgcaagtcagaaatatttaatttaactgacacagctaattgttgattattcataaaccatgtttcaaattggtggattatccaatattctttctttcttcttgatcccccctcagccatttaattcatttgtg

SEQ ID NO: 56101 - DNA, 1203 bp, Bovine  19866880705844
atgagttaaaactcatagatggtaagaaaaataaaatatacaaaagcctgatgttatttacacacaccacacgaaaagaaaatgaggggaagtaaaaacaaaaaccgtcatgtacctccaagaaatgcagcgtatcttcttttctagtaatgagcacactaaactgtctcttgatgctgtattatttgaaaaagtgtaaaataagtttcgtggaagaatcccaatcccattgttctcagttgagaataataataataatacagtcctaaagtagaaagggaaaggagtatctttcaagagtagagatgagccatattgttacctttctcctgtcccattaactaccctttaaaacggtagcaccattcattactgaatatacctctaatatgaggaaaaaacagctaagttgaaattgattcttatttttccaacaacagattagagtgagtgcttcttttattgaggaattcacagatggcttcttagaaatacctaaaatgcattactttgcaacttcctcttcaaaaaacacaaccaacctccccactttttctttctggtacggcagctcagatttagaagctggattacaaatggattagagtcagaagatctgtccctacgtgtgtgaccttgtgcacatcatttaccccctcagtttccttattagcatcccactaggaatactccttgaaacagcaaaggtgtaaatacatattaagaattacatctttataaagttaaacttgcctattcggagcaaaattacctccttagagggaccacatcatgaaactggaactgaatccgtagatctctgtcaacgttttgactcttccttctacagttctcttctctcaaagggcataacccgagtcaccttaagagtcgacttcaagtgccccttccttcctccactccttccctatcctacttctaaagctaggggaaaacagcagtcttcatctccccgccccaagccacaccttcagaggaccccaccccaggcacatccgccctctccctactccgggggcagcagaggccaaactcgcccttcccctcccgcccccacctacaggagacttcctgggaggcgttcaggcccgagcagggcaggcgggcatttacaaacccgctttacgccactcgcgtagggtaacctcgcttacgcccatagggccccgttcccagccctgt

SEQ ID NO: 56102 - DNA, 1378 bp, Bovine  19866880728314
tcctgttcaaagtgtcccttcagtctgccgtgcactatccacacttctcatcaggacattcaggcctcagctccctccagcctcagctccatctgattccttacagacagcctgtgctccagccaaactgaacactcgctcggcaccccacatccccccagcaccccatcattatgaaatctctcccacctgaaatatcttttgaactgagcctcaggtcagatatccctaactttaataagtcaccatgattataccaaccaaaagctaccactccttaactactacaatattctcttatttttcttatgtcacatatcatgtctaatctcctaaaattatttatgtattaggtatcccctgccagaatttaagctcccccaaattgatccttatgtgtgtttaagaggcacccagcactattgctttctgctttgtactgtctgaatgaaagaacaaataagatgagatgctctgtatctgtggtgtttattttttcacctcagtttgatgtccattacttttgacgctaaattccattaacataaaacatagtaaagactcatataataaacatggaacctagagagtgctgagaatcattttcttctcaggctgtatttaaatgctcatctagttgcagtgaggatccggttatagagtagggctatttttgtaatggaaatgaatgtcagcatttggattaatagataatcctcttggaaggtgtaaggggaaagagaaagagagtactaaatccttcagcacaaagtatgagctttaataaaggacccaataaaataaaggaattaagaagacacagcaaaagccgtattcaggtcagactcaagtatgtggatttgtgctgtactgactcttaacaacctgcccttgtttgttctctttcttcttctgcctgtaagtcagagggctgcctttctcttccagctatggttccaactgaaaccataattccacttctccccctacttttttgcctggactgttgcaacagctgacaaagttgatcttcttgcccccagctgattgctcatccaattcacgctttccagctgctgccgcaggtatctgctaaaatcagagcagtcgtgtcctgttccttctgaacgaaccccaggctctctagcatcatgatccaagctcttaagatcgagcacattccctgccacttccctcctcctatagccccggcttcagttggactttcaggtcatcaccactgctcctctcaccttgcaaatataattcctgacttgggaatggccttgtccccttctccagctttcactcttctacttattcttcaagaaccagttcatatgtcaccatccctgagcagcttcctggacatcattcc

SEQ ID NO: 56103 - DNA, 1668 bp, Bovine  19866880746129
tatgactgttaccaatagagttgctacataacaaaaaatgtcaaaatctggtaggttaaaaacaacagttattttattgtctcagtttcagtgggtcacggatatgggacaggcttggtgaggtcgttctggctccacccatgcagtcatagtcagatagcagctggaggtagaggacagaggggaatggagcagctgggactaggcaggcacacctcactctctctctgtaatctcaacattgcccagaaggcctctcattcaggctactttggacttcctcaaagcatactggtctcgggcaggcagactggcagcatttcaactcagggctccattgcaagtgttccagtgatcaaggtgggtactgtatctactttccggacctagccttggaagtcacttactgtcacttctgccacattctgttaatttcatcagagtcccaaacctgtccagattcaagcagaggaattagacctcctcttttcatacggagatggcaaagttcagtaagaacatgtggaaaaggaggcattgctggaaaataaaatctttggaaaatatagcatctgtggaaaataaagtctccctcagtgagtttggtaaagttagctaccttttctgtgcctcagtttccttatctatcaaataagtataatatatggcccttcacagtattcttgaagtttaaaggagttaatttagtttaggtgctcagaacagtgcaagatgtcattttcatgtattttatttttaatttaatttaaaatttagattttattatcattagtatcttcaggtctcaattcaagtatcacttctttctgtggagctttcctactattcacagtgccttttcattctctctgcaagcttattatgacttcagattgcttcttttctaatctactttttcagattgtattgtaatttgatgttcataggccaagatcctgcagtgtacgctgaacttccaggagcaggaaacaaaatggttgctccgaaacacaggtttgtttatcagggattgatgtagaccaaattacgggctcaaacagcagcaatgaaaatgtagattttaaaagatggtgaaaacaaggtaggataacacaatataaagaaggtaggatgtacgcaggtaatgagtgtctgacttccacttgggtttacccttccatcaaagctttaaaggttacaattgccttaataaggggttgtaggagatggtgggatttgcaaatgagaaaacagaggagtgagttgaaagctttgggctccaacatctagaaatgagatgaaattggttgtaatagactagctaaaattcagctagctttcttattgctgtaatttcacatttaaagtgtccatatttaaaaacatttgctgaaagacaacttcatttgagaatgaacataagctttgagcctataaatgatataaatctgcagcattctattcattttagaagagaaatcaacattaatgtcaaacgaatacagcaaaaatgtctgtcctccggtaccatatagaaatctacaagatcttgagtaatgaggaagactgccagtgcctttaccaacaagaatgtatttgtaagtcatagaagagtcatgcaaaatcatgcaggacttggtctcctaaccaaggagtaatcatttaaat

SEQ ID NO: 56104 - DNA, 1878 bp, Bovine  19866880750035
gaaaatgaaaccctggaaacaaatgctactatcttatctttctttggctgtactattaccaaagttcagtaataaattttcaggaagcactcagcatcctttcaaacacaccccaaaacatcatgccattaatttctaaactcagcagaagagaatggagaggttcctcccaataaataaaactccagggtaaattgaaagatccatgcaaaattcttttgttgctacttttgccttcttacatacattgtggccactgtctgaggagttaaatgaatgactggtggtgacaagaccaaaccatgtaacataattggtttgtcatcctttgaaaattctatcctcagaaaaacttattctgagaatgattttgctattttggcccttaactggtttgctgaccagtagggacactgatagtattctattatgccagacaaaattctgtgtaatgctagcaaagcaaaatattttaaaagagtagattaacagtgcaaaaaaagactaattagactttggagttttttatagcactaaattttcctaggtagagatccttgtgagcgtgaggagaagaatgcatattttatttgggccatgtaagaaatcttcctgctcagaagactgcttttacctactggctaatacaaggcatgactaagaagtaatcagggaaatcccacaagccatatgggaaaatcagtttcatcacgttatagccacatcttgtatttcctttattccatgctgtgccagtctcagaaagggctgctggtattggaaacagtaattggagctttgcattcagtaacaaatagtgagattaatattccctttggttaacattatagatacaagtgtatggaagaacagtatgcaaggaagggtggttgcagcgaagagggaatgggaaaaccagtacaattcaagtgttggatttatgtaaaggtagaagtaaaagttatttagtaacctgtatgacacaggaaatttacaaattcagagcagatgccagagccaccagggttctcaaggatccctgctttaataattttttatctgaactgagagatgtctgagacatcccagggactggggaggccatccagtgggtggggtcactcagtgatttcaggacagagactgttttccaactagtgtggaaatacatccatattttaacaatcagtgtgcatatcagtgactgaattctttcatggtgttttatttggggagtttgtccaggatttcagattccgaagtattattctcagcttgaaagtgtaacatttttgattctaagagatttcttctaagcattttctgctatctcttccctttgagtcacagaatcctggtttgtttcttctttttttttttaatggctgaccttggttggtcatgcttcccagctcaagtcctaagagggtcaattattactggtctggtaaaaccatcagcaagatcatttcctgtgtggcttttgatgaaaacaactgtcaaggcactgaccttgtcctaggattggagatctcttcccctgaacccctcctctgagaatggtcccttgaacctgggtcacctatcagtgcttctctttcattcactcagcagcactgatagccgcactgagccgcagcatctagcctgacttggaagaaacgtgactcatcacaggcatctttctaaattatcgtttggaggtgtcaaaacacacatttgtccagtagacagaaaaaacccactggcccagggaagacacatttgtcattcctgaaacccattaatggtttgactttacatttgtgttttaacgtatctcctgttattcagaatttggattgccatctcaattctttgtcacttttgggagaagag

SEQ ID NO: 56105 - DNA, 1423 bp, Bovine  19866880813106
tcctacataatgttcctcataccgtgttgttcacatactgttgtgcagacatgcttaaatgtttctgtgcttacttgctaagttgtattcaactcttgcgaccccataaactgttgcccgccagatttctctgttcatggggttttccaggaaataatgctgtagtggtttaaatttccttctccaggggatcttcccaacccagggatcaaacctgcatctcccatctccctccctgcattgcaggtggattctttagctgctgagccatcttcttcctcagttagactgaaaaaccgtaagtcaaaaggcatgatactttgcatagagtcagacatgagatagacaagtggttgtaaatagacagcctgtagacttaaatggtcctactgagatcccatatatggtatagttttaaaaagctataattagtttcaaacatttaaatatccagatattttacctgaaacatcactttgaggcttattttaaaatggaaatacattccatgttggacagaataattgtcaccttaccaatttgctattgtttagtcactcagtaatgtctgactcttttgtgaccccatggactatagctgccaggcttctctgtgggatttttccaggcaagaatactggaatgggttgccattatctcctccaggggattttccaagcccagtcttctgcagtgacagattcttcaccagtagccaccagggaagccccaaccccacaaatatccatgccctgatctccagtacctgtgaatatattatatagaaagcagggatcaagggttccatatggaattaatgttggtaataaatggatgttaagtagattatcttggattatccaggtggacccaacataagcaataggtgtcctttaaacatgggaaaggaaagaaaaagaatcagggtcagagtggtacagggtgggaaaggcttcactggccactggtgactttgaggatggaagacagccaggagccaagaaatgcaggcagcagacataagatagaaaagacaaggagaaaactttcccctagagcctccatatcactgccaacaccttgactttagctcagagacccatttcagacttctcatctttagaactgtaagaaaataaatttgtgttcaagtcaccacgtttgtggcaatttgttacagcagcaatagggaactgatacatatgcacacacgagacccctgctgctacactggaacagttccaattctccataattatttcttctccctactattgatataagcatttgatttcatgacacctaaaatagccattcaatgactagatgaccaaaagagatattaatattattagatctaatattaaaggcaaagattgtaatttttaaaaataaaaggtaatgggaaaatgtgttcacaatt

SEQ ID NO: 56106 - DNA, 2960 bp, Bovine  19866880854585
agtatgagatggttagagcatcaccaactcaacggacatgaatttgagcaaactccaggagatagtgtaggacagggaagactagcgtgctgcagttcacggggttgcaaaaagttgaacatgacttagtgactgaaaaataaaatcctgagcacgtaaaggactctcaaacatcaacaataagaaaacctaattttaaaatttggcaaaagatttacatagagccatcatgaaagatgatatacagatggcaaataagcacatgaaaagatgtccaacattataagtcattcaagaaattcaaattaaaaccacaaggaaataacactacacacctactagaatgtctacaattaaaaaagctgacaatgttggcacgaatgtggaggaactggaactttcatatgctgtgaatggaaatgtaaaatcgtataaccattttgcagagtttggcagtttcttaaaaatttaagcacacatctgttctgtcacccagccattctcctggacaattacccgagagaaatgaaagcatatcttcatacaaagttttatacattaatgttaatggcagctttatttatattaggcacaactggagaaaacttaaagtttgtcaatagatgagtggacaaactggaatatattcatacaatgcaataggactcagcagtataaaggaatgaactatttatacacaacatggataaatcacaaaataattatgctgaatgaaagaagccaggagaaaagagaacatactgcatgatttcattatgtagaatgcaaattgatatttaattacaggaagtagatcacttttttgcctggtggggctaatagggtggggagcagaactaaaaggataaattgcaaagcagcagtatgaaactattgagggtaatgactgtgttcattttgctgattttgatggtgatttcagaggcatatacatatgtcaaacttatcaaattgcatactttacatgtggtttgttgcatatcagttataagtcagtaacactgttaaaatgctaattgtaagggctttccgctaccttttgccagctctcttagggaatatcttcccaagcagacagttttagctttgaataaaatgaataaagatgcataattggtgttgcttagtaccaagcagccctactctctgttgaattatttttcatctttagatgtgactctgtaatacagtttttgtagtaaaaaaaactctgcaaattcagtttctaatccccatgcatgagaccttaatgtcctcaccaaccactttgccaggtgctttgtcattccagctatgcttgaacagggaactcactccttaacaggagtatataatagcttggacagttcttgctcttagaaacttcttgcgtattttgacaagtttctacttatgttttgattgattgggaggaaaatacagattgtcaaagaaaatctttgatatttgaaagcccaaatctgagaatgagataaatctttttaaaaccagcagagcaatatgctgcaatgattggctaatggtgtccctctttaactgccaccaaagagagaggtttgatgtggggagtgtcaggggaatggcccagctagtggggtgatgggttcctgactctctcacatgcttaattcaaagcagacttattttgatctgttttaataccctgctgttgtgcaagttttcttttttttttttctttgtaaatcattggagtggtgaaaagaccttgttctttgagcccagaaaaatgaatttatgtctttctgacacattacgtggatattttacacattagtcatgtcagtaagccaggttaggtgaaatagtcagctattagaattgagagttactacatcaacattgtttctatattagtttactttggctgccatagtaaacaccgcacttggatggcttcaacaacagaaaattgttgactcctatttttggatgtgagaaaatcaagatcaggtgtggacaatttggtttcttctgaaatttctctccttggcttgcagatggccatcctttcatgtatctgcctgtggttattccacagtttgcatattgtctgtgtcctaatttcgtcctcttgtaaggagactggtcatactggcttaaggaccgccatgtatcctcgttttaccttaattatccctttaaagtttctattttcaaatacagtcagtcacattttaaggtattggggattaggacttcaatatatgaatttggggaggcaatgcaatttattccatagcaatttaatttcttataaaatgaagacttgctttttaacattcttttcaacagtgataaggtaatccatataaagcaatagtaaagcatctggcacattttagctacatagtagatgatgatgatggtaattgtgaaataaatgtataaatctgtgcttatacagagaaaatattatttagaccattgatatcctgattgtaaaatgtactgagaggtaaaaggaatctataaagacatcatggaaaattattcaggttacagtgcatgtttattgttatttttagcaggctgaattcaatggcaatggcatgactcaacttttaacacagctctttgctcaactgaagaggaacaatagcccacagtgctctagagcactccaattaagatgcccagtgaggagcaccggctatgcagaatgcatagggtggcagtggtggcaactggcacaatcttcaatttcattcatgtttacctccattctagaggagaaatgagaatttgctccactgcattttaagctggggtcataggaacagttatttttgtttctttccctagtgaggaatttaagaagtcggaaattcaaatacatttgccaaatgcaaatagttttatttattaatggctactaatggtctgtaatcatcacagctgactatgtaaataaatcattt

SEQ ID NO: 56107 - DNA, 1906 bp, Bovine  19866880864515
ttttcttttagataagatttatgaatatgcatttggatatacacacatcaaacaatttgcttcatgaaaagaggtccatggtcaaataattttgaggaacactgataccaatactcctttaaggaaaatcaggcaaaagagaaatcatttaactttgtttaacccaggtttcccaaacatgttgggaaaacatgttttcccattttgagaaattgtttaattccatgatatacattgcacttccctgggggctcagatggtaaagaatctgcctgcaatgcagaagacctaggtttgatacctaggttgggaagattccctaaagaaaggaacagcaagccactccagtgttcttgtctggagaattccatggactgaggagtctggtaggctacagttcatgggtggcaaagagtgggtcacgactgagtgactaacacttgcacttacatgacgtagattaattgttcttccaaatatagaactgttggatggggcagagagtatattcagggaactcaggaatgacttctttggctaaagagcaaatggcttcaattcaagaactacattctatagttacatgggaagaagtatgtttttcaataggagatatttgaatagaacaataatggtatgaaactgtgatttctgaaagttattctggccaaagtatatatgatgaaatggaaagacaagtgtacatggaaatggtagggtgatcactgaaatggagtaccatactctttgtaaataaggtggtaagtaatacggaataaattattgatagcagaaatgccacttgcaatgtaatagaaaaaatactgaacagagatatcacatgtaaaccacatttattagcatatctgtataaaaatgtatactatagcaagcaaatttcagtccttttccccccctcatttcttatttgaaaatcagtgcttgatttctgtgtttgacctgccatgggttttgatattgccatctggcagagcctgcttatcatcttcattatggacctagtatttctctatgctgattcctaattttcttcattaaatcctaagttaagccaatttgaaattaatgagaaataagattaaagatgaaaactacctctgaatgttatcatttattatgctgttggggcacactatttatcactgctcaaatctggttgtaaataagttctctctttgaagagttgacctgcctttacttttgttccttttagtttagtcactgttttcgtttgtcatgaaattggaattgccagatggtttgcaaagactgagcaacaacatttttttaaagactctttatatacaaacaagttagcaaacaaacaaaacagaacgttagctcaaattaaaaaaaaaagttcttaaaaaacaaaacacaggcataatatgagtgtaaattatatcatctcatttataacaggaaatgtataacaaatatgggccacatttcttaaattagcagaaaaatggatctctaggatggatacaccttgtcagggtaacatactcagcattgcagacagccctcggccagcatttttttcttcagctatagctatgtaagtttctattcattttcacaagtggtgctctccagtatcagtagagattttcccttgttgcccacatgagtaattgaagatcgctgatgtggacattaggaaaccactttagtgaccacttcacatccccctactgggaactcagaatatataccttcccttctatgggctcccatttcctcatctgtaaaacactttcatgtcacttcgatcccatttgttaatttctgtgatagattataatatggttcctatatcagccctgggtccaattataagagacagaaaacagaaatttgaacatgaggagtttaatacaaa

SEQ ID NO: 56108 - DNA, 1427 bp, Bovine  19866880878458
gcctgctatagctcgtgttaaatatttatcacctgaggacagccatctgttctttccattctcatttggccttcgccgcctctcttcctgccaaaagcattagatgcttgatggtttgattccccaaatcagaatgctttgggattgcctattgtatgcatttatttatagcaatatttattctgtctgacttgcttcctgcatttctcaaaacaaaacatccacatctcataaatgtgctatgaaatttctaatcatgttgcaagctacaagcactctaaaataattacttctctttttgcttaaattggaaagctggagaataaatattcagactttattagtcattcatattagaaacaaggcagagaaactccaagttatacttgcatattaaagatcccaggaatctgaaaatattcacgctttttccaaaatgcattctctgggagaactcctctgatgtaattattacctcagggtaatatctacatggatggctttcaaatgtccatcccctcctttatcctctcttcggagtcgcagccacacattccaagttgcctagatatgccacagccccacaaccatcctgggccctaaatgtactcaccacctttcctcttttactctgcttccttcctcctacctttacatccaactcaggctcaaaatcttggttacccttttcctccttatttctccttcccaataaccaaaggatttcaaatcatagcaatctatctcttcaattttgctccccactaacaactaatattatttggaattattgggatatcttcccaaacatattttggacatatcaacaatatactacatgtgataaatttataaacttacttgtttctccttttgtaacacaaatagtaacatttcttacatgctgttctgcccattgatttttcactcaacaaaacacattggaatcatactggggagtgtgtacggtgtttccactctttatgccaccaaatcatcttctctacgggtttaccatgatttttatctaacccaagacattgcaactataggcatgtatattttagattttgatggagaagccaaatcatcttccataaatgttccaatctgcgctcccttcagtagtgtctgaagtaaacatttataattaaaatagagagtcatcctatcatataatcatataaaggtgctcttctgtgttggagagaaatactgttttctattatttcttgataattacaggatagatacaagatgctactgtttcattaagtaaaaagctttctctgactaaaaatctcttttgcaacttctttattctcactggtagggctttgtgcaaaatggcttcactcaaacccttaggtaaagcatttataagattcgacataagagaaatcttttttgtattcacttctccatat

SEQ ID NO: 56109 - DNA, 908 bp, Bovine  19866880890782
cgtttcagcattctttgtatggcttctcatgttcccctgcctcctgttttagtagcacttcaggaatgtctcccagtctgttttagagacagtttattggctgtgatactgagaaacatgtaacttatgtttcttaacttttttcctactgtattttcctttccaaaataataccacaaatggcaaccatttaaaaagtgggaacttgtcaagagaatttgaaaaaaaaaaatcatccaatccccaacttctgtgatacaatgttaatgaaatattttgatatgctgaaaccttaatttaacactgccctggtaagtgaaactgtcttgtaatgagtatcttcaagtcacagaaagtcttgaaacatttccaaagatgatcagagttctataatacaaaattttatcctgtaataagtcatataaagactttcaaatatttaagacattctctcatcaaagatcaacctcactttagttgttatatcaaaatttcttattgatctttgatcatggtaaatgcttatcttggggatgtttgcgtaactgggtcatttatgataagatgggtattcttaaaaccagaaattagatgccaaattccaactctaataacagctttttaaatcacaagattcttttttttaatgacttgtgggttattttagaccttctaaaaccattattccagcctgttcacttattctttgcctggagattatttctttttattaagcctgcaaaaagttaaaggtcaaaatcccacctgaaataagttggggagtttccaaatagaaattatttctctttcatctttctcccacctgccttgtaatttctcatcccttgtctgccatccaattaatgcacatcagctttgtttgtcacctctgttgagaaatgtggttg

SEQ ID NO: 56110 - DNA, 1153 bp, Bovine  19866880937519
tttaatccctgggttgggaagatcccctgcagaagggagtggctacccattccagtattcttgcctggagaattccatggacagaaggagcctggtgggctacactccgtggggtcccaaagagtcgggcactactgagcgactaacactttcaagaacaaatatatatgtgcattccattattttatataacatactccatatcacattgtcctgatatctgtatattctcaacatctctctcaaatccccaatgacatgaccaccacacccttttctttcttcctcaaaaaaggaaaatatatcacctggggagaatcaaaacctttttggaaattattgtagtggaaagatcctgaagaatagaaattattctagtcacaaatactaggaatatactctgtgttaaaatgtggaattgattttgatcctgttatggccatactatttatatgttaccatttagatgttatattaaactaaattaaataggtaaaataaattaaaaatttgacttctttatggccattattaattctttcaaaccaaatgagattatttgtgttagatatatgtgtcagtcaagtgttaataggtaattttttcaaaggagtcattaagtacaaataaaaaattaatcccatacaaatcaaatattatcagacattttgaagatgtaaaatatttttagtgagaaatattttagtaagatgtggggaatgttgagtcatcatcttatttttattttctaatagtaaagcaattatcttacctttttaatggtaatcttactacttaatggtaattaaactagtgccattaacatatatagcactggtattcattgactacttaataatatcaagaaaacaataaaagtcatgccacaaaagcagaaaagccattatggtgtattaggaaaatgtttttaaatatatatttaaaatttttttaatctaaattagctttgtaaggatgaataaaataggttgatgctactggggatattttattaagcataagatattggagaacatgtcagctctctattattctatgtgttgatgatagcatttctggcagtttcatttctggcttatttattcacccagcaaatacttacgatgactttcgaaatggttaagaatcacag

SEQ ID NO: 56111 - DNA, 1060 bp, Bovine  19866880953734
taagggatttgttttaggtcatacctgaatggtctattggttttctccactttcttcaatttaagtctgaatttggcaataaggagttcatgatctgagccaaagtcagctctgaaaatggcaaatgggactagatttctagttcagggattttcattggcagtagtttttctttcttttactttttaaaaatttattgtatttttggccacacctcatatcttgtaagggcttccctggtggctcacctggtaaggaatccgcctgccaatgtgagagacctgggtttgatccctgggttgggaagatcccctggagaagggaatggctatccactccagtattctggcctggagaattccacagtctgtgtatagtccatggggtctcaaagagtcgaaaggactgagcaacttgcacactcacagcaggtggaacttcccaaaccaggggttgaactcatgccccctgcagaggaaacacagaccaccagggaaccactggaccaccagggaagccccctatttatttatttttaaccaagagctcctgaactttgttagttggaaacacatatccaacagttacagttagatatgtaagaatattattacgagtacatttttagtagaggaagtctccaaaaagtgttactgctaatcttctgagccattagtggcattcatatgataaaatgttaatgtttccttctaatttaagtgcatttctgaacatacctcaaagccaagccatgctgggttgaaatgaggaatgtgattgcatttgattttaatagaacataacattgatggaattgagattgacctcattatgatgctcaattccatactagatctttgctttaggcattaaagagcatatggtaataactttttttaagctttgctgttaaagatttagtagaaagattatctggaatactttttatcaaatatcttatttaaataagaggaattctttaaagcattagcattaaaaattcacagaatgcatgaaattaaatatagaaaaatctattaggttattgtctctctcccag

SEQ ID NO: 56112 - DNA, 1218 bp, Bovine  19866880986015
aggagcctggtaggctacagtccattggatcatgaagagttggacatgactgagcgacttcactctcatgcattggagaacaaaatggcaacccactccagtgttcttgcctggagtatcccagggacaggggagcctggtggcctgctgtctatggagccgcagagagtcggacacaactgaagtgacttagcagcagcagctcaaaacatcattactataatcttgagtctaaagaaggctcgtctcaacaaaaacaatttcagcgttaacccaattccatatactaagaaacatatcactgagaacaaggaaatatgatagtccttaacttacaatagaaatgttttccttaataccttatgtactttgaatgaattcaatttcttgaatacctaaattataaccagcactattctagatatgtcagatatagagctatgacctaatgcagattataagatatacctgaagaccagacgtgcaaagaattaaagacctttaaactgtaaattttcttaaaggtcatgaagaaggagccattttacatctgtaggaactaaagccaggagaattgaagtgcctttgtacaaaccacaaagctaattaacattctgctgggactagagtcaagaagcctgactctcagtgttgctcatcttgaatataaacaaaaagaaaatctgcaggcagggttggcggggatggggtgggtggttgggcggcatgctgtgacacaaagtatgcaaatatcaacactgtgaaaactccaagtttgggcaagactcagggaagggtcaacatttttcaccaaatttaaattactgctgatatcacctgttcctggagccttaatccctaatagtttaaaacaggtcaggtgtgcattattccaaaccattttgaaataggggctccatatatgcacatgaaggaaacaaaaatatgtcaccccaaaacatgcctctttgacataaaaattattttgagctgaaggcaattaagaggcagcaaaagtaggaacagctctctctaccctcccccagctctgcctaaaggcaggatataaattctccttttattcggcagactcctatccaatctagagatggcagcaggggaatcggtaaacaacccaaattcggttaagttcccgcctatatatttatgttcccacagttcaccacccttgggagcctaaagtcactttcctttgtc

SEQ ID NO: 56113 - DNA, 1124 bp, Bovine  19866880989210
tcttggctgggatgctggagcattcaaaggaatgtactgatattttacaaccttgcatacaattgccaaggggcttccctggtggctcagtggtaaagaaactgcctgccaatacaggagacttgggttcaatccctgcgtcaggaaaatcccctggaagaggaaatggccacccactccaggattcttgcctgggaaatcctatggacagagagaggatcctggcaggctacagtccatggggaggcaaaagagtcagacacaacctagcgattaaacaacaaaaatacgattcagagagcagcaatattcactttaaacagggcacgtcctagaggtgaccaaacaactcatgctgtgagaatctgggtccctctagaaatttcatcccttctgccttactagagaaattgagacagcttactagattcggcatttcataatcatccattgaccacaccgatgtattcaaagtccatttgtttattttgtattggatatatttaacctgatgccttcattagaaaggagtttactttcaagaaaaaggctcaactgctaaacaatataggaataataaccactttgtgaatgatagtggtaataatactagtgattataataatagcaactaagacttattgaatatagcatgacaagtactttggatatgatatacaacttcctaacaacctgcaagttatatatcacattattaagcaaattgatcaagatcactgatccagtagtaacaaagttggaatttgaatcaaagctcacaacgttcctcaacaccaaatttactctcaggtctgaaatttttgagacttcagaagtaaagcactcacaaacaacaatcttgaaaaatagaagctttccaaaatatggccttaaatcccattttaattatttttgctatgcaccattttcccaacatcctagccaggactagaattatgaaaatcactgtatgcttcactgaaaaacagtttcattagcatagaatgcaatccagctattcctcaatgggggacaaaaattagtcttaattgtaaaagcttattaactagagatcgcttttccagttaactatctctattcaacattagaaaaatgctcatcaa

SEQ ID NO: 56114 - DNA, 1522 bp, Bovine  19866881041807
ttcggtagttttggtgaaattcacaagggttcctcttgagtataagggattccagtggcgtgcaccgtaagctggacagcccagtcagagtctcaatatggttgtcagccaaggataaatgctgtatctgagggatctttggcaattgcttgaaagatgtgagatggtttttgttcatatttaaaactctgcaactgtatataaaatataaacatcctgtcatttgtctcctaaagaggatggtaaactaccaaatattgcaaagcactagcatgcctcacctagactatgacacctcaaaggtgtgacagggacattttctacaaatatggtggggaagaaaaatgaaatatgtatattaaaatattaagagaaaataaacagggcagataagactgaaagcttgtctaaggcaagactatgttttcttttcactgtgtttggtccttggtgacttctcaataagtcctggatgaaagagtaaagggctgcttgaaatctcagcaatataaaagttcactcaaagcttctgaagagtattgcccctaagtagtgagattataattgttttcctttctttctacttttctgtacttaaattcaatattgagaaaatagtatttaaaattttttttaaagtcctttttttttaatgcaaaagaaagctaaaattacccttgggaacagaaatatgtgttaggcattgaggttgaatacattttcctgacagaatataatgcttcttaatattttgccttaaaaccataattgtataaaaccatgccattaaagaaaataattccaaatccatcactgacgccttgccttacagaaaaattcctttatgcataagctgggatttaatactctgagggaaacacagggtatttatttataaacctcatggcccacaaagacacttggtaaataattatcgctgaaggcctggcgtgctgcgattcatggggtcgcaaagagtcggacacgactgagcgactgaactgaacagtaaacatggtgctaaacagagagatgacagtcacacagcagcatgacaaattaaattcactttgaaccgccccacacatttcattgtaatttttcacatccattattttcatttcccttgtttccttccattttccatagggatattttgcagtcttaaccatatctttgataacttcaggtttccactctttcctaggtgtgtgccatgtaaacagttgtatctgactgttcttgcttggataatctcaggaacgggggagcctggcgggctgctgtctgtgggttgcacagagtcggacacgactgaagtgacttagcagcagcagtagatgtttttctggaactctcttgctttttcgatgacccaatggatgttggcaatttgctctctgctcctctgacttttctgaatccagcttgcacatctggaagttcatggttcacgtactgctgaagcctggcttggagaattttgagcattactttgctagcgtgtgagataagtgcaatt

SEQ ID NO: 56115 - DNA, 1888 bp, Bovine  19866881068641
aaataaaaaagtgaatcgctaagctcagtcatggtttccccttcatggacagagataaaggtggctactgacacatgaaggaggtttcttctgatgaataagtttgaggaaattcatagcaatgatgatgacaaggaaggtatgagaaggatggtgatgatgataaggatgataaaggtaatagtggtgatggtaacgatgattgtatagtgaagatggaacttggtcctgggactccagtcctgaaataagagaagtgactcctgaggacaacacattgtgatgggaagggtgcagactttggtatcagacaacctggtccatgtcctggcttcacaatcttggagaagtcatgccttctagatgaagttcagtttcctaactgcaaaaatgtaaagaactgtattcacagctcttccccctgacaaagttttcatgaggtcaagtgagagtacatgaaagtgctctataaactgtaagctactatgcaaaaaggaagaatatgaagataagaaataagagattgttgctgaaaggaatcttccctatacttaagcagttctaagaaaacataaagcagatgattaaaggcccttctgcaggaaatttttaagtttgcttgtggaagttactgagcttgctgccccacaggacagccagccagggaaagatgatgtagctttgaaaataaatacgggttccacatttcccgagttctagagaatgtagcattttctatttcccaacattacatataaaccagtcagtacttcctagatgttcaacactgtgctagaaattgggaataagagctgaggaagaaaactagcttctccttttctggcctgcttgtggtaggtagaatggcggccccttaaaatgttctaatccctgctgctgctgctaagtcgcttcagtcgtgtccgactctgtgcgaccccatagacggcaagcccaacaggccccgacgtccctgggattctccaggcaagaacactagagtgggttgccatttcctcctccaatagacctagcaagaccaatatgaatagctctacctaaaggcagagttatgtaaattcaatttataggccttgaatagcttccccaatactggcctttgaaaagctctacactgatattttcaagaaactagcagcacacttcaccttggaaaagtaatactataaagacactgccattagtgattttatgtacttctacatacccttcttgaatttgaaataatggataagttcaggtaataatttttgttctctttcaaattttatgactaaaatattgagttgtgttttatgacctacatttattatattctgtagagtcagccagcagctttaggcaaagaatacctttgcagtcagaaataagacttggggaagaaatcagaggtttaaaatgggtaatcatatattctggaagcagaggaattttccaaagattttgaaaaacaaccaaatattgcatactgtgtaatatatgagcaataattttccaactctctatacagtttctttttcttttgtggccaggataattatctattcatgtatgggccaggattgttgctataaaacttaatttgttccagagcagtttaggtagtttttttggaggaaaagtttgtttaacaaattgcacactgacaatggtacggaatttttagttatgaggaattctgacaaggtcgcaggaattatccagtctcagttttcagtctcaagagtcacattgaaagaacgaaatttaaacactgtagatttaaacatggtagattcaaaaacaagtaagcctacctaatatttgcatgacaggacgaaacactgaactttggatctttttctctttaaattaggttcttactcta

SEQ ID NO: 56116 - DNA, 745 bp, Bovine  19866881070052
tcagatttataatatataaatggacaactttgctatttggctctattataattattcagatagccttaatgtcttttttttttttgtctctatgaacacgtcttctatcaaaagagaatcatctttcaaaacactctgaaagaatttatagtatctcagagattaaaaagagattcatttaattccactttgcatttatagaatgttacttctgcttgtattaacagtgagcttattaatagaatttttctatgcccctatgccaggtatcctgtcagatgtatgagctatatgaggacaagaacaaaggaagggttagtatctaacttcatggatcccacagatctagtgatcctggatggctagataatgttctggaagcttccgagtcaggggcacaaatgtaaaggcatccatccctctctccctgcgccttgctcttcactggtgtttggtgtattatttcaccagccccatgcataggctaccacctgcaaactattgccatccaccacacacaaagtcttacataaaagggaaaattgagctctcattcaacaaaataattattgaataatttttaaggtaaaatgcagagccccagaagcataaggcagttttacatcagtcttttaatgtcttcctgtcaagctacaggatgagaaggggggtggctggggggatcaggaaataagtgcttgtcaagaagaacacaattgaagtcagaaaccagaatcaactatta

SEQ ID NO: 56117 - DNA, 1404 bp, Bovine  19866881110213
tgacaacaaaagacatatggtgcacaaatctctgtacatataggtaccctccactttttgaaagtttgttttatgccatttcgcttttatgaaagatctatattagtacctgttttggctaactgaaagaaatcggaagaggatgttcaattttatgaaaataggtgaaagcaaaaatagccatttagtgtttcatttgtagagagagaaagcaggtatggaggcagcacacacctgagcagagaagcaagaatggcaccacccacctcctttccaggacctacattcagcatctcaacctcacacccccagagctctgaatgtgctggtgagcatctgtgctttatctcaatttattttgtgtatccgttagcaagatgtgtcctatggtaattgtttcttcgatctacaccatttcagcttacaaacagtttcaaaggaacactctcagagagcaggagaaacctgtacacaggtatgcatatgtctctgagttgacattatatattacccagcagttttattaaaacattcatcatctaagaggctcaccacctccttcctcttcctggatgccctggtcctccgctccctgaacgatatcattatccacagcatcgtaacgagcttgctgcctgcaaggaaacaaacagtcatcaactccgggacactagtagcacagtttgacataagtcgtttatctttaaagagagttaccaatgaatttttcaaaattcttttaaaagccataaatatatttcctaaatgtatccaattaggtttaataaggattccaggtacactttcaaaggataccttataaaagataaaatgcttttcaaaaactaaaatgaagctagcacaacacctgacaggttaattggagatgtaaactgttactttcaggcagaaaaaaaaaatgttgattattttggaagttaaatatttagaatttgattttcagttcagcctcagctcccatgagcaagaggagcccctccagttcacagggaaggactacgaggagctgtctttaatctgcctgtggacactggaggccaagctatccaggtcggtcagaaggctaccgtggctgctcggggcgctgcagccggccctcctggagcccatcctgctgctgtcgggctgtctccctggcgaggagctgctgctgctggtgctgccgtagcaagtgtccctgcagccgctgctggtgcagggcctcctgctcctccctcagccgctgggcctcctccgcccgctgcaccgccagcctctgctgttccagctgctcctcatacggcgactggagtctggtgactggcttggctgaaggatgcacctggggaacagtgagcaagagcagtcgggtgccctgggtctgcccttcacccatttctcata

SEQ ID NO: 56118 - DNA, 707 bp, Bovine  19866881140766
ataattctatgataacatttcatagacctgaatcaacttatttataataactgatttatttgacctaacaacaaacttctgtgtttattagctgctagtggtaatagaatgatgcttgctttatttaaaatactggtacagagatattgtagttgtgggtgctttaatccaggaaattactgagagtacaattctcagtgattgggtagaaatgcttttaatttccatcttgtcttggcagttatactttttaaaataaaattctttgctgtacatttcagttttactaatgtgattatgtggtctcacatcaaaagggttcactgcttaatgaccaggaaccaagcatgtcaggatgcaggagttggaaatggttttaaataaatcaatttcaagtgaattaatctttgaaaacagcgcttgagcattttccatttgaaagttatttccattatgacttcatagagccattcaaagtgtctttttgatctttattgtctttatggtaccgagagtagctacattgcgttataataacatagtttattttctgtctctaaactatcttcggatgagagtggatttatattagctgtgtatatttgctcagtgtctcttcaatatcgttccagaatcactcatatatcgcctttgggtggatatgtatctttgggaaaacgacagcaagcactggatcagagtgatgt

SEQ ID NO: 56119 - DNA, 1096 bp, Bovine  19866881206392
cttattagaggcagatttttcaaatgagttaagtagatcagccaattttagaatcattatcaacttcaaagcatttctctcagttattagcatgtcccttctctctctggactagattcttttctccatttttaaaaggcccatctggctcattttaattgacttatttttcccatacatatcaaataaagtcaactttatcctatactgagagcaatccatgtttacaataactctgatcctagatattttatcagacatctcactttagatgaagatgcaagtgattctccattatgttaccatgtcaaaaaataagtaaataactagcgctcatctaggttttaatccatctcaatcaaataagcttataaagtcattgccatggcccacaaaacatttcacaaataatttaaatgaatatttcgatccttaagtacattataataaaaaaaaaacacatattcattgaacccaacaattccactactgggaatctgtttcacagaattaaaagcatcatactattgcagcactgatgtcgtgtcaaaaagcgggaaacaaaatgaatgctcatcaatacatgggtggttgaaattttaaggcatatcaataccatggaatgttatgcagctgtttgtatatatttccatatatgcaggaaatatagaaaagagtattaagaagattattactagggaggagagagaatactggatgagaagagcaaagaagaaaaagtaattaagaaaaaaagggggggtatttatgataaaaccattatatgagagatgatctcatctatgtaaaattccatatgttatacgaatatgattaaatatacataaaaggataaccacatgattttctgagggcaataggactatagatttttgctttcttatactgtataaactgctaatttttaataattaaaacattttaaatttaaattatttttatcatttgaatcactgtttatataatttgaaaaacatcaaattaattttaattttgatatatatataatatatctagagagagagagagtaatgcctatcagaccaagggttatatactcataattcataactca

SEQ ID NO: 56120 - DNA, 1254 bp, Bovine  19866881314748
aatcctgttgtatttatataaaatttgaggtgtttttttttttaattgcctaaataatccaaccaaaagataagcttcattactagtatctgttcactggtcagttacatattgacaatagtaaataaaaaaaatataaatatgcatttccaactgtattattttttcacctttctttaaaaagtaaaagaaagcaggtgtacatttggtgacctcaaatactcagaaaaaatatatatgaaaatataaaatttttacccactgaaaaatcagtgttcataagtaaaaacttgaaagtcattggattttaagatgtttctgaaaaccaagtcaatacttaaggacttaaaattgcagttttataaaatactcactgcatgatagatttcaggctgtttcatgtgtccaatgtcattcaaggttgcaaataaatttggcctttcaaaagcaagatgaatgacaaaaattctctgacatatagcatgtcttccaggttaggcatgacaaaagttcaatgatatcatcaaggctatcaatccatctgcaatgacatactgcagtctcttcaagaattaaatatgatgtttgtaagagcagtattgcatttctggttgtaggaaaaaaatagaattgcaaacacacaaaaagatctgttaaattacatacacaaataagctattaatttctatatttaaacaaatttgtgaatctgggttttttatatttgaccattctcctaaaacatgcttctgttttgaaaatcacatgatctacttagtctatagttgttgggttttagtgattgcttatactgctttcaagaactagcaagtgctgaacagagttggccacagaacaaagtaaagaggcagaatcagaagtgtttcaatttttactcacatctttctctaaaccaaatgtatttggtccaacttatcatgcatatttttgttcttacaggactgttttatgaaaattacccaaaaagtcaggcatatcttacatatcatagtcattttcaaatcaatagacttgctggagtgaagacctaagctccttactgcaattagcttttccagcaaattagtcaacttctgtttaggtcccagacttaatgtaattctgtataggttaagatacgacagtaatcaacatttctggaaaattcatatatgcccagatataattggggaatgcatttaaacaatgtactgggtctttatgatctcattttgagattacagaattatgaat

SEQ ID NO: 56121 - DNA, 1067 bp, Bovine  19866881352525
ttttttctgcttgttgtccactgcaaggcctagaatatatagggtaacattaaatcaatatttgttaaatgagtgagtgaataagtgaatgaatatttcacatattttcaagctatcatttccattactactgataatggaggcttttattataatttcctttgtaacatgcatgcatgctcagtctcttggtcatgtctgattcttttgtgactccacagactgtagctcaccaggctcctctgtccatgggatttcccaggtaagaatattggaatgggttgctatttcctcttccaggagattttcccaaaccaggggtcaaacttgcgtgtcttacggctcctaaacgggcaggtggattccttaccactgagccaccttttcttgtaacatctaatatcaaaagaaaacagtagaagtatattttccaactctaaatatgtgttatttaagtgtgctttgcatcatataaagtatatgtccctaaatagttgtaactaattacagtctttgtcaaacgaattatgcctttgagggaaatgctcatctttctaagatttgaaccttacagaatattctttctataagtgttgactcttaagatggtaatagtcacccctaatttaccaattttgtaactaggtttattgctactgctactgatatgggagaggattggaagggcacctctgattttatgccagaagaaataggaaaattagagaacatctttacatttcaagtttttttggatttttttcccccgtgatatgacaaagaacacaacttggattagtttcagcttggctagagaatacacactacacatatgctctttgactttggcagtgatatcttgtgatttcaggattttccttttggttggcaggtttttctttagatgaatgtatctttgatgaaaatgagatcttaatgaaaccttaattcagatactgtaaaatcacacactctctgtatagaaaaaaagaaatcctgaatagaaattttcactttacaccacatactaagagatacttttccccagattgcccagttctgatcac

SEQ ID NO: 56122 - DNA, 830 bp, Bovine  19866881353451
tcgagagatgttcaaggcatgaaatcaacaggacttttgaactgtctgcatatgagtggtgagaaacagggatggcatcaagcaaactgtgtttctgacttggaaaatggatagtttgccattattgaaaaaggaagactaggaataattttgtttgttttgctttgttaaggattgggttgaaagtggcagagaagagcagaaattttaagttaaagcacctttaggattgtgaagatttttggtaatggagttttagctttgacttacaacttatcctgccagcaccctgtttctaaatactgggtcagttcctttcctgtgggaaaaagaggtcatcacagactgacagtcaagggctgctgcccagccctgcactggacatgccctaaaactgaaagtgttagtcctttggttgtgtgcgactctttgtgagcccacaaactgtaacccgccagcctctgtccatggaattcttcaagcaagaatactgaaataggttgccataccctcccccaggggatcttcccaacccagggatcgaacccgggtctcctacattacaggcagattcttcactctctgaaccactggggatatgccctacagcccctctgattccacctctccctcctcagatcccagagccagcccagctgccaagaggagacctcagatggctcaggtgctccaggcttgagacctcaactcagaccacaatgtgtgacccttcacaatgctgattagggttgtccaactgctctaacctcacttcagctcttggtgggtttggggttcatcatcactggctcccctcgcttccatctaga

SEQ ID NO: 56123 - DNA, 828 bp, Bovine  19866881504674
tggaatttggccgtatagcagacagattatctgaattcctaaggaaaggagcgtaagaacttgaaattatcctatgctcgaaccatgaatatatttctgactcaattacaatgtacacattactttctgaatctccaccagtcctatcttcttgacaaccctactcaaaagttcagagccctaggagcctggatgtgagccatgaggacctttcctcagggaacattcacttctctcgtgaggacaggaacatctatatagtagacatgtagaaaagttctattagtgttttgggatgtaagttgtctaaatgacgggtagaagttgtggtatcgaatacatcagtatcatctcattgccagaagctgaatgctggttagaaaacaagcttcccaagctaaaacctgggaggataaaaccttttttcattgtagactccttgagaaattcttgaaagctatgtacctgctatctctgccctgtctctctttcttgtacacacacacacacatatatacgcatgcacccctatatgcaatttcgggggggacgcatccacttctctaaattcagtccatgttgagaagctattattcacactccaggttgagaagctattattcagtcagcttgatttttctataggttgctgcttcaggagagaaaaatctaaattctttcctataaacacatgaaaggctaaggattttttttttttatcacctctactctctctatagttggagactttgattcaataaattgcatataaagaagccctacctattcagcatcttttttcttgatatatatctgtctttatctcat

SEQ ID NO: 56124 - DNA, 1046 bp, Bovine  19866881089494
tacatttttatgggttaattgaggaccaattaagcccttgagcctgcaagtgattttaataggtcatttcatcagacatctcatctaattctcgagaactttctagaaatgccttacaaggaatgtaaggcattctacattaatctaatgtaatctgtgaatttacattaacacatgtgccaaaaccatacagtattgattttctaattttatagatgagggatttgaaacagattgatgcaagttgcacatctcagtagtttttgtgcaagtatttgaaactagatctaactggttctttcttgtacaacacattatctaacaaaacataagcaaatcaaattgttgattgcttctgttacacagattccgaatgagagaaggcttttgttttctaagttgatggttttgttttattctctatatatcagtgagttggaatgaatcattgactgagtaactcctgagtgtctccagagaactctgaatgtttgactgataaaatcaacatataatggatgagtttagaaatatatttagccttctaaagaagaatgaatcgttcccaaggtggaataagacttgactcattggtattagctaagtaaagaaaaaaaaatatgtcaagagaaaataagttgtcagcaatggaagctcagaaaattgcagagggaagaaaaccagtaatagcagtatatatccggacactgtccaaggaaagaagcattgaatctggatgatgtgagtcttgtctcaggaaaactcagtgcttgtcttcagtccaagcccctcatgtgagctatgccctttcctaggaagaggattattactgcgagtggtcaagtttgaaagcagtgatttgaccacgtttccttggagatatagctttagtttaagaaaaagtcttcaccagaataaaagcctcttctatactttcttgaaatcattttctttgcacaaagcgagcaagacagtcctgggtctactgatttacctgaatggggatcaatgtcaagctatctctaggctttaggacaaactatctc

SEQ ID NO: 56125 - DNA, 907 bp, Bovine  19866881353744
ggctttctccttccctctgctgcctttcacaagagggtttacatagtcctaacccatcattcgaccccacctgccatggtccacaggggtttcgttgcttttactcaccacatgttcacatctcaaggtgagctggtcaaggcagtcttgttctcacaaggccacgcacccagcaaaagcaaagccaaggttggtcaggatggaaacaaaaatgcagcccgccaagctggcccctttggcccattgcccacttcctggcacaggcgcccccattccaaactctttcccttaatttctagactctccttggtgtgaacccctcagaggaccccctgtgccactgttaaccctgaggacagagccccaggcccctcctgctgggctggccaagtgtcctgtgcagtcccggctctgttctgcccctgggccagtgctgaggcttagggcagacgtcctggctgcttttgctccatatctgtgcccaacaattggggaacaaagatcagggtggatacaaacatagaaaatgagaatttctcaggctttgccttggtcacatgggaggaaaacccaaggtgcccctcacccaatgtcctacaagatcacccccctgcagtccccatctgcagagaactaggacatcagaggccccaggagtcaggaaagtggctgaaaatgtccaagagtcagactggaaacttggactgaacttggcgttgctttccctgagcgctggagagctgatgaactgaactgatacccggtgagattccatttaacgagttgtttggcaagggctacttctgaaattaattatcaatcgtttctcattattcttagatggcatttcttaaatcacaaggcttgagggaacatgtgtgttgggggatgggttctccctcggctg

SEQ ID NO: 56126 - DNA, 1092 bp, Bovine  19866880616312
tcctgctaagaaattcccctttatttatttattgttaacgaagagataagagaatgtttttattgtgtgttttccagaccgacttgaaagcaattctcaactgcacgctgtcttttgttttaaaaagtaaaaatcactgagacgagtgatctgccctctttataggacccccatgtgggtgtgtaagctatgaacacatgtttttaagctttgcaggcatgtcctgtaatccaaattggaatccaacaacttggcatctcctgcttcttctccctctccacaagggacagctctcagatttccccattcacaagtgtattttttcctttgcttagcttatctggataaagggttggggaagaacttgtaccattgattccactacctggggtttgggtttcagatactgaagaccagccttacagagctggaatctcagaaatgttttcttgccccactaccaccccaaaactctcctctgaccagtcttgtcactgtctgaaggtttcccattagaggattccttccttttggattaaccatcttatctcccattatctcatctgaaaacaggatcctggagggcaggcctggatggtgtgccaaaggctagaggtagccaggggcaccttgcatacgaggtggtacccaagggtgaagggaaagagagtccagagagggcagacaaggcaccccaggggatctaaactaaagctacttgctcttttccttatttatttcttcattcaaaatgtgtttattaagctccaatatccccaccttaattctacatcaggacttagtattgagcatagctatataaaacagaaatttaatcaagttaattagcaagccaaaactgcactcaaacgtacatcaacagcaagagagctgatctgtgaatcagcagttggtcccacaactactcaggaggcaggtgctcgtatcacacctttagcagcagtttggaattaagtgagacaggatatcgacaaatggaagttttagcgaagtataaaaatatgaatagaaagcaggtgggggataatactaaaatagttcatctaaaaatagtctaattccatccagtag

SEQ ID NO: 56127 - DNA, 1216 bp, Bovine  19866880769352
ccctctccctccccactcccctttggcaacctcaaagtctgctctcacttggcaactcacaagtctgtgagcctcttgttttgtagataggttcatttatatcgtatttaaattccacatataagtgatatcatatggtattttttttctctttctgactgacttcacttagtatgataatctctagttgcatccattttgctgcaaatggcattatttcattctttttatttgtcttctgttttgttttatttcattttgggccatgctttgtgactttcggggaccttaattcccggaacagggattaaacctgcaccttcagcagtgacagaggggagtcctaaccattggaccaacagggatcccctattttgttctttttttatggtagagtagtgtttcattgtgtatatgcaccacttcttctttggtcattcatctgttgatggacattcaggttgtttccatgtcctggctattgtacacagtgctgctatgaacacaggggtacgtacattgttttgaattacagttttgtccacatatatgcccaggagtgtgatcacctccttcagcatgatttttatttctcaatctcattcccagtccttccctggcttgagtcactcattcatcaattcttctgtccttctgcctctgctatacctggttttatttctctggagattttaacatatggtccttgcatgaagaacaagcttctactttttctttctggttctgcctcagagcaaaattacaaatggaatctcctaatgttggatgaatttagacaaggcaacttacagcttcgatgggacagctttagttcagctcccagaccacttattcacagaggaatggtcaccacagtgtttggtttccaagaagtctggaggaaaacaggtgttttccctggaatgcagtttctgtgtcactgtggtaaacaggaattttcagacttgcagttaatgaaagcctttaaaattctctttggacgagactaatcaccaaggctgcctaacgtccctataacttagaatcttacaaggtttgttgcccaaatgtttgattttcctgcctgaaaacaatgatttgcatgtgaatcactgaccacatggtaatgcttaacatcatccctttaaacccattggagaccagtgagtggtgattaaactgacagtgcggaacaagcctttctaggcctgctgct

SEQ ID NO: 56128 - DNA, 1099 bp, Bovine  19866880778152
atcatctagccaaaattatttccccagacccctacactcgactatgaaaatgccaagtaaacatgaatataaagtgagtatctggttggctcttaaagcaaatttgttataggtcttataatataaaaatgtttaagtttgagatttccctgtggtccactgattaagacttcacccttccaatgcaggggatgtgggtttgatccctggttgggaagctaagatcccacatgcctcgtagccaaaaaaccaaaacatagaacagaaacaatattgtaacaaattcaataaagactttaaaaattgttcatatcaaagaataaaaaactttaaaaaatatgtttatgtgatttttcttaaatcttttaaaacagctccagaagtatttaagataaactttatatttccaaatggagacaagtatggtaagcatacatttcaattactttttcctatatagattaaaattaaatagcttaagagtgcaaaactgagactgtcacacttgataaaagtacttttgagatattaactccattaaataaaatcacacagaaatactgatggagagaaaaaaagatactaatggaggaacagattttaaatctttaactctaaagtatagacagtgtgccttggaaacctatgggaaggccatagccatatgtcagtcttccaggcccttgagtcaatgatttaaaggtccatggagcacctcatctctggtctcattagttttagttataggaaagcagagagacccactgtgatgcagttttgattaagcctgaacatactttattatttagccaaacagggttctcgtttataatcttcagtatttctctcttacttagatggggactgtataagaacatcttctggagtcattgagagaaatggaataggtattcataccactcctaatgggattgtctacacaggaagctggaaagatgacaaggtattattattgttttgaatattgacagtggataagtaactctgttggttaaatgattcctggcatttcaccatttcaaaaaacacgtatgagtaagccatgcaataaaaataacaaattattatatttaatata

SEQ ID NO: 56129 - DNA, 1537 bp, Bovine  19866881067471
ctacctaatgcaattgttgtgaggctgaaaatgctcatttcagtagaactcatgtttcttggttccctggagaattggcacataccttacacccccttaaacttgagaagtgattcagcaatttcctaaaggaccttgcaaggaagcatacagctttatatggcatctgctcggtagcaatgtatgtgattcagtctaatgatctcagccatcctacaaagaagatactttcttcttccctaaacagagggaaaaatcagagcttaggggagttgactgcaccatacctgggatccctcggagactagaactcaggtctgtctgactcagcatttatccatttctcactgtgccccactggctcacactttggatacagatggatatagaaataaaacctaggcttctcacgaagtcatcaggagcctgtacactcaagtagcccatggagaaatgggagaagagacagtgggacctctagaagacacccacctcaggactgttttgtggagacagctgagacaggtgagaggcctgtgtccacccagtgggtgtcacttctttctctctctctttccttctccagtatctatttggacaagatcgggcatgttcagggtagtatggccatggactccagtatctatttaggatgaccccaaagccaagggtccacagaatacatttcctgtcccacactgggctctcaaagctgcctaactgccctccagcagttgggccgggtggaatggaacctgattggggaacagcttggaagctgagtgggggtgaagggtcggcagtggcaggctttgctctaactccctttcatggtacaggctgccgcctcctcctggcctgctttctgatatccctaaggcctctccaagtagggagagtggaaggacagagcagatgtggccaatcaagagatgccatcctctaatcaggtcaccccagcagccccctgtctaacccagttggcgctgagctttttgcttggggatcattttgttctgtaacagtaacgctgacctcaagctaggccactctgtccagaaccttgcttgatctaaagcaactctccctgggagttctgtcttgctggcaaggtctccagaaggaggcggtgccgtttagccaggggagtcagcaaatggcctttcccccagcttggcctgcttagataatctgctgatgggttttctttgagtacagaaggatcctgatttcctagagatgtgtgaaaaagagcctcagtttatcagagaagacatcaaagttgctatatagaagctcgtgatataaaaatcaatttggatttttatccaaaatttttatcaaaatcgaaattgatttttataaccagtcagttaggaaacaaaaacttttaaagtgaacatttataagaaacaaagctatgaggggccaggaataaatccaatgagatatatgtatgatctctatgaagaaaattacaaaacttcacttacttaggtattctttgctagagagatgaggcatgttcatgatatga

SEQ ID NO: 56130 - DNA, 804 bp, Bovine  19866881075529
ccaattgaggtgagtgtatcaaaatgttaccacatgtccatcatgccttagctgcaagggaggctaggagaacctggcgctttcagccttcccataaggggaggcctctgatcaagctgcataaggttggggaattcccccatcactgaaaaggattaaaattctagatgggataaaaagagtgccagtgtccacaatactatttttacttgttagattgcattctgaaccagcagcttcatgtcaaaacatcacaccagccaggccacatttgagtagcatctcctggtataaagaagtctacagatggtgcaagtggggacaaggccatcacagaacttactgtttaatgaaatagaaacagatatatcagccttcatgcttactcaagttaatttccccaaactataccctgctaataaaattaatgggtttaagttaatggtttgatccccaacagaattcagtatattaaaaactaccataattttaagtaatgaaattcatacttgctgacaaaatatttacctttgagttttaagctaaatatgtgctcaacttaatattttccctcttctgaagctgcacataacacctgttgcttctgtgtttgtttcaattttttaaagttagcacataaagtaagtccagtcacttcacctgttcccttactcttgatttcaactgacaggtctggggacgaggggatggcctgatccagggacgatgaagatgcaatgttgaataagctggaggagagaagcaacaggcaccaggaaaagaccaaaaccaagcaaggttaga

SEQ ID NO: 56131 - DNA, 847 bp, Bovine  19866881198782
cttggaaaatggggccctctcgtagggaaggaaaaaggaattttggctaaaattaaattttagcttttttgcgtattataggaaaagcagagttcatttcaactcagaaaacatttatttagcccatactatgtaaaaggcattgtgccagatcttgggagggaatataaaaatgatatttttatatcatttttcctccttcagggagtttacagactagtgggaaagatgagacatacatatagctatagcatatgatggattgggaaaatgcagtaagaaaagtataaagtacctaaaacttgcagagaaaaaaaaaaatgagttctggtcatggggattaaagaaagtgtcataaagaagataggttatgagcttgactgtgaacagtatgtagatatggcacaaaggggatcagtgaagtggacagtgatcagaggtggacagttgcaatgcatcagaggatttaggggttccaggaagtatcattggtagagtagagggtaagcctggataggtggattagagacagataaagggcagtcaatatcttcctgggagtctcatctgatgtggacagaataaggagttactgaaagcctctgagcaggggaataaccagatcacatgttctcagtaagaagatgacaattttgactgcagaggaaagaccagctgcagagtggctaagatgggcacctttaataatccaagtaaaaggcaatgatggcctgaattaggggaagtgactattagaatggaaaggagggcacagacagagcaatatttcaaaggttactgcatgagctaaatgtatgctttgcccagaaaaaaaaaaaaagagttg

SEQ ID NO: 56132 - DNA, 1233 bp, Bovine  19866881353970
aatcagatctgagccctaggctctaccactgagtctctgcagttgttattcagtctctcagttgtgtccgattcattgtgaccccatgcagccactgaatcactgcaggatcttgagcaaatcagttgttcttctggcttcattttctcatctgtaaactgggaattctgagtcagatttcaaatgcccgttccacatccctgaccctgatccagtgttggggtgggggtgtagggagtgttcccagccattgctgggttctgctctttacctgatggatgagtgggggaatgaggagccactctcgatcagccctgggctctttctcctctgctttccctctgccactgggctagagtttgctgttagccaacctctataggaagctgggagcggttctggtagcagccaggctccatacgagatcacgctgtggagctgaagagggatcgcagagagccacggactagggctgccttcacatcactgcagatggtttctttcaagatgaatgggctgtccctgccgcgttttcttttcaaaatgtcatgctgtatttttgagagcacatgaagaaataaataaagtgttaacagtaaaaaataaatagaagtgggacttcccttgtattttgctgattgatctggaggagtgggactcagggtggggaacttcactgctgtgacatgtgggctgctaggtccagcgtatggagattctccaatacgtagtgacattgaggacaagaacagcctcttgtagcccctgctaacagtttctgttatcggccatccagtgtgtcctgatcacagaggagacttgtcttacagtaatgagcaaagacagagcccatgatgcctccattttcatttgaaataaatcatgtcagcctggcccgcagtcaatatgaatttgatgtacagcaaataaaagcagctctaacttgagcagacacaatccattaccctgccatctgttgtgtcctggtttccatatagggataataaaaagataggagtttcctgaaagcttggcattttgggtgcaggggaaaacacactacctttgtgttgtgtgctccgtcgttcagtcacgttcaactctttgcgaccctgtggactgtaacccactaggctcctctgtctacaggattttccaggcaagaatactggagtgggttgccatttcttcctgcagggaattttcctgacccagagatcgaacccgcgtctc

SEQ ID NO: 56133 - DNA, 1188 bp, Bovine  19866881417542
ttgttatttaagtttctttagattctttttctattctgaatctactggaacaaaaattcttgtaaataaatatttggttttatgcttgactatcaggattctgtgaaattttgggggcccttcttgccaggtgtcctcatgagaatgaagtcatctttaaacactacatgacaatctttggctgcaccaccaagtcatccagggaagaccgcatgacctaggaattcaactgcttccttttgatcgtctcattattggatgattatccaaaatacttcattgtgggagcagaaaatgtgggctctaagcagatggagccaaaccacatactcctccatgggaaggccgtggtgctgatgggcaagaacacgtgacatgcgaggccacggaggacatctggcagacagcccaactcccccccatctcctgtcttcactaaatcacatggtaaaccacatttggtaaatttcctcagagatatccaacacattttcgcaatgcctcagaagctccagatgtggagaagacagtgccccagatggaatttagaagacattcctctggtgtgtttctcatattataggcacttttctccctacttactttgcagtaggaagggtaaaggaggtgggagagccacagggctgtaggcctgctgtggtcaattgggtctggttctgtgtagagtctggtgctcatctctgcaggagtttgcttcttgatcctaaaagctacttttatgattgtccttcttcagggctagaatgatgagccttgtcatttattcagggctactcttttgggagggatttatcttttatctgtatcctattttaaaaaataattcctgggggatttgtctgcaatggcatatatgaactgtatcacatgtatcaactcctcttgactggtaatggataactggagaactaggtggagaaacagattcatggtttagaagaaaagatgctagaatagtttaccaatacgaattaggaatgtgtgtgttgggaaaagtatatttctgattctgagtctatattctcagtgcttaggatgctagattagggaaggcattaggaatgaccattaggaaacaggtggaggtaaaatcagttgaaaaaattaccagagagttcctggttggcaccttggatggggtgggcttaaataatgttcccttgagcc

SEQ ID NO: 56134 - DNA, 746 bp, Bovine  19866881936122
tggtacatattgtctttaatcccttttctgttctgcctaaagtcaactctctgatcccaaaactgtgagacaggcgttcattccctgtctttcctaagtcaaaggttgtcatcctttcactcaggggctcccctgcctactatagtcagatggtctagagaaaggtgggtcctggaacacagccagcaatctccttcatgagagcagcctctttcctggatcaccttaccatgcattgactctagggcctagggctgtgccttgcaaaggcatgcttgaagggacttagtgaggtgtgccaggtgaggacactgtgcaatgacttcaactcaccttgtcaaaccctttgactcctccatgcaggctgttgggcccgttgttaatggctagtttatactccttcccatccaacgtgaacgttcctttggcaattcggttggccaccctgccaaccacagctccaaagtagggctgcttttggaggtaccctgcaaggatatgggatgacagcgattttaaaaccttcaagccaaaaatgaggctcacactgctgcccaccacttccttctaagggcagctgtaagtattaacaacatgggcataccacatgtgcatggaagcagggaaaattggtgttctttacacaccacccttcccctttccaaaagtaattcatattctttacaaacattttaaaaaactaaagcacaaagaagaaacttaaatcatcctgatcttatcactag

SEQ ID NO: 56135 - DNA, 657 bp, Bovine  19866882076203
ctctgagcctctttttgaacctcttggttctatgtgtgtgttagtcgctcgtgtctgactctttgcgaccccatgacctgtagcttgccaggctcttctgtttatgggatttctcaggcaagaatactggagtgggttgccattctcttctccaggggatcttccccacccaaggattgaacgcgggtctcctgcattcaaggcagattctcaaccatctgagccaccagggaagccctcgcctggttgtgatggtgactaaataaccaggcaaaactcatgggcaggtgctacaaaaaaattttctttgctatgttcagaagcccccagccttctgtgttttaaattccctaatctaatccatcctgttttctgaactttaatcagccccctgccctttgagtgcattgctgtccctgaggcactggctcacccagcagcctcctttgagcctgcaaacaatagaaatatttgtttcctggcaaggtttctataccaagaatggtttctaggcctgaggaggctgcccctgggagagagcatgctggacatggttcccagaacaggagtggacacaagcgcctgtgtacaatcttgtcctcagttacctgacaccagtctccaggggaattagccaaagacatctcaaatgtcagg

SEQ ID NO: 56136 - DNA, 968 bp, Bovine  19866880533228
ttttactttatatacagacctattaatatatacagactttatatagagacaaatttaagtggttggaaactcttaattatgtgaattgtcaatattcaagacattcattataagattcacaatgttacttaatcctacccctactagtagtaatgtaaccttggtaaaattattatattttagtattaacttcccatttctataaaacggagaaagttgcttcccttgctgatggtttgttcaacaaatatttcgtgcctagtctggggctgcaatgtgctagagtggacaactacctgtcacaaaaacatgggacacaggacagtcagtcagtcagtcctaataaacacgggactcaggagtcagtcagtcagtcagtcctaataaacacgggactcaggacagtcagtcagtcagtcctaataaacacgggactcaggacactcagtcagtcagtcctaataaacgtgggactcaggtcagtcagtcagtcagtcctaataaacatgggactcaggtcagtcagtcagtcagtcctaataaacatgggactcaggtcagtcagtcagtcagtcctaataaacacgggactcaggacagtcagtcagtcagtcctaataaacacgggactcaggtcagtcagtcagtcagtcctaataaacatgggactcaggtcagtcagtcagtcctaataaacatgggactcaggtcagtcagtcagtcagtcctaataaacatgggactcaggacagtcagtcagtcagtcctaataaacacgggactcaggacagtcagtcagtcagtcctaataaacatgggactcaggtcagtcagtcagtcagtcctaataaacatgggactcaggtcagtcagtcagtcagtcctaataaacatgggacacaggacagtcagtcagtcctaataaacatgggactcaggacagtcagtcagtcagtcctaataaacat

SEQ ID NO: 56137 - DNA, 2080 bp, Bovine  19866880535123
tgtatgttcctcggctctttgtctcgtcacaacaaagatttggagtgacggacattaaagccccctcggcgtgtcacagctctcaggtcttggacagaccgtgttatagctctcaggtctcgaatggaccatgttatagctcttagacaaatcagtgttacagctcagtgttacagctctattttatttagaagatagcaggaaaatccatctttgaggagtgagggcacgttgatccaaagacgccaggagaagagcaccccagctcgagggggaaagagagagagctagctttggctcctctttttatatgtttatctctccctgcgcctgccctatgtacattgggccagccaggagtgttgttcgttttacctgaggtcctcactctggtcctcggaccttcttttgttctattttcgtgggcttttcccttccttgtcttttagccaccgccattttggactccctttccctattctacctacctaacaatcagatgggaggagtgtgtgtctacggaaatcatctaactggggtttttatacaaatgagccgtaggttttgcaccctatctgttcatttagcataggtatggacggagaaagctggtggtagctctgaggagagccaaagatccccacaagccactcaatccttgacacagcgccttcttttgtttgggaggatggcctcaatgcggagtagaaacaaaggtgggagtccagagaatactcactgacagtgcgctatttttgtgcctggtaattttaccctgacattcaagagggtgagaattacacaacatctgtatcttagtgagaaaaaggacttggtcaacttcacgcatccctgagattcaaaccacgcttgcaagagactcagtcctctgctaatgcctgaagcactcctcagtagtggacaaatctagatgtttctcctctccgatctccttcacaattctttacactgttaaaaatgtcttttccactaaacagcaaggaacttaggctacatgtgaaattttgaggaagccagagacaggaagtaggtaagaaggtctttatttcaaaagattaacatttgcatttggcatgtccttttcctctcaattttggatttgggatttgggggttcaggggtagaaaaataagatggttatttcctctctaatcaatcattctaatctctataataagttgaacatctctgatctatcagaaaaagaaatatttcagaaggcagaaggatggaggcaaaaaagttctaaaatattcacctcttctctcgaaccatccagctgtcagcgcctccaacacagttagtacttcataggcacaacaaagatagggggtatttcaatcatcagtgagcaacgacagctgctatttccaaacaagggagaaaaaagtaagactacttctgaagaaaacattttgttttcatctctaaatgtatacatgtatacactgtatacatatgtatacatctctaaatgtatgtatgtgtgctgtgtatcagtaaaagaaaaatactgttcatattgttaagctcagttaaacctcttagatatggaaatggaaaggccctcctttattaatgagctcaactctagaattaattcaaattactactggctaacgtttcttgcctggagaatcccatggacagaggagcctagcaggctatagtccatagggttgtgaagagcctgacacgactgaagctacttagcacagcacaatgtttcctgaatcactcatttcctctaagtttcattcattctcacaaaaaggtaaatgggcttttaagcttgctaaatgtaaaaaaaacaaaagtattcatgtatcagatccaaaaccactaagctgcagtgatagcaagtttccgtaacatgtttcttggtatgctgtaatcaagtttaaacaatggtatttctggtcctaaagtgggttgtggatataagaactagtttttcttgcccagacaagcaatatggaatgaacgattacaaagaagtagctgcaagaactgcaagagccaatctacacaaacacacacaatgtagtatttaatagca

SEQ ID NO: 56138 - DNA, 2071 bp, Bovine  19866880677656
tttgtcccattccttcatcggactggatgtgactgaggttgagtggtcacctcggggaggcaatctattttattcagtttgctgtttcaaatgttaatctcacccagaaaccttcacgaacacacccagaataatttttaatcaaacatttgggcatctcatggtgtagtcaagatgacatataaatttaaccatcacaccctccaaatctgagaagtttgaagcagtgaggggcaaaaccagatttcttagaagaaacacttgtagggagaaaccttataaagagactgttgttgccgtttaggaaacagttgtacaatttcagttatcaaatatgtcgggactgagcaaagccatagtgacagaaagctgccagaacttggaggcagggttggaactggggaacggctgctgatggcatggggctcctttctgggctgagaagcatgttctggagttagacgttggtgatggtggcacgacttgtgaatctgatacagaccactggactgctgcctttgaaatggtgaatttctagcacgtggagtaaatgtcagaatgcatacatgtctattgagggaggcatgaagaggtggaggtggataatgtgacgtctctgagacgtgaagatgtaaacaaacatgggctgacagaagggaatgtggggttgagggcggatttaaaaagcacaggacgtcgtgcagcgtgtctatggattcaaacggcccactggaaaaggaaacgttaacaatgcaaggtaaggccgggggagtttgcagtggtgaaatcctgcagtgctgtcctaactctctctcttccctgctctccccaggtgacggaccagtccgtgaaagcgttcgctgagcactgtcctgagctgcagtacgttggcttcatgggttgttcggttacttctaaaggagtcattcacctaaccaaggtaggttccacggctacatctcctcggtgtttcccagcatcattcataccaatgccctcgcagtgttccacatacttgaatgaggactggtcagaccataatagaagtgtaagtagtgtttggtataataaaaatcagcttaagtcaacaatataaaatctatcctttctgaaatgggacattcatttaaacaagaagcttgctttttggcattttttcctttgctaataactgtgaatgtatgcagtaaagaaactgatatatatgacaagaattatttagattttaatgttatgtattgttttagatactttaatgaaagttttcactggtcatgtatcattagatcttctgagtatttggcttttaagaagtgcatatggtcagttcatatgattaagctgaacatacatggtgaaaagagaagtgaatgtatgccaaaatttaacttcatagttcagagaatttccttatatacaaatataggaagtctcatattttagcgataatgaaaacatcagttcctttgtaatctctcacttgtcatgcatcatctgtgctgtttttcagagttctataataattatgaactaattcttacatacatgttttagaaaactggctactataaaatttacttgtgtcttattcaaaatttgtcatgtctcttcaagcttacagtttagggaaaagaatttacagtttctttcctcctagtgaaagtgaaagtcgctcagtcatatccaactctttgagaccctatggactatacagtccatggaattctccaggccagaagactggagtgggtagcctttccctcctccaggggatcttcccaacccagggatcaaacccaggtctcctgcattgcaggttgattctttaccagttgagccaccagaggagcccaagaatactggagtgggtagcctatcccttctccagtggatcttcctggcccaggaatcgaaccggggtctcctgcattgcaggcggattctttaccaactgagctaccagggaagccctctttcctcctaggaaaagagcaaatgtttataaattacctaggactgtggcaataaggcccagagggtaggaacccaggctctgttgtcagcttgggtt

SEQ ID NO: 56139 - DNA, 1522 bp, Bovine  19866880823919
taatctgtacagtattatgtgatttttcaaatagctgatgatatttttctatagaacagaaagtttctctgatgaaatgatgtgtgcatttatcctcagatgaaattcaaattaaaggtactttttcattgttttgtatgtagtgatactggatatcagttctgatattggttttttgagtaattctaattattgaatatcacttacaggaaatattaattaatatatagcactaaagcatttaacctagtacagttacttgaaaggaaaatctatatgagatcatctgtatcttatctgtgtcagccaggtttgatacttaactccagttctgaagatgagatggaagctggatttgacgtagatgagtttgtcttattgattctccatgtttgcattattttgtcctgtggaataatgtcaatttttatgacagttccaacatacagtggtaatttttaatttctactttgtctttggttcctagtgagtgataataatgtaaaagtaaacatttttgtaagtaataataatagagcttttatagtatcatattattggtattcctggatgtgctatttaaatattgttactgattctatgtttttaaggcaatataaagataagtgagtgtatatattaagcagttagtttgtgggattaaaaatcatgttttatatgttatgaaatcagaattcatgatcaaattatgggaaaggatggacacaatttatatgatgaagaatgcactgctgtgcattgggaggcttcctaacctcaaacccattttaaaattgccaacattgaacaaaatcttcatctcttgatgaaaatgataatagtttattgactgttcaaatatatgacttcctgccctgcctccccttccctgagtagttgtcttattcttaatccccaaccagaaatggtaattaaaataactcactgttgtcaaaattttaaaatgtatgataaatgaagcccagtaaatagtgaaaatatgagaaaggtgattaaatctgacaatttccttgtaaaaggcttgagatgataaatatctcctgtgattagttattaattttgtgcaagagattttgcttcagcctaaaatattttatgaacagtggcgtaaagaaatatcttagaagataggtacacacatgtttaaccagaggaaaaattgctggaacttgactggtaataattaaaaatggcagacttgacatgtatgtgcctgggccattttctgtatgatggcccttttagaaattaaaaaagaagacacgacgacatgaagaatgacacagtactttcagcttgaacctttttgcctcatgaagacggaaaggttttatgtatctcattcctcaactgataaaatatttaatttaaggttgtataaaataactccttgctgactgaagttcaaaagttattgagacttgtttcattaacagttcagttgcactgcgaataattgccttaaaaagaatggaattccttatgttaaggaaaagaggaa

SEQ ID NO: 56140 - DNA, 1424 bp, Bovine  19866881078091
atctggtttttaagacattccaaaaatcctgattacgttatgagaagccatgcaagaagccaaatacacatctgtctagagaaaatgtcatcagccaatgccatctttggtggttagggacattcctcctatgtgaacaagcctccttagtgggcattactgaaactagataatttgactcgataattacagattacagataaccctgtgctaccattcgggaaagataatctactcaatttatttttaaaggaaatcttgtgtgtctaacatattccaattttgctttaattatctcaaagtcctacctgagtgacagatctacaatataggctcatatggaatagtcaccatttttgaaaaatagtggcaattctaacattctgtcgttatattgcttactaatcttaactgccatgatttcaaaagacagttccaaagtgcatcttgaacaaacagaaaagcaattagcctaaattaattgctttgctgatgtgatttgcagtagggatgcctggtggttttgcaactcctgccagtgctttcacaagttgatgttctgatgattttttagcctatttttgcaccagagcaattaaccagataattgttctaatgtgaacctgcccttaatcagtatgcttaggttcatactaacaattaaccaaatattaaacatacacttaaatagcagcactcaaaagtgctacgggaagaattaagaaaaaacttgcaacaattttctcatacagccatactcttctcaccaagaaacagaaaaaaatgctgtacctgtctcctctgcctcttttcaattaatacaagatatcattacatatgaagagcaaagttactgggtcttcatttaaaagtattccaaagattctattcaaaagacagaagccaatgattcaacattaaaacctatgaggagggcacggcaacccactccagtattcttgcctggagaatccccgtggacagaggagcctgcaaagagtcggtcatgactgagagactaagcacagagcacaccgtccaagaatcggagctaccgcttccagacaggaagtatgcactacagaaagcaagctctacctgagtccagacgaggacaggagcccttactttagaaagtaccaatttaattcagaaataaataaagcctggggaaaataggacatgagagccaactgcctggattttaaccagagctcaagccaaatttaaaaacaaacttacacatcctacaaaagcagcatttataattccctcaacacacaggcattaaattactcctctgagctgggttctatgcgaggtaccgggggctgaggttggggcagagggccatagccaaagaggcaggttccccttacaaggagagagtcatgagcaaaacatcacacagccacataatgtcg

SEQ ID NO: 56141 - DNA, 2842 bp, Bovine  19866881110553
ctttctttttctttcccttgaacactagcttatgctcactgggtttatttgtattgccatgtaatcaatcaacacacatttactaaacttctggtcagaagcccaggactacggaaaagacaaaattctcagatacagttttaattcctatgtggttatcaatgtcacattctaagaaatttataatccatctgaatataaattaaaactaaaagaaaaaaattcaacctactctctctctctccaaatgtgagattctccaggtacatattcacacaaaatattaatctctctctgtgtgtgtaacacaacaaaacatcaaaatactaaaacatattggtaacttgctattgaaaaaaaaaagattaatcaaaaccaaaaataagaaccgagtttaaattcaagttaaaaggaaaacaaatggaaattgtatttcccaaatgaaacaacttctcaaaataccataataaatcacggagggaaatgtttccaggctttatttaacaggcaataaaaccccgaggcaggtttgattagtgtgctgctgtagtaaatggtaagatgagctatggtatacatatcaaaaccacctactagcctcaactagtttactgatgcatggtctttaaggtgagacttaaaattaaacgtaaaagtgtttaaaacatgaaaagacgttcacttctgtttgtggaattttttgtggtatttttgtcataggtgttagtaccattattgactacatgccatagaagttatgtccttacaagacttattattaaaaaacacagatgttaaagacaaatgtaacagtgattaagtttcagccataattcttctaagaggtggactccttctttccacttctccctaacttgacaatagggtagaaaaggttctattctgaataatatgaaacacggaaaactgttttaaatatatctaaaatcaaggccctttacttatgtacttttaagtttgtatccacactatacctttcagaagacctgactttttccccttgcattttttaggtgaatactcaaaattaaacagtaacactagaaacttcaaagggagtgttattttattctaattttatttaatcaaggatatttattttattacaatgcaatttagctagcacttacattcaacagactctactggtaggtttaactgcttattgcaactgaatgtattttaaaacttggaataagctttcgtgagaagtttggtagacgggactgaggtcagggaaatctgcattcagtcctgactgtacttactagctgtgattgtccacaagatcctttacctttctgagtctttttttttttaacttcatctataaaatagagtataatgatacctatagggcttcccccggtggctcagatcctttgaagaaggaaatggcaacccactccagtattcttgcctggagaatcccatggacagagaagcctggtggcctacagtccataggggtcgcaaagagtcagacataactgaactgacttagcacacacgcatgcagtgatccctatgtcacagagttgatgtgataattaaatagggtaatgaataaaacactctgggcaacttactataaaatttcaacatagatcagctacaaaatcactgtctgagtaagaaaccacaccaacacttcgtagcttaacaaccacccttatctgctcacaggtccctggaccaacaacttggaccgggctcagcggtgcaggcctgctggttttattcacagggctgcagggatccaaagttctgcaaagtgaggctggatggtctgacccggcctcacggacatgtctgacagatgaccccggctagacctccatctccaggtgatctcccattcccagagagacaactctgggcttcctcaggcggggcagcttccagaaaggcaagaacaaaagttgcaaggcctcctgaagccaaacctttgaaggcctcccacaaaatttccactgcatcctcttagttagagcaagtcacaaagccagggcaggtgcgaggggctagggaaagacgccctcttgatgtaggatagctacaccctagtgcacacaggcctgcacacagccgtgggccaagtgtgtggctacagtttgcgatcttctaaagcctgcgaaatactgacaacttttataacacctatgccacctttcaactataaataactgcagaattcatgtcttaaaaccaaaaagaagaactagcttgagttccccccaatctagagaatactgttctgtcgcttcaatgacagacttaaaagaagaccagcatccagacctggtgactgatatcatcatttagatttctttgtttttctgtgttctaagagtcctccacatttttctatttaatctaatcagtatatttattttcatctgatttgatattttaaccttcagcatgtagctttctagtcaaacaattcacaatgaatagaatcacccagaaatctggatcagtatgctgtacttctagaaactatgactttttattttaaaaagtaaagaaaaacatatcattgtaaaaactaaatatccttttgtttttctccatgaaaatgatcactagagaaaaataattttgtctatagttcatcagcgaggctttagagatctagtcatacagatttaaacagaaataaagaacaagatttttagagccactaacaagcaaaacgtagaatgccaaagcaaaacttgaagtttaatttattgtatcaaatctcattttaatgactatctttctaaattttttgtcacagctacagaaagtcactaaatgataaatgctaccaaaa

SEQ ID NO: 56142 - DNA, 1671 bp, Bovine  19866881125713
cgtaaaagtggggtgtatgtgtgtgtgtgtgtgcgcgtgcattcagttgagtccagctctttgcgaccccatggactattagcccttcaggctcctctgtccatggtgtgttccagacaagaatattggagtgggttaccatttcctcctccaggggatcttcccaacccagggactgaacccatgtctcctgtgtttcctgcattgcaggcggattctttgcctgctgagcctttggggaagctcaaaagtgggttgggattatctaattcagaggtgatgaagaagctgggttaatggtggtgaattataaaaccacataagtagaaactgataatccaagaaagcactttcacctaaaaaggattaaaattaaagactaagaaaatatggatgggaaaagcttttacttaaatttcaggactctaaacaaagagatgcagcttcttcttattttaagacaaagtttccttagaacatgggtggagagatctatctttatcagaataagactgagtcaatgaaaagggatttgtaatctgtgctgaaagattaaatttggggaatgatgctagcgtatcaatagaagaaagaaatttatatcattaattctaaaaaggtcaagaaatctttgtacatttttacacttgggacattaaagaattgttccatataatcctacatgaatgtattaaataatataaagtatttcacaacttcactcagaaaaaagttttcactagagttcaccccaaacctacaaattcagacttggaaatacatacttctaataagttctcttaaagagttcaccccaaacctacaaattcagacttggaaatacatacttctaataagttctcttaaagattcttatggagtcaagtcataaacaactcacaactaaatctaacaactaaccagcctttccaagtgttagcactgaagatggtcctgggcacacgtggcgtcacggggttatctctttgctgacctatactgacaccacagaccaccaaggtccaggacatgccatccttctgggcattttcagcagcctgcacactgaacgtccttctgccacttttgattccacaaatctatcctccacccatcgagccatagcgatctttcaacgtgtacaaatcacattgtgtcagtctgccattcacaatcctccagtgataccaattactcgaagtataaaatccaaactcctataatctacaaggccctgcacaatctgcctcctccctagttcttccacctcgttcatcatcccaccatcccctatccaggtctgaaacgaagtctgaagaagtaaccaccgctatggagggttggatgtctggcagaagggttgtgatttggtttggaaggaatctattttattgataacgtgagacatacatgggttaaagaaactatgaggtccccttgagttccagcctcctgcacgcacctaccgcatggtgccgttcattaaaggctctaagggaagggtgataaagggaagctgtccttcaaggcccatcaggtaaactgaggaccaactaaagggatattctggcctcagggaggctgccagtgggtcacgcctacagcagggtcctgccctgtgagaagagcagtatactacagcaaggggcgccttcagcactaggccgagcc

SEQ ID NO: 56143 - DNA, 1703 bp, Bovine  19866881143858
ctcctctgtcctggaattctcctggcgagaatgttggagtgggttgccgtttcctactccagggatcttcccgacccagggatcaaacccacatctcttgagttgctgactggcaggcaggctctctgccaccacaccacccgggaagcccagagaagctgatcacctcccacacagactcctaagtgacactgtactatttttaaataccgaatctgtctcaaattgggaaaataatttattgaaagctttaatctccatttggtagctctatcttagcaaatttttagaactgagggaacaaaatcaagagcgtggtgattaaagagatggagctcagagctgaggtctaatcctggtttcaccactaacggggatcctagacaaattatttagtcattcttagttacaagtccctcatctgtaaatggaaacaatgcctacattgtagctttgtatttggtgtgtgtgtggtgaagagatgcctttccatttcagcttggtccacactgttgacctgtcttactgccggacttccctacggttctgctctcctttacgttcacaactgtacacacgacaccaacaatagaaagcacaagacaaaaagcctccatgagaagatactgctgcagacacaacacagtgttgtaatcttccgcatgtgtctcatgcttgactgtctaaagaattcctggcagaagaaatatttaaattacatcatttataagatgggatatcttatgacaaagcaattttctcatggcattttttttctaccaataatatatactattctaaacaatgtaaagtcagagttgagagactgctgctgctgctaagtcacttcagtcgtgtccgactccgtgtgaccccatagatggcagcccaccaggctcccccgtccctgggattctccaggcaagaacactggagtgggttgccattatattaactagtaggaaaagtcagacatatgataaaccccacagtaaagccaatcagaggggggaagaaagggtatttgccatcggaattagtggatactctgcaaatacgtataccatcttgtgaaactatggaactatctaatttttctgtctaaaggttttattctatgtgagccagttaatctgtccttactctgcttaaaaccatcagctgtgacttcactttgatagaatttggaaaacaatcagagcaaagaagacccatttcatcagctttatataattatgcagaaggtaacgtgtattcagtaattcaatttctaaaattctgaaaacttcctgcagcttatgcttttaagctgcagtcattttgttttccagtggcacgaagaactttcaaacagcattccttagaaaaacgtacaaagctgggcattgtctctgcttcaaaaatagtaatttgttgtttttgttgcttaaatgatcatttggtcaggggagcctatcatctgatattttccatgtaaatctgccctaggaatttaagaagcaataaaacacagcactggtcagcagaggtttgtgaacactaaaactaaagaaatcatgtgagagattaattttgagctctcacgtcatgtcacacattttatcaggaagtctcatactcctgcagtaaaactttgtcaactgtttcacaggaaagatactttctctttcatttaccacaatgcgtatattgctttcattctg

SEQ ID NO: 56144 - DNA, 636 bp, Bovine  19866881169138
aaaaatcttaacatgtcacatgcgtacattcagaagggcatgaagacatgtatttttcttccctattaagtattttacatgtgctcataatctactttggaagatctctaagcaacttttataaataccatcagatggcaaacctgtttacctataatatgaaaatgaagcaagaactgggaacagaaatcagtgggaacctcagatgctttctcacttaatatgtggtatttatttaacctttaccatactgttatgaaggaggagaaaggatgatatttatgcccattatgtgggaaaactcaagctacataaaatttaaataaattattttagtaagctattaacaaagaaactggagaacagaagtctcctccagctttccccctacatagtacagagaataaatcaactcggtagctattcaaattaatgagatgaaatctaacatcgaactgatttgataatttcctgacaactgaggtcatttttctctccaacaaatcttagtatttgttgtgttaggaacctttatgtacaatttatcattgttaatattaggccagaggtaataaatggcaaatgtagttacatttcattcacaataagggctgatgtaatgataaacggcatcat

SEQ ID NO: 56145 - DNA, 2526 bp, Bovine  19866881268540
ctgcgtccttcgtcgtgtccgactctgtgcgaccccatagacagcagcccaccaggctcccctgtccctgggattctccaggcaagaacactggagtgggttgccatttccttctccaattcaaaggctatatatatataaatgacgttctctctttaagaattatttcaaaaggactttgttttctaattgatttgatctgcaagtttaaaaagcttacatttcagtagcctttcatccaagtaaacaatgatctacaaaatacctttaacttcattactccttccttttgacaatatgtttaacaatgatgttcttacagtacaaaaggtaaactgacttcccaggccagcctgtgtaaacaccaccaaaaagcatttacgtttacactgctgggcctcacacacacgtagtctgtgatctcagatgtgaacagaacatctccctccaggtgtgctggattagtttacctcacagtcagcacacacacgtggaaccaagagaaaggaatattatatgcataaaaacggctgcctacagtattgtcagcagggagaaaaaccagaaataaataaatgttcccttcaaagagggaaatgtaaatgattaagtaaattgtggtaaatatgcactcagaggcacatttggcagcaagctagtgacgaatatgatccttctgaagagtccagagaaatatgcaggcaaatctggtgaaattataagcactacagtaattaaaaagcatccattactaacagtaaagagttagggtgcaaacacttaaaattctgaaattcttaaagtaaattttaaactcacataaactatctcctctctgaactacccactgtctgtccatgtgtaaaaaattctacattcaatccggttctttctttgagaggtcagcaaccagcactatacctaggggacgtggacacctgccctagatttgactgcgctatattttaacatttcctaatagttcattttaaattctatctgctgagttagtctgatttactaacagcaaaaaataagctatttgaaataagagaaatcttaaagtttctattttctctattcattcactctttcccacattcattcagaggacaaatgaacagcccattctggagaaggaaagttgagttccctgacagcaacactgaattcccagtgtcaagcacagtgtcagagattcagacagcatgtagagatttactggaagagaggaagaaagagagaaatggaggggttatgggaaaggaagggaaaggaggtggtctacacacagcaaatgaaaataagtgaaacaaaaggaagaggatgtcgatacgaaaagagtaaagaaatgcttaagttttcagagtcaaatatgtcagcttgaattctttctgactgaaaatcctgaatatatttacatttttatgctcccttttcctcatcagttaaaatgtgactcaaatgagttggcatctgtagaaggtttagtggaaatccaacacgtggtaggtattcaggacatatttgctgtcttatgaatgcctcaatatacagtgaagaatacgtatttttaaatcaccgttaatgttctaataccgtaaagtagtgttactgccaagaaagtcaggctgaacactggccgcccttattagctgttccgaagatatacaaccatcatttagagaagcccaaagatgctaacttcattttttccaaaaacggcaaaaaacaataaatagcaattcttaagtccaatgccaagcaactctagtatttgttacatgaccataatagtccactgagggaaattatatggaagaaagaaaaaaactcttgtatttcatctgagaatcagagtcggaagcaaatacatgaacaaatatgtgataataaatatagaaaatatatcagcagagtcaaagagtaaatctcttttgactgttttgagaaatcattttatgatgaaaataactccctcttaaatttgtctaattttttattttatatttaatatatcaggttttcttaaaccggggcctacttctatgtccacctataaatttaaaaataacagatagatgtaatttcagaaaatgaccaataaaaaaaaaaaaaacaactaattttcccctcaaaccacatagctgaaccagagccactctttctaagataatagcagagctctctttccaaggagggcctggcacagtgcagtgaagaacagcaaagcacaactgtgtccacagaggccccgcaggaggtgaacactgtggcaagattgaacactggccgtccccaccaaggcgcagactctaacagcgtccacacgcgtaaaacgtgcactgcactgacaggcccactgactcccaaaccccaaccccagcagcgtctggcttctgaggtcacccacaggctggcagcttcttctgcagaagtcctcgggctccttaccttccacttctgccctaccttaagcctccgctgcacttccttttctttctttcttattgacaggaaaagctg

SEQ ID NO: 56146 - DNA, 1489 bp, Bovine  19866881354006
tttgtcgtcttgggtgtctcgcaggcttcccccccgccccgtcccccggctgacctctggcacccacgtgggccagagccggaaagggcctcttggggaggctgcacagagcttgcgcgctcctgagccgaccccctggcaccgcgggaagctgcgtgggggcagaggtggagaaggcgctgactgaggagccgaggatctggggccgggccgggagctccggatggaatctatttctagaacccgtggattcccaggagaagtcgagggctattgaaaaaggagggcaagccactaacaagtgatgacacgtggggttttgatgaatgtgctgtatgttgcctgatagaagtaatcggttttcctaacctcggtgtgcttaactgcagaccaagttatataccagaaacttcgttcctgaaaacccagtttcccttgttctttgaactgttacctgggagataaattaaacttgtaaacagtaaaactgccctagagttggaacattccagtgcagggaaggaagatggaaggactgtgcagataaggtaatcagtgttcggaatggatatgttgagttcgtcctgtcttttttgctctggttgacctctgggtggagatgataatgggagatttgggggtgaaagaatcaaagacttagaaaattaaaaaatgtaaacccagttaaatcactgaatgctgacttgtgggtcaagctgaaactctgaagagaaagaaaaatgaataaaactggcatataggaattgtcagtgttaaaatatttatccatttaacaattgcctagttccatctgggacacctattgtatagataggaaacagaggctataaaaatttcattttcgtggagattttgttggagtttttttagaacatcagcatttgatttctctgcctttactaagtggttgagattgcagactgacacttattaattataccagatttctagttttaattagagagtctcttctgagactaaacctttttaccattagactgtttgaaacctatgagataaaaagggagagttctttcagaaaattatttacatgattttaattaatgattataatctccatggtcatttttgcaaaagagcatttaatccctcaaccagttttcatgatttgcattttgcaaaaacatgtcagccctgcaggcttattatctcagagttgtgtttttttccagatgaaacttatttgggggtgagttttagtgtgctactgctctgagccccatttcataccataacacctgtttctcatgcagagcaaaccgattggtagaaaagtaaagtttgcttctttttgccaagacatagcccttggcaaggttacctttgaaaacagtttttcatgcagagaccgtatacaagtagcatcgctgttgccaagattctctgactaatgaagggtcggggagatggtgtattctttttcattgctcgcggcacgtatatgtag

SEQ ID NO: 56147 - DNA, 869 bp, Bovine  19866881639459
agtcatcagttttttggaactaggggaattttacccttatatatgtaaaagcaattgcatattgaccttctttataaaaatttgaggtaatgaaaatgtagccagaactacagatctttatttttcctttctctttgttgcctgtttttgtgtaacagaggctaggtgattcattttatactaatgaatcatttttaggtctaggagctgccctctaggttttctcaaattggtaccatagcaaaataaaactaagcaaaacttgatagaattaatacctctcttctgtatatagagcactgttaaacatactttacagggaaaaaaagaactccatatggagataattaagtagtataaaagaaacagctcttttatagttattaattttttaacaactgccctataatacagtagatcatttggtccacacacttaattaaaaccattatctttctttttggaagcatttattatacagttccaaaattgttcatgaaaacaaaatcatgaatctacttgtctctaaattggggcactgaacaagcagtgtaaagaatctttcattttagattggactatgttttaattttcaaatgaattgaaatttaatttgctgtaatttttttcatcaaatagaattgtatcaattgagtgaaacttttgaaacttatttaagtccctaaaagttttttgaataagagatctaaacactgaatcatttaatttaaatagtagcacaaccaatgagtcatttaaaatgtgttttaaaaattaaaatgagacactgataatatctctttgtggctttaaaaattctactttaaaaattttaaattctactttaaaaattacactaactcaaaaca

SEQ ID NO: 56148 - DNA, 634 bp, Bovine  19866881844303
ttcttttcttgttgtttttgtattaaaatgtcctctacctcatgaaataatgatagtttaggtagaaagtgggaggtaccagctttttactttgtttttaaccagtcttacttaccaaataacaagacagcaatcaaacctctatgccaaatatttgttgatatttcatttgtccaagttgtccactaagttaagattcaagaacattccctctgccctaaaatgcacagcctgaacatacagaggcagcaattactccttcaaaaatacaccactgaaaggtgaacaacttcagttcagggtgtctgactctgtgaccccatgaaccgcagcaggccaggcctccctgtccatcaccaactcccgcagtttacccaaactcacgtcccttgagtcagtgatgccatccaaccatctcatcctcttggacatgtggaaaaattaagctttcccagttctttgctatattatttacaaaaatattaatatcacagtaaaacaaatccaaacacacaggattataaacatgcaaaaagtcgaaagtatattgttgagaataaaaattataattgatgacagctacttcagtaacaataaaattagccaaattcttatctaggtttttctagttagt

SEQ ID NO: 56149 - DNA, 1157 bp, Bovine  19866880387518
ggcagggcctcctttaggcttggcctctggccctgccctcctcctcggccttcaccctcccgggcactagagggcactctcgccccgggaacggaggctgggccctggtttttcagagagaagagcaaagccaggagccctaaaaaaagggagagaggaggagggccaggctctgagcggctccctctaaccgagaagaatcaagaccagacaggtgctgacatcagggacccgccctgtgaataatcccagatacctcctccctgggaaagggtgcggctgcccaaggctcccaggaagcctggcgaacccaggggtgcctgtgggaccttgggggtcacatcctgacctctgggaactttctgcctgtggggacagatctgctccaggagtctgaaggttctggatggagggtttgctccccaacccccacctcccacccctttccatcagccccaccagcagcggcagataaagtcgaaaagtgtatcccagaaggtgacgtgcatatgtgcttatcgctagaactgattcccactctgtggccaaggggcccattcacccaccacccacacctcagcatcagactgtcacccacccaaaaagcctcccacaagccaagacactccagcccctcagccgctgtcagcccaaagccacagttatcacctcacatgttccacgtttacttgcagtctgaggctctggtgttgggagcccttgagtcttcgtggaggaaacttcacgtgacaccttgtgtgcatgccataggacatgtgtctccatggggacctgcaggagctccctccgctccatgggtggagcagcctcctaagaccactgaatggacccttttgaggaaacacctcaaatctggacaggttgtcctgagtgaagctatggagtcaccctgaggcctggggtccccagaaaacctccctcagaggggccccttgaataccttagttccatctactgttctcccttgtggacccacaaaggcccagggctgggaagaagggctctggggtggtgggcagcagagtggggcgtttctggtctcatcttgggccaccggagcaagtggcagcagccccagagatactcaagggggagggagacctgcagcctggggactgacaccgcagggcctgggg

SEQ ID NO: 56150 - DNA, 908 bp, Bovine  19866880397346
cggtaaagaaactgccttcagtgcaggggacccaggtttgaacccactccagtattcttcttgcctggaaactcccatggacaaagaagcctggcaggctacagtctatagggttgcaaaaagtgagacacaagtgtgtgactatgcactcaggcaccatctgcgtgcaaagaaagtatccactgtagattaaaggatccagccactcaccagacagctcaaacccaacataaaatgtttgtttctctctattcaatctttttaggtgaatttacttaaacaagccctcatggatgtatgcaaaacacgcacataccaaatacaccaaccttggaaaggctcaggaccgtcttggaaacttgcctaggcagattcctgatgtcagtcacttcaactgggacagtctgctagtttcagaaatattttctccccagcccttctgagaggcaaggcacagttacctaaaatggggtaacccagaaagtgcaagtttcctaaatcacaagactgacattcaggcacacataaagctctaaatagcagagtgttacaaacacgatgggtggggtgctgatgctccccaacagcacacgtagccagagagaaactgaggccccatccccactcctctgtcctcctcaaatctgcctgttcacgggcatcagcccagtgaccagcacagcacggagactgttttgacagttagtccatccatcaaaacacatctccataagctcctgagatactgaaatacttctaatgaagagcaaagccttccattgtctattaatacagcctgtctaagtatacatgtccttgaggaaggtaaccctcttacacacatgtctgttcacaagatgtaaattaataattcatcttttccagagaaagaggtcctgatgcaagaa

SEQ ID NO: 56151 - DNA, 1523 bp, Bovine  19866880530223
cctggatggaatttggataaactgcaaccacagtgttcagggcaaaaccaaagatctggtaacagaagaatgggatgatcctggtcacatgttgcttgtatgctccgtgcacagccattgcccagttaaggaccgtgagaacagaaattgtgatggcaatgcacatgttggcatcatccatgaactcaaagccacctctgagttcagaatttgaagactgatactgatctggatcagccagggcactcaacagaaccagcagtaccacagcattgaagatcaggtcccaggtgcccagcaggatggtgccagctgggacatggcagcacaggcagcagctggtggagtagaacggcatccagggggccaccatcttcatcactcaggctgccctcacagtggcatgctgggctactgctgcctcctcggccactctggctccactctggctccctctccccgccctgctcaccacccacaagggctcctagctgctgtctctgacagaccacaacagctgatttttgaagtgttcccatatatacccactcttataggggaacagccctggaaatgcaaataatgacaattatttgggacaccagaatgtctgttttattatttgtacctgaaattaaaagaaataccaaattaaagtcaactctttcaaaacggagtcccaaatccatggccatgactgctggtgtctagtagggcatttagctgaggtaatcagaggtaaccaagggtaccgtctgagaagtgagcttccctttgcaaggaaactcaaggcgggcacacttttaagatgatcttctagattgctattccatggaagatatcattcccatggttaggttattttatatggcatacaaaaaggattctgtagctgtgattaaaatctctaatcagttgactttgttacttaaaagggagatgctcttgaatgggcctaaactactcaaatgaaaccatttgggaaaaaagtctagagtcagagacagaagtcagagagatccaatacagtagcagacacactctgttggccatgaagaagcaaattgccatgttgttttgaagaactcagagccctttataaatgtagataatcccgataccatttacaaaaaaaaaaaaaaaaaagtggctttccaatttaactcttttatatagtggacggatcaactagcaattttatgctgcatagcgtgaccccatattatatttgtataattgggaatgtgtccttactagcatactgctcatactgggacttctctaatggttttgacatcagcccagctacatagcaaagaaaattccacaattaggcttttgtagtttgccagcataaatatgtaaatgccagcattccttctacaaagtattctccagcatgcagaaaccattaacattgagccttttgaaataccaaagccataatgatcttttaaattcacaaatgtgatcatgacaaatgacatgcttaaaataagcatgactgtttaaaataaaattac

SEQ ID NO: 56152 - DNA, 731 bp, Bovine  19866880814224
acatgaatgggaaattaagaaatgcagagaagggggaacaggagacccctcaaagggagaactctaacgtgggctccagggacccccccagcctcttacttgtaggccacatcacaccagcctttggtgtagacggaacgggactgcaggcccctcagcttttgactgcacgcgttttgctcctcacattccatccctgtgatctggtccgtgatgacataggccacgggccgggtcagctgggccctgcaggtcagggatctcgctccccactccttgcgggagacaatggtgggtgcacctggcgggaggggagaggggaaataggctggcatgctgaggccctgccatgccctccataggctgtccaggccatcctgaatcctctgtgatgggagaggccccagaaggaggcctgcaccacctcagcctccccttcccttctccatctcttgtttgaaagtgaaagtaaaagtgttagttactcagtcctgtccagctctttgcgacccatggactgtagaccaccaggctcctgaggaaagttctgccactctcctcaaaccagcagctccccagccagagcctgcaggaagccccatgaacactggggtggggggcttccctcttccagatgaacatgcactgtgggcaaggctgtgagagccccacccaggaccccaggacccccgagggcgccctcagtatccttacttgggagctcccgggaa

SEQ ID NO: 56153 - DNA, 1163 bp, Bovine  19866880880247
cctcctgtaaatctgttatcatacttccgtaattaaaaaaaatttaaaaataggattactaatatcttacgggaattttataagaattaaatataaaatagcagcactaagatgtaaaaatgtccacacagagtttattcaaatagctactcaagagttttagaaattgttattatctgtgctggaaatctgtagatgaggcaccgggctcctaggagggaccatgatttctcagggtaatagtaggctggtggctagacagaggtgttagctcacctttgctgagcaactgctaagggtcagccttgtcctgaggaccttaagaagcctcaccaggtgctggtccttaggaggttctcagtttggcaaggaggcagacgggggccatgcaactggtaggtgctttgtttgaagggtgaggatgattagtctgactatcggtgtctctcccagggctgtgatccatactctccctgttggtgacctaggaccttatgaggatgctgctatggtttcttgtcttgtctgctttggatctcgcagcctggggtgagttttcttttactaggtcacaagtgcttttggcatcagctccagcctggttttgtttgtaaactatcctctccaggataagtcctccccatcagctgtgttccctatcggagcccagctcaggtgcccccaccccagctgagacgggctccagtcctcagcagcctctccagcctgcccggtacagcttggtatcagcgtcatggtcaggcatttgctcctgatgatttcacagaaggacagaatctcagaaccatgatggagacccttaacaacttagtcttgtagacagggcaacaggccccattgtggcagtgacttgctcttggtcatctgacaatttgggggtggatgcagagtccagtggttatgaacatgggtctggggtcagacagcctggcttggaatccaagtccacagcttaaaacccatagcattttagacaaataacctctctgagcctcagtttctcatttgtatagagggagtagttaatttgctttgtttatttcacaaagattttttaagccacaaatgtgatagagcccttgaacatgctttgttaactacagacggtctgtgggcgacactgtgtcccaggacagtgcccc

SEQ ID NO: 56154 - DNA, 1055 bp, Bovine  19866880935397
gccctcggccccttcttaaccccaggctcatgttcctctggaccctgtccagataccagcgagctttctctcccctcctctgagaaggctgctgcactcctcagcccaccccaggggaagccctcagtgacggacagaccacagttccacttaccaggtctccccaaaacagagttgccaaaagacatgcagggctcagtgtcggctcccttttatagcagccaggattggccagctgcccagggcctcgggccactcagaggcagctactcccttccagtgttgctacagcctcaagtttcccaacaaggagaatggggcaatcaccgtgcagaatgaaaagtcctgagggggagcacaggaaaggtagaaggaggaaggcaagtgccaggcagtgatgcccaggaggagaagccaggaagagggcatggtaaagattctgcctgtgggctgctagcgtcccctggcatggccaaccatggaagctcgctcctaagtccctcccactgttgctgtggttatttgcaaggcttctctgtgcatctcggaaatagaactgaagttgaatgcctcattttaagtgcatgcacataagctcattcctccacagcattcatcacattgtcaaaagggtccaaaggcctccaacaggttaagaacacttgtcctagttgctgggtttttagtaacggaaggtggagtatttccactattgttgttatgtgtgtggctggactcagtggggatgtgggctgctaagcgttaagtccatttctctgctgctgtccccacaccttcacaacacctctgttctgtgaggctggggtggggtggcactgtgtcccaggagatggactctggcttggggtccccctacgagcatgaggcactgagccaccgcataaacagcagggacccttccatcctctctggagtgattatgtgcctgtgaccccaggagtctgggctatagaggaaaacaactctgtgggggtggggaaggagggcacttttggagaaggcagaaatgcttcaaccctaggaggtgggcaatt

SEQ ID NO: 56155 - DNA, 1594 bp, Bovine  19866880982840
aagaattgatgcttttgaactgtggtgttggaaaagactcttgagagtcccttggactacaaggaaatccaactagtccatcctaaaggaaataaatattcattggaaggactgatgttgaagctgaaactccaatactttggctacctgatgtgaagagctgactcatttgaaaagaccctgatgctgggaaagattgaaggcggaaggagaagggggcaacagaggatgagatggttggatggcatcaccaactcaacggacatgagtttgagtaaactccaggagttgatgacagacagggaggcctggagtgctgcagtccatggggtcacaaagagtcagacacgagtgagcgactgaactgaactgaactgaaccctttgtcagttgcttcgtttgcaattattttctcccattctgctgtttatcttttcatgttgtctagtttcctttgttgtgcaaaagcttttaagttttattagtttccacttgtttgtttttgtttttatttccattaatttaggaggtgggtcagagagaatcttgctgcaatttatgtcaaagagtgtactgtctatgttttcctctaagaccattatagcttctggccttgcatttacgcctttaatccattttgagtttatttttgtgtatgatgttaggaagtgttctaatttcattcttttacacgtagctgtctagttttcccagcaccacttattgaagaagctgtctttttcactggagtcctctgataggcaactggtcacccaactctctgaaacattagggctggcaaaccttgagagggaccctccaggtcacctacttgcccctcagattcctagagtgatagaggcatggcactctgcatagtccgccgtgtgttcactcatttctacatcagttacttactgagcacctgcacgtcactgaggatgtatcaagagagcaaacgtgcaacagcagtgccctcgtgaagtttccatcaagatggtagaggaacacaataagaacacaaacaagtgagatagttggtgtgctccatggtgaagtggtgaaagtgctatgagggggaaaaagcctggcgagggatagggtatacaaacacaaggcacaaatgcacacctttctgaatacaaaaattatcaatagagctgcattaatagaccaaagagcttaaggtattacttgtattgacttaaaggaagagtttaacataattcaaggaagattaaaagcagatttggagtttaacaagcagcaacatcaaaaccaggacaattagaagggcgtttcctggtggtccagtggttagggctctgtgctttcactcctgggggtcccggtttgatccctggttagggaacttagatcccacaagccacatggtgtggcctaaacaaacagtatagttaataggcactattcaccttttcttggacttaaatagaattttaaagaaaattggaattttgtattagaccttggagtgagtttggtctctgcctttggatggtgtcatctgtcagtgttaataattgcttacactgacagagttttgtggactacaaggattctttttttttat

SEQ ID NO: 56156 - DNA, 1655 bp, Bovine  19866881099468
ccatgttacaacataaaataagacggaggctcaaaaccagagtgggcgttaatcagggggtgagagggaaaccgaacacacgcataggcacagagatgtgaaagggcttaatcttttccgggagcagagtggccacactgttctataagagccggaagtaggacaccagctggatgaaaaggaaaggagggcccagagcatctggagagttacatactgggttgtgtactttagcctatagagtaatggtttccaaaactatatccctcaaaaccctattgcctgggatgttcaaatatcatctccttggagagccacgcctgcagacagtatgagttgctctgccttgggtcacttccagtcctttcgccctgccgccaccgttgctattgtgttaaattcctgtctctgcaggcacaaaagctggaagaagatggttctcagagtcagggcactagcctttgaatcatgagtatgctatttagtgtttttgagcctcatctctttttcttaatctataaaatggggttaatctgtaaaataagaaccccatagaactatttactgtgataatgagagtaacgtttaacaggtagtagattgtaaatacatttttgcttcctttccctcaccatcttactgataagaagattccttaaaaattttgagtcaggttttaaaagattgtttatctttgctgctgctgctgctaagtcacttcagtcgtgtccgactctgtgcgaccccagagacggcagcccaccaggctcccccgtccctgggattctccaggcaagaacactggagtgggttgccatttccttctccaatgcaggaagtgaaaagtgaaagtgaagtcctcagtcgtgtctgactcctagtgaccccatggactgcaggcccaccagggcccctcccgtccatgggattttccaggcaagagtactggagtggggtgccattgccttctccgtgtttatctttaattcttaaccatttgggctatgtgggggtgggggttctgaggagacatcagtctggaccttccacttatcttttgctgcagtcagagtcattacacctttacctgctgtatatattggaggtaaacaatcaatttcatctgaaaactctattatgctgcctaaaatagtttgacctttttaagagacagttggggcatcattgaccatttaagcaaagaagggacgtgatgagatttacattttagaaagattcctcagtttaggtggccttaggtgccttgacttgattacatgagctgatgtctgtggtgacaaccaggctacaagtctgatgtgaggatcagagtgggactagggggagctcttttgttaatgagtttgtaattgttgaaacgtgattgaaggtcttcccttgacagaggcttttctggactggagaattccttgtgcatttctggactctgctctcatctgcccaaacacctcctcaccatcctgcctgcctgaggattcaggcatgctcaggattccttctgtcttgggtgtgcccttaatagaagggtgaggaaccaaccaggccagcactggcatgtatgagattcttatcaagttaattcctaagagataaataaaggaaaacaaggatcttcattagacggagcagtagat

SEQ ID NO: 56157 - DNA, 808 bp, Bovine  19866881192178
tataatagccctgggatcatcttcttggttgatcaaatatttatcaaatattcacactgaggcccagccttgtggagatttggagatttaggaggatctgatcttgcctggacggtgttcatagcgcagaaggaaagaccctgggaacctacacagatgtgaacaatggtcctatagtctctcaccttgggattctctgagcacatggatgaaacaaaagaaaaagtcactagagactctgcaaccaaactgatcattttctactctgtaggcagtgagaagatttgccccaagtcatccacctaatttcaacaggttcagcttttgaaattaagagtatcattggaaggatgaacaaaaattaagaatagccagaaagtctgaggaacaagctttcctggccaagacagggactggatctagattctgatcttcagtagtaaatcctatgaacagtctgtgagtaagagagaagttacacccaaagcccagggcagacgaggcaatttctgaaagcagcacataagtaccaaagaggattcaaaaccaaagtggagggagcactcaccttgccctgcttttcaatgacccccagaaaagaagtgccttggcatggtcacctaaagcagcacatgcctgaaaaactgggattaaatgagcaaagaagatgtggtccgaatatacaaaggaatatttctcagccacaaaaaggaacaaaactgggtcatttgtagagacatggatggacctagagaccattatacagagtgaagtaagtcagaaagagaaaaacatatatcatatatta

SEQ ID NO: 56158 - DNA, 1760 bp, Bovine  19866881305317
ctgagccacagtgggctcctggtctagttttttctgactgtatagatttctctatctttgactgcatagagtataatcaatctgatttcggtattgaccatctggtgatgtccatgtgtagagtcatctcttgtattgtttgaagagggtatttagtatgaccaatgtgctctcttggcgaagctctgttagcctttgccctgctccattttgtattcaaggccaagcttgtctcttactccaggtatctcttgacttcctacttttgcattccaatcccctatgatgaaaaggacatttgtgtgtgtgtgtgtgttagttctaggaggtcttgtaggtcttcatagaatcttcattctatcttcatataatcaacttcgtcttcttctgcattagtagttggggcatagacttggattactgtgatgttgaatgatttgctagaagagagacaagagaaaacatgtgaatattttcactagcaggcaagaagaaaatgtcatatgttcctaaatctccaaataggaaatgataaaggtcaatcaagagtacaacaaagagagaaataaagtgttatatagcataacaaaaaggtggtatgctgtataattccctttgtatgaagaaatatctcaaaatattatagctaaattactcatttttaagcttcatataaaaggaattatacgcataccatcttcttgtctctcttctctaagttgacactatgcagttttagtttactcactggtgtattttgtataccattgcatcctatgtaatacttaacttctctctttgttgtactcttggttgagctttatgtcgtttcctattggagatataggaacactacggcattcttcatgcctgctggtgaacatagtcatacattttctagggtatgttcccagaagcacatgcatcttcacatgccaccccagggtttcattctcttaattaccatcaattatttcaaaagcttttgcctttagatctttctcatcttgagtcactacttttgttggagcaaaacctcaagaagctgcatcagaaaacataagcctagactttcgtatttgtggaaaatatattattttattcatatttgatgaatagtttggctagatgtaaaattgtaggttcaaaaagtattccccccttgaaattttaaaggctttgctctttaatctttgagcattcatatttgctgatgatttcttctttctctcatggcttacttagtctctcttctgctcatccccaagacagtcaacttctctcctggataaacactattactggtttctaagtaacatccagctaatgatcatgcagatatacaagattttcagagattcaatttgctacaaatgcttcaattattcatcattgaaaacagtaaggatcaccagtcctttagtcatttttcctgtgtatcaagaagtaattattcttctttctaagtcagtaacctcattaagtactcttttcttaagaaaacccaattctccttcaatttatcaaacataagtgacaacccatataatttattggtaaaaaagtaactttggaatccattagtaattcatcaggcaagaaaagcaagtttaaaattatgttggtagaactgttctaagtcacatgttccttagataattcttttgctccagcaggccccacctagttcttggacttcaacatgaaaagaatgtcacgagagcacttgacccatcccaagacatgcctcttccttctgg

SEQ ID NO: 56159 - DNA, 872 bp, Bovine  19866881354079
actgaattttgatggactttgcaccaatcaccaccaccaccaccagaagtgaggagaagaagttggtggtgttgcaaaactaaaaaacgggataattttgtatctgtatcccaaaacaatgacagaaagtgattagatgttgaaatgttggctttgttttaaaaaatgaaactaaatgaaatgtaaatggttgattccaaatagcgaataaggaaagatgtgattagatgtttggggtcctggtgattgatctttgtgcctcattgttgacctgctttaggcccttaatttctgccatgtacactctttagagatggatttgtgactgtgtggtgcaggctgctgtcctccagattctttgccttcttctccctggtgaaggtaaaatgcagaataaagctgactgtaaaacattcctgacttgatgtgtgctcattcctgctgttcttgtgatgatcattttctccttttttgacaagtctcaaataggaataaaaaacagccctccaagatgtacagaacagccatgctgaaagaggcctccttaaggggtacccagaccatcccactcccatccacaacatatcataggtccacccatgcccatatttcatgcctgagaaaatccagctgagactgggacttcaacacttcaggtccaggattctttccacaacagaatctttcctctctgacccttgctttccagaggaaaggactaatatgggaggaggggccttcaatggaagagccatgatacccacaagcatagcatccctctctgaaggaaaacccaggtgtgcttctaagatgaacacaaacttgagggccagaactgtgtgccctatcatctggccaggtttcagaaaagc

SEQ ID NO: 56160 - DNA, 1304 bp, Bovine  19866881355686
gctccttggaagacagaagactagagtggagccttgacaaacgcttaggatttcaaaaggcccaggagaggaaggcacacaagatggaagtgacaactcaaacagagatttaaagtagagcaaactgggtgtgcttgctttgcaacttttcctttcatccctctaacttttattaacctgagttctaataaaagtttttccagaaggcaaagtgacagatccttggtccatcctgttttcttggtcactatgaaaactctgagaagctaactccactcttagaagtgtcataaatcaaggttgagaagatgaagattatctgcgttctcccttctttttcttcccctccaccctactttacaacccgagtgacaaatgactccaatttccctccagatctcctttcaaaaaatcactctctgcaggaggccgtaggttgtctgtcaatttgggccctatcttcctcgtgtccaaaggagtgtgactttgaagaaggatctagtagaaaggactgaaagggtccatatgtcccttgacccagacagacttcagactttaggcatacatttttacatggctgaagatgagatgagcaaggcggatcttatctcaccacatcctgaaccagtttgggcagacaagggacccagtcctagttctgaggctgagataacgttttatgaacattcttttgcggctgcctctaatgagagagatctgatgggagcccctccctgctgaggtatggtgaggacccagaggccaaaagagaggctgattaacaggcatcccaagcaatgactcaaaccatgggcaatttcagacgaagctcgttatggtgactccacaattaagacctcagcccacgtggccagtcagtcttgcaggaggctggaccaagcactgtataaaagtcctaccagcctgggctcctccatccacatcctttgtagaagcttctagaagatcaggtaagtggggacatctgtgccctctctctcactttcagttctgtctctgggagactactattctcttcctccactggactgtactttctattgattttttgaagtgatttgccacttcttagggcttcccaggtggctaattgaagagtctgcctgccaatgtaggagatgcaggaatcatgggttcagtccctgggtggggaagatccactggaggatgcaatggcaacccactccagtattttttgcctggagaatcctatggacagaggatcctggtgggctacagtcccatgggggtcacaaagagtcagacacaactgaggatgcaca

SEQ ID NO: 56161 - DNA, 728 bp, Bovine  19866881779620
aaaagaaaggtaactcaggaaggtgagtagtgatttttaaaaccataggatattgctcatgaggaagtggtttaaagagagatgttctaagagatcaacgtataatactaggaaatggttgtagcaaagaagttaagacgttggagtttgagattgaatcttaactccactgtattctagcttcattgatcaagatctttcagccataagagatggcagttcaaggcaagctcgctgaagaaaaaaggggatatactatgttacataactggtaaggtcactgtgataatttacaggtcaatgaaccacagccccgggacccagaacttaagaccatccatctatttgtccattcttctctcatcactgtctctctgcacgttggcttcactcttactgtaacaaggtctctctatatatcaaggaatgtagccacagactgttccagctttgtaaacccagggttcacatagcccaggaagagccttgattggccccaccgggttcacgtactcagctgttgaccaatccctgtttccagggacgcagggtattataaacggccagcgtgggtaaggttcccagcctaccatcaaggatctctttccaagtggaggaagcaagttactgcagtcactacactcacccgtgaccttacaaacatgacttaacccccgctgggaatcagggaggttcctatcactcctgtaacatgaggacactatcat

SEQ ID NO: 56162 - DNA, 3936 bp, Bovine  19866880480818
cagacttgtcttgatcgtagcttaggggaaaaccttccgtttttcactgttaagctattaagtttttcatagatggctcttctcagattgaggaagttcctttccattcttaatttgttgagtgcttttatcataaaagggtgttggatttagtcagatgatttttctgtatctcaagataatcacatggattttctcccttcattctactaatacagagtattacattaactgattcttcagtgtgaaccacccttgcatgcctaggttatcccactttgtcatggtgtgctgctgctgctgctgctaagtcgcttcagtcgtgtccgactctgtgcaaccccatagatggcagcccaccaggcttccgccgtccctgggattctccaacccactggagtgggttgccatttccttctccagtgcatgaaagtgaaaagtgaaagtgaagtcgctcagtcgtgtcggactcttagtgaccccatggactgcagcctaccaggctcctccgtccatgggattttccaggcaagagtactggagtggggtgccattgccttctcctgtcatggtgtagagtccttttaatgagctgctaggtttggtttggtagtactttgttgggcatttatgcagttatattcgtaagggatactggtctgtaattttcttgttgtgtgtatgactttcaacttgtgtgtttttgtgattgtgtcttttgtaaatagcatatggtaataagatttttcctttacttttagcttgacaatcttcatctcttcctggaggggttaagttattcatatatttggaaccatatttttgtacaaaagttgtcttactcttttgatttctctattttctttctttggttcctcctcaccctcactttttatggttttattgagttccctccattttttcttttttttttttccccctttttgacagcatgaaagttgtatacttacttttcttgtttatagtttattatgatgtgtctgggtatgggttttcttttatttaagttgcttgatattccattggattcagtgaatttgagaaattgtgtctttcatccatcctggaaagtccttagttttcacttctttgaatattgcttttccccaattctcattattatgtctttctccatctctgatgttgaatcttctcagtttatttttctgggttttctgttgctctgtgcttccttctgcctgattcttctggtcggtcattcagttcactagttctcttcagttatatcccagcagttttttaactatccattagcttcctaattttataatttctttaatttccagaaattttatttggctctttttcaattcttctcattttctttctcctgtcatatttttactctaaaacatattaaatatgtttagtttatattctttatcttatctcagggtcagtagtctttgtgggtttggttctgtgatttgttgttttttcctgatttttttctcataccagtttgtttgctcttatttcagtgtttttgtttgtgtgtttcctgtattttaaaacttttttggagggttttgtttgtgtgtgtgtggttaatcttttattttgaaattcattttaagagtttgtgtcatgcaggtagtcatttccagtcctaaattcaggcttttggttaggaatcttaaggtgatattcttttcttttctgtatagagccatggttcagatggtcaaattcccttcagttggtcattttcctttaaatactcatccactgagtgtcatctatttggaagtccccatttgagggaagatggtgcctttgatctgatctcctactcatattagccccacctgtgtttcttgtctcctgttaaatgaacattctgagccactagagaatgtgtagttggtgcactatggacggtaggccagctccaccttgtggcctgttttatatggttcactagtgaaggatgatttttaccacttgtaggaaattgttttttttttttttttttaaagaatatgtgagactgtagtccccaatcctaaaatatttactctaacattggacaccaagttcgccgacctctgctctaaagtgtcaggcgttcacaggtgctgttggctctagcacttgagtctgttggtggattagcactttctgcctctaatgtcttgctttctcagctctgcattcgaaaggctttttttttttaatgttaattttcagtttgttgtattgggttgacatctaaatcttctatttgtatgacttaatcagttttctctttgttttgtttatggcttcaaagttctaaaggctttctgtttattaatcttaaaaaaaaatctttgtttaaaagtagttttggtatatggatgtacataatttcttcagttcagttgctcagtcgctcaggctctttgtgaccccatgaatcacagcacgccaggcttccctgtctatcaccaactccataatctcttagtcatcttaattttactgagtacggtaatggctaacttagccttaaattttacaagatgttttgttaagtatattatgatttggatttctgcagtggaaattattgtactaattttatattctaatcagtactgtaggaatagtcctagctcactaagtctcacctatattgagtatgatcattttaaaaacgttttaaagttttttacaccagaaatgatagttcactgttgctttgcctcctttttaaaagtcattaaggttgttggatgaagaagaagcgactgacaatgatttaagggcaaaattcaaggaacgttggcaaaggacgccatccaatgaactttataagcctttaagagcaggtaaaaatgtccctaaatgactttcacttgagtaagttctcattttgcttgattgaattaggcttcatatgaaaagccaggtgtttttcttcagttccatgtaaaataaaaaataacaagaatgttcatcataataaattcagattcttaagaaagtgaaaattaaaatgatcctgtgactctgacttcctgtcccaagctttctgcgtattgtaaaaaaaagataaatgagatatatataaatatatggtgttgtgatttcatttcatttagtagtaatactaccaggtagtaaaggatgagttttaaaattaacctgaagccaattatttttaagactttgatgataaagattttgtgcttgtttagataaatgatatctgctgctgctgctgctaaggtgcttcagtcgtgtccgactctgtgcgaccccataggcggcagcccactaggctcccccgtccctgggattctccaggcaagaacactggagtgggttgccatttcctccttcagtacatgaaagtgaaaagtgaagtgaagtcgctcagtcgcatctgactcatagggaccccatggactgcagcccaccaggctcctcggtccatgggattttccaggcaagagtactgcaatggggtgccatcgccttctccgaaacaatatctagacttgctttatttctctgtaaaaagcatttaatactattgtgatttttctaaaaatgtatctgcttttcttataagtcagatttaaagagtgatcttttgagacaggaacttttttgaaataagttgtaacagtttttggagtgaatgttatctttctatattcatgagttgtagaaaaagattaatgtcagttggcttttatttagtggactgtaaccacaaggatgttttaaggttataaaacactaaagatgcaaggactgacaggagctcagtttctgtcatctagtgctttggggctgacagggagacaagtaaaattggagaacaaaattgaaagtacaaccagcttatgtacttcactgttaaaatcgttactgtgctctggtaacatttttttcttcttccac

SEQ ID NO: 56163 - DNA, 1299 bp, Bovine  19866880487873
atgctggatttgtggatctatgatttgacttggatttgaggaaaggagggtcgttgcagggtcgttattatactgattggaaatgcaggcccatttcctgtaggtgacaagtgcagagaacagatgaaattgtaagggtcttctgtttggggattcagttttttaaatccagtggtctttgcttagccttgttaaatggcatttttttttttttttttgtaggttacagcagaagaagcactacagaggagtcaagaaaagcttcctatatggaatgttgcttttattaaaacttgctgtgtgcctttgggcaagtcactgaacctctctgattctggaaactgagtcaccaaatctgagtttggtggaaggggtaggcattcaggctaaactgggcttgttcacatggcaggcatagggttccgtgacagtgagtggaggcagccaggtctcaatgcctcctctctcactttctgtcggtaaaagcccgatgccaggcaaggccagcctgatgtgaggagctgcaaaataacgttgtgaaaaggtgagggaagtgagaggagaacgatcacaagctgtctacactgggttagtgctcattctgggatcttcaaggaagatgagtggttaataatgtggtgtgcgatctgcctgagttgtgactttagccaggagcagagacaggttcaaacaacagaagagaacagaacacaaggaatcacagcttgatcaccgtgtgaccttggacaaaatacttcacctgtcagaacctcagttttttttttttttatcctaagtttccctaaaacctgtattaaatctttctattctgggtactggagtcagagacgagaaaaacgaggtgacccttgtgagtttctgcagctgtgtgtgtcagtgactggggagtgggggaccctggtactggccacttctggtttgctcgtgtgctgcccagggcagtttggagcctggacccttgcctccctgaaggtatcaaggactggcaggcaagcaatgttccctgtacctccagcaggcatttccccatgggaaacctgctcttgttagcccagcttttgaattgcttgacccctttgaggcccatgggttgggaagggcttccagggcatctatattgggctcacttgtcctggctgattttcaacttagttttccagctgtgaaaaacatctatatggatggcagtaattgggaatttaataattttttgatgtttcttgtggtgcttggaaaatccactgggaatggtctatatattttcagtgtttccccatt

SEQ ID NO: 56164 - DNA, 1378 bp, Bovine  19866880542463
tgggatctttagttgtggatgcggcgctttgttgtagtatgtggggtccgattccccaactaggaattgaacctgggcccccttcactgggagcatggagtcttagtcaccggaccaccagggaggtccctcgcttggggtcttattcatgccttataatgaacctcccagagggaaactgaagaagactgaacgcccaactagccccttctccaagaggaaacgatgtagtaatcaattcatcatgtttccctgctgacaatggaccacgatggatcccagtgtttaatgtcatcagactaatacttgagcagccaccaggttggtgagctgttagggccagggtcgcccggtcctgggatctgggctgtcagctgtcacctctctgaacctctcttttctggagcccaagtggagtgcctgcagcacccaccttcagatacttctttctgttgatgtgattgtttgtgttctgaattaagaccatggatacaaatgaagctaatttgtttctctctttgcagctggcacaggaaacattctgtctcagaggtgccatttgcaactgacctcatacattatttattggttttataatttagcccagcctttcagatgcatgcaggatgtcatctgctcatgggtattattatctgcagtttataaataagggaacgaggcctaagaagtggggacaggggttttccagggtcatgcagtcagtcaaggggagacttggaggcaggttttctgactctagattccaggttctttgggctcccacgcctgccccatgcatagctgcccacagagtcacactcggggctctcactgtccttctgttatcatgcagtgatacctgggcggtgctctgctgtttggtgaggttgggctgtgtgcaaagggcaagcttaggagccaagtgaagaggtaaacttaaaaaatgatcatttatttggttgcactggctcttagttgctgcatatgggatctagttccctgaccagggatcaaacccaggccccttgcgttgggaacacagagtcctagccacaggaccaccagggaagtccgaagaagaggtaaccttaaaaaaagaaggaagccaacaaaacagcagggtagaggggttgtgtacccatctcccatcttgaggaaatgaactatttagtgacacagcggacttgccacccaggtgcaaaaacaggggaggcagtgcctggtcccacttcctggctccatccccagggtaggttggggccacatctttgtccatcatcttttcttcgctggagcatctcttggctgagtgacagaggctgctgttaccccatcaacaccacttaaaggcagggggcttggcaagaggcagttactg

SEQ ID NO: 56165 - DNA, 2298 bp, Bovine  19866880566211
ctatgctgctgctgctgctgctgctcagtcacttcagtcgtgtctgactctgtgcgaccccatagacggcagcccaccaggctccgccgtccctgggattctccaggcaagaacactggagtgggttgcccatttccttttccaatgcatgaaagtgaaaagtgaaaatgaagtcgctcagtcgtgtctgactctttgcgaccccatggactgcaggcccaccaggctcctctgttcatgggattttccaggcaagagtgctggggtggggtgccatcacccttctccgcctgtgccatgcagtaggaccttattgtttttggtctgattcctttaaaatgactctgagttgtgtttagcgtgttgctcctagccccctggggagaagaggctctggctttcctgtgcttcctcaggccacagcctctggagcagctttgccacttctcggccaccgtcttgttttcattgatgatacccaacacggtgttgcttaaccagccagagttctccccaaagttagatcatctttagcagtggcattaaacctcatatctttttgtcctttttatgcagtccatgcagatctcatggcaaggatactggggtggtttgccattccctcctccagtggaccacattttgtcagaaccctctcctaagacccatgtgtcttgggtggccctgcatggcatggctcatagcttcattgagctatgcaagccccttcaccacgataaggcagtgatccgtgaagggggacatggacatgaatttgggcaaactttgggagatggtgagggacagacaggcctggcatgctgcagtccatggagttgcagagtcgaacgtgactgggtaatggaaaaacaacaacataaaacctcagtagactcggttatccaccagatccttcatacacagttagtcccgaagacttattgctttttcattttctgtatacccatggagaatttaatagcaggacatctagagaaggagctattttcctctcaatgcaggatgtacattttgtgtttggtctagtattgtctgtgtgaattgcctgcctggggatgggggactctaaaggcctttatctggcctcttcttacagcgacttttgtaaactcaccttattcctgcctttatgttgtctttattttgtctcaaattgttgatttatttagtttgatttgctgaataataagcactcttgtaagccgcctccagtaatttgggaaactagatgggatccaagcatgtcccataaaaagtgtgatttattgggtcaaaagatgtgaatgcttttgaggctgttcttacatgctgccaattagctttccttttcctgatgacttcccagggctgtcatctgtttttttttttttttttcttggactttaggctggggctaatgtaagcagcctttagtgaactgatactaatgggtcttaaaaaactcttagccatggaataagtgaattagtgtagactgacttgattggaagaggccatgaatgtcaggtcagttttttttttaatccatctctgtctctcctctttgcaggggaaagagggctccctgggaagcttgccctgctgctgactgatgcagggggctttctaggaagtgctcttgggatccatacctgtggaagggcaggagcagggctgggcagagggggaagctgagctgtgatgaagtatcagtgatcctcaggatggtgcctcaggtagctctgaagctgggatcacccctcagagttgtcccaagattgaaagagaaggttcagaaggatcggccagtggagtcagctgctctcaaaagtaggcgtgaccatgggcaaggcagtcgccacaggggcctgagtgctgagcgtggcctgccgggagctctcctccacgcagttgggggaatgtgtacattagtcctacagggagacagtgtctcccaaaggaagccttcagagatcgactgatttgggggcattgctaggcccatgggggatttttttgcaagagcatttcacctgcatttgtgaaggttttcccttccatcggcacttgctgccaccgccacctgcgatttaggaaatctgcctcatgcttagccttctgattttataattacctttccagaataataaccccgtccaggtgttttgtaacacaaaacagcaagggaaattaatttcaattagaaggggaaaaatacaaattgaagtgggagttgtggaaagaagcaaacaaaaaaagcccaacatgcctttctttgagtgtacttcatttacgtaa

SEQ ID NO: 56166 - DNA, 1182 bp, Bovine  19866880598645
caggaaagaacattagagtgggttgccatttccttcttgagtgcgtgaaagtgaaaagtgaaagtgaagtcgctcagtcgtgtccgactcttagcgacccccatggactgcagcctaccaggctcctccgtccctgggattctccaggcaagagtactggagtggggtgccattgccttctccgacccagaacggtgccccctcaaaaaagcgctcaacagacaggataattatttgaagacaatgtaactcaccttagcgttctctggttttttagtaagttctgcagacccaggaggccttccttcctttctgaccagttggagctggcacatctgttgaggacttctgccacgtcttctgtctgcctcatgtatgtgggaatactaccgttccgagagctgtaggagcgttccgaacaagcactggatgcatcgctgttcgcatcatcatctgagtgcatcccgtaagattcgtatcttcttcgagcaggttttttctgttatacgtaaagactctcattagtggtagctaaaataacatgccggtatttcacgatttctactgaccagaaaaggactggcctttgtttaaaaatcagtgtaaagcatgctgctaatcattgtaataacaaaatgttgaaattttagtttttttcagaaaacatgttttaggagttagtaggagatgaaatattctttaactatggggagtggtagaagcagaataaaactactatatggaagtcagatacataaagtggggagtgctaaaaacatgaggtttttccttttcttttttctttttgtggaaaaccaagaactactaccagagtgtaaatgaacaggctctgtgctaaaactctgagttgttacaaagaaattataacctttttaaaggatgagaatggacgagaaaaacctgtttcctgtgtaaagttctattttttctgtctctctacctcccttttcctctattcttctttcacttccattatcatttctctgccgctcttccttcacttgtacccatccctgatgtttctttgagaagaaaaccacaaagaatgatgacagcccgtttagcttactcttacttttaggaagcaagctcctgaagggttctccatgctttccctaatgtgtctaaactatctatttcaatatatataaaaaagcatta

SEQ ID NO: 56167 - DNA, 896 bp, Bovine  19866880650960
ctttggcttactgcaacctaaaataaatcactgtgtttactactttcacgttaatactgaaagctttagaaccctttaattttgctcacctcttagcactattttatatcagtcttaggcaacaactcaaatgtctatcaacagtagaatggatattaataactcgtggcacatttcatgcactaaaaaacttgaagcaatgaaaatttgtcttccaaacattttattgagtgaaaagaaactaggtactagagtacctattattcaattccttttgtataaaagttcaaaaatgggcaaaactgactagactagttagctttgatagacaataacgactttagggcaattcagtgagggtgcttagagaatattgataatgatctactagtctggagactggttacactagcatattcattttgtgaaaattaattgagctgcgtgctttaatttatatacttttctctgccttgctttgataaaaagggaaaaattaatttcctaatagttttagaatgttaagagttaattatttttaagtggtagaagtatttactcatttcaattcttgtgtgtgtgtaggaacagagagcactgtttccatgggaacttctggctgctcagtgttttagtacctctcactctgtagatttggtgtgtataccctgtccttcttagctgcagtttttaaaaataggggggggtggtcccccccctcaaaaaaaagaagatttatttgagattatattaatgttttttaacagagcagtctccatagatttaatggatccagaccggctgccagtagcatattgctaaaatatgtatatattttttaactaaaagatacatttttcctacaagttgtactggttaagaaaaacacttgctga

SEQ ID NO: 56168 - DNA, 1792 bp, Bovine  19866880681148
cacaagaaccaaacggtgcaaaaagagaattaaaaacccacgtcaagcacacgcgggctgggagctctctcctcaccagcaacctcaaatctgcttactccccgggttgcgaagctgttcggtctttaccctggacccccacagggtgcaaggcacaaagcgggagtggggcagggggcccaggattcttctctgtgcagtcgcctcatcactcggcatgcaagcttttttctcccagaagttatgtggaaatgagggtttcttttttttttttaagtttggcaaaagatggtactatcttgaactcagctctgatgactgagaacagcccagagcgtacgcctcgccctgacacccgtgctgggccaaggaggctccagaccagagcgtgccagcacctccggttacacctgtctgtccgtggctgcagggcgccctgcagggctgtcaggggtgcactcaccagtatgcattcttcaagatccattttctccaggtcgtggcaattctgtaagagttcacgagaacccatgagacatcccctgctcccacagtgacccagtgagccggagcatctgagcaggcgcccttggaatcacagtcacgtggaagtgggcactgggggcggccacgtgtccttctctcgtctacaccttcccggggtcttgcaggtcccagcgtgtagattttagccactgaggggtttctgggaggatacggggtggggcgctcaccacagggtggctggtgggggatgcgataggaggcagagtcacagcaaccccaggaggacagcggctctgggcagcaggggggtgtggagaggggggcagaggcagaccccggcacagctgagggatgctgctgagacgagagtcggggtctgtgaggaagggctctcctgcagggaggaggctgcttccactgtggccccgcctgacaaagtgagactgagggccaggcccccactcctggtatagaaccccccagctcccgggcccaagggagaaaatatagaacgcaccccccagccccacgaggactctattctacttggggcctgtcattgctgaaggccattttttgcacactccgagttgctctggagggaggtggctgagaggctggttggtttggaaacacctgtcttacccgagctagaagcgtaaagcccgcatcagtcagatgggaacatcgggcggcctccaagatcctggggtgcggagtgcgggggagacacaggagcagcgggttaaccacgcaaaaggagagcctgctttacagtgctgagtttactccactctttgacacagaactgaggctcagggagtcccactccaaacagggcagtaaatacagggatcttcccacaataccagcacacgactgctcttgtttttcgctattattccagtatgtattgacttgtaaacaattaaaatgtattttcactgcccctctgctcacacagatcactcacatgtcaaagtaatggcaggacgaggccaaacgggtgggcaccttgagtgatgcccatcaggaaatgcagactcaggtgccctggggatggacagagtgacgccctccagacagccccaaagggagccagtgcacgctccgtcccgtcccagctcatctgacagaagccaccgactcaaccgctgcctccaggcctcctattccaccggctgcgagaagccccccgcccgccccctgctaggccccaggccctcagagtgcactcactggagtcctggggcagttcaaggccagggctgtcagggaggcgtca

SEQ ID NO: 56169 - DNA, 1768 bp, Bovine  19866880711318
cgaagggcggccgaggcgctcgccatggcggcgttcatctcggtacagctgaaaaagacctcggaggtggacctggccaagccgctggtgaagttcatccagcagacgtacccgagcggcggggaggagcaggcccagtactgccgcgcggcggaggagctcagcaagctgcggcgcgccgcgctcggccgcccgctggacaagcacgagggcgcgctcgagacgctgctgaggtgggcctggggccgggtagggggaggctgtcggcggcctgccgcttgccctgcttcctccgcccttcctgattcttcacatccacggccggaccggccgccccaccccagcttggcccggcgcgtaggtgtggtctgcatttcttcctcctgcaggcccgggtgaccctacccgcttcccctggctgcccgccgcggtccgccgtcctcggtcctccggggcccggccgaccggccacctgggaggaacggtccaccacgtattcagtctctcttgtcacatttacccagaactagttttcttcacttttttttttttttttttttgcgggggagggggggtgtctgtgagactcctcccttcctccatttttgcatcaccgcaaaactttgttggccaggttggaatttcataatagtaatttgcttgagggaagtggcagaattggggctctggaactcatgtttgttacttactccatactgtccactttgaaatgaaccctcttcctaagttcatcgaaaccgaacgaccgatggagaattccattggttgctaagtcagttcagtcgtgtccgactctgtgcgaccccatagacggcagcccgtgtccgactctgtgcgaccccatagacggcagcccacgaggctcccccgtccctgggattctccaggcaagaacactggagcgggttgccatttccttctccaatgcttgaaaggaaaagtaaaagggaagtctcacagtcatgtccgactcttagcgaccccatggactgcagccttccaggcacctccgtctgtgtgatttcccaggcgagagtactggagtgcattggactatgttaaaaattatttgatctaactgaggttcatttgatagtctctaaagtatctttcaggtccaaggttccatgatcacagtgacatcataccttttaaaaggtagaattactgtacagtaattcctgggacggcaaatgtaatgcaagtgcctagatttctgagaatctggtgtgatgagtgccttcagacaattagccatattctatacagtgagcaaaaacaagacctggagctgactgtggctcagatcatgaactccttattgccaaattcagacttaaattgaagaaagtagggaaaaccactagactattcaggtatgacctaaatcatatcccttatgattatacagtggaagtgagaaatagatttaagggactagatctgattgacagagtgcctgatgaactatggatggaggttcgtgacattgtacagaagacagggatcaagaccatccccatggaaaagaaatacaaaaaagcaaaatggctgtctgaggaggccttacaaatagctgtgaaaagaagagaagcgaaaagcaaaggagaaaaggaaagatataagcatctgaatgcagagttccaaagaatagcaaggagaaataaaggtcttcctcagtgatcaatgcaaacaaatagaggaaaacaacagaatgggaaagactagagatctcaataaaattaga

SEQ ID NO: 56170 - DNA, 1223 bp, Bovine  19866880790313
acacatacacatatgtaattgtcttcgtgtgtgctgtaatataaatgttgtggagtcactaagtcctgtgtgactctttgcaaccccatggactgcagcccgcccaggctcctctgtccatgggatttcccaggcaaaaatactggagtggattgccattttctactccaggagatcttcccaacccagggattgaatctgcttctcttagtctcctgcattggccgaagtgttctttactgctagtgctccctaggaaaccctttatatctgtatctgcatttatttgtaaaaaccaaaccggtagcagtgttatcatcagggtgaaggttgggggaagggagaggcaacttctatagtctgtaacagtttagtatttgtcaaagagcatctaccatttatgtaaataaggcaaaaaggaactggctcctgggcattgcttctggtcctgttgcctggcagtttaaaaatacaaagctatattggagcgcacacaattcagtcaacgagtattgagtgcttcatctgtgccaggcactcgaccagggtgggggatgccagggtgaaggcgatctccgtttagggtacaggcagcacccatgagggaagagggggtcgctttttcagttttttatttctctcaggctgaaaaagttctgcagagtttggggaaacttactgtgcttccttgtccgcagagaagccgtgtggagacccgccctcgttcccacacaccatcctgcagggccgcaccggcttggagatgggggacgagttgctgtacgtgtgcgccccgggccacgtgaccggccagcgcgaaacggccttcaccctgctgtgcgacagctgcggggagtggtacgggctggtccaggcctgcgggaaaggtaagcaggaaggcaacgccatgaccgctgtgtggacggctgccctgcagccttgctctgccccctgcgctgccccttgtgtctgactgaaattatatggtggtggtggtttagtagcgaagtcgtgtccaactcttgtgaccccatggactgtaacccgccgggctccagtgtccattctccaggcaggaacactggagggggttgccatttcctcctccagtgcatgaaagtgaaaagtgaaagtgaagttgctcagtcgtgtccgactcttctcgaccccatggactgcagcctaccaggctctcggtccatgggattttccaggcaagagtg

SEQ ID NO: 56171 - DNA, 1276 bp, Bovine  19866880817391
atgtttctgtacatgtcacagacagatacatacattagtgatagatttatcaaaataacaagtcaaactcactcatagccagttctaattatgaccttcgtaaagttcaccagggactgtaatattccagaatatatactatctctggtgaggataatactgttattcaagagaaactcatgttttagacctagattctcattctgaccctaggaggtgggtgccgttttccagttctactgataagaaaacccagcctccacagtaattaagagtgtgctcctgtcccacaaaggctgagagagagaggcttgctgagactcatgagcctctgttcttttcacagaaccacaatgcctttctgtgttagaagaggaaatacagttgactatactttctcaataaataatttgtcctttctttggcagaaattattttcctgtcagtcatctgtccagaccattatatgtgacaaatcatttctaattatcttctagagtaattacaaagcctatattcatgaagaagagaactgagttcctttgaaacaaagcgttttcttgagatttccctttattcagctgaaataaaatacactcttaatcagaatgattttctgacatctttgaaagtctgataatgtaagttctcaggagtgattcttgaggagtttgtagagatgtatttatcctgctgcagtagttcttgttaaaccagcaacattgttctaatgttggtctataacagatgaatttattataagtttatttttattctccaaattaagatctttgaactgaaatttcatatttttcatgattttgctttgcattcctaaaaaattcttcttaattttccaaaatcctaatttggttctcctcagtgctcattctttccagattacctctagttataatttcagtagtcacattttgtgctgtcatatatgagtgtttggggatcagaggttcttagtgctcttactatagttccacgaaagttgtcctaacacatttccttttttatagttggtaagtgttgtcgttttatttgattcagtttcccttgcctatcattgttagttttattccaatagaagtcatctgggaacttgtgtggaggttcagtgattaagactcggcgcttccaatgctgagtggggccaagggttcaacgcctggtttgaggagctaagatctccatgctatggggtgcaaccaaaagggggaaaaaaatcatctgttcggagttcagctggttttctttcttcagattt

SEQ ID NO: 56172 - DNA, 1218 bp, Bovine  19866880914144
tttaaacatggaataagagcactagaaaacaagaggtggcaaaaaaactgactgtaaatttagtgcttgaatataaataaaattttacctgactgttggaatctccaaacaggatacacaaatgtggtaccaacttgctgaggactagtggctgagccccaaaactaaatataatttgaaaaaaaaaaaaaaaagtaaagagaatttggttttaattaaatagtaaacaaaacactgttatacttttttcttgtctgtctcaataagacaaatatggtggagagcatgagcatacatcattcaaacatgaaaagtatgagacacaagcaaaaactaatcctaaacaatgtgagatatggaaactttaataatcatgaccgacaatgaaaactgtcaacacatgatccaacggagcaaaatgttcaactaatggcactcttaaacctagcaacctatcactcactcagaaaatttgaacttttgtattaaaatactgattttttttttaagactctgggtcttacacaaattggcattccactaaaataagtaaattaaaagatatttatttatgcttactaatattttgatgaggtcatgggttgaaagcaaacgacaagggagccaaaaaccacaaaagctgtgcggactgaatgcacttacaagctctagatggcagaaaggaccatagaggagtaaaagaaataaaacaaaggtatagttagagaagaggaagtaacactacaggaaaaattgaaagctcctacacactacctatcttgctgcacagaacttgaaaaaactaatccagaaagagaacaaacgctttcgtttacaatttcctcagactggagctctgcggcatctctgctgtcggatctctgcatactgtggccagctgcactgtctgattacctggggggttttactcagtccatgattttggtaaccacctgcactgctctagaacgcctagggcaagtggcaaaagggggctggggaaattggctacaacagctaaaataccacagagttaaagaaaactccaaatttggtccagaacagaagtagattctaagttctaccagcatatttgttatatgaccatccatttcgggtggcaaccactaacatatgaaagagaaaaagagaaacttatcagtgactagtaatttttaattaacaacatgagagagcacttacacacaaaaaaattag

SEQ ID NO: 56173 - DNA, 921 bp, Bovine  19866880973360
tagaatcttaaaaatgaaaaaaaaagaaagttcataggtacagagaacattggttgccagaggcggtaaggaataagaaatgggtggactgatcttttttttccctttttagcttaaataagctgaataaaaataaataaaatataaattaataaaggaaaactataaaagactagccagacacctgaatcactatgctgggcagattcactgttatgaactgtgttctatgtggatttgtccttctctgtgacctcaatacatcttgaacatgaaagcacaaaaacagacaacatttcaaaatgagaggcagtgccatctactatttaaaagcaaaaggcacacgtgtattcacacacacacacgaaagctgctgccagctcgccgctactaataaagatgaaaatctctaaatgatctactgccagacttgatcacactgatctgtttctgatcggagcagaaggaaagcagagactgcaggaagatggaaagtaccgctcggtttgacggaaggaaatatgattagaatgcacccaggcagaaataatgactcgcctccccccaggacaagcccaccctcccgcctgtacccacgacaagccctgcattgctaacgacagggtgctgggaggctggtggcatctcaaatcccacctgactcatcatgcaatcaaataatacacaacttgagaagcccagacacttcccgaaggatggtgcgcaaaggcaggttgcacactcacctccgtgcatcagaacctaaaaggaactctctcattagatgggtgccccagaggagcctgggagggagatgtggggtggtgtgggtttattgagagggtactcttggaaggaactctcggggagcgaggagaacagagaggtcacgggaaggcaggaaggatgtctgggtctcag

SEQ ID NO: 56174 - DNA, 947 bp, Bovine  19866881011593
tgcagtgcctcacaaggcccacccacctcagtgagaggacccacactcaagtgagagctgacctgctgaccaagggaaggatcttccttcccaaggaaacaatcccaggattggattctagcttaactggtaccagagtctccatttatttcctaagctattgtctgaattgaaccactgctgcatttcaatctcacgaaagcctctgtcttcagaggagggggaaaagaaatgcagtcactatagaagaaaaaataataaatgaaaagggcaagtcccactttccctgtgtgaaatctcatagcaatttctggaatggaagtggcagtgtctctaagtccccctggcaagcctgaaatagggatgaagtcctcatccctacaaaacatgaactgcctcccagctatgaagatatattttcaaaaccaaacttcagaacctatgcatttgacggtcaggatggactatgtgcagctggagctatttcaggacttatgaacaaccaggacttctgattcacacagcaaatagcccttccttggtggtgatccaagcgctgcccatggtgctatatacgaaaaatccaatagctgtatttctccaaactctatagaacataaacggacaaaacagttttccattacttctaggtatgagacaatgagtggtaggacttagatgccaaaatggcagtgcttctaaaatattttcaggatttgtgtggatgatgcaacagaaagtttgagagttgttaaaggaaatctgagctgaggagttgtgtcagtcacagctatcattacagtgctgtaacgggaatggggaactcaggagatgctttgaagtgcttccttagggctgaatttctgaggcaatgagttcactgtgaacaaaacttatcccccaagtctccaccttttacatcccagagttctctgggtgcgtgcttg

SEQ ID NO: 56175 - DNA, 3073 bp, Bovine  19866881029597
tgtttttctttgctattattttagttaattataatatttattgtatggacagactatgctatcctttttcaatatttaactggcttcaattaattgccattattaacaatgttccatctttatacataaatctttacatgcatactcgattcatttactaataaaaaaatcctagaaatgatagtgtcaaagaatagttttcatttgttaagtattctaggtcatattgcccaactgtccttccaaaaaatgactctcagagtcatttgccattgatctgccatcaacagtactcaaatgctcaccttctcacctcttaaacaactcttaacattatgttcaaattttttttcaatctgatagccaaaataaggtctttcgctatttgaatgtgcatgtgtttaccacgaagattgagttttttcaaacttttcttcttattaaaatcatccaatttgttgtgaggttgtccatctttttcttgttagattatagatctctttctcattgaaatacattaccattctatcttgtatagcatactcctttgtcatttgcctgctacatttttatggcttcttttttagtatttctgtaataaaaaataaatttcaggactttgggttctggaaactgggtaaactaaggccttctcccagctccactctatacaatccacatagaaattatagaccaaaagaataaaattaaatatacagcttaagttaaaagacaagagaaattccttgatgccaaaaacgaaggagtaggataaaaccatgtgcagagtcgtgacacttgagaggcatgtcaaactgaacacgggccttaagggtcttgtgttttaatagttacataagagtgggtgataagctttaaatctacagaaagcagagagcaaaagcagaacttattccctaacaccagaccatggaaaaactgttaacttcataaaagagaagactggctcttaaatgaaaatatactctgtagcaactctttcacaatcaataacccatgaaactgacacaagaggaaagaaagaaaaagtaagaaaaagttttgctgaaaatgtgctcaaaatccaaaatgacaagccacactcactatttactgttacagtatacagaaaaaatgggcacagctgaacttgtgataaagaacagtcttaaaagactcctgggtgattatcttttaaatgattaaaaagaagaaatacaaatctacaaaaatcgaaaaatatgaaaaaacttattggcaaatgaacttttagaacctaaaattttactgtacaagatcaacataagactgaacgtaactgaaaagttaatgaactggaggaggagaaatgaagaaattaatgagacaaagaggcagaaaatgtctgatagaactttttaaaaggagagtggaaaataaaagtaggaacttccctggcagtccagtggttaagacactcaacttccactgcagggcctatgggtttgattcccggttggagaactaagatcccacacgccaggtggcactgccaaaaaaggaaaaaaagtaatattttaagagataatagatgagactcttccagaattaatgaaagacatgaatcttcagttaaagtataatgagctttaaaaatgatacatttttaaaaccctacccataggctcatataatgaaaccagaacatcaaagtcaaaatgaaatgccataaaagagacttgaggggaaaaacagatgatctgtaagaacaaagaacaataattaaactgacagcagacttctcaccagtgacaacagaagcgagaacacaattaacaaaaacctttaaatgactaagtgaaattatatatcaccccagaattccatatgcagcttatacatgcctcaaggaggagggagaaatagtcactttcagattaaagactgagatttacgtatcataacagaaaagtaaaaaaaagtaaagtgaaagtgttagtcgctcagttgtgtctgactctttgtgacccctgaactagatcaccaggctcttctgtccatggaattctccaggcaagatatactggcgtgattcctgcttccacggacatcaccgttcagtttctgttggctgagtttaccctgtggtcccaccatctagtcctacccagttccatctgttagggaggggtcctcatcaccttcactgacccatttcagaatctctgcagttgtccttgaaacagtcactcagccgtgcccaactctttgtgactccgtggactatagccctccaggctcttctgtccatggaattctccaggcaagaatactggagtgggtagccatatctactaaagggaataatacaggggcggggaaatgaaccctaagacaacagtgggaggaaagaagcaaggataagtaaggaaacaggtaaataaatgagtaaaattatgcaagcattgaatgaaaaaataaaaggagtaacaatagtaaggacttatttggaggactgaaaacgagtagaactaaaattctataaaaaagaaacacgggcatggggaaaggaaagatcagaattaaaatgttctaaagtccttgaattattcaggataaggctattgttgtagctgttgttttaattaactatgcacgttaaaaattaaagtgtaaccaataaaagaatagaaatagaatgaataaatttcaaaacagttgaagctaaaaagggcaataaagaatattttattaacctaaaagaaagcagggaagaaaaacagcagagaaaaggcatggtaaatagaaaacagaaaataagatggttggtataacttcaaatagattcacaatcttataaattaatcagattaaatgtatgaaacagaaattcgctgattgaatgcttatccatttgaccatatgctatttaccacagactcatctgaaacacaatgacatataaatgttagaagtctatgaatgggaaagatatgctgggcatattcaactcaaagaatgctggtgtaacaacatgagtatcataaaaggaagactaaacaaaaaaatacagatttagagatatacttattta

SEQ ID NO: 56176 - DNA, 1317 bp, Bovine  19866881183895
ctcctgtctggtttgtctcccgacattcctcttccttcctgggaatcctataaacttaagcagttaaaggtttttacaatttctatctgcaaatgaatgcaatttattctcagagactatttgaaatgagaattgtaaagacatctgaaaattatgaaacatttgctttttaaaatgcccatgtaaattcaccctaccacaaaggtttgtggaggaaaggtagaaacttggatgaagtgatccaggcgtcattgccctgggtttgttaagatttgctttagtggtttcaggggaaccaggagggctctgagtggaacatggggatttcagtaaaatatggatctaggctgcatatttaagctttcttcatttggagatgactgcttgcctgacagctcaagagaattctgagagcttcctggacttaagggcttccctgatggctcagttggtaaagaatctggctgcaatgcaggagaccccagtactattcctgggttgggaagatctgctgaagaagggataggctacccactccagtatccttgggcttcccttatggctcagctggtaaagaatctgtctgcaatgtgggagacctgggttcgatccctgggttgggaagatcccctggagaagggaaaggctatccactctagtattatggcctggagaattccatggactgtatagtccttggggttgcaaggagttgaatatgactgagtggctttcactttgacttttcactttcctgcacttaagtggtttgtgaggctggcaagcagaagactgggtagcccatgtgtggagggctggggggaggctctcattcaccaatgtagttattttattagctctagtcgctctctacccagagggctgtttgtttcactgaatattaggggctgtgcagaggcatatagctggttcctagagctgtgggtagggcccacctgggtcagcactccaaaccacgagacatctgttaaaaaattgagttttccaacttgtaggcattcctgatggctgatagagagctgccagacttcctttaatcattccatgggactcatttgacatgagtactttgacttttggaattcagatggatgttcttgatctgcttgatttgtagatgcgtgtattcttaaccatttgcctggcagttttgtgttttagaacagtcttcatcaatcatgaatcacagaagggaaactgtttctctactgtagttgaattagcagcagttgtagatggatgcttggagaaggcaatggcaccccactccagtatgcttgcctagaaaatcccatg

SEQ ID NO: 56177 - DNA, 1294 bp, Bovine  19866881222829
gtaaagacccctgcttccatgtaggagggcacaggtcaatccctggtttggggaactaagatcccacataccatgcaacaaagtcaaaaaaaaaattctcttttaatttttttttaataaaaaatataggaacctatacagagcataaagtgggctttctgccctttgcaaaaacatgaggaagcccaaatcaacccacaaaacttcagctaaggggactcgtcttctgcatgacttacacatgtgtgtccttccaggtcagaccactccccagctgtcagtattaaccacagggagagaagcccagttccttgtacccttaatgctttccctatgtcagcactcccctcgttacgtgtgagctaatgttagaatggaacatttggggcagatcaagaagaataaatttcacagttttcagtttcctgtctaagaccagaactggaaagtcagaaaaagtctccagggaagaaggctgtgtaattgtttgagagatggtgtggcagcctcctggagacttaaccgtttaaaagaacaactcctatcgcttctatgaggattctaaaataaaacacaagtgcatatatctaaaaacagactcaatggacatagagaacagatttgtggctgccaaaggggattaggggggagggatggagtcgaagtttaggattcgcagaggtaaactaatatatatatatattaatagaatggataaacaacaaggtcatactgtatagcacagggagctatattcaatatcctgtaataaaccataatgagaaagaatgcatacatatgtgtataactagtcactttgctatgtgccagaaattaacttgtaaattaactgtactgcaataaaattttaaaaaataaataaaacaggctttggtcatgccaagctttcctgagcactcgatctacaaatgggtcagctcatctggaacgttaagcacggcccaaagctttgggcatgctacccaccgccccttccagaagcccgaggaccagctgcttcttagtgacatgggtcttggttgagaaatgggtccatcttttcctttatgagcttatctctctcttgcttcctgccagctttgccagctcctcaagaggagggctccgtctgcccagtgatacatgatctctgaaattcagccaggccagccagagaaaacacgatccaggatttcctcatttaagagagagagaagacaagaacttgaaatttttctcgttcaataaagcccataagtcaacattttccctcagttctctcaatatcccttca

SEQ ID NO: 56178 - DNA, 1018 bp, Bovine  19866881296814
gtcacagggcttgtcattaaatcactgacatccagtgatgtacatccagtgccaaaaataaaagcgcgcttctgaaacatttatggctgagatttaaaacccctggaactgagacattcaaaggtgagtgtcccaggacagctttcagcctggcttcgaggcctcagctcagaacccaggaaggcagctctcatctctctcctggtgatacccaggaaagaaatgtgtctggaggggtgacagagcaatccgtgtggctccaagatgaggctggagaatgcagacacgttttgcttcctcttttacgctttgagcattaattctcatctgcagagaagaggaagggtctagttatctataaacaaagttgggctcaccctcttctgtgtctacaccaggtttagaatgtggtgtcagtaacatgtgggcttcccagtggtttagcagtaaagaattcatctgccaaggcaggagacgcaggttcgatccctgggttgggaagattcccctggagaagggagtggctacccactccagtattcttgcctggaaaatcccaaggacgggagcctggagggctacagtccatggggtcccaaagagtcagacacgacttagcagctgagcacatgtgcacacacatcagtgacatggtcttgctgctgatagtggagcccactggaattgagggaaaatattctgtgctctttttagacgagttggccccaagattaagcaccatgagagccacttcctagttgccatttcttcatctggtggtggtccaccatctccttttccttggcactgtctgcctttctctttacaccggttgacatatgcaaattgtgtaagtccaaaattcacttgctctgagatgcaggacaagagaagatgaattcaagtaacaccactgatgacaagatatctaacaaagcctttcaaggctagcactgccaaaaagagatagactcaggaaggggaaccagagggacctagacctcgactgcaagtcaaa

SEQ ID NO: 56179 - DNA, 1778 bp, Bovine  19866881354487
atggggtggaaaactggagctgtatttgtgataattgagaggaagattgaagattttattgagtaaattcaagagacttcagacagaattgagacgtgattattggatttggatgagggaggtgatatcaactgcttcaaatgtcagggtttaagtcccactctgtcactacgggcaaattagtttaacctccgtgttatttcctgatctgtaccatacgcactccacgagtagatcgagcgggcaaggattaatttgttgttttgtatgtagtgtttgagttgacatcatagctttcttggtcaccattgtgtatcttcaatttctagtgcatagtaggtgtttgataagtatcttttaaattaaattaaattttatatttgaaaaacattttcaagttaaaattaaggtctttttgaactattaagcataggaatagttggagtcttaaaaaaatttaagtatttgatagtaaaaatatctaaaaatatgtcttatactttaattcagaagacaaaacgctgtattatagaagaaagtattaattaacatttagttgtaaaattatataactgagtattaatgttgcaacatttagttaatagtttatttttatttttcaggcgttcatttgaatttttagatttattattacaggagtggcagactcactcattggaaaggtatgcatcgactcttcctcttccaccactctcccctcccctttgtcatcagttctttagaaattgatggtattggatttgcattatttcccattttcctttaaaagttatttgtactgattttcctttaaagctgaggtgctcctcttactcatcgtagctgtgattttcttctttgtggggtgaatgagggtctcttaggtgaatgggcaagaaattccaggttaaattgggcaagaaattccaggttttataagaaattccaggttaaattgggcaggtagtttaaaatgtatttctagtcatgtaagataggtttcccaaggtgcaattaatcaagtaatgaatgatttaggatagaagaagggcacttcttttcagaggaaagagatcaaaaacgtgagagagatctgttggcagatttctccacaccagctgtcaggtgtcattggccgtgtatatcctgggcagtgtttaatgaagctctgcagcgaaaaagaggaaaataagggcagcgagtcagtcactggctatctgtatggctgtatttctcatttgtttcacatgtgaagcttgggatacacatgtatttatgttgaatacattgctgattttccattcttatggaaagcattaaatttattcacatcccatttttaaaaaatagaatagttgtttactgcaggcatgatataattccaagttttctttaagttcttttgtggcagctgctattcagtctggttagtaactgattgtactgctagcacatttctacactggtaggttagtgaggaaccacacacaagattttctttaattcatgaaaaatttaaaatgttagtactatttgtctggattccatataaaaataattatgttcaggtttataatgtttgacttgtcagaaggaaaccatacatgaataaaattagtggggcagattattaggaaatcttgcaatcttagattcattattatatgctagttgccttttttctcccccttgcccatttgtgattgctgtgtgatatacagtatataggcagtatcgtttgtggtgaaatagatagttttatacatgatcccaaaggt

SEQ ID NO: 56180 - DNA, 1023 bp, Bovine  19866881370033
cagaccgatattctgtgagctgctcttccctagaagaaatctgcagatatttgtggccactgctagggatcttagccatcttacagggctagagaaacagaaaatagggtataactgccaaggcagcaagggtttgaggtggccagcataatgatgagagtggagtcacagagaagtgagtcagacactagataattttgtcccctggagggagttgctgaaaatctcaaactatgccagaggcaagcaaagaaagcaatggcgtgtttaccagtcacacagtgctgtgtaaaagttttaaagatgatttatgaatctccattataatccctccacaacagtgccctagaaatgggctacttactatatggactattttgggtgtattaaaaaaaagtatatgaattagtggtttccagtctttctcaaagatatgaacatattctaacaaaacgtgtctgaaaatgttcgcacaaactttgaatccctaaaactcaacccaatgagaagaagctatacaggcatgtaatccaacccctgaggcaacagaccaaaggaaataagcacattcagtcatcattcttccaaggctttaagaagaaagcaatcagatactcagccatccaacttaaggaactctgtggagctgaaaagaggaagtaatcagtaatgatcctttatatgaccttacttgaggctttcttgggagctagatgaggacctgtctgattgtggaagagatgctacactgccagaactctttaagtaagtctgaagactcttctgataagacggctcgagggaattatacagtgtttcagcttcaccagggaagtggtttctaagacccatatatgtcctgtaaaacaaacaacaaaatttaagggttttttctaaaaaaacaaaaacaccttaaagaaataactttgcatgattacacattaaccgtaaaatgtgtacattcaagaaaagcaaaagtttttaaccccaaaggttttaatacagccacaatgtgccaagtga

SEQ ID NO: 56181 - DNA, 1091 bp, Bovine  19866881406046
aaatatgggagcagattatgggtgagaaaacaggtctggaaacttgtttttgtgagagctagtgggatagaggtcatagtatttctctttgaaacattcattttctttagaaaaaaatataatctgatgaatttttccttctcaatcttttacagctcttgcaagcttaggatatgaaaagagctgtgtgttgttcaattgtgcagccttagctagccagattgcagcagaacagaacctggataatgatgaaggattgaaaatcgctgctaaacattatcaggtacgcagaacagtagttactacctaactgtcaacactgagttggattgaattgaaaatcatttgcgtttagggtttgtaaatgtttctttacatacagatgcttccttgaaaaataatgtattttttaatgaattgatacatttttttgaagtccttagataaaagaacggatttgtaaacccagctctgttttcctcaccattgtacacccggcacctagcacagtgcttggcacataataaaggctgagtaaatgttgggagaaaaaatgattaattgtttgagataaaatctttggcgagtcccttttaaatgcatgacctcatttaaaatatttgtacattatttttgcataatttttcttagcgagatatagttaaaatttcaccagtgtcacaaaagttaagacatcttggcaagaaaattttacctctaagacttgtgaagaggtcatagttaaatgtggtcagatacgtaatgttattaactaaatgtaggttttacatacagtcagttactaatatggcatcttatttggcgagagtgtattgttgactcagcttttttttgcttcaatttaaggaaaaataagtgattattgtgaagtggtaatctataattatgttttcatgttttctgttgctttatcatttacagagtacgttcatgttctcttgcacacttggtgatgcacgctgcataatgtcattcttgttttccagatgaggggactagagggcagaagtgttaatgcagtggtcccctggggtttcaggggttctaaattttagggaatcccaaaggtc

SEQ ID NO: 56182 - DNA, 1138 bp, Bovine  19866881950190
tttgggaaccactgggactgtacaacctctgaaactcttctgcacgacctctgaaactcttctggaattcaatcccatctctattttcccctggttcttccgagatctgaaagccttttctcaacctcattcccaggaaactcttcctcttatttcccctaaaagttatactccctagtttggctttcatacttttcccaacccacagtctaccagagaagataaatttattatcttttaaggaaactgttcctaaatctacgtctccacctcttttgagttttaaatatattacatctaaatgccaaagagaaatttctacccagatataacacagaaaagtcaaatttgacctatctattgaaaagaataattatccacaggtcaaaccaagttacaaatcttaaagtcaatcatcaattccttctaaccagcagaaccattggttttcacctctgaaccctctttcaaaaccatcctttccccaacccacagacacgatacttggtctaatctcttcatctctcaccagtttaatgggtctgtttctctctagtctctggatttaggctttttgagtcatatacagtttcattaaatcttagaaagtcactcatctttctaaaccagttttagtaagaatagtgccttttctcactgtgctaagagggagtttagttagataacatgtataaagccctttcacagtgcccaggtggaataagctatgagggaagaacacaaattgatagcacacttgcaactcttcacaatctactctccaatggcttcaccctccaaaattcccgcatcacccagagtttcaactcttatcaataattatattaatatgtgttaatatggtaacttatactatatgatactgttatataatgttatatagtatatatcctataatgcatacacattatactatagttatatgtaatattaatattattcattgtagctagtatttattaagtcttgttttaaggactttacatgtattccactcatttaataatcccacttcagaaatgagaaaattaacacacagaaaggttaacatgatgagctggtagataaaaaaaagccttcactcttctgacttttggtttttctacctgtaacatta

SEQ ID NO: 56183 - DNA, 633 bp, Bovine  19866882014114
ttaagtaggataaaaatactaattcaaaaggataacttgacatctcttttgaacttaaaatctgaatcttcctgtcctacgtcttgccctgggtagtgttacacaggtacgtacgaatgtataataaagggtctgctacacttttacgcatgtaaatgatcactaattttttaaaataggtgttgaaacataatgccctagtgccaaggaactccacacggtgtcacggaatcactgaatttgccactgctcacaatcgtggaaaaagttggtcttggtgggaaggtgggctcccgctagctttcggagaggcaggctcgccgctgggggcaagtccagaggtgcccggggccacccgggggcccactcggccgtcggagcacgtccgggattaaagggccggcgggagagggcgtgccccgccaggccgcgcagccgccgcttacccggtagttgctcgagcccacccagccggtgagagcgtcgaccgtcttgctcagacgggccaggtcctcctccagatccgggatggcgcccggtgcgccgaggtagagcagcagctcctgtccgacctgcaggcggccgccgacgtccttctgctgcacctgggcgctaagtactccatgctgcggg

SEQ ID NO: 56184 - DNA, 2598 bp, Bovine  19866880017775
tggtgattgcagccatgaaattaaagatgcttactccttggaaggaaagttatgaccaacctagatagcatattcaaaagcagagacatcactttgccaacaaaggttcgtctagtcaaggctatggcttttcctgtggtcatgtatggatgtgagagttggactgtaaagaaggctgagtgccgaagaattgatgcttttgaactgtggtgttggagaagactcttaagagtcccttggactgcaaggagatccaacctgtccattctgaaggagatcagccctgggatttctttggaaggaatgatgctaaagctgaaactccagtactttggccacctcatgcgaagagttgactcattggaaaagactctgatgctgggagggattgggggcaggaggagaatgggacgacagaggatgagatggctggatggcatcactgactcgatggacgttgagtctcagtgaactccaggagttggtgatggacagggaggcctggcctgctgtgattcatggggttgcagagtcggacatgactgagctactgaactgaactgaactgagactcaaatccaatcacagtaataactgcattaaatgtaaatgaactcaattgtccaaataaattttcatactggatacaaattcaaaactcaattacgcactactttaggcggcactaatgataaagaaccctgctgccaatgcaggagacgaagagatgcaggtttgatccctgggaagatcccctggaggagggcacagcaacccactctagcattcttgcctggagaaccccacggacagaggatatgactgaaaggtctatagggaggcaaagagtccacgactgaagtgacttagccctagccaagagaaaccagctttaaataaagacacagataggttggaagtaaaagaacggagaaatgataaatcatgaaaatactaagcataagaagtgctggtgtgatatatgaatttatctcaactaaaaatacaaacaaaaaaaatttttttaataaaaatacaaacaagtggcacagtctgataagtcaaacaaacaagttgtagtaaacatttcagtaacaacttatatttactgttttcaaaactgtctacaattcttagtaaaaactgcataaatagaaattcaagaacatattctaactaggtactgctgcaatacttaaggcagatacactgttttccataaaaacctgggttttaactgacaacattaattgaaaatctgaatattttatttaggaatatttcacagagaaatttagggttattttaactaagtaaatacttgtattactgttttctcttttctttattcttgtgtttttatgtttttttctctcctttactatcttttaaaggggatttgggaaggatgaaagataaacccataatgtgcaattcaacttatttcacaggcagtccctgaagatagctgataaagagtcagcctttgaatctctggaaaattttaaagatccaactaaaattcagatttatgtttaagtcatttatgaaaaagaggcagatttgttaatgaaagtgtgaacaaaattaaatgtgaaaaaatatacctcaaaacataaaaagcttctttatctaaaatgatacatgctctcaattctaatgtagctacatgatatttatagaaacaaacctgttaaaatatctaattctgtttgtcccctagtagattttaaactgctgtgttccccgaatcatttcatgcttaatatttcaattctaatctacctacaccctcaaatcatgaaaactagtaaatatggtaaacaaaataacatctatgtaagactgattgttcaaataccctgaagaattcaactcggttgtctgtttcaaaatacacccatttctagggtatgaaaaaaactgtccataaattatttttaatgcttaaataaaatttcaaaaatccaagtattctccttataggctatcttagaggttgttcacactcctgcaccatgttccatacataaacagaacctcaacctttgaagagggcagagagaagtggcatagatacaataaatgaaaagttgcagaaactggaacattttgaaatgtctaatcacatctgttactaacaaatggatgggaaaataggcattcacgcagtggtggaaactggcataaacttcttggaaattaacatggaaatatttattaaaatttaagatgtgaatatcctttgacccagaagtcccacttctagaaatcaagtcggcaaaataaatgggtacatgatgacagagaatgctaactatttataataaacaaatgaaaatattttaaatgtctatcagtggataacagaattggcacaaaagtatataaccaacacaggaaaatgtccatatacactgtttcacaagttgtaaaatagtacttttaggatgatcccattatagtggttaagagtacagacaaacatcaaattttttgatatgtatctggggttctctacttactaactgtggaactctggaaaagtcatcttccttataccgaattttttcatttagagaaaataatagtagagga

SEQ ID NO: 56185 - DNA, 1022 bp, Bovine  19866880186908
cagttcagttcagttcagtcgctcagtcgtgtctgactctttgcgaccccatgaatcgcagcacgccaggcctccctgtccatcaccaactcccggagttcactcagactcacatccatcagatcggtgatgccatccagccatctcatcctctgtcgtccccttctcctcctgcccccaatccctcccagcatcagagtcttttccaatgagtcaactcttcacatgaggtggccaaagtattggagtttcagctttagcatcattccttccaaagaaatcccagggctgatctccttcagaatggactggttggatctccttgcagtccaagggactctcaagagtagggtagcctatacatagatctcagcacccctaggacttcacagagggctaggcagagataactgcttgtgtagtaagcatgtacagattagtgacagcccacagaaacaaaacagaattcatcatagtgtcaatggatgctaagggaggtttcaggcttgtaacagattcacaggtgtcagcaacatactaaatttttttgtcaaaaggccttatactataggtctttttcctctttggttaatgacttaccttcaaaggttggtttcttcttattatagcaagttcaatgttttttccaccagactggacaacctaatgtaaaacaagtgcaagtttagaattactccaggaaagtctgtgttttaataagcaactgaatggggggaggggggggaatcccatgattttctgtatatgctttattagatcacttacttccagcaaagctcttattgctaatttgatagcttcattgtcatttgctatggcatcttctgtgtaattcttttccagaaattctcggacagttttggcacttcgacctattgcatttgccttgaaagatagaagataattattaataccactgcaatatgaatgaatttatggttactaagtaaagtttaggggttcagagtttattccactattacttagcataattactaagt

SEQ ID NO: 56186 - DNA, 1851 bp, Bovine  19866880392818
caaaaagaaaaaaaggaagaaaagaaaaagaactctgcttattgtcacaaagaagaaacattttaaatgcaacttctgatttttcaatagtaccaacaaagcacaagaagatactagggatatttgctgggctttcagggttcagcttccattctattgagctcagtctcaaaagtctatcagtagcagccaattagttacaaattaacagggagcaaacccagcattgaccttggttaagctctcaatgaatcctgttaattaccttattttttacttgtattattctatggtgtaatggttttagatgcaatcatacaaatgaactgcctttataccctacctacctctttttttcttcttttttatgttgaagaaaaagaatatttaaaattgcatgagctagtccctttatattgttaacttctcccactctttcccccttgataattccacttatattacttttgctgttttgggggtttcatttaacatcaccttatggaatctgttaatcatgcattattaagtagagaggaaattgatagggaatgaattttcaagtggccagagaagaaaacaatctacaatgtcctaatttaaagtcctacagatgtttaagaaagtaaggccttggttatcttgatactaatttcataaacaatatttttctgaaagatatcatttcactgatggttttcttctcatggggtcacaccacatacacacacacacaaccaaagacatctatttctttacatagaaaatcatcatcttcagtgtgtatccaattctaatttgctatggattttaaaaaattgcaatcaacagacaatgttatatttgttttaggtgtacaacacagtgattcggtattttcatctcatacaaaatgatcaccatgagaagtcgagttaccatctgtcaccatgaaaagctattacaacattattgaccatatattccttacactatacaattacatcccagtgacatttattttataactggaggtttgtacctcttaatccccttcccctatgttgcccaacatggcgggaattgtaaaagaagtactaggtctgtgtctctataacaacagcatttccctctcattacccctaagatgagtctttctttggagttatgaaaattcctctgcccccttactctcaagaaagcacgttggaattgcaaatagattccagggtggtagttatataatttgtatgtaaataattttccaatttcaacactttagaattagtaacacatttcgtgaaacaatgagaaatgcctggacgtttcttatccttacacaaagattagcagaaaccctccaactccagagacactgatgtttagatgttgtttagtcgctcagtctaaacaacagtttcgattctttgtgatcccacggacagtagcttgccaggttcctctgtccataggatttcccagacaagaatactggagtgggttgccatttcttcctccaggagatcttccgagagcagggatcgaacctgtatctcctgtattggcaggaggattctttaccactgagcttccagggaagctgatgtttggatacatctttaaaaaaaaaaatggtggacaactaggcaactactgtcaagggaaaccttaggagcatttcaactctactgggagagggtttgcaggagaccttcagagtcatttcccttcgaccctggatcccagagggtctcctgctgcaggggaaaatgttcccttgttgtattgtctcaggaagcggcaccttgtggcatcagcttcagagttgattcctaattagcctgaggacacaggggcacagattcctgggca

SEQ ID NO: 56187 - DNA, 1830 bp, Bovine  19866880478513
tatttgtctttttgtgaccttgaggttccaaatcttagtatattttaaaaatatggtaaaactagtccagtagaaatttttatgttcctacttctctaccacaggacaacccactgtcctttattattggtctatttgtatataaaggtgtgcaaatattttattaaaagtggggcatgctctttcatcattaagcacattcctataaatatggcctcgttagcatacttttttctttttggcaagaacagttatttgtaaatttcttcatccacgtagttattctttataatatcataactcctttgagaaagatacaggaatgtctgagttcctgccctactttttgattaattttttcaaagcttcatttttatgtgtcatttgagtttgtcacaaatctcagaaacattaaaggttccctggtttctaataatcagagattgtaaagtacttttcatttattgtatgtttgaatctgagaaagtctataggttacagggggcagaaatgaaatgtactattgatattcaaaacggtgattaaaaaaaaatcagtttatatcagtattaaaatggaaatttatttaatttttatttatttaatagaaatttaaatttaaatttttaatttttaaatttcaaaacagatatatgttctaacttggctataaatatattgaagtgtttgtttccttggtgcttcttcagttttgagaatttaggcacatatattttcccctttattcctgtatttttaacttagatcgttgtcagactttttctgaactataaacagccagtactttaagtaatccaacttgaattgaaaatgtccatttctttaatgagttggtgacattttagtacaatccttattttgaaattagctgaaaactacttttttgtgttgatttgtattcatggtgttttaactttaaaggcaattttctttgaaaaatgggaaactggagagaaccttcctatatgctctttcagtgtttacatagactgctgattgatttgcccctccagtcgcttaaattgcatggatcaggattgttaaaaaccctttaacaatttgatttttttattctcacaaataacacaaaattgatatttgaaaccatttatatttttattactctgtacctaaaaattgagggtctacttagtgtctgcctctttctttatagatggaaacctgaaatgttacctgtttggtctgaatttgctggaataagcataaaatcccagaggggagtggggtggagtcttgctctttgaggagtaaatccttggctcaaatgcaggtttttctagtaccgaaggggagagctttcagtttggaacgctgcataaagtagtggcaatttttaaaaatataaatttcagagaattaaacttagaacattcagcattcatagcttatcatttttgttgataatgaatcaacaaaagtaaatttggagaaatttgttttagaccttcttcctttagactttttttttgttatgcaaaactccctcttatccttcaaaaatctttctagttgtacaatttatatattaaactatcctctatgtagatttacatttaatattctcagaagtcttgctagagttgaatagcatcagccaccgtctccgggtgttactctggcaaaaagcaacaagtaccaattatcatttagaaccaactatttattccataagcctgttaggtctaagggagggggactgttaaaattggctactttggagtatttaatttctccttaatttacttctgtgcattgaagtgtagaaatcagttcttagattaatataga

SEQ ID NO: 56188 - DNA, 2547 bp, Bovine  19866880490144
gaatctttgtatccttgtttgatgtaagaaaacaatctacacttagagcctaggaaaaatcataaacttgatgagaaggggcttgcagggtgaagagatagtcatcacgtagagggaagcatttctgtcagaggggaaaacatggtggcatgaaaagtctggagcatttggagggtctttactactccacattatgactgtgtccaagcacaaaattctgatcaaattatcaaaagaaaattctaaaatgagtcctcaaagtggcttttgtcttcaaacacgttgctgaaaagaaatctttaaataaagttcaatatgcaaaacaacaaaagtggaacttcctggttgaagaggcaggtgagagacacgaggactacctgtttcccatccctccatctaccacatcctcatgctgcccttggtgaagaaagcacagtttgaaaacgactcaggactgtctcctcgattagcccacacataaacccataggctacggaaatattcattcctttactcatttcccagcagccaaaagcccattagccccagacaagaagcttaaaacttgagagccctggagtcaaaatccctcccctctccctgctgtgattttacctgcctgctgttcctcaaaatgaagcaagagactaaattatttttttaacatttggctgaatgtattcacttcatttgatagcatacctgagttttaaaaaagtaatttgttaaatggattatgcaaagttttagcattactgactaacatcttccctcacatatgcttatgttaacttcccaaaacagcctttggccatcagaaagacaaggagagagtccaattagctgccttggtccattctccttgatcaaacaacctatttggtgattcacattctttcagtttctcaggtataaatgtgatttagtgccttcctatctggacaccagatgttttatttgaaaatagttactagaatataaatggaatgaaaactaatcacgtttttataaattcaaataaggtagtttgtttctttgagaaaatctttggtgactgagcaaagaaaggagtattttcatcagatgaaacttgggcattgcacaagaaagccctgtgtaatctttccacatagctttgggcactccataaatattaaacagcaacagtaaaaccaccatggccatgacctgcaatacctctggattctcttggcttctcatgaacgctgtctacctatctaacggtataatgtttgttagagaaaatctaaagtgtaatagtctgtctctacttagtaggagagggaagtaaggttcctgtcaagcaagtttaaaactttgagtatttctttatagatacagataataaatttagttacttctcctgtgctcagttgtttagtagggataacttagaatcggaatgttgttgttaaagcaaatttcaattataagaacaaatacggtgtatttttcaagtttatttattgtaagggggaaatcagtgaaagtggccaaaggatataaacttccagttataataacattctggggattgaatgtatagctggtgactgcagttaacaatattttactgtgtattcaaaagtcgctaagagaataaatcttaaaagttctcaaaaaatctttataactatgcgaaatgacatatgtgttaactaatcttactgtggtaatcatttaacaatatatacatatactgaatcattatgatatacaccttaaacttaaacaggattatatgtcaaattatgttaatatattaataaagcaggggaaatttttgcttattatatttgtttgcaagggctgccatagcaaagtacaactgattgggtggcttgaacaacaaggttttctcacagttctaaaagctagatatctgagttgcaggttggtttcatctgaggccagtctccttagcttatagatgatgatcttctctctgtgtgttcacatggtcttccctttgtgtttatctgtgttctaatcttttcttgttataaggacacctgtcattttggattcgggtcaacccatatgacctcatttaaatttaattacatttttaaggccttatctccaaatatagtcacattcctgaagtatctagagttataatttcaacatatgaattttaagaggatgtaatttgtcccataacacttactttaatttgaaggagcctcatgctcacttactataaatccctcattttgtatttgaggaaatctgatctagggaagtaaagggacgtgcacaagaagagatttgccataaggacagaatgagaaagggacaggagagtccattgttctttttctgaaaatttagagagggaaaaaactgttccgtgaaaacctggctgtgtgcagtggagctgtggtgtaaaagtcattccacttgatctatggattggacatggtgaagtttacacgagaactggacacttcctcttagtcccagatgtaattgcactgacttatatttagagcaaaactacgcgacttcacttacctatcaaag

SEQ ID NO: 56189 - DNA, 1970 bp, Bovine  19866880544475
aaatgtttcagcaatgatgtctgtcatataaatattaaagcacagcttgagtcccctttgtacataggcttatacttcatgattgcttttagatgttaagggctagagttttgatcttggtcatttctccccttggttttcttgtctctaatacagttttagaatctatgcattccttctcgacaaactgtgttcaattgagcaggtttttataaaggtgtctaatttcttttcatccttcctgttgacttcttccaattttgtcattctcattcagcacattaaaaaagagtaaactgggtacttccctggtggtccagtagctaagaccctgcgctcccattgccgggggcctgggatcgatccctggttggggaaactagatctcatatgccccaactaagatccagtgcagccaaataaaaataaagtaggctgcctttgggtttgccttcagcttaatctcaatccagtgaagtagctcctgctacattctattcttattgacctgacaggttatctgtctatttgaaaaccttgttgtctggctaaaatggctgtggatatcaaactttctttaaatttatttttattggaggataattgctttacagtgttgtgtgggtgtctgccatacaacaatgcaaatcagccataaaaatacatatatccctatatcccttccctcttgaattctaattgcaacttcggggccatctttttcctgttttctattttttcctagaaaaacatcattatacgtgtcctctctttttattgcaagtttatattttaaatatggtcacttttaaattgtgatggcttttttattcccttagatacttttacaaaaatgtaagtactgacattcttccatttcactgtccgtttgtgaaaggttttaaatagattactaattgccagattgtgacttcaaacaagcaggggcatttttgttcagtgcatctgcagacttgtctgaaatgtgtgctgtgtgtcctagattaccatctagccttcagtgttttcctttcttaccacatcatccagaattctatggagcaagccatctgaccttggagttcaaacagcctgactccttaaacatttgttatatatattgtgacccttatttccttttaaatatcttctttctcctgtgggaatgtgagttcagtacatctgtgcagagtgagacaaagaattcattttctgtataacaattcctagcattcccattttcatttgttatcagacaatagaagaaagaaaaaggaatgcaagacatgtagctactggcacattagtctcacagtgctacctctggaaactacaaaaataagtattaaatgattaaaatgcataacagtaccctgaagtacttggggtttttgattgtataagatagaagaactataagaaatacaattttccataaaacattattgtgcaataaatagaatactgactcataagactcattactgattagaaaatatattatttaggtacaagaagggtaagggacttttttataatgaaattttaaaagatatggagtcaatgaaatgtgatggtgaaggctaactgttaaattatagcaaattgtgtttaaactttatgctagttctacaggagtcaaaattcatggaacactgaacagggcaaaatgaaatttgtcattaaaagtacattctagcaatcaaattaatgtagtatggagaaggtgttcttaaaatgacaagttataaagaacttgtatacatagcagagaaacagaattgccgtgtttcaaagcattggtagtctaagtggttctcaaactcaggtatacataagaattatctggaggacttgttaaaacacagattgctgggtcccaggcacctatgatacagcaggcctgggtgaggcctgagaattcacatttccgaccaatttccactgattttgcaattgctgctgctgct

SEQ ID NO: 56190 - DNA, 1033 bp, Bovine  19866880562958
tttgctggtgactggtcagctcagtgggttcacctgaaggctgaggccgttttgtgggttgaacctaccttatccttttcccctttacctctccagtaatcagcttttacttcccaagcccacactgaagatgaactgggatgaaggatgcaggtgaataagggcaaatccatcaccattagtaggaaaaggactcaaaacttcctcactaataatgtggatttgttgtcatctgcaaagccagaaagacaaggacagcacttcccgatcatcttcctgatctcatctcatctgagacctacttaaacttcctgagactgtgaaatctaccttatttattcgtttgctgcaagtcccctggtcccccagcaaatacacatgcctcgcagaaccttggaaagtcatcggaaactctccagcagttatgaaccatagttttaaaaaacctctgaactaacaaaattatcattctgtcccagatttaaactgaattgtggtgattatagcgtatactctgcagttctggttgagagggcaatttaattagaagcctctatcttgaggctcttataacttcaccctttccctcccccctccaaaaaaaaaaataattctttaggatgaaatttctcatgctgtctctcagcctaaaggtatgttttcttgtagaaagttgagtaagattccatttaggctatttttaaaactcaagaaaaagggcaaaaagggagattttaccacttaagaaatcactccgatacttttttatgattttttttccccaaatgcaaactgcttcccttagaacttttaagttgcccttcttagtgcctttggcatgtttgaagaaatttggttgatctgtaatgaagttgttcacagaacgtgtgttgctcatatgaagatttatttccactctttgaaagaaatttgcaaggagatgctacatggggaattaggattcaaaccaggtctgtgaatatgtgtgtgtgtgtgtgtgtgtgtgtatgtatgtaaaacgggtgcattcaca

SEQ ID NO: 56191 - DNA, 1138 bp, Bovine  19866880567393
catggactgtagccgccaggctcctctatccatggactttcccaggcaagaatattggaatggatagccatttccttctccaagggatcttcccaactcagggatggaacccaggtctcctgcattacaggcagattaaattctttactgtctaatccatgttaaaatgaactagaacaaggttataacagcctagtgaacttaaggagccgtgagcagtgcaattgaagttctggtctccactctggcaaacaatctatgatgattacaaaaacccaacagtcatgatacagtttgtatttccaagtatatatcctgccaggctcttaaagaacacgtttgtaatacttcatgtagatttttaaactttgagaaagtcattatttgtaaaaagcagctttggttttagtgcactttccctcaagactcgaaagtaaaagttatgggagcaacagatatgggaaacagtggtatcaggtgacatctgcagtttgtcccatttatatgatcacagtaaggaagaggaaacatgagaaaatcttgtcattagcagggagactttttttttctttaaatgtgttgtaggtcagtgcttggttctggtttttgttggaagggatgaggagaaacatcagtagatacatctaccgcccagcgagtctatggactggcttggcgcctttgggtaaattcttaaactgtgataaaccaagcctgagtcccagaagggcgtcgacagttgcacaagacgcgcacacctatgacaacgcattgttgatcctggtgcagccaaaggcaggtgctgtcagtaagcaccctcctgatttctcaaccccccacacccgagaatgttgtctttgaatcatgagctgataaaaacttcatatttttcacatgtcacttttgatttagtgactgtgtaaataatcttgcaacataaattcaaaaccttaagcctctcaaagtacaaagctaaccaggcacatcatccttcatgatttgaagagataattgaatggtgttttcaacaaaagggtggtatggatattttatatattctttaaaacgtgtagatgcttttgaagctgtgtaaatatgactcttgggccggttagcagctttctttccttcttagctt

SEQ ID NO: 56192 - DNA, 1514 bp, Bovine  19866880591932
tgctgacattactttttgtgtacagaacccaaaatggaatccattgttaaaaatttctaatcactgattaggattttttttaattcaacaagatgcttaaaacttaggctaaaagagtttataaaactatccttcttgagatttgaagcaatacacaaaacaaagaataactttcttttgaaatactgtaatttgaaaatgtttgacacattttcctttttggttgggctgtgatttttgttttttccctgttaacaaaacatgtatgggctgctttggagttccaatttgatctgcctcctcttaggtgtataaagcatcagtttggaggcagtaccccatcattccttcgtaaactatcttttccaattttcaatgaggtataccagcagcttcaatgtatagcatccttccctgacaaggatgtccccttggtatcagagcagcacgtagcacgtagtgacatgaaccagggaacctcgggcacaaactatcaccatttatcaatgttttgacatcaatgggtctcagctgaccaaagtcaccactgggcctttccctgtggcttgtcaccttcaaccacagaaggtgactgtcatagttagcttagcaacttctgattccagcccagaaaacctaacgctttgagtcaggttccgtgtaggatgaaatacatacagttttctggtaagtaaagactcctcttgtccccctgcatctcagtgcaggatgtaacagggagagacaccttacctgttaacaagtgaagcaggcagtaacaaacaaagccttgctgtaattaaacacgtacgaaggcagaggcctactactggtgtaaaccgtatgtcacaaccacttttcaggagacaaagctgaatcctagtcattaagaacctcatgggatatataagcacgacttagtaaaagtttataactgtaaacaatggtctcccctactggtgattattttctagaaactgaaatgtgcaacaacgctctcgacatcttctttggcagtaagtagcaagggtctggatgacggggctgtggtcacttcaggagggccaggtatagagctcgggaatacttcatatccctctcctgctccatacagaagatcaggtccctgaggcagattctcgtgattcttggacgaaccagctgcttgctggctgtcagactggacgtcccagaagcaaacaggttgtcttttaaaccctaaacaaaataaagggagaagcaagtataaagtaagccatctttcaaagagaaatctgtcagctcagcaagaggctgctctcctctggctcctgagttcggtgctggaggtcacatcacgatggagctcaaccaggtcctccagcactgcaggctgtcaggggagccgcagccggcacacctgcttcatgccctcactctctctcttacctggaccacagccagagcctcttaactgacttctccactgcactccattctttgcccacacagcagggcgaccgttcattcaaggt

SEQ ID NO: 56193 - DNA, 2122 bp, Bovine  19866880665680
aatgaatgtttagggaacagtttgcgaaacagggtacattaatttgggggcatttttgttgagatcctaaagtgtgagcctgtgagatgacacctggggacccactgtgtgtgtctagggaccacagtgtgaactggaactgttgacgtcacagtcagagcgcagaacccccagccctgacacaggattacagaaaactcccgagcccggcacgcagaagttacctggaaatccacaccgtgagaatgcaattgtcctgaaactgcggaccaacctcttaatgttgcacacgcccagctttcccttcagtgctgccgttgttgttttagtctctcagtcgtgtccgactctttgccaccccatggacagtagcccaccaggctcctctgtccatgggattctccaggcaagaatactggagtgggtcgccacttccttctccaggggatcttcccaaccaaggggttgaatccaagttaccgggaagccctcccttcagtgcagctccaggtaaagtgccgtggaatggccagcacgttgggggtgaagcctgccagagccggctctctgctggcaaggcacacatgcctagcactgccatcctaaagcaccagatacacacaccccttgggtggccatgggtgttgactgcaaggctgaaagctgagtctcttgggttttgcaattagctacatatgccagtgtgcttagtaactctgctgctattcagaagagaccaattcagcataatcttatgtgggagttaactcatatacttggtttaaaagatataaaagctctgtgaagcacacagataggatggctcaggggactgtaacatgagatcttgtctttcacttccaggttagcagctcttttagctaggcattgcctcactgccgcccgataggtttgcttcatcagttgtatcaacccacttcctggttttaagaagtccacatcagaatagccatcaatataacaactgctgttaatattatttttgatcaaggtgaccattaaggctgaaatagacctaactctgaactcagatttacgttttcttttaaagcagggatctctagcctctaggatctaatgcctgatgatctgagatagagctgatgtaacatagaaataaagtgcacaataaatgtaatgtgtttgaatcatcttgaaaccatcatcccccatccctggcacagttcatggaaaaattgtcttccatagaattggtccttggtgataaaaagattgaggactactgttttaaagcatgggcttcccgggtggctcagatggtaaagaatctgcctgcaatgcaggagacctgggtttgatccctgggccaggaagatcccctgggaaaggaaatggcaacccactccaaaaattcttgcctaggacatttatttagtggctaggtagatatttcagtgtcaacattcagttcagttcagttcagtcgctcagtcgtgtccaactctttgcgaccccatgaatcacagcacgccaggcctccctgtccatcaccaactcccggagttcactcaaactcacgtgcattgagtcggatgccatctagccacctcatgctctgtcgtcccattctcctcctgcccccaatccctcccagcatcagagccttttccaatgagtcaacccttcacatgaggtggacaaaatattggagttcagcttcagcatcaggccttccaatgaacacccagggctgatttcctttaggatggactggttggatctccttgtagtccaagggactctcaagagtcttctccaacaccacagttgaaaagcatcaattcttcacagtccaactctcacatccatacatgatcactggaaaaaccatagccttgactagacggacctttgttgacaacgtaatgtctctgcttttcaatatgctatctagattggtcataactttccttccaaggagtaagcatcttttaatttcatggctgcagtaaccatctgcagtgattttggagcccagaaaaaaaaagtctgacactgtttccactgtttccctatctatttcccatgaagtgatgggacccaatgccatgatcttagttttctgaatgttgagctttaa

SEQ ID NO: 56194 - DNA, 1273 bp, Bovine  19866880777818
gtcatggtgagagaagcaaatttccttcctttaatatttatgggaagaaaagaattcaaatctgggaaatgacttataaccttaagcaataggtcagggacagaatgttgcatgtgaccacaaggaccaaacaggtgactagtctttgggaaggactctgaggtgatgctgtgaggtattctgctgtgtgtgcatgcctatgcgtgtatgtgtgagtgtactgtgtgtgtgtgttagtcactcagtcatgcccaacttttgtgaccccctggactgtaacccatcaggttcccctgtccatggaattctctaggcaagaatactggagtgggttgccagttccttctctagactgtattgtgtacctgtgctaaaatagtgatattaaataattataactaaaagaactcattatatgctgaaagttcatagaagaatagtggattcaacactagaaaaagaaagggcaaaaaaataaaaaacagccagaaggtatttctgtggtcatttaagggtaaattgacaaggaaaatcctcagagaattgcaaaagtcactatgcaaaagcatggatgccgtgccacatggatgctaaaaacagtctccagtgttccacctcctggtatccatgtccttgtggcttcttcccaccaagtacatggggactatggcttgcttctaactaatagaatctgtccaaggtgatgggatgtccatgaatccatgtgagattatgttacgtaagactgtaatgctcatctcatgaggagagtcactcccgtgttggctttggggaaaccgtgctgggaaagcccatgtggcaaggaactgagagtgttcttcagacgacgggctctcagtccagcagcctgcaggggaccgaatgctgggagtggatccagccccagtcaagtctggggcctggctgacaccttaagagcacctttgtgagaccctgaacccaaggacacagttaaattatacccagactcctatctagtggaactgtgcaatagtaaatctgctgctgctactgctgctaagtcacttcagtcatgtccgactctgtgcaaccccatagacggcagcccaccaggctcccccgtccctgggattctccaggcaagaacactggagtgggttgccatttccttctccaatgcatgaaagtaaaaagtaaaagtgaggtcgctcagttgtgtctgagtcttcgcgaccccctggactgtaacccgccaggctcctctgtccatagggattctccaggcaagaat

SEQ ID NO: 56195 - DNA, 1039 bp, Bovine  19866880791996
tgcagctggcactaaattaggtggggttgttattgctctgcaagacagaaataaaattcaaaatggccttgactcattgagaaaatggctctacaaaagtgggataaatttcagcagggacagtataaagtggcacaggtgcccccacagccctagaacagtgtcttgggcatacttggggctcagcaaatatcttgactaccttccttgtgggggttgttgtgaggatcaaagtgtgataatgatgcaggaagtgctctgtaaatctcaaagtgcctcacaaatgagaaaggtctgcaccaatgcgagcaaagttattattaaaggcaaggaaatatgtcctgtgaggcagtgtgaagggaactgaagctgtttaagcaagagaagaatcagcgatgatttcatgagtgtaaccattttatgacggtattgacaagagagatggtcatttcgtctctattctatttgtgtcaaggagaaagggggtcggatggtaccagaaggatttcagttaaatgcgaggaagaactccttttctaggttgggtccaccccggggagaggcctacattctcctgcctcacagatgttccatttgtccaatattgacttttctaattcactgcgaactaagagtaggctctctgcagatccctgttgtaaccctgatgtctgggaccggacttgaaatatagcaaatgcacaataaatacttgttgaatgagtgaatgtcaagggcataaaatactggctcagatctcagggagtcttcattctcggagaacctacaaaatgagggtgatttattcagagaccaaaggatctatccaatgctgatttcatgactctatgtcaatcaaaaagaagtgaaaatgtttatgatacattctcatcccagtcttagctttggttctgtaactgctggtggaagggattattggcaagagtggaaggaagaaaaacaatgtggatttcgtcccatccttacctcttccctatgaagaacctttatgaatagaacccctagaagataagaggaa

SEQ ID NO: 56196 - DNA, 2278 bp, Bovine  19866880794371
cctttgatgggtccccttagacccaaccccacccatatccatatgaagggaaaggttatgaatgaaagaattcaattgtttgcaggaaaaaagtgagtctgccagagatggaggtgatctggagcagatctgatacctaattacaaagtaatccaatacttagcagtctcacctggcagtctttgtcttcaaaggatcagacctttgaatattaatgaattcttcacctcctttcctctctactccccaaatagctactctttcatgaaaagttggtctaatttcttagcagacctctcattatcctcttattctaggatacagttacaagtatccctttttccttttgatgttctgtgatattgcctttaggcttgttttgaattgatattgtatattgtatgacccttaaaaaatacacacacagacaggcacattggagcttctacatggagatactattaatataataaaataatatggaagtattagcataggacaaacatcagagatggcttcataaaagcctctaagacatgagttgggtcaggtaagtacagataagtgggaacgtgtcaaatatggaggtggattcccaggtggctcagtagtaaagaatccacctgcaatgcaggacactcgggctggatcctgggtcaggaagatcccctggaggaggaaatggcaacccactccagttattcttgcctgggaaatctcatgaacagaggaacctggtgggctacagtgcatgaggtcgcagagagtcactcacgatttggtgattcagcaacaacaatggtggaaggtagggtgggtgtttgggaaagtggtgggtggctcacatttgttggttttcaaggaggaaaagcttacacagatggccaaactaaaggctataaaggtgtcccgtggacatctaaggacaagacgctaatcccagcctggactcgggaggaggctgccccctcctctgtgcttggtacagcctcagtcttggctccttccttgttccctgagtcacagaacagtggaggatgcctggtttagggagatggcattagaactgcagagcatgagctgaatgaaatagatctgatgtgaatgcgggggaacggtaatggtgtctgccaggttcctagcttgggtgccctgcagagacaggaggtatgaggaagagcaggtttggaaggtgttatagacagagtttgtgccccctaatccatatgcttaagacctaactcccagtgtggctgtatttggagataagggccataaggaggtaattaagttgaatgaggtcataaggtgggggggccctaacccagtaggactgatgtccctataagaagagatatcagagatctccacctccatctctgtctccacacatgcagggagacgcaggcagatgaggatgcagggagaagacggccatcttcaagcgaggaggagaggtctcaccagaaaccagccctgatggcaccttgatcttagacttccagcctccaggactgtgagggactgcatctctgtctaatccacacccggtctgtggtattttgttacagcagccggaactgactgatacagagggaaacacaattaatccacacttggatgaagatggatttaaagcaaatggtgacttagaattggcaggtcttggttcgatggaagcggagggtgagaaagagcaagaaggaagcaggaggaagggatgtggtccaggttgcagtcttggatagaggatgaactgtggtgacttgccttgagtctgaggttccggagccggacagggcagagagtgaatgtgtagataagctcttggttgtaagcaagagaaattaagatggggcaattaactgtacggaggtagtgggcttgtaacagaaatgaaacctcgcggaaacccaaggtcaggattccagtagagtcattcccctggagtccagacacagagcagccccagggctctcagcagatgctcactccaggagcaggaccaggctgcctcgatggcctgtcttctccctattggctgacttactttcattgtaatccctagagagagagattgtttggttcaggagtttcaatacaggcttctaggtagcttaggggttggttgtgtaaggacctatccttgatccagtccattaaggtgttggtcatgtgatagaatgactacttggcttgacaaatctatcccttcagcagtggctgtgagcaaggcagcatcctctagaaagattctggggtgtgccaaccagtgtca

SEQ ID NO: 56197 - DNA, 1300 bp, Bovine  19866880811983
gacagagcatctcaggagagaaagctgcctgccacatgcatccatccactcggtcattcattaagtcaatcagctggtcatacaaccaactcggaccatcttttgtgctagattctgaggacagaaggtcagagataacagtgataatagtaatggcagtggtaacaacagtggcagctaacatttattggaggcttattttgtaccaggcatgtgctaagagatttcatgtgcattaatataatccccacttaatgcattgaatggcttgtaatttgtccagagtcacacagcttcataaatggtagaaatgaataagaaccttatttattcttgaggaattcataatgagtagactgacatgtaaaaaattgcaacgaataatatatttttggaaaacagagaatggaaagttttttttttaaataaaaacataaagtcctttagtttaatatccattgggttttccaagagtcaacaccctcggacttcttttttggactttgcagtgtaaacattgattcctcccacctcctgcccttaattcacccgggaatttttattgttatagattatctgctggcctgaattgcccttggaattccaagctcacacctgggtatcctggactagggaatggacccagaccagctcgccttggtaatctggagcaggtagacgggctgcatggggggaagaaatggagtgactctttactgtctcctctgtgctgggaccatccattactgtgtctgccggcacaggccagagacactgcagctactaagaggactgcagatgactccccatgtaacttctcttaaccagcacataagtgtgttggtagctctttcctggtttgcctggcctgacagggccaaggcacagttggcatccttcttgctgaatctcttttaattagctgtttaatgaccatcgttcttttccttgttgggcttccttagtggctgagttggtaaagaattcacctgcaatgcgggagaccgcctgcaatacgggagacctgggttcaatccctgggtcaggaagtcgccctggagaaggaaagggccacccactccagtatccttgcctggaaaatcccatggacagaggagcctggagagatgactaaactgctggaggcctccaggagccttgattcctgtaaggcagcacatattgagtccagccttggcaggcaaaccctgataggcttctgcacccccagactgggtggctgtacgtgcacatggattgccaagcacccgtttgccccctggggtctctaaatcccaga

SEQ ID NO: 56198 - DNA, 961 bp, Bovine  19866880834687
cttgctgacccaggcatcaaacccaagtcccttagtcaaacccacgtcccttagtcgaacccacgtcccttacgtttcttgcattagcaggtgggttctttatcactagcaccaccgcggatgcccggatctaaggatagatttgtgctaccagagatcatcttttggtttctgcgctccttctgtagcaatagggggcgatgcttacatgactgaggtgtctggacgaaggacctgtgatctcttgtgagacatgcattgaccctgcctgtggctgtagaacacaaggttctccaggtggggaccttctgaatggggagcattcctgggtcctccgtgactgtcacgtgacttcagttctaaatgagatgcagagggtcagagaatcccacactttgtaagttgggagaatcttaaagactattttcatatgaagataaagagaatggaaagcaatgagataaacacatgtcccttgcagataccaggaatgaaatgtggagaggtggctggatggtcctccatcacactcagagggctgctttagccaatgggagccagacagatgtagtaagacctcttcattgccttttgatctaacgccacgtaccttgactttgccctccaggccagcccttctcactagttgataatgactgcatttgggcaacaagagaaaggcagaccgacaaacgcggacttactttttcacctaacacagccaagtggtgaacgatttggcttgtacccagttttgctgaagctatgaaggtccagtgggattcagcctttgatcttgagagaggctgtgaggggtttgtttttcacaggggctttagcctacagttaagtgcaaacacctgccggaagtagtggtaattagtaggtaattagtagttaatgttcttagaatttaaaaagaaagcttacataagtaattacttactatttcttataatgt

SEQ ID NO: 56199 - DNA, 823 bp, Bovine  19866880849988
ttttttttttttttttaagaaaaatcagcgatggaaccaaagggtcccctttcctcctttctgttgggatgggagaggagggaagtagaacagatggaagggaagagaaatgctgggttgattccagaaaccttttgaaatgccggggtcttcatttcatatctatttttgcatatttttaaaattagtttttattatagtatagtagcttttcatatattttaaaatgtccacaatagggaatttcctggcaatccagtggactctgctgtctcactaccaaggaccttgattcaatccttagttggggaattaaagtcctacaagtcatatggccaaaagaaagaataatatccataataaaaagtttttcttaaaaaggggagaggtgatgctatgctgggtattattataatgtaaaaaatccccaaaaccaaaaaacaccagtcaactcactgttagagaatccttacttatcgaacagcatttaatttgcatataattgtttacaaaatttgagaaatagttgtgtagagtttccacacttgggaagtttcatcgatatttcaggaacacagataaaaatgaattcagagcttgttacagaaatggacagaagtaatttaagagaagagagaaaataccttctaaggaaaagcaaacaaaacaaattatatctacttatgaggaagtaatgtttccagtacctgttccctgtggcagcatcattttcttaaatgattcacagagctgaagaaagcaggggagaaaaagaaaggcaagtttaaaatataaaaaaatatatgagcgcgccaggattctg

SEQ ID NO: 56200 - DNA, 956 bp, Bovine  19866880862619
ctgttaggacttgagttggtatttgcttctttggactctcatttcccacccaatatatttcattttattacaggaaaaataattgagggcttcagcaaacacaattaaatagttcataaactagtgattttttttcaaatttgtagctgaatcaaatattcataagatgtagatccgtaggtacatttcttagatgggaagtgcatgggaccaccagggctttatcacactgtggttgacagagctcaaaggcaggccgccctgagcttgatgtttatgttaaaaaaaaaaaaataagtgttctgtaccattgccttaaatccattctgccatgtctagacccctggtgcttgtcacttgacgtggcatcattgacaatgactggagcttcaaatacaccttttgtcctctatggtgtttctagtatccttttcagtaaatttttaatgacctttcagtttggggccaaacagcatttgacagaatgcaccattgtctaatattagcacttagactggagtggagtttttagatagcaattagtatccacaatgctatcatgatatttgtgaacatactttagtgttgatcttaatgatcccattacaatatgctctggttttttcacaaatgtgatggtcttgcttttatgatactgtggagaagctctggatttggcttttgattgtaaaggactaagctagtatctttttcctttctggacctgtgacttgctggcgtatgatctgttgaaggtctttggtggattcccagtgtagccctgcagggcagtgtgggagagagctgcaaccattctacatggaatcactagggcgtgaagatgctaaagcaatgttttgtgaaccattaggtgtgatgaaaggtctcatgagtgtccaaaaactgtagggcaagacacagtgcttcagacaatattgtcttttccataaaacaat

SEQ ID NO: 56201 - DNA, 1685 bp, Bovine  19866880905495
atttggtatagtttaagatcctaggatgcaaccacagaaaaatagacttctcggaatgtgtcttgggggggaagggtacatgcatgtgcaaacatgataatcaaaattaccactcctttggagcaaagatattacacggctaagtcgcttcagtcgtgtctgactctgtgcaaccccatagacagcagcccaccaggttccccggtccctgggattctccaggcaagaacactggagtgggttgccattgccttctccaatgcatgaaagtgaaaagtgaaagtgaagtcgctcagtcgtgtccgactcttagcgaccccatggactgcagcccaccaggctcctccgtccatggggttttccagtcaagagtactggagtggggtgccaccgccttctccagattttacactgaaaggcagtaaaacacaaacaatggctacagctacaagctatggggttcatatttatctgctcatcacatatatttctttttcaggcaccctgcctatgaatggcaggaattctttgagtaagttgtttacaatagtctaggagactcttctatctgaatatgcgtcatcacctcaagagtgacaaatccaaaactgaacacgtcattgtctgctcacaagtattttctcctcccagcccttcctgactcagataggaatacccttcttttcctcatcactcaggcttggggagttagggtcattcttaactcatccctcaccttcaacttgtcatccccttcaaatccttctcagcagtaggtgaagtatggattgtacataaataaagataacatttaatcattgaacattaaatacatcatcaacagtcagatcagtcttttcctctctgttcccactgtcattcccttggttcaggattttatccccgaaacgtttatctgaagcattttcccagtagcctcctccacccactgcctatcatctcagtccaaccttcctatatttcttcagctggtgagcccaaacacagccattatcattcagtgaccaaattatgtttctgagcccttttcatgttttactgggtgtttaaaaggaggaagtaggactttcacaatgtatcccgtcctaagtctttctgatgcacaggactgcatggacatatccacacgttggtcctccattcctggatgtacagagcctcttccactcaaatgcagaggtggaggtaatgccttcctccacgggtccttgggaggggccctgaacaattcagtgtcagcagcttctgagcaccgcaaatgcagggctagttccctagtactgcctttcctcccaggaaaggtggcccagcaggactgagaactgaccgcctgacctctctgcagctcagagacagagtgaagtgcaaaacgagacaaaaccacagtcaccacagtagggagagaacaacttgcgtttgtgcagtgagcacagatactttcttctagccttaaagtgacaggagagagagaggaaggaaagaaggaaagaaagcaggaagggagcggggagggagggaagggggagaagtacagctatgcccacacgcaaaagtctaccttcccaaattaaaccttactcttctatttatgtcttcttgcaacagataattttcaagtatctactttgtgccaagcactaaacagaacagacaggagcacccgc

SEQ ID NO: 56202 - DNA, 1954 bp, Bovine  19866880925285
ttacatgcacccccatgttctagcagccctatttgcaaaagccaaagcatggaagcaacctaactgtccactgacagaggaatgggtaaagaagatatggtgcatatttacagtggaatactacacagccataaaaaagaactgaacaatgccatttgtagcaacatggatgcaactaaagatgatcatattaagtgaaataagtcagaaagagagaaacaaataccatatctagaatttaaaataagacacaaatgcacctaggtgcaaaacagaaacggactcatagacaacagatttgtagctgccaaggggagacaggggaagaggggtgggctgggagtttggggttgttagatgcaaactattacacttataatggataaacaacaaagtcctaatatatagcacagggaaggatattcagtatcctgtgattaaagtataacgggaaagaatacaacaaaagaatgtgtatgtgtgtttaactgagtcattttgctgtacagcagaaagtggcacaatattgtaaattaactatacttcatttttttaaaaaattgagaaataaatcaacgaaaataagcaaggtcaggtcagtcagtggcaaatttatgaaaaaactgaattctccctgtggggtgcttgtatctaaatttcctcattttataaggattataaagtcctattggattagccctacacacacacatcctgagtaaaacctcaccttaactaattatatctgcaatgactctagttaaggaggtacattcagctacagtgggggacaagatttacccctaaaggtctgactaaatctttacagagcagggctgttttcctctgtctcccccacatcacataataaatgaatgaatacttgttgatggctgattaatggtacattttacaatgtgcgtgttactgtgtttgtgttaaggtagtttgagatttatttgtgtgctagcaacagatctcacgcttagcagataggaacgtcttcaattgtttcagggtctgatatgattagtaactgttcccggagaccatgtggaaaaaaatagctggcatctaacgaggagccagccccctttgtctgccggcctgcctcccagaggcagcagagccgaggagctcagacacagctggcggaggttacgtttgttgaagatccgagaagagagcacagtgaaagtacagtagcaagaatgcatccagccaggcctcaaggcagttcatcctcctcgcccagcctggggacacacagctgccccgtccagcctcagaggggcagattcccccacttcagaaaagcagccctgggctgcaaaatggaaacctggccagcaaggaagcagctggtcttggcaaacagaaaacaatgccccaggcaaaaacaaagcaggagggagcctggaagagcttcattctgaggaaccactccctccctaaaccaattctttaatccaacataaaattcaatgcctatttgagaaaatacgatggcaaattccttcgatctaaattctttgtgatttgaaattcctagaaagtttacttcttccttttctaataatttgctccaatagaataattctcatggtggctggctattttgctatccactcttctttttcagtgtaatacaatcacaagatcttgtgtaatttcatgaagatttgtgtgacccagaattgcatttttaagtgtcatttactgttgtcctatctttttatctcatgaaataagctattcatgacaagttacttttcattgttgaaaattatatttatgtatacacatatacatacaacaatcttttatgaaatatgtgcttaattcatttattagtttcccactgtgtaagaagaactcgtgagcctaaaaccagctgtgaataatgtgtctttcaataagaaaagtaattccacagatacagacaaaacaaggt

SEQ ID NO: 56203 - DNA, 738 bp, Bovine  19866880926954
agtgctgtattctgttaattttagtaattaaaaaaatagaaaattacattttgccctgtttgacactgttagcaatttacaacatttatttccatgaattcagattgtgagtctctgttaataacttgtctacatgacacacctatactttttgtacaataccaatcatgcttactttgcactaactcatgttctataaattgacttgataattaatttacaagttgaaatgagttcaaagcctcatcattttactcatcaattttaaaaacttctctttcactatatctctttctataaataaaccaaacttctattcttccttctgctaactaggaagaaagtttcaggaaaacaatttagaccacataccccaaaacgaagcttacttataaaacaacctcatcagtatttaaacagcagttctccagctcagtgaaaccacctgtatcatcagagatgataaccctaaagatatacgcaattacataatctcatctaaatgagttttctaagtgctattgtgtttgtttttaacatatgcatttacacaaacttaaaaatataatacttaacttgcactctatctgaaatacattcttatatattcaaagtgtgaataaggattacaaaaaaaaataagctttaatttaaaaagccaacaaatcttaaatacattgtttggatcataaatgctgccataagaaaatgttgacttttagttcaaaacatgggcta

SEQ ID NO: 56204 - DNA, 870 bp, Bovine  19866880965982
cccatttgtaatctccatcaaaggcatttctcaaaatccctttattatgccttatcactgactctgccgcacgttatttgcaaacaatctctggctaaactgtaaatctacaagcaccctcgtggcgatcgcctggcagaattcagacataagtgctgtttgagctttttcctaattgtagattctaaatgtttgaccctcttctttgagtgccagagacctgacttgacttgtctgtggtttgggctctaatttgaaagcgattgaccatgtttggatggtgtttgaaatatttgtattgtatccacggaaaggatggcaggttttattttctcaagagtacagtttcttcagcacgttcttgtgccatcgtgtgatgtcctccttctgctttgtttgcttccaggatgtctttgtggggcagcacattgcgcccggccatgtgcctcagccccatcttggaaaatgatctctactacaagctcagcacgcacaagagcggctggctcatggctcccaagcacatacctgaccactggaggggacacgcttttcaaagtgtgcccagttccatagtcttctagtgagagaagcaggaacccagtgggtagatgggggttatttttttgtttgtttcatctgttgactgatgaatttctggtacctgtttacaagcttgctttgagtgtgtggactgatggttagaccagtcatgccccctttttcctgatttggaagaaaccattctgcagaacccaagtgctgaaggtctgtatttatccccagcccacagcagtaaggtagttttccaagagaaggataaagcatatgtattttatctggatggagaccgtttcaagtattgattat

SEQ ID NO: 56205 - DNA, 1733 bp, Bovine  19866881137400
tgtgttcagcagacttctagcgaggtggtcactactacgtgtcccacgacatcaacgccttctcccgtggtaacaacagcagcttcttccatccaggctgagaagcctgctgttgttggttcagaagcaggggtgcctggagttgtgtccgtacaaactctgaaaccacttgctggtccagagggagcaaaaactggagtcgtgactcttcactctgtgggtccggctgctgtgcctggagggacaacagctggaactgtcgtgctgcagactccaaaacctctggtgacatccctgcagaacacggtgacagcagtctctctgcagcctgaaaagccggttgtctccgggacagcagtgacgctggcgctcccctcggtaccttttggaaaaacctcagcagcagctgtttgcattccgtccgtgaaacccattcttacttcctctgggaccacgtccaacaagcccgtccttggccctccactccaaattaaactcgcgcagccgggccccgtgcttgcgcagccagccggtatcccacaggcagttaaagtcaaacaactagtgagtgtcttttcatttcttcctcagtttcttctttagaaaaagtccgacattcagaaaactggcaagactagtaaaatcaacccctgtgtacccttgaccattgttgatcagttggtaacgttggaacatgttggctttgtctctttcccctctattcacaggtgaaaacacacacatagtttttttcctgaaccatttaagagttgtttgcagaaattgtgactttgcaccattaaataccatgtatctcttaaggaaaagggtttctttttctttgcagtaactgcaacgtactaccacgcatgggaagttattacaggcacaatatttcctttgttgtcccaacaagttcctggctagtttgcttcctgatgttgtttctagtaaagaattgcgtattacccttatttgtcattttttttttttcagactcccttaatttagaactgttcttagccttttgtggttgttcattgtgttgtaataattttaagtgctagttgtttttcagaatatccttttgtgtaatcttttcctcaagattagattcagattagatatttttggtaggcttgttattaatacataggtgatgttatggtaacatttcttctaaaaattgctaaggagagaaggtgacaatgaggggagtagatgagtaagaagtgatgttttctccggaactgtgtaagttgggaagttcttgggtaaaagaacttgggtgaaatctgagctgtttatctatttgtgtttagataaaccttactcaagaccagttttatcagaagactgaaagtactgttaagctgtaggagacagtacatggtgaattaattgaaaattatgttttttaaaataagttctcacctaccttgtcctgtaacagaactgtttttttttttttttttgattgcacctgttctttataaacctccatgttaacggctatgttttgagtctctttgttttagtgttctctgcttttttggagtagtaaaatctaagtaaacttctcagccttgtttatgtgatcaggacaaaacattagtatctgtgggtgatggtctttgaggcagagggcaaactttgggtgtagaatgaaggtgtagaatgaaagaggaaagatcagtttggacagtagtcagactcttttttttttttcatcc

SEQ ID NO: 56206 - DNA, 933 bp, Bovine  19866881208016
aaaactgcgctagatctggggaagggaactcagcgatcacttttggatgcctcatcagtagtctaggatacaaacctagagagcaatgaaagctcactgtgactggagctgaatgagcgaagaagggaaaatcacgaggcaaggtcagagagggaggtgggtgccacttaaaatttggtaagaagtttggattttaatttaagtgcaaggggaagccactgaaggaattttatgcaacagagacacacacatgatttgttatgaaaacattatcctgacaacagtatgaaaaatggattgtagaaagaaaaggatgttagttagaagatatagatgttcaagggcaagatgacttagagtggtgacaacagtgatgaagacagggtgatggatacattttgggaactgaataggaagtgactggatgcaggacaagaagagaggaaaggagttaacaatgacgtcctaggtttcttggcttgaacatctgggtgagtaacaatgtcatttactgggtaagaaaacctgcaagactacaaggtgaaaagaagggacagtgagagcaaatataatatactacatccaacaagaactaaacaagtatttaatagtttataaccttgtttacagcatagtaattggaaataaaatcccaataaaccacctcgttacagaggctgcatgcttgcttataacactcacaggctcaggaaagagcatctgcctgtcccagctgcctttcccagtgcaagaggggtcaaaaatggggactgagactgtgggcagtgagaagctgctcagtcacacagctctggtgcaccctgacacatgaaggtgtagaccagaggccaagaaagaagggagatgaagggctgtggaggctcgccaaggcatgggccagcaagcaggcagccaatgcatgtgccataaata

SEQ ID NO: 56207 - DNA, 727 bp, Bovine  19866881219124
tgaaactgacccacatttccgtcaagggtttatcctaagaggggaactctgggcgctgcaggcaagttggccgactgcccctgaagtacaggacatagccttcgtttcccgattttgggtcgcgcttactttctaattgttcggcagggctctgtgtgcgcacgagaccgtggactcggaggtgcgcacttcgggggcgtagccgagccattcaaaccagcgaatcggcgctcccctagtccggccacccctgccccgtctcagtagatgctccacgggtgcgcacgaaactctcgggttctgaccttcctcctcccctctccgggtacccgcacagctcggggcggccacttctacccaggagggggtgaggatgaagttggcaaaactgctcgagctatagcgcggagcgccgaaacgccgccgagggacacccgggcgcgcggagagagaggcaagtggccccgcgcgaagagggcgggccggctcgggcgctcgcatttcctgtgacaggggctgccctagccgctccctctcccgcgggcggcgggaccatttcctgaatcgctgaagcggagggagggctggggcgcggccctaccacgagcgcagagggccgggggtggctgggaaggacaggcggaggaaccggaaggcgaccgagaacagggacgttctgccggggccgcggctcccaggtaccctgcagaaaccggactagctcgcg

SEQ ID NO: 56208 - DNA, 1311 bp, Bovine  19866881252397
acaacatgtaatacttgggagagatagaaatagaacacctttttctgctcttaaagatcaacccaacacttgatgtacagattcttggtgcacataaaaaaggcataaacacacaaaaacctaaacaaacggaaaatcagtgtagctgcgtcaaagtgattagctcaatcaaaaagtatttgtttgcttgtattcagagggagtgaaagaacgcaggacatttggacctgagtagacttacaggtgtgagcctccgtaaagagggagccttgagcaagattctctgtaaggtggaaacatgagctgtgaggctggatgcctgcacaggccatgtccggggtggctgccccaggtgggtttcagaatgtataaaggaattttagttctagtagctattataatttttcaagtgttagttgctcagttgtgtctggctctttgtgaccccactgactgtagcccatgaagcttctctgtccaggtaattctcaagacaagaatactggagtgggttgccattccctcctccaggggatctgcccaacccaggatcttgcattgcaggcggattctttaccgtctgagccatcaaggaagcccataatttttcaaacagaggttttgattaatttaagttatttacataggcaatcaacaaaatatgtaaatacaagtcttgagcaaatatatctaatttgttctcatgatctttaaaactcatcatttaattccttacaaattgcagggttgtttttttttcccccccactttccaggtattcttgccttatatttttaggtgaacatttcaagcttcctattgttcccaaatggttgagaaaacttttgtggggtgcatatgttgcagctatggcttttctcctctcacggcctgtgtacattcccttctctcctgagctttcacaaggtgaatgaaatgagcatctcctccatagaggagtgctttcagggtaaatcttttcttatcggctccttgtctctctctggccagcacagtgcctgacatagcaagtactcctggggcacagatggccgattgtagttgcctttcctgatgttacagggcagggaaaaatgaggactttatgctcttaggtcgagcagatcttgtagatgaattcatctaagcagatgaatcgtaggttcatcctgtttatggaaacagttggtgctgagttttttttgagggtttgaagatgaatatacacactgcaaattcaagtagaaagtttgatcaactctatctcaacactggcagtcacaaaagttgttattatcagtcctgcaattt

SEQ ID NO: 56209 - DNA, 990 bp, Bovine  19866881253078
tgccagacctggagcagcatcattccctaggcatgagaggagagtcaacccattcttcctctccctttggaacttcttaactttcccccagatttcttatgtccagttcccctctgagtctcttcgacagtgctcataggttggagacaggtgaccagctaagggttacaaaccatttctcagacatcttcactgcttccttagtagtctggacctctgttcacacccattgttttgggacctgagccagaactgatcacattttttaacatcttgttcttaacacttttgcaacacctgccaagatgattaaaacaccctggaatgtaacaaagccaggactggaaaatgtggtagtaagcattcaatttatactgttttaaatcatagtatccggttgaggaaagataaattcagaacttcatgctattttcagaccagggaatcgagtgctcccagataacaaacccaactgggaccatagagacaatggagaagaggtagacgacagaggctgaccgattataaaaaaaaaaattgatcctgaaagggagtctaggcaacaggaaagaactgttaaagataaaggaaatcaatcagaagccggtggaagacccattggcactcctggagcacctcagggaatggctgccactgaccctgagtcattggaagggaaggcaatcctgttgcatttcatttcccaaagtgcccctagcactaggcataagcttcctacctctcatctggtcaaggttgcctagcaggtgtttaagaacaagacatagaggaggataaaaagcccagaggcaaggccatctactggctgtttccctccaaggtcagtctgtcagcaggaaaatctggactaaaccacgcacagagactcttgattccagtgagcaagccctggctcccatcaagggacacccagccaaggaaactaggacccagtcagtgcgccccacgtggacaagagggacactggga

SEQ ID NO: 56210 - DNA, 1254 bp, Bovine  19866881256692
ttggatttgtgccactacagtttagcaaaagttggagacagagcggggtacatctgccgcgctcctgccagtgaaaatacggctcctcagtgtgtttggtcacggctgtgttctgaccacggaggggctgagagaactgcctttgccactttgctacactgaatccctctggctcaaatgcacatgctaaatctcttgtcgcgtgacagacacactaaaaatctgaaattcagctgcctgtctttctttttagaacttttgtctaatatacaattctagagtagtccatatcaaaaactacagaccaaaaaaaaaatacgacttgcttaaaaataaaataaataacaggttagaaagaatttcaaactaacactatggtctcattatttaccctccttctcctgaaaatatcctggaagaagaattcactacggatgctgagaaaattcaaaaagtaatttttttttttaaatcaaatgtaaacaggttcaaagaattggaaacatgttaagaacagatacatttaggaaagaaaaattccaaagcaatatttataagtttccaaaacttaattccaaaggaaataactgatttaaaaaaaaagagagcaacaaaagaaactgagaaacaaaattaaagtgaaggaagagcacagataaactaggaaatcttctaaggataaaaacatcagaacgtctttacatttttgctaatttaataagcaaaactatctcccatcattttaatttgcatttgtttgatcaccagagaaatcaaatgttttcccatgaattgtctaaccaatctatttcctcctttgcaaattgtttattaacaactaatcttcatttatccattgcttttcgtaccaatttgtctgagctttctatacaataaagatgattgtatttactgtatttaggatagttccactaaatgacacagctataagccagagatatatttatttatttacaaatgtgtatgtcatgacttttgattcatactcatcaatatgagaataaatagattggaaactaatattccagataggtcaaccatgttatagtaaatatttagtaaacatgtaaggggcagcaaattgggtgacagtcagcatctgagaaattggtggttcctcagtacactgaaaaatgggggacacaacaaagtggatttggtggggcaggtgcagtatcagaaaaagccatgggcaacttggaggacctttgagtaattcacaacattcactta

SEQ ID NO: 56211 - DNA, 1188 bp, Bovine  19866881263589
ttgttaggatggcttgcttttctccccagtacttgacatatgcctcccctgatctaacaatctgctgcaacttggcagcctgaatttatcaagttttctattctttcagtttttcttctacagatagtactctgattttcttcttcatttgtctgggattgatcagttttgaggcttccctcatggctcagcagtaaagaatctgcccacaatacaggacacacaatgtaagagagacagtttgatccctgggtcaggaagatcccctggagaatggaatggcaaccgactccagtgttcttgcctggagaatcccatggacagaggagcctggtgggctacagtccatagtgttgcaaagagtctgacatgactgagcacactgaccagtacagtaaccggttttgatctgatagacttgatgcaaaaggaagctatttgtagaagtaacatttgtcctttatagatatggccagtcaggaatgtgtcctccctagggtgattccaaacacttcctttcatggccttctcaggctcccactttttcactctaccctatcaacagaggtggaacggtgttcacattccttgtgattttgttggaagactgcaaaagacgtcaatacctgaggacatgtatcctctaatgaactttaaggaaaagaaaaaacaaaaagacaaacctagctgcatgaggtccattgcaccatgttaatacaggtacaaaaccatgttatggcaaagtcccatcaatcgctatggtaactagtatatcaaccaaaaggccaagagctgctttgtcctccaggcagcctctaaagatccttctcctcctccagttgcctccacaatcatgttcaatccaagattttgctacatagggtttgcttttatttcttcttggcaatttcatttctgctatgacttccacaaactcaacatcatgaatcacttgaacaaataatgagccagtaagcacagatccaagggaaatttctacaaagccgtcttttgactcttttcacacagagtgaagtgtttcttgtcatgggataataatctgagaaacaacatctggccagatccacaacttcgtttcaaattgcaaactattttaatatgttagaataaacattcctttatgcaatcaatatcttattcagtgcctacttagatgcaagaacaaaa

SEQ ID NO: 56212 - DNA, 1326 bp, Bovine  19866881282026
ccagggaaatcccagtgctgatttttctctgcttttctttccttccctgctgttccaagtctaggttccactgcagggacagcttcctaaacatctctcattcatgtacgcacacctacaaacacagacactcactcccacacatacacttacacatctgcacaagcacacaccttcccccagccctctatctcatttgctgtcttccttaggtatcaaatattaggacagaagcttggttgaacccaggtctcctgcactgcaggcagattctttaccagatgagccacaagggaagcccaggaatactggagtgggtagcctatcccttctccagcggatcttcccgacccaggtatcaaaacacggtctcctgcgttgcaggtggattccaagtgtgagctatcagggaacttgggttagtaggctcgaaaaagtatgaagccacagtgcttctgaaaacaaaatcattcaatagaaaaaggctgtaaatcagattttttaaaaaagtaatatcctactgattggtggactcatcacagattgtgtttctattttgctgcttcttcatcctctgtgcttttctagtttttaacaatgagtagttattgcttttataatttaaaaatatccaccaaaagcagtgctcaagaggtcacttggatattgcctgtgaaacggttcaccagcaaaataaatctggaccgaaaactaaaggaaacattttcctaaagttcagaccatatattccatggcttggaagcccagaggtggagaaggaaaggcttttcttggcaaaggagagctgagtgggtgaaaggttccacaacccgtgtcctgccttttctcaccatctttatccctccgtgtgtctttggcacttagctctcaaccccacccctgggtaggttcttctccaccctccctgagcaagttaatcctagcatgggcactgcccacaggcccttgtcctacgcctccctcccttgtaattaccatgtgtgcaccagctcctcaagagttgaaaggattaacctgcttgcctctggtaaagtagggccgggtgctgcattgcctgccatggtgcttcacgtggtgtggggtcagaccgcacaaggacctctgggcggatggagctcagaagagttggaagcatctccaagctaaatttctttagctgtaaagtgaccattcccacagggggattggcagaattaaataggggcaccgcacataatgggacgcaagaactcaaggtaaacggagttgaaatacgccatttcaggtatacgcctcaaccggaagaagttttcgtgtcctaagtat

SEQ ID NO: 56213 - DNA, 1058 bp, Bovine  19866881356333
catggactgtggcccaccaggctcctctgtcctgggattctccaggcaagaatactggagtgggttgccgtgccctcctccaggggatcttcccaacccagggactgaacccaggtctctttcatctcctgaattcacaggcacgttctttaccactgcctgggaagctcacttaaaaataaggcattgacaaaattttggcacttgaccaacacaaggatgtttttacctaaaaatgcaactcaatattatattcagtttattttggaatagttatctctacctgacagtcaatgctggaatagcaccaaattattttttaattaaaacatttttaattgaatttgcatatatgaaaaaagtaacatactgagaaagttataaaatatagtctcaggcttatgtaaagtcatgactgctttcaacaattactgaactcttttaaaaaaaatcttcataatcatgtttgtttgtcatagatgaatgccacaagtatgacattctcaacacatgtaactactaaatgtaatgttgcatattaacttatttcctttaaaatttcactaagcaattctgagtacaaggacatattaaaatatcccagtgtttctcctaagaattaggtggtcttctttgattttttcttctctgcttcttctttttccttttctatttcatttacttgtaattcaatttctttggcactaaacatctgaaaagaaaaaattttaaaaagcaaatttcaattacagcaacaatttcttaactataatgccgatgaacccaattatattttataattttattttttatagctttatatcttataacttcaagtacatgatgaaatatttcagaagtagcttaattataacaattatggacaaaatcagaactctacaacatttccactatcattgtgctaaaataaaaagccaggaaatacaatattgggttccatatcttatatatggatataattctgaacacatttgaatgcaaagcttattctattcatgaaaaaataactgattactgaattcccaccccatcccaat

SEQ ID NO: 56214 - DNA, 1785 bp, Bovine  19866881587335
atttttgttgttgttgttgttccctctgcttttgtatatctttgaaattttccatggtaagttaaaaggatgaaaataagatctatttggagatttaaattgagctgtgtataagtttgaattccactctgaaaattacagtgtgagatggtcatggttttcagttttgagctaaataaatttaccgcatacaaatttaaacttcaggctttcttctgatgctaaggtaaaggtatgtatggttaagtgaggacagtcatttgttctcttgttacagttgaaagtttgttcttttctaaagcaggtctagttggaggactgtattcatagttctcattgtttcaggtagtccagcagccttcaggaggccttgcaaaacaagtgaccactcttacccattccccagcactgaccatccagaaacctggacagaagaaggtgacagtgagcactgcaatacctaccagtcagttttctcaaggtagataataactaatttctgcctcgtcatgttgggtttggaacatgacaggtttctgtgctttttttttttcaccattatattcagagaagagagatttcttttaagttgagacctatggaaaatagctttattatattctttgtacatagccactttttagggatgtatgttgttttagattaaatcaacaccattcatggtattttgtaactagataaaacaatctactagtaaatacagtactttttttaacttataaattttgctattgccttatttcttttattaaaaatgtgcgtttttctctacatttggaagtcagtcttacaaattataagtctttatgtatttttaaaatctaccaatacaaaagatatagtattaacatgtttcttttcttcatagtaacaccttttcttcatagtaacaccttttcttcatagtatttttgtaatgctggtaattctctacacaatttggggaacatataaaaagaaatggagaggtcttgattttgtgatttcttttgcagggaataaattaattgtaatgtttgaatttaaatctagaaagctttgaaattttctttgattattctatatgcactgaaaatagctattgtcctgaatttttccctaatgtggtatgattgcttttttttcattttactttttctttcttcttttgtttttatagcttccattctaaagcaagttacccttccaggaaataaaattctgtcacttcaatcatctgttcagaaaaacaaaataaaagagaatggaacaatatccttcaggtaaagaaattaaatgatcaaaattttgcctgatttaagaaattaatattctttttaaaaacataaaagagatgacaaaataatacttatgtaaaataaatttaatgatgccttttgaaaaagctaacagtgcttttgaatataatttataagtagtaaagtgcgtagatcttaagtgtagagctcaatgaattttgacaaacgtatacctgtgtaatcttaattcagaccaagatgctaaacatatccatcatctttatgctcctttcaaatcagttacttccaactcttgtctctggcagccactattcttatgtccatcaccaaagatcatttttgtccattcttgaaccttacataaatggaaaattacattatctactcttttgcatttgattttttcactcaacatgtgtttaagattcatctacatcattttgattattagaagattgctcttttgttctggtgaacagtactcattacctgaatgtaaatttgg

SEQ ID NO: 56215 - DNA, 947 bp, Bovine  19866881845398
catttccagtaacaggctcttcatttgctgagaaacttcagatatgatgaaagactcaaacagggtgtcactgtgtcatcaagcagtctttagtggaattcagtgtgactccacttgataaggtctagcctgcactaagggttagacagcctatgttttataattaagtaataatgactgaaccctcgaggaacacagggtatttcctgcaaattaatgaccagccaaaggagctgccgacctaaagtgatgccttaggccagcaaccccagccagtcattaaaccccaggaaatgccctgaacctcaatactgattttagtaaatacaggaggaaaaagtttaatatcagctttgtacttacactgaacatgcatttcatacttagaatgctcagacttttgaagggaattctacagaagttactaaatagttcccttaaacttcttaatgctgatgaaaaaaatttttactctaacattagcgaaagcaaagaaactttttgtagtgttttaactgcaaaggatttagctaagatactgtttgaaaggcatagtgataacataaccaacatatggacatatggacactccaatctatatttaacttgggagttacctaacaagaactcaagaacaaaagcatcagtgtccaggtttatagaaatgactgatctcactcagttaaaataaaagactgtggcggagtgctgtaattcttagaaaaaaaccaaaccaacgaaaacaaaggtccttcatattttgcggatcttaagtcaggattccatgtgacactagagtcaaaaaatcagtagacagatgccaggggaccaactgcttcactgttatttcaagcagataggtactttaataaactctcttaggcttttaactcttaatcaggtgctaccgaaatcaggacattttaagggttttcttatcagaagaa

SEQ ID NO: 56216 - DNA, 988 bp, Bovine  19866881852828
ttttttttttgtcttaaaggtggactcaaacttctgtaaatgtgaaaggtacgttcatgcttagtcatgtccaactctttgcaaccccacggactgtagcctgccaggttcctctgtccacgggattatcccggtaagaattctggagtgggttgccatttcttcttccaggagaggatcttcctgacctagggatcgaacccacgtctcctgcattgcaaagcgggttcttgaccactgagccatctgggaagcctctcagttgagacagaagggtgtttaacagttatgtcaatggtaggttatctggagcggttaggattaaccaccttgtgtaaaatggatgttttcctgatttttaataatattttgtggctgtattcttttttctcatgcaggaatgtttgctctcctttatagaaagttcaaattggtaaaggaactaagtggcattagcctaagtaatggaagtttcttcgttcttttaggaaacaattgctgaacacctactattttggctttggtaccagaaatctttataaattaatcattttccacttggcaagtagtctcactggcaagattttggcctcattaaatattaaaggagattaaaataaagacagttaaaaggtaaaacactcaatgttttgaaagtctgtttttgcaagtgatttgggaaagaaatatgtaattttactcttttgtattaatattgccatgagtactcaggtgtgttgttttaaattgatacaaacccacatatatatcatgggcagctcactccagtattcctgcctggaaaatcacatggacagaggagcctggcaggctatagtccatggggccacacagggtcagacacgacgagcgactgagtgtgcgtgcatgcacacacgtcagctcactatcgaatctaatccagaaaagggagaaaaactatttgctgccaaagggaaaagtggatgccagtcatctaaatgtaaat

SEQ ID NO: 56217 - DNA, 710 bp, Bovine  19866881946180
aaaccatctctcttcccccacccaatccgtggaaaaatcatctagcacgaaactggtccctggtgccaaaaaggttggggaccactactctaagtggacagtcaagacagaggtttgtggggaaggtctgaagggttctctaggtcctacaatttgcaagggtctcctttataacgaatctgaaagatccctctaggtactgcttccttctgaagattatcaggaggaacaagcctaactttcagagaaccaggtagatagatctgtgaccctcatgcaaagctggccccataaatgagctcacagatcaatgacaccagccagcaggatggaagatcacaggcatccagcgaaagcttacagccttcatcggagtgaaaccagggtgtggcgagcactgccgggttatttttcctaccagttccccacagtacttaatgaaatacatttttatttttgcacacagtggaaaatgaatacacagtactgatgatgataaagcaagtctataaggctccataattgagggctctgatcgccttccagtaaacaacttcagcgatttcttccttcgggcaatggccctcaaacgctttttgattgttatctacccattccatccatcaagtgaaaaagacaagacaaaacccaccaactcggggtgttaataggcacgaatgtcaattaaggaaaaatcaaacactaacgag

SEQ ID NO: 56218 - DNA, 1630 bp, Bovine  19866880469003
tccgactctgtgcgaccccatagacacagcagcccaccaggctcccctgtccctgggattctccaggcaagaacactggagtgggttgccatttcctccaatgcatgaaagtgaaaagtgaaagtgaagctgctcagtcgtgtccgactcttagcgaccccatggactgcagcctaccaggctcctccgcccatgggattttccaggcaagagtactggagtgggtgccattggatgagcgccaaagaactgatgcttttgaactgtggtgttggagaagactcttgagagtcccttggactgcaaggagatccaaccagtccatcctaaagggaatcagtcctgaatattcactggaaggactgatgctgaaactgaaactccgatactttggccacctgatgcaaagaactactcattgggaaagattgaaggtgggaggagaaggggacaacagaggatgagatggttggatggaatcaccaactcgatggacatgagtttgagcaagctccaggggttggtgatggacagggaggcctggcgtgctgcagtccatgaggttgcaaagagtcagacacaactgagtgaccgaactgaactgaacaccaagccaaatctgaccttaccgtaacttctacctaatgtttcttcacctgcctctggaatcacacagaccaagtccaatctcttctagtaaatctgcatatgctctcctaaggacagaagactgctaccacccacctaaggcatctctgtccccagatgaaacatcttgggtcttcaggcccttctttctctcccagctggccccctgctaggtaagctacagatgggtcccaggtgggagatgcttctcctctgaatagtttcttgagttagtccatccctggagctggatctaaggctggaagggacgcgatcattgagtagatctgcatgtctcagcctcagactaggggccagctgattctttgttcttccgggtcatcctgtccattgtgggaggctcattggcatccttggcctctatccaccagaggctgggagcattctcttcccagcggtgacaaccagaaacatccccagacattgctgatgtcccttgagaggcaaagccaccgtgggtgaggaccactaggatagaatgttggacgagggtgcctccaacaacaaggttcaagccttaaaaactccgtaaagtccctaacttttcccaaatcttctgcttaagtcagattgtgaaaccactaaaggcatgactaatttaacacacactcacaccaaaaaaacttggtattttgaaagttctcactgggtaatgaaaatcatactgaaaagttatgatggtgaaggtgaaattgcaagaatgcccagtctccttggaatgaaggggtgggggtgtgaaagaactgagcagagaggaagattcctgaaaccctattccttaaggactgctctttctggctaagagcattcatagcagacagcttagcaaatgaacttcaggaaatgttctttccacctgcaaatggtggtttcctataatttcagctggcaggaagagagagaaaataaaagagccacagtttaaattaaaggaatagaatagtcggtgttcagacatcct

SEQ ID NO: 56219 - DNA, 1119 bp, Bovine  19866880556580
tggggttcccatcttagacttaaaactacgagcagacgtgacagaggtttcctggaccgtaagagaactgggaggtgttagccatgtggctggccctgccccctttatctgtcccctgcctgtgggcaccacccaagggggtctcagccccctccacctcggaacaaaaaagcagagtcagcttccaaatctgcttagggctccgcaaaattttcactatgaaaacacgcaactctcttcatcacttgaagaaccaagcaacgacattttttccagttctaagctgagtcgattcttgtgtaaccaaaggatcaaagattccagcagcaaaccattaagtattcaaaatcagaggactgcccccttttttctcattctttcccttttttctgcttgctttcactttaataaaacatatgtctcccagagccataatttcctggactttaaaaacacttgacatgacacacaaatttccacctacacacatgcaatttgtctggaagcccttctaaaactatttctgtccctgaataaaaaccaagttccgtggttgcctggatgaaaaatacaaatactttctagcccggaattccactcgtgttctgcagaaccactgagaaccatctcaagtcctaaaacctttaaggttttttccttctcctggttacccttagggttcacagaatgactctctttcagtctcaggtttgagtaaccaatgtccctggtgtctcctggaaaacacgagcctctctctttgcctggagtgatcagacaaaaagccactgttcctgattaagtaggttttttttgttttggttttttttttttccatccagaaagactatactttgcctgttctggacctgattagaaaccataataccttctccaatctctcaagactggatgctaatatgggataacctcggaagtcctgactcagttaagcatctgcatgctccctgcactgtaccttccagaacttttaaaaaatgacaactgcaatgcacatccctttaaaaaatcagatgagcagcaaaacacagcagcaagtctcaattttcttttgcttttccacccaaatcccgagcaaccctcctcccccacccccat

SEQ ID NO: 56220 - DNA, 2285 bp, Bovine  19866880568142
ctgcaggagtctaaggcctcgagctcaggaaaggtctggaaatgctaactgcatgggggccggatctatgcgcatttcagcgtgagttcaggggagaggcatcccaccccagccatctggaatcccagcggctccgggatcaacaggccagcaggtgcagaaagagcaggaagtgggagcccaggatgccaaggtcgtccaggtgcaaactgctctcccgttcctcaccaggccctttgtgtgccaagggaataatgctgtcctggctcctgcgtcccgcatcctgcatcccaaatcctgccaactctccccccagctggcggctcttctcccatcgtttccttcccatccccagggttctgtttccctccgctctgagaccttttcccaccctgaccgtgagaagcaggtgcagtctttgtctttagctgcctccctaagcctcccccagaacacgcacgtgggggatcggagccccctgcccactcagtcccctgaccctggagtcttccttctaccagggcaagtggaactcacagaagggactccagaagaagcatctcatgactgcctcatctttcccccacgacctctgtccttcaaggtcacagaaagtgccctttaacttgtcttcaccctggggctcatggaccaaaagtcacagcagaacaacaacaacatggggtgccggacaggaaccagaaaagtgccgactcctgggccttttattctggaagtaatcacttgctgatgccaagtagaagctggatcccaggacggaagcgggtgggaagggaagaaggggagaagctgccatcaagtgctggactagacccagtgccatgaagcaggacagcggtgaggaccatgatggcgctgggggccgggttccctcacccccatcatccactcgctaccccccactgctcagccaacattcactcagccaggtgcgtgcggggctttgagtgcagctgaagcagggagcagccgacttgctgctcctccgggaaccctgggcacaaaaaggtgggtgccagcagagagaggggacccctgagaccacttcccacccggagatgccccaggtggagccaggtggctgaggtttgaaccccaccctaagactcgctgctggagaaactggaccaagttccttacacgctcaagactccagcctccgcatgcggaaacgggttctcaactcacgtcatctaaagcatggttcgtttccctctctgtgtcctatctccccaagcttcagctactctgcctacttttaacccagcgtttccacgttgatagtttccttttgcttttatttagacgctcgttcaggactagttcatgggctcccctggtggctcagatggtacatgtctgccctcaatgtgggagagctgggttctatccctgggttgggaagatcccctggagaaggaaatggcactccactattccagtattcttgcctggaaaatcccatggaaagagaaccctggcaggctacagtccatgcggttgcaaagagtcagacacgactgagcgacttcactttttttctttctttcaggtctgagaaaacacatcccttctgctgaacccagggcatatgcccggcagtagtcaggtccatccggggagaacaccggagtccagcaaccttgctcctgtcctgccttcgcctccacagacaccccattctagggacccacaaagcagcggggacagttaacagatctcccgaagccaagccatcctgggggaagccttctcctcatggcaggctggaattcaggggctaaaggcctgagccattagacatagctctccttccccaggacggagctgcagcatccttaggggtccttggaaccctccacccaagtagaaaaaaagctcctttcccagcagactggtaccgaacccagagatgccttgctcacaagctgtcggtttcctcctgaacaacatgtttactgaaaccagcgtttattttcctgatgggatcctgaaagacggagggagccgaggagacgaaacacgtctggtggggaaggggcggggtcgcccgaagcgctgactgtacagtcagcctccgcctcggtcgctccatagacggagtctggaacaaattgcaatatttaatgcacaattatggttttcaataaattgttcccagatggcttggggaagcagcattaagcagaaaacaagggagtgatcagattttaatgaattttgttttcttttgccttggttccttcgtaaatcctagttgaagc

SEQ ID NO: 56221 - DNA, 963 bp, Bovine  19866880666207
tttattaaatgtctgtcttggtttaaaaatcacacctgctgccttaatgatgtttaaagatatataaaaataggagtacataacactgcattcactgtgactggagacggcttttatctggtacaattttgcacaaagcacaaattgttgcaaaaatacccgaactccgctatcatgggggcgctttgaagagattgttaggtgtgtggcaattattcatgggcccacggtaagtcctagcgcagtcatgaagacccgctcgccccgggaggggctcagagccaccttccagatgaaaccacggccacaaaggcagcaggcccacggagacgaacaaacggcatcacgggggccctgtgctgaaacgggcttttctcaaaatgagcaaacttgaatcagcgtgggagtggggcataggctgtaattaaaactcgtggcccagttcccttcgtttgtagcagaaaactattggctcatttcaagccaaagccggtggacagtcagggtccttggagcaggatgtagggacccccagggcatcctgaccaccagcgcccacatcctgaagcaaaggaagatgcagcgcgcatgcgcagtgcagcctcgcgaggcgctgctgtcccggcggaccgtcccagtccgtcctgctgttcccagggcgggtcaagagtgcaccccagagtaaacacgtttacaaccaactgtttctcctcgcaggtggcccgcaagctccagccctccgtggtatggatcggagacaccgagaaaaccttctacaaaaaagtgccccacgcggaaagaaaggtgaggccttctcagtggggccttttctctcctcccaaggcggccccgtcccagggaccacctcgatctctcaagaaggtcttgcttgttcaagggaggaaggaaacaaggggccggcgctctctgccctgagcgcttgtctgtatctgaaaggatcca

SEQ ID NO: 56222 - DNA, 961 bp, Bovine  19866880868490
agacagtgtaacccactcctggactttggagggcccaggagagcttggagatcctttctcttccgtgtgctgaaacagctgaggatgtcgggaactcacgggggtaactgacttggacacattgaattgcctgtgaacttactgagtgacgatcattgggttttaaagagtgtctgcaaagacagtgagtgaccttagggtctggagtaattcaacttgagaagttcttcctggttgcgattggatcttttgaggtcattcttagttcatggtcataaaactgtgtcatcagcagaaaggaggacatttatcctcatcccagctctgttgggggacacacacccagttcttcaaaagctctattcaactataaagacccaagttcatgggtaaagacaggggaaaaccgagcttcgacctgggtccccagtttgcgactctgtccctgcctgttgggtcaccattcctgtcccttctcatttctgtcatggttttaaaatgcagattttttttttttggccaaagtcctgagagctgaggattctctcattgtttcttgccctctgccgctctggtttttaatttgtttcagattactaaattatggtaccttgaccgcctcagctacgtgaaaagaatgccaggctaccagattcactccccacattgtcccagaaagcacctaatacttgcaatgttttcacatttcaaaaatgctttgaaaaaaccacgggtccttcccattcacaaatgcttctgtgtgtcagctgcacttcattagcaacagacgtttcttaaacgcttcctttcgaccacaaatatgaggttgctgaccatctccgggacagaatgaccatggcagaggcttgaatcagcacccgagccctcagaccagcccccttggccgggagacaaaggagaagggccttgtgcatttatcagtgagttaatgagaccctgg

SEQ ID NO: 56223 - DNA, 1739 bp, Bovine  19866880878738
aacggaggcataacgagagaaagagagaggctgagacaaatctgaaaatcaaaattccaaaacatttcagaaaatctagtgctgagtacaatcttcaaacagaaattattaaaagacaatagtttaaacaaaaatctaattacgttagattttaatccattatgttagattatattaatataattagattagtataatgaaaccataacttccattagagaaacatacaaaggtttgaaacaaagatggccagaaatggagtaaaaacagataattatatcaaaaaaaagcccacagaaagcttagaaatgaaaaatatagtcactaacataaaaagtcaaaaaacaaaagagatgtgaacgccaggctagagatggtcaaagaacagattagtggaatggatgatggtcctagggagctccctcagaaagcagcacaaaaaaataaacagataaaacctataaatggcaagtaacagcctttgaaaacattggcacccagataatagttttggaagaagagaggaaataccagaggaatgattatttgaagaaatacttgctaagaactttcttaacttgaatacatgaattcttagattaaaaacaaattccacatgcccagccgaatgagtaaaacagatctatatctacatacattattgtcaaactgagaacaagatgacaagccagtcttatgataccagattacctgcagagaagcagtggggaaattagacgtctccttggcaacaattagtaccagaagaaagtgaaagcctatcttcaaagtgctgaggaaaaataactggctgcctaaaatctatatccagcaaaactagcctcgaggggattctcaggaatcagagtagtaaagaattctcctggcagtgctggagacgaaagagacacaggttcaatccccgggtcaggaagatctgctagagagggaaatggcaacctactccagtattcttgtctggagaatcccgtgggcagagaagcctgatgggctacagtcccgtgaggtcacaaagagacatgactgagcacacagcacacatacttacacacaaaccagcatccaagagatggaagaaaatacaggcattttaagacaaagactgagacagtgtcctactcacaccccttcagagataaaattgaagaggctcatgacctacctacaaccccaggaattcttttttgggtatatgccccagagaagctttctaatataagctttctcatatatattaaacttgtgaatttcaacagcattcataatgacaaaatattgaaaatcacctctaagtccgtcaataggagaattgataaataatgtttattatagtcatttaagggcttcccaatagctcactgggtaaagaatccacctgcagtgcaagagacacaggttcaatccctgggttgcaaagatcccctggaggaggaaatggctttctgcttggaagaaaagctatagaaaagcctagacagcatattaaaaagcagagacattaccttgccaacaaaggtccatctagtcaaagctatggtttttcaatagtcatgtatgaatgtgagagttgtgtaccataaagaaagctgagcactgaagaattgatgcttttgaactgtggtgttggagaagactcttgagagtcccttggactgcaaggagatccatccagtccatcctaaaggaagtcagcctgaatattcattggaaggactgat

SEQ ID NO: 56224 - DNA, 2958 bp, Bovine  19866881013342
ctatgggaccttccccatgacagacccccatgccctccgcctgcttcatgtctgtaagaaaagagccaaagaataaatttaatcagagtaatttagtcaatgaataaatttaatcagagaaattagaaaatgcagaaacaaaggaaaacagtcaagacaaaataatgatagtttaaccattaagcaaagtcaaggacatttagttcctcctcaagggctgtagataatagtctgagccacatcctttaaatactgaaacccccatcaggtgggagatgttaattacatgatgactagactggagccatgacataaactgctcccatcttgcacagttccatgaactggcctcaaggaaatgggaacaaactgaccccagggttgaagattgtacttaaaacagttaagatgttgctgatcaaaccactgcatggccagtttccagagctgctctgcacatcgccccctcccccatacacccctgaaactcccctttaaaagctcttgccccttcattggcagtgaggaattgattctttggaatgtgagtccaccttctccccaggattgccagcttccttactaaagctttctttccttttacagagcacttgcctctcagtattggattcttgagtgatgggcagccaaatgttaagttcaataacaaagatcatttgtactttgtatgaattcaaaaataaccttaaaagtcagcgtcctctgtaagcatctgttcatttatatacgcaatctgtcttcaccaagtgaccgctttatgatatagccttcacttgatcctgtgtggtagcaaaggagataaatacagtttccactctctaaactcaccgtctactgccagggctgacgaactacagtgtgagggccaaacacagcccaccacttatttatgtaaataaattttatgggaacacagccaatggccatccaccagtgcatcgtctgtagcagagttgggtagttgtcacagagacctgtgtccacaaatcctgaaatattgactacccagctcttcttagaaagtgtttactgacccctaatgtagcaggtcccaaactttatgttgcctaaatatctttctgaagcctgttaaactcaagttctacctggagaatttctaattgagtaggtctggagtaagtccagagatgtaagtccacagatgtctagatgattctcaagcaagtcgttctggaccacacttgggaaaaactgcttaagaaacacagacgttaagcaatgaactgcaatagaagggatcttctttgcaggattatagtacagttcatgcattaaactcgagttcgacagcctggtccttttagaagttgcttcaactatttgaaagtggcaccctctgggtaaaacaatattttgaaaacagatgtttcagaaaaaattatgggcaaggggttattttactcaccttatcttccactatgaatacatataaaactgctgaagaatttggtaataaaaccacacattattttaggtttcagccctagtccagttcagccagggttcatcagggaggcaagatggccccttggtgggagggccatctctgtctccgcatggaatcctgaggggtagcagtacaggcggctgggtggaggagacgaaggggtactgtgggaatggggaagacatgctagaagaactggagatgctcctggggggacttggcaataatattcaccgcacaacccctccttcctctaaacttttccccaccagcacaatcattcaaacgtccctgctttctgagcatgaaggccaatccccagctgggccctggtatccccgacacttgtaggatgtaacgtagaattaaaggtcaaggcagaagagagaccatcttcaaggagcagaggaagctgttgtgaaataattattacccatgatcactgcacttagctctgagttttctcaaagctacagtggaaaaaaaataaaatgaataaacaaatcacaaactcctcatattagcaaaattccctaaccatgggtaggggtgagtcagaaaataagggaagggtcaggaggaaaggaaatgtttgttttcgaggttgcccccagcagcctgtctccaacagacactcaatgggatctgtcgttagctgacctcttttgcctccatggacagctctggtggttgatttcaggactcttgagtcagcccagaggcatctggtgaattccgtaaacttctgcgttctaatcataagtattttagaacattacaagatgagactctgattgctttaattagtaattaagtgacatcatgactggggagattttattttgaaagtgaagctagccatgatgcaaagtgaatttattttgggtctctcatgctgtctccttggtggcttataactctgaagtctcacagaacgtgcgaactatgtccagtgtgtaaacataaactttttaaaaataccctgcttagtttccaaatatacttaactggaactctgcatctgaggccaagatggccctgctgtatagttagtaatgaattgttgtctgcctcctttcaatcattttctttctggttatgttttgacaaaagcagtatgtccaacaggtggcccatctgaccctcctggccagagtccgtgactggcgcattccaccgtgacggagggaaggggatgaaagcctgcatgcaacgtatgcagaaaatcagaagatacacttcgggctggaatgaaaggcatgctcgttgctgcagggacagcaggggcatcacggggccaacgctgatttatcctgccgccaacaagacttcatacatggttccaaagcagcagtgaaggagagaaccccaggatgctcttctccattaacggtcgtgggaggggctgatgtgaaggcggaaaagaggtggccacttgttacctgcgtcctcatgaggtcacgaggtca

SEQ ID NO: 56225 - DNA, 1847 bp, Bovine  19866881105059
ccttagttctcttgtacttttggtcaattaagcactgtgtgcctcagttttctggtctgtaaaatgggcacattaattcttgcctcaccaggagttggggcaatcaaaagggaaagtgaatagaaaactcctgggcacatgctgaactcctggccagacaactcgagtcttccttgagccttcatcctctgatcaaccatcacaaaacagcagaggaggctggcactttgccttgatagcttttgtccaaaacatatctattaaatatgaatcacttatccccttgggctgcagctactgaagcctgtgctctagagccgatgcttcacaaaaagagaagccgctttaatgagaaaccagggtaccgcacctagagaaaagcccccactcagcaatgaagaccccatgcagccaaaaataataaacaaaaaatcatttatcccacagttcttaaccattagatgcatttctaatacgtcctaactaaacagatgtatcggaaaaggaaatgggcaacccactccagtattcttgcctggagaatcccatggacagaggagcctagcaggctatatagtccagggggttacaagagtcagacacgacttagcgactaaacccaccaccaccaaacagatgtatattccttcccccatctagccttactggaagacagaattttaagtgacaattgtttacttgtactgtacacacatttgtggaaggaacacactggattcattgtgtgtagactaaaggaaccgttccataataatgagaacagaatagaatgttttgtcaaattattttcaatttttttgtagaaaatttgaatttgtgcttggaaaacaaatcagagactcgtttcaccagcgtgtttccacaagcacagggttttgtgggagaggcaaacgcctccaggcagaagcgatgttttctaagagttgcgttctcagtgctgcagagaggaactcagccacaggaattctttaagagaagacgtgatgaataaccaggcccttctgttatttcacctactcgagcaaatgcctcagatccgaattttgctgccctcaggcccacgtaacatgcccaagtgtggggctctctgcacttctccgattaattaaaagcaggtacctctttgcaatgcagatagctgctctgcagtcctgccagggcactgtggctcagtgcccgtgatttttaattgaatgactcccactcccgagacctctgggccttccattaatcacttacatatgcagtaaaggtgaagcgtaatgaggtgtgtgtcaggcccttcgacgcggagtacacaggctgtatccacatcttgatgatctgacatccagcattttgtgccccacggaatgcccatttgcaatgattcaaattaatgccaagacagcttgtctgatatcaagacaaacttctcagcagcaggagcaaataaaacaaccatgcccttggctttgccctagagtctgaacgacagagccctttggtgggtggagaagagaggcttaattcagaagctgaataatgcggtgttaggcctggagcctctgcacccagactgatcaggctcatgccacggcactgcagccctggaaaactacttagatgctgtgtacctcagtttcttaaatcagcaaaatgggtgttatgatactgcccacctcctcaggttactgtgaggagtgactgagttaacacagagagggataaggtctgtgatgcccagatgctcacgaaatgccaatgtttttacacttttgtgcttctgttggttacttgacaatgtcaacaaaatccggcatttagaatgagttccctggggcgtt

SEQ ID NO: 56226 - DNA, 1517 bp, Bovine  19866881129475
gttatcgttaccatctttctaaattccatatatatgtgttagtatactgtattggtgtttttccttctggctcacttcactctgtataatgataatttcttaagtcatgattcaatacatgaaacaagctccttggacccatgtttcagtgatactacttcaatgtaagaataatttcctgaggaagacgcttctcttggctttaggtagaaggtacttacatgtcattatggagtagatacaaagctagaagctgaccatacactgggggtgtagcaattcctcctggagcctataaggccaaaaaaaacaaagagaaataaacctcatttattcttttatattttaaaaagtgttttcttaagtcacctaaagagtaagcatactttgtagcagttgttattatggatggagaaacggtgcaggaagcatcagacactaaacccagaggattacacttagctctttcttcagctgcgactcctctgtctgggcctctatgtattcatatacacaagaatatttaaacgcaatccctttcccaattttcaaattcttactttgttgtactactgtaagaaatgtctccaacagattcctaaagcaatatgattaattctgcccacgataccaaatacattgaatatctaagtaaacacataataaagagaaaaacatcagctgagttacaaaagagctgagttacaaaaacattcttctcctcactcaatttcagttcattcagaagacatctataaagtgtctactggagagctgctgcttctggcagctgtctcctttggttaattaactttttatatcaacactataaatgccattaagtgcctttcctcgaaaaaaaccttactactttagtagttgcgtgatacaatgttcacctgtccttctgaagacaaggggcttccctggtggctcagactagtaaagaatctgcctgcaatgcggacaacgaccagggttccatccctgggtggggaagatcccctggaggagggcatgacaacccacgccagtattcctccccagagaattccaaggacagagaagcctgtggactcctggggtcaaaagagtcggacacaactgagcgacacacacaccacacacacaggtgcaaaagagtcagacacgactgagggacacacacacgaacagaagactcggacacgactgaatgacacacaccacacacacgagtcggacacactaagccacacacacacacacacaagactcggatatgactgagtgaaacacacaacacacacacacgcaaaagagtcggacacactgagccacacacacaagagtaggacacacacacacacacacaagagtaggacacacacgacacacacacgagtaggacacgattgagcaacacacacagataccacacacatacgcggacacacgagtcggacacgactgaacgacacacacacaccccccccacacacacgagtcggactcgactgagagacacacacacacca

SEQ ID NO: 56227 - DNA, 1912 bp, Bovine  19866881177642
caaatacagggattgctttagcgtctaaaaaattttacaacttgtattaagctctcacacagtagaaagatagaacaattattccaagactaataaccacttctcttgtaaaacattcaccagatttgaatcataaatttagatgtggaattaaaaagcacagtttgaaccacaatgttgtacttactctaagagtaaatttggtatttattatttttagttaaaagagcagcaaaattctgttgctatatttggttttgaggtgtgaaatatatggttttatggaaggaggatttggatcagtcacagattttccttttaacggtgtttgtggaaatgggatttttaaattagaaaggaagaatcgactgaagacaacctaaggaaaggagtcattcttgaccatcctgccctcacaggtaagcatcaatgagaactgcaggctttaagaacatgttaatattggacgggcttcccaggtggctcagcggtaaagaatccactgtcaatgcaggagatgagggttggatccctggattgggaaaatccactggaggaggaaatagtaacccgctccagtactcttgcctggagaaccttagggacaaaggagcctggtgggctactgtctatggggtcacaaaagttgaacacaacttagctactaaacaacaacaacaaatatttggatacattctgataacaaatgtatctagctcttacatgacaggtacatcaagcactgttcttgcttaagttcatgcataagttcatgctgtgtacatgaacttatgaagccctcacctggactctatgcattaggaggcatcaccatcacaaccccggtgatggcagggaaggccatccagccctgtctgtagacatcatggtgtctacaatggatgggggagcattgacttcctgagaaagacagcaccatttatcctacagagaaacatccgagctctagaagtgtgattttgccctgaagcggtggataggtatttgaggtagtctgcaagaaatgttttataccaaacgagatgctgcctcactggtctgtttgtttccatttctgtttccaaattatagggctttatacaaccaccagatcattctctactgaatggttcagttttaatttaagcctgctgaaaatagagaccaaaattggatcggccacaaatgtttcaaaggggctttttccttgttttgtttttagctgattttaggatgagaatatagaaaagtgagtgacaggccaaggcaccatttttctctgaatatcacttcttgtacacctgaaactaacacaatattgtacactggccatacttcaataaaaaatttaaaaaaaaaatcactttcttttctctctgtcttttcatgtgtgtgtaggacttctttactgacctcatatatttttgtttagccaaactttatgtgaatccttttatctttatttctgttttcaagagaatgttttctaatgcttgtatcattccaatgcttaagtcatttcttacttcctttatccttaaagacagaatattttcaggccactattcttttgtcacagtttaaaatgtgggttctatggtttctcgtcagattaaccttactaaggatagttcaaagaatagtaagattattaaaggaatttaccaaaagattttctaatattttaaagctcttgacttattttcacagatgtatttcaaatttatgtctctttccacaagattgctaattatgattgctgctaaaattcatatccctgaaataataaaaacacaaaagacttactagatgtgaagtactgttttaagtgtattcaaactctgagctcattcaatttcacaataactctaagaataattattattttcagaagagcagaatgactgaacaa

SEQ ID NO: 56228 - DNA, 628 bp, Bovine  19866881306998
tctggctgaccctggcacactgggcctcacgccctcttctgatgctcctgggtgatgaaggccaccctcccggccccacacgacagcacggccatcacagatggcccagcctcgctggctgcacacgggaaggggtgagggggtacttgccatatctggaagcgtagtctggtctgggaaccaaaataattttttggtaagctttgcagaaaggttgaagttccgcatcaaaaggtcgctttgtggtccccacaattagaatcctgtcgtctggcttcaggagtttcagcattttgggaagctgctttttcaggcgcttaggttccatctgggagaaacagagaggaaaaaaaaaaatgagcccacatatagaaaacagaattaagagctaaagaaagttcagcctcggacgcaccgtgggatgcccttactaatgtgctttcagggctgctggccatactttcctagagtgtgtcctgggccaggtctcaggacgtgattcctggttggtgtggtctgaattgctggcccttcctttcctcaaatctggtgttcagatttggacagggggaaggagggaagcacctgaccgaacgttctagcatcttagccctaagcatgggaaatg

SEQ ID NO: 56229 - DNA, 974 bp, Bovine  19866881351083
tcccccaggagggggatctggagcatccgaaggacacaagctggagtcgcagagtggatgagatgtctgggggaccgtgagaccccaggatggggcgtttggggaaatgcctcttccagggaaagcaggaacaaaagggattggactgagctctccggaaggaagggagcccctccctcgcactcccagcttctgccccaccgccccccgctgcaccccacccccctaccctccaccagtgagctgtgatgcatgggggaggagagaggaagggaggtgagcgtggtcgcctcttgactgaggaacagtcctcatttaccaggcggctgtgcgtcccagcacccgctttctgagggaaggacactcaggaagccatgagaagcaaaagggacccacagtcatcagccagggcagctgagtctacctggtggctggtgggtgacatggaggaaatcaccaccggctcctgagatgtgaaaacaggctcaagcaaagctgccgtcagcggccgggactaatgatgcagcactcagcttggatacacctgacctttcctcagtcctttcagcaccctccacccgctccatcctcagcgtgaccttgggagcctctgctcttcacacatggggacactgaggctggaaggagcaagttatttgaaaatggctcttggccacaggagcagtggcctacttcaccacacacagctcctcttttctatggaaacagttcaaggatcacgtccagaccatcaacagtaccagtggccccactgctttcccgtttactgtcatttgagaaggtgtcgttgattacgtcttttatggatctctagctcaacactctggtactttggccacctgatgccaagagccgactcactgggaaagaccctgagactgggaaaagattgaaggcaggaggagaaggaggcgacagaggatgagatggttgggatggcatcactgacttga

SEQ ID NO: 56230 - DNA, 2964 bp, Bovine  19866881359787
cctctgctcgggccaccacggactgggcttgaacaacggaagtttggttctgcaccgtctggaggcagaaagcccaaggtcaaggtgtcctcagggctgatttctgcctctacttgcacctggccccttctcaccgtgtctgcacaaagtcttctctctgtgtgtgcgcatccctggtgcccaccagtcagatcggaggagggcccactctaaccaccccagcttgtggatgtctctaaatgccctctctccaaacatggttacattcgaaggagctgggggttagggctctgacacatgaatttggatgagggtgcagttcacctatagcaagcgatcttacccacgccaaatatgggtccttgggctcctcgttccatgcctctggccctgacttccagggacccttcctctaaggccttctactcacaccccgtggatttgggtgagagtggctctcttggcctgtttgggccactgcaaccaagttcacctgccagggggttaaacagcactcgtccactttctcacggttctggaagccaggagtccaaggtcaaggtgctcggtttccggcgagggcctgcttcctggcttgcagacgccttctcgccgtgtcctcacgtggcctttcttttgtgtgtctggggagaagggagagagaaaggggacattcctggggtctctcgctcttctgatcaggccacagtcccagttagggccccaccctcttgaccccatttaagcataattacctccctgaagaccttatctccaaatacagtcacatgggagttggtggggagggggctaggactccaacatataaatctgggggcccacagttccatctagaagcagccgggccttgggaatgtggaggggatctggggtggggcacagggccaggagccccagggtggctttctggactcagctttgctacctcttgcctgggtgacttcagccaagttcatagtttgtctgaccttccaaaaagtgtcctgtgtcccccacagggctggggtaaagacgaaggagacagggcttctggggaagtcaatgccctgcatattccaaccacgtggaaacgggtggtgtcgccaggaaaacaagctggttgctgcaataacatttcttttaagagaaccttgtccctggaggtagggcctggctgctgacactcacataccttccatttccaatgaatacagttttttttttttcctttctatgtgactggaagcttaataatattaccacctaatgaattccagatgagagatctgagatagcagggctgtcagcctgtcccggacactccttgggcttgctggtctcacttgttatatgtcctgacatttcttcaagctgaatgagaggtaaaaactcaggttttaaccattaaaaaaaaatatccatagtctttagtaatagatgtcactgacatttttggttcttgacattatttagcaaacctagcagggatgaaaggcctctggagatcttacatgccccgagggctacgctctatcctcagggagtttggtttgtgttttgctttctggaataacctcaaaccatgtcatatctccgtttttcactgagtcctgtgagaataatgccaggcctgcctgtgtcgtgtggttctgccctgttatgcctcattttatatttggttgtaataaaaccactcctaggccaagcctaggaggctctgactgattcgattacagaaatgcaggtgaattcagacttgtggcagctgcctgatgttttagcgaggatcccagggaagggtgtgagcctgggtcctgggtggggcaaggtgctcaggtagctaggggactccaggcaggtgccagggagaccagcctcaattttcttatctgtaaacatggagattgcattagctcgaggctgctgtaatgtttttcagatatgtaatacaacacaaagggcttcccagctgccacagtgataaaggatttgcctgccagtgcatgagatgcaggagatgtgggttcaacccctcaatcagaaagatcccctggaggagaaaacagcagcctactccagtattcttgcttagagaatcccatggacagaggagtctttcaggctatagtccatgggcttgcaaagagtcggacacaactgagcatgcaataaaacacaaacaaaaatccaagctgctctggttaaggtggaaatcacgaaatataagcttccctcttccccacctctacaagagaatttgggcactgctggggaacacggtgtaaaatccatggatcccactcgagtcagacccagagctgtcagcatctgcactgcgtttttaatgttcactgatcaagagcgctaccttctgcttacgtttcatcatgaacaattacccagtgactctttatggattttattttgatgaaagataaatgataacatcttcatgtcagttagttgaactagttcatttattgaaacaataacgcacccccgacaataatggtgaagtagtcaaaggtgccgtggtattttgtatttttcaaagataattgcagcaaggtattctgacccctgctctctcacagcttgacttggtcactcctaagacaggccacgtctgtgttctaccagtcacatacctgtaaaaagtcttgcttatttatgacccatggggacagcaacatcgtgttccagcttagccacagaatttctctctgattgtgaaggtgaagtcagtgggaaggttcaagggtggggcagggatgaagtccttgagctcaaactgccatctttaaatgcaaaccagtctcaaaaccaagtttaagctcattccagccactttctctgctcacctgacttactgcataatattgcttggtattttgaaagaaatcgagttattatgtatattataatcaactttggattggttacagaagatggggaaataagcga

SEQ ID NO: 56231 - DNA, 1053 bp, Bovine  19866881396767
gtgtgctgcagtcctggggtcgctgagtcggacacaactgagtgactgaactgaactgatgtgtataaatggggcttcccaggcgattctatcggtaaagaacccttctgccaatgcaggagacatgagagacttgggttcgatccctgggtcaggaagatcccctggaggaggaaatggtaacccactccaatattcttgcctggagaatcccatggacagagaaaactggcaggctacagtccatagggttgcaaagactcagacgcaactgaagcaatttagtgcatgtatataaataactgaattactgtgccataaacctgaaactaacacaatactctagatcagctatacttcaataaaaaaaaaaataataataaatacaagagaaggaaaaaaaaggagaagcccacttgctgggcttctgctttgggtgtggcacatgcaggccacttccagcagcatccacccagtgagatttgacattttcctcaccagccaggctgccgagttcatggggctcagtggtggggaggtctcctcgggtggtaccccagcagggctgggcctgagcagaagctggtgccaaccagaaacctctgtctccccacggcacacacgggggtgcagggctcagtgcccagacccacactgggtcttgggggctcccgtggctccctgaacacagcaggtcaccccgccaggtgacctgcaacagccagagtggggatgacagccccactaaagcacagaatttactccaagtggaaactaattgattctgcctcagcaactttcccaattagcgagaattctacaactgaaggatgagctgatggggaaccttagctttatataaaacagttagccacagacttcaaagggttctcgaaggtaaatttaattacatccgccccaaccagacatccaaaataccctcgcatagcttttgtgtgtgtatttatactaagtacaatgcccacgtcctgtgaccttagtatgtctctctacatcattgaaaacaggagtcctttggaactggttagagca

SEQ ID NO: 56232 - DNA, 2073 bp, Bovine  19866881424285
tttgactaacacttgtgctcacaggtgaataataaaagagaacatttttgcaaaacttctgaaagatcctggagctaagggcagatgaatgttagggaaagtttgcaggaataaagaagagtggtacaaaatggtggcggtggaagcaaaggcattaaaaataaagcacggaagaacagcagagggacgagggtaagccagagccgtgatagatggggaactgggtggtctcataggaaaacgtcatcactgaaagccccttgtcacattcactgttcatttcctgggtgaagacgtgtctcttggctgcaacatgagacggaatgtagagcggctcactttgctttgttttgattctgttgactccgtggggcggtgccacactctgtgttgtgggcgtatctgaagcagaaggttctctgtaaatttctgttgaatgagtgctgatgtgtgctcacgttcctttcgtttattcgctgagaccagaaccttgcctggcttgcccttcctctctgtccgtcaattctctctttatttccttccacatctccatctcctcgcagcaagggctttcagctctgggagcaatttggtgaagaggacctttctcaagaccaagagtgtaaggatgttgctctcgcctccccacctgtggggatctgctccctgttgcacccagacatcaggacaggggcacagccagaactgcccttgtcttcagagagcccaggacagaacacccatggagacacctcccaagtgccctctgaagtagggaccagcgctcctgcctggacaccagccttctgtcctgtgacacttcctgcttgtttgtgctgatgacttctatcatcttcacactccctgggctgcggtgttaccgtgactccaagctctctctgtttgtagcaggccaataaatctgagagacgaggtgttgaggcaatgaatgcaactttatttggaaagccagctgacggagaagatggcagactgacgtctcaaaataaccatcttacggggtctggatgtcaggttattttgcagatcagagacgggagaggtgagaagccaagtacaaaggcctttcatcttgcaaacatctcctagaatggcaagcctcaggcaggggacgtgttaatttattcctgcctgccatctacaggtggacagggtcctgaaaaagcttcttcagcttcatggtcaggcagaggggcagggttctctgaggcaggccgtcatgtgtgaacataataacaaaaacaatggaaaccgagtcagagaagcatgtcttcctacgtggagactggattggttattccctgcaacagtaggaccacctgggaccccatccattcccaccttgctgggactccactgtccatctcagacagctctgggtcctgccactgctgcagcctttgctaatcaagcatagtcttctttccagtggagcctggatgtgtcttagcgtctcccctcaacaaagactacagccagtccccaccagtggtcagagttggtgagcagctctgcataaccaggctgaatagctgggcagtggccttcattccagcaaagaggtgccaagctccataggctggatcaggttccatcttgagcacctccagaggctggatcaagacggcacttcccttgggcacttctgcctctgttccttctcctctccggcttcctgcttgctcgtgtgtagctgtgtactctgtcacttcagtcacacccgaccctttgtgacctcatggactgtggcccgccaagttcttctgtccatgggattctccaggcatggatactggactgcgttgccatttcctcctccaccggcttgctcagggctccccaagtcccagcacacccccaagcctaacccaggactcacagccacaacacatacgtggtaataaaccgagttctgcttgatctcccagctgagaggctcagtgtggccttgattgggagtcaccagagtgacccgggtgaccctgtgctctggcgtctgtgctaaccaccggcccagagtgtgaggctcctgctgctgactcccccagcacc

SEQ ID NO: 56233 - DNA, 1296 bp, Bovine  19866881505580
acttccccggcagtccgtggctgagactctgcactcctaacacaaggggcacaggttcaattccctgtcagggaactagatcctgcaagccacgcagtgcagccaaaaaaaaaaaaaaaaaaaagccacacatagtgtctgagcaccaaccacatggaggaggagaggaagttcctagcagcaagtgggatgaccattctgagtccccagaaggaagcttcaaggggagcatgaccttgaaggagctatttggtgagagggtttgcttacgagtcgtgcagaattatcaggaaatatgcaagggatggttccccaaaggaaaacagggagaggatgcaagcaatgggcaatagtccaccgccaacatgataaaaggcgactagattttctagaatattccgccccctctgatgagtgtcacccttgagcccagagacctcgctcacaagaggaaaggggggcacctctgttgtgtaaagcacaggccaaaagggagagtgaatccgtgtcatcctgttccctggtcctggggtccttcggagggaatgcagggggagggggaggggtgcacacaaagcactcagtttgcaggagaaggtcttgtagacgtggacagctcaacatgcgaatccatcctcccatggagagaagaggggccccagcacgggtggtgggggacagaaaagcactctgcgagctgcttgtcagagtgtcccggctcactcccatcctcactcttactgcaagccctcaaagctctgtctaaagtctgacttactttggagaagaagataaaaggcatcaaaagccagggacttgaaacatatctgaagagtcacctttaccatgtggccttgggggtgttttgaaaccctcagtcggctcactgatttcagagaaaaggcccaggaacagacactaagttttccttgccaagtggagccactacctgaaaacaagagccaggcgctttcttaccaagaatttggaaagaaaggaaatgctatgaggctccaggaaagagacggtctatcagtgaggagcgggccctcgtcgggaggctccgtcccatgtggctggtggtgggctcagcggtgcagcaacgggatgcgtccacagttatgaggactgcggtgaactctccaagaaactttttgatgacagagccagcaggaagtctcggcagtggagagacagacagaccctgatcatgtttatccagcaatttccaagaacaagggccattaaatagagtggacacaaatattctggccactaaagtgatgctttctgcta

SEQ ID NO: 56234 - DNA, 892 bp, Bovine  19866881537286
gtcgtgttcctccgcccccagtgacaggccagaccccagggcaggagaaaccaacacagacttcctgcataatacagggacctctgctcagtactctgtcctcacctaaaggagaagagaagttgaaaaagaatagatgcgcatgtatgtgtaactgaacctgaagccaacccagcgttgtttatcgactgtaccgcaatgtaaaataaaaagtttttaaagcccaggctaccaccagctggacccccgtttcccccctttcctcctatatcttcctgtctgcttcacgttcatcttcccaagccttcaaagggtgcagtgctgttgctgacaaacagagattcccctgccccctccccacagaatgccggagctgagttatcgcaggaatgttctttacaattacaagtttagggagaatgctggggtgagggtgagaggggaagtgatgtattggacacccaaggagacccgacagttccaccttgacgtacaaatcaaaggtgtcaccgagctggctgagacaggaggcgcgcccctggtgagaatgctttcaacacatccatcattattgtcgagactggggtcacgccgcggagtcacggccttgtgggagcctgacctaagaaccacttgtttttttggcaggatcttagagcctctgcttctgcctttttttaggctctgcagccgtgcacgagaaagcccctttgggtgaagtccctgctgttggccggaccgtctgggggggggaagaagatgctggtccatgccatctgtaccgaaacaggagccaacctcttcaacctgtctgccgccaacattactgggaaatacccaggcaagagtggcctccagatgatgctgcatgtggtcttcaaggtatttgtca

SEQ ID NO: 56235 - DNA, 1145 bp, Bovine  19866881878556
tcttctgtcgtccccttctcctcctgccttcagtctttcccaataagggtcttttcaaatgagtcaattctttgcatcaggtgcccaaaggattggagcttcagcttcagcatcagtccctgcaatgaatattcaggactgatctcctttaggattgactggtttgatctccttgcagtccaagggactctcaagagtcttctccaacaccacagttcaaaagcttcaattctagggatggtatggggagggaggagggaggagggttcaggatggggaacacatgtatacctgtggtggattcattttgatatttggcaaaactaatacaattatgtaaagtttaaaaataaaattaattaaaaaaaaaaaaggtcttttcttgaaaaaaaaaaaaaattcttgtatacagtggctcatgggccacaatgttggtagtgtcattgcctgtattagaaaaacttggaaaaaatccaaatgtccaatgaacaaagaatggctatatatttttacaatgactaaatagcaggaacaatgaaccagagctatgagtattggatgaagttcccaacataatattgaatgataaagggaagtcatcaaagagtacctacattatgatagcatttaaataaaatccaaactcatgagaaactaaagtttgtggatactgtagtgcaaaagacaagattagaaagtaggaatttcaggttcatagataccttgggggaaagaaaggaagggcagataatcagggagggatacttcagggtcttcaactaaattagcagttttttagacctctggagtgggaatctatgtgctcattatgtaattctttatacctttttagttgcataaggtttgtcataattaaactttggaaaaaaacactctagccaagtggaaacttttagtctaagctgagatgtggttgacaattgttatggaaagcataccttgtgtgcccacatttaagacaaagctttccctctctgagcctggagaaggagaaagactttcaataatgcctcttaacttgctacaagttcataccaggccaacgtgccgctcagccccttcatccaacaaattttacgtggctccaccacaggtatttattttacactatgagcaacagcctt

SEQ ID NO: 56236 - DNA, 737 bp, Bovine  19866880442031
agtcagacaccactgagcaactgaacagccaccactgcactcagccttcgtttcggcgagcaggggttactctctagttgtggtgcacgggcttctcacttcagtggcttctcttgttgcagagcatgggctctaggtgctcgggcttcagtacttgcggtacatgggctcaggagttgcagctcgcaggccccagagcataggttcagtcactgtgacacactggtttctttactccacagcatgtggaatcttcctggaccagagattgaacctatgtctcctgcattggcaggtggattcttaaccactggaccatgaaggaggtccccttgtcattatcttttaatcctctgtgagccggcgtgagtagcccaggtgatagatgagaacgctgaggctcagagaggtggtgatagccacagccacacccatgcacagacatggcggagcccacaccggcccaaggctggtctgtctgcagcagagggctcttcctccccgagtatggctgacaccctcaggtcacctgctgctgtcactgctggtggttttgctgaagttgctgaagacaggacttgggagtgaaggtcgtgcattttccccttcccctccactctgggcagggtgcccagagctgggttctgctgaaggacagcagaaaaaatggaaggataagattcccacacaacccctgccccactgggacacaccaaaggcgtattcaggatgccagg

SEQ ID NO: 56237 - DNA, 4278 bp, Bovine  19866880459168
tacataatactaatattaccactaataatccatagaagactaaaggtaaaagagaggcataaagatgtacatttaagataacatgcttatatcctcaaggttccaatttatttagtagaaatccaccaatacttaatatttgaaatatttttatacatttacaaattgatgagcagtatttggaaatgataatattaagcatttaaagatatgtcaatagaaatcctcaacagaattctgcatttcatcacaatggataaggatgatcattttattatacaagagttttgtaacatatatcacctatttatacaagagcaagtctaataatatattttttaaacattgacaaaaaaattattttacttgagataagactcacagaatttatcaagtttgattaagagaacagagtcaactaacagtacaatatgaactgtaatacataaaacaaacttgttagccacaaaactgttaactcatgtttggtttcttagggattaatacatttcaaagcatgctttgccttagaagatatgatcaaatatatcttcaataacaagtttataccacagataatgtgaatgcatgtaaaagacaataatttaaggcaaaccccatggtaattctatgctattttattttataaattaaatcaacaaatggctttatctaaaaatgtgaaggttctgtgtattcctatattcccttttattttcagctggaattttaatgaatttgagtaagtatggggagacatagaagtttaaaatcccctggaaattttatagtaaaaggctgtttgtatctcttgttaattattttctgtggctactgccagttgttcagaagggtgattgggcagacaggagtcttgaggactcttgtttgccacagaggtatacagtgccagccagactgttaagggaagagcaagagagtctgaaaaaaactgtcactgatccaaactcttcatcaatacaggtcttggtgggattgcactaagcaatttcttaaaaacggcaagaactattacttatcaaatatgataaaaagagctaagcatttccagtgagaaaggagtatatttctcacctgagacatcagttctttttttcttagaatatttctgagaaaataatctgtatactggatggatggttctccagagactatcaattaccacagaaagaaatatatgaaagaggtcagtactggggaaataagaaaacttccattcagtttaaactcatattttagtagtaacaaacttcatcataaacaggaagaaaattctcttctcataatttattaaatttgcactcctggaacaataggagctattgttcctgaaatagctcagttcttgtgtttttatattatgtaaccattttgtgatgcttttgtacattctttgtcttctcttctgaattttgacatgtcataaataaactttttcactatgcaaaaaaaataaaaaataaaaataaatttgcactcctgttaatgtatccccagtttatcagtggagtataggataaatgatactatctgatgtttctaagatatgaaactttgagaattgctttactgctgtgaggtacagagtcttacatgcacagcatagataaataacttttctcagaaggctattggatacaaatttacaagcatatgtatttctcatagaatataaatatgtaactgttagatttccttatgcctgaacggactttgcaagtccctcttggaaatgatttttagtctggaagccccaccattagtctaacagagatgctaattcactgttgtctgtagtttcaattaaaaccaccagatgataggagcaccttggtatacatgcagcagatgaatcaacttaattactaagagcttttaatgtagactgtcatataaataatgggaaatacaccaaatttcaagccatgaaacagtgattattaatgccttgggagtttatatttcaatctatcattaataggattcaaagaaaccagagacacaaaattgatgggcagggaagaagcacttaaatgctgttaaagcactcatcacctagtgctaagactctcttgctaggataagctggtcacagaacaggttagtttcacactaggtcacctgccaacctcaagaaaatgtctgtgcaaggaggtacactgcaaaatgccacaaaagtcccagtttagcagtacatcactcttgggcattcaatgactccaaaagacccaaagcttagctaagctaaaggcttagcacaagtttcaaaggactagtgtactactttctggaacacctgcttatgactaagacctatggtgtagaagcttcagatagctataaaaatagtaaagtcttactagaataacctagaatcataatagccactatgggaatgttccagttagacaagactgttcatttaagaagtgcatttaaaagcaagggcttccaaatcaaacaaacggaatgggaaatctatttaactggtatgcagaagctgccaacaagcttcaggattccacaagagcttcattgcatgattcattgcaaaaggttaataaaaaattaaagacacaagaggtacttaaagcaaaagactctaaaactgacgtgattattcctactcttctctgttctctaaggtacctgcatgtttagccaggaatgattaagggagttttataggtattaatactaaaatattttatatttattaaatccttacaaataaggatttcttatttgtaagaaagtaaggaagacttacaaagacttcctttgtaaggaagtctaatagcctcaaacattgagcagggctgacatctatactagatttgatgtgttaactcttgtctcattaacaagtttttacattaagttttaaaactcgcattgctaatactttttctttgaaagttaaattgacaagttttacactggttatacaagttatacaacaaaaatacttcactaacttaaaagagagataaagttacactgtttttcgacttttgctttttattgaatgtgttattttaacgttctcatgttggtacatacagattttacaaataatttctagttttctgatctttgtgtgtatatgtgtgctcaatcgtgtcctactcttttgcgaccccataaactgtagtgcaccaggcccctctgttcatggaattttgcaggcaagaatactggagcgggttgccatttcagaggattttcctgacccagagatcgaactgatatctcctgtgtatcctgcattggcaggaagattctttaccactgagccccctgggaaggcctttctgatttttatcccaaacctaatcctctaagggaacaatttatagtgatttcaaattgtctattccttacaccatatccaatgtcatcaagaaggtgcattcagtgaatccaggacttatttcctaggtatttctttctctaaaacagcacttccatgtttttctcagacaagccatttcagcatggtgttgtttgttctttaatctgctgctttgattttaaagctgtaacaaatgtgtgtggcatgaaaggatattttgaaacattaacaatttatccttctccagtagtttttttttttctaatcttcattaggccattctgagcttttcaggtatagcttggattttactcttcagaggtttagaatctctcagaagaagaaaaaaaaatttttttttacaaaagatgtggaaggtaaatgatcaataagaccaaagcctccctgtatgctctcttcccacttaccagcctctccataccataggggaaaaggattgatttagcgaagtagtggattgcagaagggggaaagatacgacaaatggacatgtggcgttagaaagatggtagtttcctgaaccacatcctgctctgagtgatcacagtaaatcccatgtcctccagaggggtaggggctactgaaaagttaacagattaaaacaaaaaccaaaacaaaacaaaaaaacagtgcaatggagaccaaagctacactggccctgaaaagagccctaagaaaaatgggaatagtgattttaggcaaattaagatttcaatactccagtaaaataaggacttgaaagagtaatacattttttaagacaaagaaaattatgcttcttactctgtaagccttaggactaactctcttcctattatacaagtaaattaatctgcttcttctaagtgaacttgaattcaactatgttatttgtatcattt

SEQ ID NO: 56238 - DNA, 3009 bp, Bovine  19866880567756
ttcttttagcagtagagcttccaaggttaaaacctggatacacagctaccctgttagagactacatatccccagcctcccttgcaggctggtgcagcaatgggactaacttatagccaatggaatgtgagtggaagtgatctgtttcatctctgggccacattcttaaaaggaagttgcctgctctccactgctctttccccttgtgcagactggaccatggacatgggaatggaaatgggggcatctttgatgctgctgccaaggacagcatcctaaggttggccgatcaacaagaccttaagaacctgtttcatgatgacctagaggagaagagtcctggaccattgacaccttggtctctgtgacaatagctggaccaagagccttactgataaacctgattgttcaagcccacagtagatggggagcagcatattggaaggagaaagttttcattaaactgaaagcacagtgaaattagcaaaagcctagagtgagaggagaggaaacacctgtaaaacaaactcagagtttgggatcattcagttcaggatcatgccaagaagccttggtggcactgttatattacaggataatgttggaaatggtcacaacaatcttgaatcattgctaagtcacttcagtcgtgtccgactctgtgcgaccccatagacggcagcccaccaggctcccctgtccctgggattctcaaggcaagaacactggagtggattgccatttccttctccaatgcatgaaagtgaaaagtgaaagtgaagtcgctcagtcgtgtctgactcttaacaaccccatggactgtagcccaccaggctcctccattcatgggattttccaggcaagagtactggagtggggtgccgttgccttctccgcttgaatcattaaaagaaagttaattgtgacagaatattttatattgaaagaaaagcaactatgtgatatatttagaaagtaaatatgatagaaaatagttgacataaaacttgcatgcttaagggtagacaccttcagcatctattcaaaataatacctttcctgatgggccagaaagtagaggctttgattcactgatatgtaccttctcccccactagattataaatccttttaagatcagcttgtagggacttgcctggtggtccagtggctaagactcccaaggcagggggccagggttccatccctggtcagggaactcgatcccacatgccacaactaggagtttgcatcccgccaataaagaccctgtgtgctgcaagtaagatccagtgcagccaaataaataaatattttttttaaatcagattgtatctcctttttctttctattcctagtatctggcacaatgatgactcaaataaatattccttaattgctaagggggtgaaatccgtgttaccttagattccagagcttagtggtttcacgagctgatgtggacgattgagcagtgaagttgcctgaggtcccaaaataccctgatggagagcttcaggagcatagccctcttagccaagagtgttaagagcccaggttgaccttactcctgttgtctagaaatcatttcatcagaaacactctcttgaactcagaaggccaacatgctcaggattttcattgcagaactggttgtaattccaaaaccaaatacaactgaacacagcctacacaacagggcgtggcctttctgcactgtccagatgagatgttcaggaaaactcaaaatgggagggaaaaagcgggaggcccgggaaagttagctcggcgtgctcactgttggtttcacatcacttcgactcctaggattttaggtttcaaggcagcagagctacactgttgtccccatcaccccaaggctggtgctgggtcagattgctaagcagcctgtaagaaggtgggggatgggcctggaagtaacgatcttgaaagtccgcagattttgctataggatccagaagtaaacgtagccactgatagggacagtgtttccaaggcagaactacatcactattaacactttgagtgataatgcagatactgtagggtatcccctgcccccaagagcccagtcaagactctgcaagaaagtgggtcaattttgggagcttggacttctatcacaacaccctcttatctgtctttcccgccaactcgttggaaaagaccctgatgctggggaagattgagggcagcagaagagggagacagagaatgagatggttggatggcatcaccaactcaatggacatgagtttgggcaaactctgggagacagagaagaacgaggaagcctggcgtgctgcagtccatggggttgcaaagagctggatatgactgagtgactgaacaacagcaacgacaataggaatttgatttcctgttcagaaggtaggggagcagcatattgggattttcatgtcctctgtctagtcagacatggggctgtggatttcaagagacacacagcacagatccctcactggaagcaggacttccaaggatggtggggccagagtggagaagacagagccctctaaccatgtggtcctcaaggcagagaatccaggcctcccctctgctgggacagccctggcctccctgccctcccttacccctggcctcaggctgggtccccactcaccaaggccccaccaggtagatgctcttagcttgcagcagcctctttgactagtacttctgtcctggaagaggtgaaagtcaggactagttggggggtgggtgtggtctctgtcattcagcacgcacagccactaccaatgatcaatattggaaacttccggtgggcgaggtcagaggcggatgctggtgacatcacaaaggaagcaccactgtcatgatggaactctgggcacgtgtcagagagggagcacttccctaaccagaaatgagctaaactgaacatttccagggcagatctggaggtctgaagcctgcacaacctcacctccatcctatcttaagcctag

SEQ ID NO: 56239 - DNA, 1711 bp, Bovine  19866880848447
cccgagtgaatgcctggggcctagaaacgcttgcctacttcctgcgcttccttttagttccccagagcttgttgcaggagacgcaagagacatgagttccatccctgggtcgggaagatcccctggagtaagaaatggcaacccactccagtattcttgcctggagagtccccatggacagaggaacctggcgggctgcagtccacggggttgcaaagagtcagacacgactgagcgactaagctcgagcaccagtggccgaggagaaacaggtggaaacctgagcgatcagtgcacgcctggcgccgtctggacatttacacaccacctagttgtacggccctcgttcagctctgtgtctgcgctcactagtgaaattttggctgctattcactgagcacccactacaggcagcgtgcgaagcacgtgacatgcatcgtctttatccctatgaccattgaggaaaccgcggcctggggacattgtataagatgaaataatcttctgggaagcagatgtgggtaaacggtggggaaccataagttttcagtctctgaaggccaaccctcctcacccaccacactactgtgtcaaaatctaccctgttaggagaaatgttgatggactccagatgagaaattctgcccctacgacgctgcgtccaccggagtgggtacagccagagatccggtccagggatcttggcagtgggtcacacgccataacaaggcctccacgaacacctggccaggtacagtgtgggtcatggatcatggataaacattcggtcttagactgaattacactatctgccttctctgcgccagaccctgggccaaattggtacccagagaggtatcacctgtggtttccacgtgagggaaccagaagcacaggttgcctaaggtcctataactaatcctgagaagtgcaactagaagttagagtttgagatgcccaagccccaagctctgtcccaccagctgggttgcctcttaggtctagcaggctgggctcagggtccacagagctccacatacccagaacatctccagtgtagttgataggcaagatgatgcccaaggaggggatgcagaggatgaggataaagatgatgaggtggtactggaacatgatgtagatccgggcatcgtctccacacctgctaatcagatcttcattcctggaggagacacagagatggggacactgctcaggggccagtgtggccacaactcaagtcaggggcggagggagcaaagggcgaggaaatgaccgcccccatgcccgtgtcttcatcttcagaaacatccctcttctcaaaacttgttaggcctgaaatgggtttcactgaatttcataggcatatcaaagaaagaggctgcagataacgcacttgggaatccagaagcactcttaaatcaggcattgatttcctcttttattgcttcttcaaacattcctcgcgcctgccatggtacaggtactgaacaaaccgttagtgataacaagattcatcctatttttcaaaaagctgctccttaaaaaccacaatgagctaaaaacttcaaacgacaatgagctatcactccatactgccagactggtcagcattggaaacttggtgaggcaggttctgagaggaggtgctggtgagggtgtggggtgctgggagctctctcatactcatgggtacgactcggcaaggcca

SEQ ID NO: 56240 - DNA, 3229 bp, Bovine  19866880932905
tataacttgtctgtttcttaagaatatcatctaaggcacaggcgttgacttttgattcagtgcattgtgccagtcaattatccctttttgcagtcgtctttccagagttgtcagtggggctggatgatagctgctgccctgtggctaccatctgcttttagtttagccaaaccatcagtaaaccaggcacaaacattaagaggaaactctgggaatcaagacctcactgagtcaggggctttgctgcaggtggtggagtggaaaatagtttcttcgaaagggacagctaacacctctgtttgagaaatcaagatgcttctagggccaggccagctatgctcttgaatataccacttccgtttcaccaacgaggcttactcagcagtttccttgctagccacagtttcaaagcagcacgatcaggccaaagactatggttcaggctcttcttaatttcaacaagagcttaggagtaggttgatagttgcttcttttaaaagatatgtacttgaagcctatgtccagcagatggcattgctttcatagagaacctgcccaccggcccacccccgcccccgcaaccccattccatctttaaagctgtaatgtcccatttttgtgattatattgtttctctaggaccccttgggaggggacaggatcacctctgactatgcagcagtccctgaatgggataatctttgacatgtgtaggataaatacaacaatgcatccagcagtgggagccacaacagtagtttcaagggccccacccacaagggcactttaccttcccttcccagatgggaacttggctcagaccctgtcagtcgaatctgggtgctttccctgctctttgaactaacaagtctaatcggcctgcatcaggagctacagacagccacctagagattatgctgctcccaggtggggagtctgggcagtgccggatacagggggcaggaggaagcctttcttccttgtaggccctggacaggtttgccccacttcttcccagtgtactttcctgtgtcttgtgagcccctgggcttagggaccttcttctttcagtccctgtgctcattgctctggtcctccctgcagtcctcggcactttggtaacccctgcacctggcagatcgtctccgaaactctaagggattgagtagggctcctgtatccaacaggaccttgagcttgagtcccctctcctcaccatgctaagatgagtatgtgtggcctttatagtcccctttagggacagggagaccttaacctcacctttcatcatttttctctttgaagcagctcagattgtggcaaagggggcgggatcatgggacccagagggacagagtggctctgaatctctgagccaggcacactttgagcttgagcacacagctcacccaaggacctttcaatgttttcactctgcccagagttctgtatggaatagcaaggtccttactgtgggcaccattcaggtaagctttgggagctccgtgattcttcagctgcatccatattgcgggtcctcagctaattgccccatactgataattacatcttttcctgcttttacccagaagaatgtgagcagtaaccaaggcagcattcagacagtttgtttcatttctgcctctctccactcagcctcattcatacataggccaggggaagattcttactacctcccttccccaccacttgggcaagagcatttactaccagatccagggagtcttctgtcatcccctacccctgtccctgaggggccttgtcctttctcttaaggaaagctataactcggaatcctttgctcatcagggtttagggttttatttttaccctgtgtgcatgcttagtcacttgtcatgcccgactctttgcagccccatgggactgtaccccaccaggctcctctgtccatgggattctccagtcaagaacactggagtgggttgccattcccttctccaggggatcttccagacccagggatcgaaccgacgtcttctgcattggcaggcaggttctttagcactagtgccacatgggaagcccttgtttttaccctactcaccaactaatcagttagtctgtcactgttctatggatgctgccaggagacaaagtcctgggtcagagacagccgatttcatttctcatagtacagcaagcaggatgggcatcagtatgttggcatcagctccgcttgcccctagtgtcccatgtgatgccctgggcctggatgaatgcctgcacatgcagtgggttgcatcacagccaaggtgtatggagcttggggaatccgctgttttataataagcagtaaaccagactgctttctgtcccagagggagattctgtgtctttaggttgctggaagcataacccagagaaatggcctgagtaaagagctatcaggaccttgcattcttggcatatcctgcaaggtctgtgggaacccgagagagcctgggaggactatctcccaccacaaacatgcagtggaagccaagaggaagtgtgaatattactactagttttacttgaaagtaaaaatcttatactcctttatcagtatgtttccatacagactttgaaactaaccacaaatgttgggacagtttaaatagtgccccgcatgtgtgggactacagtctgcagagttctctcacatgtgttactcgataactccctgggagatggactggcagatactattcttgtctgcttcatggagatgagaaaagaggtccagagagggtgagtgactttgcagggtcacgctcaccctgggtggcggtgctgggaccgggtctcgctctttgtctacaagtctgtttgtcacgctgcttggaagttattttctccgtttgacatcaccaggtcaccatcctcatttcatgtcaagccctgcgctcagcagatgcaggagtagatttgcccttctgcctagctgttagagccagggagtaagacaaacaaaagagccctgtatttttgctaagagcgtgttttgccctcatgttgtaggtcagcgataactgcttattgcatctgacctggggatggatagtcactggaaagcaactgctcctctgagctgcagggagagactgacacacaccaagggccaggtctgctggataactggcctgccactgtaaagcctgcatgtagtggggtgaaaggcttactgggttttgtagaataggatttt

SEQ ID NO: 56241 - DNA, 2257 bp, Bovine  19866881013749
ctgactttctcctttccctgatctctatgttcatctctctacctcatttgccatcacatccaattgtcagtttccattagttgatggtagatactctatgtttttaataatgtccatcaattattccatagtccaattcaagtaacttatgcaggggtaatttttggatttttttttttgaccctaggaggttttttcttagctatgtctttggttcttcctggcaaactagctgtcctacaatttagcttggtgctcatggagttatcaacttctttgcctaccaacaaaatctccattctcttagataattcttaggtatgaatttgcctctattctgtttcaaatgaagacttcctcagcagagagtttgggagctctgtgttctcatggatggcctgtccctcagggaaaaatctcgtggacactcttctaggtcactgggtgggagtggtagcctctgatcttctcactttgtttttcctggtgtggaacaactgcttgtaagtgagtgagagtaatcagggacccagtattcttggcctgctgtgcctgagtcaggaaatgtaagaatggattcctcaacttttcagcagcacttgactgtaatttcgcttctgccactcagagttcactagagggtccaacagcaggtttgagcaagcagatgattgaatcagtgagcttaaagataggttaattgtgattctccatttgaggatcattaagaaaaatgaacagatcctaagagacctacgggataccatcaaatgtaccaacatatggattatgaaagtgccagaaggagaagtaagataaggtagaaaaaatattttttttaaattaatgacccaaacctcctatgtttgaagaaagaagtgaatacatgctttaaaaaaattgtcaagtaggataaactcaaagagatccacactgagacatgttataaatgaactattaaaagataaagatgaggagagaatcccaaaagcgagcagagagaagctacttgtaatacacaagagattttcaaagacattgggcagaaaccatggaggccagaaggctgtgggatggaatatccaaagtgttgaaagaataagatggttaaccccaaattccatatctagcaaaactatcctccaaaaaaccaaagagaaattcccagatttagagaacaaaactgagagggttcatcactagtacaaaatatactaaaaaggaaatgtccttcaggaaaggacactagtgagtgagtgaagttgctcagtcatgtccgactctttgggaccccatggactgtagcccaccaggctcctctgtccatggaattttccaggcaagaatactggagtgggttgccatttccttctccaggggatcttcccgacccagggattgaatccaggtctcccacattgcaggcagatgctttaccatctgagccacctgggaagccctcgaaggttgtgggatgaaatatccaaagtgttgaaagaataaaatggttaaccctagattccatatctagcaaaactatcctccaaaaaatcaaagagaaattccaagatttagaaaacaaaactgagagagttcatcactagtacaaaatatactaaaagggagtccttcaggctgaaatgaaaggacattagaccataactcaaatccacatgaagaaacaaagtgcactggagagggtaactgcatagataaatatagaagtcaatattaacatagcttatttagcatttcccccttttattccatatgattttaaagacaactacataaaacaataattataaacccatgacaattaatatccaatttaaaaaagcttaatttgtaataatgacacagaggaggtgctgctatataaaagaagagcgtttacatactaatgaaactaagttggtatgaactcaaactggatttttgtaagtcaaggtgataattatcacctgcaaggcaatcattaagaaaataactaaaaatatataggtaaaataaataagaaggggatcaaaatggtataccacaaaatatctacttatcaccaaagaaggcattaaagatgaacatgggaaaggggaagaatatgatcatagaaaacaacaagtaaaaaggcagatgtaactccaactatataataacattacatgtgaatgaactactcttcagcaagtggtgctgggaaggttggacagttgcatgtaaatcaataaagttagaacacactctcactccatgcaca

SEQ ID NO: 56242 - DNA, 1913 bp, Bovine  19866881053238
actagaagatttttaagctgggaagataaataataagatttttcctttgggtagtaaaaataaagtctgccaaatattaatcccatgcaaatgatcatttgcgcagctctcttcaaaatcaaacgttaaacctgcatattttgctagtgattatcttgtctctggcaatagacttgatcaatgtgaaccaaagaaaatgatggaagaaaaggactacttctacatcatcaggaagtcaagaccaatgaagatctaatgaagtgacgacagtggaaaaggaaagtggcagtaatcagagcaacacagaaggatccttgcaaatttctgtcccaggagtggacaccaacactcaaggtcaggaaagagatctaccaggacaaatcactggctcgcaagagaattcgagacctcagctggagagacgcccattcctacgctgcctcctaaggtctcttaaaaagaataatcagcaagatgacagatcagatacatcaacggggagggaagttttacttcacatgggcctgtgggggaggggcactcacggccatcaagaacacagaacccttcatctagacagttcccacttcccaagtgcttggggcgacctgccttcacacgactccttcgttactgggtgaaacgcagccaccttaacctggaagctacaacagggtaacagaacagggatgcttaaagagctggtctgtgcccacttgactttagaaagacagctggtcttccctcataaatcctcattgcaatagaccacttatatttggcctgttaagtcaaagcacaatctataccagtcttataagggtacagaacagacccggcagaggagcctggcaggctaccgtccacagggtcgcaaagagttggacatgactaatgcgactgagcatgcaggcacacaatggtgtcatagttcatattactgaggagtaggtgcaaagacactggtcatgtcggtcacgtttctagtcagaaaaccatggcaataagaggagctggggaaaggaacagagaagatgaattcagatgagaagttgccacttctccatgaagaccaggagcagctgactcgagacaggctgagccaggaggtgtttgccgaggagtcacagtgaacacctgcggcagaagacaatcggcaggtgagcgggagacgccctctgttctcttctcttctcaactgcagcagaaggcacagcctgcaggtagccagctgtctgtccaaaaaacagaagatacagacacagcccttgccacaaagccccaggaggccaggtgtgcttcagagctgcttcgcccaggccgttcagaggcagctgtgcaggcctagacaaggccagccagagggctggcaggcccacgggtctcccactgactggcccagctctgggatgagcagtgggcagcagccctctatcacatccggacagccacgccgtaccacacgctggggtctgcaaggcttgctgtgctccaaatcagacgagagcagcgactgtgtgtccccggtacgtacccagggaacctcatccagaccaagtctgagcctcggcctgttctctggcttcaaaatgacagctctcagggcctgatcttatcactctagctcactgcttatccctagaccaaccacagtccttggaatatagtgggggctcaataaatcacttttgaaaggataactgagatcagtcaagatggcaaagaatgctcaggaaagcccatcctagaaccattcttttggaagcatgagaaatgttaaggaaggctcagagtaagtaacaatagaagcatcagttctctgccgcattacctgagttcgaattatgcttcttaataatccacaggttgttgtagtccttgtgcaaataggtggtgacctgggggggtggggg

SEQ ID NO: 56243 - DNA, 1058 bp, Bovine  19866881190766
atattactttatattaaattaattgacattaaatataacttctggacttttggattcttctttttttttaaaataaggatttatattaatttactgctgagttttggtttctatgtcttgacatggaactatggagagtgactctgtttagaactacttagagaaaaaagtgagttagtggtccatatctgagcccccagaagcagcgttgctgggcaaggctttccctccacacagcccagctcgagcgcagggcttgggcccaagcagcctggggctgttaccaacgcttggtatctgctgacagttcttaggttttagctgcttctaattatatgtgtgaaaaagcaagttttacactattgatggtcaaggaaagagaaatgaagaggctgatcctctcaagcgttttgagggattcacaactcacaggcttagtttgcagttgatgtgttcagtttgggggtgttccagggtggcctccctttggaagactggcagtaggagaaaccagtccctggccttctggcttagtttccaccaggacttttcccttccgctccgaggaggtgcatccatctgcgttctcctccccattttctccccttctctctatgcctggtgtgtagccacttggcctctttccttgctcctcatcctgacttggagcctcattttcctttcagtggtgcagtctcccaggaatcagcccctacccacagcctccgtccatgagctgtcgtgttttacttcacagcaagtgaaaaaaggctgaatgaggaagcccctcactagccctacccttcacactatgattattttctttttaagtactcagtcttcactgtacccaaggacttggccttaacacaggagaggatttgtttcaagccgtgagctctgtaaacaaaagagtctttgctctgcagcagctgccggagagcagctcccccactgctgggggctcctcctgtggacggttgtcggggaagccaaggtctgggtgcagctgggaggggagtgggaagagacggagtcttctctccgaggcctctcat

SEQ ID NO: 56244 - DNA, 2090 bp, Bovine  19866881343092
ccccccaaattcagcccagaacttgcctaaggctcccccaccctttagccctagtccctaagtcgggcagtggcccacatgcatcctctttagagcaaaggagaccctgggccaccacgtacacccactgccagggccacaactgcgtgtgctctggagtcacgtctcagtgggccccccatcccatccttgccggagcccttcctttgtctcccggggggcccccatgcctggcctgagtggaggaggcacctgcaaattctcgatggggcgggtgacgttgtacaagtcgatggtgttgatgatgatggcaggcgtggtgaggaagaagaagaggaagaagaggaaagtgttgattgcgataaagcgggcccaccaatggaagcggcggacggacaggtgtttcctgggcgggatggaggagggaggcgcgcttagggccgtgggtctcggccctcagacccagccacgctgctttctgcatgccagctgtggaccaggctgccctggtctagttcaacgctgtgggcccacgcctgcatgcgacagccctaggccttctcctatcacgccacttgtcaggctctgaatacatcccacaggtgagccagaagaatgatctgaattctttccacaggaaaaaccttttccccaaaagggggtggacttgggggcaggcagaggctgcgatgcccaggagagacacagcccagcaggggccgtatgtggaggaggaggacaggccctgattcttttccccatcctacaggcgtcttccatcccaaaggagctcaagggagaggagacagacagagggggcttaccaaataatgtccttggggtgcggggcacgtactaccctccagcggtaggacttgacgatggtggtcactgaggactctttgggggacatcccacagtggatgaacttgtagtcctgcagaatgctgcggagacgaggaagagacagaggtctgggggtgaggaattcttggagacttggatatgtctctcctgaccttataggtgggcaattcctcaggcctggtcactggaggaaagggtgttagagggatggactgcccaggaaaagaggggaccacgtagttctcagttcatgtcttgtccccctattggtagtgacggcacaaagacatgctctttctgtgaggttgacaggggaggtactcatttagcctcctcttaatatcaatagctaccgactgctccagccagtgcctgacactgtgctaactggtgagtcacatcatcttagctgcatagattactgaagacacaaccaaagaggggcgggtgctggcactggggccccaccttgggtttcctaactcacatctgctgtaattaaacctgagatccctctctactgagcgatggttctcagaaagatatgtagatgtctcacacacactaaataggacacatattccttcttacccttccaggaggtggacaaggaagatataagtaaccaaatttgatgaataagaaacttgagggtgtaactaacttgcaaaattgcacgtgatctgttgccctgaattctagcctgtgccactgttcctttgcagtgtcagggcgggtgaaaacaaagccttgtgaacgatcaggctccctcggggagaggatggctccatcgtcctcaaaagactgattctgaggctcctatgtatttgacccaggcctaagattccttccagaacactccagagcagacctcatccattccttatcaagatggggctgccagtggctggggcagaagagggaggagcctgcaaagctatgaaacagagaaggcttgcagaggagaggagaggagcaggaatggcagttgggtcttctctatgctgactctgtcactcgcggggaggggaagggtgacgtaggggtgatgggtaatgaggggcggaaaatgggtatcattcttgtcaaggcctggaagaggaaccaagaggtcaagggctacgctgaccacttctgggctgaaacaaggatgtatgggggtggggagcccaggacctgggtgtctctggagacaagctagcccagcagcggaggaagacgca

SEQ ID NO: 56245 - DNA, 950 bp, Bovine  19866881582380
atgggagtgaagaatctctagggtgtgatgtagtagtctggagccaaacaagtgatgtgtccaagcagctgccggttccctccagttttcactcacacgttcccctcttacctaggcctgaagaatgcggatgaccctgaccgtgaaccctgcatctgagtctcaggcttactgcattggctcacgaccctgaaggggtgttgatctctctggtcaagttcaaggtgaaatagcgagtccctgtggtgtgccaggcactccacattcttacattacttagtcttagaagtgatttgccttccctggaaactggaccagagagtcgtaagatgataaagacgatcgttaatggccctgtctgcacgggtgtcccgtgatgtggtggttccatcctccaaactgaatattttctccctgagacctttgtgaggtttgttcaagaaaaacatcacagaggtggaagtaggaaggcccaccggatgtgcgtttaccaatgtatctgggctattctgccatctcggccctgggtttgaggaagttggtctcttacgggacaggcctgcgtgccgtctgagggctgagcttgccttgaccagttataagctcagcgtacccctccaagctccccgacaggcttctgtatcctgcacagtttgggggaggggggcctcgagtctgacctggggacccctctccagcagggagcctcccaggatgactgtcttgccgagcagcctgaacatggtgggaaagtcccggaacttcacggtggacgactgcttcagctctcggaacaccgtcctaaaggggcagccctttgggggcatccctactgttttgttcctcaacatcatcttgtgggtggtgagtgctgggcactgcggagggcaaaccagaggggtctcaccggggcacatggtccagctttcccaagggatacaagggcccca

SEQ ID NO: 56246 - DNA, 3095 bp, Bovine  19866880140661
cttagaaccgacatggaataacaaactggttcaaaattgggaaaggagtacgtcaccctgcttatttaatttatatgcagaatacatcatgcaaaatgccaggctagatgaagaacaatctggaatcaagattgactgccgggagaaatatcgataatctcagatatgcagatgacaccacccttatggcagaaagtgaagaggaactaaagagcctcttgatgaagatgaaagaggagagtgaaaaagcgggcttaaaactcaacattcaaaaaatgaagatcgtgacatctgttcccatcacttcatgagagatagatggggaaacaatgacagacttgattttttgggctccaaaatcactgcagatggtgactgcagccatgaaattaaaagacgcttgctccttggaagaaaagctatgacaaacctagacagcatattaaaaagcagagacattacttggctaacaaaggtccataaaatgaaagctatggctttccccagtagtagtgtatggatgtaagagttggacgataaagaaagctgagcgccgaagaattgatgcttttgaactgtggtgttggagaagactcttgagagtcccttggactgcaaggagatcaagtgaagtgaggagaagtcactcagtcgtgtctgactctttgagaccctgtggactgtagcctaccaggctcctctgtccatgggattttccaggcaagaatactggaatggattgccatttccttctccaggagaacttcccaacccagggattgaacccgggtcattgtaggcagatgctttaccgtctgagccaccaggaagttccaaggagatcaaaccagtcatacagcatcaggtctgacggattaaacaccatgaacttatcagtgataaggagccataaaaaggacacaggcatgctaggattttacaaagatcctactcatgggcgactagacggcagctattatgggtggggaaaagactggaggcagggtgtacaggccaaaaaggaccttgagtttggtgagaatcatagataagaaatatttaggtattaaaaaaaaaaaaacagattttggtgattgactggatagttatgagacagtgaagcagaatttaatgttttatagcgcttgagtgatccatggacaacagtaccaaataaaagggacttaaggtcaactggggctttcagaggttttgtttcattttgataatgataatatacatatctgatgatgagcatgctgtctaaggacaaagtgaaaagaaactggtaaagtaagtaaagctgatgatctcggtccaaaactggctgagtctgaaatggacagtgtatgggagatccaggctcttccttcagggagacgtttcatgactgcattaaaccagaggactatgcaagaaaagtaaaggacccctggcaacaatctgttaaataagcaacaatccagaaattagccacctgggcttctcaggtgcaccagtggtaaaaaaataaaaataaaaaaaatctgcgtgccaatgcaggacacacaagagagttgggttcatccctgagttgggaacacggttggaggaggccatgataacccactccagtattcttgcctggagaatcctatggacagagaagcttttgtgagccctggggtcacaaagagttggacacgacttaagtgacttagcattcactagcactcagaaattagagacaaatagggtactcacttgaagaaaaattaggaggctcaacagcaccaagtccagattggggatgtgtaagcctaatacctggagtagaatgggcaccagcaggcatcatgttcccgccccccaaaacagggtgaggctagagaggaaaatcactcaggctcaaaggagacagctttgaggtcctttcaatctctcatctcatttgataataatctttccctttgctggtcaagacactcccagtaaacacgcacttactgagtctccccactccttccccctggcaccgaaaatgggaaatgttcttgtctggtttactctcaaatattttctcagttttccaacacttttcaaggagttagtgaggccgtgtgaattacaacttggaaatacgtcccaatacattcagaagctattcttacaacagcctcacagccaaaggtcacagccaggcatgggaaagatcctgcctcctcctgctagctgaagctctcacttaccaggtcagttgcactcgctcacgttcactcttgctcactggccctcactctctctgtctctgcatctgtttgtccgtctctctcctggtacccagtttcataccggttactgtttggtcgagcctggatcacttgtcaccctaaacacaaatcagattgaactcacacaagcacagaggaaagagctaggctccagagaggactggacatctgtggtacttgacgttcaagtccttggcgagatgtcaacatttcatagagcactttaaatgttttgtttgagcgctaatgcagcattccccactggtcaacagcaggagcccaggcagaaagcaaagcagatttccttcaacatcagatgttacacccagtggctgagccagtcttgccttccgaaaccacaagagactggataaactggtaagtaaaaaagtccatccaaggcagagtgtatttaaaggatatttgttgtgccactgtaaaatggcactttggtgcttatcatgtcctagattcctttttataatagacagggtgacagatttacaggtgagattttacttttccaggttcaaagactaaactaagtccaattaatttttctctgtaaatgttctttttaattgcatgaagcaggattttctttcaagaccttatgcacaggctttcgtaaattcctgttttagaaactttatcttattgcttggaaaatataagacaatgttgtgtgtatctggatagtgagttaaaatcagttttggaaatggtaaagagcacaaatacagctgggttatgatataatcctcagagctgagggaatccagtaaagaactaaaatactgcaggagaaaaaaaacaggtttggtg

SEQ ID NO: 56247 - DNA, 2782 bp, Bovine  19866880296444
tttgaccccagctctgcccttgctaactcaatggcctcacaccagttaacttcacctccggagcctcaagtgctaatttgtaaaataaggataaggggaccattgtttctggagggccagcaccttgcttctgctcctagccattctctactctcattttctgaaatctgcttggcaaatatgatcatgtctctctctcccaagaaatgttattcctcccctcaagcctcatgaaaagagttttgaggggatcactggcctgggcatttagcctctgtctgctgcagtttgcaagaacccaaagaagtagtctctgacctagagttgagatctttcaaggtgaagaactgtgacttgcagaatgtgtccatgtgggcaaggagataaggctggtgagaaaatgcctgccccagagtgtgtacaggcaaaggacatctgtgcatttcctacagactaaatgcagggagaaaaagccagcctgtgagctgtcttaaaggaacctcatccaagaacacaaaagaggactcaactatgaactacaagggactccttgtagaattttgaaaaaccaagactagcagaaagaacagaagcagctaggaagatccctgtggctcagggatctttgaggagtccttggatgtgacccaacaaaaaaggtcacgcccctttttacaaatttctaaacatgcctcaacccacaaaagcagccctagagatttaacttcatgcttggaggataaagtcccatatgctttaaatggcttataattcctccttctctgcctgcatttcaatcccctttcctcaccagttgtgttaaacttcctcaggcacctgaactcatctcttcttgctgctgctgctaagttgcttcagtcgtgtccgactctgtgcgaccccatagacggcagcccaccaggctcccccgtccctgggattctccaggcaagaacactggagtgggttgccatttccttctccaatgcatgaaagtgaaaagtgaaagtgaagtcactcagtcgtgtccaactcttagtgaccccatggactgcagcccaccaggctcctccgtccatgggattttccaggcaagagtactagagtgggctgccattgccttctcccatctcttcttgctaggctgaggcctaagctggggcctctctggggagcccctggtgttctctgagtaattcatgttctgtacaaactgttcccaggcctagggaagggagggtcattaaccaaaaagataagatgccccttataggaacagtgggcttccctgtagctcagatagtagagaatccacctgcaatgcaggagacctgggtttgatccctgggttgggatcaaagagcctctagaggaaggaatgactacccactccagtattcttgcctggagaattccatggacagaggagcctggagggctatagtccatggggttgcactaagtgactaaagctttcacttccacaggaacagtagcaaatgagactcacgttatttgataaagaatctgtgcctacctgctgtactaaccagcactgtcatggaaattcagtcacagcagagaccctgtggctaactggccttagtgagcttaaagatcagctctggaatggaaggagagtgagagggtaaggtggggatggtgaacaagactattctgtatggcaagtctgaaagtatgccaataaatgatgcgatattaaaagaagagaatgaccacttctgggaatatatctgaaggaaatgaaaacactaactcggaaagatacctgtacccccagttcatagcagttatatccccagttcatagcagctatacttacagtagttaatacatggaaatgacctaagtgttcattaatggacatatggataaagatgttgtagaatattattcagccattaaataaacaaggaaatcctaccatttgtgacaatctggatggaactctaaggcatcatgctaagtgatataaatcagacgcatgtgcatgctcagtcatgtccaactctgcgaccccatggattgtaacccgatggactcctctgtccatgggattctccaggcaagaatactggagtgggttgccatttcctcttccaggggatcttcccaacccaaggattgtacccatgtctcttgcatctcctgcactggcaggtggattcttcaccactgagccacctgggaagcccagttagataaatcacacagaagacaaaggctgtatgatctcacttatatgtggagtctaaaaacaaaatcaaaacaaaaccaaactcatagaaaaagaaatcagacttgtggttaccagaggcagaggattgggggatggggaaaccgaggaaggtggtcgaaagatacaaacttttagttataagataaataagaactagggatgtaatgtacagcatgatgactatggttaacactgccatatagtgtataggaaagttgttaagaaagtatatcctgagttttcattacaaaaagaaaaatttcccccttctttctttccttttttactgtatctatatgaaaggatggatgttagctgaacctattgcagtaatgatttcacaatatatgtaaattgaaccatcatgctgtatgccttaaacttgtatagtgatggatgtcagttattttttcaataaaactgggggaaaaacatgagaatgaaaactgtgttaagggtactgaaagaatcaaaagatgattttgtgcctcaagagtttgaggtgggggcttccctggtagt

SEQ ID NO: 56248 - DNA, 2236 bp, Bovine  19866880418894
aggctcttcagttcttctttgctttctgccataaggaagggtggtgtcatctgcatatctgaggttattgatatttctcccaataatcctgattccagtttgtgcttcatccagcctggcattttgcattatgtacattgcatataagttaaataagcagggtgacaacgtacaggctttacgtactcctttcccaatttggaaacagtacactgttccaatctggttctaactgttgcttcttgacctgcatagagatttctcaggaggcaggtaaggtggtctggtatttccatcttttgaagaattttccacagtttgttgtgatccacacaatcaaaggctatgatatagtcaataaagctgggtatcatagcctaacaagttgctgctgctgctgctaagttgcttcagtcatgtctgactctgtgcgaccccatagacggcaggccaccaggctcccccatccctgggattctccaggcaagaacactggagtgggttgccatttccttctccaatgcatgaaagtgaaaagtcaaagtgaagtcactcagtcatgaccgactcttagtgaccccatggactgcagcctaccaggctcctccgtccatgggattttccaggcaagagtactggagtggggtgccattgccttctctgagcctaacaagttataaaattaaccatcacaaccatcaacattcttcattatgccagttattaaagctacaattcattcagctaataggaagagacatacttttaaatttatcccagaaagaaatcaaaccagtccttcttcaaattgtgtaaggtttctgtgtgctaaaatccatatcaagttggccttgatatggccagtttcctcctcagcctacactttacccaacagtagttgatactgtttttcaatatcatcatgatggcttttagtctctttgactacacatttccaaggaggcaacacagcataaggtgctatcacattccactaacatgatatctctcatcaattaaattatcccagttgctttgatacagataagtcattgcagtccttttgtttataaatctgtgtcttggattaaacattcatggtatccatacagtgaagaaaaacagagaagtgttccacccctaatggaagtttaatcgtgatctgatagcaaggtcttacaaaaagcccagagctgcaactgtgtggcgtgatctcctcattggtcaaaaggtagggactgcacacccgtcacctgggcatctttgccagccaactcatttcactgccagccctctctctctcccatttgaacaacttccttcttccaattctttacattatctaataattatggagccctcagaagaggcacaaaactcccaagagctggatttagaggagataactagaaagcttttatttcttgacaaatggagggaaatctttagttatcaccggtaagatgttctcattttctcaatcctctagaaccagagggatttctttttttaaattttatatatttatttttggtcttttgggggtcttccttgctacactggctactctctcactgtggtgtgcaggcttctgattgcagtgacttcagttgttgcaaagcatgggctgtatggctcctgggcttcagagcagaggctcaacagttttggcgcacagctccaaggcatgtgggatcttcctggatcagggatggaacccctgtctcctgcattggcaggtggattctttaccaatgagccaccagggaagcccccctagaaccagggggattttatgtggctaaacaaccagcttttacgcttgctatgtgagaagtctccattgcagatttacatttaaaatgcttcaggtataactgtttgcagaaaaagcatcccaagcaaagtggaggttgaggaggtttgagggaataagggttgaacagagtgagtaattttcttgatgttttctctttcatttataggttgggaaccaataatacaacttctcaggtaattacttttctcaaagccagagtgttttcctctagttgcttcttcaaacaatcacattaacagcataatctccatttattctgtgcatgtaatgtcactcgggcacttggcatttaatgtgtgaaaacacaaaactggaaaccctgttgggagatcttttcttgggctttcttttttcataaaaatctcttcttacttttacgagctactttgcatcatt

SEQ ID NO: 56249 - DNA, 860 bp, Bovine  19866880430043
atttccctctattgttgatgcaaggagtagctttcagcatctgagagcttgaaaataatttgtttttataaataagaaagcacaactgataaaactgtcccaccagtgcactaaacataccagtgtccaattattttttattaaaatttgcttaaaatgttttattattttttaaaaaccatatgtgctgtttgaaaatccatgaagaataactttgtcagagtcagcatggacttaagagtctctttcacttcccctttctttaggctggcctagcgatgaatataatatgggatgattataaatatgttatttctttctaggttcccatccttagtaaaaaagaagatgtttttgcatatttagcgaagtattcagtgccaatggttcgagcaacatggctgatcaagatgacgtgtgcctattactctgctatttctgaagcgaaaattaagaaacgtccggccactgatcccaatttgggtaagtgagacagtgtgatacattttaaattatcctgtaagtcattgttgcctgcacctcctgtacccagcccagcgagctgagtactgagaaggtccgttagggaagctaagtcattagcggtgtggataggggctgattctgtttcctcaggcacagattcccaattctctcagcacgtcctgttgctcttagctgcaaaatgtgtcctaaacacttcaccaccactttgactgacttgtgcttccaccaccccatctcttggctggagaatggtcacagtcttttaactggtctccctgcctttatttttgctccttacattctagtctctccacagccaccacgctgtttgctcagcctaaatcataccattt

SEQ ID NO: 56250 - DNA, 1924 bp, Bovine  19866880509069
cctagaaacaggcccatgttcacacagaaggccagcgttcactgtgcaggtttgtatttgacactgataaaaaaaaatcagaccttcagtactttgggtgaagtactaaggcacccataaatcttgggcatttatcttgaacttcagagaatgatggtattttttggatcactttcagagcaatcttttaatttcagtaagtgtttcatcaggaaaatgagtatattttgagtctagtttggaaattggctaagttctttctcagtcaaagggggggaaagtcagtttagcacacttttcaatgaccatcataaaagcagataataaatgtacacacacaggtgtgacagatgtgcacacacggttaaactcctccagacttctcatccacagcacagaacatgtgcagagacgtgcgactgcctccatcacctactcgcatctaacaaactaactcaatgactgtcaacgaaatgccgccacagatgacaatgccgcagaagcagaaaaatgtgcctctgtgcactagtcagacaggctatgcttagccagggtcttacttcaaacaaacaaaattttttaaaacggctttacgggacttctctggagtggtccagtggctgaggctctacgctcccagtgtgggggcctgggtttgatccctgcccgggaactagagcccatatgctacaactaaagatccactaaagatctgcaactacagatgccaaataaatttttttttaaatacctttttgattattttccctagctttgtccgcctctctcccagaagagcattctctgtctgcaggtcccatttgaaaagtaaggctatgaaaatatccatcacagcccaggttaacagtcttcaggcaacactttctgttgttagcagatacagatgacccaagagatgagggaaaagtctttctctcctcacacctcaacattagccagttcgaagcacacttctaccaaaacacatctcacatctagtccttcctttacaagaacacagccatctctctaactgcggccactggcacagcaggccaggccgctgctctcatgccgcatacctcccatccgcacccaggtccagaccttgcctgagctcagcctgcccaatggccccggatgaatccttctgaaacaggctgccttttctgcactcccctttttcaatagcctcagaggctttccttttcctccccccctcagaagacgctaacgaatggaagcatctggcaccaccttctatggatcctcaataacatctgtgggccttctctgcacctaactccagccaggactcacacacacaacccgctagcatgggcattagacacctggaacaatcgagctccgctccccagcctcgctcccattctgagtgttgaatcacagaggtctgagtttgaatgcagagcccttacctatcacagagaacaagataaactgacctctctgcacctcggtcacctcaatcaaagtaagataagaataactcacagggctgagattacataagataaaatgcagagtttagcacagtgcctggccacatattgagtgctctgtaaaatggtggttactggtattaaaaaaaaaataattcatagcgctttttcttcatattttaactttcctggaatctacttgactattatattccttgccacacacattgtctttccacctctaagccttgcctaatgccattcctatcccctggagtatattatgcaatcttttgccttcttcgaaccacaacccatggctgccctgcatttaatcactaaagtatacagtagtgtgctcagtactggggattccatagtgagcaaactgcaactgtgataaaggccccaaggagaagcaccacctgctcagagcacacttgataggggcttaccctaat

SEQ ID NO: 56251 - DNA, 2944 bp, Bovine  19866880584052
ctgcgagattttttttcccctcaagttggcatacaggttcaggagaaccaaaactggacagagtcatttttgccaaatctggcaaacagttggatcgattccactgtggttcattccggcctttagaatttacatgctgtaccttcacaaagactctggtcaatgatcttgccatggaaaaatttagtacagctactcctaacgggtttccgtgtacctcagggtggctctcacagaagccctgggttaagttcttggtctaagaagtttaagttctaagcaacaatctgtttcagcaccttttgaccacaacaaaagcaaagaaaaatcctacataaataagaacgcagttcataaagtgcttatgaaattacaaatattttaaattagagcaatgcaaattcatgtccacttcaccaccaaaggtgactgcagagtaaatggatcaccttcctgccaagatctgacaagcctttccaatcagtagtttggtccagcacaggttgccaaaaaaaaaaaaaaaaaaccatcaatgatacataaatattttaaatccaccataattccttctttctataactacgagattcaataagagcaccaattttaaaacgtctgctaccaaactcctcctgcagtaggcccacacgtctacatttttaaacctactttttcagttgaatgaaatgaaaccaaaccacaccctttcctttactttttgtttcaacacctttgtatgaaatgtggcgtaaaatacaggaaaacttttaaagaaatgaaaaaacagacatttccaaagatgactaatgcagtaaatgtgattttctatttttcagtgcaaacaaaaaagtttgtatctttgtcctcttccagactcagaagtgtgaaggatgcccgtagggagtcactccttgctgtggctggttacctagtgagagaaaaaaattcaaacaaaattgcagatgcaaaatgatgctacatagagatggtatgcacgtgtcactgctttcagtaccagcctcaggaacaggagaacagactggcccgggagtctaacactagacagacacttgagtggccaggtcttaacagcacccttggattcattctgcagagaggccagctctacatcacggtcccatacctgccagcaaaaggccttgggatgtgggtaactggcccaccaaaagtctctatccctgaaccacctaaatactaatattaaaaaggactgttaagtatcataaaacattaaaggttctcaaaacttcataaaagtacgtcagagattctactttaacactgacattgtaatagttgaaagagaagtagcttgaagtgggcagtttcctggaaatggccatagatacatcagagagaactaggcaagagtgtatgcgcgtgagagaggctgcgtgtatgagatgcgagcgtatgcctatgcacatatgtctatgcacacagacaaagaaccatgcacaggttcaaaaaagtgacacaggcttagaaacagctactgctcgcacaactctggtgggactgttcaaatccagaggccccatgcaaacagactatggcataaacggagccctctagagatgtgcagtgggcagctcagctcagtcgcccttattcaacaaaggagacgagcgccactgctagtgtcaggcagcagaatctataccgtggttaaaaggtggctctggaacgagtcactctgagttttagtcccagctgttggcagaataaccttgggcagacacgtcagtgtccctgttctctagttgttttctcatgtgtaatatgggaatagcaataataccttatcgcaggtaaagaatctgcctgcaatgtgggagaccaaggttcagtccctgggttggttagatcccctggaggaaggcatggcaacccactctagtattcttgcctggagaatctcatggacagaggagcctgacggtctacagtccgtggggtcacaaagtgtcggatacaactgagtgactaacatgaggtggtgtagaaattaagtgaattaacacatgtaaagtcatagtaactgggggccccaaacctgccccctaacacacttgagggcatcagccaagatgctctcgggggcatctagctttgcaagaaaagaacctattgtttcttggggtcccccagatggaaagaaacattccaagactcagatggaagcaacaggaaaacatctttgctgaactcaaggaaaagactaagggcttttgcaggaaaagaagccttcaaaccaagactgaacacagtagggacagccaggactaaagcaaacaggaaagcagcgaggaagactgtggtttttgaggagcggccaagcgtgtgtagctccacctcctggaagccatgtgtttctgagggagcatacttactggaaagctgcttctggagctgccgcaccagggcagccgtctgctgttgctgctgggtctgctgcaagccttgcctggggaactgtcatcgggagaaaggagagagtcagcaccgatcaaagataagaacagaaagcctgcagccacgcctggtccacacctggccttcacctgaaagtgcctgatgcattccaaacccatctccaggtgcggacgtagcctttaccggaggagccctgaggaaggagtccagcggtgcccagtggttcacaaatccttgttccctcacccatcaccagctgactagttggtgtcactacattccaaaccatttgcagcagcaaactgaaagctgcctggtgggaggattgggtcaagttccacaggcctggccttgggtgaatggagacaagagtgtgggtgcagaggcctggaccccactgggactgcaccttcctgctggtggaggaggggagttgggtagggtgagaccagagaggcaccgaggaggaccacacttcgaggaggcg

SEQ ID NO: 56252 - DNA, 3714 bp, Bovine  19866880639558
acagttataaaaataaaatgtgaggagagtaatctggctttgatttttttttccccccttacctgaaattttgtgtgttaacgtgattacttaaatggccattcatttgccagggaccactacctttaattttgggacagtgcccggaacactggatactgttttgcagttacagtgggaacagaactggtgtactggttctgcactgaaagctagacccgtgtagtgaattttccaatgaatcctttattaaaaaaaaaaaatagaatagaaaaaatagagaaaattttaagcctcagtccttgtcttaattctttttcccccctcctcagtcaaggaaactgaattcttgatggcctttgtcccctcacagcggatccaaatagcgaatgtgagaaggtggagtttgtcaacctggtgctgctcttctgtgagttcatccggcatgacgtcttctcccacgatgcctacatgtgcaccctcatctctcggggagacctgtctgtcaccgcctccacgcgaccgcgggtcgccagcaggagagaatacggatgagcattatccaaaggaccacgaacatgaaaatggaggtacggtcctgggagagggccagcccttggacctgaactgtgctgggagtcactttcagaagggctacacgctggtggaagggtgatggcttttcagttgtagtctctagtttcaaagctcatttatcgctgcttctcactgacatgaaaaagtttggactataatttacatcttctagaattgtcttttgggtatgctaatactgaaaagattcgacaggccatcacatttttcactgaattggaattgtgtgcttccaattttatgtatttctaatctccagttttactttaatgtttagcctcaaatttggacttgttttgttcctgacgtcatgactgtttttattctaagtagcatctttcccccaatgtctcattacctatattgctctttgatacttatattgctcttttatacgtatgttttagtcataacacatcatattttcatttcaattaattacaaatttaatctgtctttcaagtgtagaattgctcttttcagcaaattactttatgctgtgagtatgactttatcattttctgccaattttctgatattttgggcattgttccagatacttttgggacttttcaaggccaaaaacatgaagttggtgatgggaaataatagaaaattgttagaaattatgatagtttctgaaaaataaagcctcatatcggtcctgtgagtttcagcatatgctgttatgatattttacaataatggctatctttgtaatttaaaaacgtgcctttagaattgcacatgtgaatttatagtttatactcttaaagatttttgaaaattacttgtttattatgaatacttttgtttctaaatttgtccacagtaaaaaagttagagtaaaacataaaattagtttacctgtttatgctttttctatgtttctctgtctctctctcttttgtttcctgcttttgaacatcaaggtatcttgtatgttaaatatccttagatttttcttactaaggcaagttggtgagcatgtgactgggaatagccccgagaaggaaattatggtcagtttgtttttaatcaggaagtttgtgcaattttttcttgaaatagcgcggaagtttaatcttttttatcatgaggatgaagaacgtgctttgtaaagcagtgtcgtgctttgtaaagcagtgtgtatcttaacttccttttcttttattgaggaaaaacacactgaggggaaaagagacataagatgactgatgtcactgtcatgtttcagcttcagcttaatgaactacaaaatttacaatgtgactttctttctctggcaattatcaggaacagactattatggcgcatatgggcattgactcaggaactactaatatttttgatgaagtagacaagaatgactttaaaactgactttggttcggaatttccagtaggttcaaccttccaattcttattgaccatgaacccctcctcccccacctctatcccctgctgtctcctcctcctgccccttgccttgtgtactggcatgacccctgtacttgtgatgcaaatgtctttctctggaatgaattccaccccaggccacagttcatcatctcatgcagctgcctcatttcagttcatccacagttttggctgcattgcctcctcctggttgaccgtgactcctttgtttagacatcattatctctcaggaatccatgaatatcattttatcaggacaggccatgttgatttgctggatgtgtgttcaacttctaaataacagctttcctggctcaggacttgtacattcttctactttatcttggtataattacgtgttcttcctcagggatctcagtgtgtaactaactctatgaaaacacatgttggttggggtacagactaaaacctttgtgtctgttgtccatgagctttataagtgaattattcctttatatatgtttttgtaggaaatgtagccctatgaggaagacacttagttatcagtctaatttcgtctctggtcctctgggaaatggagctgtgcacgcgtcttacctgtgtgtgtggttgccagtttctcatctttggaacgggagatgatgctctttatctgaacataaaatttgtggaaattaacacagttccttattttgctaatggttaaataaggaaaagatatggtatgagtgtcttgtgttgtttgaagttgtgtgctttggttttgctctttcatttacagtctccaacatttgttttacatgacttagattttttctcccatgcctggagagtcctgtgagaatgccaacccttctctgggcagaagaatgtcagttaatggtgagaagctgttgaagagagaaaaaccaagggagttgatttttccatctaattatgacctcctacgacacctgcagtatgcaacccattttcccatacctctggtaagtcgcttgtcagttggcaagctgatcatttcattgtagggtcatttattattcaactgcttgcctgagtactacacatgaaagaggtgagtgttttgtattcactacctgcttttgtttgttatggttcttatcatgtagcttatgtgctcgtgtagtctacatttgtggtgtcgtactactgacatttagcaaaattttccatattagtatacttgtactaagagcatctgagtcactgcaaattatatctgtatgtattttcctacttctatttgaaactcatttactacgtagcttttatctgcactgtattgtggtaggtacttttggcattatacagatgagtaagaacttttgagcacagaaaagatgaaaaagatagggagacaaatgtctataaaatgacaagcaccataataagtgaaataacttgagtaaaaacccaagtgaccactgaaaagtgaaccgtttgacattcccagagctcttctgctactctgaaagaataaagatgggaggaggggaaaacctctggttgaaaaattggctcatgcttcatagaagaggtcatatatgtgatagacttggatttccacttgttgactgtaagaactggatatcgatagcacatgggaaatagttgctgggaaatttagtgtttgagtcataacaagtgatgtgcttta

SEQ ID NO: 56253 - DNA, 4224 bp, Bovine  19866880717807
cccaggtcccctggtgattctcttatctctgcacattgcacccaagtggttcagcctacacagttagagtgcctcattcactccaagtctatggcttctgatggggttcacttcatcatgtgtctgaggtgtgaaaaccaaagaataaaaaatgaaacctgcatgcaaaggaatgtatttctaagggcttgataggtatattcactgccatgttatttttaacagcaagttataatcaattcctaatttattgatgaagagcttagtgtctttagatctggattgaaatttaatcttttcactttgaatggaagaaacctgtagtgtaagtaaaatgtgaactagattatctttttgaaaatgattatttaaaaatcttgtcattatttttaatattactgctgttattcattactaataaattctacttatccattgtagcagatccaatcaagtatctacctaggaatactaccttggtggtttgatttattcttctagatggtaatataactgaattaaaataagacatctaatcccaacacctagtttagccttcaatatgtaaagctttagctcaccaaagtttaataaatccactagattatcttccctttaggaaaaaaactgaatgtgtgtgtgtatcctccaagcactaaacacagtgcctgatacctgatagtcagttaatatctggggaatgaactagtatattttgctcttattattttgacttgcaaagaaatttttgttgccaaattttacatgggggatgttatcttcattttgttagagggcagtccactccagaaataagaaagctcagatacagctgattaacttttagataaatatagcattcaacaccagagtggggaataataactgccagctattgcatgtgccatatgtctagctctttaaatccattttcttagataattctcccattgttcacaatatctacaaattgatattattaatccatttaacagatgaagtaatcaaaactcagaaaagcaaaagtgataataagtgacactaaagctttgtgatttcaacaaataattctctctcactgacagtccttgtccataacacatttgcaggtatacttgccatcatctatatcctattactcagccttatggggcaggtccaatcaggtttgtggccagactcatggcagtgattaaaaacatcacagtagatcttgagtggcctcttaaacattgtctctgacactttcactcatatatcactgatcaagacaagtcatgtagccaagctggtttcaaggaagcacagatatatgatcttcccatggagcccatgaccatacatgcatgatcagttgtgtctgactttttgagatgggcacttcaaaaaggggaatggatattttgtaaaagaatacaaagagttggacacaactgagcgactgaactgaactgaacaatttcccatcataacagcaagagctgatctgatcacaagcctgtggctaatagaaaaataaaaaggtcactgtccagaagtgcaagggctgctaacagctatggagatgatccatgaggcaatttaaggttttctagtcttcctgttttcttcttagctttgcctgatgcttctctgtcttctgcacttctgttacgtaggttgggttttgtattccagctcactcatgagctgaaataagctattagcctctctgagccatttttaagatccatctgtagaagaggggtccttgtaatacctactttccaggattagagatattgaaagtaatgcactttgtataatgcttatttttaaataatggtacaaggaaataccacaaatcatcagcaaatagaatagtctccaatttgaaatctaggaatgtcatgacaatacctctgctgatccctttaagaaatgccgagttagtggtttgacggaaatgtgtaggatgtaggtagatggatgaaattttagaaaaacaaacacaaaatgataatcaatagatctgtgtctcaacagcggtcaatcaagccctcatcagaacactgagtgtgtaggtaaaacaatctggaaaatgcagattcccaaacttctgcttattcaaattttccccataaatttaaaaatatcattttaacattgtttttggaaaagcaaacagtcaaagaactcttttgctcttgccagtaaagttacacaataactgataaaaaagtcttagcatttatttctcaacatatttctctttagttcttctctactttaaatcaaagagtcccagattatatctataaagagtgatgaattcaaacactgctaagataatgggaaattacttaatagatcctcctctgtacctcctggatccagccacaggactgcacgtgtggttgtctgccttatctaagtgttcacatgacacttaggactctccacagccatgtctcatggagccaaaagttcagaaaattttttttatctgtaaagtttcaaacaacaagttttatcagatttgttttgtcttgttttgcttttttattgtgtgagtatgtagacttggccagaaggtttttcataccaacaacaaaaacaaactcaggagaaaaaatagcattctataagtaaacttttatctaaaaatataaattatctaggagtttagacacagttatgaattcaagtataagcgaaggtgagtagggaaatgaatcgatggagtaacatgtatttcagtcaatctttgcctggtattttggcgtggtattcacaggaccttaactccactaaaaaccaaataaacaaaagcagtctctatagattttgccacacccactgctgtttttgttttgttttgtttttgttttttgtccttgggaacagcatgcaggatctcagttccccaatgagggactgaccttttgtcacccccagtggaagtgtgcagtcctaaccgatggacggccagggaagtgcccctaactcctcctttcagctaaaccttagtaaagaaaaatccagagcatagggtatttatttcaatttagttttatgtaatgccccaattctccattttaattattataaagttatatattagcattaccaaactgctttaaaatatttgaaatttgaaatgggaagacttcagcttccagtactggtaggcttggtaatctggacctaccctcttgctgaaaagagctaaaaagctcaaataaattgttaaaaacaaaccttcttaaaaaatataaagagctgacaatacaagaaggaagtactgatcgaaaactgaaaatgaaaacaggaccctagagagagagaaggaagcttgggaattgcttttgtcctgaaggcttttgtgacttagcaaatctgaactttcattttgaaacctctttagtaagaggaacagaagttatatgctcatgtctggttgaattgggaatccaactgcagactgtctccaaaataaactgggactccagcatcactcagagtaaatcataagtagaagagccctcagaagcccttgaaacctgagatcgtattacaagggaataaatttctaaccctgaacataaaataaagggtcaggactgatagttccaatgcaaagtcaagttgtctctggagaaataaatctttataataagcctccaagtaatccttaaataaattttcatgtacagtgaacaatatgcagtcaaagataatcaggctcagtaggaagaaacacagcagaagtagcaaaaccaaacaaatagcttgtgtaaacaactgccctagctatctaaatagctaatcagttcagttcagtggctcagttgtgtctgactctttgcaaccccatggactgcagcatgccaggcgtccctgtccatcatcaactcctggagtttacttgaactcatgttcatcgagtcagtgatgccatccaatcatctcatcctctgtcatccccttctcctcccgccttcaatctttcctagcatcagggtcttttcaaatgagtcagttctttgcatagggtggctacagtattggagtttcagcttcaacatcagtccttccaatgaatattcaggactgattttctttaggatggactggttggatctccttgcagtccaagggactctcaagagtcttttccaacaccacagttcgtggtgtcaattctttggtgctcagctttctttagagtccaactctcacacc

SEQ ID NO: 56254 - DNA, 948 bp, Bovine  19866880766735
aatcacaggtgtgtgagcatatacttaattaatttgcttacagctgatttcctgctcactctggcattaccagtgaaaatcactgttgacttgggtgtcgcaccctggaagctgaggatattccactgccaagtgacagcctgcctcatctacattaatatgtacttatcgataatcttcttagcattcgttagcattgatcgctgtcttcagttgacatacagctgcaagatttatcgaatacaagaacctgggtttgctaaaatgatatcagctgttgtgtggctaatggtccttcttataatggtgccaaacatgatcattcccatcaaagacatcaaagaaaagcccaacgtgggctgcatggaattcaaaagtgagtttggaagaaactggcatttgctgacaaatttcataagtatagcaatattcttcaatttctcagccatcatcttaatatctaactgccttgtaattcgacaactctacagaaacaaagataatgaaaattatccaaacgtgaagagagctctcatcagtatacttttggtgactacaggctacatcatatgttttgttccttatcacattgtccgaatcccatacaccctcagccagacagaggtcatatctgactgttccaccaggatttcacttttcaaagcaaaagaggccacactgctcctggctgtgtccaacctgtgtttcgatccaatcctgtactatcatctctcaaaagctttccgattaaagatcactgagacatttgcttcccataaggagtccaaggctcaaaaagaaaaaccaaggtctgaaaacaatgcataaaatacaggattttttttgcatgctataatttcttgcctcactagacaattaagtgtacaaactcctgggaaggaggggaaaaagagcctccgtaagtaaaaatacaggcagagggcaaag

SEQ ID NO: 56255 - DNA, 1748 bp, Bovine  19866880805557
gtcttaaaaccagcaagcaaactttgagtaaaatttccaaaacagcagaaattatttaaaaaataataaagataattattttctcctgattaaacttctaaacattcagagccaataaaagtttatacttaccaaatgtgtcatagttttcaaacacgttgttacccacattaatttccacagctcctcaatattatccgggagaggtgtgtaaacataatatgccccaaggacccccacgatcagaagcaaaatcgtctttcttcccatcatgttttccaactgcacattctacttggcagcaaagcaaatacacttctgaaatatttgaatgttgaaatttcataacagtttttggatttatcaaaaagtgttatcttacttcttagacacaaattccattggtccaattgtcattctgcaagctgctgggaaataattaactcagaaaaagtacaaagaactctgtgaaatccatactcatattatctgcaggttctgccaagtacaacagccttataatattgctaggcagtcagtaaacaagcatttgttgctcaattacttgttggggagtactttaaccattagagaaaaggccacaggaaatataagaaactcagtgtatgcttcaaataacaaatctcagagtgggggagaaaaaatatgtttaaactattgagagcttttacaaagtatgatagatatggtcacttgtatcttatattacttttactgtcttgatacaaataaaattattagtgaaaaatgctaaataggttaaagttatacaattttttccaatgcaacataaaaccttatattcaaacaacttcagcatagggcacaattcagatttttttaaaaagcaaaggaaaaaggaaaaatattttcagcactttaaatcttcatacaagttttgcagttttctgtttacatttattcattcagcatggaatcccctggatttgagatcttttagcaaaattaggggctttgctggtggttcagacagtaaagaatcagtctgcaatatgagagacctgggttcaatccctgcttgggaagatcccatggagaagggaacagctacccactccaatattgtggcttggaaaattccatggatagaagagcctggcaggctatagtccatggggttgcaaagagtcggacatgactgaacaagcaaaattagaacacagagaaggttcttcttataaaggtctgtgttctggctttgttttttttttttttttttttccttgattataaaatcaaggagatagctaacagtttttgagaatttactctgtatcccaggcaatgtactaaaacaaatcttaacatcattgttgttgttcagtcactcagtcgtgtccatctctttgtgaccccattgactgcagcaggccaggcttccctgtccttcaccatctcccagagcttgctcaaacttaagtccattgagttggtgctgccatccaaccatatcatcctctgttatcgctttctcctcctgccccatgaggtggccaaagtattggagtttcagcctcagcatcagtccttccaatgaatacccaggactggtttccttttggatggactggttggatctccttgcagtccaaggggctctcaagagttttctccaacaccacagttcaaaagcatcagttcttcggccctcagctttctttatagcccaactttcacatccatacatgactacggaaaaaccatag

SEQ ID NO: 56256 - DNA, 1376 bp, Bovine  19866880808235
ctcctccgtcctgggattttccggcaagagtactatgacaaatcttgaaaacaatatgctaagtgaaagaagccagacataaaaggttatcttatgattccatttatctaggtatcattgtatcattatatcatacaagtcaacttatatgaaatatccataaaggcaaaattcatcaagatagattagtagttgccagggccagtgtctggggggaatggggagtgactgcaaacagggtggtgatgaagatattctggaattagattatagtgatggttgtacaattttgtgaatgttcagaaagaactcaattgtatattttaaaggaatgcattttatattatgtcaattacatctcaaaaaaaagaagcctggtgtactgcagttcatggggtcacaaagagttggacacaaccgagggactgaactgaactgactgaaagctaccattaaaaaaaaaaaaacactgaaaaaaaagaatactcagtggtcatcaagatcaaatgaaatcaaccaccattccatgtaaaatacttacatttagcaaatactacacgcacatacatatattaggaaataatactaatccttgaagatcttaaggaaacacttgagactatgaacagttcagcagaaattagtagaacatctaacaggatggaggcctgaaattatgattaagttgattcataaacattttaaaaatgattgtttttacttctgagtttaaggactaagatgtgtatccgtcatccaagtttaactctgaaaactgaatcaaaggaattttacagcttagttcacctcctttagtatctgcattacctgacaaaaagaacattggctttgagacaaaaataattcgcttcaatcccacttctgctatttattaactaagacatcttgtaaaatttattaaaaaaaatactccctgagcctcagtttcttcagctgtaaaatgggcatcattgtgggaattcattagtcagtgcctttaaaattctgggcttgctgctatacaataggcacttaaagattggttcctcttttaaaagaaaataaaatctaaacacattttctggaggaaagtgttgcagaagcacaaattacacagtcctgttccaacaccacctagttgttttatgaagaaactcaactgtaattttaaaaaaattttgactcacacacattttcccctgctttctaaaactggaaactaaggaggtaacgtgtatccatctgtgcacccacacccttctgaatatgaaatttacataaaagccttctcagtctgtttatccaggcctccttggctctgaggcagatatatctgcttcaattagaacctaatcctgctcacctcatactaaaaa

SEQ ID NO: 56257 - DNA, 3127 bp, Bovine  19866880910754
atctctatttgcttattgttgttcagtcgctgagtcgtgtctgacttttgcgacaccgtgaactgcagcatgccaagcttccttgtctttcacggtcttgtggagtttgctcagactcatgtccattgtatcaatgatgccatccaaccatctcatcctctgttgcctctttctcctcctgccctcagtctttcccagcatcagggtcttttccaatgagtcagctcttcacatcagctggccaaagtattggagcttaagcttcagcatcagtcagccagtgaatattcaaggttgatttcctttgggattgactggtttgatctcttttctgtccaagggaatctcaagagtctcctccagcaccacaattcaaaagcatcaactctttggcgttcaaccttcattgtccaactctcacatccatacataactactagaaaaaccacagcttgggctagatagacctttgtcggcaaagtgatgtctctgctttataatacactgtcgaggtctgtcacaacttttcttccaaggagcaagcatcttttaattttgttactgcagtctccgcctgcagtgactctggagcccaagaaaaaaatctgtcactacttccacagaaaaataccccaagctccctagtctaggagagcacatgtcagggcagtgtggccatccagagcatacaaggatcaccctgacctatccaagtagcgctcaatcctccaaacactaagccagggagtcattaaatcaaccagatctttacatgacagttctcgaatctgctcgctcacagcatcatccaaagtccctgaaacatactgctgtgcttcttagtggggacaacatatgtaaattatcacttttacacaagaaaagaacaaaaaattatttatgtgagttagaaccttgagattcctaagtggtctaaaatgcccatgcccttttttggcttagaggtaaacaagataagatctacagatcttttctagctcttcactcttcctttgcttcctaaagaatcttataaaagaaactgacttacatgtggggggacagaaggaccaaaaaccactaacagggtaagtatctgagttactgggcaacattcttttattgacaaatagttgagactgtggacatttaagaaatatgtattgtaaactatttccatttttaaaatcataaaattaacattcaagaaaaagcattgtaactttgaaaacaaagcaagaaggggtaaaaaatttctataattcatgcattcttcagtgaaccacttttagtccaaaggtaaactgcttatttataaatagactgtgtttcttcccaatgctattttttgcccaactcactccttaagtgcaggaggtacgggttctaacattcaatagtctccctgagcaaatcacaaatacgtcacatcagccagcactccctaagggctttatagtcctatttgccctgatcgaaaaatatccctctttttccaaactgaaatgacctcctgctgttatctggtttctcccagaataatgccaggaacaaattacttcaatttgtagagatattcaatctgttgagtaaagaatagacaaccaagaagttgtctagtaacttttgttgtttttgttgttgttcagccgctcagttgcgtctgactctttgagacccccagactgcagcacgccaggcttccctgtccttcactatctcttggagtttaacttaaaaagatgctgaatgaggaccaatcctccaatgtgggaataagagaactagaaactggaagttagtaaaagtcttaaaatattaataggatggtttggctgcattcaggaaggggatgcattcatatgcattcatatgcatatgcattcataacgtatcgtccaaaccggtgggacaggccacgggagcagagcagagaccactcctggcaaatcaggacttaggctcacctttgtcacatgcaatccatttatctgctattttcggaaaactatctaggctttatttcattaaaacaagatcagttcctagcactgtatctggcatatagtaagtgctcaataaatatctattgaggaaatctaagatttaatttagtttatctgctaaagaagagatccagaggtaaattgagatttatatctcagcataaattagtttaccaagtgctttcaagtgccccatgtttttgagtatcatcttttgttttaaaaactcacttttcaattcaattcttagcatctgtcattctaatgatttcttctttcgttttattagtacctagagagtagtagctcaactgccctctccttccgcttaactgaaacaatcagaggcaacattaacttcacgcttttgtgagtgtaaagggcagttcaggaggctggtttctgatggagcatttgtgtctagtcaggtgccacactgtggtctggcttcagctcccctggctcaggtacccaagttacaagtgccaagggagtaagaaacagttaactgggcaattctgacagctacatgaacccatctctaccctgagacccaaggttaattcccacaagataaatttaccttgtaaattcctacaaggtaaattcctaccatgtttgtttttaaacactttgctttaggtttggctctggataagaaatagcaatctattttattttctaaaatttccacttcgtaaaaactttttaaacagctgtgctgttcaataatgactcttcttcctggcctgtataagattaagtctctctcttactgctttatttttaattagacaagagagtatctgagctcagacagacgtaggctgaaaacctcctgcgtgactggaaacgaatgaatgcagtaggtttaacatttgtgataaatcatcctcaaagactattttcaatcttctgggtcttcttcttttcattacttcactctgagtcaactgagaaaatgtgaggctttctttctacaagagaattggttatgacttcaattagcaggcagtaagcattacaatcagcagcacttcaggatcaggaaacttctctccactcaattcactagtaatgatattttcaaattcctatttagtaacttgccaatactattt

SEQ ID NO: 56258 - DNA, 1608 bp, Bovine  19866881016126
tcccttcctttctccttcctttcctttccttccttttatctatctatccatccatccctccacctattatctatctaactgaagtagtaatgtacacacatgatttacaaaatttaaaaaatgatcaaattgtaaacagtgaaaactaagtcttctccttcccggaacttctgtctccccagctctctcccctgagataatttcttgtaaaacttgcctgttttattcgctgaccatcttagcatagctgtaaatatatcttctctccaccacctgctttctaaacaaatgataatataccatgcagattcttctacatctggctttatcaattaataaaatgagcattctaatgggaacatatatatgattgttttgattttttgatctgtctaattgttttgacaacaacaaattcaacctttgataactctggataggatctcgatgatgtatgtgccctgtccaggcatgtacctacagctatctactgcaacttcccaagatgtccacaccctctttctagtttgagatctagcagcagttctctgcatccatgttggacaccctggcaacctctagtccaagatgcaaaaggggaatatttctgagtttgaactctgtatgccagaagtgggacctagcacttaagttctattttactgctataaccaacctgggaaacttactctcagccatgaagcagctccatatacctgatttggacagggcttccttgtgcaaatatttttgaaacaattgaatattttgtcagccccaaacaataccttgattaagcaacccttgagtctgtaatatccaatgctagaaatcaggaatggtcctatgtcttaaatgggggataatcatggatggcaaagatgaatacagtaatgatataaacaccttaaaatagtgcttggcacataataaatgttcaatgcatgttaactattctttattatagtaataattatccatattataattcttgaactgcggagaactgttcaagaatggtttcttgaacgctttcctcactggaagcaattaaaatcataagcacatttgaagaaaaccaatgaactaagaattaacacttgctaatgttagtttctattcttccatcgagttaataatattaaacatatgacttaaattcttgacaaatttagacttaaatttttgttgcctgacgtcctagtaagctttgttcagttgctcagtcatgtcccaactctttgtgaccccatggactgcagcacgccaggcttccctgtctttcactctctcccggagtttgctcaaacttacgtccactgagtcgatgatgccatccaaccagcttatcctctgttgccccctcctcctgccctcaatctttcccagcatcagggtcttttcctaatatatttagttaccattctaatatattttttgttacaatcctctctgaaacataactttagaaagatttagagttctgaaatggggctattttatttcattttagttcttgacaacagctccctatgtgaattccctataggaacatgcacaatttaatgcgtgcaataggatttattttagttccataaaaaaggcaga

SEQ ID NO: 56259 - DNA, 1489 bp, Bovine  19866881061541
aactcgaatgggacagaattagcagaggaggcccatagaggtggtgggacaggctccagagagataggatagaacagtttaaagggaggctaaggcctttgcaatcagggctgaggagcaagaacacaggtacaaggtgcagacagacagacaaagacagtgattcaatcccaagggaaggccaggctaaaagtgggtattggggttacttcactcccaccccacacagcaaaccaaactggcagatctggatggtgtgctattttagtggaactccttgcatcagccaagggccaactagaccacaggatacatactaacttatcagagggaacataatgttctgcagtggttcttcaagtggaggccccagaccagcaccatctgcatcacctgggaacttgatagaaaagcaaattctctgacttcaccctagacctcctgaatcagacactctggagtagagcccagcaatctgtgttttagcaagccctccaggtgactcacagcttcccaggtggcacagtggtaaagaatctgcccgccactgcaggagactcaaaagactgggtttgatccctgagtcgggaagatcccctggatgtagagatggcaacctgcgccagtattcttgccatggacagaggagcctggtgggccacagtccatggagtcccaaagagttggacgcgactaagcatgcacaccaggtgactctgctgaaagctcaggtttgagaaccagggctatagggagttgattatgcagacattggaggactgaaaaaaaggagacccagaggtaagtcagagatggcaatgtcagatagcagtggccatccctacggcttagagaacccagggaagagtttagggttaccagaaccttgaggctggaggagaggcacaagggcactgggtctcagccctctgaggaggtggcactgtcccttgaggagatgtcactctcacgcgacaccagggggcagctctgggagtgtggcaggagcttgggaactccccagttgctgcctggcacagcgctagcccacagcaagaccagccagacctctctttcctgcttgttcctctccctgtgggcagaacaggaggcagccaacaaggcagaacccgagtgtggggagtctggacccagcatcacagggtagaggaaagaagagttggtctgatgccgagacacagcagcttattaagtggcacagctatctcacactccggcttctgaatgaaaactgagaacagcccatttggaagacaaattatttgacagttctaatggacgaccgaactaacggtatttgaaaagcaggatgactcagaaggatgcagaatttaatccaagtcccagttcttatctcggcttttggccaagtccaatccaaagaaagcctgagcacagaaatatatgcgggaacacaggccctgtgcttatactgtatcggatttatccttgaacttattgcaaaagc

SEQ ID NO: 56260 - DNA, 963 bp, Bovine  19866881251756
actttccttaattctgttcagcaccaagtagcatgatcttgtcaaattgccctgctgaggccaagttctggtatatctgagatgaaagaccaggtcgtgggtcatagctttaccccaagtcaccatgtgaatatccacagcgatgtctcctgattgtgaagggccccctcgggtcctacgcccacctgccctcctctctgtgcagctccctttcagacttcaataccaaccacccacaggctgcatagtagtgtgtgtgatccaccctctgagcatgatataatagaacctggcagtcattatgcctgacagccttcttttgaaatttcatcttaagtgtcttgaatgacagtgatgacaccattttccttgcagtctctccgagaatttgagtcattaatgtcagcaagttttcaccaagtatcctactgaaatctttacttctctcaatcttaatagcaatatacttggtgacataaggaaaggaaactaagccttgtcaccttccccaccatgacccctttctgggtctagatataattcctcagtgtgattggaatcagtaatcagaaaggagtacgattgcaggcgattttgttacttccaatgtagtatttatgcatcttcttgtactaatctgggttcattggtttgtacccttatagtcattttcttaaaaaaagaaaaggctccaatccaaagccataggggttctcacctgatttgttccctgagagtaagagggaacaagatttgggggggttgtggaaagagagctggggagaaagatggagtctagggtttggctccaggtccatcactaaattaaaaattctttaatttttctggcatttgttttagtcagttagtcatagtgttctcagctatacacataggcaattctcaaattatttttaaccagagaaatcatttcctcaactaaactcttgggtataataagag

SEQ ID NO: 56261 - DNA, 765 bp, Bovine  19866881340445
tacataaagtaatctctaatgtaatacttacattattacattttgtgtcctgcattgctgattgataagggagaagtctgttgatgactgaaacaaagtactttgcaattgggaagaaaccaaatccataggtagtcaaagggatatctggaaattaattaagcatttatagttctacctttaggagacttaggtcaaaatcgtaatgacaacttgtcttatttcttcagattatatttgttttaaggatattatttgatttgtactgattttcttttctgtaaaaatatgtttcaacttctaagtggaatcatgtataaattcacatttcttacctcccaaaattaaaataatacataaaagttacttggaatattggtcttctaattactttcacttttttcacatagatttctaacaatgtgctagaacaaatcacaagctttgcatcaggaacatcataccatctcccattggctcaccacattcagctcatctttgatctcatggagccagcacttaatattaatggactcattgacttcgcaatacaggtatcaaaggcatcctgccttttagcaaagcaaacctactaggcattgtccagtttacaatgagccaccccgtgcagttctgtacagttgagacattctgagtcaacagtatctaactagcagctatgtccataattttcaattaaatataattggtgttaaaatataatagtaaaaaagtgagagtttgactgtatttcttatttgtctt

SEQ ID NO: 56262 - DNA, 1541 bp, Bovine  19866881362375
ataaattgtttcttggaaatacagattttgagttttattaatgttatggaacataattaaaacatatatccttttgtttgcttcagtagagaataaaaacaaacttacaaaaatttaaatagagggattagacctatgtaattaagtataaatttcctgatggctgcattatttagatgtaggtttgggatagtttcagtttaaacaagggaaatgctgtataagttaatttcataatatgaaaactggaaatcactttttggtcaaatttcaaaatgccaaagagtaggaaacctcaaaagaggaactgatttatggtggcatttctagagttacagaagtatcttctcttaaatgtaggtttcaaaatgtttgaccataggaaatatccaacagactcctttatgtctctgtgcttcatacatgttagccagtggtctcttagtttacagcagcgctggtgcccactggggtagggtcctctgccttgatgatgcacctgagaggctgtgatgggacaggagcagtgctcgcgagccagagtgtctgggttcatttccttatattccagcttacttttcttgtgaccttggtcaagttacttatgctctctatgaaaccattgccccctcataacaatgaaaataaataatagcatttgcttcattgggttgttaagggtataaaaatgtttgaatgtttgccaggtgctttgaataatgcttgtcaagtggttcatgttagtccatgtcttgttaagtgaaattaaaaatggagtactctctatacctgtggggatagctgactaaaggagtgaatcaaagaagatataccatgaaaggtcctagaaattattctgatttgtcaggttcaaaacatttaaaatctcatcaggctcaaagggaatttagtcaaaaccaatgaaatcacactagctatatactgttctaagtgattatgtggtcttaaagaaatcagtcctgagttggaaggactgatgctgaagtgaagctccaatactttggccacttgatgtgaagaactgactcattggaaaagaccctgttgctgagaaagattgagggcagaaggagaaggggacaacagaggatgacatggttggatggcatcaccgactcgaatatgagtttgagcaagctccgggaggtggtgaatgtcagggaagcctagcctgctgcagtctatggggtcgcaaagagttggacatgactgagcaactgaactgaactcttaaaacaagctcagagatccgtcccattttacagatgagaaaatggaatctcaggtgttaagcaggttgcccaaagtcctgcaactgaagccctctgcaaacccacaccgtttggttccagagcccccacttggaaccagcccctctctcttctgattgccagagacaggatgagtgtgggagtggttatcaaattctggagtttttgagctgggtgtttcttattgctaagtgaggaggtataatccactttcatggatttgtgaaactgtttgtctcagagtgaggt

SEQ ID NO: 56263 - DNA, 2594 bp, Bovine  19866881386788
atagaagggactttcatataacaaaagccgctatgaaaactcttcagtttttttttagtgaagcattgaacaatgttctcctaagatccagagcaagataattgtaatcaatattcctggaagccctagccagtacactaataagagggaaaagcaaagcataaagactggaaaagaggaattaaaactctctccagagagtttctgtctctggttacagaagttatgattgtttttgtaaaaaatcctgctgctgctgctgctaagtcgcttccgtcgtgtccgactctgtgtgaccccatagacggcagcccaccatgctccccggtccctgggattctccctccaggcaagaatactggagtgtgttgccatttcctctttcaatgcatgaaactgaaaagtgaaaatgaagtcactcagttgtgtctgactcttagcgaccccatggacttcagcccaccaggctcctccatccatgggattttccaggcaagagtactggagtggggtgccattgccttctctgagaaaatcctaggaaatgtaaaaaaaaaaagaagaagaatatatgagtgaaactttcaaggatatgattgggaaggtcaaagtaaaaatgaaatgtattcttgtacactctcaatgaacatttgaaaaattttattttagaattaagttccaaaataagtcagggatgaattcaagaaaagatttgcaagacttcagcattgaaaaaataatatattatttaggaagttgaagaggaccttatgcattacttgaaagtctcaataatggtaagatatcattcctcccctaaatttttaggtttaatgcaataccaatcaaaatcctattagtggttctttcttagaagttgacaaaatatcctattattttgatggaaaagacatggaacacaagaaacaattgtgaagataagaacaaagctgaagtcagcatggtattagcataagggtaaaatatatagatcaatggaacagaagagaaaaatcagaaatagtcatgttatggtctttattttagactcaagcatcactgtaatctaatgagaaaggatagtcttttcagtgaatactgctggaggaacagggtgtctgcatgggggaaaaaaatgagctttgaactccacttcccaataaaagacaagggtgtacctgttgagtcactgccactgctaaggtgcccccagaactgtctcctaaaataccaatttggataggatccactccatattttgtaagaattttatcctgaagaaaaaacttgactgcagtaatgctgtcttgaaatggagcaggaaagtggtgttgaggggctggctaatctatagctttaaaacaaaacaattttatttaaacaattttttaaactatggtttatggctctatctgtgaatgtagctttcaaacaccaaatggatgcaatttaacaccatgttctcttgtttaatcttccaaataccaaaactgagttctctactaacttcttatatgaatgactcaaaattgatgttaaagttttcaaccttgtatctgaggtccatggatggcattgcccaggagaagtatggagagtattaaaactctcgagaacataaacatgaatttagtgcaagtatattttggattggaaatgccctatagctcatgtcatattctcaatgtaactagcaatctaagcattaaaaataaaaaagcatatgaatttttgaaggcagtagatctaagagcatactctaggcaaatgttcaattttttcaaagcaattagataaaaattatacagactggcaatgcacatacctcattatgaataatgcacaggaattgattctaaataatttttttgaaatataaatagtatttagatatgctagagagcttgcttgtttctggtattgatcaattcatttgcaaggtaaactatcttaccatccctttaatggatacaaatggattttcccccaacatgtgtggaccagtaaaaacaggagagtacttctgttaacctgttctcagggctaactttttcttttcattcttcagaatgctaaaattagtaagtatttgtacttaacattaaatattggtgagataattcttatatgtttattataatttatatttagaaaatcctaaacaaagtataatttaaacataggtatgtaccaaaagatgttggtttctagtttaaatacagtacatttaagcttttagagctaaaaacaacaaaaatcataaggatctgatagacaatataagcaaagcacaaaaatatcactgtattaaaacagatttaaaatcaatgatttagattactccaaaagctatggaggtagaaagaatatcctaatattataagttagaagtatccctgaaaatagaagttcttccttgttctatatgtaaccataacaacaaggacagaaatcactgcttagatgacccatttttaatctgttttctctctaaactttcatagcttccaactgaaaaaccactgccaccaactacaaatgtcacaatgataccactatgtcatctcagaactgtggatggaagtctctaagga

SEQ ID NO: 56264 - DNA, 735 bp, Bovine  19866881479085
agtggaggctttatattctggcccagattcttcccgtcatatactcttaggttaccattaacagttctatgccttaaataaaaatgctcagttaacagtatcttggttttgctttaaggtgcaaatcttttctttctcctcctagtgaattattcacaacagttcttgacatgctgggtgttttaatcaatggaacattggcctctgacctgtcgaatgcatccccagggggatctgaagagaacaaacgcgcatacatgaacttagtcaagaaactgaaagtaagtttgtggcctgctcaggagttcacgtggtttttggatttgttatttagcgcacgttattttattactccttaaattagatgttattttttgtgtttatatcaggtgattattttgctgtttgttttacctcagcttctcagtaccccaaagttagaagtatatatagcttgaagatttttcttaaaataattatattcataaagcatatttaattttttaagggactgtagaagtccattatcaaatatgtaaccaaaatgccaacattagatttagggtaaatttcatcttccactggcaacatgcagttgaatattaaacatttgcattgctatttctaaattcaattcatttgcctagccactcatacagtttttgaagtaaattataaacaaacaatgcaggaaaaaaattaatatatctaatgaccttactaataaaacaacca

SEQ ID NO: 56265 - DNA, 889 bp, Bovine  19866881787751
gatttttaagaaattccacactgatgcaatgtgatagctgaggaaacctgtgatactttataacggacatctcttcaaaaactctcggacacagtcactaagaaagactggacacccctacaaatctgagcctggacatcctaatcccacacacagaaccaatactctaaagagagtttttcaccttaagaaaacaaactggctgccttcagaacgcaaactgctttagttacgttatgccctgcaccgtgaaggacccaaggcacttagtcaactacgaccagactaccctgaggagaccagacatgacgtctcagctaccaaaggaggagactcctagcatctccactctaaattaagctattttagttattttggtttttttttcatttacttttccctggcaatcacactctggtttatcacttctacagagagagaagaaaacaatttatattatttcagttaagagttgagtcaactaaaaaaagttactaattgaatatttagttgcacagctgagtttttaaatgaaacagaaaacttacatcgacagtgcaaagaacatcattaaagccccacacatgatttgaagaacaacaaagagccttcaggacccccagccattctgaactgagaacagtgcagcaggctgtcagctcggaggagaaattggctatgtcattaatcctacaaagaagaaaaagaacataggagaaagtaacaaaagacaaaatactcatacaggataaactcaacgaacacataatttcagtatcatcgaacaggggactaatttcttaagattcaaggatataataaaaatccacttgacaaactacctactagaatacgggacagaagagaaaggagatgtcttcacacgttt

SEQ ID NO: 56266 - DNA, 1036 bp, Bovine  19866882094137
attaccaccaacagaatagactgtctctctctctctatatatatatacatacacatatgtggggggcggggctatatatatggagagtctgtatatatgtatacattccctatatttatatgggaaatcaaattaagtttatctttataaaatcttatatacagcttttccactttttgatatgagcatttgttctttcgattacatcttcttcaaaacaatttaatgccagctagttggatagactaccgtcaggaatttgttggctccgctcttgttggataattatacgtttctccgccttttgctctcataaatactgccacagtgaatgtccatatatatgtactgtcgttttacatgtgggtaggtgtatcttttgtacactgacaagcccatttgtcttcagaggtagaattttgtactcacctgaaatgaagctcaagagatacaaccccagtggaccatgcagagtttcaaagggcttgccaaaagcattgtacatgaagaaggctgtccccaccagggttaaaacgataaggattgtggagaagagaatgacattgacgtgaatactgactgggatagctttgagcaaatctgggaaaactgaagacaaaacaaagattgggaaaaatttcatcagtggtcatttgcaagtgtaatttaaaagattaaatccctcttttttcacttcaacagtccctaaaatccttcagatgaatacattctcacttactcatttacaagggatttacaaaaaggtttaaacatggtattactttatagaactcaccagtaaaagctagcagtggggaaaatttgagggattttttttgcccttggtcatatataattacttaagtgaacaagtgctagtcttataaccaaaacctatacattttgatgaccaaacttttaaagacatttctccgtagcctttttttttttttttcaatctatcttaactcgtaatgacattttcagaactgggagagttaaaccatcaggagatttttatacttcctttgctaca

SEQ ID NO: 56267 - DNA, 3514 bp, Bovine  19866880287763
gtgctgtggacttcccggacggcactagtggtaaagaacctgcctgccaatgcaggagatgtaagagacaagggttcaatccctggatcaggaagatcccctggaagagggcatggcaacccactccactattcttgcctggagaatcccatggacaaagaagcctgatggggtgacaaagagtcggacatgactgaagcgacttagcctgcacccatgagtgctgtggtcaaagaaaacacagaaccagtgagaggtattagtgatccagaggagaggttgctcagataagtcgtcgtggaggaagtgggtctctgagcaaagactgaaaggagatgagggagccaagtggttttctaagggaattgcattccaggacagagagaatgatgtgtacagaagtcctaaggcagggctgagcttggtgtgttggcgattcattgaggaggccagcgtggctggagcaaagtaatcaagggggagagggaggaagctgtgagtagagaggggacaaggggggccagatggggtaggaccttgctttaactttgagactggagctaggggtggacgctgagcagaggagggacaagatctaacttaggtgtgaactggttccctctgcctgccatgtaggagtagatcgatgtgagctctctaagggctggaactacatctttgtcccttctgtctccttggcttctggtacaagggtctgcaaactatggcccacaggctaaatcctcggattttctgtttgtataaataaagttttattgaaacaaacccacacccatttgtttacatattatctatggctgctttcctgctaaatagaatagttacagcagagaccatctggctctcaaacctgaaaatatttactgttttgccttttacagaaaaactgtgctgacccctggtcaggaacaaggcctggcacatagtaggcactcagtaaatatttgttgtcacataactgagccggtctctcatctgtgacccacacgaggctgccagcttgctcttgtctcagagccagttccagtcacatgtgggaaaacaacagcccagggaccaaaaataaaatactggaaccattcacatctctgccacggaggaactgctcaggcaggaatatagtcaggacccacagagaaactcagcatactcttcgtccttttatttttcttcgttaagactcggggctcctttacccctgccaggcgtggaaactgctccccccatttttttctcacttaaaaaaaatcccccaaaccctcttccatagagaagccccccctccctgactttcctgtctcctctcctgtcaactccaacgttttgtttttgtacatgacttaggtcccagctgtttttgtttttttttttcccatgcttccgatgcccattactcagattctgcataatgaggcagttatgagttaagaataatggggctgtgccagctggcagaatatctctgggaactgagaaagctcccacactccaatttccttttcttcttacacacatcgatcacagtattctatctgtcctcactttccaagtttctcctttactgcagtttgtcctgtaccctcaggatccacagagcaatcagagccagtccctgagagctgggaactcacagtttaatggagacagtcccagtgctgggggtgaagagatggatgcacgctgggatgcatccacccaccatccatggtgggggatgacttgactgtcaagggaatgagtttgaagttttatgctgaggaccctctctggcagacttggatggaggccagatggagggctctgagggagcagggtgcctccttctgacctggtgtacattctggtgatttcacataggtatctacaccctagacactggggccagattgcttgggttcaaatccagaggctctcatgctttctaactatgtagtcttgggtaggtttccctcagtgtccttactgtaaaatgggtatgactaatacctaccacttagagttattgggaggatcatggggttaatacatacaaagaacctggaactgtgcctggcacacaattgttgttgtttagtcgctaagtcgtgtcccatactttcatgaacccatgaactatatatagcccaccaggctcctctctccatgggctcctctgtccatgggatttcccaggcaagaatactggagtgggttgccatttccttctccaggagatcttcccaagccctggatcgaacccacatctcctacactgaaggcagattctttaccgctgagccaccagggaagcccacccggcgcagagtaggcactcagtaaatatcagcaactattaaaagtgcttagcaacaggcatcctattatcatttagtgatgtcatcaattatcctatagattgagcagaaagaacgacatcttcagtttagaccctgggtggggatgatgacatcaccagttaccaggtagaaaatggttagaatgtactcgccagaggtttcattcccacttgaatttctgttgtgtcccagtccacactcttctctggggcacatgggattatcacctatttgcgtctcagttttctatcaatcaaacgcagataataaaagtatcagtctcctaggattgttgagagaatccaatgagttagatacagacaaaggccacagtgtcccgcgcacagctggcactcaatcaacagcagctcccgttagcctcatggcaagaggactccacggtagacacgctggctagggtaacaggtgctctcctctgtctctgggagtcttggctaagagcacagacccactgcagtctgagcccagatctgccttcaaaggcagccaggagaccctgggcacgttgcaggcctgaaagtgggaataatgacagtgccagcttacaggactggcatgaggaggcatcaacatgatgacgaccatgctcccagcactcagccttcgtacacgtgaaccgtataatcactgaggatgtccttgcaaaggtcctcccctccttggaaaccgtttgcccacctgcaaagaaatgggcagcgactgtggcaatctcaaagcttcttgcctataaggactcacctttgctatcgctgagtgtaggtgttgggagatggatgctcccacccgtgtctgccctcagcccagctccagctctttccttctgtctcctcactccccatctcttaaccgtcaactttcccctttctctggcttctttcccttgttctagactttttctttctctcttgtttctctcctgcatgctatcagaagactgtttgtagagcaataaatagtgatagcaatcataatttgtgtatttaatctttcccccatactaggacagctctttgcatgtattaactcatttaattcacacaaagacttgttactgttggttcaacaaacacttacggagtgcctcctgtgtgccagaccctgagaatccagctcggagcaaaagaaagatcctcgcc

SEQ ID NO: 56268 - DNA, 1760 bp, Bovine  19866880395137
cagaactaactcccttgagctgtcccatccctactcagcatcctgtagattaagagaaacagtcagtgcaattacttcaatcacttatgcaaagtaagaccgacttcccaaattggaagtgagagtctgggccacctggttagtgagggcaggctgtccccagggggggaggtgtgcttttccttttcgttctttgggtctttgcttggtcgtgagatgatcataattaaaatcactactccttcaccagcaccaccatcatcatcaaatacaccaaagttaaagcacccagaggaactttccagttaacctgaaatgggctccagggaccacagagaagcaggcatcaagtacccacatgctaagagatacttctcaaaaaagttgtatggtcacagcatattataagcatagtaaaggtgctgataagccctgcagtgaagatatcaaattagctttgttccccaaagctttgaccaccaccgtttttagaaaattgctttgggcacttaacatcatgaacaccctacagaacaaatgtggggaacgtggcttgatgttggtagtctccaaccttggttgtacgtcagaagttttcaaagatactaatacctgagtcccatctcagagtagatgagctaccaatgcagatggcggccaacatgtcaacctgaccctgctgttctgcttgagaccatacctagcacttcaccaccatcccccaaacagaaccaacatcgcaaaacactaagaggaaacggacatggtgctgaactgttcacgaggtgacggaaggggaaatgttgcacacaagggtgcaaaacttcccaacaattcccttttaaaaaaaaaatctttgatttttccccaaagtttttttccaaatggcagctcctttgttctcttttcccttctcccattgttctccccgctggatggtctctaaaagcctctattattctgccaattccctttgaatctaagcttatacgattcactcaagaataatagtagcactctgttcttactcaaatcgtcccccaggggtcttgccccccagtccaaaatagcttatcaaagtgtattttccaaatccacatccactaaaacatcctttacaaagagttcaacatgaactcttatggctaggtggagccgaagacatttttataagactaactggggggactggactgagaaagatggaccaggaaggttgcatggaagaggtgagattccagtcaccttgaggcaaggattcatgcagaggaaaacaggaaggacccggagggtaaggacagggcctgcacaaacctcatcatctgagaaaggagctggggagcagggaggaggaagagaggagggaggtagcgaaaggtttgtgtcgtgatagattgaagagcttcaatggaacaaatgataataccaagcaagtaccttgccctcaccgtgtgccagacaccgttctaaacactccatttgtcttgctttgcttaaaccccacaacaacccagtggagtgggcactgttttcccagtgagtcagcagctgggctgagatttgagtgaaggtgcttgtcttcaggggccatttgcttaaccactgcattaaagagtaatgagctagagcaccgataaaaaccaagccaattaagcagccagagtgacagggttctggagtaacccagactcttgctgtcacagacaggcactcggaccaagagcctcagcatcacctgggagcttataagaaatgcagca

SEQ ID NO: 56269 - DNA, 3496 bp, Bovine  19866880428339
cagcatgccaggcctccctgtccctcaccatctcctggagtctgtccatgttcatatccattgaatcagtgatgccagccaaccatctcatcctctgtcgtccccttctcctcctgccctcaatctttcccggcatcagggtcttttccaatgagtcagctgttcgaatcaggtggccaaagtattggagccatacgtacatgattaaaaaacttatgttcattgttatctgaagttcgactgtaagttgaatgttaagtgggtgtcctatatgttaggaccctctgggttcagtccctgggttgggaagttcccctagaggaggaaatggcaacccacttgaggaatcttgcctggagaatcccatggacagaggaatccagtggtctacagtccatggggccacaaggagtcggacatgattgagcccacacgcactactcccatagcctcagggacccctgcctccaccagccaggcccagtgcagcccagtcatcatttcagccagaatcaagagcttccttctacggacagacacagagaagcagccacagacattgtctgctttaaaatacgctgctgcgctccccgggccacccctactccaagcccagagcccccaggtgtgatttgaaataaaacaccaccacatcttttctctgggaaaagaccttcctcctcctctattcctgtaggttgggagatggtaaatctcttccctgaaccatggacttcacatgtcaggttcctggagagatctctctggagaggaaagggagagggagccactgaaatcaagttcagacttgttagagggagtcgtgttgaaaaggcgccctgaacatgtgaaatgcagctgttcccggcgccgagagaatggtgatgattttcctggcgagacacggagaccatcatatgaggagcagttaagcagtaatttaacactgctgttctgctgagagctgatgcgagctgcttctggcaggagggtttggggggaacttgttttctcggtgggaaatcacaaagcctttccatttgactttcacttaaatccctgaatgttttgttgtaggtgtcgcttcattcgttcatttacgaacatgttgtaagcacctcctacatgctaagcactgactgatttctcttcctcagtgtttgttccaggtatccattccttttttatccattatgaataaacatgcaggtatttatttgttagtttattacacaaacattttccaaaccaggcgcatgcctggagctgtgctagagatacaggagttaatggggcccatgctttcccttcaaagaactgattgtctggtgggggaagtggacatctacatgggtcaaggaaatacagagggtcagcctgataattaaaaacacggtatgtgcatgcgtgctcagtcatgtttgactctttgtgaccccatggactgcagcctgccaggctcctctgttccaggcaggaatgctggagtgagtagccattcccttccccaggggatcttcccaaccccggatcaaactcttgtctcctgcgtctcctgcattggcaggtggattctttaccagtgagccatggtgagattccatttactgagcatctgctatacaccagtcactttatccacattgctatttataacatgtcatacccaagccattccttgaagcagggtagccattaacatccctgttctgtggatgagaaaagagaggttctgagaggttgagtaccttgccccaagctataagtaacagaactaagattcaaccccaatcagagcccaagcatccactctgctgtgttgccctcaggcacaaacaggagagaaaaatgcaacaggagaagctgaagcaactggcaggctctgatggggggtgtctgccctgggttctggaggctgaattaagagtttgctgtcagagaagatcagaagagctttcctagggaggcaaacagaacatcttgaaagaatgaggcatttgggcactgagggaggcaaaggagaggctttggagggtaaagtgtgggaacccaatttctgggttgcccaggtaatctcaaattggtctgttcctctacaacagacagctgagagtctgaggctcttcatgggatgtgtgtgtgcacgctcagtccctcagttgtatccagctccttgccactccatggactgtagcccaccaggctcctccatccacaggattctcctaggatgagggcttagcacttcagagagccagctatcacccaccaggaagcggcaagtgcacacaaaggtcagtcacacccgtgtgaaaatttcatccacccgactctgaaatctcagccgtgaaacctccaaccacacatcagggcagaactgccagtaagcactgatgtgtgctgcattttaaagtctgggcaaggtggctgattacagatgctgttctcagagccctggaataaagtttctcatcccacaagagccaaggcatggtccccaaagtaattggcattgcattattgataaaggtgttgggccacgcacgcaccgaggaatccatcttcttctctgacatccgattactctgtgcagctcctccgttcaccttgggctggcatgcagctccagaggcacagattccttcactcattggcaacttcacgacgtgtgctgtgtccaagggagaaagaaaggggagggaggaggcatgagcagtgtgtcagttttgaaatatttgtcctgaatatatatatatattttttaaaaagggggacttccgccctcctgtcctttctctgccgtcttagaaatttgattagtcgttattaaatattttgaagtggaggaaaaacagggagaagtttccaagggcaagccacaactttgatcttgacagagccgtcattgtcaggagccgacataaaggcgccttgcgttaggctggcgttaacacgttgagatgctggtaattagggccttgtaatgacccgttccagaaagaaacagctctattccttatttgccattaaagaacaaccaagagtttatttgcagagaattgggtttaattcaattagcaggaattgtgaggcattcacaacacaaggtatattagcctggcacttggtttgtaatgacacccagaaagcatttagggaaagaaaagctaattatccaaaattcttcatttattttttttttcttttcaataacatggagggtttagtccaaatttcagaggcctgtattcccaaatcccttaagctttaattaacgattaacagagcagcaggatatggagagggacaagaaatctttgccgtggagtcagtgccaaaggggattattaataacccccaccctgagacagcacttcacagtttacagagcgtttccaccaccattatcttctttgaatattcatttccttgtctctctgagcccgttctctggttgctgagtgtctttttcacccggcccgtctgactttcagat

SEQ ID NO: 56270 - DNA, 703 bp, Bovine  19866880438239
cctttagtgcagaacgggctgtgggtaggagcctgaagtctgtgactttttcttgagcttaaatctaacttcctctactgaataactttctgagctggaaaagattacttttcttctaagctcaatactctcagcaatgaaatgggataataaaagttgttctggggatgacataaagagcatggcacaatccttggcatcgctctttagttcagagtgtttgaggcattttggaacagaaggttgcagtttctgtagtttgtagttgtaccttttcagaacactgactcaaaactttaagggaaaaagaaccctccatgtcttcagtgcctttgctttttttggtgttcatttaatcattatcagtgcatgggcattgcacacagcccttccccttttttcttcctggcaagattgttataatgtgttgaaaatattaattatcctcttcaccttattcacaggactggaaaaacaaatcttgctcctgtgcttgatagaagaaaaagcacctctgtgtgtgtgtgtgtgtgtgtccgtcccacccattgtcccctcgggtcataacaaattattgatgccagttcctttaaaaagacaattaatccaattaccttcttgttgaatcaatactaatgtctttttttcttttaacttgcaggtttcagcaagcctggctgccagcacaactgaggtaggaaat

SEQ ID NO: 56271 - DNA, 1778 bp, Bovine  19866880491009
ttacctcttgaagatctcttttaatacagagatccagctcatcacccttctcaagcaccttttaataggaaacctcccaataaacttattaaaagcataatgaaaacctcactccgtcttctgtcagccttcggagctctaagtggcttctaatttgcacgagattggaatagcattgaagaattacaggaactaagtgaaacactctgtcggattttcaattttctgatagcatcccatgtaatttcttgtaacgcatctgtagccaaatgcggtgacacgtcaaggctcctgctggtgcttctgcccacgtcagcgttacaatgagaagcctgatgctgtcagcacttctcatggggagggtgcggctcggagcctttgtttggccttgatggatattccattagatgccgtcctctgaacaacagtctcataatttctaacagctcagatagatgtgtgtgatgcttgacatttgacttcacgtatttattggaacaaattgtgcatcgttccttccacgaggctgcttggcagaatatgtagtttgtcctgcggtacctgttgatttgatggcctcactggagccaagactacatgctttgtattctgatcaatggaattccttttggagcacctaggagaagctgcgggcagattgtggctctgaaccagagagatgagaccccaagcttcccttagcacatttcatattattctcaggtattgttttcaagctaaagcaattcactctctttttcagagaacctaagtatttttcttctaaccttaaactgggagtctcttgtgcctaactctaatgtcggttgttagattcatattgatgtatggcaaaaaaactatcccaatattgtaaagtaattatcctccaattaaaataaataaataactttaagccaataactgtcttacagatagactcatcacacttagtgaaggaaaaaaaaaagccagtcaggctttgtaattgtccatatagttaacggtgtggctgttctttgcatgtggtcccagcaagattgtcccactcccagggcgggtttttggctggcttttctacctgagtgaggatgaatttgcactaattcaccttcacactcttcaggggtcccctctgtaactaaaggcatttatttgtgaggcagtagggcttgaggttaagacagtagtctaaagtcttatcacggagtcaagctaattggctcacgtggggatgagagctctgtactaactatggtgcttcggaaaccaaggaccgtgtttttgacccctcctctcacccatggaactgcagcaaatgtttactgagttctcatggaaggggtgaagccctaggtcgagagctgtgtgagggggcagggcagggcagccaggaagggctcatttcagggcagccggacttcctgcacgctcagggcggatacgaatccaggcttctatttcaaacctgctgaaacaatgaaagtgttagtcgctcagtcctgtccgactctttgtgaccccatagactgtagccgaccagtctcctctgaccatgggatttcccagacaagaattctggagtggtttaccattctcttctccaggggattttcctgacctagggattgaacccaggtctcttgtattgcagacaaattctttattgtctgagctatcagggaaagtctttttcctttattatttgcatctttctattagatttatctaataggcaatcactgaaaatgagttgaatttagactgtgaaattatag

SEQ ID NO: 56272 - DNA, 1112 bp, Bovine  19866880516516
cctgggtggcttaactttatggggcatgttgtgctctggcttccgaagctttagtagaatgaatctctggcttatcaacttggctgacaacacacttcctgttagctcctgtccctcctgagcttccttccctactggcttgccactgtttctaaggttcacctcccagataacacttacacacagatattgctctcagggtctgcttctgggggaacccaacaaagtgtctatagattaatacagcaggactgtttgaaccaagcctaaagtaacagtgtaggggaaaatcagaggaggtatggaagtatgccttatggaagagagttcacttttgaccagatacgcaaagcgtggcctttagatgcttgtactcacttccagaatcccatattttagccattgacccatggtggctcagtggtaaagaatccgcctgcaatgcaggagatgcaggttctatctctgggtcaggaagattccctggagaaggaaatggcaaccaactcctgtattcttgcctgggaaatctcatgaacagaggagcctggcaggctgtaataaggtcacaaaagggttgggcacgacttagggactaaacaacaactaatccatatttcctcatactaaccagtgtgtattcttgaaagagattcccgatgatttcttttttttttttttttagtttagaggtttgtgcctcttaagcatatggaataaatagaaataacaaatgtacaaatggagagcatagcggtgcatactttgaccatgatttacagatattttactgctcagagcatttataaaccactggtgaccactgcaaatgcatattctcccctgtaaggttgcatatttcattgtaaatggcttaactatctttacttatccatttgtaataaaatgacgaggacttaaaataaagttaatgcatttgaaagaaatcgattgtcaatactctggctgctaatatgtggaacattttttccccctgaggtgttagtacattaaagcaaaactatttatgttctgattataaattcattaactatttacacctcattgacttacaacttatttttttctttagaagactcactttcaacctt

SEQ ID NO: 56273 - DNA, 2898 bp, Bovine  19866880551675
acaaagggtcggacacgactgagcagctttcacttaggatgtgtgaagctgcaggctctggcctgggtgaaaagtcacggaagctcttatggggctgtcctgacaaccaaacaccactggaggtgagatgcattttgtaaagtagtactcacaggtcacttgccagggttttttattcctgatatcatttgggaatcccaatggcaccccactccagtacttttgccttggaaatcccatggacggcagagactggtaggctgcagtccatggggtcgctaagagtcggacacgattgagcgacttcactttcactttccacttccatgcactgggagaaggaaatggcaacccactccagtgttcttgcctggagagtcccagggacgggggagcctggtgggcttccgtctatggggtcgcacagagttggacgcgactgaagcaacttagcagcagcagcagcaggctcatcagagacattttgttgggcctgagaaagcgaaggacctaccttgtagacaaaggtgcaaacaaagtcgatgaagccgacctgaagcttagggagttcatccgccttgtttctgtccatcatgggctgtcagggggagagagagttaattgcactgggcccctcttgggctgatgcagcagggaacccatcctacctatgaagtgaaacattcttccaaaacaaaaaccctctcactggtctccctgagtctggtggggagccagcggaccattccagccaagtttactttcaatatagatagattcacagctggacaggtcttccccttgcatggtctgtgctgttagcacagagccatgggaggtagactcctagactgtcggaactgaaagggaaatctaagttttggccatctctactgagctgactgagccaaggatacaccttagaggagggtctccaaactttagtagggagcatgttgctggacccacccccagagtttctgtgcaggtaggtccagggtgtgcacggggggtgagggggtggagtggtctgtggatttgcatctctaatgtgtacccaggtaacaaggttgatggtggtctccagggaacacactttgagaaccactgcgttaggggaagctcatctctgtggtaaggtcacacatctgtgtgtcaaggatgaaggggcacatctctccatcatggccaggtcactgctctccaccagaacaagatcacacgcccagtatcaggctgaggtcccttctctactcacaatgggattctgttgcagcaccgtgcgctccaggtcaccttgttcccagaattcagcagcaaccagcagagccacctgcaacaggcagacaccctccatggagtcaggtctcagccccggtcctcccaccttgctcccatccctcttgggcttccagctcagcacaaaaaccccaatcctgccctaccaccccactatatgtcatcacaagagattgccacatcttgccagaggatgatggagcagtgggctgcctcagcagctagagaatccaagctgcattagctgctgtcaccaggactgggatgctcctcctctcaggacaggaggacaggaggagtacgtaccttgctctgcacctcccaaggcttggtgatggctgagagatcacaggcggtcatcatcatggccctgcacacaaggacaccaaccatcagtccagaggcagtcagtgctgtatatctgattgattccatctatctcttctttttctgcccctactagtaggtggcctcatcccattgtgagcagaggtgtcaatgcccaactgcatctgaaggtcaggttttgtagtcaaacagatttaaatcctgcctttgtcagttattaggagtttggcattaagaaattaaactaagttctgggccacagtttccttgtctgtaataatactgctactttcttcatggagtgagtgcaagattcaatgagataatgtgtgtaaaaatcttagcatggtgcctagatatattatgtgcacaacgtgtgtgtgtgaagtcagtcgtgtctgtttgtgaccctgtagcctaccaggctcctctgtccatggaattttcccggcaagaatactggagtgggttgacattcccttctccaggatatcttcccaagccagggatcaaacccaggtctcctccattgcaggcagattcttcaccatctgagccaccagggaagcccaagatggatcctacatggagtcagagcagactgaaagaagatgcatgtctttgattcctcctgacactgagcccctacatctatcatggaattgatttctttcttaaataatagtcatttctgtttgcatctaatctctctagattagaatttttttttaccatctttgagtacccttaaatcctgcacatagtaggtacttaataacctctccgtatctgaactgtcccaagaaggggaggggaatcactaattagtttcaatccagactaattgcttttctaaactctcatataaatctgacttttaataggttctgagaatcgatgtttcattattttttgccgcagtggagtttatccctgttgatgggtcattacaaatcatcggtctctgagaggtccccttcctatctctcatttcctgatctttcagcagggtatctgtgttcttgagagtgaaggggtaaaaaattaaatgggtcttggaaattaacaactgggaccaaccagaccagaggaagagacgctttggttttctcaaggagcctactccagacagaatcctatcactcaaaaggaataaatggaaggctgtatctgcggtctctgtcaaacagatattttcgatatatatctgtcattcagtgagcgcccactacacaccagatgctggctgag

SEQ ID NO: 56274 - DNA, 2234 bp, Bovine  19866880566031
tttcctttgtatgcctacccagcctccctaaaggcttgtaggtacgtacgctttaatatttcatatttctatcagtaccatctcctgggaaacatgtaagtaggatcaatgttattctcaaaaatcagctttgaatctgccagaacaccatggggaaagatacagtagccaccctggaggtttgctccacttaatttagaagagaaaactttgtgttaggaggacatgcttcagcacctaggagagcgacaagcctcagggtggccctctcttggttactataggtgaacaaaccttttcatctggactgcaaatctcaggggattcagcagctgtcccttggctccccctgcctgccccctcagtatcctgatagccatatgtgagtgcatatcactagacagcctataaatcatgccttttattgctcttcccttaactcctctctttgagcagatgggtttcactctgaaacgttacaggtttgtgctttgagttccaaatgtttttcacggttccctagaaggccagggatttaggaaagagcctctgtgtgtcaatcatagagtgaggttccgactgtgctacctgagagatagggacaggctggcccacagtgttcctgaaagatctgatgggcctcttactcatacccaaaactaatcagcctcggatgcattcagagtagagaatggtcctgggaccagagttcattgtccaacttgaccttcacagaggagtgatgataaaacagataatattgacaggttctcttttggacacctgcatgtaaaatcatatctaattctctccactgcatatatgggttctattctcaacaccattttgcagatgaataagtcaaggcatggaggggatgttacagagatgtgtctgaatgggcaagcctaaagcttggcaagagtttctgcagcaaagttatctaagttcacaattgtaccttgattgagtggttcagtgattagtatctaagcttttttcctgctttctggatttccgggttggggtggaatactatctcattttgtccctgtggtacactcagttgttaacacaaagatagacacagaagactcttggagtcccttggactgcaagatcaactaatctatcctaaaggaaatcagtcctgaatattcattggaaagactggtgctgaagctgaaactctaatactgtggccacttgatgcaaagaactgactcatttgaaaagaccctgattctgggaaacattgaaggcaggaggagaaggggatgacaaaggatgagatggttggatggcatcaccgactcgatggacatgagtttgagcaaactccgggagatggtgaaggacagggaagcctggcgtgctgcagtccagggggtcgcaaagagtcagacatgactgagcaactgaactgagatgcttaatgtgttactcactaattcatggatggatgatgtagctatggatgaggagagtggaggagagggtaggtatgctctctaggcagagggaatatagtatatgaaaaaaatggtttaaaattaaaaaaaaaaaaaaaagtgagagagagatacacagagagaagactccccagaccacagcagttctgcggagagattggtttcagatgtgagctcggtgataggattctatttcctccttagccctcttgccctgcttatcccagcacccccctgctctggcctcctgcagccagttcctcatccgtattcttcccaggccatccctccagcccagtaatctgttcctgtcctttaaagaagttaataggacaaaaacaaatcaccgctctccagcaagtcatgcggggttcttggggacctggcagccagctcggagaagggcgtgagagacgtgggcagtgccaggaataccaaatcaagctcccctccctgaaaggagtcaccagcatgtccatgccatccaggaaggcgcaggagcccccttcaggcccctggagctccaaccccccagggccaagtctacgcaggttagattacctggggaaattaaccagaggaaaatcttccccccagggggagtggaagatgcagtggttatgtttgggaggcatgtgaggggtaatggagctgttactccatcagaattcaccaagtcggccccagagacacccgcctcctctcctttatccagctcataatcctgtcttcactctctcctgtgcctggtgtcacaagaca

SEQ ID NO: 56275 - DNA, 1030 bp, Bovine  19866880679447
tcttggataaaaacttgagctcttcctgttcctagctgtgagattctgggccaattatttctctattatgaaactcagttgcatgatctgtaaaatggggataatacctacctccaagggttatcaggatgagaagtaattacatttaagaaagctcctggcatgagtcaaggattaacacatggtaatctcttccactgcaagtatgtgtcagaagtacctagactgtgaatgtcatgcttatcttgagtaccgcctcataattacagagtttctcttttcaaagtgctttcccatcgatgatctcattttaaccagtttttatcgaatactacttgtgacagcagcatggtgtccctttttattcttagacccccccaaaggggatcagtggtgcccccatgatggtaaggtttttaatggatgcaaattttcaaggcatgacacatttattaatccttcattggagtaaactgtaacaaagccagcaggagcaatcattaatttacattaatagctttcagtgttgcataccccagcgcctgacatgaaacagtaatctgaaatcaaactatggttgtgccctacatgagttcatgtatcacagccctttagacccagtgctcatgcatttcaacaagggtaagatgcgtgagtgctacacagtgcacacaggaaaatattcacctccttactatggcctttaaagttctacctcctccagactcatctcagagcactcaactcttcttcagctggatgaatctttctatatattctgcatacactttaggcttatttccacctcagggcctttgcacatgccatagcactgcccgagacattgccccctccccactgctctttgcatgactggatcttttaatcctacaagtctcagaaaaaaaaaaaaaatcttttttttttttttcccagaaaggtctctctttcctgaccacgttatctaaagaggtcctccctagaaacattgctttaccctatttctttgcctcggagcccttttgttgtt

SEQ ID NO: 56276 - DNA, 1395 bp, Bovine  19866880687531
cacaacctcaaaatcttttagggggaacagacagaggccaaaaggtgggaccttggagatccagctttgtacaaaacaccagcgttgactggggaaaaagaaggaagcatttcaaatacacagcacacatatggaccctgcccaggaccgcatgaacatctctgataaaggaatccactcttagccattcatttgtcactaccacagcatcttgccatattctttccatgttcttcttatttccatactatttttttctttaagtcaactcatcttttttaaaactttaatattttcaaaatacatttcactaccataaagagaaagccagtatccgttgctataaagagaagatcatcatgaaaccacataacaacagtcaatacaaaacaacagaaacaaaagcccatgtgccccttgacgtcatcgtgggctcaccactaatacacaggctgactgcacttcgggatctcaccacgaggttaaacatcctggagacattgggcaggagtgaacttggaactgtaaaggcagggaacatctctggtacctggttgacaggtggcgagggggagggggagggcgggtgcacagaaatccacagagatcctaataccaaccacggtcacgtgccctgaagcccccaatccaacgccacaaggtgggccccccaaggcactcagtacgcatccctttctttaccatggggacagtcaaatgataaacttccttcccactttcccagcaccttggggcccaccgtcacatcaagaagtaaagagattagcccatggcccctgccctggtcactgtttctcccgggtttgctctcccaagggacctggcccttctcagaggaaggttcttgtctttcacatcatgtgccagggctgaggctctggccccaggtgtttcctaacagaaattcagtgagtgcctgggaacatttattcccctctcaaacccagttacttctccaatgagatcagttttaagttacaaacacacacacacacacatgcactcccagtgatggatgatggtgaccaagaaggctgaaaaggatgcaaacgcagtttcaaactctaatctgttcaacaaaatgcttctacttactgaggcatgcggactgttgttggcactggagaagcaagctgaatgttcagatgtgtcgtcctggcgaaaacaaagacaggagtaggtgggaaaacgggttgaggaaacaaattctgatttggagtatcccagtttagcacaatcccacagcaagctcgcgcgccctcccattccccctctccagtagggggtctagaccctcactgtccaaaacggcagccgctagccaccacgtatgtatggctagtctcaactgaaatgtgctgcaagtattaatta

SEQ ID NO: 56277 - DNA, 2549 bp, Bovine  19866880710125
atattgctgaagcctggcttgaagaattttgagcattactttactagtgtgtgagatgagtgcaattgtgcagtagtttgagcattctttggcattgcctttctttgggattggaatgaaaactgaccttttccagtcctgtggccactgctaagttttccaaatgtgctgacatattgagtgcagcactttcacagcatcatctctcaggatttggaatagctccactggaattccatcacctccactagctttgttcgtagtgatgctttctaaggcccacttgacttcactttccaggatgtctggctctaggtcagtgatcacaccattgtgattatctgggtcatgaatatcctttttgtacagttcttctgtgtattctacacagcttcaaatggagcctctagaggaccccattgtctgtcggattccagagcttatgccatgtaagcactcacatggggtttgttgaaaaaagaggtttgtttgatagttcatggccaaaatgaagcttattgtcattgggtcaggcattcacatcatactcttcattttcacattacataaagcacttaagacttttgaaaatactctgaaatatgaaattacacttcttttggactatttcaactcatctatagaacaacgtgaagaattataagacagttgctatgtatcttttaacagtaattgttttggtgttacctgacatgcttacctaaaaatcagttcagttcagttcagtcactcaatcgtgtctgactctttgagaccccatgaatcgcagcacgccaggcctccctgtccatcagcaacttccggagcttactcaaactcacatccattgagtcagtgctgccatccagccatctcatcctcagttgtccccttctcctcttgcccccaatccctcccagcatcagagtcttttccaatgagtcaactcttggcatgaagtggccaaagtactggagtttcagctttagcatcattccttccaaagaaatcccagggctgatctcctttagaatggactggttggatttttactataacccacttttcggtaggcatattgatacagtggaaggataggacttaaatctatcaggtttcatgtaaataccagccccgtgcttctccaatatgacattctctttttctttccccataaactgttagtaaaacaacaaattgaactgtgaagatgtcattttcaaatgtatcccccacgtggagctagaattacgtttgcaattaaactatgcacattttccttgcccttctaagtgttaatcagtgattcatgcctttcatagagcagtcatatctcagaaccttctagctgctcatgaaatattaggggagtttagaagcggcctggattccctgaaagagttttcaacttcacagagctccagctctgctcttccaccaccctgtcactgcttatcaaccccaacatgttgaaaagcccaacatccctttgatttaatcagacccttttatgcagaaatgaagccaacagcctctttttcccaacagcgcagcatttcctggaacatgaagatcaatggtgttgatagatcattgatcaagtgttccccataagcccattaaacaggatatgaaactggaattgtgttcagaggtcccatcctgaggtggccaggagccaggaggagcaacaaagccagtttctttgtgcttgtcactttcacagcgcaagggtgcccttggaagggggcaaggaagcttgagaaatgagttttgcaagacacttttgtaacaccccctaactttctagcaaaagtggtcatcccattcttactcataacttctccccaagaactgcatgtcatcttttctctggggacatcacattccacttcactccacaacacatccaccaaagggcatcttatcacagttactgaattcagtcatcccacgatgcgaagagcccactcaatggaaaagaccctgatgttaggaaggactgagggcaggaggagaagggggcgacaggatgagatggttggatggatggattgactcaatggttgtgagtttcaacaaactccaggagatggtgaaggacaaagaagcctgccttgctgtagtccacggagtcgtaaacagtcggacatgactgagcaactgaacaacagcaagaatccactaggtagctaccaacaatgattttcccacatttaacccttgttgaaactgagatacttgcttaaacttctaaagttaccaactagcagagccagaatctaaactcaggtggtgggacacaaatccttaactcttaccacaaaatatatttactgtgcttgttctctaatctgccctgtcctgtagagctacattcagttacttccagtggagactccaaagaaggtaaacatttgtatttctctaatgctgcactcaatacgccagcaaatttggaaaactcagcagtgtccacaggactggaaaaggtcagttttcattccaatcgctaagaaaggcaatgccaaagaatgctcaaactacca

SEQ ID NO: 56278 - DNA, 1090 bp, Bovine  19866880713760
tgtttctgtaatctataatccaatgtgcagagcactctggttcaatgagggaaataattatgtcaatatatggcattctacttcttaaggatgttttcaccccaagagaacaattttagaaacttgaatcaccttgaaccatctttttttcctcaaccctctcttaactacctcctccagaaaaaaaaaaaaaaaaaaagaggaaaaaaaaagtcaaaaacacaaaaaccttgattttcatccttccaggtaacatctcctgtcaaatggattgcctctccctaatcttgtcatttaccttccaaattatgcagaaataaatgagtgcagcaacctttcggctgctagataattttatcagcctcatttatggctttctatagattgcattagctgccatttctcgggagatgaaagataaagtgtgccttatgcaaaatgctccactgaaccatgggagccttggaagccactaacagcattagaaggctgaagggaaaaggtgaggatattcaataatccatcaacagcagggttaacgttgacgactgtcacaggcacctcgagccagaaacctgtgtggcaggtgtgtgctgagccatagttaaaatctgtcttggcaaaacttccaaagcatctccaaacagaacttgagacagagctgtgtaccttctgatcttttctaagcaaatgcacccacttagaaaaagtagttctttgatgacatttctattcactattagaagagttaagtatatttaaaaaaaaaaaaaaatgtcctcacctgtactatggatggaaaacaaaaaaaaaagaccatgtgcttaaaaatgtatgttgtttttgaagggaacattggggtaggggagagaaaattttccctttatacaatacaaaataacaaactgaaagtgttagttgctcagctgtgtccaactctttgagaccccataaactatagccagccaggctcttctgtccatggaattcaccagaagagaacattggagtggatagccactcccttctttaggggatcttctccaagtaatcgaactcgcgtctcctgcattgcagatggattcctcac

SEQ ID NO: 56279 - DNA, 2594 bp, Bovine  19866880747679
agtatcttgttagggtgaatgtgggggtgtgttcagtgctgtacttgtttggaaaagtcatcctgaaaaaattccaaaagccccagttggtcaaaggaacaggatattatattataggatgttcttgatttgttttcttttctatgccaaagtttttttttttttttttttaaagcttctattcctgactatttataaccaggaggcggaaagacaacagtgctctgtacatttgcagcagatattcaaataagataagtacataattagcatggagccacaggtgaggtacactgaaagatttgaattctgcatagggaattaacaaatagttcctgataacaagacatcctaaacatgttgctttcagatgggagtgaatggggagtgtggatacagcccttccagacagttaataagagaatggattgtttatgaacaccagtttcttgtgtgcacagcacgtgacaaataatacgccggactgtgtacgtatataacttagtcctcacagtaaccatctgaggcaggtactgttgttgtccccctttgtagataagggcattgaatctctgatggttaaaagagatggccatgttctcctttctttgtctttctctccccatcattctctctccctccagccctcctctgtctccatctgtcccttctcttcctccctttctgttaacacccatgtatcctctcagtaaatggaaaagctggcatttgaactcaagtctcatctaactccaagccctattctcttagaggtcaattttggggattttagcaaagaggttacttttcgaagtttactttttttatggggatcttagttccctgaccagggattgaatccaggtcatggctgtaaaaaccctgaatcttaaccattggacatccagggaactcccaaggttactttataaaccattctgttttccaccatcctgtataagccccgtctttgtaatactgcccagagtgatcccatctggactttggcgtgccacctacttcagaatgcgaggcaacctacacagcccacgtgcgccagctcccgggggccacacggcaagcctctaagatgagcaccactgtggctgcacctgtggctcggatgggcaagctgagatccattttccaaaatcacatacacagaggtggcactggtatcaggcttctctgagctctgaatttgcactcttaactaaatgctctgctatttggtcttccaaccaaagctaaacagatgatatatgaataggtaggtagatgtgtaaagatatacatatgtgtatacatacgtctctgtctctgtctgtctaaatttagaactcgagatggccctgcctttccccttcttctgagtcatctggccagtccactgcattctggggagcagtgcatttaactccttgctgacattggtattcctctttgtcgcagcccccgtcatagcagcagtgggaataaaacccagagcgtagtgccgggaatataaatgggttatttttctcttcaactctgagtaggataaaactctcataaagaaccagggaacaaaggttctgtgagaaacatacaccaggggacttggctctgtctgatacagcctgagacaaaatggaaatagaaactcaggataaaaaggaattccagggagaatgttaggcttgcttccttgatggatgtccacagtcctgtgcatttagaagcattaatagcagttattgagtatctattccgcaagcaaagctatggtaggttgccctacctatcagcttatgattcaggagttatagatggatatgaactcaagagttgtgacgacagagaatgttgatctctctatgtattggtctacatgtacggttgtgtctatcaaaagcatggagctaatcattacaagtcataaaaatatccaggtgcctatcattggaagtaagacctttttgaataataataattttttaaaaatggatgtgaaagtaaaccttttcttttgagaagtgtactggtaaagtggttgagtggggcttggtcattatcttcctgaatttgaaggttggttccagtgtcacatgactggggctaagtgagtaacttaccttcagtttctttgtccatagacaataggttctttataatctgttcttgttcagtcactaggtcttctgactccttgcgaccccatggactgcagcacacccagtttccctgtcttcgctacctccctgagtttgtttaaacccatgtccgttgagtcagtgatgccatccaaccatctcatcctctgttgcccccttctcttcctgccctcaatctttcccagcagcagggatttttccagtgagttggctctttgcatcaggtagccaaatgttagagcttccgcatctgtccttccaatgaatattcagagttgatttcctttgtaatctgggcaacccttataaacccttgatccatggaatccagtctccttactgagctccagtcaatggggtagagcaatgaacaatattcgagtcgactttgaacatgaaaataagacaaaacaactcacgatttctcctgggggggggggg

SEQ ID NO: 56280 - DNA, 1718 bp, Bovine  19866880769929
aatgattggatgctgtattttctatttggtggtcttggaaacaaatataggacacagtgtttaaaaaaataagccattggcactggttggacctaaaattaggattagggtttttacatataacaagaatggaaaagcaatttgcttactaattgggaggaagaagcttgttgctactctgtactgaatttgggctctcaaattcttctcagtttcagttccgctaaggacatggcccgcttcttcatctgtaaaacagcgataataacatcggatacctggtagtattgaagtgagaattcaatgaactagtagatgtaaaacacttcgaacaatgccaagcacacacggaatgttttaagtgctagctgttactttgggctattattataccactgaatgaagctcactgcaagaacctcctaagacctcttttccttctaacgctttaagttgaccttttgcaaagcatctcttccaacgcaacctgtaagttagcagtttgatatattttggtgctcctctcatgctttgctctggtgttgtacacagacaccctccacacggttttgttgctaggcaatacagaatcagcatccatatcacccatctttcggctgcaagtaacttaaaccccttcttttttttttttaaaaccccttcttattaccttaagacaagaacgtatcttggaaagattcagagctcttttccacaaccaaaggacacagaggtcagtcacagaacccaaagggagacagttcaatcagttactcatgaagaactgaaaacagaaaaagactgtagaaggtcggtcacacagtcttttgaggcctaccttggatctctgctttcatctttgctctgcagatttttttcccttgtgttatggcactcggacaagcacggtcatgctgaatcttatcccaccctgcccacaagactggtgacagtcaatatatctattcatttcagattcctgattggcctgactcttttcaggagtcaccccttgtctaacctactgacctggaggagcatggtcatggcacctcatccacttggagggagatgtaagggtgggttccaggagaagggcttttagaagggcagggacccactgttacaaagtaattgatgagataagaaaccgatatgcccagattgactgttgttgttcagttgccaagtcatgttcgactctttgcaaccccgtggactgcagcatgccaggcttccttttccttcagtgtcttacagagcttgctcaaactcatgtccattgagtcaatgaagccatccaaccacctcatcctctgttgtccagttaccaaactttattttctcctcacactggggctctcaagactgtcttttactccactgttgatatcgtcctacattgtttgatcagataattagactatattgaatttgttcttcataaggtcagagcacagaactagagtcgattggtgtcagtgacatggactcaagtttcaagtcctagggaaggaatttctaaaagtatgcatgaattatagatgaatctccccctctctatatgtagatactaaatatctatatctgtgtgtaatctagatatctgtatctaagaaaatgtgtctgtacagctatcatctatttatctattgaaagagacttgctgtaatctctttcagtagatagataagtagagatagatatagagatcgatt

SEQ ID NO: 56281 - DNA, 2477 bp, Bovine  19866880800952
gagcctggtgggctacagtgcttggaaatacaaagagtcacacatgaccaaacaactgaacacacacacctaattgacatatagccttactttaatttcaggtgtacagcatgatttgatatttgtatgtattgcaaaatgatcaccacgataagtataaagtgtccagatactcactcttcccctccctggcagcttgatgtgggactgtgcatgcatgctaagttgcttcagtcgtgtctgactctttgtgaccccatggattgtagcccgccaggctcctctgtccatgagattctccaggcaaggatactgaagtgagtcatcatgccctcctccaaggtggtggtgatttagttgctaagtcgtgtccgactcttttgacaccatggactgtagcctaccagtctcctctgtccatggattctcccaggaaagaatactggagtgggttgccatttccttccttcttggtgtgggactgtgagcgtgggccaatccagtgcttcctcttggctctggagggagagctcagagcctgttcttgtggcagcactagccaatcagcaccctctgaagagggcagtgtggtgcaaactggtctcttctgtggtcgttctggttgtggtggctggttttattctccagtctccgtggcaagttggttagcaatccagtatccttccctagaactcctttcctgattaaacatatccctgccagtttctatcacttataaccaataaccctaatcaatataggaagtgaagaggtctgtgtgtgccgggggtgggtggagggatgaggatgagggagtcatgtgtttttgacacttgaagtcaaacaagcataaagagagggtcctgtccatggtccagaatggtgacctgggtaatcagtactttcttctaggcatttgaatccctcccccaggaacctgttaaccaccaaagatgggtgaaaacctcagccgatgtgtcttctcttcctccgcacttcctactacttattttgtgtggacatatacatcatggagtttatctacatttgtgttctcagaggaaggtggtgacaaaatgtgcagggtggtggtcattaatatctactttgagtcagtcccctgttccaggacaattaaaatctgcttctcaaaactctctctcttcccatccttatttgcaaacccagctcacgagtaagggtggacagattcctgggaaagagcgatggcttaattaatggtaatgcaaaggatgtaggtgcctcagtgattggggctgtgtgaatgcagaattggatggaaggctgagatgcaaaatgggataattgaactgttagctgaactggaatttagcagttaatcacttttatgaaacctgcatctcaattcattactccatttatgccttgttgcaatacagagctgttcagctaattggtaaacagcagctaagcagtggagcccagaaagggcaaggccatcaaagataccatgatattttctgtgagtgcatatcttcattccgtccagccaggaattgcccgtcagcctgggttcaggtaggcactaatagtgaatagcacacggtagggaagtcatgctcgtacatcccaaacagaactgctgatcatcaattctgttttctgaagtccttttagccaattaatccctggtaatgaactttttagtatggggatgaaggtaatggcttttggcagcagagcattccaaattagagataagactctatatagatttcctgtgtaacactggacaagccaatctcccctctgaacctctgtttcggttgcacctacctcaggcatgctgtggtgaggactccatggggtacttttcataatgagagcaacgtgtctaggatggcgcctggtataacgtgtatgtgttcagtcaatgctagctatcactgttatctatcacctagaaatccttttttgcttctttatttgttttaagaaaaggaagagtcagaaaataatctctctcatatgtgtattgaatcaaagacagaaactgaagggggaattagagtaaatagctgattggtttagcaagagtttatcaacagggacttcaacaaaaaggatgggacttttaagggactgactaggaacaaagtcaagtgtaagggcatgaagcttggcttggaggtatggatacaggacatcatcaataaaccttttgttattctggggggcagtcttactgaaaacaaggccttagtctcctgaagatctgctcattttgtttgatggaggaataaagaggccccatttgaaaaaaaaaaaatcttcattttgacaccaagactgttataccccaatatcctagtgaactttctcttcctatttaatttcaggactctctccctctctctctctctctgtctcctagaatgtagacttgaaaccatgggggctaagttagacacagatataagtgaaggactcaacta

SEQ ID NO: 56282 - DNA, 1903 bp, Bovine  19866880817382
ggtggaacggaaaaatgcaagtacttgtgttttaatacagacattctcatgaaaatgatttcctatcagcactgtgagtgtttgctggttttcgctgtttccttcctttgcctctcctaccctcccaccttctagatctggatgtgctgaagatccagactttgccaacttctcatgcccttcgactatgctattgtttgtgttaattagatctctaaatccatctctatgaatttgtgatgttcttaatgacaccaagctgcattgtccagaaaatactgcgatcagtcttatatgtctacctgtccatccatctgttgcgggaagagggaacccctcccagtgcccaagagtgggctcttgtctaacatccagaagcgagttgtccaaagagaatcatgggctgataaagcaagagactttatgggaaggggcgcctgggcagagggcagcaggggaagggaaaccagaaggactgctgtgccgtgtggcgagctgtcttgggttttatagagatagggttagtttctaggctctctctgtctgatcatcctgactcggggtccttcctggggctgcactcattgctcagccaagacggaggctagcgaggcagattctggaaggtggcaggacgcgtgacgtctccttttgacctttcctgaattcttcctgttggtggtggcttgttagttctgtgttcctaaccaggacctcccgtcttaaaataactcatgcaaacggtgcctggtgcctggccagggcgggcagtttcagtcagtgtgtcccctaacacatccattcatccgtccttaatttttatattaagggcaactgcacagtggggcttaatcacttcacctcagcctgcctatcagtgaaaccggtgcacctctttcagaccttagagctggggaataaagaaaaatgatggccctaaatgaatgtcacgtctttgcaaaagcaaacatcttgtggactgttaattattatgctgcttccacttttaatcctcttcctataaaagtcatcatttgcatatatggggtcaggatttttcagaaacaggggtggaggaggtgaataagtcatcaggggacacggagtgaaagttttaattttctcctggactcaagctgccaactgcaaatcaaggtggctctgaaggaagagacagcccaaaaggagaagaataaatagaggatgctaataaacatccttattcaacagtggcagttataaaaatgaatcagaccttggagtgtttgttgtaaagggatacgtggccagaacagtgagtgtctcttatccaggggactgggataggattatttctatagagaaggcctggctaaaatctctgatattatttgattctttttaatgttctatttactgagcactttaaaacaatttttaaaaaaatgttttaagagaaaaatgagttccttaaaagagaaatattcccaagtcatttttgcttgtggggaggagcgtttgtgtttaaattggttctctgggtaaataaatatatttttgacgtgggattcaaaaatccctgtgtcaaactgtgcatctccaggttttctgtgttatggttcttctttcttctccctactttgtttcacgtttagaagctgaagcagggcctccaccatctgtttctctgtttcagccaaattcaccattcagataatgtagatttcccaacttaagcccacttagagatcacttttcaccacttaaagagcatttagccatgattccaggaatagaaagtgtatcttgagacccgtaatggcttgatgggagaataaagggtcgttttgttatgcagcaagtataaaattataacaacttccccctctgtttacagatgaaggacattttggctctgatatgg

SEQ ID NO: 56283 - DNA, 1154 bp, Bovine  19866880820012
ctgcagaaacatccaacgacatgccaggatcttgactcatgacagtataagagtggagactcagctgtcccgattcagggctgttgcacacccagggctaccccaccttcactggggtaaaatgctgcagcctgatatcaagcacttggaaggccggtctgtcccagatctcagtctccatcagcaccgacagctcggaaagccgatctgtcccagctctcagtctccatcagcaccaaccgcaccacacgcactgctcccatcatctcgatcagctcagcaccatctccagacacagccatggccacggcagcttcctccacacctcctgactccaagctgccctcaccctcgtccatccagctgtagcccaggacctggtaggcaccaagaaaatctctccatggctctgctttcaacaagaaactagaggcaagttccagttctgctcctggatctcaaatcccctactcacttgccccatcaaaatcatctctattctcagcatctcttcacgcagtcctctcttcaactcagtagatatcctaatagaatctcatggacagtgtctttgttcttgcatccgagcctctgcatatagcagccccttccttccagatttctctttgacaattcacactctctacctcctcaaactcagtccgaatttccttgtgtagaaaaatcatcccctaatatcgcactctaaccctgagccatcactcaatcgatcctttgaacaaattcatctatacaggactggcgatctacaacaaggatctgaagaacaagaaaaagcatttcaccacatatgatctctaaggcattgctccatcctgcatacaggatctcagaccaaatgaatgcctacaaagacacgatcacgtcaggacaaatatttttcaagtcctctgggagacctctccccttccatggcaagtaatgaatatccaaggaagaccgagaaataacaacatgagattgactttaagtcacagctatttaggccagaaagaagatgtgggtcggcctgtctgggactcgaaggaaaataacacatcctgccatccttctctgaaagcctctcgcctgccctattcttcaggatgtcaagcaaagaattcgactccactctcaattctccaagcaggcca

SEQ ID NO: 56284 - DNA, 1279 bp, Bovine  19866880861271
attaaaggtttgagaagaaatgtatctgccacaactgacttttgttttagcgaaagaagatggcaaaacacaaaacacagtctttataatcctggctggcaatttcttccctgaggttattgtctatttcagacaaagaaaagaggtgtatgatctcagaaaccttcagctgtgaagaaaacaaaacagagagcaatatattttgtccctgctagtattttctgctaactccttgtttctcagctacccgagtgccatcaacttcagtaactaaattaaaaactataaagctgtgaacgaagaaatcttgcaagtaatgagcccacattgcatgaagtagaggaagaaatatatataaggaacatagtattcaccattcttatccttaaatggaaataaagatgttgcaaacttgcctgatgctgagaagtgaagtacatccagctcattcttagccagatatgtcaattttgtgttacccaacattttgggttaaaagtgcaatttgattttctttactaagggatctgaaataaaaggaattaggaggaaatttggtgaaccaaaacttagtgagacctcaagcccaatgcagggcttcccagatggcactggtggtaaagaatcttcctgccaatacaggagatgcaggttcgatccctgggtcaggaagatcccctgaggaaggaaatggcaacccactccagtattattgtctggaaaattccatggacagaggaacctttcaggttacagtccaggggggtcacaaagagtcagacaagactgagagactgagcacatatgagcacgatgcaacatgaagctagtcagttctgaaatattcagacacctttatttatctaacctgcgatgggccttggcacagattctgtcttccatgttgtgtgtggtttcagatgacccctgaaaactgcctgtggcatcctacacctcggatgattccattttccatctcttgtcatgccagtgttttgcttaccagcagctgtcagatgggtattataatgaatgcgttcatagcaaatgttataaagccgaatataaccagtgttcaggattaagccaacagcacggtgcttacaaagagactggaaatgggcctctcttgtctgcatcaggaaactggcttgaaactgtctcacaggctggtttacaaggacctgtgtttgccaactcagaatgaatctttccctagttgatgcagagatgcctgctacctggctacagggaacttcacagtaattgccatttagcc

SEQ ID NO: 56285 - DNA, 2970 bp, Bovine  19866880875622
ccgggcgcggcaggagttctaggtaagtccgggcggagccaccgcctccgtgtcccccgccccccccaagctgaccagagggtcccacagaggggagagctggctctgcgagcacgggcttcctccctgggccaggctgggcgcgctagactgggaactttctcagtgcgttggagagatttcccggcacgtcttcccgggggtctgagatctggacccctccggcccccgcgtccttccagacggacgcccttgctcgcctcgaagctcctctccggagcgccccggcggccccggccgtcctcctgggagcgagtgcaggtgcagcgagcagcgggaatctgcctgcgcactttgcataggttttctggccggcggcaagcgggcacttggtgcgccccgggcgctgtctcttcaccgcccttcgcgaggtctgggggaggaggcacttggtggcctgggagggcgtttggaagcgccgaatccgttctgggaggtggggaagtagagggtcgctgcgctggagtgagagtgtgtgttcatgggcaccgggagggacgccccaaaatgtctctgccttcgaccctgggtgatggggaggggaagggggcgccagcctgggaattcaggacttggaaactctggctgagccccttggttcctttggtggcatagggcaccttcactctggggaggaaacccaggagcagttcgtgaaggccagggtcgccccttgtcagccccagtttcccaactctccagggttagaggtcaggggagggctgacgagtctctgctcccatctcgctgcttcgcggggagccaggtggtcgagatggtccgggagccttcaaggtcttagctcccagaggccaggccagcccggaagttgcccacgcggaaagggcggggaagacccgacccgccctggccgcggagccctgaccgcggagcgagccgccaactccattcactgcctctaggaaacagggggcttctgctttctgcttctgcccgggcaagggccaagaaggtgcttctgcgggactctgggactcggggcttgtggggcggggttgctcaagtgcttgtaaatccgagcctggcagtccagagaactgaactggtaccctacccggggtcttagttgaacttggaaaagaagtagtggaggtgtcctggaatcgctttgtttgagccgaaatgtgatgcacgtgagtggagtgttctcttataataatactgattgtacatacgtttattattaaaaagaaaaacaacaaacccacaaaaagcctggccttctcagtcaagcttaagacacgccccagccggtgatggctccctgcccctgtcctagttcatccaccctccgtttcacatttatctttgttacaaagggaaaaataaaagagatgtgagggcctggatcctttcaatttttaagtgaccacagagggcctggctggagccatgggcagttttatttttggctaggtctttttttgtcacaggcaaggacctaggcccacgaagggtaaaggtggctctgacggggacttcaaggcaaactttgggactgactccaggccttgctctctcagctcatctggaaagcgctaggatctaaaggaatccactgggtttcccttatgttaactcatgactgagttggattaggaagaggctggcctcatccttcacaattttcgagggcaccattagcatccagagataaggcttgagaggagtgccaggccctggttctgacacctgcttgctgtgtgaccttgggcaaatggcttcacctctctgtgttttagtttattcacctgccagatgaaagtctcagtggtggtggtggcctccgagggtctaggggagaattaaagaaagcgataagcacggagcagggtctggcacacgggcaggtgcctagacaacgtcaatcttccttatttttatcaaatagatggctctctgttgtgagtcttatgacacctggtgggatatagaaggctggcagcctcccttacatacatgtacttcctcttaaacaacagctccaatggaagcagaaaaggaggttaatcataaagggagatttctcgacagaacctcattctctccaagcctgacctctcctcatgttctaaggaggaatcagcgacatgccgcccactggctaagagggggggttgggagcatctgacaacatctcaacaggcacctaaaccctgaaattaagttttttttcttcaatcagcagaaaagcccgcttctcctcggcctcctgggatgaaagtgccatcctgtgaaagttcctttcctaagcacgcgctgtctttaacgtcaccccacggtcccagagttttccactcagaaacgagccaaaacgtgggtctgagcagatttctcctcctggaattcacccactctgccctatttttctcttcatgataattgatgctatttttttacctacttctctaatggctgaggataggcctcttcgacatccttatgtctctgatgacttttttttttttttaaagcaaatttagccttttcagaacaagccataccaaatcattttattttataaaattcctttcagatgagtttttttttttctttttgcatttagaaaattggttctgccctgtatacatatgtctgacatttcacctttcccaaaattagaccattttgtttgcatcctttaagctgtggtgtggagtaatgaacacattccaagagggaaatcggacctgacatagaaaatactttggggaggcagtggatttccagtggcgtgtgtgaagactgttgaagtccgagtacatttgctctgaaggacacagggcagctcatctcgcttttcccacccagcatgggagccacgcagtaagcacactccacagatgaataccagatacttcccaaaaggggtcactgtcacatttcctt

SEQ ID NO: 56286 - DNA, 2620 bp, Bovine  19866880915881
tccctttccttgctctcccagcaggttgcttcttcagccaggctggttttctaggctgcagaaacagaaggaaaggattaagagcacacaggctgcagcttttgggggagagatgcctggaaatagttgtaatatatctgagggaagtgggagtggtgggggcgctggtaaaataagtcctgtttgggggtgtgccttccatgagggttttcatgagacaaaaagaagaaactgagttgattttgaaagcattctctgctttcttgagccccctccccattgctgatcttgaaccatctgaggcctgatggtagggttacactacagtgaattattgttgttcagtcgctcagtcatgtctttgcaaccccagggagtgcagcgtgccaggcttccctgccttcactatctcctagagtttgttcaaactcatctccatcgagttgatgatgccatccaaccacttcttcctctatcaccgccttctcctcctaccctcaatctttcccagcgtcagagtcttttccaacgaagattatcaaactgactctgaaatgacctttcatggttaattttaatatctccaacttacagaggcttccccggtggctcagacagtaaagaatccacctgcaaagcaggagactcaggttcgatccctggatcaggaagatccctggaggagggaatggcaacccactccagtattcttctctgggaaatcccacagacaaaggagtctggcgggctaccatccatggggtcacaaagagttggacatgaccgggcggctaacccttttcactttcgccaaggcgctagctcaggacctcacggtcagcaggcagacctgcatctagatgtctctggtctgactgtgtcactctcctgaccactgaggagctgcagctccaagtcagagagcagagcagtgagctggagactgcagcgtgtggaaagagctaaagaatgatcatcattgcagctccgtgctggaaaatggcaattagcttctagtttgtttgggttaatatctctggggacctttgtgaaatattatttattgataaggaatgtgcagaacagcccaacaggagttgggagttctacgctcagtgcccttggaggagcatctaaatgacgtgaacctctctcctcctctcaaaggtgatgctctttggtttgggaaattattatgtagtttctgagttttcttttttttgttgttctggtaacttctatggggaagtgtgctctgagagataagtgtgccttaggacctggatgaaaagtgaaagtgttagctttctctgactctttgcaaccccatagactgtagccccccagactcctctgtccacgggcttgtccaggcaagaatactggactggcttgacatgccctcctccaggggatcttcccgactcagggattgaatgtgggtctccctcattgtaggcagattattgtctgagccaccagggaaacccttaaagtcctgccggtaatcaacactgttgctttgggtaaataaggctcttagcctcttggagccctagttcccatctcagggcaggtttgggaaatttgatatgatgtgtgtcaaactccagcatctgagatgtggaagacatttaaaagcaacaatcattattgtcataacctttaaaatttgaacacatgtcaacatgaattgccaaccatattcctgctggcatgaatcaagtgaagagtaaaaattactgagattcaaaaaaaaaaaaaaaaaaggaaaataaattgcccacaaagtatatattctgcacagtaagagtttagtgttgagcttaaatacacagagagatgaactgtagaaatcctccacccagttgcaatctttaggaatgggatcaggttgaatttaccttgacacaaaacattaaaaacccttttttttttttttaaaaaaaaaaagagagatacaaggagaataacttccttcttcaaagaacaaagagtttcgtgttctttagaaggctctgtttatatgaaaaggaggcagctgcaacatggtttgtgacagagggggaaaaaaagaggttaacattgcttaggcaactctcttcgacaaaagctacttctgtaattgactcaaattttatctattcattaaagtgagatcactaatgggtaaccctttcgtcaccattgctaagtaccatgtgccatgaaaacggagaagcctgaattcctttgaacagcaacccctaccttgaagctttacaaatgaccttcctgcaattagtgtaaatcaccgagctctccctgcacatgcctgtgtgtgtgtgtatgtgtgagggggatggttcactgtcatttctctagaagttcaatgaggaattaaaactcactgtcaggaggcactgtggagactagagtgagcagcagatgtctgctggcctgcgtcagggtgaggacacggctgttccgtcaggggctctgggcttgagctgcgttcccctttctcctgcccccaaccagtctcagaaccatgaggaccgacctgcctaaactgaaatggatacagagcatgccatgcccgcaacgctgacccagagacttcctgtcccctgggttcctt

SEQ ID NO: 56287 - DNA, 1382 bp, Bovine  19866880948358
taatccatctccccagcattttgtctggcacagattcagaaaatataatatgatcagacagatgtggctctaatcccaggcttatcgcttaccggctgtgtgactcctttcatcctttcatctctctgcgcctgtttccccatctgtgaaatgggagtgaactgagattccatctcatctgttaggagctttcaggggggagaatgcctgcaaacccctcagcatgatgccagggactgagttagcactcagcacatctcaatgctcagtgtcgttaggtatacagtagcatgtgatactcagtcctgtccaactctgtgcgaccccatggactgtagcctgccagcctcctctgtccatgggattctccaggcaaaaatactggggtgggttgtcatgccatcctccaggagatcttcccaaaccagggatcgaacctgagtctcttgtgtctcctgcattggcaggcgggctctttaccactagtgccacctgggaagcccaggtatacagtaggtgctatgccaatgtcagccatcccacctgctctctcaagattccatcacaggggcttcagacattgcaaagccgggcttctaagagaccatggtgtctccgaaagaggtggtaacagaggtcaggggtgcgaggtggagccattggcactgattccttccagctgatggtgacctgcgtgcaggaagggggatgcccttggttcaccattcttcatgttctttccccaaaactagagccttccatgccaagccgtctttcctgagcaacactttaatttacatcttttaataactttggttgccatggaagcattggaattcagttttaaaatagataaactaattgtttcagtcagtttgggtatttgctgtcaaggaaacagcccgcttttccccaccaccaagagcccacctaattgcatatgcgaggtggcaaacgaggggtattgactgccccacagccaggcagaggaggcaccatcacacacccaaggaatttcagccaggcagaggaggcaccatcacacacccaaggaatttcaaccagtcctgctcatgagcttgagaaagggacagtctggactaatgctggaggctggggaaggtagtggggtgaggcttccaagggccatggacacagctcctgaggcagcgccagaacagagtgcagggctcaggacattccggcagccagacacagttcctgaccttggatggaggtccaaaggccctccaccctgatctgagggattctgagaaccatagcagtaatagcagcaacaaagcacaggagcccagggccagagcctacttcccaatgagacaacaaatgttcctctaacaacaggcattcgcttacctcct

SEQ ID NO: 56288 - DNA, 1456 bp, Bovine  19866881061798
attttggccaaatggtgcattaggagttcaagagcagaatcaaacgagagcactttccaagcaggggtgatagcagttggagctggagctcagagaatgagagggtcacgagaggaggaagaggatgaacaagggagctgggggacagaccgtgggcaaggccttattgacccgagtagggcacatggacttgacccagaaaagggagaggcacccagaggtgggagccatgtgagctttaggaaagggagcgaggatgctctgatgtagacgaataagtgtagttgaaagaaaaatcgaaacactcatttggggtttgtgcatgagacagggattacatttaagcagcagttgttgagaacagaaggtggcttctaattgcagttgttcggcatcaaatccacattcaaacttgcaattatttcaccgttaaaagagctgatggttccctcttgtgccggaggcagtcccaagggagctctaatcccagggacttggctttctcccggccccctgagccccagaccacactcccacaaagctgttctcattggctggtcacgcagacagattcacgtggcccatgaggtagaggggggctgaggaagggaaagggccatcttagcaaggactctggatgcattcagagcagccgagtgaaagggagtgatgacacagcttgggattgaaatcagtgtctcctcttctgcaggactttaactggagccacagaaagcatcaacgttaccacgcatcaaggttttgatgtgctattggggtccccattcccttaaagatgggaaaatcaagacagacaggttacataaccttccatggtcacatatggaagagagagcagagctagggtttgaacccaggcatgtcagggcctgaagcacatcgtcttaacttcagtgtccctgatggggctgggagctttctaggagaggcagctgccagttaagccccaagtgcctaccgagtgttgcaaaggaaagaagagtgagagctgtagtcagacagactgtccctcatcagcttagtgcgaatgcagccaagcaaacccctgggcaacttgcttaccttctctgagtcttgtttttgttgttgtccagttgcgaccccatgcactgcagcaccccaggcttccctgtccttcactatctcccggaacgtgctcaaattcatgtccattgagttggtgatgccatccaaccatctcctcctctgcttcccctttctcctcctgccatcagtctttcccagcatcaaggtcttttccagtgagttggctcttcacatcaggtggccaaagtattggaacttcagcttcagcatcagtctttccaatgaatattcagagttgatttcttttagcatggactgctttgatctccttgcagtccaagggactctcaagagtcttctccaacaccacagttcaaaagcatcaagt

SEQ ID NO: 56289 - DNA, 2260 bp, Bovine  19866881063290
tacgaagaccccatttccaaataaggtcacttccacaggtaccaggggttaggacttcaacacaccattgttgggagggcgggtggatacgactcaatgcacaggaaatgccgccttcatatccagaaaacagagcaggtgggtctctgccacctccagcctcttggaaaattgcccattcagcccgatgtccaccaacatctggttcattcgttcaccccatgcttactgaacacccacacatgctccccacggcagagaaaccggagggaacaaaggcgagaaaacctctgttctcgtggagctcacatgttgctgagggaagaaagacagatgatcgacaccaacaaataaggagatgatttccagtcatggcaaagcattccaaaaataagagcagcaattgtagcaggacaataacctccacgccaggcattgttctaaacacttgacgtgaacatgtgcccttcgtcctcaccacaagcccgtgaagtagcttctgttcaattccatttttaaaggtggggaaaccgaggcacagaaaggttgcacacaacttatagcagaacctggattcgaacccaggttgtactgagccccagggaccccctgtgaggaaaacaaaatgctgggggcaagaataggactctagatctggtggtctctggaaggggacttttgagtcaaggcttgagcgaacagtagggcagatgcctgatagtagcagatgaaagagggactataaaggggggtgtgaagatggcaaaagaagggttcacgcccattctgaatgggatgacgtcctcccaaacaggacagcttctgaagcatccatcggccacatccgatagaatcaagattggtaggggctcagatggtgaagaatctccctgcaatacaggagacctgtgttcagtccttgggtcaggaagatacctggagaagggaatggcaacccactccagaattcttgcctggagaatcccatggacagaggagcccggtgggctacagtccaaggcgggggtcccaaagagtcagacacgactgagcagctaacactttctttacagcacattaaggaagggtttcttagagagcaggtgctgcctcccccagggacactgtgatcactgggttcccttctcactgactcatctccgtcctaaagcctaccttcccaggcttggctcaggccagccccactgccaggggtgattaataggtttaatttatctttacattccgtggagctgagctaggccgacgacgcctctggaatggtgtgtgagtaatcagtgggcaagcagaagcctctgcatccttatttatattcatgttactctggggacatttctaatttgtttgtttttctctgatctggcttcacccacccagacttggatgactgggaagagaccagagaagggaaggtccaggagaccaggagacaaaggaagagaggctgagtccatgaggacagaggacagaggcaggaagcgactggacgagggcctgtcaaccctccatctctgtgcccaccagctgctggcactgtattcatccacacatggtctcagccagtcgttggtacaggggcccagctgaacaccgggaggggctgacaagaggactttggggtcctgccttcacagggctcccagcaggcagaagagatgcacatgttgaggatgtcaaagcccagccggcccaccgatgggttcaaggcagcacaggctcaaagtcaagggcagggctcctcattctcattactggtaggggtttctggatccaggaccctcagagccagcctgaaatctgggcaatgtcatctctcctcccaggaccggaatgcacccagctcagggaatcgtgaccaggcagagccgggagagagggtaagagaaggtctccagcacagggagggtgaggctgcgcctgggtttgctggctgatgcgtcctggctgcgcgaggcttcggcccctcctaacacacccccacaggggatccccaaccagccctgcaaaagccacaggcttccaaagtgtgctgggcggggtttccttcgctctcacccctcctgtgagacagatgtctgtcatgcagtcagggctgacaaggagacagaaaccttctcagcaaagtgagaggcaggagcccacacagacgaggtggctctcagcgcagagcctggggtctgtctgtgctcagactggtccccagagctaggcctcgatgagggcaagcaaggcagcagaa

SEQ ID NO: 56290 - DNA, 1223 bp, Bovine  19866881088401
ctggagtggggtgccattgccttctcctatatatatgcgttaatatacaatacttgtttttctctttctgacttccttcactctatataacaggctctaggttcatccaccatcactagagctgactcaaccacaagaatgaccatgtaaaattacttgtatttcaaaggcagtgtgagaggaagcaggacactgctgtgctattacactgtatatgctgtagcgccatctacaagattgtatgttgtgcaaaacaagaagaactgaacaaaacaaagaggtgacccatgtctatgagaaaacattaattgtacgatatgattccagcacattctagtgtacattttggtcttgttttctttctcctcattgttggtaagaggctgtgaactgtactgtttccagctagttacccatgttggagaagaaatttttttaaaaagtatgagaagaaagcaggagagaaagagcatttgtgaattacagttgtccaaaaaaataaataaataaatagcctagctggtcttatttgtgaagcataattgcctttatcatatggaagtattctttcacattttctttgtataaaatttttgttaaacttaaatgtcttttttgataatggtgtgactaagccagtggactcacatggtatgctctttcggagtcctccttaactttttcagattcttaaccctttttaaattaaactgttttggaaaaatgaaaaaaataaaataactgtattttaagacccttgggcacagtgtctatgtctgagatcaggtatgtgctagttaatgcaccaaaaagtctggaataaatactccacaccatcaagggggagggggtaaggggcaccctcaggaaagggtgaggtgaggagaaaagagaatatatacctttcttctatgaacttctctgctcttttcatttgtttcacccacaagtaagtgttacttttgtgattctattttaagtggatggtgggaaggatggtggggagagaatcaggagcccaggatatggatcagattcaagagaagagagaaaaggtctgcacacctgagtgcccagaaaaatctcctggtctgagcacagaaatgagacttgtcaagcaccatcctcaaccctgccaggcatgaaatgcaagcagagtaatgacagtgactagcctggggacccaccagctgaaatttaataagcgagtaaccaactccatt

SEQ ID NO: 56291 - DNA, 1220 bp, Bovine  19866881100535
attacctaacacgtttccacaggagtatcactgggggagtttgctgatttaatgttcctaaaaggtgtagcaaaggatgctaccaaaatgtaaattctcccaaaacttaagcctttaaattccactgcacaggggctgtcataaagtaatattttgtgagctacagattccaataaaactcactctgagatgatgaaggctttcttggtagcctaagggctggtgtatgaataatctgccagcattatgctgtgtcacttaaatattcctttggagatttgtcagaagaaaatttaagtaaaattaaagttcaaatggaaatgaaaaattaagttatgatcaaagctataatctcatattggattttttaaaagctgtagagaaaagtcccgttaaagatttcctggtttgtatttatggatccaaacagaggtattcccactgtgccctgcttaaaaggctgatgtgcagagtctgggcctccccctttatttagatgctgaacctgctgcggggggaaacagcatctcagtttctacaggcaatccaattttaatcatttttgctttattggaattttcataggagtccaggtacaagaggttcagaattaatctaagtcataaacaaagcagaaatggaaaggaatagagtgaatggtaacacctaataagtcatggttcttttctcctaaaataagcaccatggtgtgggatagaggaggggaccaaagcactgtttgcattcgaaccccttcaagtcagaggggttttatataaacttcatgtctgaagtttatgtaaaacactggcatctgtgactcccacaaacagcttttcactaaagtttcagaatattccctgacacttttcaaactgagggaagcagctgtgatggaaagggatggtgacagcaagcagaagtctggaatcccctggaaagagacccagcttgacatgggactgaaatgcacactcccaaagaaagcattaaccgcagactgagccctgtgtggaccgtccacatagaatccactgccagtgtgactcatgggctagagcctgacagaaaatcccagagagaacaagagtcatatccagtgtgccctgtgctgtgcggatccatcaacaccacgatgatcacattaacgaaactagtgaattacctctctagtctagaccaacagcctctctgagcataagcttagggcaggacttttc

SEQ ID NO: 56292 - DNA, 2271 bp, Bovine  19866881118386
aacatggaaaggcattatggggtagcagcactgacatcaataaattttggttcaaatgccagctccactgctgagttctcagtcaagacacttcagcttctgagcttctgtttcttcctccacgacataaggtttttgacaactctcggagttgttaagagagtcatcatgagcatacataaagtacccacatgactgttaacacatagatggttattaaaaagtagtgattattatttgtgtgtggagggcagcaaagagatccaattgtaaaagagctgggctagagactgtgttattcctagaggtagaaagtacacttttgttgtctttggccagctgtggcctggaccaaggtctggactctatgaagtgtttaataaaagtcaacaaatagataaatgaaaaatgaaataattgatgcatatacaaagccttagaaagatctcaaataaccataaaagccatcatcaatatcctcaaagtaaatgtatctggcgaggtatttagtgtctgattaaagaatcctcacagcagtcggaagacttaaaacctgcaacatagtacaaataagaaaaaaaagtaaagcaatcatttttgcttatattcataaacccatgtgactgacttacaaatagagaataagcagaaagagacgcgtacgcctacagaaccaatgtatggttggcagtgggaaggtcagggggaagggatagttatggagttcggaatggacaggtacccattgctatagttaaaatggataaccagccaggacctactatagagttcagtgaactctgctcaacattatctggcagcctggataggaagggggtttgggaagaatggatacatgtatacgtacggctgagaccctttgctgttcacccgaaactatcacaacatggtttattaatcagctatacctcaacacaaaataaaaaggttaaaaataaacaaaagccagctgtttaaaaaaagagagaggggaaaatatgcatcgttcatccaatcattcatttatctgtcagttcattcacaggcattagcttctgttctgattcggcaatgttatgcaccctagggactcacagatgaagacacagttgctgccagggaaccctcaaacaagggcatgaagaagacatatgaatgactaactttgatctaatataatacatatcattctgtcagaggtattaaaggctccagatctcctgaaaaatgagcattcactttaaagaaggagactggaatacaccaagacaggctgaggaaaaaaagtaactcatgaaggaggaaacagcatagcacaggcataaagtcatgaagataccctgttgtctttgggaaggacagtgaattgtctgatctctctggaacaggcaaacttgaggagagtaggggcgccgaaacgtgaagacggggttgaccagatatccacaggccttgactaccaagctaaaacaaagagagttcactctgcagaagctgacaggccaccaaaatgtttgataaagagtgtgacataaccaaatgggagtcttagtgaaataactgaaaggagagccgagagcaggttagaaaggatgatggcaagacagatattattcattttatattgaaaagtcaattgccaaagatattagtaaggatgagtacatatatggacacactggaaactgaaagagagaagtctacataagtcagggctctaagggacaaagcggaagaaaacccaacccaaagtgcatcaagagggttgggaagaaggcgttactgtcctatgtaataactgaaacacacgtgtctgtatgatttcttccagattttctcgacatccctgtaccatcctcatcatcatttatataaccattcccttgtaaggcagttagattatgtccagtttggggaacgggcagcatctctcatcacggtgccatctcccatcctcacaatttctaaatcagacaaatcaaggtgatttgtccagaaaattctgaatcatgtttcagtggtctgtctagaccaggtactcatccctgagtcatttttgaggccaatgtgtgggatgccctgatgggtcaggtctggattatgtgccatttgaatttgaggtgggttatacatgttctttgaaacgtatacaattatgactcttttcacattgatcaaacattcaaactgcagtacagtgattaaagatgaataaagttgaaactaaaaggagacctgggtcccaaagaagggccatgtgtttattatctg

SEQ ID NO: 56293 - DNA, 1176 bp, Bovine  19866881124204
atatatttcattaaatcatatagaaatataagctatatatgtatggtttatattcttaaaagcattactgtactttatgtactaagtactatgtactgataattatgcacatgtataacataataaatatacaaataaagatgcacatataagaacttttatatgactagaactttcatgaaaaaatacataagaagccaaaaatggttgctgaaggtgacctggccacctggaaagagaccttaaattttattctatgtttgaaattcttattttttttaaatgttcatctgttttatgggttcagtttttagaaacatgctcttcatatcactctactgtgtttgtttcattcttttaagtatcgacatttatttatttggctgtgctaggtcttaattgtggcatgtgggatctttagctgcagcccgcaaactcttagctgtggcatgcgggatccagttccctgaccagggattgaacctggaccccctgcattgggagtgcagagtcgtagccactggaccaccagggaaatccttgaaattcttatctttgcaaccatgtgcaaaatatcattccatgcctttttcctaaacgtgattttcactgacctttcccaatgcatctgctgttgtttatcctatcagtgaaaacgcccagcagaatttccattcctaatggtgtttgtgtgggaatggaccagcttttttcagaccaccatatttacatgcaagggccactttggtggaaacgatgctagctgattaagagggtttgtgcaaaagtacccactgtgattgaaacactcatttaatacattttaagtgcccgaaatgctcagcttccttgattggtgttgattgtttgcatttgatttatttcctccgtatcagtgttcattaagttacttaagtaatggccaccctgtagctgtgtctctatttaactccacatctttgggagcattctaattcagagactgttcacttcaggagctgggaatgtagatttgacctctgaagggttgtgtattcctcatagaaattatttacaagaaaaattatctttcaaaaaaaattcacagcagtctcctctgatttttttttctatttatagcttctattcttggcagaagtcttattatttttgacaatttattaactaccacagaca

SEQ ID NO: 56294 - DNA, 1477 bp, Bovine  19866881130242
cgcctcctgtcctcccccggccccgtctggtggggagacaccctcgacctgtccctgctctgctcccttggggtgttgggggccggtgaaatccagggtgacatccagggctttcagggggccaaggctgctgggaggaaggcttctgggctttgagttggggactcggattcatccctgccagaagttagagcgcgaggcaatttagcaaattgtagcttgctgcagatgtctaattagtcctgaggctgggtggaggggagtggtgactgaagtctgcggagtgggagggccactccgtctgctgccgaggttgcctcggctgagggggccgtgggctccccagctgagggtggggctggtcgaggagagccagacacccgcccccagagagctgggctccggggaaggggctcagggggcagggctctggggtgtgggggcccaggtggaccatgcagggggagctgatgagtccagtcggggggacagggagctgctgacaccctatgtccagacagccgggagcactgagtgagttttccactgctcacgtccaggaccctggcctcaacctgccccaaactgagtttccatcctgatcccttccttgcttctcctcctctgtgctccccaagtcacaggatggaaccatgacccttcctgctacttaggacatgtcctccttatttcctatttcttcagcctccatgtctggttcatcatcagagctcccactgtactttctgaacacaaacccaactcttcatctctcagtgccaggactctgccttggcactgttgacatttttgggtgggtgatcttctgcagggggtgcctgagcactataggatatttagctgcatccctgaccctcacccactgtaagccagccccacctacctgctgtgacaacctgaaacgtttcccatcgttgccaagtgtctaggagcacaaactcccctggtttgaaaacgcattctacagcagcccaggccacctcttgctccccaaagatctttctctccaagctccagcttcctgccttgtctcccatctccaacctggcttccctcaatgcatcctccacactgaagccaaagggatacgcccctaatagaagctggatcatgagatactttacacctttgaccctccagtggccctgggcacctgcagaaggatctgtattccctaatgtgatttggaggcatctcagtataaggctttccaggtgacacagtggtaaagaatctgcctgctaatagaggagacacaagagatgtgggtttgatccctggatcagaaaaatcccccagagaaggaaacagcaacccactccagtatacttgcctggaaaattccatggacaggaggacccttggcagtttacagtccatgggcttccaaagtcagacatgactgagtaactgagcagacacagtataaggacccagcctacacttctggtcttag

SEQ ID NO: 56295 - DNA, 1979 bp, Bovine  19866881170845
tagatttgaggagtattgcacatttctctctggagacatctggttgaagttgaaaggaatgcttcagtaaaacctgggaaatctggtaattgtacgagggttgcatttctctaattgtggctcatgagaccatctgtatcagaaccatctgaagcatttgttagaaatccagagatctgggcttgattttagatgtataagaatctctggggctaatgtcatggattctgaaaattttagtctcgctgctaaaatgctctgtggaccagcagcatccgtatggcctggatagaatgcagaacttgttagaatgcagaactgcaaaccgatcctgctcctactgactctgaatctgtatttttaacaagatccctaggtgatccctaggtgacacatatacttcagatgagaagcagtgactctgagaatgacacatctcattttacttaggtatttatgtatttttatatcttgctctaattatgtattttgtttgaaaggctatttgaataaagagttcttttttagttgaaatcataattgaagagatagacttgatgacctctctcttgtttactctgtggcaagtattattgttcagatcaggaaccttttgaaaaacaccactgttctattgccttcagtgtatactgactttattcagattacctaaagaaaatagtctctcaggggttggctttattccaaatttacggacataatgataactcttaggtatagaatgtggaatgtctgtcaagagtaattgactctatatagcttaattccacttccccttccataccatctgtgaaatgcttgtagtcatctcaacttaataacttgtatattgattttactgaatataaccaccttacatctcagtcaaggaaaacaatgaaagaacagattttgagtggacaaaaagaccacctaacacttctgccggtattttataaatgttggttttctatcaaagagagccaaaactgtcagtttaaaatactagcttcatgagtttttgagtaagtaggccacagttacgtctatggggtcgcacagagtcggacacgactgaagtgacttagcagcagcagcagcagcagcaggccacagttatgctttatttctttgtaggttctttgatttgatacttgaccatccatgttaatcgatgataaggcagggtcccagaagactcggtgacccattccaggaaacataatccagcagctgaaaattactttcagggtcgttcataaggattaggggatatggcacttggtggtcacccatggctgagaataatgcctgtttctaccagtcagagtagaaaacctctgaattcatgagacattgagtgaagtactcagaagtttcctgtcttagcagtgggactagtcagccctaaattaaacatggctttggtctcatctaacaaaccttaaaaataagacttaaagggatcaaacaatttccaagtaacttaactgtattgcagaacaaagctcaagaatacaaagatgttcagcccaactgaattatatataagaatcttaaaaatacaatgtaaaatgaggggggaaatcaatcaactgaaaccagtacagaacttatacagatgttagaagtagcagataaggacaagtttaaaaagtttaacgagaaacatggaagacatataagagaccaaaataaaaactccagagatagaaacctataatctccaagacataatgcgctgaatgtcatcaataacagatttgacattgcacccacacccacagacacaagatcactgaccataataaagtagtaatagaaattatccaaaatgaaacagaaaaaagaataatcatggggggaaaaagtgagcatagaacctgtgatctctgggacaacttcaagcaatttaatatatctgtaattggaatctctaaaggaatgagagggatggagagataggaaagacatatttg

SEQ ID NO: 56296 - DNA, 2567 bp, Bovine  19866881251355
tgtgtcctggttggttcctattttagaaccttatagctttttggtgaaggtgaaaagtcatggtataaattgtgggaggcaattagcaatgttacctggtgcacaaataacccttcatatatgctagtcattgtagttatttttgttagggttcttgggcgctccttctgatgtacaggaggaaagatcagggtgtcaactaaaaccagttcatagtctctaaactgaatggattcatcagatcttgagccttccagaaacacctcaacccttggaaagtaagtaaaggtccctgagaaaggtgagcagtcaaaaacattctctttctactgcttatatcagaaaaaaattggtttctgttactctgagcttttgaggatgagttagaagaatctcaccacttgtacattgcgatgaggttaatgaaaaagagtaactaaagggaaagaaaaagtccgttgggtcttaattagtatctgactatatgccaggcactctacaagacattttatataacttatttaattgcacccttacaagagccctgtgcagtgactactagtatttttcctattttacagatgagcaaaccaaggttcaagtttcttaattaagcaagttacagagttcataggaaagggatcaagaatctcatccatgactctcagaccccaaagtcagctgaagtgacaagcttaaactggaagttacctcctgtttctcagagacatagactgggcctcccaactcccgtgagaaaaacccagtctctcctcttctccttctccctcctgcccgcctgcccctgccacagctcaaacaacctcgtcaactctctgtttcaagatgttgtgagggccctgtgatcacagagcccattcccacaccataaattatttcctacagttttgacaccatttatttccatagcattatacactccaaccttctgactacttaagatcaaaaggtatgctccgggctcacatctcactcagctctcagactcgatgcaccaaattagacccaacagcagaggctccaacctgccagggtctgtaatgttacatcactccgatagtttagcccatctttatcaatggcaaaggagaaacgaactgatccacgggggtggggcttccatggaggaggcttaaagatgtgacagttgaaggggagtgttggggatgttcagaatcagcctgggtggtaggaattcaactggctgtggaaaccgaggccaaaggcaaagctttgtaacaggccagagaaggaaaagctccatatggggaactgtgagctgcccctgagagaatcatagaaacactagtgaacaagagggaagagggattgtggctggaatcagcccgggctcagaggttctggaaacctgtggaccacatactcattagcagatggatctgtttggaggagcatgcactgatgcagaaagcggaaagggcatctatttttacatcactatttttttgagagcctgatggctcaggtagtaaagaatccacctgcaatgcaggagaccctggttcgatccctggatcagagagatcccttggaggagggcatggcaacccactctggttttcttgcctggggaatcccatagccagaggagcctggagggctgcagtccttggggttggaaagagtcagacacgactgaagtgacttagcacgcacacatgtaaaatgaataagacacatctcctgctctcatagagccccaaacctaaaaagatacacagatggatgaacagatgctttttattcaagttctgaaatagaggaggattcaagggagagaatgaacatctagaggggggtgatcaagtcatcctcctctcccacccacccctgtgacctagcattgaggtcagtaagaggcactgggggtcgtagccctggataccatggtgcatggcttattttaatcatctggaccaagtttggcaaacagcagagagactgccttgggtttactgtgcatataggtgagggatggacaggagaattgggaaatcccccagacatgtggattggcacctgactgtaggggcatgcaggaaagaagacccttgatgacggtggtggtggccgtgagaacagccagcatttattggatgtcctctgcctgccaagcacagtgctgagaattttacatggattacctcatttcttctttccagcagacttgtgtggataagtattcacgtaaataaccttcatttaatgggtgagaaaaccaaggctcggaagagttgatgggatccattcatggcctcacggctagcaggcagagttagtgtttgattctaggcaatttgcctttggcaccagcagcccagctaagatgggggaagcaggcttgaacacccccttgggttacagtctgattgctcagcacaaacctctcatgacaaatgatgttagcgcacactggagaaacttcatgactgagcctgcttctcagcactaatgtagcttgacttgaggctgatattccacttatctccccagaatgacaattaggaggagaaaaaaaagaaaga

SEQ ID NO: 56297 - DNA, 1915 bp, Bovine  19866881277393
ggacaatcagttttatttaaaaatctctacaaattctgcagcaaatataggatgatgagatataaaatagagatgtactgaagccagaaggtaggtacaggaagttcattatattgttctctaatctttaaaagaaaagatggtgatcaaccttttaagaataagcaaatgagtttacatacgtattttcaaagattcaatttatgtgtatattctctaattttctgctaggatttcctactttctagatttctctgtggagaaggaaatggcaacccactccagtgttcttgcctggagaatcccagggacgggggagcctggcgggctgccgtctatggagtcacacagaaacggacacgactgatgtgacttagcagcagcagatttctctgactttatccaaacttaaaatcatgtttaacatttccctctaacctcatatttcctacaactgtcaattaggtttaaaagcttcattagatttacatgcaatttattttctttttaatgttagcacatcatgggtgggactgggtattatatattgcatagatatgtctaatttccccacttttagtgattctaagactgagcagtgggttcaggtggtatcatttggatccatccatcatcaaattccccataatcctgttacttcgtggtttcagcagttattgatcattattgacaaactcttatttcattaggagctgcaaaacagtgattttctaatgatttttagggattgctggggggtttatcatcctgcttgctcttatatctgtggcttttctataaagaagctttccttcataactatttgcctcatgggtaatgaggcaatacttgggtaatgattgttggagttgggtggtaagtacataggaacttgttatactttctacttttcagtgtgtttgaaattttctgtaatacaattaaaaaccaaggaaaaaaattaaatgcataggaaaaaactgaaaggaaataccccaaacatattatcatcatcaatgagaaaatggcaggattatttaggatgacttttaaacactactgtatttccagatttattaagaaaatatatagtattacatttagaattagaaaccaaacagaattctacagaaaattagtaataatgatgggagcagtgagtgatctaatttaaatcggggttcagagcccacgtctctaagaggcatcatttgaagaaactggtttgacaaaacccttgggaatgagtgcagcaggcaaagaaacccggatcccagagcagggatgaccctagagtgtttgtgggaaagggaacaccacagagtaccatgagtatcagtcagctctcaggaagaacagagaccagccgatcctccaaaccaccccccagactcctgctgatttcactcaggagcctgtgtgcctgaagttacagaacccaaattgcacaggaaatctcaacttctgcccccactgggtaggtagaaggcagaaaacccgaaaaccctaaataatggatcgcagcagctctgtaatgacaaggcaaaatagtgataattaaatgattctaatagtgtgtcaagatgaaggataacagtcttggaaaatgaggttggtaaatcattacccctcaggctcgcatgcacaccccagttagggcgtgaaaaatgcagaatgcaaaatccctggctgcccatcttggttttgcacaatgttggctcccaccctattagggttacttctgagccaagcacagttgggctccattttcaactctgagggaaaatgagagctaagctcaaatttatctcacttacggagcactttactctgtgcccccaagctctacgacagacactggcaatggatacaaaagacatctactcagactggggaaaacaggcactgccggggc

SEQ ID NO: 56298 - DNA, 796 bp, Bovine  19866881282284
tgacataaactgaggatgacaacaggagcagctaggcccttgatttatcatgaaggctgaatgcggacaataaagacagattgcgcacagtacggctgtgtgttagttgctcagtcgcgtccgactctttgttaccccatggggtgtagcccgccaggctcctccgtccatgggattctccaggaaagaagactgggaaaatacatttccttctccagggggaccttcccaacccaggaatcaaacccaggtctcctgcattgcaggcagattctttaccatctgagccaccagggaagcctggtgcagtacagattagtgggcttttttacatttgctatacttaatacatgtactacatgtgaactcttaccattgtcagcatttcccttttagacaggaagactggagcctcgcccagtttcagaaggtccactgggtttctgtctcaggccaaccacttcacgcaggtgaacacaggttagaacagtggtggctggctcatgctaccccctgagtgtaaattctgaaactgactctgtgccccaaagcaaaagaaggacggaagtgttgcctgtgagaaaatattatgtaagacacttccccagaatgtgtggtatcgcagccacgtgaacacaaatcacttgacgtgcaaatactcctcagaaatatttatgatgaaacttcagcaccaacccaaacagccttcacagagtgaaacgaaaccataaattatttccaagaacattgtaatgccaagggaactcacttaattatccattatcccagaaatgta

SEQ ID NO: 56299 - DNA, 1071 bp, Bovine  19866881300423
tttcatggaatttcccaggcaagaatatagtggagtgggttgccatttccttctccagaaaatctttccaacccaagggatcaaacgctcgtctcctgcattggcaggtggtttctttacctctgagccactagggaagcccagagtcccattagaatctcctagaaatagctggcgcttctgttgggggagctgatttctcacctgggcccagcagcgggggacgcatgagccattgccttgcgagcctgtgtgtgaatgacgtcggatcttgtcaagtctgggcgctgaggccagatgttctttgcatcccttgtggatgagcactttccagatggagacccctgggacctcttagccttgcccgtttcttctgaagtagcagtggcggccacagtctgccaggctgatggcgtctcccgctggttcctctccgccctgcaggtgatctgtctccatacagcgatttcgtacatcgttaagggagatgtcatatgcacacgcatgaggctcttacccagaatgtcacattagactcctggaggctttggagaaaaaaaaaaaaattcaaatccaatcacattccccacacccttaaatcatccaatcttccacctgatgccccaaaaggaagctgttagtaaaatagcaatttgcagagttaagaaaagcgtcacacagaatgtaagctaaaaatgtgaacttttttgacctatgctgagggagtggagtcaggaccgatagagctgtgtggctttttcagagggcttcccaggtggttcagtggttaagaatatgcctgctaatgcacgagacatgggtttgattcctgggccaggaagatcctctggagaaggaaatggcaacccgctccagtgtttttgcctggctagttccatgtacagaggagcagaccctcctttctctctctaagtgaccagcagagagacttgggatgtggtcagctttctgcagagatcctggcttgatctgagctctctacttctgtggttcccttcaaaaattgtccctatgctaatgtttcttggagaaatttgctttgaaaccaaa

SEQ ID NO: 56300 - DNA, 1426 bp, Bovine  19866881312097
aggcaggggtaacagctagctcagaaggaaaagaacttcatggtgggttggggtcaagtatgttagtgcttttttaaagtgtatgcattacttttggctgcgttgggtctttgtggctacacgcgggctttcctctagttgcggcaagcaggggctactgttctttgcagtgtgggggcttctcatcgtggtggcttctcttgttgccaagcatgggctctagagcatggactcggtagccgtggtgcacgggcttagttgcccgcagcatgtggactcttcccagaccagggatcgaacctgtgtcctctgcattggtaggcagattcttaaccactggaccaccagggaagtccttatatgttaatgttgaccagagcatagtgaggggaaaagatctctcatctgaccttcccattgtttaagacctgatagaagcagtttagcacaggtgaaagcgtggtcttggaatcggacagatgacttgagctgaagactctgttccttcactttctagctctttgaccttaagcaagttaacttaacctgtccaagcctcagcttcctcatctgtaaagtggggataagggccaacctgatagcaccgttgtaaagattaagtgaaatcacggtttgtggcaatctgtccaacaaaacacacttcttcttgggtcacatctacattacatttccaggtctccctgagttatgaccaatacagcatgagttgaaatgatgtgttcttctaggctagcccattaaaacttcccacctatgctccccatgctctttcctccatctgctgactgaacaccagcagcaagggagggcaaccttggaagctgttcaccgatgatggtggatcacctaggctttaattcagggactccatcaacctgaatgactacatggaccaaaacttccccatcctttgccaaccaggaatgcctgaattaaatggttaatgaaaaagaaataaatttctgttgtgataagctactaaagtttgattatctgtcatgacctttaatcatacaaatgcaacatgcttttttttccccagtagtcatgtttttccagtagttgagtacggatgtgagagttggaccataaagaaggttgggcgccaaagaattgatgcattcaaactgtggtgctggagaagactcttgagaatcccttggaatgctaagagatcaaaccagtcaatcctaaagggaatcaacccttaatagtcattggaagggactgatgatgaagctgaagctccaatagtttggccacctgatgtgaagagatgactcattggaaaagaccttgatgctgggaaagattgaggagaaggtggcgacagaggatgagatggttgaatggcatcagtgactcaatggacatgagtttgagcgagctctgggaaatggtgaag

SEQ ID NO: 56301 - DNA, 965 bp, Bovine  19866881337605
ctacttgaaaacaacccatcttggtgttccatctcactgtgtatgtaaacagacggatagcctcatagcagtgtagtcccagatggtgggtgacaagcacccacgggtccccagagacagctcccagaatcgttctgagagaggaatgtgaccacgcgcatctctcttcttctggaattggaagcctgtttgtttgaagctaagagcattccaggcagctccgtctgataagcatgggattttcagccatccaccctttgtttctttcatgttctgactagaacaccagtcatgtaaggcaactggatgagaaaatcactttgattagtgactttcctgtggatatatttcttttctttcatatttcatgtactgaatattttatgaaaatgttttcctttccgagtgagctaatgctgtggtttaaataatatgactggaaggtacaaaccctatttctcaaaacagaatcgtactaaggggaagaaaaaagcacaaacatgtaaaagccagtggggcaaacacttgagatcaggttcacctggatgtgatttccagttctcttgggattgctgtgtgctctctcagcacctccgcttctgtgagatggggacagtcactgttacaatctgacaccatcaatgcatgcgtgcgtgcgtgctcagttgctcctgtcctgtccaactctttgcaaccccgtggagtgtagcccaccaggctcctctgtccactgaattttcctaggcaagaatattgatgtgggttgccatttacttctccaggggaattttcctggcccagagatcaaacccacatctcctgcactggcaggcagatttttttttcctttttttaccatctgagccatcagggaaacccatgagggtgaggattacatgagataaggcagttatagtgtggggggtacagatcctggtacagagcaagttgtcagtaaatggtcc

SEQ ID NO: 56302 - DNA, 1939 bp, Bovine  19866881363062
aaatttatctttattattcgcccctggacatgagacagggcctggatgctgaaggcggtaaaagaccagccagggcatttgagagatgtgacaaacttcccagaggagatggtccctaaggaggccatttacaagcaactgcgagagagtcatccgggaagccttgttcatctttttcacggccctcgctgtagggtttccagttttcctcaggtcgtcccacagtttgcatgccctttccccataattagcacaacatactacaattctgcgatgtttctgcatatcaatccagtgcaggagataaggagggatttttctgttcatctaaaaaatgtaaaaactggactcatgaagattaagctacaactgacaaaggggagggcttttctagtctgtgctcaactacatttctgtatctcctcatgccttgctgttgctgttcagtcatccagttgtttctgactctttgtgactcgatgaaccccagcactccaggcctccctgtccctcaccgtctcccggagtttgcccaagttcacatccactgagttggtgatgccatccaaccacctcagcccctgtcactctcttctgtcctcagtctttcccagcatcagggtcttttccaatgtgtcagctatttgcatcaggtggccagagtattagaacttcagcttcctagcacctaaattttttcacagctttccagttggcttactaaggtataaaactttcaccatgacctctgaggaattccaaggtctggggtctgggtgctctctgattttatctcccaccattccctcctcttcatcatgccttccaggtccagatgaaccagatggaagctaataaaacagattcctagggaaagtggtcttttgtaatggtcagctaaagctctctatcatgagtttgagtaagctccgggagttggtgagggacagggaggcctggcatgctgcagtccatggggttgcaaagagtcggacacgactgagtgactgaactgaattgaaagctctctgtgtcataggttaagtttcaggagaagccactggcttagcctatataacaccaaacagccacacagtatcaattattcattcaacagggtcaggctggaccaaaggaatgaacttctaaccaagacttccccagtcttgactccatccactctaaccgtcactcagctgccaatgtcatcaattaaaacactcttttactttataataataataactaatgtgcctaactaatgtgcctagcccaaataagtccaagcagtgatactaagcatgttacatatatgaacacatttaataagaaactttaacagcagggtatcatttttattctgattttactgaagaagaaactaaaagctcagaaaaggtgaagtagcttgtgtggcaaagcctagattcaaacccgtgtaatctgggtttcaactatcatattttccaacttcagtaaaatacttttaaaatatttatttatttatttatcttcagctgttctgggtgttcattgctgcacgggcttttctctagttgctgcaagggggcctgcactctagttgaagtgcacggacttctcattgcagtggcctctcttgttgcagagcatgggctctagggagctcggacttgagcaattgtggcacctggatcagtaactgcagctggcgggctctagagcacaggttcaatagtgcacaggcgtgttggatcttcccagaaaagggtttgaacccatgtctcctgcactgacaggcaaagtcttaatcactgagccagcagaagagtcctccagtaaaatactcttgtggccaaagttaccctcaaaagccccctaaatactcttataaagtgccatacacatggtttccccctattgacacttgcatattaactcatccactaaagcttgagga

SEQ ID NO: 56303 - DNA, 1737 bp, Bovine  19866881363763
cctgacagcctatgacagagaattcaggcacaaatgactagatcaccagcttaacgtttggtgggtttctaaatcaattctcctagaattcaaggtctcaaatgctccccccacctcattttccttatacctttataactataaaaaacagcatttcaatgcagagaattagaactttcgcttacataacacacacagcaaaatggtatcaagaaagtgtctctagacaaagacgtctgcctgaattttctttatcatctacaatgcctaactcataggaactgctcaataactgtttgtttaatgaaactaacaacttgaaaggaagtaaaatacccaccactccatttgctagaacattagagatgaaatgacaataagtttcagtgaaaggtaatcatgtataagtattccaataaaactcaaatttaggttttatataaaaaccaaatgagattctttatggctgaaaatcaaaggaagccccaaggcatgtggaggtgggtaagagctgccattatttcagtcactattgactaacaggctgaacctcattgaacttctgagatggaactaaacagccttattcacaatcatctgatggctttaaggtacattacctgtggttcacagtcttcagctcaatctaccccacttgcagcaaaacattgactcagacagaaccagggccctgcccagttcactgcaagcaaagcattctttcagatcagtgctctgtctgaatgcccagtgactgggaggacactgttgttggttggtcagcattcatctcatcttccttctcagttttatcacagggaccaccctcccccatttccatgaaggctgactttccacatgaaaagtcaacctccagtgtcaaagctggtcacatgaccggtactggtccatccatatatcccatctttctgtctatggtaatgagtgtaagagttgatctgagagtcaagtccatctgctatgacctaacctggtggtttcatgtgaaagtgagttttcaaccccctttggttgttggcatgtctcttctcagttacttgatagatgggatgtcttcctatataagcctatcaagactcaaaagatgagtatcctcttttgcatgtctcttccaagatcaaggaaacatctcacaggcagcctccagcagaaatccttacgtcctgtggccaagaacagggtcacgtgtttacctcatcaaattataagcaaggaaatgttgtataattaagcaaagctcaccatgattcaggcttctctgatagctcagttggtaaagaactgcctgcaatgcaagagaccccagttcaattcctgggtcaggtagatctgctggagaagggataagctacccactccagtgttcttgggcttcccttgtggctcagctggtaaagaatccacctgcaatgcaggagacctgggtttgatccctgggttgggaagatctactggagaagggaaaggctacccactccagtattctggcctggagaattccatggactgtacagtctacggagtacagtataaagagtctgtatagtctaaagagtcggacaagactgagcaactttcactttcacttttcaccatgattcacatgaggccaggaaagcctcctgtgaaacacagggctatccaatcctttaataaaatcaacattctactagccaaggggtaggagagtaactgtggaaaagttatctacagggt

SEQ ID NO: 56304 - DNA, 1191 bp, Bovine  19866881364402
cgaacagtatctctgcatcccttggaaaagcagggcatgttttcctgctgacacacacaagccttataatttagcattagaaaagaaaaatggtttagaacaagaaaaatatatttagagctcattattcaagtaggagtcgcagaaaaggggcaaggacggagccagtcaacgagaaacagctcatattacagggtcacaaggaagcgggagcctgctactcagaagacaggcggcaagggtgacagggtctcgctcaaggtcaacagtcactaagggaaggtgcagaaggttgctgtctccctaagtaaaactgtcctgaagacggaactaatcccttgcatgtcccctcccctccctgtctcccaggaaaggtcagtttcactgtgaatttccacgttccagccccaacgaggcctctgcttggtctccagatattggtatcaccgttatcaagactggaactggttgtcccatcaaacctaaggggtctgtgatgcagcagttctgactcagtgaagtcatgtctgccttcgggtagaaggcactctccccccacatatgcaccccccccacctatgacttgcatttcttcactcccctgccccagctacctgctgtgtccacctgccaactaccctctccacccactcatttttaaaatttttaatttatttttaattggaggataattgctttacaatattggtttgatttctgccatacataaacatggatcagccataggtgtgcatatgtcccctccctcgtgaacctcccttccgtctcccaccctttcccaccgccctctcccaggtcactatagagccccagtttgagttccctgagtcacacagcagatttccactggctatctgtgttacatatggtcatgaatatgcttccatgctactctctccattcatctcgaaccctggcttccatgtcctcctgctgctaagtcacttgagtcgtgtccgactctgcgaccccatagacggcatgcccatcaggctcccccatccccgggattctccaggcaagaacactggagtgggttgccatttccttttccaatgcatgaaagtgaaaagtgaaagtgaagttgctcagttgtgtccgactctttgggaccccatggactgcagcccaccagactcgtctgtccatgggattttccaggcaagagta

SEQ ID NO: 56305 - DNA, 1260 bp, Bovine  19866881509101
ctggtgatgtatatactctttggacagggctgtgggctgcctaaagatctcttttagccataggacatgagtataaataagctttatgtagttacagctgctaagagagattatggatagagtgtcttctaaaaggatagggcagtgtgttgattgttacggggacgtggggaaggagagacgagagatgatcccgaagggagaggttgggtgagttctactgaacaaaattcccctgtgatctttgtcactttttaacagccctttggggaggtgattttattttaattgaaaaaaatagagatatttgtggttgaaaagtggctcagcatggaagttaagagcacaagttttgcaaccagacatccctggtttagccttaaatcccagatttagcctttgtcatatatgtgcatcacacaactagcatgtaggttgcttaatgtctctgtgcctatctccatggcgatgactgtacacgttagctgggaagatgaaatgaaaggaggtgacacgtggaaagagtttagagaagaacttggcagatcatgagggctcagccaacatgtattcatttttatgcattttatttttcaaaattagtttattactttttgttttgttttgttttttggctatgtggtgtcatctgtgggatcttgctgccctgaccagggatccaacctgtgtcccctacattagaagcatggagtcctaaccatcggacacccagagaagtctccaacatttgttctacttattcgttcttatcctttgttcttcatcttcttaatatttattatttgttcttatttatgggtacatggacataaataaggccatgacaaaaataaaaaattgattctttcacactttgaatgtgcaatgaaggaggcccagttggggtttaattattggtagttgactgcttattgctgttgttgagtcattaagtcatatttgactcttaatgacctcatgaactgcagcatgccaggctcccctatccttcactgctgctgctgctaagtcgcttcagttatgtccgactctgtgcgaccccagagacggcagcccaccaggctctgccgtccttgggattctccaggcaagaacactagagtgggttgccatttccttctccagtgtatgaaagtgaaaagtgaaagtggagtcactcggttgtgtctgactcttagcgaccccatggactgcagcctaccaggctcctccgtccataggattttccaggcaagagta

SEQ ID NO: 56306 - DNA, 759 bp, Bovine  19866881598601
ttttcactttttgatgaaactggccgtccaaaatgccttttgtctcctcctaaatgcatattcagcagctttcagctgcaccgggggttctcatccagctgtgctcactctcctgcaaactcccatgaaatcaatagcacacatccatcattttatctccaccacttagcggaagcaaaaaaaccactttgccaaagtaccctccaccggacaagacgtatcaccccactgccatcgcacccatccatctcacatacaattgtttaagtggtttggggtcctttggaatcagagatttattcctgcttcccttacgttttattggggaaggtttatcatcgatatgaaactttaattcctccaaagccgtggattaatagactcataaactttaatacctggtgctttacacacttcattcaggctgtactccacacagctggggagtaacaattcacttcaatcttctggtctcccccccaccggcaagattcttagacctttagggacatagttagattcaccctgataaagtattgtgttgtgtttaggaggctgaacactagaatcaaaccaacatgagttcaattcacttacttgctgtacaactccaggctagctgctttacctctctcagcctcagcttattcatctataaaatgagaataatatttgaagctatctcccaaggttattaattgctcatggggtatgtgtgtgtgtgtgtgtttatgtgtgtgtgaaaagggatgggaggag

SEQ ID NO: 56307 - DNA, 787 bp, Bovine  19866881803876
tggagtaggaaagtgaaagggaaagatttctgttgaggaaggcaaagatggttcctttcacatgccagctgcaaatccttggtttcctagagcactgcatggaggacgatcctgaagatctgaccgggacgggcgctgggattccttagcgatgtctgcacagtgcacagcctgagggcacagcatcacgggagtctgccttccgagtgcacgggctttactgacagatccagaaggaccaagacgtgggctttcccttctccttgtctacggcctttattttcacaagagaggcatttcacaagaaatttcttgcaagggcaagaaatatggagaagaaacattcaataaaatctcataggtcctaacaccaggctctaagtgctgttttgttttgctgatcaatagagtaaaatatggtctttaaagaagtcaggggaaacatctacagatacagcgttgaggagaaaaatagcaccctaatgtttactaccgcaatcagttaccttttgtacaagtaaaagtgcccctgctcgcaccatgaaagataagcaggtgtttagaggctccgtggacttccctggaagctcagctggtaaggaagctgcaatgcaggaagatcaagggataggctacccactccagtattctttgacttccctggtagcctcagctggtaaagaatccgcctgcaacatgggagaccctgggttcgatccctagattggggaagatcccctggagaagggaatggctttacccacttccagtattctggcctagagaa

SEQ ID NO: 56308 - DNA, 1255 bp, Bovine  19866881948463
aggacgtggaaatccgctccagtatccttgcctggagaatcccatgggcagaggagcctaatgggctacagtccatggggttgcaaagagtcggacacgactgaagcgactgagcacgcatacacgcacatggtgattttttttaaaacctcactactgtttgggctttcccggacccacatagtccttggaacatcttgagatgctgagaacttctaagttggttgtgagaaaatgagaattcctattcttctcttttcctggtaaaaccacaaggaggcctattgcaggacagatgatctggtatctacggtcaaggtggttgttttgagctgactttgtgccctgccttctcagtgcttcggcagtaactggggtgtggtccgtattctgtgtgtgtagctgttcatccttctcccgccagcgggatgctgcacaaaactgcacagggaggctctcagtccccagcattgcaggcagcccaggaagctggagacgggaggcttctcaggtgacaggggaagagggtgataaggggtgacaagggcaggtaggtcctgccccggggagtcccgggcaccccaggcaccaagcagttaaatgctctgcctggggggtaacttccaccaggtttcctctcctgagcgtgataaagaatgagggggagctggggcatatttacacctgctccgtgcacaagtttcaatggcagtaattctctgaccttttaaaatggataaatctccttggcagtggcatatttctcaaagcttagctcagagtgggggccgaggagctgggagacatggccagaccaaggagaagattgatgagccccgaggggtctgttctggaaacctgccacacccatggccgcactcggggtggtctgggtagaaaaaagcgtgttcttggctggagtgtgagtccttccatcacctcccagatggatgaaagcaggcaggctgtttttcagattgcagtggatttattcctttgatcacctgccttcgcctgcctcctctctgtgagttctgatggatgctctgttcccgtgtctctgttgttctccgtcacggggaacgcagggcgagaatcttattatcacgggttctttaactcccttgcagcatcaccagggagcataataacccctgtggttggcagttcccttccttttatcctcctttccttcctcctccctccagagcttccgaccaagagtgcgggagaccccagagggaagggtctggcg

SEQ ID NO: 56309 - DNA, 1166 bp, Bovine  19866881963793
ctggggctttgggctcctgctctgtggattcactacgcttggggcaggtggatgtgttcttgccattgaatacaagatgtggaaactgaccactccatgcttaaatagtctttgcattcccatgatgcacccagcactctgctaggtcctgaaacatagtagtgaataaaatatagccatgcccacacggagcttgtggtctacaggagggatcagcacactcctctgcccaagggccagattcagcctgccacttgcttttgtcaataaagttttgttgaaacactgtcatgtccatttgtgtacatattatctatgactgtcttctcactccccctagagaaggaaatggaaacccactctagtatccttgcatgggaaatccaatggacagaggagcctggcaggctacggtccacgcaatggcaaacagtcagacacaattgagcaactaatcaacaacatttaacagggcagagttaagtcattgtgacagagactgaacagcctacaaagccaaaagtatttactctcagaaatccgtttatccgttctcaggggtgccaacccctggcctagaaacttgctactaaacttgaggtacctgggctaggtgcatcagcaaaaatctcagttcatccaagactttaagagctggagtctgcctgttgagctacactcattataattaaagaaacactaactagaaggtccaagcccccatcattctgctcctgtttcgcatatttaaatacttgggtaggcacagttcccaagtgaggaaaagactcctgaagaggtactttcaggagaattttcctgccagagccaacctcccagcatcagtacttcagaggaggccacccaagtcctgactcttccacccaatagggtctgcctcgctcagtaagaatgaacccacatcatcggcccagacttacctatcctatattaattataggcacagcattgagcttaaacgaaccattcggccgtatgagcggcaatattcgagccatcaattttatgacactgctcaggaaaatgcagtgatacatcatcccaccccaaatacaaaggtcaaatgatattaattaatgcggcgacacaactcgctgcagctaaatgggtattcttgattatggctccttgattggagaactaat

SEQ ID NO: 56310 - DNA, 2475 bp, Bovine  19866880425065
atttccctcatcagagattcagggccttaatgtattatgttgttaagatttgaaagccttgttccagttctgatgaacactcttgcatacaacaaacaatgccttaaaatgaaaatctattttcctttttttcctctttttcacaacattgctttctctcaactactacttaaaattcaagaagggtttattttttttatgactaaggtcacattataaaatagcacataagatggaagtaatagagtgtagccaaagaggggcatgaaaatgaacacatcaggagccggggtgctagagagcagtttctgaggtgttcattttcattggatctttaaggtaggttgacaagaacaatcagtcgcctcatagatcactgacagaacctcaagaagacagatgacatacagaatagcaaaccccacagaaattaaacaaagtgctggaagaacaattaacatctttgggaatgaaaatgctgaggtggaacattgctaatttcagggcacaaaaccaaacctgaatgacatcttcatctcaatgtcagttaagcccacaaaataagtattgtgattctgcctacaagtctggttgtgtgttttcatatcattttacaatgtcatcaatttctcatcagttacaagcagatacacatgtcccaggaacttttgtgacttttatgtagcacattttaaatctcatcccagttccatgacaggaatatgcctcaataaacaagtggactaattcttcctgagatgagtataaatcccagaataaatcccatcctctacaaaaatgactctatagctggaaagtgaaatttggaagctcccagagcttagggtgctaccatgttcttcaagcaggagaaaagcctagagctcagcaaaatctccagactacaaaaattctgaaaaatgatataatgaaaaggaaaaactgtatttattattgagatcatgaattttgtagcataattcaactttgagtttatatataatcaataacgatagtaagacatagaaaatagcatattttgagtattaaaatttgtattggtggattccacttaaccagtattttaaaataccatatttccagatgctccaatattttttcttttcaataatttgtattattttctaatgcaatttcatacttcatggggggacaaagataaatatgtgtggggggtctaaaaatagaaaagcagagtcaacagtaaaatggtctcatgttgggaaggtcttaagaccatttcatgtgcttctacttccaaaaaaaaagaaacaaacaagtcatcagtcaatccttatattccctgcaatattcttggtatatttcctgtaatataagaataatataatattaaaatgttttagctaatatggcttttaataagaatctattttattactttttatattacttatgagtgtaattattacaaagcacaaattgaatgtcttcaactccacatatccaatgaaccaccagcatgtaactgaagtcattttgctttagacaaagtgtaaagatacagcatattctaatttttttgctattctaaaacatgcaaatcctcaaacaatatttaactgtatattacacaaaaataaaacacctgttaatcattggtttggagttggaaattcagcttgtccaaaagaaattcttttccaaaagaaataatttgcctaatattttaattcttgcctaatattttaaacatgtttattattttatagtttatattgaataataaaagtaaagtgtgagcttcttcacccaagtgtcaagttcagattttgctcactgcaagagtaaacttgcccaaattcattttgcagttcatgggttgtaaagagtcagacacaacttagcaactgaacaacaacaaattcactcagaaaagtggctatataacaaacttacatatgcagtgatctaattaaaaagaacaattttaaaccaaaaatttgatttatctagaaatctattccgagcatcctgtaaccttttcttattctcattcattcaaatctaaatcaattaaaagctaatccagagactgtcctgtcattgcaaaatatatatgtgaaaatgatgctttaggatctaagctgtcatttgctttgctcacaacattaaatatcattaatatgagtttattgtttagcaatgaaacacctttcctatgttgccaccaagataagtaacttgtacttttctagttataattttccccattaatggttgaaagctgctgctgctgctgctaagttgcttcagtcgtgtctgactctgtgcgaccccatagacagaagcccaccaggctcccctgtccctgggattctccaggcaagaatcctggagtgggttgccatttcctagaatgaacataatgaaatttatccaaagcatgattagaaagccacaaaagggaagatggccctaaaacacaacagacat

SEQ ID NO: 56311 - DNA, 1622 bp, Bovine  19866880504955
ctgctgctgctgctgctgctgtaaagtcgcttcagttgtgtccgactctgagagaccccatagacagcagcccaccaggcgcccctgtccctgagattctccaggcaagaacactggagtgggttgccatttccttctccaatgcataaaagtgaaagtgaagtcgcttagtcatgtctgactctttgcgaccgaccccatggactgtagtctaccaggctcctccatccatgggattctccaggcaagagtattggagtgggttgccatttccttctccagtgagtacatgttaattccctttatttaccaaaagaaagcaaacctgctgggggatgggataactcttcccagtgcaggtgctcatgaagcacagtctcatccagcttcttacaactgaaggtgtacactgctttaggggaatggcatcctactcaggctggtaccctagactcacgtgggttgttggaggaaacccagacactaactctgctctcaccacctcatctacccctaaggggagactgactttgctgtatttcaggacatgatagagcaacacttataaatttatctgaaaataaattatataaaatttaatatagggctttcctgatagctcagttggtaaagaatctgccttcaatgtgggagaccctggttcaattcctaggtcagaaagatcccctggagaagggaaaggctacccactccagtattctggcctggagaattccatggactgtatagatatatgaaatataagaaatatatataatgtaatataagaaagaaacataagagatatgcatttgtggtggcagcctgaggaactctgcaggatcagtcttcagtgaaacaaacataaccagtggaaattataaaaacaacaaccatttaaagtttctggaaattgtcctaagggtatccaactagtgcagaggcattttctcaagagaatgtaataagttgcagtaatagcagtgagattgtggcacttgagatacaacatgcatgtcttccccaccaatccccagcttagactgatgggaactctactctggacacatgtggccaagaagatggggctccctctctcctcaccttacagtcaacagctaaagtacacttcccctaggggcacgtacccagtagtatctgcacagaggggcagatttagtcaagtttaatcagtcagactgtggattcatgtataccacaaggcattgttgaaaacagttgagtcagtaagatttatggacacctcaattgaagtaggagcccggggtcaggcttaataccttgacatgaataaaagccgaaacaatgctgcagggcaatcagctcttcgcatccctagtctccacatttgcagatacgcagatccctctgtgagggacttgagcattcgtggatttttgtattcatggcggtcttggaaccaagcccctacagatgaagaggatggactatactctgttcagcattaaacatgctaaggtacctctgtggcggtatttagaaataagatataaacagctgacaactcagacgaaacaggttcccttacaatttcacttccaatttaagaagaattagaaaatgcagaaaagggagcattt

SEQ ID NO: 56312 - DNA, 2537 bp, Bovine  19866880665496
ttaatgtgagaagggattggcaagttgatgccacagtgtgatttccctcaggagggcactgggccaggctcaaagctgtgccacacagatgcagttctacaaatgtagaagataatgactcagtggccaaataaatagtacacatcaaaatacacgtgttgacttctcagggttccctccagtgctaaagtcccaagattctttctatagtctacaaaatatgcaaaataccgaaatgaaagaatttatgccctaaggttacctcagtgtttaaaaacacaagtcatagatagcaaaagactttagggaatggataaaatatagagaggaaagataaaaaaaataggcaagaccaaagaaataaaaataaagaacaaagaaccagaaataaagaaaaccatggctcatttaatcaaaagggaaaatgctaaatatttaaatgacaaaagtggtgatagcctaaaacaagaaaataagcactttaacatgcttgtctaaatatccagaaagtatagaggaggtatggagagatgatgtgttcttgcaaactatcaatatctttcaaaattgccatttttctttccaaatcttttttaaaataataatatttaaccatcactttaaaaaatccccataacctattatttatctgacaggttcaagtaaaaaatatatatttatttcaaaccaaatatacattcattttaaagttgaagggccggtagagatcatataactcaacctttaatttttcaaataaacaaacaggcacacagataacttgatgagtttacccgagaaaccagtgaaagaaatatgtcaagaataaagaatttcacatccctagctaaacttgctatttatctgtgatatttgttttccttgtaaggaacttcttcaatgcatataattgttttccagaatattaagtgcctgtcttaaggactagagtaagagacacacacacacacacacaaaaaagatattctagaagttacacctcccaaaaagataaagctaaagatcttttatgtatttatcacataaagaaatggaaacaaatagcaagactgtgtgaagatttccgctttcttaaattctgtcaaattttatcttgctttcttatctggagaaaatacagtataaaactatcacttgaaagtgtttaaattgtggcagtcataaccaccaggcacatatccttcatatcatcactaaagaacctccctggcagggccagggaaggtgtctgaggtgatgtttatgtttgacttcaggcacggatctcattgttcgtggttcttaataaaaactgtttcattgcaatttatggtctagaaacttaagcttaaaaggaattttggagttttgaaataaatgtctgtagcaataaaaaggtaacaatacacattttataagaaacaaacaaacatatatactttgttccctaagatactacacaatgactattaaattaacagagactattatattttaaagagaaatatttagcagtagcaaaataagaaaagtgactaattgaaaattcaaaccataatggtaagttaacagatctgcagagatattagtgattctcacaaacacttgagtatatggctttaaacttagtatatatattttataaagtatttatgttttgaactataaaactagtaaagtccaaggtcatatggagtccatgaaggccttcaatattatatttttattgatgagctcacctccatgtgttctccatcaactcagggataaagcaagtccccagctaactagccaactaagtatctaagtcatcctaagtgttcaataaatgtgaacttaccttttttgggaggggccttttttttttttttaatgttatacaattttaaaggttacattccatttatagttattacaaaacattgactctattctccatgttgtacaatacctacttgtagcttgtacctctcattcccttacacctatatctgccccccgcaccctgccaaactattatccaccaacttgttctctgtatctgtgagtctgcttctttgttatattcaccagttggttatattttttaggttctacatataagtgacttctgacttatttcacttagcataatgccctccaagtttatccatgttgctgtaaatggcaaaatttcattatctttcaatggttgaataacattccactgtacttggccacctgatgaaaccagcccagtcactggaaaaacactaatgctgggaaagattgactgcaaaaggagaagggggtggcagaggatgagatagttagatagcatcaccaactcaatgaacatgagtttgagcaggctcagagagagagtgaagaacagagaagcctggcatgctaccatacatgggatattgcaaacagtcagacacatcttagtgactaagtaacaacaacaaacatagatacacacacatacacacaccccacatcttctttattcatttatctgttgatgaacacttaggtgcttccatatcttcaca

SEQ ID NO: 56313 - DNA, 1165 bp, Bovine  19866880702938
aatgattaatgtaatattaaagttaccaacaaaatactgccttttaaaatggcactcaatattaatttgattctacaatatttaaggaaatttccattttccctttagaaacaacaaaaaatatattacatgaatcattatttcattcactataataaggtctatttcattaccatgtcaatatgagactttatatatttagcgaatctactccccacactctccatgtcttctacaatgtattgatacttagcactgtttccttaaaacacctaggttatagagcaataaaaagaaatggtgttactgattacatagacagacttcaaaagtcagaatgaactgagctcaaatctcagctttgaaaggtgtttactcattttattttggtaaattattcagtcatcctgaaacttaatttctctatccatgatactgggaaaataacaactttgtcatggacttgaggtaaatttaataatttatttttaaagtctaataaaaagtgatacctacttaacattgtttatgtcattgttgaatatgataacaatcatactaatgttacaaagtaacgtccctaaaagaattaacttcttaaggatttgtgtgtcacacaatttcaggtgctttccactttctgtcaaaaaatcaatagtaaccaaaaacacaaagtatagcttatatctgagattaagcaacagtttgtaacttgacaactatttgcttattttctcctataacatcttgctaacagcttaataacaaatatgttatggtgggatatactcactagacaattattaataaatataaattgctttgctaagcttaaaaaggactcatatatagtatcatataaataataacacttttttaaactcataatgaataatcttatgaccattaaaactgttatatcaattctggttctatgaaatttatcaaatttcttttatgaagtaatacagaatatgtccctttaatatgccaaagtttacttcactatcagaacatataaatgacagaggttgtgtgatttgcttatcttttatgtagcaaatttcactccataagtggtacttccagtaaaaagaaaggcaagttatcctatttcttcctggtaaaattctttagatcaacattattttaaaaatcaattctt

SEQ ID NO: 56314 - DNA, 851 bp, Bovine  19866881236517
ccagtgatggagagccagtcagcgcaatggtgagtagtgcctgagggcccagttgttaagaaacagcagaactgcatggtaccatttctacctgaacttctacgtgtattagaattggtttcagaagcactggtgaaatctagatattacccccatctaccctatatctccgcttcccaggtggttgagtggtaaagaatccgcctgcaatgccggagacacgggagacacaggttcagtttctcagtcaggaatatcccatggaggaggaaatggaaacccacttctgtattcttgcctggttaatcccatgcacagagaagcctggtgggctatagttcatggggttgcaaagagtcagacacgactgagcacacactcacgcaggcactctacatctatcctacttcttgcctcagtcagtttggagcatgagtggagtctgtacaggtgtcttttgtttatcacccaggtaggatcttgcttcacaaaaggagagcatcattcaagtctgctatttatttatttgtttgctctgcattaaagagcaagaagaaattcctctaagtctttaaaatgtgggtgccatccttttcaacttttctggtgttgaagcagattttactgaacaaccatacgttcatttattaatctaaacagcaaacatataatgagactattatgtgtggggcactattaagcactggggaacttgctgtgaagcagatctttacatcgacaatatgccccctcttaatgagccatataattgggatccttttaggagaaatagggctttgctgtcatcatctgtcttgggaaaaaataagggagagaaggaggtactgaaa

SEQ ID NO: 56315 - DNA, 748 bp, Bovine  19866881379108
ttctcgacccagggatcaaatttgcatctcttgcttggcaagtagattctttacaactgaaccacctgggaagcccctaaatacaaatgaaatcttactgtgtttgaagcaaaatgacatggtatgttgcaaacactaggtaacagttccatggaggcacgtatccaatcaatacggaggttttggggaaaaaaaattccagaagagaaaaagctacacttccatatcacagctttctattaacctagaaatatgcaaatataaagctatccgggcatcagaggataagatagctgaatggcatcactgatgcaatggacatgaacttgggcaaaccacaggaaatagtgacggacaggggggcctgggggcctgtggttcacagggtcacagagtcagatatgactggtgactgaacaaaaatgtgcaaatataaatgtatttaactctgttttgaacaattcctagtaacaagttttatcaatagcaatgaccaacagctcatatgttttaattagatttaaaatttaatagtatttcaagtttcccaactcagaataaatttgaaaattgacacaatacagtaaaaagtttccacaaattaaaaacatatatatttttattatgtgtggcattttttaaaacgaaagtgtattaaaaagttgtaccctatggcagtggatgtggaaataagagttcaatgagatagaaactacaaagcagatacctttcaaaataaattatatgg

SEQ ID NO: 56316 - DNA, 1328 bp, Bovine  19866881561373
gaactgctaagcaaaatttgagcgagtaagatcataaaagcagaatatggggtgaggggatgcctacataaaatagacttaagggtgtgctgccaatatagctgtctacaaacttaaagctaaatttttaaaagaataaaactaagaaaatactattttatactttattggataatctgagtcatttttaatatttaatatcttcttctcttatccctcttaatgaagaatgtggaagcattaaatcccatgtaaataacactgaaaatatgagttttgttctttcatcactttgttgatatgttgttgctggggttagaatttctccaaggagcataatgtataaactttaagattgagatggagatagatttttaaattaattttagatatcccaaaactcagaataaagtatactgtgataaaacacagaaatggtgtgtaagtattataaaaaaataaaaactcaagatatattgaaagaagaagaaagagtagtagtgaatgaattctgatcccctgtgagctgtttggattatgataagaaaatggattattatagaacacttttaagagttttgagatctggaaagaaaagtgtgagacagtaaataaattaggtggtgggtgaaggtcattttaactgtactaatttagaaacgtacagagaaaaaaaaactttcccatttcttactgagaaaaaatatatgattagatatggtttgagatcctgtttgaacactttttaaattatattcaataaaatgaaatttaaaaaatgaggctaattcagcaaatcaatcaataaatactaattaattaatgtcagttttcacttataaagcagcttaaagatggaacattctgtgcttgttaagtcattttattaagattataatgatgaagaatgtggataaaaatctgacatggatagcatttttaaaagtcatttatattatgaaccttatatttaaagatggcatagtatttaggaatagatatacagctatggggaggagggcatggcaacccactgcagtattctggagaatccctggagaatcccatggagagaggagcctgatgggctatggtccatggggttgcaaaagagtcagacatgactgaagagacttagcatacacacactcatacagttatgtttcttaggtttcttttcaaaaaaattttttttccgaatcaattgattcttttaaattcactttctgcatcatttctaatgatgcaaaattatttacttagtaaatgcaaaagtatttactaagcccctaacatacactagatgctatagtgaacattaggaattt

SEQ ID NO: 56317 - DNA, 828 bp, Bovine  19866881954669
gatcttcttagtatttcgtttattttataagtatgtgctaagcagatccaacttccgccatctgcttgttcttattctcatgctttttgagaataaatatattctataaactcagaagatactttttaaacatctgcttaattaaacttgtgaaacttttttttagcacatacactgaaacatctataaactatttgggtggttgttgttacaaggctgtctaagcacgtaagttttgtggggaaaagtattcaccaaagtttcactacacatactatcaggccatttgtttattttttgctactccttgtttgttttcatttataagtaaccattgaagcaaactagagcaggcttataagatatgcattataaattaaagtcatctgtttgaatctccaaatatttagatcaaggcaatattctctcttgacatatgcagatagaacaaaattgtctttctgtgttcatcatgagccctgctttgcaaatgaggactgtatgctttaaaatgcatacagttttgaccctaaaattacaaactgttagcttcaagagctataattataacctctttataaggctcttgaataacctctttaaagtcctcagcatttctgcgcattatccagaaaaccaacaaaaaatgtcatatgcaggggtagggaaataaaatgctgttaaaaccttggccataaggatgggagacattggctacactgaataaccttacatgtccttagtacattcaccttagaaagtcttcttctttaatgtgtaataaaatgttctgttttcattattgttaatttgtgtgattcatcactg

SEQ ID NO: 56318 - DNA, 2929 bp, Bovine  19866880413967
ttcccagcatccaggatcttttccaatgagtcagttcttcacatcaggtgaccaaagtattggagtttcagattcaacatcagtccttccagtgaatattcaggactgatttcctttaggatggactctgtagatcacaacaaaccatggaaaattcctaaagagatgggaataccaaatcaccttacttgccttctgagaaacaggtactcaggtcaagaagaaacagaacaggaaatgggacaacagattggttcaaaattgggaaaggagtacatcaaggctgtttattgtcaccctgcttatttaacttgtatgcagagtacatcatgtgagatgtcaggctggatgaagcacaaactggaatcaagataggcagatgacaccaaccttatagcagaaagcaaagaggaactaaagacggtctttgatgaaagtgaagaggagacttaaaaagctgtcttaaaacacaacattctaaaaatctaagatcatggcattcagtcccatcacttaatggcaaatagatggggaaacaatggaaacagtgacagatttcattttcttgggctccaaaatcactgcagatattgactacagccatgaaattaaaagatgtttgctccttggaagaaaagctatgacaaacctagacagcatactcaaaaaacagagacattactttgctgacaaaggtctgtatagtcagaggtttggtttttctagaagtcaggcatagatgtgagagttggaccataaagaagggtgaacgctgaggaagggatgtttttgaactgtggtattggagaagactcttgtgagtcccttggactgcaaggagatcaactcagtcaatcctaaaggaaatcagtcctgaatatttattggaaggactgatgcttaggctgaagcctcagtatttggctacctgatatgaagaactggctcattagaaaaaatactgatgctgggaaagattgaaggcgggagaagaaggggatgacagtggttgagatggatagatggatggcatcacgactcaatgcacatgagtttgagcaagctgcaggagttagtgatggacagggaagtctggcgtgctgcaatccacgtggtcacaaagagtcggaagcaactgagtggccgaactgaactgaggttccttctcttctgagccagttacttttatcaccttattttttcattctggcctttcatttcattgttcaaatttactgatattatttataatttaagattgtagctaaagaatattcactgaaatatcaatattttccccatattggctgtttgttctaataagactctcagtgtctggaagatgacattttaatatatcagtatttcaatacaattcatctggaatttattttaacaactacactgtgtaaagcatcatggtttggagaataagtaaggtactaacactgcttccagtattttatattttcctaaagaggttactctttctcttctttgagagtgatttcttttctcaagtcattatacctattttactctttatatgaaagctttcgtcagtaactagctaggatttttgcatgtttaaatgtttaataacacttgatgaatgtctaatgcataatgagtagttcctcagggagcaatacacttttttcatgtcattgctcagtctattatgtcagagaacaaaaagtaataaaataatttgaaaggaaaatacattttaaaaataaaggagtttctaagcccaactttatgttgctaaatgacatgtctctaagatatttgccagagaaggcaatggatggaactttgacctatcattaggtcaaagttcagttcagttcagttcagtctcttcagtcatgtccatttctgctaccccaatggactgaagcacgccaaaatagtaaactgtagacagtcttttatttttatgagggcttattaaattaaaaattgtaattaatctatttcataaagtttaaaatttttaagtgctctaggagctaagaaatgcttggcatgtacttgattgttcagaataagtcacgttaacttaacaccagagaacatttactaaatattatgatgattttttaaattgagagcctaagcaagtaagtaaatttatcagaagtgttttaccatattataataattgtcttcccttttctaatattcataattttccaaagtgaaagagaaaggaaagaaagaaagacaggaaggaaaaaaagaaagatagccagagaaggcatgtatattagaaactttccagataagagccagtaagccagagttccacaagtggcaatggacaactattatctaaactgttcaggttaatattaaacatcaaaaacaaacaaacagattgagaattatatgatcaaaaaccacattgctttagttcgactcagtaacttttaaaaaaggatctatcctgttttgcatgagatttaatgactcactttgaaacttcatcacagaacttttgaatttatgttatactacatgtaatattatttaatatgtttcagaaggtagagagtctgcctgcaatgcaggagaccagggttcattccctaggttggggaggttggggagatcccctggaaaagagaatggctacccactccagtattcttgcttggagaatcccatggacagaggagcctggtgggctacagtccatggtgtcacaaagagttgaacatcactgagtgactaacaatttcacttttttattatttaaggaaactaggtaataagaataaagaaaagagaataaacataagtaaaaagaaaaataaaacagtataaaggagtgagaaagacaaagaaagaagaaaaaaatggaagagaagagaatgaaatcaaaatgtgtgtgtgtgtgtgtatctgtgtgtgtgtgtgtgtg

SEQ ID NO: 56319 - DNA, 1191 bp, Bovine  19866880725332
tgacacatacatggaatatacagagtatataagcatgtcattttcaaaggagaccactcgatggttaaaatcctccagtttaaaaaggaaagaaaaaaaaaaacaaacaaacactgaattctctctttataaaagcagcagcaggatggttgttcagattcaagtaaaggccttttggaataaaccaagcaattttgatttgctattttacctttgactgagaaacttcagggcttgctttatgtaaacagaaatactaggttttatgtctaaagagatattcaataagtatgtcacataacagaatttgtcttttcaattatacttttgcagtttcatatcaaatgtctaatctatctgtaggctatttttgataattttggttttaatgcaaaaagactataaaggatgacaaagtgtttaatcatcccatatctgtctcacaagtgcaaaagcattataatgctcttggtgaaattacaatgatgtgcatatgtttataaatcttttattttgacacatatctgttgggggataaatttccagggtaagcatgaatgattttaatttcatgacacaccacttttctagaatcaaaatgtatttagaagctcttggattttacaattttgcattcttagttttatagattaaagagctttgtagattaaagattatttatatcaaagccttgattgtatagggaagtggaaatagtatcccagagtggtgaagtaaaccactagttcacagctagttaaacagagtaaaacagagctcagaaagcacattccaataacatacatctctgactctgaacatttgagcattttcttgtgtaattcttcatgcttcaggttttgcttttcatatgatatgctttgaggaaatccaagcttcagcaaaaatctaggactaattggcttatgcgagtgaacattctgacctggaacacatcttgtcagaagaaagaggggaataattagacacagtttatgctggatgaaatttaaataaagataaatctagaagtacttccttagagttagtaaagctactgttgtattatttgttcaaagattattttttccaataggaaaacatttttatcttaatccctgtcagaagacctaacgctattctcagagacacaaatttttcaaattagggactttaatgttttcagataca

SEQ ID NO: 56320 - DNA, 1205 bp, Bovine  19866880798004
aatattttaatcctggttaaagaaagaggccattaaaacagaatattagaaataaatccccaatgttaaagcatgaaaatattcaaaaataacctctaaaatgcaaatagaataatatgactacaatagatgattggaaattaatttatattctaagcaactctgatggtatcagttatatttgtacaatgaaattcaagtgaatcatacagaaattcaagttaatacctggtatagattctatttcattgtgtactctctgtaagcaatgaaatcacataaaaagggagccagttcatcattaagaaattacttttccatctgggtctgtgaattatttttactgggaaacaataataatttcctactaatgcatgtgtcaattgctgctataatattgtattagcaatagcaaatatttaaatgcttatttacttttatcttcatttatataaaataactcagactcgagatttcacaagataaatagagtggtgttctcagatcagataacagatttgttaacagatcgtcagtcacttctgataatgcagtgtcacattgaaccatataaactgctctttttaataggtcataaattatgaaatatcagaaaattcatctagttctattttaagatatgataaattaattttttaattccataaaaatattcctaacctactttttaagagttctaacatatttcatgtaattctggatgatttaagatgtatctattaattacattcacaactcctctctctaagaagcccagagaactatcctcatagttctagtagaatactagaatagaatagaataactattagtaggtggtcataaacatggaatgagaattgtgagtgcctcaacattcttggggaaatatttaaattaataatatgtacttcctctttgaaaattataaatttcttgaggctttttaaaaatctttcttttaattttttgcccacactgagcggcctgcaggatcttagttctctgaccagggatccaacctgcaccctctgcagtagaagaatagagtcttaaccactggactggaaggggaagatcccctgagattaaatatgagaacaaaaaaggcatcagtcatagtctattggttgacataaatgatgcaaaaattcctattataagctgggcatgtctcagacaaaaagcctaagcaataatataaa

SEQ ID NO: 56321 - DNA, 2537 bp, Bovine  19866880849113
taatattatgagagtgtggaatagtagttgttagattagactccctgtttaataaaataagttagtaaaatagtaataatagttcatagactttctctaaatactgtggtatatcatgcagctgagattttatttatgccactataggaagcacacttgacaccctaaaatgtctctttagtatacatactacttgtgtactaaagagacaatcaaagcccaaaagactgagacagtaaatttcaattttccccctaactgcctaaaagaaagcagatagaagacctgttccaggaagggagctgtcactgtaggctaactataatgtgaactaggtgtggacagggaggaacttagcaaatctctatttgttaaaattcctatgttctattttctctgcagggcccagcaaacatttgtttaccaaacatctgctttttcatttgtctgaaaattgccttcctgccctctgaagtcctcttttgtctttagctgaggatggtactcaaggtgaggttttcagtcatttaaggtaagggtttcagtcattgaggacagtacttaaggtaagggttttactacttaaagtgacggttttggttttcctgggtctctcccatttatatacgttattaaactttgtttgattttctcctgctaatatgcctcatgacaacttgatccgtaggccagtcagagaagtctagaagggtcgtggaacatttcttcctctctgacactattctgtttgtccatcttccgtctctcatccaacaaagtccaaatccactcatcctgaagactcattcaattattactacctccaccacctctccttgattccccaagggggagattatattcttaattcactgaatattttgtgtaggattttctatgacatttatctccttctatcttaaatgatttggtataacataatataatgtgattttttataatataatatgttttcctgataaaccatagtattcctgttatcctaaagcatacaaaagaatgcttgctacagagtgaagttcaatgacaaacacatagacttcttaactatagattcaattataaattcagccacttaattcttaatttctcatggtttcagtttcttcatataatcttccaatgataatgctgctctcttcttacctttgaaaagttgtacacacctttaaaggatgaaatgtttactgagatatcccatcttgtattatgcttgcaatttaaagtggaaatacagcttaattaaatctgaagagcatactaacttcttgccttaaagctttataacctgcaactctttcatatttattactttgctagtatcaaataccacataaaatatgaccaatgtttaatgtaaaatgatgtgataattactatcattattcatatgaatttttagagatttaagtaattttttccaatatcagacagctgatgtatgacaggcataattcaaacatgatctttttatatgaaacacagtctatttcctgtctttttggaaaaaaaatacatgtgtatatatttggaaagccatacatatgtgaatacatataaaaatattaaagacaatctatttatctaaactgccctttaacttagattactttgtgattttcaaataccaaccagtttatttaatgatttccccccccaccttttttttttaacacacactctgaaaacattcctttctgtttttctgtctcctagttttttttctttggaattatttttaaagaataacctggcatgtagctttttaaaacaaaatcatctttacaattttgcaatacaaagtataaacattcaatttgaagaagtcttaaagcatttatacatatatcattcattctaaagtatcttaacgtaaatataaattttcattcatatgctaattttgttatcatatatgtaaactattaaacaactttattttacctataaggtaaaagagtcactgtgtaaataattaaattgcttttgataagcagtgacaaacaatgaagtactgttcctggtctaaaataaccttggaaatagcattgtggaattaatagctaaactagaatcaagaactgatagcaagggctactgaatatttctagctctttattttagaatattaaatcccttacctcttacattcttttcaatagagccaaacccttaaattttatcagttgtatcacttctcttcagtagcagcttgtactttgagatcaagcaaacacatcatattgggtaatgaatcaggaaaagaaaaaagaggaattagaaaacgaatcttatactcacggaatgttctataaaattcttcaagagccaggtgcttgtctgagttaaaatcatcatatttcagtagatcatacaaagtacaatcagaaaggtccttgccaagttcttcctgttttatcacctgaaaagaaaattaaaatcatgcaattatatcagtgtcttaacatttctataggtaaatttaagtctacacttgagcaaagaactgaacttat

SEQ ID NO: 56322 - DNA, 1624 bp, Bovine  19866880887409
tttgccttgcttctatggagcccaattaccctttcaaaataaaagtgtattaggctactgaagttttattttattttttcaggatttaaaattattggaatgtagttgatttacaatgtattcgtttcaggtgtgcagtgaagttatacatatatgtatagccactctttttttagattattttctcatgtaggtcattaaagagtactgagtatagcagctgctgtgctatacagcgggttcttattagttttctcttttacatatagtagtgtgtatatgtaaatcccaatttttaaatgcgcatttaaattaatcagatgacagaggtgttttccaccacctcaaactgctcccatccccagcctcccctagtttcacatttgaacaccttatttctgcccagctttagaacgttggtctccgagtctgcgtgttggtcctaggttgtgcattgcatcacttgaggtcctgaggagactcttgttcttgcccttttctatttataattgctccacggttaagtcaacttgtagaaatctttgactcactgtgtaaaaaatttggtagttaaatcagtaatgaaccatttaggaataaaacgatattaaaaaagttgtactaccttgctagagttaccataacaaaatatcacaaacctggtgccttagataacagaaagttattgtctcacatctgtggatgctagaagtccaaatacaagtttggtttggttcctctgtgggctaaatgaaggatctggccttggcctctctcctcagtttgtagatggccatcttcatgtttacatggcatttttcctatacacatgtctctgtgtcccaatttccctttttatctaaataaaaaatcactcatactggattatggattactttaataacctcatcttaacaagtaattgcatttgcaatcaccctgttttcaaataaggtcacattcttaggtactgagggtcaaggtttcaacaaatgaattttggccaggggacagaaacccatgatacaagtagtcacgtcgaacacatttttaataacttaagtgtaaatatcatgtatatgtaaataatgtgaagcatagttgttggcattttcctttacaaatactgcattaaatgaaatttggacaagaatgtttttcttggtaaatttaaaaaataaaagtgcatttataagagagcttgattacaacttgtatgattaaggaaattgtgcaagtaatttaaccaaaatatgcaaataaatgagaatagtcagaaaaacaagtcaagtgttttaagtattctcaaaaatatgcaaatcatgagacttactttctagtttagtattttgttaaggcaaatagttttgattttgtatataagttttcaagtaagtaaagcattattatttgaatttgatcaacaccaaattaatttggttaactttctactaggtgttcccactatatttttgttcatttttgtaagcttcagtataatgcaagttacactttgatcatagtgtattacattaatcaccctatctctgaatcaacttcagtgatagcttttctaagttttattttattcttggtcatataatacttggtttcaatgtgctat

SEQ ID NO: 56323 - DNA, 2899 bp, Bovine  19866880945223
atttgaagactacattggatgggaaggtggttagatcaacataagtttattcatttctctattttctgattttttaataattcatattatcttttcaatatgacagtttaatagcatcctatcattgcttctatagtatatatttttatattgggacctcttcttccatagctagtagaagttatttaatttccttagctttgctttaaagtataagtcttatgatttttacacaaattagaaaataacctcatctcattgttccagtaagccttaaaggattcagcacttttcatcaccatagcaactaggagcctaaacaggaagaaggttaaatatctataaaactctgactataatttgatatatctgtttcacaaggtcttctctctcatctttccaaatatcaaaaatcacaagacatcttctgtcaaacatgtggaaaaatactatatatttatacttcttagaaattacagggacttggcagtgtgtattttaaaatggatttagaaaagtaggtggaaaattatacttcagatcatttcaattaaatttaatttttaaaaagaatgaaaaaattttaaagcaaatatttaagctggtattttgtgccaggatatttcttctcaattgtttgaatgatgcaggaatatttgcaggtcaatcagattctttattttaaacttgaacatgtggcaatatgcaatagaagtataattcaaaaacaaggtgtgttttaggtattgctattcagtgaatcatttttatgacaaaaactataataagctaggaatggtgcaaaatccatctctttaaacaaagctagaaaatcatattaatttataccagcctcattacaatcctaattcagtcacttcaccattactttctgtccaggttgatatgcacattcacagtcattgtcagattcctattactacctttccctgtcatttatcattagtgtaggaaagaaagtcaacgtgataaggaatatataaagggaatatagtgagtaaaatgaagtgtttcaaataatattccttgcctattatggtgcttataagttaggaaaagaatgttatttccttttttgtttcctttctaatattattataacattgttcatatgacaaacatgctaatgagatattattaagcaatgtataattatgaacaatttataaattagcaaagtcagttaaaagctagcctcttaccccaattcccttctcagagttcatagagatgggaaaagtacagaactgtgatgaaagactcaggtgaagttatactatgggaaattgagcctgatcctatgctgctttccattattgaagcccagatcaaaatgaacccttgaaaggctgagatggagaaagattttctatctagaaaagtcaaagagaccagttaataatgtaggcttttaggcatggttcacatcattatcaaccatgatggttcacatcattatcaagcatgatgggcaatctgttctccaagtcaggtactctatccttccatatttttagctattaaatcaattaggttatcccaataattgctgtaaaactggcaatatggactttaaggaaaagaataaagtaagacagtgaatgacatagaccctctcttattgtctataaaactactgcttggattttcagaaaaaaaaaaaaatatatatatatatatatatatatataccatggaaaagagaaacatgcagccaggataggaatatgattggttatttcaaatgtcaatatatgtaaatttagagtcattagttgtttgcatgaggatggtaacagtactatgtataactcaaaacataaaattaatcagaagcctctaacttcagaggagaacatgaatcaatgatatgcacccaggatataataaaaatgtaccagatattcagatcaaaatccaatgtgtatccaaggcaatattttggtcaatgtttttactggtgattaataaaacagagatatcatcaccattaaatatactcttatcttccaaaatggaaaagcaaaactaacaacgcttttgaaaagtgttccttattaaaatcgagacattttcatcatgttgaatatgctttcttaattctcaatatccatttgcttctcctatatgccttgctctatgtctaaaaactaattttccagcatctcttgctagatattcaagatgcagattagctgttactgattttatgaacttagaagacatagaaggcagaaaggaagccaagaccatctgactgatgttttattcttttattcagcaagaaaaacctacgagggcataggtatctccttcagtcaacacctttctgagtgcttaaggcaactgcagatttagggtggcattttcatcctgactttcttatcccgtaaccaataggttcagtagtgacttcctgatttttgctcatgcagcctttccaattattttgtaaaattcctagattaaaggtctttctgtttaaagtatctggaataattttgatttttggaagaaaatctaactaatataaagcaacaaaaagtagaaaatgatgttagtctatttgtattctcaaaccaatcttttttttttttttttcagagcaaactacatttactgtgaaatagaaagaagtactagaaaaaaacacaaaggaaaaagtctttcttcaatatcttggtctataattttccagttatggttcaggattggtgtgtctgtgatggaactattaaatacggaatgttttcccttgatcactaagggagcaatatgaacagggtttcaacatcactcttcctgtgatctatccccttgggatccaaaaagtaaatgaaagacatcattaaaaaatatcatagtaaagaatattaaa

SEQ ID NO: 56324 - DNA, 1138 bp, Bovine  19866880951895
attgtataaatgaatgcagtttatgtaatttgaaattaatttaagtgctataatgattacaaaggtgtaaatgagaagtgccacatttagcgttcagtgtgaaaagaatctacctaaaaagaggaaagcagtcaaacaaagcaatgtttgatattactatatcaaagttttgtgtaaggaaaaactattgcaaattcagaatcaaatccttttgcttacatccttcaccatatgctcatagctatgaagcttgtaaatagagttgtagcattcaaaagatattacaataactgctgctgctgctaagtcacttcagtcgtgtccgactctgtgcgaccccatagacggcagcccaccagaatccgccgtccctgggattctccaggcaagaacactggagtgggttgccattgccttctcccattacaataacaatcccccccaaaattaggtggctaaatgtatctgaatgtatacaaggattatacacaagaatctggatgtatggagtgactaaatgagacctatacataatagagtccaattccaattaaaataaaatggcttaatcttatttttttcattattgaatctgataaaaataaagattctgtcactgaaaactcaatgtagattcagtgcaaaagtctatatatttatacttagattaatatgtaaatacatttaattttatcagaaaataaaactaatttttaaatattttttggtccctgatgaaaatgctgccctgtgattttacttaatttgtaaatcagtttcaatactatgttcagtttgtcatctgtttttcagatacactaattggagtgtgcaagaaatagaaattggatattccacaatttactgataagacttgaatgaaaaacagagataaaattgtattcataaattaattttgttttccctgaaaattagggaaagttttaattcatggtgcttttgctttttgctaacaatttagaatttctcagtgaaaaataatggataatcaggattcggattggatcagtcgctgagtcgtgtccgactctttgtgaccccatgaatcacagcacaccaggcctccctgtccatcaccaactcccggagttcactcagactcatgtccatcgagtca

SEQ ID NO: 56325 - DNA, 1297 bp, Bovine  19866881005072
ttaataatgactttctgttataatttttacactcccagtggagtaattaaatacatttaaatctatggttttctatatagtacaaaattactgattactcaaaaataaatcaccacatctatagatttactaggcttcctatcacattttctttcttttcagctcatttaaaagatttttgtggtttttatgttttagattcacagaaaagttgcaaacataatgcatatagtgcactaagtgataatcatgtaactaacccctagtatccccactgttaacctctgatttgtatgatatatttgtcataattgttgaatcaataccaaagtgtttttaataaagtctgtacttcattttgagttctttagttttacctaatgtcctttttcttccccaattatttcatgaaggatatcccattaatttggttattgcattctataggacctacagtgaccgtgaaagtcattcagtcgtgtccaactctttgcgaccccatggactgtagcctgtcgggctcctctgtccatggaattctccaggccagaatactggagtgggtagccattcccttctccagggtattttcccaacacagggatcaaacccaggtctcccgcattgcaggctgattcttcaccatctgagccaccagagaagctacagattcctcttaaatgtgatcttgcttgctccctagtttttcagaatcttgtaaatgttcttatctgggacttagtttctaaacatatttatttctttttagatcactctccctagcttaacacagaaatgttgctttttaaataaggccaatcaagtccaacttcaggaagcatttcacaagaagctgttttcacaacaggtaaaaatggaattttaaatctacaacacttctttgatgcttgttatttccaagtgtgtcttataacaaaagctgtaaggtttctttgtcatacagaattatacattttactattgtgagaaaatacaaaatagagtgataaatccaaattgaattcccatttttgtacactattttagttaagattctacatgagatcaattcactaatctttctctgaaggtttctagaagcattttttgtttgtttattcgtgtcacattctgagtttgtctacttgcttaggtataggaagtcataaatgactgatccattttctttatctgaatcacaatgtgagttacctagaacttagcattatctgaattacctagaactttgcattatctgaatcacaatctgagttacctagaatttagcatgctattt

SEQ ID NO: 56326 - DNA, 1915 bp, Bovine  19866881091494
tactatttggggaatacagcaatgaataaggcagagaaacccttgcccttatgcatcttatattctacatcaggggttaccaaatatcttctgtaaaagaccagatagagtacattttaggctttgctgaatattaggtctttatcttagtagcactaaatctgcccaaaggcaataattaaacatatcaacatatgtattttctaataagacttttatatatggatgtgcatgtgtgctcagttgttcagttgtgtctgattctttgagagcccgtggactgtatcctctcaagatcctctgtccatggaattttccaagcaagaatagtagagtgaattgccattttctactcctgacccagggatcaaacacatatcttccacgtctcccacattggcaggtagattctttaccactgtgccacctggaaagcccttatgtatgaacccctaatatataaattttatataatttttttgaaagcaccacaaaataccatttctcttttaatccttttttcaaccatttgaaaatgaaaatagcaggtttaggtcatacaaaagtaggaaaagtgaaatggatttggcaagcacttctaggtctacattccacatgagaaatctgacttagcttatgatgagcttggatgctgtgggccatcctcgagcagatatttagaaaatatttgaaagagtagaaggtagaaggaacaaggtcaggtgtaaacatggagagttaggaatccagcacaagagaattcagagcaaggaagagagagacaaaggaagactggaaggagtgcagtgagccccaggatttaaatttgcattagaacttaaaaaaccaactgatttcctttcatattagattccagaaaagggaaaaatcagactaatattctacagagaagaaaaaaaagatttctgaaactatgacacataatttgatataaagcagttcactcagagatcaataatgtttaaaacagtttaaaattaatattatcttttacctagaccttctcatagcaccacatggaaagatatcaggacatcaaaagtgagggaaaaaacagcatgactgctaaatagtctgatccatatttcagactttagaataaaactgagaaaatacagcttatcatgaaatattcttaaaaatgaatcaattaactctttactatggttttgtgaataaaatctatggtccaatctttcttactatttcatgatagattgttgaatgatttttaatgattgttagcttgtgcaagaaaactttatcacattattcatcaccatacgatatttatactcaatttttcctcatagtaatagaatactttcctgatgattatacattttggtcaccatcttagacacgtccttttccctcttcttcaatatacaaatttcttacaagtctgtaaactctattcctcagtgtgtatttaacactgcaaaaaatgtgttttttgtgacatatcaagtatgttggacaatttgaatcattagtacctgctgtcatcttgagtttaattgatggccaaaaagcaaagtgatataaaagtcttactttccgcaaaatttttcttggctgagtgctatcagtgtcaaaaggtaaaagcaaaatattttattttaactccatcatttctaatggcagttgcttcatctgacatgtttttgggaaattggggtgagggagaatgaatggagagagaagtataacagaaatttgagtaaaagcaatgtaagaaattaaacccaacaaaactttttacaaccccttataaattactctttctcagttcagtcactcagtcgtgtctgactctttgtgaccccatgaactgcagcactccaggcctccctgtccatcaccaactcctagaatttacccaaactcatgt

SEQ ID NO: 56327 - DNA, 1584 bp, Bovine  19866881263022
tatgcttattccaataaaacattagcttttttagaagatcttttctcaagaaggtggcaatttattgtatcagtattaggattcctaggtatcatgctagtggatttactatttctttcaaagataattttttcctttatatcctgttctacaaaatgtgtttaaaaatctaatttctaatacttattgacctctgcctcacgttgttaatatatattatctcattcaacctttgaaacaacctcttgaagcagggactattattctcctagtttatgaagaggagattaaggtggacaggataaagtatttgactgggccatgaagctaaatggaggtggaaactgattggcctcagaaaggaaattctctcacgatgccttctctcaaggatttgtgttcctctttgtttcagcttaaggtatgattttaccaaaggtagaacctgagtgtgatgcttttgtaataagtgtcagtgattgaaatctgtttagtcctcacttcttgctcatcgttggtgtgagaaaagagttgtgtgaaaagaatgaagcaagtatcattcagagcacaaaaagattgccttccttttgggcttttagaaagccaatgaaaagattttcctccatgagtttaaaaatatctggcaccttacaagtgacttatgaaaataggctgaataaattctgaaaacagagtgattgcaaagtttatttgcttctatgggaacataacaaagaagccagaagcaagcaaattcagtttatcctgttgcttgtgtgtcagagatgcccctgaggtgtcttataataatgttctatgaataattctgtcttaacaacccaggtttaataaggacaagtaattctgtttgtcacactgcaaactgaaggagtgtttcagtataaaattctaaaaattgtagacaatattgaacgagtgaatgatattaaataatgaactagtgtagtttttttttttttttttttctatactggatcaccttaaaagcaactgttctctgctaagcctttcaacccacagtattataatcaggtaaaattatgccttcatcaacttcctcaacttgcactatccagttttattttactcttgtgtatcacactgtaagtaacatcaaatatttaaagagttaaggtttaaaaacatttaatatgtttcaatttcttcaataaggtgagtaaagaaaaatggcattcttttcacatataggctaaataaaattgctaaaattaaacacttttaaattttttcagtaatgttgaaatggtgcctgttgttcaatttctaaatcatgtccaactgtttgcaactccatggactgtagcatgctaggctcctggcagatagctccgttatctcctgggagttgttcagattcatgtccgttgacttggtgatactatctaaccatctcatcctctgctgcctctttcttggtttggctttattctctcccagcatcagggctttttccaatgagttggctgtttacatcaggtggccaaagtactggagcttcaacttcagcatctgtcctttcaatgaatattcagggatttattt

SEQ ID NO: 56328 - DNA, 2032 bp, Bovine  19866881363523
aggtagtagaaaattttataatattaaattttgaaatttaatattaaatttaatatttggagcatcaactatatcatctcattaaaattaaagcctttttaataatgaaatcaataattttcttatttaacttaaaatagcatatgtttatatgaataatatttaacttattggaattgtcaagggaaataaaaagctttccaatctaaataagatacattaacatctaactgtatacagatgttcagagaagccacagaaagataattgcactttgttaccaatttagcaatctttcctgctctaattaaaggaggaaataaattatcttgtgaagaaattgctcataacattaacagtacaaatgctaatttaaattatttagatatatgatttattctgtaccacattaaagatttgtcacaagtttagaaatagtctaaatatgtttaagaaagtcacacacaaaaggtaaatattttgtcctattgatattaaagggaaaataaaacaagaaagaagcaaattatataaaaattttaagctatctcctattcctaatctaaagaatgagaaaaagaatgaaacacagaacagggacacaatttgtcaaatgtttcatcaacaagaatagaaagtgatacaaggacattcttgagataatcaatgaaatgtcagccatgggaggagcgtggctagtctcactgctacagtgtacaattgattgctcaggactctgtggggaattgctcagcataagaggaatacaaattagatctctccacagttcagacatgtgcaaagccctctctcacatgaaggaaaagctgtgaatttgaaaatatctttgagcttattatttcatcctctgcctgcacaatatagtgaaacagggtaacattcccagcacctggagtaggtaaataaaacgagaacagtgggtggtggttagagaataaataagagtgatgagagagacactggtaaacagtgcagatggggatatgaatcaccagaattttaggaaaataaacagtaattggaaaagaatgcagaactctaatgtgagtttaatgtttacagatcctgttgttttccctctagcctaaaagttagatggaaagaccaataaaaaataattggcattcctgcttggctgttccttttactcgggtaaactatagaaataaatattagagaaggtttgcgatgagctgattctcttggtgcattaaagacactgatgtcccatcaagagctctgacacaacttataactgaaagcaatttggattgttggaaaaggtgtggtgacccagggaggcagctggaattcacgaatgccaccaatggcatcctgcacacacttaagggagttttgtttctccaaaactaacactgattttaataatgttagagaaattgaggtaagttttatcttaaatttttaaatggctttgacccatatatgcacatttcctctatgtgtgatttaggatagtaacagatttgaacattaattctgtgattaattggctgtgaccctagtcaactaactttgtggaatttgatgtctttattgacaaaacaagaatgttaaaaccctgcctcatacctgcatttgcttaagtgaggtgacatttgtaaagacagtatcctgtcatttttatttattcactgagttgtgtccaactcttgcaaccccatggactataacactccaggctcctctttccatggaatttctcaggcaagaatactggagtgggttgccatttccttctccaggggctcttcctgactcagggatagaacccccaactcaactcctgcattgcaggcagattctttacaactgtgtcacctgggaagaccataataattctaagtcctatagtaatctttctaaataccagtgctctaattcattaagatataccttctctatctacttctcaaattgtttctaatgatatatcttttttttataaaaaaagttgaaaaagcaacttttcatttaacaattctatata

SEQ ID NO: 56329 - DNA, 1127 bp, Bovine  19866881394039
ctgttaagaaaaaaccccttcgtatccactggtagataacattagaaatattatcacaaataatacttacacttcttttcttagtaacaactattatttatacttaatggggtcattctgtttcttatatagatactgaactataatgcccaaaaaattaatttcaaaacttataaactgtaacttgatctgtattaagacatctgtatatgcttgctaaatttaaattaaattaagttgaattaattaattgtattttattttaaaattttaattatgaattcacattatcaattatgaatgtgcttatagaatttaaatctgagcacagacattcttgcctatctttagtggtcagtataatagttaatgctccttactaattggatatataattgagatcattactaatttaaatgcccaaagcacattattttcttcccatttttctctttactgcaaatatttcttggctctcacaattgcgataagttgcacattttttcagtaccgacatcatctcacacacttgaaaatttcaacagctatagcgacattatatatacatttttaacacacacacaaaaggagatgcatgcttttacagtttctaagcagaattttctcaaaagctttttgttttctttcaagattgcacaattggagtgtgaacattactcttctcaagatattgcatgtttcagagtcaaaatgatttaatgagaaattcaagacattgacattcccagggtgacaccccagttacagagttttcataattatattggaaacaaaacctgccagcatagttgaaagctttatttacaatatttgaatgcaatgaagagtagtgaagggccttcattggcttcagaagggaaaaaaaaaaaaaaacttgtctagtgactggtctgcaggagataaacaaaacgtattctaatgtgatccaaagttaatgaactttcaagcatgcatggaaagaacaaaattcaaatgcacacatcagtgatttatatagctataacttaattattttggaggaatttccatttgtgttatatgtgctattatcgatgtaactcaattggactgccttcttatatttgcattttaagcactaagaggat

SEQ ID NO: 56330 - DNA, 2197 bp, Bovine  19866881875982
ggatgtgggttcatgactgatccctgctccttccttcctatcagatgctttgtggctctttgtttatagccttggtgtagaagagttcttctgctagtcccaggtagatttcagcaagagtctttccaatgtatatttagtttgatgtgtttgtggtggatggcgagcccaggtgcctcctaatctgctatcttgatctctccctcacaagccttttaatcttgataaccctttggggatatactataatccccattgttcagatgaggaaaccaaattatagatgtgttaggtacccaatcaaggtatggttccatggagtgtagactcccaagactcctctgttcattggatttctccaggcaagaatactggagtggtttgccatttcctcctccagaggatgttcctgatccaggaattgaaatcacatctccttaattgcaggcagatactttcccattgagtcacagggtttacaacctcccaaaactttatttttttgccatgtatgtgtcagcagtgataaatatatctacatacattaacacatatgtatatatgtgaatatatattattccttaatatatatttttctctatatacatttttaaatagatagatacatagacatatatgtacactttattttttttttttttcagtcacgtaatgttcttagatttacctataaaagcctaagaatgaaattacttggtttggttttactgcaagactgccagattctcctatgtttttgaggcagatgtagattgttagattaaacaagtaacaacataataaaattcttcatgatttgttcctttagtcatgaaatgcatcagtgattgccaagcggcaaaggtcaaaacaagaaaggatcagacgttagaacccaaaaagttttcaagacactttttctcatttctatcctctcctgtttcccactttacatacatacgtttcctttctcccagcagaattctgctaatgtaaacgttggcatttgttaaatatttcctgtatgccaggactgtgtatcctgtggatcagtacatgtactgcttagtacactctaggagatggtctatactatcaacctcgcattatggatgggaaaatttagcacagggaagtaatttttccaagggcataaagctaataattggcagaaaatttgagttccgcagtttaaatttagagcccttgtccttatggactgtaatactcattgagtatggaggtaagagctcaaggagaaagtgaaagaaggggacaatgtcaaaggttttttttttttttttttaaagtctggttctgataaaaatcccttctcctaagaacaactgaaccctgattatattgtatttctcttagacttattttttcctaatcccttgaaactttgatatcagcatattatttggatacatcaatctataaatccaagtgattttatctctcttttttttttttttgtctacagggatcctgattcaggatggctctttgggatcttgtgaaaacaaatactgtggtttgggaaggcactgtgttctcagcagagagacagggcaggcaaaatgtgcctgtatggaccattgcaaccggcactacaaacctgtgtgtggatctgatggggaattctatgaaaaccactgtgaggtacacagagctgcttgcttgaagaaacacaagattaccattgtccacaatgaagactgcttcttcaaaggtaaatgcagggtgggcctaaagtgccacctttctctatttcttccttcttctttactagtgcccttaaatttaaactctagcatcgctactgaaagtctctaaataaaagagagaaatatgggcttaaagacacttgtgattagtaagtgaatagaaatttgtatggatacaattctgaatctgttatgagaacaaagctggccaaaatatgactcaaaatttaatatagcttacagcattgcaccatatggcttgccaatcatgacagttttcttagggacacagagtggccaattcagtcaacaagccaattccatgcagtgaaatgcacctggagtgaaactgagagaagagtgaatgccaagccatcctgtgataacatctcatttcttcctgattaaaaacgatgcctacagtatgcaccacctgattcaaattacacagaactggtaaatgccca

SEQ ID NO: 56331 - DNA, 1303 bp, Bovine  19866882067182
tgtaaagctaacagaaagacttaggctacttttcttgaagttgtgtacttgaatccacaggctcacacattatactgtagtttagaatacaactcttctgaatttagagaacaaacagccatatttttaaagtatgctctggaggacctactcaggttgcctctgataatgcattcttaaggagagaaagagaactgaagtaatcctttgatcagccatctatctttagggcctttaggcagttaaatgtctaaatcatttcatagagttgtgtcttatattcataaagataaaaaactttgccctgagccaatggtaaatggtcatttaatttaatgtaggcttagttctctataaacccatctcctttttgtacatggttacgtttttaataaaatgataattcttaaagttatcaccataatgggaatttgagttatataacaatttttcagaagcagttaacagttgatagaaacaaaacatatctatttacaccctgatcatttttttcttagcctagtatcatatctaggtttcttatatatttactaaataaatgaatggatttattttattaaattttaaattgaacataagaccttgataatgttatcttcaaagccagatgggatccctttattgcataagaatatctaaattcaaagataagatgatttcatatgctaagtagctatctgaaatctaaaacaaaacttagctaaacatttcagatatttttttcaaggctttggctaaaagctatacgcagtctttttatccttattatatgatgggttaaatgattttccaatgacctcaaatctctctgtaataatcccttgaaaaccactgcattatattttaccttgtctcctttgtctggatttttatcttctctctcactttccatctctaggtctcctgaggcatgtttttcaataaggtcaaaagtagaactattgattgagtctgacaaatgtcaaaattcttttctaccaaaaaaaaagagatgagaaaactacctgagtgattgattaaagcaagtgagatgaacagtgtcacattaaaaagaaaatccattatttagccaatttcaacccttaaacacctttagttatttgttaaattatagttctctaaatctttttttcctacatattatttttaatttaaagctttgtcaagaggcttatgttttcattaattcaaagagtaaacatataataccttgaaggctgtatatttaaactaaataagaaataagtaaatttaattatagctacatctaaatcattttcta

SEQ ID NO: 56332 - DNA, 1338 bp, Bovine  19866882116473
ttgaacatgcttattcagtttctatgcttattcaatttctctaccagagatctaactggcactccctgcaggagaagtacagagtcttaaccactggataaccagggaagtccccccagtcatctcttaaattaaatagagttagatatcatttctaactggagaagttaatggcattcattggagaaggaaatggcaacccactccagtgttcttgcctggagaatcccagggacgagggagcctggtgggctgccatctatagggtcgcacagagtcggacatgactgaagtgacttagcagcagcagcagtagcatatatcatttgggtaatttgggtgatcatgggctatgttttctcattggagatattttataatatacattatttgtgggctaataaagctctattaatattttatactaaacaaatgaatccactacaatatttgttagcattcacacagtgaaaaaaaaaaaaaaaaaaggattgtggttataacaaggtcacaatgattgatatcaaaatcaaattctaaattttagaatgtgaggattctttggtaacttaggaataagttcattgatcttctctcaaactggccatctgctggcctcatttctaatgaaagtcacgtttcaaaagattcactctgttctctggaggatgtggctaagccattcaactctctttacagagatgatagtaatcaaatgtcacaatgatataaaattattccgtggaattggacatttcctgctaaggcagtggcttctcactgagaagattccctgggctagacagacacaaactgaatcggaacgaaagtcaaaagcttcagcacaggagagggcccagtggtgaccctgctttgtgcctttttcacctccttgactttcccttctttcctgcctttgctttctctgcactgagaccagcagacttgacactgtccccaaggcaaaagagagcctctgttaaaactccctacgttcaaccaaagacattctgatttcagggctttcagatgaactccaaggatctgcatttcaagcaggcatcacagataactctgaagccccaggctgagcagctggagtttgtcccctgtgaatggatacaccaagatgaatataatagcaggaatttaataagaggagctgagccctgccccgataaaagacaaagataccacatatttctcgttctccagggcaaggagaccttcccatctacacatgtgcagaaaggctccttgtggagcctattatacagagtgaagtaaatcagaaagaaaaacaccaatgcagtatattaacgcatatataggaattta

SEQ ID NO: 56333 - DNA, 1301 bp, Bovine  19866880398495
tggcgatctgtttcttctgaggatactagtcatatggaattgttcagttgctcagtcgtatctgattctttgtgaccccatggacagcagcatgccaggctcttttgccctggaggtttgctcaaattcatgtgatggggccaaatttcttttgatttgttctggctgctgtgtggaaactggaatggagttgggacaccaggggggcccagctgacagttctctggggaactaacaatggtggctttgtggacagtagtccttttattgatgctttccaactgtggtgttgaagactcagagtcccttggactgcaaggagatcaaaccagtcaatcctataggaaatcaaccttgactattcattggaaggactgatgctgaagctccagtattctggccacctgatgcgaagaaccagctcattggaaaagaccctgatgctgggaaacattgaaggtggaagagggcaacagaggatgagatggttggatggcatcaccaattcaatggacatgaacttgagcaaactccagaaaacagtgaaggacagggaggcatggtgtgctgcagtccatggggttgcagtcagatacgactgagtgactgaacaattagtgggaggtattgctctaggtactgggggatacgatggtttggacagaaccaagtctccaaacctgtttgtaatagggaggtgaggaaacctttcagtgagatggaaacagaactctaaaggtgagaagggccacatggctcctggagagggaagagccttgtaaggcagaggaacaagtaaaatcatgcatgaccctcagtgaccaagctggctaaacagatggtgaacttgatgcttggagggaagtgagtggacaaatttaggtgtcggcttcttgaactgatgcctcttcgctttcctaggggtctgcaagattgaccaccagaatcgagctggctactctgccctcatgttggcggcacttacttctgtggggcgagaggaggacatggctgtggtccagagactctttcaaatgggcaacgttaacgccaaggccagccaggtgcatagatgcctcctccctggttgagtccaggtggcactttcacttccggagccaagtctctgagacccccctccctttcctgcagagcccacaccagccctgtccccttctttccctctccccagacaggacagacagccctcatgctggccatcagtcacggccgccaggacatggtagctgccctgctggaatgcggggcagacgtgaacgtgcaagatgcagacggggcca

SEQ ID NO: 56334 - DNA, 1227 bp, Bovine  19866880518797
taaacctcagccggtgctgcaggtggtctgactcacagtaccccccagagacacctgaggagctctgcaggcaagaggatggcccaggtcctgcacgtgtcagcccccttcccaggtcaggggtctcgtgggaaagagggcccagccttggggttggaggtggggcgtgagggacacaggccaggtcctgtgtggcctggaggagagaagggggcctgacctgagtggggctgagggtaggacacagctctatcctgagggcctgaatggggacaactcggttctgccctcgacaggctaatggaagagacagggtttttcaggaaaggaggttggtctgagttgggagacagggtcctgactcatttgggaggttggaagcacagccctgccctgggagggttcaagggggacacagggccttgccttaggctggggaggtggagaggggcctgagacttacagctgagcattgagcagccagtggtgtcccatcctttgggccaataagccatgactcacccaggggcatcagtttgccccagaaggggaccacagtgttcagaggcgctggcttttctctctacctcagggacccccggcccagcctccccgcctgccttcccctctaaagagcctgatgtcccctactcggtggagacgccctacggctaccgcctagacctggactttctcaagtacgtggacgacatcgagaagggccacacgctgcggcaggtggccgtgcagcgccggccccgcctgggctccctgccccgtgggcccggctcctggtggacgtccactgagtctctgtgctccaatgccagcggggacagccgccactcggcctactcctactgcggccgtggcttctacccgcagtacggcgccctggagacacgcggtggcttcaacccgcgggtggagcgcacgctgctggacgcccgtcgccgcctggaggatcaggcagccgcccctgccggtctgggctccctgacccccagcgcggccggctcgacgagctcactggtgggcgtggggctgccacccccgacaccacggggatcgggactgtccacgccggtgccgcccagcgccggacacctggcccatgtgcgggagcagatggcgggtgccttgcggaagctgcggcagctggaagagcaggtgaaactgatccccgtgctccaggtgaagctgtcggtgctgcaggaggagaagcga

SEQ ID NO: 56335 - DNA, 4063 bp, Bovine  19866880551554
ggtgagcttgagttggaacagttgctctccctagaactcttgccacccacctttagggagccccccacacaacacccgcctttgatcggaatatgtactgtgaagagtgggggtggggagggggtcagccggtgccctgcccccccccagcactgccctgcccctccactctgagctggggggcgaaatctatgtccgctatgggggaggggattagcaccacctccctgccaccctgcccccaaccagaccagctagaagcgggaggcagagctgggaagacccaccccattctctgccttacctgccccagggggaccccgtcatccaggctacccccatgatggtgctacaggccctgccctggggcccacacaccccctcaccaggaagccctacatcaataaagttctgtcttgtgtagatttctgtgcccgactgtgtgtgtgtgtgtgtgtgtgtgtgtgtgcgcgcgcgcgcgcgcgaatgggtcccatccaattatccccccgccctggaagcggccacaccccctcacaggtcggccccaacagcccaaaggggacttgtaccaatacagactagagcccagtaaccttaggtcaaaaatacagttgcttcttggacttccttggtggtccagtagttgagcgtccgcctgccaatgcaggggacacaggttagatccctggtccgggaagattacacatgcccgtgggccaactaaccccgtgcaccacaattcctgagcccgggctagagtctgtgtgctgcaactacagaagcggaccagccccatactctgcaagagaagctaccgcaatgacaagcccacacgcaataaggaagagtagcccccactcgccgcaactagaggaagcagggtgcagcaaagaagacccaacagaacctaaaataatctttttttttttttttttttaatacagcgtctcttagagactctcaaagcaacgcaatctggcacctgttaccccagccaccacactccctgtcactctgccatctccagccgccctggactcctgaaatttcctcagagtccccatcttcccatcttaaggcctttgctagagctgttttcctctgccaggtgtaccctcccgttcccccttcacctggttaactccagctcacttcgcggtctcagcaaaaaaagtcgcctcctcccagaagcctcccctgacgccctcaataaggtggggggcgggggtgtcgacctgactgttcacttctagtgccctggagacattgctgaggtttgcaggcaccaagcccgtcggttgagaaacgggctgctccccagatgtggccactagggggcgccgcggcactccagtctccgcgcaggatgcggtgtgtggcctggagcgcggggatacccgagtatgcaggccttcctgccaggctctcccagggtctgtttctgcctccgccacttccccactgtgtgtggcagacgacagcctctgggaaatgccatttcctcacacggcaggaggagaccagcacacggcctactggtctcccaaacatcagaagatgggccatcatttgacggatgtcatgtgcttccttggtggctcagacggtcaagaatctgacggcaatgctggagacccgggttcgatccctgcgttgggaagatcccctggaggaaggcatggcaacacactccagtgttcttgcctgggaaatcccatggacagagaggcctggcgggctacagtccatggggtcacaaagacactactgagcgactaatactgatgtgcgcgccaggcgctcccggcaggatccccagccccaccgccgccgttttaggatgagaaaatgaagagagctggggcggcgggtgcagtcattaattctagacgtaacattcaaagtctgggaccttccaaatgcccctggctctcgggaccctccactcccctggcagaaacgcacctgattcccaaggtccctcctggaagaaggaccagcggaagcggcttcggaagtgagagtttgcccagggatgcccagagcagatacacatctcaagtgggtcttggaagactcctaagcagcccaggacagagcaatcagtccgcagccaacggatccttgtcccgcctgctgcagccgcgtcccgcggggggcggggcggggcggggggcgcgaagggagttggagactcggtttcctggggtctggcaagctgctgccttccatccttaacctctcccttcgggctctgggctccagaccagcagctccctcgggccagtctgggcgctctccccgcccccaggctcagcttccctccccggtagccgcgggcccctcccgccaaaggaagtgagaagggggctgttgtaagaggaactagggccgggagtctgcaggaggagcaggagcagggccatgcccgagccgcccccaggagcttcctgagcctgcaccccttccacgacccctccaggcacctccccagggacccagacaccagcccctaccatggtaagtcattcagggtgggccctgaagtgcagcagtcgggggcaccagtcagatggaagtgcctagaggccaccaccagaaagtggggccatgggaacgggcacagcagaccctttgggattctgcagtacagctcaggtgctccaagcatcccacaccgggcaccaagctcccactggatggtggacaagatgccagggtggggatggggcaccaaggatggagcagtaaccggaggacagaaggtggttttgaaggctcccacagtgcctgcaggtgcagggacaaaccccttttctggggcgtggggaacccagttcctagttgagtttggtgcctcatctccgtgtggccttgggccagtcacttccccctctgcgggtctcagttcccacacgtcatatttggaagtctctcaggatgtggaaggtgtttgggggctcctctccattggaaccttcagagggtcttgggatccagcctctgtgagtccaccagagctgggagagaaagctgggtcaaatgggtggtgggttgccatgatggtggcatgccggcatcccagtgtgggtgacagggtggtttggcagtagtcatcacagaagcgggaatgggtgagatgaaacattccacaccaccacgggttccttctgctggagggcagcagggaaaaaacactacacccagaagcctcaccacctgctgagactgaggtctgatgatgactgtggtgataaggctgtggagatggtcatggtcctcggtctagatccagtagcatcatgtcacacgcatgaagaggagacttggctggctataaatgtcacacctccatcccccgcagccaaagttccatggctctgcaagccacttcagctttcattttttgtcaatctgtccatgagggcgtgtggctggggtcagtcacagagctaaaagtgacaactgcagagttgctggcagttgccgcaatgtggaggcaggggttgtgagatcaccctacttcagaaagccagtgataaatggggcaccacgggccaaggacccctctggttaaccggcaagcaaaccatcaactagagctctgggcttgagacagaagcccttccaagacggagccagcccaggaagactccttgatcaaagaagcacaggaaataatttgctacttcagagaaaagcaacccctcccaaggaaaccatgtgaaatgctgagtcaatgatctgcttggccaactgggtctgggaagggagaaactcacccaagaggatcatgaattaaaaaaaaaaaagagtggaatttatccatgaggttaatacctctgtctagaggtgctgacatctttctggaggaatgctggatgccagaaagaggtgttgaaagattcagtgaaatgatgttcgtcaagtgcttcacagagcacataatgtgctccatacaccgcagaagccatattcacagtgggagttagccatggtgatggatggatgggcttcattcttggttcctgtagaagaattgggctgtgatgtcattgtt

SEQ ID NO: 56336 - DNA, 1699 bp, Bovine  19866880607942
cctgggctcttctgccccggcctcaaagaatggagagttggaagcaggaccagcggatgaatggagaaggtggtggcagaagaccggatcctcaccagacttttacactctccccagactcagctggaggctcagaacagcaggatccagcaactcttccagaaggtggcccagcagcagcggcacttggagaagcagcagctgcgaatccagaatctacagagccaggtgccagtgcttgctccagatggggaggggaggttcaaggtggacccctgtggggtctggctgtggagccaggcaggttgagcagcctgaaccagccagacctgacatcctcctcctggtcctgtcctagatggatcacctggcccccaggcacctgggccacgagatggccaagcccgccaggaggaagaggctgcccaagatggcccagcttgctggcccagctcacaatatcagccgcctgcacagtgagtgtccaaccttttgctggactctagcaaactccccccaacccccaccctcattccccgacttaccattctttcccctttccttgttcggtccaccttactgagaaagagagaggctctggctgtgcatcctcgtgggaggacaggtctctggtgaaggggtgaccaggacatcccccctcttcagcccttacccttcctctctgggctcccctcaaacccttcttcccagaaagtcagtgggattttcccaaagcctcgagagccactaactggagcaggggttgggaaagtgggtccaagagggggttgagctgcaagggtgtggggaaagggctggcatggctcagggacaacttcctgggggttagacccttgcaggagggcgggatggtggacaaaagggtgccagtttgggagactggagccccccttgggttaaaagagaacggctgctggggagggggatgttctgacgtttggggccaccaggtgtttgttgttgtttgtttgtttgttttctgcatcacttggcatgtggatcctagttccctgaccagggattgaactcacgccccatgcactggaagcacagagtcttaaccacaggccggccagggaattctgggccctcattttagagtgtggatctgggaagggagactaaggcagggaacccccatctccccggccagtcacaccattcactcttgcatctcttaacaagtctgggccccttgatccatgcaccttgcctggctctcacggctctattgacctggaagtgctgatcgccccttctcaccctgccccgactcctacaagttctagatcctttattgtgtgtgccccagagcaccccacatctccaaaccagcatgtctgtaggtgtctgaccctggctcccagctccccagtgtctctgtcccaccctaagttcacaggtccagacctggctgacttccctgaggtcctcctaccccatccccccactggcatctgcagcagtctacagccaaccgggtgaaagttcgaatccccctcttcacacccgccctcgggctggttgctggcttgcagccctctggtcttgaaggctctcccacctcttggtcccaccacctcccccaccaggaaggggaagggtccgctacaccctcccaaatggtagccctgccatgaggggcttcgggaggggccagcaggcaaaggtcccacct

SEQ ID NO: 56337 - DNA, 1917 bp, Bovine  19866880878643
cttctcgcccccggccccccggaggcagcgtcggggcacgggacctcaagcagagtcccgtctcttctacaaggtggccgcacccagcacccacttcctgctaaacctgacccacagccctcgcctcctggcggggcacgtgtccgtggagtactggactcgagaaggcctggcctggcagagggccgcccggccccactgcctctacgcgggccacctgcagggccaggccagcaggctccacgtggccatcagcacctgcgggggcctggtgagtggagggttctgggagatagggaggaacgcctacaagcttgggagttaagaaaaacacttatataggtcacagaaggaatcacagtggcaggggtttttattaattccaactttttttttcccctctcttttttcctttctgtctttattcagctgcgccaggtcttagttgcagcacacgggatctttaatcttcatcgtgcatgccgcatctctagtggcagcacgcacactcttagttgttccatgtgggatctagtttcctgaccagggattgaccccgggtcccctgcctgggaagtgcagagtcttagctactggaccaccagggaagtccccttccgtgggagttgttgaaacattttgagctaacccagaggattagctattttaagatgcagctaaagcaggacttagaagaaaatgtgtagccttaggtcaggctgaaaattaatgggctgaacacccatctgaagaaactgaaaaggcagtagcaccgtaaaccaagtaaaacggaatcaaatcagaacgacagagatagggccccaggggtcccgggacccggaacctgaccgaaccttctgtcccactttcccgacccccagcacggcctgattgtggcagatgaagaagaatacttaatcgagcccctgcaaggggggcccaaggggcaccggggaccggaggagagtggcccccacgtggtatataagcgttcctctctgcgtcaccctcacctggacacagcctgtggagtgagaggtacagctgtctgtctggggctgggcagaggcacaatacctgtgcctcaagatagaggtgcatgcccggcgtccctccacctggaaggtcagctgcgtgcagggagcaatgcagatggtcagcagggcagtaggcagtggacaagcccatctgtcacttccagagtccgatggcccaacagtgagtgagaaaggcagccggatagccagccaggtgctgtaaaaccatccatctgtgggattatcgtctgatcagacagttaagcagcgggatagtggtagcagatactggagcagttgcacaatggaaaatgtcaggagaacttaaccaccatttgggagatcagatttacaaccagatgtgcagggggacagttataacatcagatatttaagggatgggaaaggaagtaaagtgttagttgctcagtcgtgtccagctcattgcaaccccatggactatagcctgccaagctgctcagtccatggaattctccaggcaagaatactggtgttggtagcctttcccatcttcaggggaaccttcccgacccagggatcgaacccaggtcttccacattgtgggcagattctttaccatctgtgttaccagggaagccccaagaatactggagtatgtagccattcgcttctccaggcgatcttcccaaaccagagattgaacccaagtctcccacattgcgggcagattctttactgtcttaagccattaggggagccagctggacatcagtgattcaccaggatagtcatagagctaaaaacaataatctctgtccgtgaaaatacagaccactggaatgttggttagttgcatagctgacagtctcaaagtagcatatcgtggcagacacacaac

SEQ ID NO: 56338 - DNA, 1099 bp, Bovine  19866880910953
cagactcgagtcctggaaaagtttggcaacctgacctccaagaaacaagagagaccgagttcttaagaggggcccagaataggaaacaaaaagaaatgaggacaacagcttgtatcaatcaagagcctactgagtgctggggctcaggctatgcctgccgcccagatcttcacagtagatattagtatttccattttacagataagccacccgatgctcagagaggtcaggacgcacagctagtaggtgctgaaagtggaactccagtctggctaagccttcctgctagcgtttgtctttctgactcaaacccccagctcagcctgtctacttgtcctccatcctcgaggcccacccaacagctgcctctgcccagaggcggcctgaaagatgtgcacatctggcctcattccatactgtctgaaggcaccgatttgagcatcaccactggaaagtggatgtgtggaggctggaagctctggagccagtggtcagaggggaggtggatgactgaggccactctgtgcaatgaccttgaagccctgagccatcaccatcccatgtggaaactccccagaaaccctggcaggtttgaggaaacttggaagcccaaggaagggaggcagagcctgggcagaaaccagtggggttaggcatgatattatgtctacataataggtcatctgtctgtgctaaactttctctcttccctttttgcttcagtggaacaacagcatcactcatcaaaccctgactacatgccaagttgtctagctgtcttccctcccaccacagctttgtgacaggtactattagaatcccattttacagaggcgggaactgaggctcagaaaggtccagagtcttgatcaagatccaagacgggcgccaactctgagtgtgagtcagccagctcatcttgtatgaatttacaggaaggtgctcgggtgagccctgcatgcagagagacgcacgcccataagtgtactgctaacctcaacaagtacctgcaagctgcctgtttaattttatacagtaaacaattataggggtaagtactatgagttaggtgtatggtgagcactttagcaattcactg

SEQ ID NO: 56339 - DNA, 1522 bp, Bovine  19866881072377
aacactggagtgggttgccatttccttctccatgcaggaaagtgaaatgtgaaagtgaagttgctcagtcgtgtccaactcttagcgatcccatggactgaagcctaccaggctcctccatccaagggattttccaggcaagagtactggagtggggtgccatggctgcagagacccaattgagcagaaggaacctcatgaggaatgggggagatgtgctccaggctgcagaaacagcatgtgcaaaggccctggggtgggagcgtgtgttccacacaatgggtagtggggagagggtgagctgtgtggacaggccggcttgccctcccactgttctcttaagagtaggtcctaggagggccaggggctcttccaggagcccccacctcagctcagtgacatcaccccttgtagttctcagatgccccatgccaagctaggctgggcatggaggagtctggagggcaccctggtaagcagcaactgctctgggaagccgtgtggctcccaccacacttggaaataccttgtgtcgaccccgacccactgcactcaagctgagctctcgggattggcccacaaagtcccccggccaggtcaccacccctccttcagggccactgtcctcctcctttaactcccttctctccaaccacgtgggcttgaccaaggacaccaagctcctcctcaaaggaggcctcagggcctttacacctgctgtgccccctgccaggactgtccttccccaagttggggctcctcattcctcaggtctcagctctagggtcacctgaagtaaccaaaacagggaaggggcacaggacctgtcagatctggaacctcaggcccagttcccacccccatcagcagaagtggccccagggagaggagagagggtcctccctctagagaagccgcttccccagcccactaggatcctccaaggccatttcctccttcggccccatgtctgccttcctcccttctcccaactccggcctctggctcccaagcgtacctctgtgagagatcgggaccgcttctccactgcaaactctgtatggcacagctcgcagtagctggtgttggatgaggaaagccacctctccagacagctcttgtgcacagcgcccagcgtgccactgcacccacatggagacagtaggctctccccatttgccccctcatggcagatccggcagaagggaccatcgctagacacagagatgggacacatgagtaatggttgagcctcctgcctgctcctgcttcactctgccctggatcgtaagctcagtgctgcccctatatactgctttttggcaaacccctattcatccctcaatgcccagctccaaatgtccttttctcttggaaagccttcccagactcccacaggtggagtgatgtgctccctccccagggttcctgcagcatcgttttaggcccagggtgggcatcacttgtacctgcctgcccagtgtctgctcctccttctataccaccactctaactggggttg

SEQ ID NO: 56340 - DNA, 1144 bp, Bovine  19866881200447
tttttttctctctccgggaatttcccaatccagagattgaacccttgaaccctcatctcctacactggcaggaggattccttacccatgagccaccaaggaagccctctacacccactgaggaagaattgaaagtcttcaactttcttttacagctaaactatcattattttttcctgcttgactgctttcctttgtttctttattttctcacttttctgattaaatttgccctttggatttcagaggcctaggaggctaaaactttcaaacagaaaataggcgggggacatgggaaggaggaggaattgtctgtctttgggaagttcccctcaagggtcctgctcaggttcaccaaagtgaatttaaccaatcccctgttgatggacactgaggttgtgcccatctgtgggtatcacccacggggctggagcatcaaggtccttgtctttatttccccgcacgcatgtgcaagcccctgcctgtaagacatttcctccaaggggacctacctatgatgccagagatgccacatcacttagtcaaactgtcttcttttacttgctacccaagtcatgcacagtcacggagggaaaagtaacagtacaaataaatcaaggaaccaaaaggatgaaacccaccctctggttctcatcatcacacccaccaaccttcagggagaaccgcacatgtacagcatgatctctgggtcccagacacctcaacagccccacctccaggaaggcacccaaggttcacctacacctccaaactccttctcttcccccacccagggccttcctccggatgctctttcccgagaagctggacgtggaaaagaagggccgccccagcactgccggttccaagatcaaggtggacatggggagggacaggcccagttctaccattcctgtgtccatctctccccatcgcagagcctctgcccctccctctggcatctcctattcaacaagggcttcttccagtgctggggttgggggagcttggaccagcttccttaatgtcctcctaaccccctaaatccatacatgagccatcatcctaatgattttttttttttttttggtcttttggtcatttgtcactttcttcttcgttatggtaaaatatacaaaaagtca

SEQ ID NO: 56341 - DNA, 1012 bp, Bovine  19866881364485
agtagcatatcgtggcagacacacaaccacagtgggttgtactaacagaaaagtggtgtcatagttggatgaccagtgagacagctgatcagaaaagactgtcaggcagggggattattctacagccagacagttgggctgcagggtgagtaaaaagttgcccagtcagaaggccagggagccataccagcacacagttttggcagtagagcaggctgctacacacctctatttgggcagtagaattgtcgggaagctgcatggtcatgttaattgtcatgggatgctgggtggctgttcgaccaatgagtttggcagtggggcagcctcaccactgtagaaccaagagcaaaagaatgaggtgtttgacaggcagatgaaccgtcagacagggactcggacagctagagaaagcagcagaatgaccagaaattgcccatccagatgagaaaccgtggaaggggcggccgtggtggctgcgcaccctgaaaccgccacctgcccggcccctcgggaatgaaacagagcgtggccaaccaggcctgaagcgctccgtcagccgagagcgctacgtggagaccttggtggtggctgacaagatgatggtggcctaccacggacgccgggatgtggaacagtacgtgctggccatcatgaacattgtaagtgcctccccctccctggacatggacccccaaaaatgtggagcccacctccagagtcaggaaaagggctgtcaccatcccccccatcactgatcaaatgccagtgaaacagaatgggaaggggacagggtgcctcagaaagaaagcctgttagtgaaagtagcctagcacagtggttaggagcatgaactcaggagctagccaacctggccttaaatctcagctttgccaatctttgactgtgtgcccttgggcaagctactttgcctctctgccttggattacccacctgtaaaatgggtttaatcatagtaccaacttcataaggctacgtggatacagggaat

SEQ ID NO: 56342 - DNA, 749 bp, Bovine  19866880071296
atttgtaaggcctcctcagacaaccattttgcctttttgcatttcttttccttggggatggtcttgatccctgcctcctgtacagtgtcacaaacctccatccatagttcatcaggcactcgtctatcagatctaatcccttgaatctaatccctgtctatcagatctaatcccttgaatatttactaaaatattttagtaaactgtaaattattccttaaaactataatccattaatatgtaaattatgacagatatatagataataaataagaaagaaactggacattatagtgtttgctgtcatgattcagttgtcaaaagtggaactcctttaccagatgatgctacacattgcatatgtttgttttctatttggtaggtcccagcacactttgaaagtcctgcaaggactcagctacagaaggttcagcgacagcaagtaaaacccttcatgacccttgacccccagattctcaaccaaagttttaaaaggtcacatcctcccacgccaagcagtgaacttttggtgcagcatggacacccgtctcccgagagtgacactggtctcactggaaatccactcaccaagttgctaactcttggcaaagaagatgacaatacagaatggcatgtatgtctaatgactaacttaagaaaatatatagtttttttaaaaaaaaaaaaaaaaacaacacttcaagaaatgaagtcaatatttttatagtaaacattctatatgcaaattc

SEQ ID NO: 56343 - DNA, 1134 bp, Bovine  19866880351454
tcaccttcatcaagaggctttttcgttcctcttcactttctgccataagggtggtgtcatctgcatatctgaggttattgatatttctcctggcaatcttgattccagcttgtgtttcttccagtccagcatttctcatggtgtactctgcatataagttaaataagcagggtgacaatatacagccttgacgtactccttttcctatttggaaccagtctgttgttccatgtccagttctaactgttgcttcctggataggaagacctaaaagcctacccagggtcttcatcattctcccattcagtgtcatgaatggttaactcatgcaggcctgaattggaaacgctgtttgatgcctactgactttttgacagacactgcacaatttacataacctctcttaacctcaagaaataatagtaccttatgcatctgcccttactcccctgcagttcttttttcaatacagcagccaaactgatcctattaagacacttaagtcaaatcaatttatgactttgctcaaaactcactaatggcctttcatctcactaagaacaaatgttggtctttataaggatctgcaaggctctatgtgattggataaatgcttgacctcattttctatccctctccgtgttcactctgttccagttcaccagcctacttgctaattttaaaaactgcccagtggaaaacagggtataaaaacatgcttggtttctgtctcctcagcaccattattatttctgataatattctgagagcttccataatcttcagaataaactttccccaggtggcgctagtggtaaagaatctgcctgttagtgcaggagatgcagagatgtgggttcagtccctgggttgggaagattccctggagaaggaaatggctacccactctagtacttgcctggagaatcccatgggcagaggagcctgatgggctacagttcatggggttgcaaagagtcggacacagctgagtgactgacacttttatcttgagtaaaagtgcttttaacagatatagaaaccatgattccaagtggccaactaatacttagtttaactggatgacaaatcacacaataactttgatacagagttcaagagagttcatgatgt

SEQ ID NO: 56344 - DNA, 1235 bp, Bovine  19866880389898
taagcccaggatgaaatatgagtggcagtaatgactggaaggaacagatgttgtcataagacatatatttactctatgcatattgactgagggtccagagtgtgccaggtcctgagtgaggcgacgagtttacaaagatgccaccaactgagacccttcttcaataaactctcagtctaatgggagaaacatatgcaaacaaccgatttccctacagtggaatatatgaatatgttagagtggtaccaaaaaaaaaaaaaaaaggaggaagtccaactggctcaggagcaggcaagtgctgagacaggagtgtggtgtgggaattgggtatgacagaaggtttggaaatatcaatgagctggaaactaggggtgagttctaaaaaggcaatggataaagaggttcttggattttaacagaatttgtaattacatgcttaattttttactgtttttttttttcttaaattcttccccaatttgcaggtcttagctgaatttgaattttaaaaaagagagagagataaagagacagtctttaaggaaaccaagtgtaaactatatgtagaaaagtgaaaaaagtcttcagttatgtaccttatttacacatagcaaacatggtaaatttaccctttgaaataattttgtgtgcttcacacttatactgtttcagaatgaaggtataacagagcaggtttggcttgtttctttctttctttctttctttttttaagcatctatttgcatttgtgaatgacacagcaggcaagtatcatcagagtatgtagttccctgaaacagtggaaacagtggcagactttattttgaggggctcaaaaatcactgcagatggtgactgcagccatgaaattaaaagacacttgctccttggaagaaaacttatgacaaacctagacagcatattaaaaagcagagacattattttgccaacaaaggtccatctagtcaagactatagttttcccagtagtcatgtatggacgtgacagttggactataaagaaagctgagtgccaaagaattgatgctttttaaatgtggtgttggagaagactcccatggactgcaatgagatccaaccagtccatcctaaaggaaatcagtcctgaatatccattggaaggactgatattgaagctgaaactccaatactgtggccacctgatgtgaagaactgactcatctgaaaagaccctgatgctgggaaagattgaag

SEQ ID NO: 56345 - DNA, 981 bp, Bovine  19866880401118
gaactgcgtgtcggctcgccaacagcagccagttatggcgatgccgccacaaagtttgcatctccagaatgcaattcattttttaaaactagaagttcagagccttttgtttgccaggcctcaaactagtaccagacctaatgtgtttcttctttccactatacatatttactcaagggatttagagtgcctgactagaatcatttttccatatgtattatagcaacagtgggctctttagtaccaactaaatgaagcttgaaaaactgttatatgaaagccaagtattacaaaggtagaagtaacagcaggcctgacttttctaatgttgaaatcagtctcggttgtttgtagttacagtatgggttagaccagaaggatagcaggatttactatgtctatctgcagatttggccaaatttccagaaaacaaaacaaaacaaataaaaggtttacagcccccacaatgaggaagtttctctctcaagaggtttttttcctttttctttttgtattatattatgcagaaagtatgtataatgctcccaggaagagcacagaaggaagcacatagaggtttcctgttgccaagacaattgggtgattggtaactctttctggaagatctcctggagaaggaaatggcaacccactccagtattcttgcctggagaagctcatggacagaggagcctggtgggttaccgtccatgcggttgcaaagggttggaaatgacttaagtgacttagcagcagtagaactctttctggaagcaaccctgggtcttccgtgactccatcgtgcacatctctcccagaccagtgttcctgcaacatcttcattatgtcgctcccctgtgccacgatggacaaaagatttagggcttcccaatgtgcaactccaccatttaatctccttgtttgagtgctgaggacatttgtctctataatctgtttccactgcatttatgcaaaattttc

SEQ ID NO: 56346 - DNA, 1416 bp, Bovine  19866880429313
caaaaaggaacaggtaaagttaattgataatatccagtatttaactcatacattcaaatgccaatagaaaatctactttaatttctaaaagaaattccaggcccaataaaagccttaacaaatcaaaagttcatttttagcatatctttattccagatttaagaatgacttttatataggttcatagaccttttttaatgcatgcatgcttggtgattcattagaatctcaatcatccctcccttctgccaaccatccactaaaaaaaaatggaaaaatcctataatgtttttaacctccagtacagggtactcatacatggatggagttaaaatctcaagaggaatatcctgaggcctttataaaggcaatatgacaactaggaacaaaattcagaagtaatatttaggattaggggatggtaaccttactgtgtgatgtttgactaatgtctagtatatataactgtacttgtttagatttatttgagaagctaaacctcttaattctatttattccatttatgcaaaatctgagtatcagtcaggctagtgttggataacaggctaatgttgagcaagataccattctattatattataacagtgacaacttctcttttccattttacaaagtatacttaaattcatctgcaatctgtctccacacaaatatgaccaccaccactaaccatacacacagtgagtcacccatgttaagggaccaggatctcaggtatgctgtttattctaaatacaatgcacgtctttatccagtaagagatcagagtatgttccttttaattcaactttaatggaaattttatcctaccaacacatgtaaccatttaattctttaccttattttgactggggtcagaacagctttactaagtgatcaagtttctctatgctttggtctacaatgtgaaataaaacaaaagatggtcaaacggcacacatccaaagtttttaaacgttgataatcattttttataaactggataattttataagtgaaatgtcttgtattattaaaacttagaacatctttatctaggggaaagaacattttctgttatacccgttagaccatacaaatcagcacagtatgtctaagcttttcttagctgatttgaaacaattcagctgtgtcaggtggaaaggtcataagagagtctcacattctgggtgactgtgtgattggtgaattaaaagaataaagtgttaaactgacattcacaatatattttcacatttatatttttgtcttttcataattcctattttattggttcttttgctttatgataaaatgcagaatggaagaaaagtgtctatgaatcacaaaccatgtgctctacttacaacaataattagttgtcaaatttgcagtaagcttattaacttctttggg

SEQ ID NO: 56347 - DNA, 1666 bp, Bovine  19866880447037
ctgtcatccccttctccttctgcccccaatccctcccagcatcagagtcttttccaatgagtcaacccttcgcatgaggtggccaaagtactggagtttcagctttagcatcattccttccaaagaacacacaggactgatctcctttagaatggactggttgaatttcgcttgcagtccaagggactctcaagagtcttctccaacaccacagttcaaagcatcaattctttggtgctcagctttcctcacagtccaactctcacatccatacatgaccactggaaaaactgtaaccttgactagacagacctatgttggcaaagtaatgcctctgcttttgaataagctacctaggttggtcataactttccttccaaggagcaagcgtcttttaatttcatggctgaagtaaaagattaatttctttctatgatctgctcttggacatctttggttgccgacaaaatttttcacctttccctcatgactggaagtgatgaaagatgataaggtatttgtatacaatcttctctgtcatgaaaattaagcaatatatgcaacatacatatgtgtatatgcaacataagcattgcatttaaaaccaccacagaactgaagattttgtggtggaatctgacattgagataaaaattgattgaaactagaatttttataaacaaatttctgttatcagtcttcattaaaattaggcaactctaaaatattttgttagttatcccatcctgtgtcacatgtgtttattatgtgtaatgtgagactcaacatcaggccacaatatctatcttgtcaatgccttcatgcagataattcttggatatccaacaagtaagaggtcattagaaccattttctgaaatgatgttatcatgtctcacatgaaaagacatcacttatgggtagataattcatgctgctgccttctgaatatctagggctcctcagcaatcagtttaaaacatgatgctcttggatcctatgtagttgattatgacacaacaggaatcaaaaaactctgcatcttttttatttccacaggaggtagcccaacatgaagaatgtgggctctacagtgagaaagcatagggtgcccttattttacattattattccacatctgcagacaaatgatggactaaacactttgggaattatactggagaagggaatggctacccactccatttctcttgcctggagaataccatggacacaaaagcctggcaggttacagttcatggggtcataaagagtcacacattaccgagagactaagcatgcgtgcacacacacccaagatggacgggtgttggtggacagttctgacgaaatgtggttcactggagaagggaatgacaaaccacttcagtattctttccttgagaactccatgaaagtatgaaaggcaaaaagatgggacactgaaagatgaactccccaggtcaataggtgcccaatatgctactggagaagagtggagaaataactccagaaagagatggagccaaagcaaaaacaacgcccagctgtggatgtgactggtgatggaagtaaagtctgaagctgtaaagaacaatattgcataggaacctggaatgtttttccataatcaaggcaaattaaagggtcaaacaggagaggcaaga

SEQ ID NO: 56348 - DNA, 999 bp, Bovine  19866880448415
tttcccttgtaggtcaggctacaagctggactctgccctagatcttaataggagctagtgacatagaagagtacggagcatgaagagagcacttcaagcgtgggtagtggaaccagcagtggatgtgctcactttgcaggggtagcaggcagcattgctggccccagcaccccaggttcagctgtgggggtgccagtggggaaaggtgggctgtccgcacccaagggcgatgacagcggtattttcacaggacaaggtttgcaagatgatttcagttttgtccttagctacatgtaatccctatatctagttgtctgatcataccagagattttgagagctgtatacttgagatttatttttctcttaaatcatctagagtttatttctaccacctacaactaagaaacttctgtgatacagagatataacacttttagtgttcttttcaattgttttttattgttaagcagttggcttcctgttatttttgcagctaaatagattttctaaatgtatcaactaatatctcaacaagcatgagtctctagtatctaaaaggcacatgctgttgcaactaccaggaatataaaacagaaaatttctaatcaggaaacaaaatttctaactttggtagagataaataaattttaaaagtactaatttccccatatagacagtcaacagatttacttatataatggtatcttaggcagaagtcataacatatttcttcatacagtggaaagagttatttattatcactttctttaaaagtcttatctaactaagacttaatgctcctggttataacatggtctttaatgagttcttttattttattctaattttgaggcactgcactccctgatttaacctggggctaaaattgagtatcgaaattccagtgtggtttctggttcatcagaaaacacactgagctttccccaaaggctcatttctctatgtttataacagaggaggaggaatacaggataag

SEQ ID NO: 56349 - DNA, 3629 bp, Bovine  19866880467552
tctgtcttataatctataaaagaaaaaaaaaatcgaatgcaactggatgacctttaaagtaatgagagaaacattaaaatctgtttacctagaattttatttttcatgagaaatacccctccaaaatgaaagtaaatgaaaacattttgagataactttaaagttatatttaggataatagaatctaaaaccagcagatcagtaggagaaatgttaaagttcttcaggcagaagggtcaggatatctgatggaagttctgatcttcagaaactaatgaaaacctctaaaaatggcagatttgtggaaaattacaaaatacaatacgtgtttttcttctctcaatttaaacatttaaacattaaaaaaagcataacttgtgtggcttttacatctgtatatacacaagatgctagcccaaaggacagaaggcaaatggaactatgttattccaaatttcctacaatttatgagaagtagaatattaattctgaatagactctgataagttaacggtgcataatgtagtccctggagcaaccattaaaaaatgcatggaaatagctaaaagtcagaagaagaattaaaattgaatcccaaaagtctgtcaactcaaaagaagacagaaaaggggaaagaaagaaacaaaaatctgatgagacaaagcaaagaaggcaaataatggttcttgatgctttacaaaatctgcgaagtttttatttaaatgatcttttcccctagaacttatagcatagtcgagaggaaagtgaaccaaagataaaactgtgagacagaaaataagctgcatccctccctctaacaaatgaatctttgttagtgaatcaagtcttgtcagtttgactgcaaaatacctcccttctgactcactaactagtcagaggttctcatgtctcttctacacgtagacttctggtgagttacttgtttgcaaaacaatggtgagtttgtcttaaaaccaagtgagggtagagtataagctcaaattgacaccactggctttactagcatactaggagtaactcttgtctcattcctcatggcagtacattcaataaacagtaaatcactaggttttgtccatatttccctccaaggaagataatttacaaagacaaattctctatccttaaaacccaccacattagtttgggctttactgttgtctacctgaactactgtagtatcttcttaacacatttttgattgccaacagcaccaagtctgacaaatggggtcagaatgtaagtatgtacaattgatttgaaaaactgtttggcagttactaaacatgtaagcctctacctatcacatggcccagatactcctctccgaggtatttacccaagagaagtaaaaacatgttttcacaaatacatgtaaacaaatatttatagctagcgcctttattcacaacagctaactgctggaaataccacaaatgtccatcagcaggtaaatggataaacaaaatgtgctgtatccatacaatggaatactactcagaaataaaaatgcatggactttttttatacatggaacaatatagatgagccttgaaagcatcatgctgagtgaagggagcaagacaccaaatatagatcatataattgaattttaattcaatgcaaaagcagatcagtggttgcctagagccatggatagaaaaaagaatacatctgccaatgcaggggacgtaagaaacatgggttccatccatgggtcgggaagatcccccggagaagggcatggcaacccactccagtattcttgcctggagaatcccatggacagagaggactggtgggctacacacaattcatggggtcgcaaagagttcgacaacctagcaactgaagcaacttagcatgcccgcacctgctctcggtgcctgtacctagggcataatatgaagatcagtttatgttgtggttattgttcttagcagccaacttctaatttacttataaatctgtagtgatgcaggctctgacttggaagacattatgatattaaatagagcaggccccatggttcatttcttcaatctaaactttaagctgatttgttttgctttcatttgtctaccataattcctttaggatatctattgctctgttgctaattttaactgtattcgttgttaagtgctctaggattgcagaacaaagggcactgttgcactgtgagaatgtattgttctctgttatattccaaagggatgcgttaatggcagagatttaagctaagctcaacatgtttagggttttgttttttatttccaaggtatctgcttctttaaaagaattgattttgttccccaaatttgaatctcattcaacacagtaatattttagaaatattcatttaaagcttctctcgtacagtatatccgaatgataaattacaggcaagaatgttgtctgcattgcatgctctctacacattggcagagccacataacattacatttgtgttttccaagatgtgtactgacactactgtacatatttttatcaataatttagggtatccttacacaatcaccttttaaccctatacgttcaggactgtgggttgctattttaaccagctaaataattcactagaaagaacaaattgtttcactgactgatctgaggattcagccataaaggttggactgcaacgggcacctgatgttctgcatccatccaataggctcaggtctagggaaaagagaaagggcgacactgagagcaaatcactgggcctctaaactcccgagagtctcaaattacagtaagagagaaaattagggtgtttcttctgtttccttattagaaagggaccacacagagtgaacatcagtaacaaaatacaactgtgaaaacaagattttggcaggaaagagaggtgtgaggaggaaggtgagaagggcatatttggaggtattccacctcattttccctgggaataatcggtgagccaactacataaatcaaaaaaatgcttgaaaacattcattatcttggaagaccatttattacacatatatgaggtcaagcctggtgctctataaaagaacaagtgcccatgttgtaagtgtgcttgaattatcaagaaatgaaatagcatgtttactttttttcctaaaaaggaaaaaaaacccctactgagtaatgtatttcataactcatttgagtaaaattccagaaggcattagttcttccttgagtacttaaaaaccaaggacatgagaatatcatttctgaatatattattaaactttatttagaaaacaaagcttgttttctcaaaaaaataaataaaaggcatttttctaacactgtagaattttccatatacctatgaaaatgcagggtactctaagtgcatgctaaaacagtttgaaaataatttatttcttatcagtatattccagtgacttgtttcataatctcatttgatatagaattcagtgaggttaagtaatggtggtgactacctatataacatggtcaaaatattacttctaaagtggtaaatgaaaactaaaatatcagacttgagatgaaagtcatgtctattagaaaaggtaaacattagctctggaagaacgaatggaatgttt

SEQ ID NO: 56350 - DNA, 975 bp, Bovine  19866880474481
ttattaaagattttagtttataatattggttgatgactgaatttgggtgagacacaaaataaatgaaaatgaatatttgacctagatttttagaataatgcagatactatttaagttcacgttatatgtaggtattctattaactatcactatcatatgtaatgataactttatgactttgtaattaaaatcattttgccctgcaaaaataatattatatgcctataatcacctggaaagaacctttgcccttttatcatttcgaaaagaaggtcatttagatgagaaactgtaatatgaatttggaaaggactggtacagtggattaatgcactggctttgtcatctctggaggcccgtgttaaaaatgtgacttaggacacttgtgaaatgaatttgatggtagtgatgaaacccttaagtgtgccttagtatacagaattatcttaaaacttaaagatgcaactaattaacaaactggcctcaaaacagcaaaagtctctacttcagaattaagatatatttatagctctttctgaggattctgatattttcaggaagcataaagcccttacacattatttatgatttgagctaaatttgaaatggctaaattagagagaaggtaaatttaggtccttatataagagttctttggtttcttattttaattgtcttagatcgcacaggaactattaatattagcttaggtttcagttagataagtataaagtagagtaatttgccaatacagccaatcaggcagattcttctccaattctgtaatttttctgtggattaggtagttttatataagttggaaaataaacactcatattttcgttttatcaggttaaacacaatcgggggaaagtagggtaatcagaatttagtgaaatatttaaccgaatggttattggggttggagctaactacttccagtctattatttgtaaattctaggacaagtatctc

SEQ ID NO: 56351 - DNA, 2600 bp, Bovine  19866880508434
actcttttgttgactatgagggctactccatttcttctaaggcattcttgcccacagtagtagatataacggtcatctgagttaaatttgcacattccagtccacttcagttcattgagtcctaaaacgtcaggtgttcactcttgccatctcccgattgaccacttctaggtttaccttgattcatgaacctaacattcgaggttctgtgcaatattgcaggttctcatgcaattccagtttcctatgcataatccatcatcctggcgttggacaatttttctgtcctcattcaaaatgtgactcatcttagattaattggcaaccaacttttcagatttttcaagtatcatctttctatctctctctattttctccttagtcaattttctagactgagatttcactgaaatatccagtagaaatcaaaactaaaaacaaagtaaaaataaaacaaaacaaaacaaaaatctggacttagtcctgccagtattttcctttacctgccaataatttcagtatagttttcactcatattttaaaaaaaagcaatgtaggcattcatgacactgagatatttttaaagtgcaattacattcaaaagctacagttcccaagaaagtatttcagtttttcatcaatttaaaactaaaatagttatgaatttcaccctgcttcagtctcctcatttgtaacatggagacaaaatttgtaaatatcttatgatttgggggactaaataaaatagtaattgtaaatgcttagaatagtgtgtggcaacaagtgcttaataattattttcttctgttattataattaataacttacaaattcaagtaacccaaaccctgccacagttttttgaccttcatatgagtttctcactaatcatgaatttcagttagtaacctaagaactaaatattgcatgtggatttttaaacatctaggtgcccttaaaattgaaaagcaaccacaaacacaaaaggaagaaaaggaataagacactggattaatgaaggaaatgatgctattggagactctagtggctacacaatatatctgccccaggcattgagcttgaggctgtttttatgttttcttccatcactttttctctgggtttatgcccacatgtaaatgcaagatcagtccattctcctctccattagtgtcttgacagacttgataaggctattcatgctgttccctagagtttaataattgccaaaagatgcattaaatgataacactgatggtgaagtactttaagtcactcaattctctcattttgtaacaattaatttcatatccttccaaaaacaatttcaactgcttggcacagagcatatggtacttaatattttactgacatttaaacaagtctaaatttgctggtttcattaaatagctttacactaaaattcatttaatttcaaaaacgtatgtttggcaatgaacatgctatcttatgtaacctaaagggtacatggatagtaggctgtggcccaaacatattagatatcttgctaatggatgccggaaaatttctgctctctaatatcaaaattttaagtctggggacttaaagtaaaaataaacttagatgagaaacaaactagtttctatatggcctatttgaaatatgaaaagggaaagcaaataaaattttctctacccctttagctttaattataaaaaaatattttccaactcctcatgctgctgctgctgcttctaagtcgcttcagctgtgtctgactctgtgcgaccccatagacggcatctcaccaggctcccctgtccctgggatcctccaggcaagaacactggagggggttgccatttccttctccaatgcatggaagtgaaaagtgaaagggaagtggctcagtcgtgcccgactcttagcgaccccatggactgcagcctaccaggctcctccgtccatgggattttccaggcaagagtactggagtggggtgccatcgccttctctgatgctacagtccgtggggtcataaagagtcggacacaactgagcgaatgaactgaactgaagtgaaggccatctatgttcccattgtctgtctcttggtggtataaggcccacaaatctgaaaattaaaagcttcatcttcaaaatacagcaagcaaggtaacttaaaaagctaaaagctattctttttcataaaaatgcaaatcatctagcccatagaaggaaaggccattaaggaaaaatatcaacatggccaaagtgcgataagagtgacatctggaaaatgctcacggagttgagatactctctttttttttttagcatttcaaacatttattcatttatttacttatttacgtttggttgccccgggtcttcggttttgtgcgcgggctttctccagctgcaatgagcagggcctcctctctagctgcagtgctcaggcttctcacaatgcggcttctcttttacagagcacgggccccaggcgcagggccttccgtagctgagctcctgggctctggaacaccggctcagtcgttgtgcacaggcttagctgctctgcggcatgagggatcttcccagatccgggatccaacctg

SEQ ID NO: 56352 - DNA, 1272 bp, Bovine  19866880557824
tcgcttagttataatcatattccatttttatctgcattatgaaatgctaataacaatgctattaattaataatacatattcattgaaatttagtgacttaaaatctagcttcctatttgtattgtcctttgggacacatattcagacctagcatcatatccaaatatagtgagaataagatgatctaacaagcataatgcttttataacaaagatgaggaccagaaactatacacatcctttgtctaacatgaccaagtcaagaggatgaccaaggaccatagctcggtctttagactcataacctaataactctttttctgttataactaaatctattttcagtaatgaaatgacagaacaatgatctgattaagtcaactcattctatcctagataagggatctattgtcttgcttttctttctaaggttactcactagcctttactacattactttcacatatccagtacatctataaattgatttatttagtcaaaactgtttgaacaattaacttgactaattacatgactaaattactgggtaacaagagcagctagtaaatttatgctaaaatttaatcaaactggttattgcttataaataaacacattcagtggttaaggacatattttattcttccttctattgatttaacagattcagcttttgagtgaggccatattcaattgttaaaggttgtaataaactcaggacaacgttttttacatgacatcaaataatcactttgacttgcttttcatcttttttctagtaactctggcatcatgtttcctaagaaggcagtatgttctggatttccttagttcacttctggaaatcatcatgaggaagaaaagttggtattgtttgccacctgggaactcaggactggaggagacagagggaaattgggttaatggctcacaggagacagtaaacagacaaagaaagatacaaaaaatgtgcaagaaagtaagaaaagaggatttggtgaatgtgaagtatcaccattatataattgcaaaaaaatttcagttagttaccttgttgttggctccaaggtttagaaacaatttcaacaataaaaagctatttttgtttccatttaaatgttgacctaattctatctgtgttaaacaatcatagcatatgaggaagtcaatgccaaaacaaagatatctgttacagaaaagaaactcatagcttgtaactagtgttttattgcttaaaaatgtccagaaattgttattaggagttgtcgattct

SEQ ID NO: 56353 - DNA, 1166 bp, Bovine  19866880677452
aaaaaaaaagttactcatattccagaaattctaaaaattattttcagttctcattcatgctatacactgcaatgcatactatataatagtaacattattaaatagtacaaaataactttggaatcccttggtgtcttgaataattttggtgaatgttgtggatagagaacagtaaaactctgaagtgcttatacacacaggcacctcacttacttgggtctcatttgaactcctaaaattgcttaattttacatcatgtcaaaattgtcttaattgattttcagattttaagtgtcatcactgctgtttttgttcagttgctcggttgtgtctgactctttgagaccccatggactgcaacgtgccaggcttccccatccttcactatctcctagagtttgctcaaactcatgtccattgagtcaatgatgccatccaaccatctcatcctctctcacccctttctcttcctgtcttcaatcttccccagcatcagggtcttttccactggaatgtgtttttattttactactctgtctctgcttcatcatttttctcaaaactagcccattgagatctcttgacgtggggcattattttctcagccatattttattgaaacatcaaccagtaggagaggtttccttcccctggatttttgaaactcagggtgatcttggcttttacatgatccttaaataatgatgccaatcccctgataagttgttcacatcagctatttagccccagtatctaaagcttgtgaatagcaatgattctcttcacactctgcttctgcattccaagagttatgaatattaagttgtatttgccccaaagcaaaagtatattcaccaaggtatgtgctgagatcaggagtctgcacctcattttgaaacaatagcattaataataaagcaacacaaaatatatcacatttgaaaagtcacagaaataagaactcagaatttttagtaaagttaaaaaaaatccattggttgaaagttaccctgagtaatgtaacaaaggactttatatgaggctgatgttgaattctttcaattcacaaaggattcatggatttttacactttaattactatccttggattgcatttgtatgaacttccataaatttttaaacattttagacagtaaaagtttcag

SEQ ID NO: 56354 - DNA, 791 bp, Bovine  19866880716619
taagttgataacatttaaaatgcatgttcaaataaaaaaaatcccaaatttctagcttttaataaaaataaactcagaagttttattaggtgcccaaatatctgcaaagcaacaggtgattaggctaaatcagctcagcccactctgactacatatgtagtgtccagaagaacaaagcctctgtcaagcctggttaactccttatatcacctgactggtccccataggcactcagggttgcaatctctttaaatctattcaacaaattactgaagaagggtaaatataaaaaacagggagtggggaatttaatttatattaataatattatcctgttgaaaacaattcattacatacaaagaatataacaacatttaactgatttggaattggtagggaacatcaattgcactaaatcactggaatagagggaacattcattgatctaataacaaaatctcattcaaaatgtgtttaaatctgcattttccctagttttatatttgcaaaatgatttctacttttcaataactcatatcttctgtttgattttcttttatttttctgagattgcctaaaacttttggggataaagattctgttaattaattaaataacaaagtagctcatttaagtaatcagtcttttttggtgaataccactcgactattcatctttgggcttcaatattccactgtgcgatggtgactgttaggtgagtgctagctgcctaatgtctggtttggtagcctgggcattgtctgccaggcaacaaacatgcatttatcacc

SEQ ID NO: 56355 - DNA, 5248 bp, Bovine  19866880768028
cattatatacaccttaaacctcaacgatatttaaaattttgtcagtttttcacatagcagtatttgaagcaaagcaagccaaccataattctttgtcagtaattctcagaagcatcaaatattaaacaaattattttataattacagtaatgggaaagtccatgtgatatcagaatactttaaaacataagttaaaattatatccatatattttacttcttaaaagtgattattctatcaataataagtctgtggtttttaaggcaccactgattaattctcagtttagtggatttagaggcatacagaaaaagtacatcccaggaactcatcaatcatcagctcagtcacatgatcaggagactcatttaattaataataccactttatagtcatatagcattttgtaaatctgctatctttaaatttagcagacatgctttatctgcaacaaagaaaacaatcagaatcaaggataagatttaatgtgtagtgctttaatatatgagatcaaagacagccatcattttttttttccagaaaaagggaaatttgattaccaagcttaagtatgctgtatcttaaatgaaattctgatcataaagaaaggtactatctactcaaaagtataatttctgtactttgaaaatcatctcagcaagaattatctccctctatcaaattgtagcacttgtcaaaatcaactgtaaagcatctcaagtgctcttctgaatcaacaaaacagatgtatagctatgtgaggttgcaaggagaaggaaataacagtgactggatgcccatcagtgcccttaatctcttgaacccacacttaacatggttgacacggcaggtctttaggactttcctcacacaagggaaatgcaaggatgatttttaataatatgtaaaaatatgtaaaaataattttctttctcctttgctgctagactttcattctttctttatattcttaaacaggccttagacatgtagcgtggcattattttttcctttggtctgctagtaattataagaagttttttatgatacacttggagaaactagaagatcaaactctagaagtcaaaaaggaaataatgattttatcacaggtaaaatttttgctttaatcaaattgtttttctcccttactgataagcaggtctttgtagcatgtaagaccagaagctctagagtaagacttgaggccaactctttgtttgagcccgggaggggttagttaatttctttgtgccttcgatgaaaaatggatatgataatgtactgaccttatgaggtagttttgaagattgcctgagatgcatcctgctaaggcgttgaaaacactgcctggtacttaacactcaaatgtgattcttatatttttgtctcttattcttcatttcattaatattcagatgctgtggttctctctttgtcaaatggtagtgaccaaataataatgtaccctagtgtactgtaagaaactactacaaaccagagtcctagagactatgtttatgatttatatgcatattttaacagctagcaatggaaaagctcttattaggctagctaaatatagatactttgtggtttttcagagagtgtcatccaagtacaggacaaactttgctggttgatagagacataaaccacgtggctgatgttatgattttgtggtcccatcataggcacatttagcttatgtgttgaattcggaacctaaccgctgtgtcagggccattatggtgagacaaccatctaatggaatgagagtggaaagttttcttggtgccactacagataaccaccaacttcgaaactcagaacactggctggattcccctagtcttctatactgtttctatacagtatacttctatactgtttctctgaggattttaatgagggggtgatgagaacagtatgggaaatacatccatagctccagactatgaagacaccacttagaaagtaggttttgaaaaatctgccactaagaagcgaggaagcaaaaacaagacatcacctaaggaaccgtatcccattgcaactacggatgacttttcttctctacattacactgtcctactcaaaatttaagattcaatcagtgtatgaataaatgagcatctttcctgtttttcttaccatccctagtatctctaagaaactacgttatggactgaatgtgtcacctcaaaattcatatgttgacatcttagcccccattccctcagtgtggctgtatttggactaaggaagtaatagaagttaaatgaggatcattagagtgaggccctgatctaacataattagtgtttttgtaagaagagacatcagagtgctctctttctgtttctgcaaagtcacataggaaaggctgtatgaatgtatagggagaaagtggccacctgcaacccaagggaagaggttgtaccagacactaagcctgctgcgactttgatcttggacttctagtctccagaactataagaaatttctcttgtttaaaccgcccagtctatagtattttgttatggcagcataaacagattaatacaaactattacatgtaaccttgattgtttttattataattatcaaagtattttctgtactctctcttataaagcatcttgagattgggcccttgtttgtttcaggattagggttagccaatgacttgcttaaaaaatagatgaatggatgaagcttctttattaactgaacttatgtaactattgctattgggctttcctggtggctcagatggtaaagagtctgcctgcagtgcaggagacccaggtttgatccctgggtcagtaagatcccctggagaagggaatagctacccattccaatattcttgcctggagaatttcatggacagagaagcctggtgggctacagttcatgggatcacaaagagttggacacgactgagtgactagcactttcacttgtttttgctttcaactattgctaaaaactcactgaatatcttttgatagaagtgagttaaccacatttaacagaatattatatatatctttaagtttatcataaacaggtaaaaaaataacactaaaacctgacagcaaataatgtaaacagttttatcacaaacatgtaaatacaaatggatactgagaaaaagaaaccctttgacttcagtaaaacaaatagatgaaagttgtaataagatactcttttaaaaaatgagatcaatgtccaaaagatcattaacattcaaatttacagagattgtatttcctattatattttagaaaatagcctagcaatatgcatttagatactttgttatttacacaagtttgcctattatttccaattctagattccatcctaagaaaataatcttcaaagcagaaaaagttttgtgctaaaatatttgatttcttctgaatttatataattctagaaaagggcattgtggaacttcatgcttaaagtgtgcataactgtcactcattttaattatagaaatcaaacacagtttatcttgagatcttattctcttaactcagttgcactttgaggtgctcatttccctctcttgggtaatatatattcttggaagtctgctgcctagaaaatgtgagaaaagcccccagtctatctaccccgtggtcactctcaggtgtccactgacctatccatgcagtctgttccaaagccatcactctagtgattcttacgcaccatgacctttagaaattttctactatctccaaggtctcaacgaatcatacttcagtgttcaagcaaacacgaactttccctatttgtggaatttcaacctttcaggcattcctaggataaaaaaaaaaaaaaacagggcacagatttccattatttctataatctaacatttcctttattagtttcccaactctctctgaaattagatcattttagaagtgacttaacagcagcagactctttccaaacctgtggttctctctccaaaaatcagtccagttccttgctctctggaggaaaagaatcaatttgtcgatttgccaacctatatacctaccgatctacctacatttatctatctatcttctgtctatctgtctgtctatctgtctcccttctactttcatgacagtctcatgggaaaataagagacttggtaaagagagtctcttaaaggtgagcaagtggaaacaagttaacaatgatgactctagaatgtggatgtggcttatgagtaattttcttcttctgaagtttggcaacaagtgcagttttacttagactgcatatttatttcatttagtttgtgtatttttatttgggaaaacttgtgggatttaggactgatggagagtagaggagtacctttctcaattagcccaatccattcttcagctcatccactgctagtataattatagaatttgagcaatcttgttgggtaagatatcctgaggtatgatgctaacagagagtggggctcaaagaacttggcatttgtacaaaaggaggaaattttaataatcttgtctccatttcccactactatggccagtacattttataggcaatacattttaaaatttatattaaatccaatgtattacattttcaaataatgtattaatttatcaattatctttagacaaaatgacttacaaacacatgaaatatttcagtcttcttgtttttgttgttcagtccctaagttgtgtccaactgtttgcagtctcatggactgcagcacgccaggctcctctgtcctcccacatctcccagagtttactcagattcatgtccatggagttggttgtcctcagctgctcccttttccttttgcctttttagtctttcccagcctcaggatattttccagtgagacagatcttcatttcaggtggccaaaatgttggagcttccacttcagcatcagtccttccagtaaatattcagtgctgatttcatttagaattgactggtttgatcttgcagtccaagggactctcaagagtcttctctagcaccacagtttgaaagtatcagttctttagcactcagtcttctttatggtccaaatctcacatctgtatatgactactggaaacaccatagctttgaccatacagatctttatcggcaaagtgaggtctctgttttttaatacgctgtctaggtttagtaagagaggttaaaaatcataaaacttgttgcaagaactaaataagagcaataaaccaca

SEQ ID NO: 56356 - DNA, 1064 bp, Bovine  19866880799493
ttttagagtacatatagcttcagctgttctgttccatacagaaaaaaaaaaacagataattatatacactttaaaccttatatacatattgtttttgaaaatgctcctgacagaagatggagacgcagcctccaaaagtaaaagaaatggctgaaaaaaatgttgtcacaagggaaaaagagaaatacattacacagttttattcctgagatagggaacattgtacttggtgagagacgctagaaggagtgaatgaatgagtggtgtattctagatagaagaaagtgccaagtaaaatgaatacagtatacttgtaaagtgttcctgatggagagatagagtactagatttaagagacagttggcatttgctaaaacacttgagtgacaagtcccggagaaagaaaggaagtgctgggcataatggcagctagtgtagagagcatggactacagtttttctgcggagcaatgttgttcgtggctagtagtgatctgcagaaaatgtaagtgaacagttttgacagagcagcatgtgaaggagaataaactagccaggatatctggctgcagtgcaactgactaagggaaaactgtatgggtacaaaatcaagctgtaatctctttggaaactaggcagtaagtctgagaaatatgttctgaggtagaagtgagtagtatacatttcaactcaatagatttgtatggtgatctttcttctgtgttatggaaaaaaagtgttatagaatgctaatgagttaattacaaaaacagtatgtgaaactttgtcatttgtttaaatgatttttctctaattgatacagctgtaaatgtaaaaagcacttactgaatgggttccatgcacagagcacatgtgaaggacttggtggacttagtggggaaagagcggtacagtgtaggtgattctgactctgtggcatcaggttctagtttaaataggtcttataaactcaaagcacagaccactgaaaatgcgccacatcgaatatatgtgtagtggtccaacataaatagatttctcaatgttaatagaaacatgtcaaag

SEQ ID NO: 56357 - DNA, 2620 bp, Bovine  19866880813553
ggagaacgattatggacaacaaagatcagaatttggctttgaatttggtttgagataccaatgagatatctaactagaaatgctgatgagtatgctgaatgcttaagcctgcatcagcctgtaagagtctgtgatagggagaatcatggcccctcaaagatgttcacatcctaccccactagaacctgcaaatatgttagtttacacagcgaggggtttaagatggctagtcagttgaccataaaataagtagattatactggattattacagttggtccaaagtaaccacaagggtctgtaaatgtggaagtgggaagcagaagtgccattgtcagagtgatgtgtgtatttgctcagtcattcagtcatgtcctattctttgcaacccagtggactgtaacccaccaagctcctctgtccacgggattttccagacaagaatactggagtgggttgccatttccttctccaagggatcttcccgaccccgagattgaacccttgtctcctgtattggcaggaggattctttaccactggccacctgggaagcccttgtcctctggatctcaaggataagtttgccctgttttaatttactaaatctgtgtggttcagatatcagaatggcattggatttctcagcattaacaagagatgagacaaataacaagcacaacaatagcaataccttcttcctgagactacagataggagaaccaagcctccatgaggctatttcagtgaaaataaaaaggatcttatacatttcagaacttttgagtaagttgagaggaggcatgggagaaagttggaaatgacaagtcaatgatacacttagctttgtacggtgcatggaccagcacgacaactaggtacgatgtccgagtgctttattttccaaactgggatattttgagaaagagaaagaaggtattattaatacttataggcctccatcataattggttgagagcaaactgaacgtatggtcgcactacacagagttggtttcttacagtatgtaacgatccctcagccactggatagtcagcatgaaataagcagctgtgttgctttcgaaagcgtacctaattgatgaacatctggtggcaggtagccaggccattaaaaatcaattatactcaatgacttgcatctgagccatactgcaccaatctcctcgcactcatcagatccacatgttcctgaataaacacacgcaccactcaagctagtgcctttgaactttgcgtggtttggaagtgaatttcatcagtggctttcctctgacccatagcagagagaagaatttctgttgatctacccctgactgttgacaggtcaagagaccaggcagcagtttgaataaagctctaaattcaagggtacctagagcattcactgctctgtgaaactcgtcagggtagcataatatataacattaatagcataggctgggtaacaaaataaggagggaatgatgatcagggactagatttagggtatgataaggaaataagttactaattatggagaatgtggaaaagcttcctttacaaatctcagctgagaagttggatttatgtttctagattctctgcagcaattagtgaacaattttcctgctcttttgagatgcacagtccaaagagctgtactgttaaggaaagtgggttgagagaagaagatggacctgttgcctaaactaccacccccaatgaaaaccaaaatctcctgatcagaagtatccttgaattgtaacttgaatggcaacagagatgtctgtaataaatcctagacttttgtcaggtcatgagagtgattgtgaagaagtcatttaaatggaagataaattttattttaaaattaactttccattaataatcaaagaactacttctaaatacacaaagctctggaaacacaaaagcatgcttgttacggggtcaggaggcaagcatcattctttacccgttcaacaactaacatactagtcacaaagaagggttttaggaaaaaacagaagtgagatttagaaggaatctggacaaaaatgtgaacaattccattgtgaaatatataaacaattagatctcttctatgaacatggtttaaggaaactttcctgtaggtcagtgtatagttttaaacacaaaatacataaaataagagagctcattatcttgactttatgcttcaaacacgtttttccctccattttaaactgtgataatgactgtctatttgcaatgagagttcttaaatttgtaaagaagcttagagatcatttagttcaaccctcttatttatagttaacataattgaggccttgaagggtgaccccaggtcagccttacctcaggtcatgcaccttataaatggagattggagactcaaagccagatcttctggctccaagtccactgctgtattttttcaactgtttttaaaatgtaagacttatatttcatattgacatgtttatgaagagctaagcctgattatggcataatataacttaaagccatattgaatctttggaactgaaatataagcaaactaacacttgttaagctagttaactattcttcctcctaatgggcttaataatccatca

SEQ ID NO: 56358 - DNA, 1267 bp, Bovine  19866880845422
ccctcgccgacgccgtctctccttcgaataccctggatcagccggggctggtccccggcacttcaccaccaccacattagaagtaatcattcatgtgaagtgaattgaagtcactcagtcgtgtccgactctttgcaaccccatggactgtagtctaccaggctccactgtccatggggttttccaggcaagagtactggagtgggttgccatttccttctccaatgcatggaagtgaaaaatgaaagtgaagttgctcagtcatgtctgactcttagcgaccccatggactgcagcccaccaggctcttccgtccaaggggttttccaggcaagagtattggagtgggttgccattgccttctctgatggtgtttctctcagatactgcataattatttaaaattaacctaataagaacaggatgcagctgataggttttattggttccatggagattaaaataagaattttatttatttatttttttggtcaaatatcaaccaagagtaaataaaagaagaaataacttcggaaagctatatgtggaacataaatgtatgacaaaggatatcagcaaaattttggaaaagtaatctaaattttttataactgtaaagatactcaattgttctaaaaggaaaaatataaacaatataaagactaacagagaaagtagcacttggtgcttcatgtaagaactaattgcctgtttcataaaatatacacgggagttacaatcctcacagtctacttaattatatatttaaaaactcataagaactaagaaaagattaattatcacctactgcataattaaaattcttcaatgcatctttatattttcccttttgctttgtatgtacacttgtttcaatttgactaccagcacatggtgcaaaaaatgtatatactgttaaaatcactgaatttatgacatttttctctccaattttatatatgaaataagtgaatcaaagactttttttttcaccctattgtttttactctagaagccactcaggtcttaagaagaagaaatagtaagtattagttgtacagtagtctgtcaatcaattaagcacttacactttgggcagcccactcatggagctttagaaaagatttttaaaaacacaaataaaggaaagtcacaattaaattaaatgtggattggaaaactccattttatattgattttattaccagaatttggagagaagtcttctgattgtattaagctaatgttgtaatgggtgaaatgaaag

SEQ ID NO: 56359 - DNA, 1322 bp, Bovine  19866880944396
tttgtaggaaggagtgtacatttatatattctgttctcagttgttgaagaagcatctggttaaatctccccagactattatgaatccctttttaaaaatctctagtgccgtaaataatgaaatagcaatatcttgcaagcattgtattgactataatatccctttgaagtgaagatttggcatatgggttactcagattctgttcttccattaattataattcttacatattttttgagggggtgaatatcttaaaaatttttttcctagtgacaattcaattatataactttcttactgaccaactgtcctataggagtaatgacaacgacagcataattaccgcacacacatgcacacacgttcacctccttcatggctaagaggacaaaaaatacagaacaggtcttttcatacagttgatcaaatatggagcttcttgaggatcccagggtcagattggttccaatgtatagaaagtatgactccaaataaaacctttcctacattcacaggtgaaagaataacaaataaaagcctagctgcacaatcaagtcttttacactgcaaccgtttgcatttccaatgaatgttgactgcaataccagagtcaagtaatagcaaggtgacaggtgtgcaggagatgattcagattcacaatgcatgtaacttaaggtacacttgtgcatatcagatcgtataacactgtttatcagaaatgttctgggacagcaaaacatttaggtaaacaaggttttatgtaatcaagagagttacagggtaattgattcatgtcaagagacataatctagattttgatgggaggtagttttgaactgaagattttggctttgtggagctttaactacagaaatataagattcccaaatttcattagcaatattaatgtgtatcttggtttgcattttaaagacataaaaataagttacctggaatcctgaaggtaattccagagacaaaaaaactaaagcataaacattcaactatttgaataaacattgtcctaaagtataatttgtcttgaagctaaatactaactaaagtgaaaaagaatttaccagtatatgggaatgtgggctctgtttttggttcctgaaatatgtgccttaattttttcaaatactaaaaatatctctgtatacagcctgttttctacataattgttcatattacactttaggttttcctggtgtgttcctgaaccagcaatccagatggaaccatatcagttctaaagtatgggttgatgattgctttaatggttgatttactgatatttctgatcttcactacatgcttcc

SEQ ID NO: 56360 - DNA, 1112 bp, Bovine  19866880949097
cactgtggcccaacttctctttccccttaatcttttattcacgttagtgtttggaggactcctgggtgctttcttatcagagattagaaatgaagaatacacttgttagaacactggctgcaactgtaggcttggctctcaaagttcatatattactagggtattgccatgcctctgaaaatgcacaaagtgttattatgcttagcatgagccttgcaatactttcatttggagaatttattttgatgaaaatagctcattagaccagaaaacgcctattttgttttcatttcattaaaaaaaaatctgtgcatgtttgcatagcaggtagagctaaaaacccagtatagcaagacgctggctgtttttttttttcccctttcaaaaacaataacagagaggggaatttatatataatatggcgtaatttacttgaatataatgaatgcatacaattttacatcctaaagtattaattatagaggtatttatagtaatttataatgcattagaagattatttttttaagagaacttggccaaagccaacggtaactctagctctcatttataataatggaataactgcactgaaacttgattttttattctaatcgtataattgaaaaataacatttaacataccccaaacatgatgaactcattaaaaagctttttatttgttattttacaatattcaaaataattaccttgttttaaacaaaattttagccattattttccttagttctttatagactaacaaatagcaatggagttgtttcttcaattatgttactgtatatgtccaaataaactggaaatctattgaattatagtgccctgaagtttctatttaagaaactctctataattataaacttacatggtattgtggctctagaggtaataggcactttttttctttttttttgtacgtaaaagaagatgaaagttttccagggttggaataaggaagctgaatcagttgttgaataggagcaggtagattttatggtgttcctttgggaggttttaccatatttattcctactgtacttgcaactctcaccctgttcctagttttgctctgagaagtgggtgtagtgtttt

SEQ ID NO: 56361 - DNA, 1545 bp, Bovine  19866880949580
acagcctttatgtctgcttttaagagactcgttcttgaattccttgggtgaggaattcctaaggtgaggtaacgtacctcagcttacctcacgataagttgggtatcggggagtaaatctttcttggaggtgacatggccttagcaagaaacttgctaatggagcaagttgggtggcctaagaattactttagactaggaattacagtctgttcagtcttagagtttcttaaataatataattctattattgagaaggtttccagtctatttactttctatcaagtgcattgggtaataaccaaagccaaatgtcctgtctaaatataaagtttattgattcctgtctccaagccactagcctcagtgatttgcccatctctactttaattcacattccttagtttaatggcctctgattcaatgtactgctgcttcttatttttaaggtaaaatatatcatgacttcacattgatttttcaattcaaattcagaacttcaggaatttaaagtttctttgatcttttatctatacctactttctcatatcttgaagagcttggttctcaatgagattaggaataatagaattaaagtattatcttataatatgcacacaacaatctcagaatgactatagaaatgctgtgaccaataatatcattactgaaaacagtaagaattggttacagttctgtatatcctactagggatgtacaatcaaattgctgtgttttaaaatcacttacagttactgttagtgtggttatgccagcaactcaatatgcatttaggttcatttttttatttccttttcaatttttaaaaattgtttttcaattaaattttatactaatgtaacatatttagagagttacaaagttaacaaaacaagtacattcagagaagataatcttttaacattatcccttttactctactctcttcctcctactttaggtgaccaaatttaatgatttatccattttttatgcttaaatgcatatttatatgctcatttacttagataaaataaatgtgtattgtaccaccaccttgtttaattgctgatgttcaatatatctcttcttaatagattatagagtataattattgtgtggagttaaaataaataattcagtttcctattaagaaacattggagttgtttatatattattagtaaccttgtgcatatatattttcatatttttgtcagtgtgcctatgtatgggatagactcctagaagaaggattgacagctaccaaagacacactgataatgtattcaaatacatatttctcatcataacctcaccaatataaatgaatactaacttttagattcatgccaatataatagctaaaaggattggggtcccactgtagctttaatttacatttcttttaaattgtatgaggttaagtttcttttaatacaattaagtggtattgtattgcttttcttagaacctattcattcactagcacattttatatagagttcttcttctctctctgtaaaagctaaagtgtattttaaaaa

SEQ ID NO: 56362 - DNA, 1630 bp, Bovine  19866880951364
ttgtatggatttccattttgtggtgtgttagtgactgtgaagaggaatgtgtgtggatatgggtatattttcatagtgttcttagttcatgtttttacatctttttaagattttagagacagtaacacaagagataaaaattttaaaaaataattgtttaaacgacatattaactaaatgttttctcacttcacaaatgctgaggctttgtaaggaaggaatcacacatcatcctttctaaagaaatgaaccaagctttgctatcactgctttcacactggttccacgtgggtggtcttttatttcacagggcgtattaatctcctgtcatacgtggcagccactactgtgtgtcatctcagtacaggacaataaagtgactccagaatttctttctaaacttagtgaccaggcttctcttactgtgacaaatgtttatggattcttctaattacacgtctggtttaaaactaagataccaagagaattcagttctcttttgtaaagttcccaaggtttttctataataatcaattaccataatgagtttttttaaagcttccattcatcattttcttaaaatatataaacttctaggataaagataaatagccatagccagtataccctgaggcactctaccaaaggtttcctttaaatcaaaatcaactggaaaacatgttgggttttatttcaaagtcaatcctgcttaggttttaaaaaaatgtgtaaaagcaaaaaaggagtaaaataaaatccatgacaagttggcttcatgagaggaggttaggcaatgcatcactctatgaacatccccatagttcacatgtgtttgttaaatgggtctcactagccagctcttgtgctattgaaactagaaactaattctcttcatggatcttccctcacctatcaacctattatctccttctgttcttaggaaaacagtatcccaactgggagttatttgacatgtctttatctaagccagggtttctcaacctgggtactactgttactctgggaagtacaattctttattttgtggaaagtgatcttgtgcagtgtaagatgtttagcagcatttctggctgctatccatcagatactagaagcagacacctccctcccctgaactgtgataaccaaaaccctctccagacattggcaattgcccccagggggacaaagaccctccaccttcccctgtttgacaacaacgttccataagcattcattccataagccttaattgtgagggaattcagtagaatattctactggcataaaaatgttataaaattaagaaaactagggcaaagaagagcaagatcattaagctggttggaatttaaaagaaatgaaattgggtaatatttgggtgatgatggaggaaataaccaagaaggcatgaaagttttcctatatcatttaactgagtgtgtgtgtgtgtgtactcagtcactcagtcatgtctgactctttgcaaccccgtggaatatagttgaccaggctcctctgttcatggaattttccaggcaagaatcctggagcagattgccatttcctattccaggggatcttcctgaccgaggggttgaacccacttttcttgtgtctcctgtactga

SEQ ID NO: 56363 - DNA, 2634 bp, Bovine  19866880983145
catcgatttaatagatccgtttaacatatatttaacctgcaatcactattttaacatctctaaatgaccacttagattttgaaggatatagaaccatacacagtcagctaacaaagaattcaggtttttattagtctttttcctatgatcattactgcactgaataaagataattgtgaatgcccaatattttcatcagaaggtacaaatgtatttaatgtattaggtagaagggttgttggttgatttctaccagtgtcaagaatagagctggaaaatattaaaataagcatcttggttcacaagtcttgaaaattaagttaaaaaatcccatgctcccctctatgttttgttccactgaagttctaagaggttacaagctatttctactctgtttcccactgtctattcttcatctagcattgcttccagcctttctcaatatttattgaatatgtttattattgaataaaggaagaaatgaatggtaacttctgcattatgaggagctacaaagcaggcatcctttttaagaaattttccttatgaatcctgtagcttgatatcttgcacaattaaatatcgagtaaaaattatactggaatgaggatgaaaaatgataataatgattattgttctcaagcttggcttcagttcagaatcacctgggaatttaaaaaaaaatactattgcctggttcccacagcaattctgttttaattgttgcccaggcactgggatctttaaagtttctccagtagttctagtgagcagctaaaattgagaaccattgttatatatgatgatataatgatatgatgatgaatatgaggaataagagaaattcaggacatctaccttatagtctaatttatgaaaataaaagggtgtcttttcccttgaaaagccaattttaagtaataaaaacaaattcattccatttcagcctgacacaccagcacacatggatgtacttagaaatatcttaagctctttcctttgtcccttttaaaaagtgcttaagggacctttacctgttactcagaagctcagccccattctaataccatgtgactttggcctctagatccaggaaacggatttctgttttgtccccacatgcataaattcttgctgtgagacactttttatattaattaattttatttttatcaaattatgattgatatatgacattgtgtaagtttaaggtgtacagcatatccatttcatacatttatctattgcaatatgattaccacaatgatatcacttacatatggaatctaaaaacgctttgaaacactttgacttgacttatgcactcatcctcaatggtaaagaatctgcctgccaatgcaggaggcacaggtttgatccctgggtcaggaagatccccctggagaaggaaatggcaacccctccagtattctagcctgagaaatcccatggacagaggaccctggtgggctacagtccatggcacaaagcatcagacacagcttagtggctgaacagcaacaatagattcatcctgtgagcagagttcttgtttggttttctcactctcaggagccagaatcttgctctttctactctccagaaactctttaattttttcagaaaaagtatagctttgagtccaagataaccaaggggcagagttgatagccacctacaaagtataatttatggatctacaaatagccctcatgaaacacatcccaaaatatccactaaagtatctctgctagagatgtttacttctgttcaactagacaaattcactgagtattctagggctgttattatggaagctgtattttccaaagtaataagtgggatacaccttgagagtatctagcagtaggagaggatatttgatgccaaactcactaaatccaaagttaactaaaacagcttttcccaaagtattgttttggtcataaaataagccatttatcttaatgcaagagtttttactgcatttcacaacaggggaaaacaatttcaatccgaatgccaaaactgtttagaaaaaatgaaaacaaaaactctggaaaatttttcaggaaaagaacagtaattaaaacacaacgtttcatctataattttttaattttttgactctgtgaaaataaggaaaatattttttctctccagaattttcttatctgtattttgagaagaatcatttgtatttcacagtgttgtcatgagaattagattagataatgcactcaggatgttactcagagaagcaggtactaaaatgtagttcccataacaataattaatattgttgccaagaatataaattacttttcctgtttctccagaaacataaaacttattttgctctttcatttcgtaacggacctcacttgtgacctctaaaattgtccatcagtagttagttaaccattggtggaaatgcagattatcttgcagccaatctagaaatacaacagcaagcataacttttctgagaaagaaagtagagttaacagggagacattttcacctattttaagctaatttttaaatacttctattccacagcagtattgttttagttccaacagttcttcatatgcaactatcagcaaggttaagaatttaatgcgtagttat

SEQ ID NO: 56364 - DNA, 1039 bp, Bovine  19866880993512
tgtctgttaaaggcatacctttggcagatcacatggtaactgtcacatcatagaatgataagcatgaagaatacaaaaattttggctggccttactgtgtttagctgtacttgggagttaaaggaagaacatgacaggctcagtcaggactctatggtctcagctcaaggcagtgtcagaggcaaagaacatttcgtctcttatacctcaaatttacatacagaatctgattgtacaaattggagtatttataatatagagtgaattatagctatatttttacatgaggttaagagtttcaatttgaaaaatgaggctctgagaattaaaatagcaacatttggaaggatttagatgaccttgagtaccccagatccaaactgcattgagcaaaagtagctccattttccagtctaaagaggggctgttttaccttatttggaaaacttaaactaactttagtaaggattattggtagttctccttaggctctaccatgcccatgcctcacaaactccaatcttccagccagagttaaatctcagcatgcccaaggaagacaatcaccaataaaaccaagaatggaaaacgtatgtgtcgaaagaattcaaatctgaaattaaaaataattaaaaacctggggaatatataggtggattcgtcagtgatagatggaccatgcagaaagccatagagttttagatagggcaaaatatattaacatggaggcatttatccaatatgctgcattcagtgttgtagcttgagcaattaccattttcttagctggttaactaaaagcagaattcagctgtggtctgtactgaatgaaatgaatgctccttgatgtgatagactttatttttgggggcttcaaaatcactgcagatggtgactgcagccatgaaattaaaagacacttgctccttagaagaaaagttatgatcaacttatacagtatattaaaaagcagagacattacctttgccaaccacaggtccatctagtcaaagctatgatttttccagtagtcttgtat

SEQ ID NO: 56365 - DNA, 961 bp, Bovine  19866881014577
ttcttggtgacattttccttagtataagagcagacagcattgttttccttgctgataatgccttgagttattttatgacatggtttcattcgtctccacaaaagcaggagaatattgagaaggctggaatataagaaaaggccgttcagcccaccaggctcttttccttttaatgcaccctggagaacatttaattgcttcttgaatgacccccaaggtcttcctagaatgagcttgttgtcttctttgtggaggagaccatccccatttcattcgaactcattgtgacttaattataggatacatataataaattggaggcaatcagtaatccttaatcaaacagggtaaatttgtttcacatgcaagacacaatgggcccttgtgaaatagatggcacactttcatttactgcacgatacccagattaattaactcacctgatagctgtggttccaatttcccaactgcaactcaagtctatcttatgcttgcccttcttttttctctttcttattatcattctataaaactgctcttaatagactttcatattcagatattataatttctctccacagatattatttttctgttgtataaaagaagatgtttatctatgaataacatagtaatgtgtatatgtgtgtatatacatgtatatgcacacacacaaatatatacacatgcatatacacacatccatgcatgcaaatacacatttataagagaagacacgagaatgtattcagatatggcattttctttagttacagctctgtcacaaatctgagttcaatgggtctacatccagaatgttacagtaatttctgcaagcttccagcagtgcctaatcactctctagagcagagcttttagctgtttggtttctgctggctgttttccctgaaaattactgtaagagatttaattgatttatattcatttatcttgtaaaaag

SEQ ID NO: 56366 - DNA, 849 bp, Bovine  19866881042655
ttgaggtttttattaactgtaagtgtctgtttagtgcctctcattgtgtatcctgattacttttggtgactaagtgtaacatttaataactattagttttcttttggagagttcttaaccaggaaacaagagttcttacagctacatagataattaacttgaagcttgtctctctcctgagagacatcaaatatgtaaatgaggaacttaagccttaaccagacatggtaaggaaatcactaaaagttttatcacataaaagctaaaatctgcagttaaaaaatatgtcaatatgctttgaagaactaatatatgcttcttacttaggatttgtgaaatttatgggctttaaattctttttcaaagccgctggagctagtcagatctattaacaaaaaaccaaagcagttaataaggaaacaagggcagaagcatatttaactactgcacaatgtctggtacatgactagagctcaacactgcataaacttgtaccaaattttcatcttgtattttacaaaatcctcatttgtcatatctaacactgcttaaattttttaatgatagtgcttctcagagcaaaccaatacatatctttcatctgttcttattcctaaagacttaaaaaagaagtaagagccattcacatttgatattttaaactgaaaaccaattctcttcatttttcatatatatatgcttgtgctatatatctcaaggaaaatatggaggaaacgatcttttacatttctgtgcttatttgtaatctgaagagaaaacattctatcattacaaaaacttttagtgacctggataatatatttttgttataattggtggattatgttt

SEQ ID NO: 56367 - DNA, 3324 bp, Bovine  19866881048723
tacatgtaagaatctttaaatgtcagagtctatgggtccttttttattggagtttatttatgtccatcctaaaggaaatcagtcctgaatgttcattggaaggactgatgttgaagctgaaactccaatactttggccacctgatgcaaagaactgactcatttgaaaagaccctgatgctgggaaggcaagaggagaaggggacaacagagggtgagataaatggatggcatcactgactcaatgggcatgagtttgagtaaacgggagttgatgatggacagggaggcctggtgtgctgcagtccatggggtcacagagtcagacacgactgagcgactgaaatgaactgaactgaactgatttatgttctccagggaagactactctatatccctcgggggtgggcatgtgggtgcaagattggctgtcggcatgacactctgggggtgccagggaagggagctggtatggtttcatgaatcatgtgacccctgcgccctgcattatctctatcctccaaaatactaaatatcctggactgtcacatttctggtgctttccccaactcccacccctatcagagactacagccctggtatttgagggtaaggtcaacagggagaagtagcctggaggtatgccacgtgtctcccctgttctctaaacagtaaagaaggccacttttcatattactgtgcctgatattagacttcaaaagctttggtaggcactttattaggtaaaaggttttagttgtctcaaaagttattcttctttattcataagataattggaattgcacttcgaggtaaaactttattgaaagctttatggctgaccaggtgcattaaactaaatacttttccctcacccaccaattttgtaattttgttaaagaaaggaggactttagttttttgagcgatttttttctccctctaatatcccatgctgcttattgctcatgtttctattatcccatataggctgtagggtttctctccccacccaggggcctcacaatagacttgccaaattgtaattatcatggcaaatctttttgttctgacaaataatacctacatgttttattttatcccattttctggagctacttagttgagtctaagttttcaaaagtaatcactagtctttttgaatcttgggagtgtatttctttagaccttgtaatatgcacagtgtaaaaccatttaaagttatgttaattttttttcttagaaatactatttcaaataatcatgcagaggaaaaaaagtgaaaatgactatttatatcaactgaggacctcaatgagagttgttaaaaggttgagaaatagaagctataaaggaaagtttaagcaaaggaacaagattattaggctaagagaatggtctaactacccaccattcaagagcagcatagaaaaataatgacttgctgttctctagatctagggaagatgtaagaaaaggaattaagcttaaagtgaaatgtgaaaattatgaaactttatgagatgcttcaaggctgagtttcactaatactctaatgaaaaggaatgaaagtgcaggtgaggactaactagatactgaggttaaaaaagatgattctgaacattgcctacaactgaattattgcttaggaccctaagattacccccaaaacaaagactttcacttattcataaaaaattataaaagggaccaattaattcatttggcttgacaaaactatttagttaaatgtccatctccattttttaataaaacaaggaaaaaacctagggaaagaaacaagatgtgtgggtatgtgtatatgtgagtgggcatttgtgggagtgtgtatgcgctgtgtccacactatgagggacccatgtcaaggcagagcatatggactgtataggttccaagaccaccatcactacatgtgtctcatcttctggagtctccctgtttaacccagtgacttctggagggaaacatgggccttcagtccagctcccgtgcatgctggagggccccttcagtattccttcttttagacacacagagcagtttggctccactaggataattgtataacaaagcaaagactgacttggctttcttagtgctcttcatacatttttattcttgaaatataatttaaaagcagcagaatttttcacttagctttctcatatacatatacataatttacccatttgaagaatacagttcagtggtttttagtatgtccatggaattactcaacccaccccccataacctaattttagaacattctattatttcaaaaagaaacctagtaacttttctaaggattctatagaagttttcatgaagtcctttagtttcaccaaaaactattgtattttttttaacagacatatctactttaaaaaatgagtgctgtctttcaagttgacaacatgaacttggcaggaaatgtaattaatataaatatctgaatgtatacctttggtagcgccatatctatcacaaattaggaccaaaactaattcgactgcaacagattacacaaagagttgttatacagaagatgagactaggatttctaagcattttcctattcaaatatgattagattaggattaaaaggtgttaaaagacattcaaaaagagattcagaaaagatgatggatgacctgttctgtttttttctcccaggagacctgtaaagtaacagaaagatcctttcggctcttttctttcacactctgttaggatacagctgctgtgacaaacacagccgtgaacccagtggctgagacattacagtcctgagaagggtgagtggtccagaaaggttacacacctctatttctatgtgaagaaatcatttaggacccagatgttttccatcacagtgctccactatcagccaggggactcaaagctggctcctatggactgactagtattcttcccccaaatcccatgttgaatgtctaacccctaatgcaattgcatttggagactgggcctaaaaggaggtgcccccgtgcatcctcagtcactcacatttctgactgtgaccccatggactgtagctcaccaggctcctctgtccatgggatttcctaggcaacaatactggagtgggttgccatttcctcctccagggatcttccaacccagggatcaaacctgtgtctcctgcattagcaggcagattctttaccactgtgccacctgggaagccccctaaaaggaggtgtgtgtgtgttgaccctttgttgacctttcagtcatgtctgaccctttgcaaccccatggactataacctgccaggcttct

SEQ ID NO: 56368 - DNA, 1987 bp, Bovine  19866881053955
gaatacaattgatttgaactagattggttcaaacttcagtgcaatcttaatagttagaagactttacttttaatatgttttgagtgagggaaacagcctagaaccacctccctgaaatgcttttctcatttcttcctcttttttcattatttctccctctatcttttaatccttttttaatccctttctgtttcattctcctctgacattttagaaagttatttgcttaacttttgttcccacttccattttaaatcctggatgagtttcatgaggtcagtgaaaaccatttggaaggcaacataattcattttggtgattttttaaagaatgtacttcttaattcatatgtatatatggattccccccccttttttagtctaccatgggaatagaactattcaggtacacccttacagtattaaacagctatacattgtagtaatccctgatcgtagataaacatgctgagaatatatggatcagtagtgtgttccctcccctgagatgactgactttattgcctaggcagtaagttgcgccttcttcctgtgtggccaggcagggtgtgggtgcaatttattagataaaccccgaaataggtttttgttttccttttggaaatttgcatgtttttttctctgcccattaagcttttaacaagtgtttcacttgatggagtgatttatagctgcttgtaaaggtaaaacagcactttaccctgccagtggagtgacttttcactgactaaatcatgcagaagtttgtgtaggaagagcaagaggcagttggatttagctctgacttgagtgagcttaaaaggagaatttgtcttttctttctttaaaggactctttcttagtggaaaaattatttttctgaagcaaatgattcaagccatcttattgacagttctttcagtctggcggataactaaaatggtaggggaaacataatgatggaatgtcattggctttattttacttttaaaaggagctactttattttcataggactttgacatatttatgtagtttctttttcttttgaagtatgagtagttttaaaaaactctttgtcagtagccatctgatacatcatttcaatcgctttgtttacagcaaagtcttgacaagagtaaataagaatattgaactagtgcaaatgccttgagtagtcagcacagcgaatcatgtatcaactgtcatcatgagctgaaacacatctacatactgagtagcatgtttggtgtgcctaatcagaacagtatgtaatctgtgagtacatatgaggacttgccaagtcagaattatttacaagttgcagtttgtgttctggaaagtttcataaatgaagaaaacaataccgtaaaaaaaataagaaaaaaaacatgttagcttcagatatacaactcaaaaaatgaataacaatttttgagatttttattcaatagatgctatcaaacacagtttttttgttcaattccaatcaaaacagttttcattaaaatttctttttgtattatcttttatgctgatcctctactcctggttccttgtgaaaatgaccatggaaactctgcttggttagttttctgttttccaattctcaactcaaaatgccaaagctggattggttgacagcttaagtcatataaaagagtatgtctgtggttgtatattccatataggtgaaggtaaaccttgcttgttgaaggtaaaacgacatgtgcaatattaagaagggcatagatgaattcttgaaggagaaggaaagagacagtaaagtttaagaaaagcttggaattaccaaaatttatttttaaggacctcagagtcctcttctatatccttctttctgcttcaaacactcggtgtttgtatgctttttttctttacataatttttttcctgacctcactcactcttttcatcctgcttttaaatcattttaatgaccattaaattgttaaataaaatgggacaaa

SEQ ID NO: 56369 - DNA, 2165 bp, Bovine  19866881058470
aaaagattacaaaaaatacaaaagcatacttgcatcatgaactttccgtaaagttttagaatttttcttacaaatggaacttcaagaacctgaaatttgaattcagatttcaaggattcattaaactgcttccagagacttacagggtctattttttctgttgttaacatgtagaggagctatataccaaacagagcttttgacagcatttgcctccgtttgttataggatataatacatgggaagaggtcagtttattattttggctcactttgattctggggtgaaatgatcactattcaaactcccacacagtatttatcttataaggtcacttctaaggtaaaatgatgaaaacactattggaatataataactgtcactaaatgttagcctttttttttacttagtaccactacacttgtggaagtagaagtatcaaatatttctgtacccactgacacaatatcaaaaccatcaccatattagacaaaagattgtcttgagtggattatatatgctaggaatatagtcttttaatggtaacttttctagcactttggtttttccttttagacaagcagcatgtatgcctgctaagtcgcttcagtcatgtccaattctttgttacccaaaggactgcagcccaccaggctcctctgtccttaggattctccagacatgaatactggagtgagatgccatgccctcctcccagatgatcctccagatgcagatggggtttaatttcagtgtttatgtataatctacatttttttcctttgcatctccttccttcctcttttccttcttttttccagttgcttccaattgccacttgtctaattatcctagtatatatgtatttgctatgtttgtataaatttggagaggtatagaaaaacaaacagatgcactgaaaagattaatgaagcatatcaacccaaactagcaacagggatctgttttgtttatcttgaatgctatagctatatactaaatatattataagtttatattaccataataatgcatttctccctagctattaatctcaactacagaatatcacatatatatttaatcttccttcaaagagatctaagcttatttacatatagcatagttttaaggacattttaatattggccactaattttatactgttagaatgttttaatgtaattacaaaggaatgtagctacaatctaagcttatttaatctacattctctctgtttgacctttcctgtagcaacatataaaaagaaatccataccattctaccaaattcccagtgtgaggaaaacagtaaaaattttagcacaaattattttgtattgcaacagcctgtgatcagaatcatatggcaagggaaaaagacttgattcaaagctaaacaaatagctttcttgttgctcactttcttaatctctttaaaataaaataaataaggtatttcaatgaaataaattatttccaaggaacacagtaccttctgtacgatggctgtatttactttcaagtaataatgcttagaggtagtatgtacaaaagttgacataatcatttcctttatttgactatagtgtctggatctttgtcaaaggacagagtgcagttggcttgtttttcaagttatatcttgtctcagttacatgtcagaaagatcatagtgttactgttttaattttgattgctaacataaaattggaatccaaagtaaaggaaattgtgaaaattaacttgttacaagtataagagaacaaagcatgggcattatgataatgtaatcattgagaatccatgaagtaaaatgtatttttaaagacacaaagttaatgctttcctttgaaatctccatgtaaaaaatggaaaacataactttaatataagacaggcacaggtagtctatgaagaattacagcttggaaaattaataaaaaatagtatctaaaatagtattagtaagatatgaagctcattcattaacggtctctatgataatatatcactgaaaatgttgcatgaaggacagtctttgataggattatgtacagtataatagcaagttgctggaattaaaattcactgagaagatacatcttgtgaactgaagggtaagaagataataatggtaacattaataatagtaaataataagaa

SEQ ID NO: 56370 - DNA, 938 bp, Bovine  19866881059826
agtgaggtgaggcacatcctagagacagtgagggaaaggatatggatctcaatattaacccaagttgtcatctagatattgtataagtcacttaacttttgtttgctttcttctgtgttatgagaataattaaaaatatttattgccaatactgtttttatagtaaatcttagtagatacacacacacacacacacacacacacacacatatatatatgtatatttaatgctagtcagagagtctccctggagtttgagtaaagcagaaaccttgctaaattgagacatttctgaaatactttaggaaaagatgacatttgaaatacagttatgaaggaaagttaagattttaagaggtagacatgaaggcagcaaagtagcaagaagaggacagcataagaaaaggcaagaagtgagaaaaaagagaatgtataagaatagctggtagaacagagataggaaatgctgaaggatttttatagttcatgtgggtaaaaataaagacctgttagattcagaggaatgctttgagtaagcattttagccagtgaacttttggttttagatgatagagcctagcttataatggggtgtaagtatgaaaggaatttgttggctcatctcatccataaattcctaagtaatattgcatgtgaacatccctccataagtttgcctttgttctgtgctggctttattctcagctattgaacagacagtctcacagcttattcccagccatgcacacagcttgtccttgctaacccagcggttttttttagacatccactctttgacaaggaagaggaagtttctgattaatttaagccaaccctggtggccccgtttccttagccagagattgttttaagaacgagcttgtgttgcagttctggaggtttagcaggttactggagtcttctaggaattactcagt

SEQ ID NO: 56371 - DNA, 1325 bp, Bovine  19866881080277
agcttgcagttgctctgctagaagagaaggccttgctcaaaatcgagcaaagtgcacactgataaaaataagacaactactcatagatctaaacatgtcagttaatggcctggatgccatgctgattttaaaggccagagagtcttctgtgtcttatacatttgacaattcttatgttttatttattttggttggcatgtggattatagtaccctttcagtatgtgttactttgaaatgatgaattaacataatgggctagattgtacgcctttcattttcaagcccattttacagatttagaaactaagagttgctgacaaaagggccaatggtgattgcaattgtgcagtcagaaagggttcacaggacattgctcacccaaatcttagatgaatgaagaaaacaaaagttgtaaagcagggagggacagacagggaggagagacatgtcagaggtttacttaaagtttcttttttatcccatatgctaagtgcttgcttatgagagagcttttgtgtccaccccctttaacaatatgcattatgacctcttatgttgctccccaattttcccctgtacaaataatctcatatcatgatagataatgaggaagaacactctgaaagatcatcatgtattaatcactttagttgttttaatataggtaaaatggaagttagtctttgaatgtattgctagaatctctgattcccccagtgaccatggatgggtggtgaggcatcctgagcgttgccagcccctcatgggctgcgtgatcatttttgtcttgcttcataagagtgaagtcttctaagttcattagaggagaatttttgtattcaaccaaaatgaactcagtttacaattaatgcttggtaattaatccatgcacattttcctcttttaccctaaaacatattctactaggtaataaaaaggtattttttctccttcaggcatcacatctctataacctgcctcttggccttagagaaggctctgtaaatggaagagggagtctcctcatttaatttgatacatcaggtcatcatcaaaatatttatttcctgatcttcccacatagcaggtgactaaaggttaataagaacgcatggaaaataattaaggatgaaaatatatacaataaaattcaaaacaaattagaataaataaagtttagtgtgactgttaggttaaattgtcttgatgctcactccaattataaaatgttgtgggtttttttttttttttttcttttcttttgaaggacagagaagcttgatagatatagtaaactattcattactacatatctaggaaata

SEQ ID NO: 56372 - DNA, 1466 bp, Bovine  19866881080468
agaattttgattgaccctggttactgtgattgtgtgtctactgccaatgaaaatgtagctgaaatacacaaatatttttaaatatgctgcatgagtgtttcctcactgccaaaaaagaaaataagcagcacaattatgtaaactcttctgttattcccagtgcacaaacattttacagatgcttctctatgaaaacattctaaaacatacacttggctgtctttgcttacctagagttgtttggcaataactatttcttttgggatgtagcttattattgagttttgtggttgagcagatgaaggatgagaagcacagaatttatgatctggaaataccctagcttactgatattacatgtctatcacaaatgaacatcacaaattcaaaagaaataaatacacaaaaaggagggggtgggaggtctctgtagttttgaaacgagtgtgactactttagctacatccacttggatcagaattcacagatgtctgtaagactgtctcatgacccccacccttctccatttcagcaagaactcatactgtgtgacacagtttggcaactgagaatgaagtcatggtaaaggagaggaaaacattccacgcaaggagaaattcagttttgtactctccaacctgcaccaacttccagtgagttcttgcctctcctttttctacataatgacagtcaagaatgaaaatcaggctatatcagcaaattgagaagaggaaacaagaacaacaaagattaatttttaaaacttactacaaaacaaaaaacatccatcatcatgtgtaaagaaattgaaagcttttaatcttcactgaataatggatatttacccaaaaaatatgctttaaagttgtggttaaaatgccactctcaatgaagtagtcttggacaaagacacaattcatcagtttacaggtcatgtaaccttgcatactgcagttaatctgtctaaaactccatgtttttatgatgataaaaatattaatagctaacatttattgaaagtttaccatgtaccagacactgttttataatcagtacaggctatctcatttaattctcacaaaaatcctgtgaagtaaattccatattgctatccctattatacaggtaataaaactaaggcacaaaaaataagaaaaaaataagaattcatttttatttcaatgtttagcaaaaacttatgctatatgctcaactttcttctaggtactttacaaatattaattaataactgtctctcaatttaatagaaactgctattttaatctcattttacagattaggaaactgagataaaacagattaagtaccttgcccaaagtcacagtcaataactagtggaaggaaagttgaagcactcagtgtgattccagtgatttttgcacttcaaaaccactgggtattattaccaccccttagggtgtcatgaagaatgaatgacatcatgg

SEQ ID NO: 56373 - DNA, 2848 bp, Bovine  19866881140451
aaatcccctgatgctgggaaagattgaaggcaaaaggagaagagagcatcagaggatgagatggcgggatggcatcaccgatgcaatgtacatagacttgggcaaatctcaggagatggtgagggacagggaggcctggcgtgttgcagtccatggggttgcaaagttggacatgactgggtgactgaacaacagcaacaatgacaaatgaagtgccattttggtgatcttggtcataacaggtagggaaaattaaatctagttattaaggaggtaaaacaatatttcaacatagaagcgtttctaacagaaatcatagttctgtgtttattactaaaatgaaagccaattaagatttaaaaacatcctttcaatagacagtatgattctcaagattatatgacttatcttttcttctgggacaaatacattctgaacagttaatatgttgttgttagatctgctttttagtgagtggtgaataaatacataaaaagtctatttactttgatattcttggcaatgaccaacataatcaataataggcaaatccattaagatggttgaaaattcagggtctattacagagatcattatcataacttgaaagacatctcctccactttcattccaactcttaaataccactcgcacttaaactttaaaaaattcatctttcgggatctacaacgctgctccaaagtttatttttacattttttttaaggttaaaacattgctcatgaaatgttcaatttatctgaatagcattaatagaattccttcactttttccatgaaaactttttatcacctcaatttattatacagtgttgattttttctccaaaccctcatattttactgtataatatgtgaatatttttctaagtcttcgtctgatcattcatcaggctttgatatttataaatgttagcttaaacctaaataatctgaagagaaaagaataaaaatctgtagtttcaaattggacaaatatatttttcttggcagttgagagtcagtgtaactgaataatatagaatttcattgcaacgtaacaaatatagtgtgtgtgtgtgtgtgtgtgtgtgtgtataaaatctttgaagttttaatgctctctctgtgctataccttttaaaattttatttataaccagtatatgacatataaacaatggaaagctttcaaagttgaattcattacaggtattaaatgcacccataattatacctttctctattcacttgagatgacctgttatttggcactttttggatggaaatattcttgttcaattcatggaatgttttccactatattagtgctagtatgtagtggctgccttatccagacatataattcttacagaaatactggaatggaactccacgaaattaatattctgtgtttcccctgcagacccttagaaagaggaattttatatgtttttttgcagaaatctgatataagcctgtataacttaaagatcacattcacgttatttcccataattacttagcactaggccaacaccctgtatacaatggcatatttattttaggtgaactatagttttgaggttttataatttctttgcgtaatgtgtatatttagaaaacatatacatacagttgacagacattataactattcctgctatacaatataaccattgagcctttgtctatgaatcatataaacataatgttatgaaatgttttaaacttcaggaaatagattactttatcctgtatttcaaatttaaaatttttatggcaatatgtatatatagaacatttatatatgtgaaagaaattcataattgcctatgtaagtctgtctgaattaatttattcatttatttcccctgaaagtcttcattcactactggtccttcagtggtaaaaaaatatgatgtcaaggagagtcattgacctacctactaaaaacagattaacttctataaaataaaatcatccagggatgcactgatattttttgattgtttaaaatttgagacaaaaaaatattaaacataataataatcatgatccccttgattctaccacccaacttaagagctggaatattattaatagtgtttcatctacttctgtgtttccattcttcttcctcccccagaagtaactattatactgaattttgtgtttatcttactaattattttaaaaatagttttatcacaacaaattatgttacttaggttcgtttgcttttgagttttataaaaacaatgtatttattatatgatcattaggtttcaacgttacatagcagggattggcaacccgtcatctgggggtcaaatttgacctgtgaatcaaatgttacattttacataataagaaaaaaaaaacttgcagaacttttagtattattgtctgaaacagaacttccaataataaattaccagaaactagtaatttggagattgtcatgaatcactaaagaactaaaaattctttctaaattctaaaggactaaaaagttgtttcaaacttactgtcttagctagagctatgactgttgtttagaggctaagtcatgtccaactcttttgtgaccccatgaactgcaaaccaccagactcctctgtccacaggatttcccaggcaagaatactggagtgggttgccattttcttctccaggcgatcttcccaacccagggatcaagcctgggactcctgcactggcaggcagattcactaccactgagccatcagggaagaccataacagggctgccataataaaataatctgcttaaaaaaaaggcatttatgatctcacagttctgcaggctagaagtccaaggtcaacatg

SEQ ID NO: 56374 - DNA, 1404 bp, Bovine  19866881155178
tctcttactcagaaaaaagtccttcagaatgaggtattcttacaaaaaaatcattatatccacatatgttcataagacacactattaaatttagtagtcccatcacatgtaagcttcagatattgttgctttaatgcattccctcactactttgataaaagccttaagatgttgccactagttctttgatgatttcctctgatgttacagtacctttctttttttcctccaaaaaatctgttttgcataaacatgagaagtcaaggcagtttgagttaacgagtaaaaaattcaagtttttgcaacaaaagtacatatatttgtacttagagccctctttctcaacataagagaagtttattttctatttctagaaaatatgaacctttaggtctaagagaaaccccaatatgtttttcaagtttataactttgagctttattcagctatttccccattgaattaatgagatttattaatggaattagagggggaagaggtatattgacctagatattgacacagttattttccccatcacgcctgcctcactcctggagtcctgcattctgttggattcagagatggatgaatttgtttttaatgtttagttctagcttccaaatcattttgtaacaattacatttaataaaatgccatttttgttagattacttattatatccataattaggtttaatactcctgtatggattaaatattaacaaattaataatcaacttgtttgtccatttgaacaacaaagttctgctttcaactgctgctgataagtcgcttcagtcgtgtccaactctgtgcgaccccatagatggcagcccaccaggctgccctgtccctgggattgtccaggcaagaacactggagtgagttgcgatttccttctccaatgcatgaaagtgaaaagtcaaagtgaagtcgctcaatcgtgtctgactttagtgaccccgtggactgcaccctaccaggctcctccgtccatgggattttccaggcaaaagtactggagtggggtgcggttgccttctctgctgctttcaactagactatagttaataacaaggtattgtatacttgaaatttgctgagagtgggtaagtgttctctgcatttaaaaaaagagttaactatcagaagcaattggatatgttaattgttttgatcatggtgatcattccataatgtatatgtatatcatatgcatttttaaaagccaagtgtcatcttgtgtgactctcttctataaaaaaatgccattctaccagctctcagtggtacctgtgaatttttattcatctcattgtgctaagatgccatttttttcattttgccccctatattctgtgacttgatagtataaacatctaaaatctaacttttgcatctg

SEQ ID NO: 56375 - DNA, 942 bp, Bovine  19866881162727
atatatatatattttctgttgtactactttgtcccagaaattcacttttctaattctccttttagccttacttcaactcttctagaacaatgggtctactcagcatttttaactttttggactctacaatgtgactttctagacatttgattccttgtatcatggttcaatttttggctttttgtgtttactttctaagccaagaattattagtttcccctatatcatatctggcttcttggtctcccagtctgctgaggtggtcataataaagtgatttaaggtagaaatacagaaatgctctatgaccctttaagttggccatcactattggctctgcatgacttagcacattgatggtcagatactcaccttccaaccagaattggtgactttctcctcttcttccttcatggtggacacccatcttagagaaatgaactgctggatggaatgagtctgtccagggcaatcggcttttcccacagagtttctcccatcacactgttctttccagtaaacttttctctccccttttccctgacttttggtccatcagtttttccggagagttaatcagccgattcactgttaagtctattctctctctcagttctttttttgtttagctaagtgtcagatatgtcaaaaattgaaggacaagatacaggagatagatatgtagatatatatatatatatttataaatatctatatatgtatgtaaagagagaatcatatgttgcattatgttatctgtataatgtaggtaattgaattgagtgaggggaaagatttattaagcaaatacttcttttagatccaatcaacgtttatacaagaacattattttaaatattcattagtaataaagcataaaagtttggctatagagtttcctcaatataaaaagaagatggactttcctattcctatattcca

SEQ ID NO: 56376 - DNA, 774 bp, Bovine  19866881166146
taatactatagcactgattgattccaaactgtggtacccactgcttttaaaagcatgacttcaaacacaatgcaaaattgttttaaatataactatggaattaccgagagaactctttttccatttatgtcaaagatgaaagataatttgtgataatgcatagctattttcctgtcatcataactgaacttattctctaaactgtattaacaacagggatcatcagggggcctacccactgatatcttactacacacataactagtgataaaacttttagatcacagttcgtgttttcaaaatgcatttactttcataaaatgccacgttcacttatatattaatatatgagtatcatacttaagatcatgaaatacatttgctctaatttagcaactaggagtataaatttgatttgataagattttttcattactttatttgattgaattaatactaacaataaaatatattattgggtttaggaactaaatttgtggttgcaaaaatctgaattcagatgctgactctgttagtaggattgccagataaaatacaggatgctcagctatacatatgagtttcaggtaaatgacacgttattttttggtatatgtatgtccatacaatatttgtacatacataaagaaaatttaaaaatataaagaaagctgagtgcagaagaattgatgcttttgaactgtggtgttggagaagactcttgagagtcccttggactgcaaggagatccaaccagtccatcctaaaggaaat

SEQ ID NO: 56377 - DNA, 1133 bp, Bovine  19866881172542
ttgctttcatttttagccagcttacttgatccgggggttaagaatagctttcctctaatggtgtcaatctggaaaaagagagagactttctcagaggaagtagctagtcagttgctgtctgggcaaagtgtaatgtaaagagagtgggatcatccagaaccctcctcctctgtctcctgctccttccatcacgtccagctgctttttcctcaaactatggcttgagacttagaaaaaaataaatgggtctagcagaagcatgtgacgaaaactctatggaaaagtacctgtactattgcaacactgactctgtagctcacagctaattaatcccacaatagaatgtgagttggctagttgtattttgaatgttctcatgtggcctctcttgacgggacttgccaccaagggttttaagctttcaccctatttaatattcatgtctaaagaagcaaggtgccttgggatattaagaatttttaaaaaattggtcctttaggtttagattataatggaaaattcaacagctatagctgctggagacaaaaggtgaacaattcacattctgaaagtaaactatcaactatatgctgaataggaaaagccataattattggacagtgaagtgacaggctttgcaattgagtggtttagtaaattatacccaccagaagttaatatcccacatgatatgattcctgagggcaaagttccttacagtaggaacatatttcaatgagagatttagtttggatagagggagtgaaatcagatatcaaaaatatattgttaaaatttacagtactctttttaatgaagcttcaatccctacgtataaaactcattctctgttagtcattcaggcatttgacatctattgtgacttgaaccatgcagatttgaagtttactaggaatttccctccctgaaattccaatttgttgccaatactgctctagtctcttgatgtgtgcatacagcatcgaatagatacaactgaagacagatgtattgcagcaactcttgagttaataatactcttgatgtctgccagggctgttccaggcttgggtgtacattttgggaaaactcccaagtgatgctggggggcacctttgattatgaagcataga

SEQ ID NO: 56378 - DNA, 729 bp, Bovine  19866881309090
atatgcttgttaaagacaagacttttgaccttaactttctcttctcccttcctactctctagaaatagaaatctggaggatacaaggaagcagaaatacagggctggcagagtggctcaccagcttgggtcagtggaatgctccttggaatagaactacctgtatgctttggactcttacagacaagagaaaaagaaaaagaaaaaaaaaaaaaaaaaacttcaatcttacttgaagtttgtattagggttttgttgttacagcaacatggcatatacactaaattattacatgaagatatagtgaaagtcttcaccgacttactactggtcttaggataaaggctaaaatctttccctggaacacaagaccctgtgtggtgtagttcctgcctgtttttcaaaccctatcttaagacactctgctttttgcccaccctgttctagccttaaatttaaaccttccatcagtgccctgcatgctctaggctctttccatatgtttttaccttttcttagttctctctttcatccaacaaatttccccttgtgcatccatatatataattcaaatcttagctcgtttaatgttctcatgaaaatgttccctgaacccacagtccaggtcacattctttcattataagtttaatagtgtcctgcttctgaatgctgtatggtcaatcaagcaatgatcctctgttaggctgtaagctacatgacagccaagt

SEQ ID NO: 56379 - DNA, 1224 bp, Bovine  19866881357806
aagtcatctaatggggagggaggagagaatgtaaatgacgaaaatgaggccgaaagtaaaattaagctataattgtttgcacttcaactttaagaagttcaccattaattaaaatgtttctgcaccactcgccaccagactggcaagaaggaggcaaggctgcctatgagagcgttctggaaccttcaggaaggcaagcaaggcctgtgaggagggaacaagcatctccatctccagcacacagaggcggtagagacaccagaatgcagggtggcaacctcatcgccgcattcctctcacggccctcagttttgattttggctctccttgtgcctcgctataaattactcttgtaccttttcagaatgaagggggatagggacaccgtttgtttaggaaacatttaccctgtttcatggagtctgtctcacatttcttttttcccatttgaacagctctgaaatgtaagtgcatctcacagtgatgaccatcctagagttcactagcaacttttttcttgagctgtttttttccataaaataatgctgatagcatcttagcttcaattaaggatggaactgaatctctcttctgtgccaggcactgtgcaaggaatgaggaataactgagatgtaatataatgtcaaaggaatataataaagttaggcacaatgaacatgcttgaaattgaacttgcagaatggtcgctgcaattacttagtggctcaccaagcatttgaacatggaatcttgtaccagtgtcatgcactgtaacccagcattgttctggtgactcttttctggattgatgagcagtgtcagtggatgaatgtagagtgtaagctctgtggtgcagtgagtttctcctgtttgttcactgcagcgttcctatcactgagaacagtggttggcacagggagtcactggataattgctcattgaatgaagaagaaaccaggccaggggttggctttgccctgggagcaaaataatttttacatctataaattggttgaaaacaaaaatcaaaggaataataatatttcatggcatactaaaagtgtaggaaattcaaagtcccgagtacataaagttttattggcatgtgtccacattcattcacattttctctgactgttctcttgccacaaaggcaaagctgagttgtaaaggtgatcttaggacctacaaagcctaaaatatttactatttatggaatagtaa

SEQ ID NO: 56380 - DNA, 1628 bp, Bovine  19866881364894
agtacattatcatattttctactgaatatttaatacatttagtttttgtacaagaatatagcttaaagtttattctaagaacagactaggagagatactataattatcatcctttataccaaatagccaagggaaattaaattttattcatattaccttgattcttgagattttgagagcatgttgtaggaatttgtacaatctttattatagtacttttatccctaccaggtagggtggaaacaatggacatatcataggccctacataactttcaaatctcacccagcacctgagcctaataatcaccagtggtgctcagaaatcgttttaggcaaaactaagtagacagcttcagcctttctgcctcccgtgcctatccttctagcattttttctttcatttcttcggaacccactgttcataaatggttccatcctgaagtcagctaaacataagagatttgataggctatctcattcaaaaattaattgcatttacacttgttttgatggggaaaaaacttattttgtgggataaataatgaaaattcagtcactctgtatcatagaaagggaatattcttggtaaaggggtctccttagcattactgtaaagaaaaaaaaattagaacctctttcttcatccttgagacattgcttaaaggggtgtctgtggggggaagaaggaggagagggggagaaagactatattttcctagcaataaaaatgaccaaaatcctataaaaacactcataaatctctaaagggatttcttatatatgctataattttgagggttgcatgaacgaaatgatcacatccagattagcaagaaattacaactaatttgtaagggctgacaatagggactaagccatggcattcaagccagtgagtaatcagaatagttgacagccgttcttcaagactcaaatttccgatgtggcatgacacttggacaaacaattattagcaaactatagtcctatgaaaatcagtttataattaatgaaattttaggacatgccaatagttaccagaatatgctttatgtgttgtataactttcattagaaaaaaaaaaatctgcaaaaaggtatctgaagctataactgcatgattaatttttgccacaagaaatatcaatcactaaataccaaacattttcctcagagctactggagacattaaatcaatatgtaaaatgccaacaagacattgcagaatacattccttgcactgtcaaagagcactatccagaatattcactgtagaatgttactgtctaccaagaaagccaccatcctagcaataaatgagtcaccatctattaaaattaagaacttgcttaaatctggaagttttgcagtcttgacaaggaagttaccagactagaaaaaggcagagaatctgaggcattcaccaagtagtgtcattaattgtccagtggtccatatcattaaataagtgttgggggttggggaggaaaatcagcaaacaggagatatcaaataaccaaggccagtccttcagaaatccccaagtaagctagttttttttctcatgtctcattgccagtgtcctgacaacctcctcactgtgataccttcttcctatttcctagaa

SEQ ID NO: 56381 - DNA, 1920 bp, Bovine  19866881378103
tcacagagcaggtcatgtaatttttcaaaaaaaaaaaaaaaaaaatcgagggccagggcaaataaacaaaaagtcacaccaagttcacccctccaaagatactcaggccagactgtgcacacaaacttcacttgctactcatcaacatcagcaatttatggccagatggttataaatttacattctataaaattttagaggatgttattttttccactcagtttgttaattaactttcagtcttttttatttcctcaaacataacagttcactcttcttttattaatgatacagtatcatattcttgcctgtttcttcatcaatctatttgaacaaacttcaaactttcatgaaggatataaaaaaattaggatataaaaaaaatcactcacagccaccagtactggaaaactttttctgggcattattttgcactcctgaagtgaactacaatgaatagggaatcattaaaaaattctgacaaagtaaattaacattaaatctagccctttgtgctgttcttagtcgctcagtcatgtccaactctttgacaccacatggactgtagcccaccaggctcctctgtccatgggaattctccagacaaaaataccagagtgggttgccatgccctcctccagggcatcttcccaacccaggaatagaaaccaggacttttgcatcatagtcagattctttactgtctgagccaccagagaagcccagccatcagggaacttttacaccattattttaaaatccctgtcccacttaacattgccttctccgatatatatatatatatatatatatatatgtaatatatatatataatatatattttttcatattaactaaccggagaaagctaaaaatttttctttaaaaaaatactctaaaatctaaaatcctaatattaaaagttgtatttttttttttctgtagcactaaaactgctttgtaaaatatcaagtaaagacaagaaatgaaaaaaaaaaaaagacaagaaatgaagaaatgaagaaaggaaggaactcttagagctgacagttgtagaaattccatcagtttttggtgtatgtttgaaactgggccattgtgaactgagttttaaatatatctttgttttatagaatactaatacttgttttttgttatacaaatgaaacaacaaaataacttttgatataaaatagataaaatattatgtggcaagtataatatcttaatattatttccaaatttcctttattgtaaactcaaagtgtattgttatttgggagagcagacatgtttaagcagacttctttgagactatttttcatcagtgtctaatggcaaactctttttaatgttgacatttactgcatttcatagaaatttactggaaaacattttacagatgctgtgtgcacagagcaattgattaaatatttgaaatcatacagaggaatatattgctggggtcacaagatcctaaagggcacctttgtgtgtatttttctgagctcacactcttacaggtatatcagaaggagagtggttcaagtaaacattgctctgggtatggatttatgccagtatggatctactctgaatgttagggaaaactgaatttgcttattttcaaaaggttaggcagccacagttgtggccatgtgagtatgaaactgagcaggggttgtgctttttaactttttgtttcacccagttacttctttgtgctttttcctgcttatacgttttaatggctttcaaacaaatctgaaatcaggcataaatgtagagtggaaagaatcctctaaaataagacttgtttcctcaatattttttttcccttccattaagtgattaactatagaaatctctcagtctgggtcactcagatcgactccctcttcttccaagagcagatatcaa

SEQ ID NO: 56382 - DNA, 731 bp, Bovine  19866881414147
taaaattgtagttgttaataaaggacagtcatgaatagagaaattatctgaagaaatccttctttatgaagtagcaagagtaaaaatcctacgtggtttcatattcatgggattagtgtggaattggaacacttttcctgtagcaagatgggagcagaaaagtgtcttcatctctgctttccggattctgacactgaagctttattattcaacctctttccttcacccaattaacgtacaaaaaatattaatgtacaaatagtcttcttggcagacagtacaaatcatgtgacctctgttagaatcctatacactttttctgaaaacggtacaagttaccaggcaacatttactacagtttattttttcttatcttacttaattaggcagattttttttaaatgtgtttttttatagctcagatgtagcctaagtgacatttgttgccatagtcactatggtgagtgttcagttttttgggattataaatagtcacataaaatttatgtaaataaccagagatcaggttagagttttcccaggaagcgtgatggtatttcagccttctttttatacttttatttatttttttctttcattaactagctactttaagtattggtagtgagggtctagtttgattttctcaaaaaatggttgaagacagccagaagggccaccattatccaatcatttcagaataatttttctctcttttggatctcatcttc

SEQ ID NO: 56383 - DNA, 1172 bp, Bovine  19866881497148
tcctgctttgccctagatgaaaagggaagaccccaaaacattggtaggaggggaaaaatgcaagaagtaaccaaaatactctctttatttggctggttctctggtgctagcaaatgactgaatcttccttcaagctcgacctttcttctggcagccctttccaatgctttaaagacctacacccaggctagggttctctctcctgcaaaactaaggcctgcaggtatacatcttgcagcatctgagggcctccttcacttaccagcccaagaagacaacctcacctctgagttggctctgatgaagtgtgtacacctgcccaaaggctctggcctaaaaccaccttgtctcattctctcttgttatcctgtctagttcccacaacaaactcagagagcagagccacatcttcaatacccagttgacttctcaaacttaagatttctcaggaaggaagcagactctaatccattaagtcctccaacagaacaggacataattctggatttcccattgatatggtgaaaacttattttataaatttcaaggtaagggtcaggtaacctagccctacctcacttggaaaatgtgtccaatatacagcaaactagcagctccttcccaaataaaaatcctaataatctcctctccatgtatcattttcactatctttttttctgtatggtaagagatttaggagtcatttaaccatgtcttggcaacctattttttgcaacttctgcagggtgatctgacttatatcttactggcatttattattttaaagcactggcttaaattttctctttaatataatgttataaatataatagtctttgcttttgagagtgtagagacatgtgcttctcaaaaactactaacatgaatttaaattaacaaaaaatctttgaaaaacatgttgacagtatgattcatgtaatttctaatgaccagattttttggtttcataattccatttctgagataccattctaagtatacaatcttgaatgtaaaaaaaggaaaatggcatataccagctatctttaaaaatatatcagaaacaatctaaatgaaaacagtaagtggttaaataaagtaatggaaagccaggtaatgaaatattacacagatagtaaaatatttttgaagcttatacagtaatacaaaaa

SEQ ID NO: 56384 - DNA, 1796 bp, Bovine  19866881600935
agtctttcctaagtcatatggtgaagggtgttctcagaacacaaaagagagaggatttctcaaccgtcctattttcttggagcacagggcttgagtacatttcaacactgggagatcagaagttgttttcttcagctagctctaagactttgactctgcggcacctgtgctggtctctcctgggcctcttgggccttttgaacctgaatgttgtgtacagggccccagattgcatccatgcagaaggaaatagaaccagaactgcgagacaggtgaaaggtgcagccggttagctagcctgactgccctgtggcaaacagcatggcacttctttcacacttggctgcagtgaatgcccagaactgctttctcttcaagactgtcctctgaccctttgagatttgagatgtttggacatagggctttcttctactttgttgcgagttgaatattcagttggaatagttttctatttttttaactgacttttaaatccttctataattctaattaagctcatcttcatctccggagcttggctagctctaaggcaagaaataaaggaagcttgctcgccaggccaggcttcctaagctctcacatctctacttgaattgatttgcattataatgcacatgggcaggaagataggtaaattgaatgtgtgattaactgagcaaagaataaagtccatatagagttaacattattgctaggctacttgcaggtcatttctgaaggatggaaacaggcactcgctaagaatgaatgtatgaaatatgatgattatcttattgaatataaaacatttattacatcatccagttcctttttatttaacatgaaatgtgttaaacaatttctaagatgagagctaatcatgctatgtggaggtagcccagtgctggcaaatgggaaaaccaatggatctggaaatgatccttttagtactaacggggagatacagtaaaataatacagccctacctgggatgctagggttttcacattgtcctgcaaaaactaatgtttttataaagtatgtatctggcaaaaaatatatatcctatatctaattgtgtttgggggagtatttagtgcattcagaaataggtaccatttttaaaaaaatgaaacttagacgacttaagaagtagctttgtgaggatgtactttaaaacaacatcctatacataagcaaaatgttttgtctggcatatgatagtcatgctgcatgacctaatggcacccagagaaaacattcttttgacattcattgtgaatttgggttccctcattcttggcattttgtaaaatgctttgataatttaaatatcacctttagactttcacaatacaattgcttagataaagtttgtattaatcataacaatacacatataaacacttatacttcattgtctctttctatgttagtgtgtccatggacagatttttgcataatcaagttaatagtattcgtgaatctgcatgatacttctggtttattctcagtcttggttctttccactttattaaaaccaatcataataagaaaatgtttatttcatagggaaaaaatcctatttgtaattattagcataccatatagggtgaaagcaagcagtgttttataattgaattatgtacaataaacatgtgctgggaataatgcttctgtatgttaagaatgaactcagatctctaaaaaaaagtcttgtattttttaataagtaaaaggtttatcttaagccatttctgaaaagcgatgttgctgatgttacacatgctgaacat

SEQ ID NO: 56385 - DNA, 1743 bp, Bovine  19866880372845
tgccaaaaaaatcttgaatacagatattaagtgggatcatagcatcctgcaagggctattacagaatatgaattgagtgggatatttgtaattcattgattcatttgataaacttttatcaagacttacacatgccaggcaggtacctcagtatcgggaatggggggaatttattaattattgagatgcctacgtgcacacacacacactcagaattcacatcacaaaatctccttttgacacctgggtactgttgacctgaagcaccagctgcggttgcttgtttttgcttcagttacccgacttctttatttaccttcccctccagtttaatttggtgttgccactgtgtaagaagaggcttagatgttgggagagaggtggaaagagatatgtgtatttggtgtaagacatttgtgtgcacaactgagccgccgatctaatgagatgacatccgggtctgcaagctgaatgagaaggaagagagatgggatttacaagctgtctggataattaaagatttgtttaactctcaccaggattccatttcatggttttgtttttgtaattaaaattatttcaccacagggttaaaaccttatatcttaagtgtcacccaaaagcatatttttgtgattgagttgttctggaaagcctttgaaacacaaggtttaccaaggaaataataaaatgcaggcataataaatacaaaggggcaaactcaaggtggctgattagcatggaaagattattgaagtgtgcagtgaaatatggggtaatctagtggacatggtttatgggcattttgtaaaacccagctttgattagtgtgtgtacttttggtaataggatacatagtcttgaaaaaatattggagtcccctttgaggtataatggtttagcacagatttttcatttgaaattagtgtttactttcagccagagaaaactcccagatgttttttccattaagttgtgtatttaactcgaagccataattacagagcactttgcaatgtgtggtgttattgcctgtatctgaagcctatactaatattaataactaccattcattaagggtttgtcttatgcccgaccccgtgttaagcattttgcaaaccgattttaatcctgaggaaaacctgtgggtattattatgtccattttacaaattaggagcctgctacccaatgaagttaacaagtcccctgcccaagtttctggaaaggcagagctgggatcctgggcaggtgtgtctgactccagagccttggagctctgtaccgactcaggtcctgaatgggggtggggtgtttgcatggggctccctaggtcttgcctcctgtgtcaccagggtgctgtgcagttggaaagaacatgtggtcctcctctactccagcagccagcacctcagtttcatgttctgtaaaatggagatcataattaaaaaaaaattatttatttattactgtttaactgaagtacagttgatttaaaatgttgcattaatttctgctacagcaaaatgattatctatatatccatatctatatataggacttccctggtggctcagtgataaaggacttgcctgcaatgcaggagccacaggtgatgcaggttcgatccctgggttgggaagatcccctggaggagggcatggcaacccactccagtatgcgtgcctggagaatcccatggacagaggagcctggtgggctacagtccatggggtcacacaga

SEQ ID NO: 56386 - DNA, 1146 bp, Bovine  19866880379314
taacggtaccaaactgtaacgaccagtatatacggcaccgccgtgtagtcctggatttttcttaaagtaccaatttcacttagcaatgaccttgataaggcaataaaaagtattcactgtattaaatgtcaacccttgagcacataacattttaatattctgtgtgaaaaatgggatgttccaacaagacctccgtgtgtatcagttacaatgggtgtgagctaagctggctgcctttttaatggaatatcatttttacttgaaaacaaactatgcttattcagatgtgggtatttggcagacattttttttctaaaatgaacaaagtgagactatcacttcaaggaaaacaactgaaagtatttattgccaataataaaattccaactttatagcaaaaatgaaaattttagaaaacttggcagtataccaatatctaaagaattttaggatgaaatcggtggtgatattgaacaaagtgactgtttgatattgtataacaaaacgtgtcaacatttggaagatttacacaactcagtgaatcaatgttttccaaacgaccagtgcatgatacaagtacaagacagaccagtggattttaaagtaatgaaatgcagggacttccctggtggtccagtggttaagacttcaccttttactgcagggggtatgggttcaaccactggtgtgggagctaagatcccacatgcctcatggctgaaaaaccaaaacataaaacagaaataatattgtaacatattcaataaagactttttaaatggtccacattaaaaaaaacctttcaaaagagtcattgatatagttgcagaatccatcaacttcgaagaaaccaacctttagagaccatcagctgttggtttacagtatcaagtcaaaaagcaatatccacaatcatctaagaagtctattaaactactcctccctttccagttacatatttgggtgaggccaaactttttttttcatttttgcaaccgatgtatcacatcagattggatgcagaaccagatatggagcttcagctgtcttctattaagctaagcatttaaaagatttataaaaacgtaaaacaatttcactcttctcaccttttctcttttaaaagtctcttatttatgttattat

SEQ ID NO: 56387 - DNA, 2114 bp, Bovine  19866880400036
cttttcctgatgaaatgccagtatgagagcccaagtgcccatgtctccagaacactccggaacaggcattaccctgcaatcaaagttcatatgaaatcagcatgacttaactacatcacactgaagattcatcatactgaaaatcaaattctatgccaatgatacatggcacttgtagcttattttacaaacattaactaattaaatttgcaaaacatccctgagcagcaagacataatgatatctgagctgacaacctaattaagcctaattatttctaagatttccctcttccaagtgggttctatctccagttcagagaagcgggctcgctatgtgctcaaaccagatgtggaagtcagctatcacttattccttccaaaattctcttgctatgaggcgcccacatttccttttaggacagctcaacctgtaccattttctactggaaaggctcatagaaaccccaaaacccccaaacactaatctagccttgaattcatagttctatatcttaagtgacattttttgctcattttttatcagcaagcagttttgattgttatccaaattgcgttgaccagcttctctctactgccttcctttttccccccataccgtctttttctaccgtgtgtcctgatagacacaggccctatcttccacgcagtttcttgcttccaaattctgtcatcaggaagttgccttctttgtgctttttttcatattgcctctctgacttgaacgctctcaggtttcctcaagttctctgcagtccctcttttcctttctgcttaaaattaggcaactttgttccatccgttcattacatatcagcttctaaattttctcttcagcagcaagctaggccttgaaagtgaatgccatatgtttaaaaacattgctagaagacatattgtgaaggggaatgttactgtttgtggggggaaaaaagaaaaaggttatacaagtatgcttaaatatacacctcgggagtgggaaataaataattcttatgagggttgtattagaattcttcagagagaagagagagagatttatttttaaggagttggctcataagactgtggaaaatggtaaatccaaacccagcagggtaggctagtaggctggaaattcccctaagagtcgattttgtagccttaagtttgaaggctgaattccctctccttgaggggaatctcagtctttgctcttaaggccttcaaacgattgaaggaggcccatttatgttacgcagcataatctgctttattcaagtctacttatttaaatgttaatcacatctaaaaaattaaggactgatgctgaagctgaagcaccaatactctggccacctgatgagaagaagtgactcattagaaaaggccccgatgctgggaaagattgaaggcaagagcagaaggggatgacagaggataagatggttggatggcaactctgactcaatggacatgagtttgagcaagctctgggagttggtgatggacaggcaagcctagcgtgctgtagtccatggggtcgcaaagagtcagacaagactgagcaactgacctgaactgaactgaaaggcagaatacaataggcattgtggacttcattcatcctgtaagcagtcgggggaaagaaaatgaattacatccttaaaaagatcactgatctctaccctttcactcttcacctcccctcccatgcaagaatattggagtggactgccattcccttctccaggggatcttcccacccaagggatcgaacctgggtctcctgcattgcaggcaaattctttactgtctgagtcacaaaggaatcttgagagtaggcctatgcaaaaaaataaataaataaaaattccaaaaacctgtgtcctggctaggagcagggaactaaggcaccgaaattttagaaaagacaatttttgtaattttttctcacaaaatgtacatttagaaaaatgcatacatcataaatgcataaatcagaaaaatgcattagtgtacatcccaatgaattttcacaaaattaagacattcatgcaatcacaccaagaacagagtatccctagtgacttaggcatctttctgggctccctt

SEQ ID NO: 56388 - DNA, 1656 bp, Bovine  19866880413328
gttggcagtgagaaatggagctcgggcagcacgttagcatcctccagtgcacacgtgagcctgtgaccagacccgcagaccacagggtgaggcccaggccaacagcgtggggagcagctggcctgaagtgcaagtgctatgtgaaaggccccgcgtccacccagacgctcaggccaggcttgctgacccccggcttaaacaactggaggtgggaaatgtcactcttcttgcacgttccagtggtacaaatcttgcactggacagaaaaattctgttggcgaaagctatgttactggcgctgcttttgtaataatgatacttgcattatgtaaagtctacaaatctgtgttatttggaatcattgaaaacttagtatcacatgcaaatattttttaaactaagctactgaatgtgcctttttagggcttccctggtagctcagtggtaaaaaacccacctgccaatgcaggagatgtgggtttgatccctgggtcacgaaagtcccctggagaaggaaatggcaacccattccagtattcttgcctgggagaattctatggacagaggggcctggtgggctacagtccatggggtcgcaaagagtaggacatgacttagcgactaaacagcaacaactggatgtgcactttaagggtaactatttacttcgaaaaaataatataggaatttgaaaaacaatatgtagctattgtaaatattcttaccctaaagttaattttatcttctgtccctattgtagggatcatattttatcaggagtttcttggtgcagcttttctcactatatttatatatctttttgggtgagtaaatgtctcagaggtaaggcatgtgaaatcctattacttttacgtgagatttttggcattggacctgaggcatggaaaattggaaaataatataagaaacatcagtttcccgagctcttaaaagaagcatatttttcaacttaacaccctacccagagctcagtatctttgtgatttaaatatctctgtgagggatctgaaacactggagattttcagttccagccaaagtcaaggtaaatcaaaggcccttgtagctactccacctttttatactccatcagacctatcccagccttaggaacctttaggttagatctcagtcagggaaccacagatacctctaggatcacctaggatccaaggccaagactggggcagatctctgccttgagacctaataacatcagattggtgccatccctctcttgggtctaggtgcccagctttaaccctgcctcggaatttgctggacaatcattgctggtgttctggcagatagagagtagaaccttgacagaatatcaccgatgtactgattcttcccttggctcccacctggaactctctgaatgcttagttgcttcttgatgtggtattctgcatgaccattgttatgcaaacttgagcccagactattttcaacatagaaagctatctatcttgaaaattcatttttgtgagatttttgggcgaagctaaacttctggggtctggaaactatgactatgcttatggccaaggacaacgaaatttcttagaaaattaaagaataaattatttttttgcttgtgttgcatgccagtaatgggtctgagcatgcatgg

SEQ ID NO: 56389 - DNA, 1755 bp, Bovine  19866880448873
tactttggcccctcatgtgaagagttgactcattggaaaagactctgatgctgggtgggattgggggcaggaggagaaggggacgacagaggatgagatggctggatggcatcactgactcgatggacatgagtttgagtgaactccgggagttggtgatgggcagggaagcctggcgtgctgcgattcatggggtggcaaagagtcggacacgactgaatgactgaactgaactgaactgaacttcaaatctagcagcagaactgagcaagtgcctcgggatgtttcagcttatcattcttctgtcttctagcaataaaatatcatttgtatggtcaatttgtattgtttgtactgaaaggtaacaattgttgagaaatctaaaaaatgacatgtttgatagcataccttttgaaaagtattttgcaaatttgcaagctgctgtgactttgttaaaccagcacttgttacatagagcctaggggtgtgtcacagaatgctgacccccagttcaataatggaccatggtagaaatgaaaatggagagatctcaggggaggtacacagcccacctccagaggccacagggggaggaggtccaggcggggtgtagacacagagagtggcaggacctgggacacatgcctttatctgggtccttgggtggagtgcttttggagttcctaggctaagccttggatcagtcctttcaaacccctcaaagcagggcttttgcaagctccaagggggtcttatttaaggggcctagggaaggtcctgggaggcaggaaagacttgatcaccggttgctaggggagttgtatcaagaactgacatttgtttgtgactctgtgggctgttatccaggaatacgctcagggggaagagctagggtgggtccaacaatctacttggccacacagaatacgtgcggaggcagcagtactatggtatagtttaactaagctctcaacacacccaaactcggttgaatgattctacaattttgcctacagggaaaatgcacattttcatataaaggacaccaaattaaccctctcattatggtagtggtcaaattgaccatgataagcagagaagtagaatgaggcttccatgatcgaaagaacagtcgacccattcctggtcactacgtgtgttcctcagatgccggccactgtgcctcttgcttggaagagaggaaccgagcacagcgttggtggtacaattcgcattgccaggattcctcccatgagctctgatatttttcagttaatttttaaaaagtgctggtagtgaccattggttttaagacctgccaataggtggggcctgcagtttgaaaaacacccagtcaatgaaaggggttgagtttccccactgggtcaatgccagagtagagataaatgaatatccatgagacgtggcatcccaagaacagggattatggcaagtttagtggagccacccaattagtgccagaggtgaccatgagacccttgaccttttgaaaaatttcaggatgtggggagaacactgcagtttcctcaagatagggacgcaagtttgggctgaccttatcttgaggggcctggtggtcccagttgccattggcttgacaacagcagcagtgcattgagttttggggcatggatgctgagtgtgaatcttggttctgccacttactacctgtgtgaaggttgttttacctttttgtggttcaattttctcatttgtaaaatgggatagtagtat

SEQ ID NO: 56390 - DNA, 1668 bp, Bovine  19866880449171
tgggattcaaatcctggccaagttcaatgttttatttatcagttttgggtaagcctttcaagtactaggtttttattttaaacttgttgtaaaacattaacacaaaagtgaaagtgtacacatgagctgggacgtgtggcaaccttgcagaagtatgatttcagagaacacaagaaagctttgttttgctgtgttggtctttttctgcataacctaggaatcccttcacaacccgaccctgtcttctcaagtccacctggaccaactttaccttccagtctttgttattctgccggtcctgatgcctaccctccctctgcttttctcagtagcactctcatctccctgaatccccatctctgtcagtccatccattcacccagccaccccctcgatgtgaactgcatgtattctatgttgacggccacacgatgagttctagcagaactgggcctggacccggatgggactggagtttgtgaaaagaacaagatccatcattcactagctctgagaccttgggcaagttacttatcctccccaggctgcaattttctagctgaattcggtgaaactaagattcttacgaggattatatgagaatacaggctcaagtatctggaaccaagtgggtgctcctacttcgtctcctgatttctgctccatgcccatgttttgatgcaactatactaaatgtcaaaagccttcaattttagaaaaagatgtgttggtgatgagagtgtcatttggtacaacccttatgaaggcatttaggtagttagctctcaaaattataaatgtgcttgccctttgacctagtaatgccactttttgggaaatggtcttacagttacgcttgtgcactttcaaaatgatgtatgtgtaaaggaattcactgcagcctcatttgctggaaacaaatcaaatgtgcctcactgggggtttggttaaataaattacacagtggattcttaaccaagggtaaaaaaaagagaaaaaagttctctatattacaaagagattatagaaagagctccatatttttaggtgaaagaaattaagtgaagaataatagtgggtataatacaccacattttatgaataaagatgggagagggaaataatatttgaaatgtataaagaaactttgggagaatatatccaaaaaaaaacctaataaaaatttttatccatagatgtgattgtattgagcagatggtgaggctggggtggggaggtggacttttcactgtgtgcatttttcagatgttttcagttttatgactattccattacaattagctgtatgtaatcagcccacccaaagacttaccaagcatgctatgtcaagctctagaggcaacacaaagacatacaagactcagtccagagactctgcacttgaaccaaagaaatcccatttatataatactcgtatgcaagaaaagcctctaaaacttactttaatgttaatgatttttgttcttcaattacagaggagaagtgttcaggactgaaatatcactgtgtgaaaatactggttgataactaaaggtatttctgctacacaaaggtcaattcacataactgtgaaattcaagcctcatcctatttattatctagacagtggactccaagcagctaggagagttcagataagaacaaaca

SEQ ID NO: 56391 - DNA, 1777 bp, Bovine  19866880453101
ccccggctgtcccctcagctcctcagtatatctgccttcttgaggcctcgttcatccacagtgggtacctgatgaaaactccaaatatactggaacaaaaaaatacataacaggacatgctcagtcctcttctcacagctcacctgaaggcccagtccatccaagctttgcggaagtggggctaactctcctcccctcccctcccctgaagcctctgtatgcctaccccacctcctctctacagtaactttctcaggcagctgaattgttctcatcactacttcatttggaaacttgtcttctcgctccactctgagacaacactccacttcctccattcttacttagcttggcttaggtttccactccctaagtacactaagacagtcaacacaaaaggaaatctactgagccagcgacttgtttcctcatcactcgggtgctccagcaaatgctgggctccagctgctgcagttgactccattaagctatccacccaatgttagggttgccatggaaacccgaaataacatttcaggaatccctcacagactgggtgactttggtttctaggcagtttcacaaatagttctttcttgcagctgataattaagatgaagagcagttaataagacagcaaatttaatgaactgaaacggtatttcttgcagaattaatcatcacaaagcactgaggatatgcaaattctaaagctgaaaagggacttgaaagactgggttcaggttccgtattttacaaacagagaagatcatgtggggtaaacgctggagcagacttctgactccttgtcggcccacaccacgcacattctgcatcctgatcaaggtccttgctttctctgaccttcagtttcctcttctgcaaggcagagacaatgaatgtacttatctcagaggggtgccatgaagattaaatgagtgagcatgtgtaaagtgcttacaatggtgcctggcatgaagtgaaagtcaaataattatttctgttattattattaattctacctgatattgtgttgagggctgcatggaagcaacatggcaaggcaatgaaagcattgctgtggactgggagcccacagcccccatcttctggtctccactctgccacctgctagatgacagtggccacaaaaccttcttcttttctggagggagggtggctatgttactctgatctctagggttggactaaataatttctcagttcctttccagctcttgcatgctatggttttaagaaaaatgaattaaatagagatataccttgacttttacaagtgactagatacatatatggagaaggcaatggcaccccactccagtactcttgtctggaaaatcccatggacagaggagcctggtaggctgcagtccatggggtcgctaagagtcggatacaactgagcgacttcactttcacttttcactttcaggcattggagaaggaaatggcaacccactccagtgttcttacactggagtgtaagaactgaagaatcccagggacaggggagcctggtgggctgccgtctgtgaggtcgcacagagtcagacactactgaagtgacttagcaacagcagcagatacatatatataatgatagctaatattaattggcaaccattatatatcaatacaatgctacatgtactaaacccttacttcacacaacaacctgttatctccatttaacaggtgggaaaacaggctcagagaggttagagtaatttgtccaaggtcacacagttagtaagtg

SEQ ID NO: 56392 - DNA, 1586 bp, Bovine  19866880464955
tctctctccgctgttctgtctcctggtccatgtttagtctaacgcatgtaacaacagaggaaaatagactttcggaatgccttctaaagctcttactgattctacatatacaactgtgtgaagtgaaaaaaagttaaaagtaagtaaacttcacttcctaccaaagaacccctaaccatagaaggcctctctaaggcacagccttgccatgaacgccgattcttgcgctgagtgttcttagctgataagatggttcaaatgggaaagagaacacagaactcatggggccatattttctcagtcataggcacaaggttttaacggttttttgcttcaaaggcttggtcctaactgcatggtggaggaagctgtgagaacataactactccttgcctagaagcctataggtcaccccaaatccctagcaaagccagagattgttgggggtggtgagcagggaaggaagtgaggacacagaaacctgtttcctttgttctggacatcgcttctgttgggtctacatgaaactgaaagtgttagtcccttagttttatctgactctttgcaaccctatggactgtagcccaccaggctcctctgtccatgggagtctccaggcaagaatactggagtggattgccatgccctccttcaggggaccttcccaacccagggactgaacccaggtctcctgcattgcagctggattctttaccatctgagacaccagggaagcctaagaatactggagtaggcagcctatcccttctccaggggatcttcccgacccaggaatcgaaccggggtctcctgcattacaggtggattctttaccagatgagctaccagggaaaacccccctagagtgggtagcttttctcgtctccagaggatcttcccaacctggagatcgaacccaggtctcctgcatttcaggcagattcttaaccatctgagacaccagggaagccccaagcctgcatcacggaagtgttattctcagtgggagtggagagctgggatgacaatgcatgtgaaacccctctggatggatgaggtgaggatcaggggaagaagctcttcacgttcaggtgaccaagaagaacgtcactcttggacccagtacaagggccacctcacgcttcccaaggaatgatgttcctaagcgtctggtcttagatgtagaattcccctcaaaggttctccaagcaacaagggtctgttcctgccattcccactcttttccctacccttttccaatttaaagaaatctaaaacagaaattctcactaccacccaaatcaagaaaacagggtcagtccttttctatccccagtgttttgtgcaaaactgataatcaaataaatgattattaacatttacagttaaactatcacctctgctttcctcattaaatgtacattttctgagggtaagaattacgttttatattaattcaactccagaaatcataccagcaataattcatttgtaggataaaattttctattataaattaaggaatatacatcttaccaggaacatttccaaaatcaatgtaaggctgtggcagatgttccttttct

SEQ ID NO: 56393 - DNA, 4143 bp, Bovine  19866880505418
ctcgaggttctcgatttctacccagactcctccagaagctttggaactgctcttaccgcctggggtcctgccccttccctgctcagcttccaactgcggcctgcttaccatcgtccacgcttaaggcccaccggccaccctccaaccccacacgcaccccagccccttgaccgctgccagaggaactcagattcttgtgctagctgggtgccttcactcaggctggtcccttggcccagtctacattcatcagaactgccttggaggacctccctggcagcccagtgtttagggctccatgctttcccctgccagggtcctgggttcggtccctggtaggggaactaagatcccacaagttatgcggtgcagctaaaaaaaaaaaaaacgcaacaaaaccgcattcattcctcaagtttcagctcagatgttcagccactctccagaatgttctctgattttcccagtgaggattgatgttcctacaccctcttagcagtgagttggctgtccactctggccctgggtttctttgtcttgcttccgtatctgcctccctgactagactctgagcagttccatgaaaccacaccttgtcatctctgtatccccggtgctgaattttgtaaatgaacttttagaaaataggtaaatgctgaataaacacatttactgatcagcaaaagatcaataaatgttgaatcaaattggccctagttgaatcaaattggcctttgacaaggccaagcaggtcttcatctatgtacgatgtttgccaggatgggggtgaccccaaaggctctgccttgtgatgggaggaaactctcccccagatttcttgtccgtgttgagcacataattgttaaatggtatcgatgaaatatcaaatatctagttgtaataattaaagtatccatttcatcatacatgcatattcaaaacatttcaaattgcaaaatacagattcgtttagcaataatgctgtattcattaaaaatgtttcatagaaaaagtgtttttcataaaacagtgttttttcctcacttcataaaacagttttcaaatgcttgcctttccaacatcagtatttcatcaaactaaagatgtttttcgagtcttctgccaccctcacttctgtttaagttgtgtgagatacagtactttctgaatccatatgtgatgttgtcactggaaagtttatctcaggccaccagtccccacttacgtaacatgaggacagttgggttttttcatgtcctggaaacataaattcaccgtctctgcaacctattcattgcgttgctcttaaggtattgtatccagtgtcatccaacacttataattgtgaaattgtgtccagaagaataatgactaaatttgaattgatttttcttttactgttttggtcagttgacttctacgtgcattatccaaaattagtacattgattgaggacagttcaagccaacgttccatcccaaatatgttcaatgtatttgacagagctccccctactttgagagctctgcaaggactcaaatatagagcaaattcctcttttccaaggaagcattttctgggggaaaatatcctcacctcatattttggtatacagggcattcttaccatatcttttctcccttccagacaagcaagcaccacattctaccatgtgatgtctctcatgccttctcccctttccatccataccaaggtcacagccttagacctggcccttactctcactggagagactacaaaggtcttgccagacattgctagttgtcctccaatatttcccctccttctttagtaacagaatctcccttattcacttgacatgtgtgggaattaagaccaaatgctcagccttcccttcttccctacatgggtcggggggatagaagtcaacgttgtgtgtacaacttctgagaagtgtccttacaggagaggagctgagggccaattgtggagtgctacaaatgttctgcagattactcagtgctgactcattaatgaaattaatgattactcaattaatgaaaaataatccagctatgtccctgattagtgcactttcttatatgcgtgcttcagtaaaatgtttacttaaaaaacaggtaatgctaagttagaatagcagttacctttggaggaggtgataattaatcgggggtacaagggggggcttctggggtaccgatctgagaagtggtcacatgagagtgttcattttcaaaagatccactgaactgctcccttatggttttttggcatcgttttctatgtgcttttgattctaagtttacttgacaaatgtgtgcagtactactcctgccccccttgctcccagatcactccatggacatccagggagagatgtgagctgcagcagagattttggaggaagtttaatgggtgttctctcttgaatgggctactgtgcacacactgggagggatgttaataagaataaagctgtactggtggtcctgacctggaactccttcttaagccctgggatgtgcaaaataatgtccctccaaagatgtccatgtcctaatccccagaatttgtggatatgttacattacacagcaaaggggaattacggttcctaatcagctgactttaaaaatggggagctactgtatatcaactatatctcaatttttaaaatagaagaaaaaaaaaaaaaccagggcgagtatcctgaattatccaggtgagcgcaatgcagtcgtcaaggtcctcaaaaacctaagagggaagcagcatgaggagtactcagcctgacactgctggctttgcagatggcaagaggcagtaagccaagcaaagaggagggagtctagaagctggaaaaagcaaggaaatgcattcttccctaaagcctcccgaaggaacgataacacccagtaagaactatttcagactcgtgacttccagaaacagaggatgagactttttaaaattgaaatatagttagtttaccatgttgtgttagtttcaagtgcatagcagtgattcagttatacatacatgtatatttacacacacatacatacatatgtatacatattctctttcagatttttccattatatgttcttatgaaatattgagtattgatccctgtgctatacagtagatccttggcattcacctagcttatatttagtagtgtgtgcgttattcctaatttacctctcccactcacccactatcccctttggtaaccataagtttatttcctgtctctgaacctatttctgttttgtatcattcatatcatgttttgagattccacatataagtgatgtcatatgatatttgtcctctgtctgacttcacttagtatgataatccctaggtccatccatgatgctgaaattggcattatttcattcttttttatagctgagtaattcagctagatatactacatcttctttatccattcacctgtcagtggacatacaggttgcataaacttgttttatgtctctgagtctgtggaaagttactacagcatcaatggaaaactaatacagacattgtctagggaatctcagaaaggtggtgatattctcagaggagatcttgggggatgggggcattctttctgtttcactgaaatggagaaggagagggattagaaaaatcagaagacactgttgatggagaaaaggagaccattctgaggggccggtgttaaggtttgtcacagaaaggcagaaactgaaagtagtaacttgagaattgcgtttgaagaaacccagggctcgcaaaagatttgacccttagccttgaccccggtggtcctgagcgtctcatcttttagacaagtgaaaacaaactcacctaactgggaaggtgccgggatgagccctaaacagaaatgagataaaatcctttgatcgacatcattttctctaatagtaactgtttattagaataatgcccccaaagatgtctatgacctaatcatcccagaatctgtgaatatgtttttgccttttgtggcaaaagggattttgtagatgtgattaaactaaggatatcgagatggagaaagtagcctggattatccaagtcggccccaagtaagcacaagggtctttataagagagagaagtgggga

SEQ ID NO: 56394 - DNA, 1325 bp, Bovine  19866880505724
ttgaaaatagttcccctgtggtatacaggaggtctttgttgactatctgttgataatttattgttgttgttgttcagtcactcggtcgtgtccagctctttgcaggccacgtggactgcagcacgccaggcttccctgtccttcaccatctcccagagcttgctcaaactcatgtccattgggtcagtgatgccatccaaccatcttatcctttgtcatcgccttcttctcctgccttcaatcttcccagcatcagggtcttttctaatgagttggctctttgcatcaggtggccaaagtactggagcttcaacttcagcatcagtccttccaatgaatattcaggactgatttcctttaggatggaccggtttgatcttccttgataacttatatatagtcggatatttatgctcaatgctcttatgatatgtttgccctcccccttttccccagggagcgcctgtgagaacaagcgagcggacgtggtctttatcattgacagctcacgcagcgtcaacacccacgactacgcaaaggtcaaggagttcattgtggacatcctgcagttcttggacattggccctgacgtcacccgtgtgggtctgctccagtatggcagcacggtcaagaacgagttctccctcaagaccttcaagaggaagtccgaggtggagcgtgccgtcaagaggatgcggcatctgtccacgggcaccatgacggggctggccatccagtacgccctgaacatcgccttctcggaagcagagggggcccggcccctgagggagaatgtgcctcgggtcataatgatcgtgactgatgggaggccccaggactcggtggccgaggtggccgcaaaagcccgggacacaggcatcctgatctttgccatcggtgtgggccaggtggacttcaacacgctgaaggccattgggagcgagccccacgaggaccacgtcttcctggtggccaacttcagccagattgagacgctgacctcagtgttccagaagaagttgtgcagtaagtcctgctcctctgtggctcttctcggggcatcgttgggatgaggtcattcaccttcccgggttcattctgtgctacctggtcccaagtactgtgctggcaaggggtctttagcaaaggtcgagataagacacagtgttctcttggggctcacactctggccaaggatgctcattaaggatgcaatttacaaataagtaattaactgtagttgtaagtgtaaatgggggaagaattcagggcaggacctgacctaggccaggggctcagggagatttccctggggaaaggacatt

SEQ ID NO: 56395 - DNA, 4867 bp, Bovine  19866880540164
atcttctttttttttgtggctgtggacacctttcaacactgctttcttggccttcaaagcctttgctttggcttcagctttaggaggagcaggggcttccttcttcgccttcggcgccatcttcatgaaaaggctatgtattatctctaattacaggtaaggaagccgaagcttccagatattcaggaatttgcatatttcaccttggccacctgtcttcaaagaggcactggataattcggtgtggctggctcaatgctaatccttcaccaaagtgaaaaagtagctgaaagacttgtcttattgatcagtaactaacaacatcagacacaaaggatatttcattgctttcacttttcacttttttccttgattatttttattttttctcacattaaaaaattatagttgacttacaatctcatggcttttactatccatcatcaatttatagttacttttggtccagcatccttgtttctacaattctaccatttggtccagtgtcactatccagactttcgtgggttctgtcctgtgtgttaccatctttcctgtgcagttaacttctgctttcctctcaggggtttttcatatattacatctcaggtgacagaatgcctctgttaacagagaagagctctcagaggtctttactttttctctttaagctcctattttcctttttatcagtgatactatttcctttctcatttttttagtttgaatatcctattgctaccaatgatgaatatttcctaaaaatactaacattgacctgattatagctattgtgaattaatggaaatgattcttggactagcactgaattagttgagtcgaattagttccaagaaataagtctaggacctttacctcatatcttcaagagcccccaccccccgcctccccaacacaaatcgtccctcagaaagagtctaggagtagagtgtttaggacaagagcactggcctgaagctcacgatctggagtgtggttctctgggtctctgttatgccatcctcagtgctggttgcatcttcaggttaattagcaagacagctgcaactattccaggcagccattaaaaaaagacaacccaaagagccttccagtggctcttgatggagaacgtgtcttagcaggctttttcttgcgtctccttggccatccctgggttattagcctgtactgatccactcaccccaaaaacagtggcatcacccttggtgggattgactttggtgggagtcaccttcctccgaggcacttggctatgttacacctaagcaaaattatggctctgttaggaaggaagaaaagagaatgggtgtttggcaggcaacaaaagtacccactccagcaaagttagcacagatcaatatggtacaggtagttattttggtggactgtggtaacatacagaaacattagagtcagtgactagattttcggggtaattaagaagtcatagtatccagtaaaacactctgcaggcattgaagtttcattgtcaagaatacagttatatataggattgctgtgttattgttctgctgatgaatccaggcctctgcaggggaaaacagatgtttagagcaaagagctagaagagagaagaaatgaatccaagttctgctgcgtaatattcaggtgtttcatcaacttagctgcttgagtctctggagagaaggcaagaggctctgagtcagatgttcacacataagtagtaggtcaaaaataaattagccttttgctacatcacgcagcctggggtagtgtttagtcacatcagatttcctatttattcacattaacagtaggcactaacaggatgagtataacatgtgggactggatccgtaccacactctcccttggggatagtgggaagttctgcaaattcttgattattcacagcaacggatgaaagcaagagcacagctaatctaaactggcagtcaaaagggtttctttttggcactatgacttgcctatgaatatgtgtgttacctgctgttttgttactaaaaaatctggctccagaattagcaatctctccacttcctcccttctgtcctcctgctgctctttggacctctgtttcactcagatggaatcacccccaggcctctgctggtcattcctagaatgaccttccctgccttgttcacctggcaaattcatactcctctttctggattcagatcaaggctttgaaagttctctcccgctaacgattctctgccacccgagtgactaaagcgttctattgtcttcggaatatctccaggctaaaaagaagctcttcatcacaaggatgacacactgttcccttcgcctgggcctgagttgggggggaagagtgtccggggatgtgggattttcagtgccaaacccacaaaagtccagggaacactggcacaatttggtaatcctagaagatcagccacttaagtgtaacgaggacagagaggcaaggtgggctgggaggcaagaagtaataggcgagggagagggtgaaatggtgaccaagctctcacaaatccctttccctcagacttcaaaattcatcatgaggttcaggctttgaaaaactgagtgaaaacagttttgagatggagacaattaacaagatgtttatcttttccgattaaaacatgtgtattaaaagctttcagtcttaccaggaagcagtactattgaattgccatgatcacttcagttcagttcagttcagttcagtcgctcagtcatgtccaattctttgagaccccgtgaaccacagaacgccagggcctccctgtccatcaccaagtcctggagtctacccaaatccatgtccattgagttggtgatgccatccaaccatctcatcctctgtcgtccccttctcctcctgccctcaattttccccagcatcagggtcttttcaaatgagtcagctctttgcatcaggtggccaaagtattggtcaagcacttacgaggtgcttagtgagagctcaatctcccaaactgcccttgtaagttattccccactcattcattcatttatcccttcaacagtcattcgctgagtgccaggcaccatgtgggggccgtcagtctggaaaaggcaaggcgggggccctgtctccaccaggagccaactctcaactctttcctgtacctcttcttatttgtagttgatggcttttctatgcagggggatcttggtgggcttccagaaccatcttgagaacgaaagagcagaaccttggcaagtttgactataacttgagactcaagttctctgagttgcccaagaaagagcatcaccaactaaagagcttgcctggtggctcagtggtacagaatccacttgagaggccagagacatgggttcaatccctgggtcaagaagtcccccgaagaaggaaatggaaacccattccaatattcttgcctgaaaaatctcatggacagaggagtcagaggagctacagtccatggggtcacaagagtcagacatgacttaggactcaactacagtttattctcagcttaaatgcaattgtgagatgtagaagcaaatcatttttgggttaactgtgtagctcctgtcctcatcacttcccctccatctatccccagtgaactattcatagctccctgaacatgcttgctcctctggcttctaggctttcctgtgggctgtttagtttgcctgacacccttcccaagataacagttgcctcagtccccatgaagtttcatcttcttcacctgtagaagaatattgtgtaataaatgtaataaagaatactgtgtaataatgctgcattattataaatgtatagcatttattacactgtattgaagttatttagttgaagttatttattgttagatgtctttgtcactagattgtgagttttctggaggcaggactgtgctctgctcatgacaaagcaggtgcctaatagacatttgttgagtaattgaaggtgagaataaaataacattttcttaaaatgacagtaaatgtatattccatgatctttgaggttgactgaccaattctagttcgagaataatattcagaatatttattactactgaagtaggctatcagttggaatagaccctggctcagtggggctggattaaggtgctggagccccagctgtgccggaggatgttaaccttttagttgctggatcctgaggaggtggggagtcccccagggaggagcttgatgttggggggtgggtggtggggcatgatgaaaagatgtctatctaccaattgatactgaagcattttaatattttaacaactgtcatggtaatccaggtgcatttggtccacatttcagcccaggtcaggttcattttctcattaaaatggatgctgtagagtttttagcaggaggagaaaggctgcattttaaatcaccctagtttcccctggtgggatgctctgtgtaatcttatcagatatgtttatgcatagggaggactctttattcagtttccatggcaaagcagagaagcatcgattttgtccagaattctctccattagaatgccaggctgtggggcttcactggggtccatgctggccaccgtccctgacattggcgttattaagccccatgctttgacagaaggtgtaacggtttggggaagttggttgtggggaagttggtggtgggaatgttggcagtcgggcagtattgggggatgctatgctctccggagctttccaaaagataccaaccttcaaattggagttttgaaacagacagacaacccccaaactgatttctttcagagcctgaaagtgccaaagtgtgaaatcatcagaaatgaagacacttggata

SEQ ID NO: 56396 - DNA, 1885 bp, Bovine  19866880577234
attaagtaagaagtctcttgcccacagcaggaggtaccactgttaagtttcttatacattttgcctacttacaagctaaattaagtcaaataaaaatgggtcagttctaacactggcaactagaaaatgaataaaatcccagggatgtatcattatggggtatacaccgtcttatttgaaaatttaacagtgcacacccaaatcttttaataatgacctgagtatagaacattttcctggttaaacaaagtcaaattatatctagtaaacagatgattatgctgctatcacaaaagaaatctacttcaacactacaataggacaatctgtcaagctttttaggtcagatgtgcactattagcaaaggtaacacaattttgttttcctgtaagaaatatgtaacatatctggaaccttattcatataaaagatgttcaagtcgtgaataagttgtctttggcagaatgcttaataacggcacagcaatgtttagaaacacatagtgatacatccttccttaaaaacacacaacttacttaaaccttcaccatttatccatccactatggtaagctcacatttttagttttccttaaatgggggggtggtatatatgtaacattttgtatgtcactctctttattaagagtcttgcatataatttcataggctcccaaacttaccttttcatttttcttgtctgtctctattggctgctttgctgttacacttcgaggagttcggacaacttcttcctcagccacttcaatggtccgtccatttggctgcagagcaacaaaaatggattctgttatcaaattgcctggcagatcaaaccaaagatttatactcaggaaatagaatcaatgatcaaattcttcccccaacccaaattaaaaagacttttgtacagctgtgtcatctaaggcttgtcagactaccatttctaggaacttgtagtgtaaaaaggaatgaacttataagcaaaatttgtaccacaaacttatattctgatttcacctaggcatcagtacctccaacaaaaaataatggaatggaagcaagaactaaattgtacttgcattctgaccaccaactggctgtgtactcagagtatttcattatctttgagtattatttctacatctgtacaaatgataggtctgatctattcaaaagtccatgaacgtttctggtacagggccaaacagaaaatattttcggctttatgagccgtgtaagtctctgttacaacacaaaactccgctagcacaaaaacagccagagatgacacataaacaaatgagtgtgcctgtgtgccgaagaattttacataggtggagggccatattggtccatgggccatagttcattggtctttgtattagataatctctaatgtcccccgtaatcctacaatcctattctaggatttagaagctttactaacccaatgccacaatttaaaaaggctatctcagctttcccaacatctctaaaaccaaatgatagcactcagagattttcatgagtagaatgaagtctgtgaacaccaatcctaggttttaatcagaatcactcattttttttttttttaaattaagcatttctgagccccatcgccagaaatatacttagattcagggctctaaagaaaaggaccaggaatctgtattctctcttctttctagatcttattacttcttttcacttgcccattctcatattcaacacagtaagttaataatcaatatactagttttaattgctttattcccagttcttgcagaacaaactttcatcaattacttattatagcagagctatagtcaagaaaacaatatggaacgtgcaaaagtcctctaatttggacattacctacattt

SEQ ID NO: 56397 - DNA, 725 bp, Bovine  19866880594538
cccttctggttagcaatggtgactcgaaaatgcaaacacctcttaaaatccacagtaaacccaagccacgtgaaatggtgtttgttttttgaaaatgataattatccaccacaacgtgttctaaatgtttggatttaattgtagatgtgtcgggatggacgtggacccttgagagagtgttatatatattttgaaagaaataaacatggactttgtgcatatgggaagaaggagaccatcgctaaattaataaatcacatataaatgacgtactacacttagaattgataaaaccaagggaacttgaaataaacagtaggtttaggcatcagagaaagaggggaaatcttttaagttttcttccttttctaaaaaggaacctcacaggttaagctatgaaaagggaccagttagtaaagagttttattttgttataaggggtgggcagtagttatccataaggaaatagcaatgctctggagcttcacccctttatcacctgcataaccttaggtaaattatttaacttctttacttactgtaagaattaaacggcttaatacatttaaaacacttggctcaatgcctggcacatagtaagcactgaatgaacatctgctatttttaatggaaccttaaggcagagtgagaagtgagctagtgcaacacagcaagtgtgaaaaactgtggtctttgaaggtcgacaggcctaggttcatctccag

SEQ ID NO: 56398 - DNA, 1243 bp, Bovine  19866880669119
tctgactctgtgaccccatggactgcagcatgccaggcttccctgtccttcacctctcctgaggtttgctcaaactcacggccatcgagttggtgatgccatccaactgtctcatcctctatggccccttctcctcttaccctcaatttttcccagcatcagggtttttttccagtgagttggctcttcacattatgtggctaaaattctggagattcagcttcagcatcagtccttccaatgaatattcagggttggtttcttctagggttgacaggtttgatcttgcagtacaagggactctcaagggactctccagcaccagagttcaaaagcatcaattcttctgtgctcagacttctttatggtctaactctcacatccatatacgactactggaaaaaccatagttttgaatatactgagctttgtcagcaaagtgatgtctctgctttttaatatgttctctaggtctgtcatagctttccttccaaggagcaagcatcttttaatttcatggctgcagtcactgtccccagtgattttggaacccaagaaactaaaatctgcctctgtttccatgttttcagcatctatttgccatgaaatgactggaccagatgccgtggtcttaagtggatacatgtatatagtggattcactttgctttacacctgaaactaacacagcattgtaaatcaactatactccaatagaaattttttaattaaaaataaatcataaaaagagtaaaaaataaaagatgtctgggaagaagagagggaaacatggtaaaaacaaggggaggtcccagtgagcctcatagatacctgggtggggagttcattaggcaaataagtgaagtgccaagtcacttaatgctgaaattttggagggagttactgaaaggagtctaggaggccaggcagaaaatgattagcagaaagtaatcatctaccactttcagttcaacactgaaaatcgtactaaacaacacaaaccaaaaacatcacagagaaaagccagaagatgtgctctggagcctgaaggctcctgtagtgaggagggttggggtgggtggctgctgtcctgcagacagagagctgcaatgggggcagggacagtctatgatgctctggaggaaatattgatatcccagagctttgtagttgacaaagcagtggttctttcagacagagaagagaaggtcaggactgtggaagcccagcaccccttcctaaga

SEQ ID NO: 56399 - DNA, 1214 bp, Bovine  19866880807691
tgtcttgtcttacccttgcccctgtcctgcctcttgccctggtcttttaatctgtaaactagggatagcaacctccctgagagagagatgataagaactgaatgaagggccaaagtcaaagacttacacagtaagggctccagagatgagggctgtttgttctctgacctaagctcctgaagtctttatgtctaactcgtttttatgtttctaataactttaaacacattacattgaaaggagcatgtgatcaattatgtgtgagtacattaatgcgggcttgctgtctgaggcatgtaatttgggttagcgtctatcaccaggcagacaagtcaagctccgagggcctggatcaagacttcttgaactgattcatttccttgttcacattcactgtttagcagatttaggtgaggtgttctggacagcgggagtagagcccaaagcctcagaaagtcgctgaggctggttttcaaattagagccataagggaagaggctcccagagcgggatgcgtgtgccctggagtattagctcgtgtctggagagcagcggctcaaacgtgctaagtggcatgggtccatgcgtgccggttggtcagggatggatgggctcctgcctcgttacacacacttgccagctccctgggaagcagattctttcctggaactcagagcctatcttgcatcttgcctggaatcccgtgaaactcttggcagcatctgccctggctgcatgccccccacaccccctaagcatcacatttatttgatattgggattgatattcctctttttacattgtggttggtcctcattaactcaataaggaccaacatggaaggcagagtttcctcctcttctagggggaaaaaaaaaaaagtttctttggatgggccacagctcctgtgactgacttggtctgctggcatgggacagcgtgctgtgtggtaccctgaggctggtgagaaaggggacagagtcaagaattcctgggtggaaggctctaccctgtatttaccacaactactaaaacaccacatttaatagctcaagactggtctgtatttgcatggaaaccacatatatgtggaattctattttattttttaacttcaaaatggccataataggagccagactgttgatgagtctaacaattagaagcagcttctaaatttcccaacacagtcatcttgggttcaattctgagat

SEQ ID NO: 56400 - DNA, 1419 bp, Bovine  19866881042860
ggggtctccaacccatgttgaaagtggctggtttaggggagcattcccagggaaagttggggccgcgtgaagctgggagatgagctgccaggaaaggaatgaagatggagcatggaggtggggtctggtgaggccatcaggaccgccatgtctgtaaggcaaggggtctgggctggagccaagcccagaggaggtaggaaccaggtaacttaggaccttgggggcaccaacaaaaagtctgggctttgtgctgcagaggtgggagccctggaagacttgaaactggcaacagtggtgatcactgctgattccctttctacccactgtgccatctggacagcctaagcagggcgtgctgtgtgtgtgtgtgtgtgtgtgtccggctctttgcaaccctatggattgtagcccaccaggctcctctctacatggaattctgcaggcaaaaatactggagtgggttgccattcccttctctaggggatcttcccaacccagggatcaaacctgggtctcccacattgcagacagactctttactacctgagccaccagggaaacccagggtgggctaaatgcaaagctaagctcatggaagctgttagattctgccctctgtacctctcctgcctcagtggcacctgtcccctcccagactccctcctaagtcccttcagagcggtgctagctggatgttgctccccactcctaattaccgcctgctctgcatctgcacacttttctctttattgtatcacagtcatgtagggatggagctgtcaccaaggccaccagtgggggcatatcagcctttttggaaaccttaaccctccttgcctgaagccccactgtatcggcaatgcccctcaccttggaatgaccgtacatgcaaactgcctgtgcgcttctacctgctggctcccctgttttgtttgtcttttacgaggtcctgttgacatgtgctgtcttttctaaatttaccaagctcgctcattttatttctactaactaaccttgaaagcttttcctttccctgcaatagactcccctttcagatcagtggcacccgcaaagaattcgtgtttgtgatttaaaagagcactttgtgacaacagaacagtaggtctgagaagtgggaggtggtgccccaaagtctgttggagaggggatggtgggagctgacttcccatcccctcaactctgctaggaaaaattctagaggtgttcagggggtaaaggtcagggaacttagtaacatttctttcaaacagttactgctaagtcactcagttgtgtccgactctgtgcgaccccatagacggcagcccactaggctcctctgtccctgggattctccaggcaagaacactggagtgggttgccatttccttctccaatgcatgaaagtgaacagtgaaa

SEQ ID NO: 56401 - DNA, 929 bp, Bovine  19866881054668
caaagcattgcttcatttaaattttacctaaatttcattctgcagcaagttaataaacctaacattgtagggctactagtatgttcctggtgagttttatcagctgggttctatcaagtgacatgaatgctgatgtcattaaatatgtcactaaaatgtcaccttgcgtttgtcattaaatgcaaaacagtaattagtgtatgaatccatttttgttcttaaattaaaatactttaaaagatgacacaaagctatatgtgaaaaatgattatatctgtattaccatatacagtaaacattttctttttaaggtcaaaggagaatcacacggaaaaaaaaaaaaaaaggtgatgggattttacataatcagtatttgccagactgccaaagaacagggatatccagctactattattgtataatagcttaattcataagccctcacgtgttcacctagaatggggttcttaggaaagataccctcatgtctctggaaccaaagcataaatgtaaaattgtaaacctactttcataaatataaatgcaatttggaaccttttagagataaagtagttccaaatacatcttccaagtttttggccttgtaatttacactgtctttaactacagtctttaataataagtctgtataaagcttggctagagtaacagtttattatttaccaaactccctttcactcattaatcacaatatgcgttacaacacagttgcaaagtaggtcaaaatactcctaaatacatttctggcattcggtacttattactcccctttctaatctttgagaaagcctgcatttagttcacttaagacacttgctaaaaatgctaattatcatttaacgataacacatcaagttttctcatagggaaatacaacgtcaaaaccctaaggcagccgggaatatcat

SEQ ID NO: 56402 - DNA, 1040 bp, Bovine  19866881134447
taattcagcgagctcccaggttttccagctcaagggaggaagcctcttgcgcatcctgggatttccctgtaaaaggcagccggcaatcctgcttctttgaaaacaaagaatgaccaatttagttaaattattattaagagtatgttcttgcaaaatttgaaaggtatgggacctcatatctggatgcaaacaatagcattctttgtgttcagcatgtcagtccttgtttcaaagatcccctttccaacgttaaacaggattgatttgttttctaatagacccaagtttaagatttccttaagtgatatctcacctttcttgactattgttgttctccttttaatgaagtgttaaaagcccccaaaggatgtcttattaaatttttcccataaatttgttctgctacaacttaaatttctcaaaaacaacaaacatggtggcttagtaagctaagtaaggcttatcgttaatggggttcagttttttaagataacaaatgtataatcatgtaagtaaacgtgttcccaagtaaaagacaaaatgtagcagtgcttagttgtatgggaaggcagtatgttgggcttttctgcctgggtttttgaggttgattaaaaattggcatagactagcttgtagaatagcaacgatacgctgtgttttgtaaccctgaccttttctgttggctttaaatcaccagatttggacccaatgctatgagactttctcaggatagaaaggcaataaccttatggcgtacaaaaaccaagataacaaattaaaaatctcttctggaatgaaattttttctttcttcatttttacatatgggattatagctttaacttagtttgggttagtactgcagacaatgcaattatctacaagggcaaaggagattaggggtaagaatagtccaacccattcagcattctaaaaagcattacatttttccagcgtttgctgcaatgaatgtgaatattgtttcttcatggaccctgttgtagttaactctccacatttaccctccttcttcgagatccc

SEQ ID NO: 56403 - DNA, 802 bp, Bovine  19866881187143
atagtaaccttaagtgacctgcagccaaatgaaactattctgcccacccatcttgggaggataaagccttgtaagaaggtgctaagctgaaaaggagaatctgcagaccactggaaattccctaagttaaaaaaaaaaaaaaaagaagaacaaacacaagtatcaactttagatttcaacaggcatatgagattgttccaaaagttttttataaaaacaattaatcattagattcccttctccaatatcctcttcatttgaaaattaaacattaataagaacttaagttctgcttgattttcaacacttctcagcagatattatactctggctaattcattaaactagatttttttaaaaatagacataaaaatggctctttaagtcaaagggcaagaattgtgcctcattctaaagtctctgtaaggtcaacagccaagttcagcataattgtttgagagcccagtgactttacacacagtctcctaaaaaggataactactattttaagattgtgttcattatacatgagtaactaagttaatcagaggaagtcacttcagataagtcttgttgattcaagaaccaagcatatatgtttctcccaccacccgcctttggaggatttgtggaaatttgagtcggggagagagtaaggtaggttggcttccataagatagataagaggactaaccactgtctttggagacaaggtgttgccccagtacattctaagaatacaggctagaggggttggtgggtttgacaggagctcagctaagctagtccagaagcagggaaa

SEQ ID NO: 56404 - DNA, 1189 bp, Bovine  19866881208870
ttgcagcctggggcacgtgccagggcttgatgtccttgacctctgtgccctgagtgtccccagctattcatttaatgatacattagttcttaaaagctgatacattaacttttagaaagatctggtgctagctcagtgtttatattgtgactcaagtccagcagctggctgacgtccatgacattcagatcctgagactgtgtggatgcactgttcccaccaaaacggcttgtgtgttaaaaccacaagtatcaggctttattagaactctgtagggagggacattagagaaaacaacaccttagcagaaacttaatgaagcctgggagcaaaagaataaactcaacacatgttaccagcctttaaaaatctttagcttttccctttgtgccttttgattactgtgtttgtatgtcattattttctcaatgcctggttttgctttttaaaactgtacatgtgcgttaatttgaagattcgatttccttgttattatttacaaatttttcggtattcagatagcctaaatcgttatttagagggaaacatttttaaggaaaaaaaaaaatccataatcctaccaccttaacacaggaagcaaagcatttttatttttaattttcagattttgccttagagctctattgaaagtggatctaatcactgtaaatatacaattttcaaatctacttttttcaccaaattttgttctcctatttacagttatgttatgctactaataactacctactgcctcaaatggaactcctgagtatgccctacaaaacccaccccacttgcaccttcctcatccccgagtcagcctgaatccctctctttctcccttcacctctaatctgaaaggaatctgactggccccctttcaacctggtgtactgtcccctagggttgccagaacagagaaccacaaaccaggtgactggtaaccatggaactgcattgtctcctagctctgggagggcagaagtctgacaaagtgctggcagggccgtgagccctgggaaacccgtgagggagagtcccttcttgctgctgacggtggctgttggtcctcggcactcctgagccgcggctgcttgctctcgtctgtcttcgtgcggcgttcttctcttcctataaggacaccagtcaccctgaattggagaaggaaaaggcgacccactccagt

SEQ ID NO: 56405 - DNA, 1029 bp, Bovine  19866881278745
tgaggtgacatcgcggttctaggttcctcttcgtgttctgcagagcttgcctggtatggctctatcttgtcaacaaaagcgatgtttctattatcaataagggaaaaaaaatcagtacaagatttattttaggcttcgagttctgtgagccaacctgtctgctccttgttttgcttatgtgctggtcctcttctgtttggtagtctcattttaatctgccctctaggaagcattctaatgcaacataaaacaaaaagttctactgtttacaaggaacaaatgaaacgggcaaagtttgtatttgagggtcttcatgaacgtgaggtctgggtaaaacgactgccctcccacccccatccttactctacaatagaccccccctgccagagacagagaagtgagttgaacccagtatagctatcaaggggtaagtcgtttcaacaattacagattctaactaactcaagagaccagagatcctacacacccccgttcctgtctgcttgtgtgagtgcccaggtaagacctggaatcatagccccatactttttatgaataaggctctctgcactaagccagtagtagagcctctgggagaaaaggcaagtttggactttgcctagcagcctttattattgtcaaattgcattcacccccaaaggtaactgagaaacgaacaccattgttttattctgacgatatttcaggatactgaactcacttttgcttctccttttttttttttttttctggcagacctgaagatcatttcacaaggtagaacagctcactgacctatttgacttggccctacgcatactttgtacagagacttctggggaattcttatagaactccctggggcaaaacatccatcttagttggcatataccagaatcactgaagtcttttactaaattacaattcgttaacatttggaaggattttggaattgctattgtttccctggtaagttacggatcatactggtgtactggaataaggcaacgcatttaaactgtaagtttc

SEQ ID NO: 56406 - DNA, 1924 bp, Bovine  19866881355804
cccctctgtcttgattaaaacccaatctccaaagtgggacacacaagatgaatcacttgggtgggaagagaaagcactgcaacttcctttgactgtaagatgcaccattattttatatattagaaggaaaaacactgccaattaaatatgatatagcattcttgtcatttacaagtttagttaatatttcttacaagaactcatttagatttatgtaagcatacatttatttagggaacacagatggctcagtggtaaggaatccacctgccaaataggagacaggggtttgatccttgggtcaagaagatcccctggagaaggaaatggcaatccactctagaattcttgcctgggaaatcccatggacagaggagcctagcaggctacagtccatgggggtcacaaagagtcagacatgactgagcgactagcactttcactttcatggcctatccagattaatcaataagtaataactttactattagttctatcatgtaatgattaatgttgagagcatcaactaatgctatggcagcggaaagccagaggaaggaatcttgtcagcaatgacctggtgaaatacaaactttgataaaattactttccaaaaataaaaaagagagagaagctcttttttcattgtatcagagcagttgaagtaagaaagctagccaatttactctgaaatattatgatatgattaagaaaaacaagcatatggtgagaatgatttgataggtttcaaactcctaaattgaggatcttttagaaaaaatttaatacaaagactatatggttagtgcaaatatttgcaaaaatcagtcatttctttccagccttgattcttttagcttcatggagatttcaaagcttgtcctttttgggtcaatgaaatgtcaactggttatttttccctttacttaggtgtttctgttcacctcaaaacaaagaagaggtgcggtatttaaaatctctggctctcttcagggtgccccctgatgggagctctgaagacaacggtgggaagggccactctgctatggaaggccttccagagtgatgcagggactgtgacctggctttgggtcattcataagcaaagggcttgcagagggatgaagcatagcagagccgtatctcctgcacagaatatgcaaaaacataagaataagagtttctcttccattgtgtcagaacagctggaatttttatgagatgactttcaaggctacggctgggtaaagtggtgaataccacacgcacaccccacccccaggaccaattgatgaatgaacaccaaacaagatggcttctgaaacttcatgaatttccccagcaggaagttataagtaatacttgcacaatcttgtgaaattattttcctttccagtcccctgttctccgcgtactcaagaacaacatggcagccactgggccataagtgtttactcaacaattgcctgtgtccttaggagcctctctggcacactccgaactggccccaggaaggatctcattgcttttccaaaacactggagatcatcaattagacaccagagttagaaactgcctccatcatccaattaaaaacaaacagctatctggtgaggaaagagatttatttcccactgcgcccttagtattgaggtctgtttccgaactttgtacctcctaagactattgagacccatgctgaataaacaaggctgaattttaaaatacatcaatttttgaaccctaaacttgtcacggcaatatcaacctcacataacttgaaaataaaaactcatcagagtatatcaacttctgttttggaaatgacgtttaaattagaggtgaaaaataggggaaagatgagcagcagagtgagaacaggacggctggagcattgagccccacgagggctctgagtccatgt

SEQ ID NO: 56407 - DNA, 2097 bp, Bovine  19866881365445
agctcctacccttaggtgagggatctgacgtttctagttacagtccagcaagcagcgttctgagaaatcacgcttgttccacgttccctcgttagcagcgatcgctgcggcctccgacagccctctccaatctcccctctcttcaccctctttgctacctccctgcgtcaccactgcctcatcttcaccatcgccctgatcctgaccatggaaatggtctcctgaatgttctctctgcttctctgagacgctgccaagtctacctcaacctctcacaattttaaaattaaaaataaaaagcttagatcacacaaaactacttaattacaagggaaaagaagatacctaaaacagagatattacaaataagatgtctcactcatattctagtactcactagggtcacaagcttcagagccagtaactcaaaggctgaagttttaaatcctgttatcaaagaaccttcttccaaccattccctccacactgcctcctagaccctctggttcatagaggcagattactgtggtcaaggggctgttttgtgaggttatgttcaatcgacatgaatctgaagtgcccaggactggcagagatcttcagagccggcctggctgtgtctgtgctcagtcctgtctgactctttgggaccccatggactatagcccaccaggctcctctgtccatgagattttcccaggcaagaatgctagagtgacaagttttcgctgctgttagccgattaaaagaggttttaacaattcaatttgcataaactttaatgtgaaagaaatctatttctataatccacgtttagtattttaatatgctctttctcttaaggcttgattttgatgaaggcaggggagtgaatgtggcattatgtagtatgtatccagaacgtgatttctacaacattctaaagagaagactgcatctctttagggtgcctaaccctatattgtatggcagtgactcaaagggatattttaaatgttcaagtaaaatactacaaagcctgttaggtactaccctaatactcaaaagtagtctggacctgactatttaatgaaatcaacaatgtggtatttcttttggcctaagagcatcatggaggaggaaacagcaacccactctagtattcttggctggaaaattccacggacagagaaagcctgatgaggtatgtaggccatagggtcacaaagagtcagacaatgcctaagcccaagtccgcatacgctggaagagcatcaagggggaacaaaaaacccaagaccccaagagacattataactaatagcgcttgtgacctctctatcttcaagtgtttctttcaaagatttttgttttggtttagttaagaaactagaatgattaacccagagaataccctccaatatctaatgaactctattctccctgagtagtatctgaaaaagtaggtatttgccgaataatatgtgtgctgttttagagaagaaaatggaagcacatttattttctaccaaccagagccccagttctcttcccacagaggtcaccctgagactcttcagcctgggagaaaagccatctggcttaacacttgataggaaatgaaagacacgacgtgttattatgtccatgtggattcccaataaagacatgggcaacggggaaacatatgttattacacactatgaggacatcttaataaagctaggagaccaggggaaatgacagaacaacatcattcaaacccctatttagggtgcagagggaggcttcagtatatttgttgtcgttttatttttttttttaagttagctaactagaattcctttaatactagttaaaacaatctttaaatatgtagagtcctctttaaaaatccattctccaaccctagaaatgcagattatggtccttactgaaaggaagcagggttccttagagaaatagctgattccaggtctaggacaggatatggacaaggtgagcctagaacaatgtcaatgtcagtgagacagcaaagaagcactcagagcaccagttatataaagatgccaacttgaagaggccctaactgggaaagatggcacaatttgagcatta

SEQ ID NO: 56408 - DNA, 1239 bp, Bovine  19866881575507
ttgaatccaatgacccagaatcagactgccccttatcacgtttacgctgctgtcgtttctctctgtgactaattttagtttcccaggctcctgacatagccccagaaaaaaaagtgttattcagtagggggaagacaaaaaggttgcgattttgggggggaaatagggtggggcacctgaaatatgataaatttagatattaaactaaaaaccaagagtgctgattatattcatttatcctatgaatttattctaattgtgctgtttcaggcagctaattgccattatttattctggtaattttgatctgtcatctatggtttagaaaaaaattgatgtaagttatcttgtatctttttttatcttgctgggtagaactagtaggggagtgttatatatactatgggtttattaggtgaggacaataaatggcttacttaaaaattttgtacagagtcttctagggatggtatatttaagaacaatgggaaaaaaccaagccacacttctaggaaacaaagacaaaatgaatggtttttaaattgctcaagatattgagctagaccttaaatttcaaggcagttccctttaaggatagaactattagatccttaaataatttaggggaaaaagtgtctcctaataatgtcactgatgtgtacattaaaatctcaagttattaaacagaagagctaaatactagattaagcaaaacaaatgcggcttttatataatgcaccttggttaaaaaataaaaactttttttttctacagtcctttcacttgctcaagtaccttcatcaacttcctttccatcatggcgtgaactgttttgcactgctttagcatctgactttgatttcttcttatttttctttgactgaaaataaaatagaatgttacttaatatttcattatgttttcgaaaaggtagaagtcagtaaaatacataatgaaatgtatgatgctgacaactaaaaaaacttaatgtttgattaaaaaacttaacatattacatggcaataatagtatgaggttatcatttatttagtcgttactatatgctaagtactttacacttaattctttattccttaaaaaaaaaaaatcactgaagacagtattattcccattttagagatgagaaaacaaagatttaggagatgttcaatattaaataggctgctctgggtcacatgaagttaacggattaggaaataggtctatccggctccaaag

SEQ ID NO: 56409 - DNA, 746 bp, Bovine  19866881981764
ccttattctgcattagaggtcttctcccccttcttgctttccaaccctactctccctttcttgccagactcctcccaggagccatccaagccgagctcctgtttcagctctcccagaaggtcagcttgtcctcttctcggtctccagcttctgccactgtcttctcgtcctttcttcctccagaagggcaggggcccggggtggcaatgcaggctctacactggtccctggaaatgggacaagcctcctgacctggtaaaacagtgttcagtcctgcctggccacccccagtggcctctgtcccctccaactgccttgcttctttgatgggaaaacaaaagcaagtctattctgagatgactagtatttccctggagtctgagtggagattgaccttattggccagactcatctctgactccccaggagcgggaacctttggactacttctcagaatgtgaaaaagtccctctatcacctctcccctgccccaccccatcaaagcctcaggaaggaagaacagtgtgcttttgatgtgtctttaaagttctctactgaaaactgacttcaaaaagcagagagcccattgattttttactccaaaatcaaaaggtttacttgaaaaatcaatgccatgaaggaaaaagaacctttcgctctgcaatgtcacttggaaaatattcagaagtgccatttccctggcgccgcagagggtctgggccgctacggcgtgccgtggcctgagt

SEQ ID NO: 56410 - DNA, 1706 bp, Bovine  19866880426822
ctgggcccacaagcagttgtgtgggctctagctgtcagtgtgcagttccatgactgcaggatattttcacaggtatgcacactgccttagagactggtgatgggaatctactattattgtatggctgtctgcttctcccctcagttctttaaatatttgccttatatagttagatgctgtgaggttgggtacataaatattaataaatgttgtatcttcttagttacttgatccctgtatcataatatacactttcttcatctcctgttacatttttggacttaaagtctatttaatctgatgtacttatagcattccaggtggctcagtggtaaagaatctgcttaccaagcaggaaactcaggttcaacccccgggtttggaagatcccctggagcaggaaatggcaacccactctaatattcttgcctgggaaatcccatggacagaggatgctggtgggctatagtccatggggtcctaaagagttggacatgacttagtgaccacacaatagcaatgacatatagttaccagtgctctcttttggtttctatttgcctgggatatgttttttctatcccttgatttgagcctatgtgtgtccttaaagcacatagtgaatctttttatccattcagccactctttgtcttttcattggagaatttaatcaatttacatttaaagtaattattggtgaaaatagatttaatcgttccattttgttaattgctttttctagctgttttgtagttctttgttcttttcttcctctcttgctcttttcctctatgacttggtaattttccatagtagtatgttttgagttctgtatcttttgtgtatctactataggtttctgttttgcagtcaccatgaggtttacataaaacatcttttacttataataatcaattttaagctgataacaacctaactttgatacatataaaagttctagatttttaaactctcttctgtactttttatttttttaatgtcacaatttacatatttttattttgtgtatctattaatatttagctactgttatttttaatacttttgtcttttaaccattatgctagagttataaatgatttagacaccaccattacaatattagagtattcaatagatgcccttaagcacattgaggtaattcccttctattttgagttcactgagtgtttttattatgtaaagatgctggattttgtcaaatgctttttctgtatcatttgaggtcatgtgggatttttcttcattctcttgatatgtgtattatgtttcatatgttcacatgagaaacaccttgtattcctggaataaatctcacttggtatagtccttttgattttctgctggattcagttagctagcatgttgttgaggtttttgcatttatatttataagagatattgctatacggttttcttttttttcccagaaagtaatttttttattccaggtttgttgagatataattgacatataatactaggtaagttgtactgcacaaagatttgacatacatatatactgcaaaatgatcaccacagtaagattagataatatccattccttcacatagttataatttttttccttgtgataagaacttatagaattgactctcataccatacagcggtattaactagtcagcatgttgcacattacatccccagtatttatttatta

SEQ ID NO: 56411 - DNA, 1445 bp, Bovine  19866880628971
tacgtttgaactgtggtgttggagaagactcttgagagtcccttggactgcaaggagatccaatgagtccattctgaaggggatcagccctgggatttctttggaaggaatgatgctaaagctgaaactccaggactttggccacctcatgcgaagagttgactcattggaaaagactctgatgctgggagagattgagggcaggaggagaaggggacgacagaggatgagatgtctggatggcatcactgactcgatggacgtgagtctgagtgaactccaggagttggtgatggacagggaggcctggcgtgctgcgattcatggggtcgcaaagagtcggacacgactgagagactgaactgaactgaactgaactctgtgccaggtgctgttccaggcactgattacaataagaacaagtactagttcaaacttaaattcttttttcttcacagtcatttttcttcacatccagaataccctggggattgtcatctgacacaccaagtctgccgacttgcctcaggtcataaataatcctcaggaactggctctttaatgtccttgtagttactaggtgaccatgccagtgccgtccatctaggatttggattagtcttctgtccatggaattcttatatccctaaaagagtaaacatgactcctagttctccctaaggaatcatgtttttctctcaggactcaaaatcagactttcagcactttgaatttttgttaccaggctccagtctccaaccaagatatcaatgctgcccgctgtatccccatttagtcagtgtacaggccttttccatcagcttattcattctagtcatggttcccagactccatgtctccagttgccatgaaaggttgataatgattcaagaattaaagtctgaaatgaggacagcccccagagactattcttcccaaataaaattcaagtcaggtctctaaaactccgttgtcttcagggatcaggcaggtaaagtaaatatataaagctatttatgtgtaacacagtagggagacatgaggtctatggtaaaacagagaaagcacacaaattccagttttaaaaaagaaagctgagcaggccaccagccttctgtccttaagcctctgcagcccttaaggacagaatggcagcttctcaagctttatagctcacacacatagcacatcacctgcagttagtaggtgcttgagatgatgactcacagaaacaaataaagctaagtgagagagctgaaacagacaatttagattgtaccctcacagtatgggtaaatctcactcatctgagtttctttgttctcaaaactctgtctctgagacatttccaaatctatgataatccctaaattagtttttctaaaggatttcgttttcattaggacttcatatagatagatatatagataatcaaggataaataa

SEQ ID NO: 56412 - DNA, 1483 bp, Bovine  19866880737168
catcaaggtctggacatgtgcaccaagaaactctgaagcaggtatttactcttagaggtcaatttctaaagattaacattatgctctggacctaaattatttaacccttatcatttacatattttttctaaatcctaacaaactgttttcacctgtgatgcttcttgggttaggagtgctactatatccataaccgagttgtccaacagtaaaaatctcaagtttctggcatcacatgggaagactgcattttggatgggtcattttcactattataaaataattctatgtctagatgagcacagattaaaataaagagtaaatgaaatgatctcgctgtatcatttctctaaggggataatcttttttgagacctctttataatgcttaaagccagattatatagctctctggggcctatttttttcaacttcaaacttttcagactagcacttgaggggttccaaccagtctcctctccccttcaatcacattaacttcatccagcattagtatcctccttgtgcctaaataggctcattgatttagaatgtccatgcagttcaattttctcaacttctaaatcaacagaattgcaatataacctaatacatcgtactctgaaaacaagtgctgagcaggtcattcaattcattacatttctgcttttggcatggcaacaaataagtccacatttgagagagggctgtttacatatgagttgtccattattttatgtgtttcttacttttatatcaaagaatgtgatttaaaaattcagagataatttttaacaataatctcatcagtaaatcgaaataaaatcttatctctgtttgcaataaatatatcctagtggatcaaatacttaagcataaagattcaaaaagagagagaagaaaagaatagaccaagaaaaagatacaactctttatcacccatatacctgttaaacaggtatgaacagtagaagggcctctaaaacaatgagaagagcatgagatatttgtctccacacatcttttgaatttattaaaaggagaagattcctagtcttaatgttaccaacagtaaaaacatacctgattttattttccatatcttcactatctgactcttcagagcttctgtacttatctggatctggaagtgtgcttggatcaaatccatcatcatcatcatcgctccaatccagaaaggcttcctcttcatctctagcctaagaaaacacaaggaaaactgtggtttaagaaaacagctgataaataatcaggtcttatttctagccccaaataaatactgctaattgagatcctcaaattagaagtcttctattctggtgaaggcctctatgtgactttcagaaccataatcatttgcactgagggaaaaaaacctcatcatttcaaaagtaaaacaaaatacgattcaaaaagtaaatcattattaagtcccttatatgcaatataggaaaaattgacag

SEQ ID NO: 56413 - DNA, 1661 bp, Bovine  19866881098562
taacaaaaggtgaggttatggactatggtggtggcagagaaaatggagattaaagtaacaaatttgagagaaattttaaggaaaaatccaggaaatttaataactgattaaatgtagagatgaaggagtcaaagcggtttgaagatttccaggccaggagcctggctttgaagcagtgttctttgaagtactatgatgctcacactgtggaaaattatattagcatagccctttgacattttctggagaagagaaggtgcttcttattaataaggaagattgtcttcctattattctttggttacaacttaagacattctactaactcttttactctaaaagtgattgtttagatcatatgatgcataatataatgaaagtaaatatatcttatgaggcctgaggaatttgttcccatggaattggaacttgggtgttcagaaatgatgttcgtaattctgtcatattctgttagttattcaatattccagttgacaggattggcaccagttacttctgctattaatactgctaaatatacaggtttatagccatctatcttttcttatatcttagttataaattgtaacctttggtatgacatataactagatatatcttaaacattttatgctttttataatgtggtaaggcctttctcatacttgtggaatattagaaaaaacttttctcttttgatacaataattttgtaagcaattgaagtttacatattttgtcttaattgtataatatttctttatatatacaaaaactacatatggatattttgctttatatatacacaaaaaagtgatataactactagtgtggttcatttttgtgtaatactttctcagcacatcacatgaagaatccagtaagatggtgaaaaaagagactattgtccctactttatagatgttaaagttaggtctaataggagtaaagtgacttgcccgaagttgcttagaacataaagtggtgggaaagaagcatgaaatcaggtcttttttcccaactcaagtgtttggagtgcattgcacaagggagttcccttgtgcattgctttcttattctaaagcgttaaaaagtgattctttggggttctgcttttcccaggttgtgaacattcctatttggatatctcacttacatatgagctgtggcttttaaattttgggaagcaacagtggcaacaacaagtatcaatttgatattatctgttaaatgacagacactatgcttgaaattttgcaaatgtttgctctaatcttcttaataacattatgccatatgtagtaataacctcattttgcaaataaaaaaactgaaacttaaaatggtgttattctttaacaaaatggttacatcatattttagatttcacatataagtgatgtatttgtctttctctgtttgacttactttacttatgatgatgatctctgggtccatccatgttgctacaagtggcttttatttcattctttttttgtggagatacaggctttcctggtggctcagtggtaaagaatctgcctgccaacacagaaaatgtgcgttcagtccctgagttgggaagatcatctggagaaggatatggcaacccactccagtattcttacctggaaaaccccatggacaggggaacctggcagg

SEQ ID NO: 56414 - DNA, 776 bp, Bovine  19866881218861
aggctattgctttgctatttaaagagatatattctattccaaggtttagacccatttaccacaatgaaaatttaacaccactccattctgcactctatgggaaaacactttgctttggatgtatcacagggttacctttattctttctttcttgcttaagttctcagccacctaatctgtctcccctgttgcagcagggtatgaatgtggctttttatagaacccagtgttggaataaatgctgaaaataatcttcttctctctacatctggtattgctgtgattccttttaaaggcagagcttgaatccttattatttaaaagtttgaaagtcgatctctgtattcttatggaaattgcaaagaaaaggacaatgttttgaaagattgtggagcgagtgttttagtagaaaaattacggcattgttgtcactatgatccagaggtgaaaagttataaaacattcagctcaaagagatgacacatgaatttaataattttcatgtggataatcatttaccaaacaaactgtagacatgacttaatccctcctagaaagacaggagtgtatcttcaaacaaactgcctaagctgtttgttcacagtttgctttttgattcagcaagatggattatgaggggtaacaaccagagctgtgacagctttggctaaatcccacctggcgttcaatccctttctcctttaaaaaactccaaattcatattctacaaaaggcttaatcaaagtcattgggaggagtgccttggcttaaggtta

SEQ ID NO: 56415 - DNA, 1699 bp, Bovine  19866880381015
acatgacatcttatttgctggatctaacaagttacattgtatagtttctgggactgtttgactattcctttccagtgggcatttatttttttatcctgtcattaaaaagaacaactgttatcttgctacacactcctgtgatttcattttctttgattaatttaaaagtcatttccagaaatgtgcaggtcttgtgtgtgtatattggcatgtttgttcacatatgcacatatacacacacactcaaaacccctatgcgtgtggttgcataacagatgggttttaaaaatatgtatttccttgcgtggagtaatttccccggaaattccattgtaaattggtaacggcatttttatgtcaccagaagagattatttgacttcccaggaattttctgtctgtaatcactgaagtctacttcaatggagttttaaaacattactgtgcaatctgatggattgaattttaaaaggccatatttttatattaatattaaaggattataatatgagagaatgtttcagccctgattaatttctaagtgggcaatggtataaaattgtaatctgcatttttatcaatgtatccaattatagaatgttaacgcacttacctttttattggcagagaaatctggttactctagcttaatttcaagatcgttttcaagtgttttcaattaaatcataacagcatattctaaaaccaatcttcctaaaaggtctgcttttattgtatagtttatttaacaataggcaccgggtttgtgttacatatttatattttttattttatttttataatatagacatcacctagatgaaacacctttaccctgtcctgtaaaatactaaagttacatttttcaccaacttaattggaaagaaggggagtgagaaagcaaacagcctttaatgtgctgtggatctaatctagcaatgtatccttgtgccaacatgtaatcattaacgacggatgaaaaagcaagaaaacagccactcattataaaattccagcactaaacattcgtaaaatgcttttcaccatagcaagcctgtcagagagtatatgtgattagaatgttgtgggtttcacactgaatcgaacctcactggaaaaagagttcactcgttttgaacaaatcttgcctatgtaagctgtcacttgtacgaatttttaatatgctcattcttgccaaatatgacttttaatgtgtacattccttcagaactcaatgaaaatcctctccggttcatgtatgaataaatatcctgtaaatgttcttttgggtttttcaagaaataccatgttctaacttaaactgcagaaactcaggtagacgcttctctttcgtggtttttgaagtcagcgtgccatgtttggattataaagaattatcaggacattttgcacctctgaagaaacatcgaactcatgacacgtgggcccccactttcggttgcccttctttaacatctgtccctccagagtctaaattgtagagcagggcagattatacaacacagattgacttcccaaacctgctccttacctttaagaacagaagcatcaatttaaaaaataaacaaaaccttgcaactcgtatttgtttattgttggaaagcgagagatttgcaatgaaagcacagggagaaaccaccaagtagaaagttggttaagtaccctgttcttgtctgcca

SEQ ID NO: 56416 - DNA, 1791 bp, Bovine  19866880811736
tatttgtaagaaaaagaacttggaatttgggaacaaccagtgaggcccatcaatggaatatgaaagacactaaaaagttgattttctgtgagcttaacccaagtcccctccaacctgagcgacttcactttcacttttcactttcatgcattggagaaggaaatggcaacccacctcagtgttcttgcctggagaatcccagggacgggcacagagtcggacacaactgaagcgacacagcagcagcaacagcaacccaagtcccctccaacctaagactaactaaccttggaatctgagggtcccacaggactaaaacataatatatattttgatctaacttgtgggtgaagtgtattatccctgaatttctgagacagattcttcaatgctgatacctgactaacccattgagacagggcttccctggtagttcagctggtaaagaatctgcctgcaatgcgggagacctgggttcaatcactaggttgggaagattccctggaggagggcatggccacccacttcagtattcttgcctggagaatcccatggacagaggagcctggcaggttgtagtccatggggtcgcaaagagtcggacatgactgagcaacgaagcacagaattgggagacatcttatctttgggaagcaggtgagtaagaggtgtcattgggtgtgtgtgtgtgtgttgtggggatgggcagaataaggagccatggtagctgggaagggtgctccctggaagtgtgtgtgtgtgtgtgtgtgtgtgtgtgtgtgtgtgtgtggtgggggatgggcagaataaggagccatggcagctgggaagggcgctccctgggaggggtaaggcagatggaaggaggttatctttctttgaaaaatccagggattagaaattgaggacagcaataaaggctgcaacggcatttactcatcttcagcaatttactgttcataagaaattaagttttctcttccattctttaatggctaagcatcagaggaaaactgcacagtggtgttcaataattctgtctgaggtaaaaagaagagaaggaaaactgagttgctaaatcaaactttttccagttttggcccagatgttttggggagctagatgttttatatataaatacagatatagatctgtagatagaaatatatatttaccttcaggcaggaagttctctatgccaatatgatgcatgcaggaagactgctatactatggatatatttataactgaatatgtgaaggagaaattttgttttaactttgttttacctgcaggggtcacacataaatttcaaagtacgactcagagaacattttgagttcatttttaaaaaataatgtttttcaacattatagtctgcaaacccataccattttaaggggaaataaatgaataatccccgtggctgattgcattttgtaaggaattattagctagggacaaataggaggaaatgagaaatggttttcaaatgaaacatctgaagatcaatgagtacagattcataaactctgacactccagagatattatgctgtcttagcaaatcaaacaaaaccagaatgctaccaatgaattattctgaggtttttacagtattaaaggcaaactgaacaatctaagtgggaagaagggagccaacttagaggacttttacataaacatatgggcattttctgaccattatgataatatgaatggaaacatctaatacttttattagtactttatcttaaatgatctgattttatagacagtgatgaataagata

SEQ ID NO: 56417 - DNA, 1017 bp, Bovine  19866880831622
ttccctgcattaaattccctttgtctaaatacaaggagcagtttctgttctccttttttagaccctgatccagtggtgaagacttcgtgctaccaatgcaggggacccgggtttgatccctggttagggaactaaggtcccacatgttgtacaacatggccaaaagatggaaaataaatacttaaatgatacatatgttagtaagagtgacttagacacagatgagaaaagagattacaggtggcattacaaaggaacacgatgagatctcctttaggagaatatcttaagaaaccattgcctagagtcccaacatggtcacagcaacatatagtcagggggatcctaccttcaaggtaagggatccttacttactgcctaagtaattgcagggttatatatggaaattcccccagttatcactaagagatctcatagctcacctttgtactattaaacctatcagcttccatttgtccaggagttggacagctgatatgagagagagttctctgaacttgttccttactttcctgttttttttttctttttttgaatttcattttagactaatgtattaattccaatggaagtacagcttaaaaaagcaactacacgatctcatcaggaaaaaatacatttttccccctatttgaaggtctgaaagggtctctctggagattaaattctaccagcatttaaagaaatgaaaggatcaaaggaagaaaaataatttagatacaatatttcttcaatattttcataatttgatttatgcttgatttctcgatgatcatttctatgattaatacaatttaacagggggaaaataggggctgggagaaggggagagaagcctgagtagcacttgactataaaactcattcttcttgggattatgcccacaccagaaactgcttgagctcacttttgtaatttaataagatgtcatcagatatttgatgatgcctttgacatatttatagccttataattaaaactacttgatgcaaaatc

SEQ ID NO: 56418 - DNA, 638 bp, Bovine  19866880832648
ctatggtttttccagtggtcatgtatgaatgtgagagttggactgtgaagaaagctgagtgctgaaaaattgatgcttttgaactgtggtgttggagaagactcttgagagtcccttggactgcaaggagatgcaaccagtccatcctaaaggagatcagctctgggtgttcactggaaggactgatgttgaagttgaaactccaatattttggccacctgatgcaaagagctgacttattggaaaagaccctgatgctgggaaagattgaaggcgggagtagaagggaacaacaaaggatgagatggttggatggcatcaccgactcaatgggcatgggtttgggtggactccaggagttggtgatggacagggaggcctggcgtgctgtgcttcgtggggtcacaaagagtcggacaggactgaatgactgaattgaactgaagctgatctgccaaaggtgggtagctgttctgtagccatagtccctttcttgtcctcattaattcagtgattcccagaatacaatgtttggcagggatcatgacgcagacctgctgtgacttaaggtggaactaagtccatatagggtgacaaatttttcctgtatggtttttcttaagaggagaaactcgacc

SEQ ID NO: 56419 - DNA, 1809 bp, Bovine  19866881006713
tccccgtctcatgtctggcagaggggatcttcaccactagcaccacctgggaaggccaactttcacatccatacatgactgctggataaaccatagctttgactagacggacctttgttggcaaagtaacgtctctgctttttaatatgctgtctaggttggtcatagattttcttccaaggagcaagtgtcttttaatttcatggctgcagtcaccatctgcagtgattttggagcccaaaaaaataaagtctgccattgtttccattgtttccctatctatttgccatgaagtgatgggaccagatgccatggtcttagttttttgaatgttgagttttaagccagctttttcactctcctttttcaccttcttcaagaggttcattagttcctcttcactttctgtcttaagagtgctgtcatctgcatactttgaggttattgatattttccccagcaatcttgattcctgcttgagcttcaccgagtaaggcatttcacatgatgtagtctgcatataagttaaagagcagggtgacaatttacatccttgacatactcatttctcaattttgaaccaatctgttgttccatgtccagttctaactgtggcttcttgacctgcatgcaggttttgcaggaggcaggtgaggtggtctggtattcccatctctttaagaattttccagtttgttgtgatctacactgtcaaaggctttagcatagtcactgaagcagatgtttttctggaattctctagctttttctatgatccaacagatgttggcaatttaatctctagttcctctgccttttctaaatccagcttgtacatctggaagttctcaagttcacacactgtggaagcctagcttgaaagattttgagcattactttcgtgtgaaaagactgctgttgtgcggtagtgttaatgaaattattagagagttcacaaatacctcctcagttttgttcaatggttaaagatacaaaccgaataaaagcagatatcgaagccacttacacctttcagtaatttcacattcaactttatcctcatgagatagggctgaccttgttactcccaagtttagaagattagaacatggatgaaaatatgaaataactctcatacagcctaagtcaagataatctggaattcttttctagcatagatttttactcaactggtcctcttcaggaacaatgggagctaggcactgtatttcaggccctttattaacctcctatccaaacaccaccagcaagatacacaagtatctaaaagggtgtgtgaattgccttcattcaactttatcagcttaactcaatgcatgtatttccagggggaaattaggaaatgaaaaggtatatatttccttgaaaggaaaacctaggagaaatgactaatgaaactagataaggttgtttgcttttagggagaaacaaagtccagttttattaaattgccttaggtgtttcttgtactatttttgttatgtctttaattcagaaactggtctactataattattagaaaaacaggcatttcactttaactcagtggacttgttcctgaaaaatcttgtataataaaaataaggtttataggaaaaatagagctggggcagactcctcaagatctatgcaactctgtacctaaagcactaataaaagtaaaatgtggtgccatggagagggtatcccagggataccagagatcacctgcaggtggaggagagattcactcaggggagatgagaagcacagaaaatatcgtatattaatgcataaatgtggaatcta

SEQ ID NO: 56420 - DNA, 2314 bp, Bovine  19866881187395
gataagtcatttcctgtttcaacttccaagccccctggcattccttggatgctgctgccttccttccatcttcaaagtcaataatagcagggttgaattctcgtatctcaccactctgaccttctctgctgtcctctctacttttaagaatttgtgatgacactgaacccacccagataattcagtataatcttaattccattgcaacctcaattcccctttgccaattaggatgaggaaatctttggggggagctttcctggtggctcagatgataaagaaatggcctgcaacgcaggagccccaggtttgatccatggtttgggaagatctcctggagaagggaatacccactccagtattcttgcctggaggattccatggacagaggaacctggcgggctatagtccatggggtggcaaagagtcagacataactgagtgactttcactcactaacatctgttagggaagggcattttctgcctgctacgtggctattttaatctgttttttaaaaaggatcctaagcactgatgacttgagccatcttggccgtgccctgaaagagaggactaatgaagctcaccaatacattcataaggagatatctaaggagattgctggtgctggagaagactcttgagagacccttggacaacaaggagatcaaaccagtggatcatcaaggaaatcaaccctgaatactcattggaaggactgatgctgaaactgaaactccaatactttagccacctgatgtgaagacccaactcattgggaaacaccctgatgcagggaaagattgaaggcaggaggacaaagggatgacagaggatgagatggctagatagcataccaattcaatggacatgaacttgggccatctccgggagacagcaagagacagggaagcctgacatgctgcagttcacaggttcgcaaaagttaagacgtgacttagggactgaacaaaaacaaccgcaacgacctaaggagagcactttcacagcaagcactctctctgagctgtcagtatcacaggaacaaccaacacccttcaaagtgagatgagagcacttttcagaatggaggaggagaaagtggagaccatctctatgtgggcacagatgaactcagtcaagagcagaactcctgtgttaatcacaggatgcaaagaaggtacaatcaatggagccaaaccatttccaaacactagaggacctcaatctcactaaaactttattttggcttgttggtaagtttggaaaagcactgtattcatttctccacaactgctggaaaagatgaagagcattgcttttcaatagttcccaaagtctaatttggtctcagaagaggagccaatctcctgaagaacccagagggtttatgggaggggctgcatgatgctacagcacagcatgacgtgggctgttgtataatacaatgaaaaatatacttgattttttggtcttgtttcttggcacagctcttaaaaccattggaatttcctgagtgataggagcgtcttttgttcttcattagtcttacctgagtttgtgctaacaaagtgacttggtatttcccctagcccccataggttcagggcttccctggtggctccggagtaaagaatccacctgtaatgcaggagatgcgggttcgatccctgagtcaggaaaatcccctgggagaaggaaatggcaacccattccagtattcttgcctgggaaatctcatggacagaggagctgggcaggctacagtccacggggttgcaaagaatcagacacaacggaacaactaaacaacaatcacaacaatagatagcttcaggatggagactggtagccagaggagccaaaaggtgtaactgggggattagaactttcagccccacccgccaacctcccgggagaggagagggacctggaggttgagttcaatcaccaatggtcatgatttcatcaatcaatgaagcctccataaacccttaagtgggtggagtctggagagctcccaggtgggtcaacacattgaagtactggagggtggcgcccctggagaaggcatgggagctctatgtccccctaacttctataccttgtcctacgctcccttgtaactaactgctcctgagttacagcttttataacaaacctgtggtgaaaagtgaaagtattagtcactcagtcatgtctgactgttttcaactctgggggtcttacagcctgccaggctcttctgttcatggaattctccaggctagaatactagagtgggtagccatttccttctccaggggatcttc

SEQ ID NO: 56421 - DNA, 924 bp, Bovine  19866881626529
gaggagaagaggaggacagaggatgagatggctggatggcatcactgactcaatggacgtgagtctgagtgaactccaggagttggtgatggacagggagggctggcgtactgtgattcatggggttgcaaagagtcggacacagctgagcgactgaactgaactgaactgagatgcttagtactacatccttataaaaattcttgaactttgctctgaagtttggttaagtcacttggtaacagtttggtcttttcaagcctcctgttaaatcttgttaggtgaaactagaaccacctttaatctaaggctaatttcttccactactgaggtaatacgattgtaaataccctgcctgattttccttgagttatgatgttttccctctggctgcttggaacatgcactattcttggacctgtctgagttctgattatcagttccttttaagtggttctttccttttcctcaggtaattgcgccatgggcatatgctactaaatatgaaaactcacgggggtatcccctgtggatcttcatagctgtttctctgtgcagctgtcttctccccaggactctgctttttgaactccagctcctggcctctccagactccctgtgtctttcctcagttcaaggttactcctggctctgtttggattctgctttgcaccgcagcctggaaaatctgtctgggcagtaagctggaactgtcatggggcttatattatttgttttccctctctcagggaccagtgtcctctgcttagtaagttgatatgcagtgcctgaaaacttttgtctattttttttggtcttcattgttatagtaatataatattaactgtttagttgtttcaggaagggtgttctaaatggtctctcctactccgtcttagttagaaaatatagaagaagtcttat

SEQ ID NO: 56422 - DNA, 816 bp, Bovine  19866881812685
catcaaggtgagagattacgctctgctaatgcagagcaatggggagacgtgggaagaagtgaccggagtcactgagggtggacttagaaagctctcataatcttcaggccagtgatcttctgaagatgtatgactatataatatatgtatgttctgtgtgtgctgacttactttagtcgtgtccgactcttttgccgccccatggactgtagccttccaggctcctctgtctgtgggattctccaggcaagaatgctggagtgggttgccatgccgtcctccaggggatctttccaacccggggattgaacccacatctcctgtgtctcctgcattggcaggcgtattctttaccactggtaccacctgggaagcccagtatacatatagacatacacacggggcttcccgtgtggtaaagaatcagtgatttaacaaaaaaatccacctgccaatgcagaagacataggagacttgagtttgatccctgggtcaggaagatcccctggaggaggaaatcgcaacctgctctagtattcttgctgagataatcccattgtcagaggagtctagtgggctacagtccatggggtcgcaaagagtcagacacgattttagcaactgagtatacacacgcagtcaatgaaaggtaaagccttacaatactgtgaactaacttacggtatttctctctccataggtgaagtttacattctatcaagtagtaaaagtatgacccagactcacaatggaaaactctataaaattattgatcccaaaaggggagttttttttaatattctattaagtcaagta

SEQ ID NO: 56423 - DNA, 1845 bp, Bovine  19866880355892
atttccctatgcacaattctgatatgaattctttacatctctcagctgcgttttttttttttttttttttttgctcgttggctttatttcctccagatggtgatctttcctgtgccctttaacactggtggagatggatgaactggagctccagaataaggcttattatccaaaaggagggcttcagtgcaattttaattgcttttgtcttattatgagtgaaaatgggccccttgtcgtctatttcggggccatttgtatttcctcgggcacctggggaaagtgattactaaagcaaaaggcaggacatgcataataggttgactggtctatttttaaatcccagcctctgctgccagtcaacagtggcagccctgattatcatttggcttggtttttggcatggaattggcattctcacctgcttaagtgcctgaagtctcggattaaacgacacctccccagaacacgtcttgtgtgtcatcttctggtgccacccagttcatttgtatgttttctattgtctttgcttgctccctcgtcctcatctgctcgcccccaaagagaatgcaaaccccatgaaaacaaagatgaaggaggatgtggttttagagttttcaaaaatggttttagatgagttgtgctcatctaaatggttttagatgagttttcatggttttgctgtgctatgctatgctaagtcacttcagtcgtgtccgactctgtgcgaccccatagacggcagcccagcaggctcccctgtccctgggattctccaggcaagaacactggagtgggttgccatttccttctccaaacagtgaactactagtccccagttctgggcctgaagcctaattggcttttaactctttccttgccccacagggtaaccgcttggctgtcaacagcccccactgagcctctgactcactggcatcaggtgcggtgtcttcttcagactcctctcttggccacggaaggagagaccctctcagggagagtgctgtttgtcaccaataagcagtaagcaagagagtatggactcaatcctacctctggttactgggcctgtgggaagccggtgggcccccaagaccccaggacttggaagtggccaacaggctttaccaaggcctggctgagcttgcaaaggtgcccccggcttcaaagcctgcagggcacacatcgccttgcactgatcacagccaggaaagggagcttaggataagtcaaaggcagtgttccactcctgactgcacagccaggaaggaaacccatcaacttgtggggacactggcaaaagcttgagctctcaatgctctaaagcccaccacagcttcctggctttacttgcatctgtctggccaaacatccccaaatttagtgccgggaagtccatctgtaccgcagcggggagagtactacaagggcacatgcggtgtgtcaggcaggacactgctccccatggacacacgaggtctcagctgtgattacttcaacttggctcatttttagaatgctctgttttctttcatcttgtgggagcttctcctgtgtgagttagcagagaagggcctagaggagtgtggttcaaggacacttgaatattatatctcaggatattaagggtattcagaggtcatttcacccaactttcttcccttcctacctctccccatatcccgcttccttgggcctgtgcttttccatttttaaagtctttatttcattacaaaacctaaacatgctcacatataaattgaaaacttcaaaagtgtctagggtcaagccacacacccacccctaaccccattcctcaaatatgcttgcttggtccatatt

SEQ ID NO: 56424 - DNA, 1476 bp, Bovine  19866880379871
cttctgggcctggagtctccccagcccctcactttgtccagcaccctaagacagatgccggtagctagtgcagaccaggctgttgtgttcatgaagccactcctgagtaattctaggaaaatgttctccccttttgtttttgttttttaatgtatcatttcctcctttgcttcctctttctctctctgcttttccctcttttccctgcctcttctctaaccttctatttctctgatttttttttgggagggggccacatttcatgcagaatcttagttccccaaccagggattgaacctgtgccccctgaagtggaagcgcagagtcttaaccactggattgccagagaatcccctctgattctttctatagcagacttctttctttgaactacttggctttgactgatattctgtcttggtccctccctctctgtctgttagttttaattttgtctttttgtctgtttcttgctcttggctccactgcctccttcccttacattcctgcttgtctcagaaatgtccctcaggtgacctccagagcctttgcctcccctttctcatccctagttggcattagcagccagagtactctgtccctttacaaataattagaccaagggcaagtgtattggggggttgggggagaaggtgacgcctggccctgggaggtagggacactattaatagtcctaagagcagctgggggtgggggtggctgtctggccgggccgggccggggcagctcgaagggccagaaagggcagcactggaaatagagtggccggggcgggggagccgctctgcgggcccctgacctggacacggcccctctgccgcggccctgccttctcttggtgtggagggcattctccactatcagtttttatccatcaggttggtgagggaggagaagcctcagggccggggggccacttttctgggcccccagcatcacatgacgcctggccccaggccctctcagaaatgttggctcctgctgccggctgagtcgtggcaccagcctgtgctgccaggagaggcacccggccgcttgtgtggccacgcctgtgccccggtgtcctcagctccccgtatgcccagcgcccagctagtgtgggcagggctttgcgctcagcatcctcagcatcctggggcacaagtctctctctgcctccctgttagccttgccgtctcctggcaatccctggccctgcctctccctgactgtttccaatgtggtatctgccctgggactgtggccattgtattcggggagagatgtacacgtagaagacattctgctctgccctttatttcccaagaaggctccctgcccctctttgcagagggtaatgggccaagtcttgagggagctcctctgctcactggccagtggtctctagggtgagataccaagaaccatcatgtcgagttcacgcaatgtatcataaagagtacgaactccagtggg

SEQ ID NO: 56425 - DNA, 2654 bp, Bovine  19866880402457
gagagggggttaagaaatgaatagaatccacagcaggggggctccttgtagcgttcaaatcaggaccccactgagactctgatgaaaactacagaccaggaaaatacacacacacacacatacacaattttggcatgaaatttcagatggctcatggatcccattaattccaactacgagcttgcatccttaggatcaatctgccccagaggaagactctctcctctagaggctcatcaaatatcaggaagctgagaaaaaaagatcaccttgttgtaactgagtagtagatagaaacatccaggcagcagactgacctatcaaggctgcctttcaacttgtgtgtgtgtgcgtgtcttggtcgctcagtcatgtctgacccttggcgaccccatggactgtagcctgccaggctcctctgcccacggaattctccacacaagaatactggagcagggtgccattcccttctccagaggatgttcccgactcagggaccaaacctgggtcttctgcattgcaggcagtttcctgactatgtgagccaccaaggaagccctgcctttcaacttactaatcacttattgagacttactatatgctcaacagtgtatgagcttccctaggtgttttaagaaccatgtcacagaaaacagggttttgaaggcttcttcctgccatcaaggtcaagccagcctctggcagcagaagtcagcccccagggagcataagttagtacaaccactttgcagagcaatttggcaggatctagtgaagctgggaatgcatagagcatacaactcagcaattccactcctgggcatatgccctagagaaatgcactcacaagaacgaggggacagctttgttcaaaatagcacaaagctggaaacaacccaaatgtataaatacgtggtagaatgttcataccacagaataccatgaagcagcgaaaacggatggatgggaccattcttgtcaagcagattaagctcatacttcttacatgcttatctaattaactgtaacataagtatcacatatttcttatattcttatataaaagtgtaaatacataaatggaaatgataagcacaaaattcaggaaagtgcttctggatggagagaaaagaatggggccaggaaagggaatgcaggggcttacgccgtattaaaacggttgcatttttaagaaaaaagttattattggagtatagttgatttacaatgctgtgttggtttcaggtatagagcaaagtgaattagctttgcatatacacacatccactctttttaaattcttttcccacatgggtcattacagagtactgagtagagttctctatgctatacataaaggttttgctttttttggtcaccaatatgtttacttttattggttgtatattttactgcaacttcctgtgctttcaaggacagttgaaatatactgttttcttagtcaaaaagaaccttcagtgaaatacggataagatctttttactagatcttcctaaagttactgattgaaggaaaaaaggaaaagaaaaaagaaaatcaaatgatgtattgttgaatctgtgtaaaggttaatctacttgaacaagtagtctttaaatggaatatcaaattcttaatcaggtaaaggtttcatttcgatggcagtttgccccatcacctccctgtgctcacctccccgacttttcccctcacccactctgctccaggcatgctggcctcgtcactgttcatcaaacccaccagatgcagctcaacctccggcccttggcacttgctgctctctctgcctggcactctcctccttcggctcatggcttattcactcacttcctcccaggttttcattcaaatactacctccccaatgctagtcttccctgacttctagccctcctgcccataatacgacccatcccttctctgctttattttttctctaaaaatatctcatcaacatctaacacactagatattgtattcattcatgcatcttgtctttcttcaccactagaatgtcagcactacaagaggagggatttttgtctgttttgaccactgctgtgttcgagagcatatggtagttgcctaataaatattcactgaatgaatattgttcattcaatatttgcattcaatgaatgcaaatattcattcaacgaatatttgttatatgatttgctatgtgattttccacttcttttagaatttgttacacaggcatttgttatatgattctctacttcttttagaattattctattatacctttttagaaatggttatttctatcacatctttttttataatacatttttaaacaacaacaacaaagtcaaccactgagctgttgcacacacaagtttcctagtaagcaaagagaaaagtgctcaatgccatgatacatccaaggaaccttccaaggtcatgaggcaaaggaccgtgggcacagcagagcccctgtcagaaaacactagagctagccctcataaaagaccactcaaacctgaaagcctctaccaaaatagcccaactgacacagctgcttctgtgagaagaaacgttgctttgaaacaacagatacatttaaaacctgaattatgagaggccagccaacacagcatggtcactaagacc

SEQ ID NO: 56426 - DNA, 1422 bp, Bovine  19866880465116
aatgggatggagggtcgggaaggataaaaagtggacagacatgaaatagactaagaaggtaaaaccgataggacctggcaactgaaatgggcaggagcagggtgagagaaggcaaagagttaaggtaatgcccctctttgctggcagaggaagctgagtgtctggcgacgtccttcactggacagggaagtcaggagtggcaggcctgggggacagaatgaagtaagttcctacatgttgactttgagggctctgggactttggaggggtgatgttcaggcaatcaggagggtctggggagaaagagagagagagaattctgggtcaggaatatagacttgacatgggctcgggacactcaaagccccaggagaaagtgaggctgccatggagagcaagaaggatgtggagaaggatacggagggctgagagcagagcccagggaactcaaatcacggaagagggctggaaagacaacagaggggacggggggccaggaaggcagagggcagactgcgactggacatcacagagccaggggaagaccatgcttgccacgggagacacatcacagcagcgcaggcaccgtggagcaggctcaccaggctggcaggagccaccgagaacacgcagcggtgatgggtctgctgggaatccttcagagtcctgcagagcagctgaggccagtgaagtgaaaactgtggaacaaggggctcatctattcatgccatgctgctgctaagtcgcttcagtcgtgtccgactctgtgcgaccccatagacggcagcccaccgggctccctcgtccctgggtgcggcagcagctaaagataccaccaggctggacacccccagccatgcttcccagacccagagaggtagagatacccagagggtcactttcggccaaggaggctgtaggaactccccagagtgagcctcccctccttcctttggccgagcccccacccccccacccccgcccgcaacacggagccctgggcaggctaaatggggccatggggagaggaagctgagggggtggtgggcaggcggctgaggaagtgatctcaccccagctggcgccacttcctagaagcctgaagggcaggaggaaaccactagggcctccccccatggccctgtctcctcagcggccaggcctcagcctgcgccccaccagagcggatgccgacagcgggcgccccgctcttcccccaggcacgcacccacccagagcaccagacccaggctccaggtgcaaatcccagctccatggtttccaagataccatccaagcctcagtctctccatctgtacagtggcaccaagagcctctaccacgtaacacagtgaggtttcaccaacagtatgtagcaactacccagcaccaggactccctacagaatttatgggactcagt

SEQ ID NO: 56427 - DNA, 1440 bp, Bovine  19866880489148
ctttgggccctgcctaccccagtgccgagtctctgggcacgtggcccacccaaatccaaggagaggggagggccaggggcaagcacatgccccagagcggcaggaaagcaaccgggcagaccttgtcctcctgatggagcctcccacttccaccttcgcttccaccaggcctggcccagagcgcctctagccttgggtccttggctgccttccccagggccagggctgtcagagctaattatccaattagctgattagccagggggcctgggggctgcctggggaggcaggctcagctgggcgtgcaaagcctgagccctccaagccctgccccggcctcttctcccaactgcccccgaggaccctggcctcctccagaacaccggaaggcccccacccctgcctgtgtccactcagtgggcagggcctcctacctgagactgctgtgggatgttcagaaagttgccgtcccggggtccgatgctgacaaaccggttggcagaggaggcgcctgtcgttgcgaatgctgtggggagcaggggagagagggagagaccccgtgaggactgggggcccacccgggcactgccccacagggctgctgagagagggagagactgggttagaccatgctgcctgggctgaggctggcggcgggaaggccaggccggaggggcccccttatcctctcactgaccaggagctcgcggtcccccagccccggcactccatctgctgcagccagggaagctcctttgtggccctggaggctctagctgtggctcagtggacccagttctgtcccctcctccctgaagtaagaacacttgctttcctgctgggcctcttgcttttggagagaagggagcccaggaggctgggagctctggggactggccccaacctgctgggagaaggccatctcagccgggctacgcctccaacaggggcgcctagttgggtgctgcaccgcttaccaccctgggcccaaggtctgggcccgtggcttggggaacttgaagggtcccagtagagggctaagctgggtgggacaggtcagagagggtctgggagctggctgctggctcaggcgcaggggcggcagggctcaggcctggcaggcattctcctcctctgatggatgagccagctcctatggtcctgcggttcccagggaccaagatgggcccacgtgcagagaaggaggaggccggagggcctggcaaagccccagggtgtgggcagcagaggcagttgttctgaggcctgagggggcaaacgggccaaacattctggagctcttctgggttgtctggctggagccctacgggaaggagccggccctgtaccctgggaggaaggaagcccccagaagggatgaggagtgtcacaggctactggggagtccccctcccatccctcccagcacaggatacaccc

SEQ ID NO: 56428 - DNA, 894 bp, Bovine  19866880515128
ttctatgtatggtagtgtgtatatgttaatctcaaattcctaatgtatccctcccccccgacccctttggtaaccatgtttgttttctatgttggtgggtcaatttttgttttgtaaataagttcatttgcatcatttttttagattccacatataagcaatacatgatatttgtctttccagcttaattcacttagtatgacaatctctaggttcgtcggtgtttccgtaaatggaatcgtttcattcttttttatgactgagtaataatccacggtacatagggaccacatctcctttatccatacatctgccaatggacatttaataaggttgcttctatgtcttggcccttgtgcatagtgtgggcaggtgcttcctctgaataaggtcgggtgggtgaggtcaatgaggcctccatcctctcccctgttttctagccacgctaatatcttcttctcatattctcctgtcctctgcccctgcccctcatctggtaaccccgctgttctccgtacattctctccagccccaaggcctttgcacatgttcccctcctcacccacctggcacaaagtagttgctcctctgcaaatatttattgacattctgacttccagggagctagagaaaaatctagatccttcctatacttgggttgacagagacataaacttggctgagatcctgggagagggtaagtggggtgggggaattaaccaggggcagcacagtggaggcagccaagccagactcgggttacaggtaccacatgttagctgtgtgattgtgggcaagtacttaacccctcagagtctcagttcccctgtcaattaactaagtgtagaacactcacctccgagaaggtgatggcaccccactctagtactcttg

SEQ ID NO: 56429 - DNA, 1415 bp, Bovine  19866880534964
ttccggaatgatatcatctcaggttcaaatcccagctccatcacttactagctgggtgatcgcgagcaaattccttctatgcttcagattcttcagcgctcacatgggaatattaatgtttcctaattcattggattgttgtgaggattaaatgagagaatgcatgtaaagcactttggaagcagtcaattctaaaagctatttattctaattgtaacagaaagcatctgccgtaatctccagccgagatgaggaggtgaggggggttgggtaagagggcagaagcacatggaagaacatgggggctcagcatttctgagcccagcccggatgccgccaatccttatgtttccagagttctcatcattcaagatacttctaagaaacacaccacagaccacttaccctgttagcaccaccacaaagtccatcacattccagccgttcctcaagtaagagcctttatggaaggcaaatccaagggcgatgattttaattccagcctcaaaacaaaaaattccaatgaagtatggttctgtgtcatcctggaagggggagaaggtaagattagtgtctttggctggacagagggcggcatgaacagggaaccacccactcagaatctctacccacttcccctcacctctccagactttccagccctcaccgcgcctcactgcattctgcctggagtaaccttgtccaaagcctactgcgagaaaaacagaagcatggagaagacgactcctttccatttggccaactttacacactacttaggcagccatgtgtgactatttaaattgaaatgaagggatttcctggtggttcagtggttgggaatctgcctgccaatgcaggggacacgggttcgatccttgattggggaagatcccctatgccatggggcaactaagcctgagtgccacaactacgatgcctatgcacctggagccttgccctacaacaagagaagtctctgctatgaaaagcctgtgcactgcaatgaagagtagcccccactcactgccactagagaaagcccaggcagagcaacgaagacccaacacagccaagaataataaatatataataaaaaataaatttaagtgaaataaaacgaaagactcagttctgctgtcacactagtcccattccaggctaacgtattggacggtgcagatgttggatatttccatcactgtagaaagttccacaagaaagcgttggtttagaatgtttacttgtcacatacatcatccaggaccctggggttggtccctgtgcactgacctcacctccaagcccccaaatctgacacttgtgatgattctaagctggtgtgcaccagtagagcagttcaggttgagaaaatattggaatgaacacttctgcactggctggtaaatgactga

SEQ ID NO: 56430 - DNA, 1953 bp, Bovine  19866880560463
gcaatggcaacccactccagtgttcttgcctggagaatcccagggacagcagagcctggtgggctgccatctatggggtcgcacagagtcgaacacgaatgaagcgacttagcagcagcagcagcagcaagcaagcaatcacgcaaaagtcagaatgtgggaccttccttagggcaactggactggtttctgcagagtcaatggcaggagggaagataactgccttagattacaagccttaacatcaaatctagaccatgtacggatcttggttcaaacaaaacaacctgtaagatgccatttctgatgtaattgtggatatttgattactggctgggtttttgatgattcccaggaaccattggcgtgctggatgtcaacatgtcactggggtgatgtaagaaagcatcttttttggccactctatgtgccttgcgggatcttagttcttcaaccagggtttgaacccaggccatggcattgaaaacactaagtactaaccactggactgccagggaagtcccagaaagtgcccatattttgagcaatgcagacttaagtatatggcagtgaattgacgtattgcctgggatttgccctaacatagtttggccaagaaaaacaaaccaaggaaataaaaaacaaaaggaaacatgaagtgaggcaaaatcttgatatttgttgtctctggatgaggagttcatgaggggttcatggtactgttctccatgtatttatgtatggttaatatttttcacaagaatttttgtttgtttttcttttttaaaaacttatttatttatttaaattcttttggctgtgccaccagacttgcaggatcttagttccccatccagggactgaacctgggccctgatagtgaaagcatcaagtcctaaccacccaattgccagagaattccccaaaattttgttctgaatgtgactcctcatggacaacgtaacccctccatccctctccagattaacaaaaggtctgctggggggcaagagtggaggatgggcagcgaggacttctctctccccagattattagtattcatgaaatttaggttccccagggctttcatggtggctcagtggtaaagaatcctcctgcaatgcagaagacacgggtttgatccctaggttgggaagaccccctggagaaggaaatggtaacccactccaatattctggcctgggaaatcccatggacagagaagcctggtgggttccagtttatggggtcacaaaagagttggacaggacttagcagctaaacaacaacaggcagggggcccaggatctggttcttggagacaagactaagagcccagtctgctctcagatcccacaggcacatcagtttgcccccaaagcagagaccccggcggggaaacatcactcaccagtcgttcagacatcggagtcttgtcatcatcaggtaggtgttgctccagggcgaggacgatgcagtttgctatgatggtggctaaaatcatatattcaaagggagtatcacagagttaaggaaaatcttttcagctttgtttagattcaaagcacaactgagtggaagatacagggatttcccacatgtcccctgcccccacataggcacagcctgccctgttatgaacgtcccccactggagtggtgaattttgtcacccgtgatgaacctacactgacatatcactattatccaaagtccttagcttacactatggttcatgcttggtgtcgtacattctgtgagtctgagcaagcgtatgatgacatggatctaccaacatagcttcatacagaggagtttcactgccatgaaaacccagcagatgactccataaggaaactgtagatgctcttcctccatctcacctccaaccttcattggacaaatatcaatttagcacctattgcgtgccaggttcctgggcacagggtcacag

SEQ ID NO: 56431 - DNA, 587 bp, Bovine  19866880629811
tcggggctggctcgggccggcagcccgggtagtggctcgaggaccactttctgctgcggcaggagcaggtgcgggggcaggaagcccaccagctccacccactgctcggcgcccggctcgtaatggggcggcagcggctcggggctgcctagctgcgcggcctccccgcggcaagctggcggttccggggccagcgcacccggcccgggcccaggcgtgggcggccggggcggcggcggctccggtggcggcgtgggccagggctcttgctgctctgccttcctagcgggaaactgactgcctgagctctggaggacaaacagagatactgaggggtcaccggggccggcagcgggcggctgtccaggcctccaccgcccaccgggctgctgacactaggcagcaacccgaccagaagaccccacccggtgtcagggaaggggcaatccagagctctctcttagcaaagcctggaccctgaactgcccggtgctggcaaagaggaaggcttgaggcccatggttggaattgggagtccagggtggggctgggtttctcaaagttccagctaccaccctccacccaga

SEQ ID NO: 56432 - DNA, 1530 bp, Bovine  19866880655206
tggacatgagtctgagcaaacgcccagagatagtgaaggacagggaagcctggtgcactgcagtctgtggggtcgcagagtcggacacgacttagtggctaaacaacaactcagtctcatccataaaggagagtttgacttgggtaccccacggtttcagtgcctggcatttaatacatgtggtatagacaaaaatgtttgcctatcaaaatttaacgtaacagattagaaaattgggcaacttaaatgggagatttgtgggacggacataaccaatcaaacgcacagggcgatgatggagcaccctgattcttgaattttctagaaggacagaaacagatgtatccacaagtggaagcagggtttgttcatcattatgaggaaaaagagtgttttggctagaaattaaaaatgcaaattaaaacaagctttaaggtatcattacaaactgatttatccagaaaggaaattaaacacgtaataggcaatggccggggtgggagagtccataaacgtctgcatacttggcaggtttataaatgggttcaatgtttttgaaactcagaacagctctgtgaataatgagttgaaaagctgttaatatctttgatcctataattatccccaaagaaatcctcccaaagggtgggaggagtcattgtatgtaaatgctcccagcagtgctcctcgtaaaggcaaaaactggaaacaactcagataccatataataaagctaaggctgagcaagccacagtgtggccaccctctggagtgtgggatggcatggaaatcatgttgaaactcagcagtaagcttataaactaggggggagtgaagcaacctgagtatgaagtagtgggttcctagggattagaaacacaagtaccttttgatttttatttttggccgtgctgttcagcttgcgggatcttagttccccagccagggcccaaacctgtatcctctgcaatagaagtctggagtcctaaccactggactgacagggaattccccaaaacacgtgtagattttgaattccctcccccagcattgcctctatactccagccacacgatacccattcagccttaatgtctgctcctctcagagtctcctgttattttctctgcctggaagctctctcatctactcttcatacttagactttaaaaaaaagaaaaccatttatttatttaggcgtgctgggcctttgctgctgcaccggctttctctagttgcagtgagtggactactctcgggttgctggctcttcactgtggtggcttctcactgcagagcacaggctctaggctcacggacttcaaaagttgtggtgcacgggcttagctgctcctcagcatgtgggatcttcctagacccgggatcgaactcatgtctcctgcattggcaggtggtttctttaccactgggccatgagggaggccccgtaactagaatttttattttattttttggccccaccatgtgacttgtcggatcttagttccccaatcggggactgaacttgca

SEQ ID NO: 56433 - DNA, 1086 bp, Bovine  19866880657710
gtgccaggggagctctgtggggagcagtgctggctttgaacacaaaggccattgctccacaagagtagtaattctcggggcactgccagcccgagacgtatggccaaatgagaggcccctgccccaaggatggtccagagttctctgacttattcatgggcagagtttcaaatacatgcattaaaaaaaaaaatttaaaccacacacacacacagtctgttgtagccatgctgctgcccaggagtgtccctggccacatgggacagtaactgaggatgatggtcctgaagccaccgtctaatactagattttgaaacttggagactcattaatataattactcaaatgccagcctggcttggcagggcctcccgagttgtatttctctccaaccaagcactccggctgcagggccgtccctggtgagccaaagccctgctccccggtttgtggatggtggttgcaggcatgtgttggcttccccagtgaacccttcctgggagaggccgggcattcccacagtgccaaatcctgcctttatgtgtcttgtcacgagacagcacctctggagagtcttctgcaggagtgagcagtcagctgggcgaggccttgtttgaatgcaagctggacccaggtttggcggagggccgggtaattttgctcctctgtgacactttgcacttaattttgtagctttctcttgctaggctggaatcttgtgctgggactatgttttatctgccttggcatctggctttcacccagagtatagttttatacaaccccataaacccattttgaatattgaattaccttcagatgggaagcagctgacagcccatcccatccttgagatgatgcaaaggcatgaaatggcataaaaatcagagatggggctgataaaggacgggagtggggccagggagagtggtggtgtgctttctgtgtgggcatcatgaggagagaatgcaggcaggtgaggagtgattgaagcttctgaaaggctggaatgaatgtggcaggcaagtgggaagctgtgggttaaggattaaaaggactggtttctcaaaatatgttgttttttcc

SEQ ID NO: 56434 - DNA, 1738 bp, Bovine  19866880680734
ctgaagagcacagaacagaagcgaggtgctggaagcggtccgcgaaccttccacagtacctatttcctggcttcatccttcctgctctcggtggtctgagaaatggactgctgctgctgctaagtcgcttcagtcgtgtccgactctgtgcgaccccataagagaagacagccccaaatcaagaatccagttttcatcagctagtactcaatcgttccatatatggcgatttcttttccatacacaaagtgcttggtaaagacgcattgagaggactcagggcttgattagcttccagaagcgctaaaaggtttcaggtgggtcctggggtcaagtgtggggcccagctgtctttgttctgggttgtggttgaattcctggactaggagccagatactgctaagtcacttcagtcgtgtccgactctgtgcgatcccatagacggcagcccaccaggctcccccgtccctggaattctccaggcaagaacactggagtgggtttccatttccttctccaatgcatgaaagtgaaaagtgaaagtgaagtcgctcagtcgtctccgactcctagcgaccccatggaccgcagcctaccaggctcctctccgtccatgggattttccaggcaagagtactggagtgggttgccattgccttctccgaggagccagatagcaggggttcaaattgcagctctggctctccctgactctgggattattctctgctttgcctcagtttcctcatctgtaaaatggggacaacggtaacacccgcttttgggcttctgacaaagatgaaattcaatgcattattagatagcaagcgtttagaacagtgcaggtgtatagtaagccttgataaccatttgctatggactggagaagggtaggcctttaagcttctggaagcctaagttaacacacagttacaaagaagaaagaatagcaggttgtgaagacatcaaaactgaaacctggcctttaaagaagacctgcttgagaatcagagcacatttttttttttccttctcttttcagggaggcagttggacaattctagcctagttgatattaaaaaaaagaaataggtctggtcccagggagcttctttttcagtgctgctgtctggttttagtgcagaaagaccctccttttgtcctttgaattagcagctttggctgcagctagcggtggagggcctggggaagccaccctgccccccagagatggcgtcctttttgatctatcagattttccacgtgggtctttggaacccaagcagctggtgcgatcctcccagagtcaccatcctgcttaccgctgccgccatcttttattctgccaccatcactccgaaagtctgtccttaaaaccctgcaaggctcttttgatggtgtctgtgcactttcgctccaggctctcgcaactgcttccacccagggggctctatcggcttcatctctgcctacgcttttactattattattctcacttttggccagggctcactagacactttgctgttctctgtgtttgcaagtgctgctcacctcaggacctttacactggctcttccctgacctgcagtgcttttgccatggctggctccagcttgccttccaatctcagcacagatgtcacctcaagtaaagctgccccctccccctcccagggatcacatcactctgttcattacagttaggtattttctcttacattattagactgccagca

SEQ ID NO: 56435 - DNA, 1347 bp, Bovine  19866880686041
caaagacctgaaggaaatgaaacattaaatctatgcatatctgagggaaagcatccaggcagagggcacagtccatgcaaaggccccgggggtaaactcttggaggttcctaaagagattttttggagaaggcaatggcaccccactccagtactcttgcctggaaaatcccatggatggaggagcctggtaggctgcagtccatggggtcgctaagagtcaggcacgactgagcaacttcactttcactttttactttcatgcattggagaaggaaatggcaacccactccagtattcttgcctggagaatcccagggacagaggagcctggtgggctgccgtctgtggggtcgcacagagtcggacatgtctgaagagattcttggagcaggcacaagttgggtagacgtgtataagtctttgaagccttcttagcaacaatccgggaatgtcagggtgtctaaacttgttactgggtgtcaaaacccatgcatttgtgtattttgggggtgaggatccccagattctcaaggattccgcaaccccaagaaccaccatgagggagacgtgacaatagcttaagtacatccactgaccaaatacctgccttgttgcttctcctccctgcaggaattggggtttggaatcctgcctttgatgtcaccccccacgacctcatcactggcggcatcatcacagagctgggtgtctttgcccccgaggagctccaggcagcccttagtgccaccatctcctgagtggaacaccctagatggaccccagaagtaaccaacctagctctccatagcttccatatgccctccatatccccattatttttataataaacttattgaatgttctgcacaaccgctgaccttcttcccataaccacagtacttcccagagcagggcatcaggtagaatacgggaagagcctgtgtgtggcttgagaggccagcatctggagcccagctgcctgagttcataccccagctccacctctttttctgcagtgtgatcttggccacatcacttcatctctcccatactttcttttcctcatttataaaatgcagataatactggtacctccctcttaaattgctctcagggctgaaatgaaggtgacaccttaggtgcagaattttaaaggatgtcataagaagctcagtaatcaagataaatgggcttccctgatagctcagttggtaaagaatccacctgcaatgcaggagaccccagttcaattcttgggtcaggagatcccgtggagaagggataggctacccactccagttttctttggggcttccctttgtggctcagctggtaaagaatctgc

SEQ ID NO: 56436 - DNA, 1835 bp, Bovine  19866880705133
tcccaagggccaccgcggcagaagcagcggcagcaacaggccaggtccctccagggaaagtgagcagctccaggccgcccaccctctccccgcccctggcggcccggtttcctccctctcacccctggcgcagtggctggaggatgctgggccagtgcagataagggcctggctgcctggccgcgcctgataaggagccgggctgaccccggaggaaacccggcgggcggggatcccccgagcgcgggcctccgggccccgccccccgccagtgcaggcaggaccgcctgtcaccctcaaggcctcaccttctgtcccccaggcgctgcaggatccctgctccagcatacacccttgagagtgaggtgcccagttgcatgcagaggggaaactgaggcggaaacgcagcagtccctatgttacttgggcctgtcctccagctttgaataccccttgtcctgtgctgatgggggtggagagtcctttccggctctgctggggcctcgtgacccaggggcccccttctcctcctcagcctggccggttcctctttctacaagagtgcctcctcgctcttctgccaaccccaccctgcactgactgcagggcagtgttgacagtttggccctgggtgtccaggctgggccagtgtcttgggcccctggtgcaccctcccacaccaccacgccaggtccaggagggttaaagaaaaataccacagctggggaggtgcggccagtgccagtggcagaaccttctgataggtgtgcccaccaggtccccgccatccggggcctctccccgcaggctcacatggccccagctcagagacccccagcctttgtcccgctgtgtgggccacttcagggtggacagtgataaagaggcattgggtcaatatcttggaatggtgatgaagctcaaggtatgaccctgttcccacccctggtgtgctcccacctgggtcagtcatgctttgccccgtgtgactgcaggagtgcccaggcaggcccctgggttcaatccctgggtcaggaagatcctctggagaaggaaacagcaaccccctctagtcttcttgccccggaaatcccatggacagaggagcctggcaggctgcaagtccatggggtggcaaagagtcagacacgagtgagtcaccgagcaggctcacactcaggaatcaagtgaaacccagaaccccacagacaaccatcctactgtccagggaagccagagtacagttctgaatgtttgagttaactctgggatgcctactagttgggctctggaattaggtttagggtcattgtacagatgatacgatgccagtaagggctgcctccacggtcccatggctaccacgtggcagggtggggattctgccccagtcctctcgttaatgctgctaccttccccggctctggcggggaaagggttgccacaggctgctgggtgcctcagtgtaccagcccaaggggccgcagggcaggaagcacctggtctggagcggatgcaggaggcgcctggttccggtccagtttccgccactggggccctcaggggcagctgggccagagaaaccaggcggcgaggaggaggaggagacactggggcgcgagcccatatgcgggcgcagtgcctagaggacaggtctgagtactgggggtgctgcccacgcttggaggatgggaagaaggggaagaaggtaaaggcccccgcgggcgtgagcgcacggctgccgccccgtggccaccttgggaatggcaggcaccagcaaatgtgtggctcaccggtaaagaagctgcctgcggtgcaggagacgcaggttccat

SEQ ID NO: 56437 - DNA, 1655 bp, Bovine  19866880705890
caccgtgggagggccattattctattctctcttctgtatatatctgagcttttccaaaaggaaaaaaaagagtttcttttcatataaagtacttgaaataatcttgattcatattgcaacaagaacctcacaattatagaaacaaaagtactaagcttactatattctcaggcaattacaaattatattcagcatctagcccctctggtaagtcagaagcttgattaaatgcttacttatatattcctgtgtatcctgagaagttagcaagggaaatttaatcaaatgaactacatctgcttatagaaattcctgtctcagtttttcttgagaactgagctgctgctgctgctgctgctaagtcgcttcagtcgtgtctgactgtgcgaccccatagtcggcagcccaccgggctcccccagccctgggattctccaggcaagaacactggagcaggctgccatttccttctccaaagcatgaaagtgaaaagtgaaagtgaagtggctcagtcgtgtccaacttttcacgaccccatggactgcagcccaccaggctcctccgtccatgggattctccaggcaagagtactggagtggggtgccattgccttctccgtgagaactgagctagatcccctcgatttgcaaattcataagtttaccacacccagagataaagtcacaggtggcagaatagagcatgtcattccacctggaacacttgagaaaaataatcagcttcatttgctcagttactcatccatttgacaaatgagtttttaaaaatatctattctttttaaaaatttttattgaagtagagttgatttacaatgttgtgttagtttcaggtgtacagcaaaattattcagatacatatgtgtgtatgtatgaatatataggaaagtgaaattgtcagtcactcagttgtgtccaactctttgtgatcccatgaactgtagctcaccaggcttgactcctccgtccatggaattctccaagcatgaatactgaagtgggttgccatttccttcttccatgggatcttcccgaccaaggaatcaaacctggattctcctgcattgcaggcagattctttactgactgagccacccaggaaagcaatatagacatttgtaaagcaatataggctcagatttacatgtgtattatccatttcacttaattaacgtactcagtttcattatattttttctaaatttagttttcatggaaataatgagcttttcctttgcatgtttcattggtttcagttcagttgctcattcgtgtctgactttttgcgaccgcattaattgcagcacgccaggcctcctgtccatcaccaacgcccagagttcacccaaacccatgtccattgagtcgttgatgccatccaaacatctcatcctctgtcgtccccttcttctcatgccctcaatctttcccagcatcagggtcttttcaaatgagtcagctctttgcatcaggtggccaaagtattggcatttcagcttcaatatcagtccttccaatgaacacccagggctgatttcctttaggatggactggttggctctccttgcagtccaagggactctcaagagtcttctccaataccacagctcaaaagcatcaattcttcagctctcag

SEQ ID NO: 56438 - DNA, 1036 bp, Bovine  19866880729650
ttctcttgccgtgtttccttgttggagctctgcggagagccctataaagaagagcaagacagacctgctcaaccccgaggaggctgaggatcagctggccgacatcgcctctgtgggtaagtcccccagctgctgcctggccatcatttattatttcctgggagatgaaggtgagggcttggagctgcctggattgggttttaattctgcccgttctcaactgtatttcctggggcagatgacatgattatgggaataacaacagcgcctgtcttctcgtattgtttcaagaagtaaaattaaataacacacatagaagtaactggatctatgtcaagtaaaactaaataaccactggactgcacttccctggtggtccagtagttaagactctgtgcttccactgcagggggcacaggttcgatccctggtcaggaactaagatcccatatgccttttgctgcagccaaaaaaaaaaaaaaacacacacatatagcatttagaacaccatgtggcagaaaagaagatcctcatgatattggctaatattattcatgagtaatgttattattcattaatgcttactcgggaggctactgttactgaatgcccatttgtgaacaggactgagatcaaatccctacccttgtggaacttacagtccagtgcagaaaatagatattaagcaggtaattacagaaataagcttgtaatgataacgacactgcagaggagatgctcctcactcagctgctctggaagagtggagtgtagtcagagagggcttcttggaggaggtgacattgttctgagaaccgaagggaagataggagtttgccacagcagtgggtgcagagtgaaccaggcagaaggctgtgcccaggccgttgtcattggttattgccaaggacagagtttgaggtgggaacatttgtctttcctttttacccctcttgggtgagactgttgctttgaccttctctaaggagattctgttatttttttaaactagtcttcattgctgcactcaggcttt

SEQ ID NO: 56439 - DNA, 1489 bp, Bovine  19866880780567
tatcgtgagtggctagagagggagcctggtgataggccaggcatgagctccacgcaggcagcttcctccggagtctgcagtgtcctggtgtcgcttcttggcaagtgggtcctgacctcacccctcacccttgaccctggctgaggtggtgtaggtccaccacgcttggggtgaaccccagagacagcaaacacctctttcctgcatgagggacctgtggggatgcgagaaatcctggactcccaattcccattttgattaaatgatttttaaaaaagatttttttgatatggaccattttaaaaatctttatgaaattggttacaatactgactcttgtgttttgttttttttttttagctgtgaggcatgtggggcttttagttctctgatcaggaatcgaacctgcaccctctgcatagaaaggtgaagtcttaaccattggaccaccagggaagtccccgattaaacagttttgaatcaggatcttgtcacctgcaaccacatgattcccagtaggtaggtactctctttacagtaaattagagtgctcatttcttcttaccaactacagcatgcatgctaagtggcttcagtagtgtctgattctctgtgacctatggactctagccccccaggcttctctgtccgtgggattctctaggcaagaatactggagtggagccctccaccaggggatcttccagacccagggaccgaacctgcatctcttatgtctccttcattggcaggtgggttctttatcactagcgcctcctgggaagcccgcctagacaacaacagcactgggtgttaatatttctttttcgttttttccaattttccagtgaagaatggtatacctggtttaaacttcatttatttaccagtagtattgaatgtctccacacaaggagtggccatttatatttctctttggtgaactgaatttagcttactttggcaatgtgctgatttttcaagctggagctggatttgcatagggagacagttcccaagtgttttgggtgttgaaatggtttttgctgttgattataacatccctccaggctgagggtgtttctaccttcatgtagtcgatgtttcctggggaaatgagcacataacgacttgtgccaccttttccaacagccccgatgaatgttattttgagttagagagctaaagtaagaaaagacagaaggtaagacagctgtcacaagatctccagaaagtggcatcatatttcacttcacagtgccctgaaagaaggcatggcaacccactccagtatgcttgcctggagaataccacggacagaggagcctggcaggctatagtccatggggtcgcaaagagttggacgtgaccaaagtgacttaccatgcacgcgtgctctgtgaagcatgacaacttcctacgagaaatctgatgctcgaaagaaaatttgcctattaaaacaacctgaaattgatgaatccaactaata

SEQ ID NO: 56440 - DNA, 1602 bp, Bovine  19866880795641
gtgggccacggaggctccgtctcgccacccaggctgccccctggcgtgccagtgatcagcctgggccacaccaggcccccaggggcagccatggccaccacagaactcagcaccctccgtcccccgctgctgcaactctctgccttgggaaccgccccaccccccctggccctgcattaccaccctcacccgttcctcaacaggtcagtgggggaccggggcctggggggaatccaggggcagggtccttacccacaaggcattagtgacccacgaccccttacagcctctacattgggccagcaggacctttcagcatcttccctagcagccggctaaagcggagaccaagccactgtgagctggagctggctgagggtgagtatgggtttatgtccacccaactgtctctcctggggcccacgtctgccctacaaccttccactgggaaaacactgggaaaagtgatgcccctgcacacagacacacacaggggctcagtactcaggttacactcatgcagcaaaaccacagactcatggccagttctacaacaacccctgtcacccaacaagccacagcgattcatggcaaaacagcacagcatgggggctccattcgcatgcacagccacacaggaaacagccacagggcaacatccactcaagagacagccacaggaccacaaccacacaggaggcagatacacaaccacagccactgaggtccacagccacacaggaattagccacacaaccacagccacatggcagtgatcacacaccacagccatgtggatatgcaggagtttacatgaccacctgagaaaggataggaccaatcacgatgaaggaaactctcagacccacgagcacacccagccgcacagagggaccacacagaatgggaatcacaaggacagctccccagccacattccgaagggaaccccagctgttgacataaaggagtggacagaggtacaggaggcttcggttatctgcaacctgggcctgtgatagtccttgtctaggcagcttgggggcttccctcttagctcagtgggtaaagaatctgcctgcagtgcaggaaacccgggtttgatccctctgtcgggaagatcccctggagaaggaaatggagatccactccagtattcttgcctaaagaatcctatggacgcaggaccctggcgggctacagtccacggagtcgcaagagtcggacacgactgagcgactaaacccccaccaccaccaggcagcttgggggtgggggtgcgggggttgctaactgagctacacgtggatcctacacgtgaaccccttggatggagaaagcctcagtccactgccagtgttgaagtcccccaagagggtgttgggagtctcaagtaagggtaggtgggggtgcctgcctctcttgggccatggcgccaatcctgccactcctatcctcagggcatcagccccagaaggtggcccggcgcgtgttcaccaacagtcgggagcgctggcggcagcagaacgtgaacggcgctttcgctgagctcaggaagctgctgccaacgcacccgcccgaccggaagctgagcaagaacgag

SEQ ID NO: 56441 - DNA, 979 bp, Bovine  19866880804644
ctgagtttggctccaggaggaggcaccttctctcctgggccaggatgaatctcaaagttccagctctgggccctgcatcccaggaagcaaaagtggccgtcttccaaccatagtgtgaatactgaggacccctaattcccatgaggatgtggaggcaggcgagctgtggatggctgggaggatgggtgtcatcagtcagactttgaggtcccaggctgagacattcagttctgggggtctctggacaggccctcagagccttctgagcctagagttttcgaggcatgaaacaagtaatgatacccacccctcatctacttcccatgacacagagctgatgggggctctgcagccagcccacccaaggtcagcacttggtgccaccactcacagctgtgtggccctacacacatcccttcccatctgcgccttcacaactcgtctggaaagtggggacccccagacctagcctttctcacctcagggctgcagtccagctgctgatggaggcagctgggggccgctgagtggaggccaaagtcctcatcctcctcactggggaagacgggcctccccagcatctctgggctgaactctgagccttgccctgggatccctggggctgcgggagggaccaggcgtctggacgcccgggacagttatcagcttaggtggctgggagacgtcccccccagccgttgtcctccccgaataactcttgggacagggtttgtcagggcccggctgccccacacactctctgcgcctccttcccttgcagcggtcacccgtgcaggccaacagctcctccggcaagacggccggagcccccacgggcacggtgccacagcagctgcaagtccatggcgtccagcagagtgtccccgtcacccaagaggtgccaggccaaggcgggcggtggcaggggcaaggggtgccagcccagtggcctctgcatcctcctaaagctgtttgtcgg

SEQ ID NO: 56442 - DNA, 2079 bp, Bovine  19866880906841
ccagggccacgtcccctggcaacatttccggccttggctttctctccagcctggtagaccgaagcagtagggaccctaaccacccactcccagcttggggccaccctgactgaaccccagccccccaggcctacaactctcttcagggacaaaggctgccttgactttctggagagactggagaggggatggaggggccagaggcaccgcaagctccgttcagtcctgaggtgacatgttcccgcatcctggtgcccagggccagacagtgcctcctgggctctaagcttctttccactcaaccatcacacacagcttcctcaaaaccaagtccagccactgtgtctgaggatggctgcctgggcgtgcaggcgtcaggcctctgcctggtccaggcttaggggatgaagagaattttggaggctgccgcttgtccttgaagccaccagggtggcgaggggtgtgttcaggctggctcacgttgcatgtgtgtgagcgcaggctctgcttcctgtcttcccctagggaccggggtactcatgcagtccacaccctggggcagaaggcaggattgcgtgggggtaggtgacgaatctgggctcttcctaggtgtgggaccaagtgggctctgcagagcaaggctctgaaatgggattggtgctcaggtcccaggctgctctgccttcatccccttacggcttcagtcacccccaacccccggtcggcgcttgtagcctggaggcctcgtgcagcaccccgacctaggccaggctcagccagaggttggcagcatgggaccctctcttcctcagggttcttctgtgtctcctggaacagccctaagccctgaaatgccgttcttctcacccgcagctctgttcatcctctacctctgcttagttattaaagccctcgacttcctttcttcagctcctcgcctttccctctggaatcctatttctggtctcattttgctctgtcttggctccatgcccctctctctgtccttccttctccttcgctttccctctctttgggcccctttcctctccccgtcctgcctgtttgcacaagtgtgtgcgtgtgcacacgtgtgtgcttcggagaggcctctgcctcttcatcagagctgtaagaggggaagctccagcagccagaaggagcccagaatcacacataaactccaactgacagcatgtttttaatatatatactcccagccatagacagggagatatttatggctcccactaggtgagggagggattcctgctcactgcagcacacgctccgcctcggcgcccgccccaaacaacttctctccgagaaacaggccacatgtaattcaccggttggctgcccccacgcacatcacagactgagtgcattttttgggggggctgagaggggcatgcaggcacaaccgcactgacacatgcgtacccaggcacatgtatgtactagggcgcacatttgctctacatccagacacacacacacacacacacccagagatgccaccaaccacttgatgctgtccagcagggatggggtgagttggtgtattaagagcggtggtcaggacgctcactgctaagaggaacctcctttggctttatccagaccactggcctttgagggtgggcagggagaggccagccctctgggcatgcctgcccttcccctcccccagctcttcccaggcctgaggttggagaagcaggcaagagtatgctctgttctgggggtgccatctcaaggaccaattctggagctgatccctggccctgcccagtgtggcacacctcctccccccgccctcctgcacacacacacacacacacacacacacacacacacacacaccctctctttgcaactgaggagcatccagggcaggagaaacccaatctcaaggggagccgaggcctggcctgcagcaatcagagctggagaatgtaactattgtgtctcctgaaacccaagtccgagaatctgagacaccctgaggaggggagaagcagatggatggggggctaggggaacgggtcacagaggggttctccctgtctctgcaaa

SEQ ID NO: 56443 - DNA, 1669 bp, Bovine  19866880916191
atatggatctagaatcctttttcttgagtccattttccctaaagtcacgtttttcagggaagtcagcaagcagtccttcattttctccctcatcttgggctctgtggtggcaggaaagaactgggcaatgtaggtttccaaaaatgggaagttggcatagtctacatagctaagacctgggtctcaaagtcaggggctgactgtctgccactgatgaacttgagaatgtgagttgatctctctgaaccttggttttctcacctggaaaatatgagtaatgagagcgtctacctcttagagctgtggtagggaattgttgtttagtcactaagttgtgtccaactcttttgtgactccatggactgtagcctgccaggttcctctgtccgtgggatttccccaggtgaaaatactgggaagagttatcatttcctcctccaggggaccttcccaactcaggaatggaacctgcacctcctgcttagcaggcagattctttaaccctgagtcacctgggaatagagaaggcaaaataagtgtcagatactgtgacctgtgcccctgaaggtgtttgagtgcttcataaatgggagttggtgaactgaagggaaagttaaagcagattcttttggtggagtgtggttgttgctgcacgtgtccctcttcattagttcatctcacctctgggtttaccagcaactgtaatgggcagttcctatgcagctcacctctttgcacctccagcactctcatctttctgcatctctgatgcagagtcttttccagaatcataggagtttgttcagcccatgtgacagacattgaacaccagctaggagcagccctcaaccaatgagcaaggatgctgatgtataaataccctcactttcccattgttcagtgagaaaactcagaggtttgttctacagcctcttaaagagtcttagcaggattgaattccagttgctcacattgaaacctattcattggtacacatgttaccaactgtttgcttcactctcttgtaattccatggcctcccaaaagtccttgtcttggatctcctttcagggaatctcaaatcaacgcaaggagtaatagccagacacccaatgggttagagatttcagcacccaggacagcgcccagcacacttgcttgtctaaaagcgtcctcctttatcgctctgcccccacctggggtggggcaggattgagagaaggccagatggccaggtgatgttgttctgtgctgagcttcttggccattttccctgtgtggctggagaagaccttgccatctatctgtctgcaggtttgggggctgatagaggtcttgtcctcttgaattgctgtgacaaatgccagccggcctctgaagaggcatctggtcactgcttctatagttttcagggctgatgactgctctcttctcaccaaggcagggagacagctgtcctgcgggcagaggagatctcaatggaacgggaagcaattgggtgcctggggccaaggtggaggctgccagctgaaaagacactgtgctttgatttatgccggaaggaactatgagacctaacgatgctgtgttgtgacagaggttgtagaagctggacagcctctcctctctccaaaaacctgggcctgatccagatacaaaaggctgtcac

SEQ ID NO: 56444 - DNA, 1228 bp, Bovine  19866880946857
tgtgtgggtctccatagctgcagacactgggctcggtatttgcggctcccggggctctagagcacaggttcagtagttgtggcacatgggcttagtggctccgctgcatgtggagtcttcccagaccagggatcgaacaggtgtccccccacattcaagggcagattcatatccgctgggccaccagggaagtccctccacagcacttttcaactcccaggctccacatgaggtatttattttctccacaggctgcctccccctctagaacctccattccagcataagggtgacatttgtttgtctcatccacactgtgtccccggcagccagcgcaagacctggatgcagcggcggctcactcggcgtttgttgagtgaataagtgaatgacatggagacaaagctttttcccggctctcagaccctctggggtttaaccacctgatgcattcataaaggacaagaactctgtcccttttctcttttattaaaattttttaaatttatttttttggctatgcctcacagcatgtgggatctgagttcccagaccagggatcgaacccacatcccctgcagtggaagtgtccaccccagggaagtccccattttctctttttaaaaaaccagccaaggtggcaaagggcagggctcactcacagatggccatatcctgtgtgggttttaaagccaacccataaagtcccccttttagttttctaagtgactctctggagctcagaggatccagggaccagaggagagtgaacaagtaggctcctggcggcccattttgcagagaacgctgagatgctgagaaatcaccagaaccgccctcggtggccggcacctgggaagtggagcgagtgtcctgcgacacagcctccgcggtcttttgcgccacggtgctgccttggttgccgggcagctcctaagaactggcttcccaggcctgagttgccaaggaaatactaattcccgttgggccggtcctggggtgttttttgacttcctgtgaaggaggctggtcgcctgtgcggtcctggtcccctgagcgcccttctctctgcatctccctcacctttcctctttcttgctctctcctgtctcctcctctagtttcctcccgggctggaggcagaagaccctgggatttctgagtgaggcccatggatgtcgaagtcctcccgggtcctggaccccatgttctcgccccgcagttacta

SEQ ID NO: 56445 - DNA, 1529 bp, Bovine  19866880959348
tgtgacctaaaatcaaaagaggaagagttaggaaccagctgaaagtcaagccccagccccgtggctcaccccagactcttggtctcatggaggacttgtctggggctgtaagaatggcaaggattgatccttccctgctttcctcatgaggcctcccctccagtgctcaggctgctgagggcctctatttaacgctttcttagcccccaagctcagcctgaactagaatcttcagtctgtggttgctgggctctgagcatcagcgtggcacatctgagtgtccagcaagggcttggtgctgagaaggtactcaatacacttgagcagggtggagatctctcttgggaaccatcacctgccaactaggagggggcactcccttgctcatggagatgggagagcttactcccttcatgatcacgaacatacaaggaccaccgaggctctgtgtcctctcccctggcctcgtgtgacctcatgttccagggtcctggaatcccaatgggagctaggttctgccactctgatcttgtagctaattctgtctcccaagggaactaaaccagcccttctccccatactccctggagaactgaggctaagaggcctctggcttcctccctggggcctggttaacttgttctcaccatctggaggcctcacagtcagggacaggagagactcacaggagatgaactcatggtggagtctctccctcatttcccagaaggccttgggtatgggcagcagtggtacccaaatcatttaacccaggatgtgcaagggtactgattctcatctcttttctgactgatcctactgaaatccctgctagcttcccagggagacaacagcctaaggtctggagcctgacctagactatgctccagtaccagagaaaggtgggtgacgtggttggaggatttggggtgactgcttaccacgctgcagggtcatactcggcccagacacgcacgtactcatccaggtggtggggacccaggatggaggaatctcgggtgaggtactcaaagttgtccatgatgacggcaacaaaaagattcagcatctgtggggaccccaggggccaagacggcgtcggggagagcaagacacatccaacacatatacacagaggcccagagggagagagggagggagataaacatgggaaaaggaagtcagagaaagagatggcgggagatagaggaaagacacatgctcacagaaggagcccagaaacagagatatggagaaatggagatgggggagagacacgaagacagaaaccagagaccaagattgatacagttggagagagaggtggagaggttatgtgacataggagccaacaccaaggggaccaccatgaccccagatcctcccacacctgacccccaacaagaccaaaatgcacactccatggaccagaaccttatcagtttccatccccagcataaagtaattactcagcaaatatttgttggatggatggatggatgcatgcatgcatcttcctgccttgtcta

SEQ ID NO: 56446 - DNA, 1794 bp, Bovine  19866880985876
ggccgccgctttatcctacaccgttgtcccgcccccgccgcccatccctattggcccccccttcggcctccgaggccctcctccgccgttggctgcaccaccagatccgtatccaagtcgacgctgttcattcgttacgtgcactgcccgtcttttcgggactactcaatcaggacgctcagcgagctgggctgtcaatcacgaagagccgaagaccaatcacagtgggaggagaccccgcagcgccggccttaagcggagtttcggggcgggtcttgggttcattcacaacattcctcccccgcccccctcgggctggacagcgctcccagggctgctggggctgtgcccacacacagctttgtttactgagggtcgcttccgggcgccgcgaggggacaatcaacactgctcggcccgggagcgagacagagcggcgggatccccgggcaacctctcagcccatcctccctctgggctgtgtggcgtgagaaacagcctctctgggctccaggtcaagttttgatgctttgcggaatggagggatcacaggtcgcttggtagagcttatgggggctgcgggcaccctctctagaaatagagccaaattcaaatccatccttgagccccaagataagtacccccaatccattctatgcctcatatattgttgttgtcttttagttactaagtagtgtccgactctttgtgaccccatggactgtagcccgccaggctcctctgtccatgggatttctcagacaggaatactggagtgggttgtcatttccttctccatatattatgttgagtcatatgaaattattgattttcaatcatttttgatacactaaatgacagtctcataaagttcaatgtaatagatgttaaatctgaccacttctgaattattttttctgattcaacttatctgggccacatctctgaccttgaagctgtcggtggtgttcattgcagttccccagcccaacccacacccccggcttctgcccaccgtggcccctgccagctccatgtcctcagagaaccctgcatttcccctttgccacacttctctccgtcagcattacgtttctttatcatttcagcagttgttcaccttctgtctctccctgctccatggcgagctccaagaggcagtagtttgtccagctgatgcactgctttaaggccagcacctgaacacctcaggacatacagcagtggctcaatctatatataacttgttgactaaaccaactcatgcctgttcccattccactgaaatgatgtacagagcaggaaaaactcaagctggctcttaattggtctaatggctgccccctgcccctcctcatatggaaactctggctttttccttccaggaatttccagtttcacagctgcacgttctggccagtccccaacccaccattcagcaaactctctctgacctgcactgtccaatatggtcaccactggccacaagtgggctttggagtccttgaaatggggtcagcctgaattagcctgtgctgtggacttacctcgtggctcagacagtaaagaatctgcctacaatgcaggagacatagttttgattgttgggtcaagaagatcccctggagaagagaatggctactcactccagtattcttgcctggagaatcccatgggcagaggagcctggtgggctacagtccatggggctacaaagagttgaacatgaccgagtgactaagcatgtcaatgtaagcacactggatttcagagacttagtaagaaaaaaggcaa

SEQ ID NO: 56447 - DNA, 1915 bp, Bovine  19866881001946
cactgtattcatttatttatttttggcccactgtgaggcttgaggggtcttagttcccccaccagggatttgaatccacaccccctgcagtggaatcgaggagtcccaaccactggactgccagggaagtccccaaaaccagcccttttggcatgatcactggcacccagccctgtgttaagtgctccatgtgtgttaactagcttctgcagcttgcacagcagccctgtgtggtggccgtcaaagtcatctctgtccagtccgggcagctggactaaggtcttgcagctggtagggcagagccaggatttgaacccaggccctctggccacaacccaccaccctctgtggcttgagcacccatcccgaagccccgacggctcttttccgcttgaatctctggaggtgtctcccctgcaggcccgtggaatgccaccactcctgtctgccccctaccaccccaggaaacaacgctgagggtgcgccctagcctcattctctccctctcctcccaggtgttcgttacaatgcagagaagaagaaggttggcaattactacacaacccccgatctacaggtagaggcaatctggtgggcagaggggtgaggggctacacagaactcggagtgggagggaggcttgtaccgtctgcctgagggtcaccccctgctggtctctcctggaaaccagcatggtgttgtcagtctgggtgcatcctgcctagacccctccatggctccctccttcctcggactaaaattctcaggtctccccatggcccacagagacccctccctgccttcacttcctcccaccctccccgtcactcactctcctccaaccacacagcctcctcgctgcccctcataaaaactctctctggtgccctctgcctggaacgtcttccccagacatctgcaaggcccccttttcctccttggatttctgctccaaagtcgcctttcagagaggccttttctaaagcagtgctttcctcccagcgctgtggttgtttgagcattccctgcccactcagctgccactagaacatcagccccgctgagagcaagttggcttccttcaccgctgtgtccccagcagctggcaccaagcctgccccagagcagcctggctttggagggtttgttgaatgaatgagtgaacagatgaacaaacgaatgaatgcagggatgaatacataaactccagacagatggtcagtaccagggtgatgggcccctgcgtgtcacccatggctgtgcctcagacacggagagcagcatgcagcaggttctctgcaaatgctagttgatgacgtaacgcacacagatggagggaagcaggcaggggtcgcaaggtgtcccagggtggccacagtgtccagattcccgcctgccaccctccacccgcccaggttcaggatgaaatgccacctctgtgtcaactacatcgagatgcagacggaccccgccaactgtgactacgtgattgtgagcggcgcccagcgcaaggaggagcgctgggacatggaggacaacgaacaggtgctgaccacaggtgagcgctgtgggtgggtttggaccccaaccctgatcctgagccggggccccgaaagtccaaccccattctcacccttgcagagcatgagaagaagcagaagctggagatggacgccatgttccgcctggagcatggcgaggttgaccggagcacgctcaagaaggccctccccaccctgagccacatccaggaggcccagagcgcctggaaggacgacttcgccctcaacagcatgcttcggaaaaggttccgggtgagtggggctcccagcctagggtcgggtccacaggcagtgaggcatcagcaacagtggagcaaagaaaatgaaagttagtcactcagtcatgtcttact

SEQ ID NO: 56448 - DNA, 1671 bp, Bovine  19866881004759
ctttcaaaactgaaaaaatggcagcccagaaagggaaagagatttaatcaggaaacccacccacgggttgtgacaaagcctgaatttgactgatatctttaatgccactccctgagctctgtctatcataccatgaagtctactttcaggaaaattccacttctgtctttgtcttttgcattacctggatctaaatagttttgctctgtgttggttggcttttgttgctgttgttttagagaaacatgattccagtctacaatcaaaattcttgtagagcaagaatcccatttgacagccaccattgctaatttctctttaaaaaaattatttggctgcactgggtcttagttgcagcactcagggatcttctctcttcattgcagcctgcaggatctttagttgcggcattcaaactctttgttgcaacatgtgggatccaatttctcaaccagggatcgaacctgggccccctgcaaggggagcttggagtcttagccaccggaacaccagggaagtcctgctaatttctcttaaatgacaccctcatcaattgcccatgagatagccactttcatgcattacatcccatggaaacaagagggacctttaagaatggggtgggtaatctttactttattttcaagttacacaaaaaagcctcagtactcctgctgctgctgctagtaagtcacttcagtcgtgtccgactctgtgcgaccccatagatggcagcccaccagaccccccgcccccgggattctccaggcaagaacactggagtgggttgccatttccttctccaatgcatgaagataaaaaatgaaagtgaagtcgctcagtcgtgtccgactctttgagaccccatggacttcagcctaccaggctcctctgtccatgggattttccaggcaagagtactggagtgggttgccattttgatactatctcatgttaattcctgaaatttggggacaggcccaaaagggcaaagtcttggaaatcctggttttcactgcaggagcaagatgttctcacagttgttggaggctattgtctaggaatgaatccgagacataaggaagtcaaaaagaacaagagaggaaaggggaaagaagcagaagatttgaaagaaaagagacgaagcaaagagaaatgagaagaaaagatgagtacaacatacaggttacttttttgtctctaatgcaccttcatctctcaaccataaatttgattcccagggatgcacctagaaatcatatgtatgtttctgtatctggctgtcttgcagtctgaccctctctgtctttatttcaatgcacctctatgtgcctttcttagaaagtgatcatgtgtctgatggcccaaattccagcttccagctctcaggcgccccctcccccaaattgggctctgtcattgaggcagcaggaacttcagccctatctccagttataaacggggcccaagtaaaaggggaaagagggaacacatactgccaaagaaagagaactagagaaagggtgtgaggaagggatcagggagccggtggggatggggccaggcggtactcacagaggaagtcggagagccactcaggctggttgtagtgaacgatagcgacacacagcgtgttgagggctaccagactgagcacagtccagtagaagg

SEQ ID NO: 56449 - DNA, 873 bp, Bovine  19866881031063
ggccccctgggctggacatgggggctagccctggagccctgcgttggcatgtctgtcttgtgggtccccattctagaattattttcgcgatgcctggaacatcttccgactttgtgactgttctgggcagcatcaccgacatccttcgtgaccgagtttggggtaagtgtcccgccagtttctctccgggcagttcctggctgggctgggagaggtgaggaggaggtcccagaggagcagagggtcccgacagccacagctgggcaagccagcacttgaccttgaccaaagaggggtaagcgggggcccccgggaacaaggcagcccttcagggggctatgtggggagacgggggtgtccaaagcccccagcgctgcagtgtgaattccctgcatcttggctactgatgtatgaatagatactgtggataagctcattgagaaaacagagacacttaaaggatctcaaggctgagccctgccctccaaacagcacacagtgttgagggtccaaagggaaccagcttcaagtctatcctgcttgaactaaccatcttctggctcatgggcaggagggagccacggctctcaggttaatggggggacacccttcccaggactttaggagggtccccaggacatgtgtcttcctgtatccccaggcctggcaggttcccagtgtgggggtctctggatgtaagtgtggtgggctgtgggccacatcgtctttcccccttgtctggaagattcagggtcccagagctgctgtctcagaccccttccttggccgtttgccagtgagcccaggcttgagggcccttgggaggctggggggagggtaggagatcctcgcagaggaagcaaaagggcaaag

SEQ ID NO: 56450 - DNA, 1208 bp, Bovine  19866881072901
agtttgccaggaagctgcctttggtttccagcaaaaggggtgcccattgacatgtgtctctttccttgtgacattttcacaatctgcctcttgctctctggggagaaagcttagctcctgtgcctaaggtggagcactgcgtgtactggcctccctcgcccccagaacggctcccatgagcccagtacatctcaagaaaaaaaaaaaaaatcagtcaggctatagaagaataatacaacacagttgacgaatttgtgctaatggaagtctggaaaacactgcccccaaccacttcaaaatgcacacagcagatttaccaaagttgactgttgtagggaccttaaagtctatctcaacagatttcaaaggacagaatgatacaaaacatatcttctgaccacagtgcaattaggctagaaattggtaacaaatagataacactaaaagtgtttggaaattaagagacatgcttcttatttgttgatgaaatgctaagatgtctgagatttgcttttaaaatattttagtgtggggaggggatgtggatgaaacaaaattagccctgagttgataaatgttgaaattggtgatgggtacatgggaattcattacattactctatttttgtatatatctgacaaaattttgatgcttcttggttatccacaaatcagagaataaataataatggaaactgctgaatattttacttgaacaataatgataataatgcatgacagaatttgtgaggtgcagttaaagctgcacttaaagggcaatttatagccttaaataacattaatctatctcaaaagtctaggaaaagaacaaaaaagggaacacaacttagagaagaaattaatgaaatagaaaacaatgaatatatcaaccaagccaagcattggactttttagaaaaagactgataagtccatcctaagagccattttcctgcagattcaacagcattgaatgttcactggcctgtttcccagagctggttttgctggccctttcccctgactttgctcctcttccgtttcctagatgacattcagggtgagtctccagcaccgtgtgggacagaggaacctgcccgcacctgccccaatgggaccaaatgtcagccctactgggaaggacccaacaatgggatcactcagttcgacaacatcctgtttgcagtgctgactgttttccagtgcatca

SEQ ID NO: 56451 - DNA, 1760 bp, Bovine  19866881107544
atctggagtcctctactctctccacccccttctgtgcctctccctcttctggccccagttctgctcatctgaaccaatgcagtccccatccccctggtcccccagctcctccccatcatgagctgttccctggacagcagccagagggcacctgtgagcacaagtcagatcccggccctcctctcctcagaaccctctatggctcccacctgacccagtggaaacagttctgtctgcaggccctgtactgtcttcccatcacttgcctgctctcatttggccctcctacctccgctcctgcaccctggcctcctcactcaaacttggcaggcgcaacctctgcatggcagttccttctgcctagagtgctgtccttaggttcccccacggctcttcccaaattttcttcctgtgtccctgttgccctgttctcaccgcactccttcccagactccccgttgctctaccctgctcccttatgtcctcacacaatataatttgctagtttcttcctttattatttttggctgtgtggggtcttcattgctgtgcatgggcattttctagttggagtgagtgggggctactccctagtcgcgctgctcgggcttcttctcgtggtggcctttcctgttgcggctctaggcgcacaggcttcgtacttgtagcgtgtgggctcagcagttgcagcatacaggcttagttgcttcatggcatgtgggatcttcccagaccagggattgaaccctgtcccctgcatgggcaggcgagttcttaacccctggagcaccaaggaaggccagctgtctgatttctgacttgcctccttgctcgtctgtcttaggcattagaatgtcagctttactggcagcagatttgaggcccactgtaggcactcaataaatgtttattaaataaatgatagaagccctgcacctgcagacacagttttcccaaggtccatcgagctgcaccgacgtgggcaggcagcctaggtggtgtgtgcccagccgcctggcagatgcctttcaacccccactcccatttccccaggctgcaggccaacttcaccatccgggatgatgccaaccccagctcccgccagcgaggactcaagcgcttccaggccaaccctgaggccaactggggtccccggccccgtgcccggccagggtgagcgagagttgggtgaatgaaggtggggcttagctgggggggagtgggcacaaaggccgatggagcctcccctcgttctccctacacagaggcaaggcagcaggagaaactgtggaagagagacgtaggctgctccaaaataagcgaaaagagccggtggaggacccagctgagcgggctgcctggctcaaaacatttccctgcaagaggttcaaggaggtgaaccaaacccaccccccaactgaagtacccatgggttctcccagctacaggactgggccaatgggccagcagggctgggggaggtgggaccagtcaagtgggtgggagtgagctccctatccagggaaggaacccagaggaggctgctgtgctccagaatggggttcattcacacccattgtcttccaaccagggcacctgtcaacaggggggccagtgctgctactcgcatagccccccctcacctaaggccactgctgaagccacccccactgactgtccagaggcccccagtcagaaccccgctgagcctggggctgctactggtccaggcacagagtgagctaataaagaccttttca

SEQ ID NO: 56452 - DNA, 778 bp, Bovine  19866881144986
attggagaagaaaatggcaacccactccagtgttcttgcctggagaatcccagggacggaggagcctggtggactgccgtctatggggtcgcacagagtcaaacatgactgaagcgacttagcagcagcagcaacagagactagattctgtgtgcttccactgcctggagtaggggtttgatccctggccggggaactaagatctcacatgtcatccagcatggccaaaaaattaaaaaattaaagttaattgtaaagaaagtacgcaggacagtgcctgcaggcactctcaggagaactgtataatttgtttctgggcaaaagtcggaggtctcccagcccaggggtcccccaggcgctggagcctgcgaaagaagacggcaggaatcctgggtcagggtgagtggaagaggtgcagaccagccctggtccatcctcagttgctgtgcagcagcgggttggttagatcttgccaccagcctcggaatgtaattaagttgctgatgaacccaaacgtgtctctggggagccaggagctgtccctggtttcctctgcctgtagattaattcttgtttttccttctttttctccttcctcttctctctcccccctccctccttcttcccaagcaagcaaaaaaaaaaaaaaaagccttatttattatcattttccccactgttggcatggcaacacaggcgtacgttactgagttacaggcggccccgcaaccatcccagccaccacaggctccgccgcaagcccagccgccaccgccgc

SEQ ID NO: 56453 - DNA, 1046 bp, Bovine  19866881169310
ttcatctcattccaacatcactcttgatccatgaaggtcttgggtttccccttgagtggaggcagaagactggtccaggcctcctgaattctccttctctggggtcagaacatggaggagaaggcttggagcagaaaggcgagcccccacttctttctggatgactcaaagccacagtaaccggggctcctcctcccccctgaaatagatctaaggcagcactttccaaacttcagtgtgcacagagcccctagagatcttgctgaagtgtatgttctgactcagcaggtcagcatggggcctgatgctctgctttttttgctgggtgttggcctctgctgtttggttcctggaccacgtgttaagtagcaagggtgtggaccacaccttaagtaacaagggtgtaaggtcagtgttgcaggttcccatttggggtgtgtctttggacactggcagggtgcatggagagagagagggaggtgacatttgatagctagtgtatctatgcatgcatgcctgctaagtggcttcagtcatgtctgactctttgctaccccatggactgtagcccaccaggcttctctgttcatggcattctccagtcaagaatactggaatgagttgccatgccctcctctaggggatcttctcaacctagggattgaacccatgtcttctgcattgcagacagattctttactgctaagccatcagggaagccagtgtatccatacctgaccaaaaagaaaaagaaaaagaaataagatgggcatgggcagcctctttctgttggtttgcatgctgactaagacttcattgtcatactggagagctctgggtctgaaacccaggtgaccacggcaattgaaagcccgataatgcagcccatgaaagtgcagcttgctgctggtcttgtgggactcttcctggaacctcagctcgaatcagatacaaaggaagtcacatcccagccatttaggggcaggaggccagggggccccaagagtgaggcagcagccttggtgcagaagcacacagggagctag

SEQ ID NO: 56454 - DNA, 1430 bp, Bovine  19866881251911
ttggatggaggggctgggggcggggtccctgaggacgggcttggatgaagggggccttagaggccgctggaggagtgaagagaaagggggcgacgcagggtcagactcgtttttcaaaaccctgctcccctggcccttccgttatggagccttaccgcccccttggcacagactctgctaccggctttgggattcctccgcctggagttcctctctctgtccagctctgaccacaggagagctgggagttcctgtaactgcctcccacattgaatgggagggagctccctggagagggcctgatcttgagctacctgagcaaggctctgtctccccatgaaactaaactctcagcgtgctggaatctttttccccatcgggttgccagctctgggagggcaagcgtgtaaatctgctgtcaggtcagcagcaagtggggcaggtctgtgtctccgtggatcaggagtcgtgcggtcttctccatcagtctgggaactctgtgagggcagggctgtgtcttctccttttgactagaactcctggagcagagacagtccccaccctcagcctgatttgctccctgggttgggctgtggctccgcccttagcttggaagctccatggcgggggactgtgtctcccagtcagcctgggcctcgctgacagggttattccactctgggatctcctcgagggctgggctgcatctcccccattagactgggtagcaggatccgaggtgctctgatttcctcaatgctcaacttgggcctgctccccacccaaaaccttccttgaagttttgggatgcgggagtcagttggagggcagctgttaattgagaagggggagttgggcaggagttggacagtcactagtcaggtttacccttctgtctgcctcaacagacagccccccagggacctaagcgccctgtgtataggctggtgggttgggaacaggtgagtggagttggtcaagcccccatctcagcctccttagtgatcctcgatgtcagcagcttactgtgccttcaagtagccttcaggaagacagacaggtggcccagtgtgggccaggggtgactgggggaagcaatgccagtgatagtcctcatagccttggaagaggaacgtgtgaaaatgtcagtcactgagtcgtgtccaactctttgtgactccatggactgtagcctgccagcctcctctgtccatggaattctccaggcaagaatactggaatgggttgccgttcccttctccaagggatcttcctgacccagggatcgaaccatgtctcttacgtctcctgcatttgcaggcaggttctttatcatctgagccaccagggaaacctcaggcaagaggagcccttaggctgtggagttgggagggggcatggggcccggggagagacaggcgcaagccatt

SEQ ID NO: 56455 - DNA, 1177 bp, Bovine  19866881260319
ctgtgcctggcctgtagccctgccctggtagggggagtggcaggaccagatggattcttggcagtgaggcggggagggtgtggcaggggtggggtcttagagcctacctattccatccctaggaccatcacataaaggtgctccccgggttgtcagcccttctaaaaccccaagaacatccctaacactcgtcaggatcctactggcaaaactacacaccccagttcctgcaagacatataagttcactgagactcacagggatgacctgaaatccctttccagaccctttcctcaaataggaatttaaaaaacaatttgaaacagggattttcaagggcacggactggctggctttatgcctgtagcaacttcataaaaccagtttcaaaggttgactctgcaaacatgctgccagatttctgtgagctgtaggctcattttgaatgcccttgtataactttatatttaaagggaaaactcaaaaaattaaaaacacaaaatcagctccctgtggcagattcttttgcaaacacaaagaatccttttgctgattgattctgggtggaaaaataattttgttttttgcagattaggcttgcttcaaattgagtctaattgtagcttcagggaaactaggcccattatggcaaaagttctatgactgagaggcttgtttcccaaactgcaaggtcaaatgggggatggaggtgggacagggcaatggtgggggccccctctttggcaatgaaacttgttggctcccacagaggtctggaaggaaagttccaaggatgaactgatgggcagcagacactacttctattgtcctacacctaggggtgtaaaacagagggcgaaacccactacccaggccaggccacagcgggcaaagtaggggggctgtgtgtggagatggacgtggcctcttcctgagccctgggggacttgggagctgctggccagatgtcatcctggagggctggaggaagtgtgggaaggggggtgcctccctgcacttgccttccctggtcctggagaccacgccaggttggaacatggtggggactgggtctttgatgccagagtgaatggtggagtgcccgccttctccaggccatatggcccaggttagacagaaggtcaaggcaaggggagaggatggaagggagaaaaaa

SEQ ID NO: 56456 - DNA, 1420 bp, Bovine  19866881279133
gcctggagaattccgtggactgtatagtccatgaggtcacaaagagtcagactctgaacgactgagcgactttgatttcttcttctcagagacctgacacctagtagggcagacagagaggagaaaatcccacaagcccattaggccaggggtcaacacacattttccatagggccagacagttaatagttttggcttttcaggctatttgggttttgtcccaactattcaattttatctgttgtagcaaaaaagcaaccacaaacacataacaaagtaggcatggtagcattccaataaactgtatttatgggcactatttatttatttgaatttcatatcattttcacaaatcacaaaatatttttatttattcttcaccccctccaccatttaaaaatgtaaaaatgactcttagctcaaaggccattcaaaaacaggtggtgggggactttcctggtggtccagtgcttccaaggcaggggtgcaggtttgatctctggttggggaactaagatcccacatgcagtgcagcttccaaacaacaacaaaaaaaaggcaggttttattttctccacaggtggtagttcgctgacccctgtgattgatagtgataagtggtatagagaaaaaaaaaattgcaagaggagtctggtagccagggtttgagtcctgacttctgtcttcccagctgtgtgactttgagcaagtgactttacctctctgagccataaagtgaagagaggatgaattgcagcctcagaggcccaaggtgagagttaagcagtgcccagcacacagcaggcactccataagtgtgtgctgcccctgctggcatgagtgctgagcctcctccatgcccacattggctaccctccctccccaggggccctgtgggtgtgcgtcatcttgagtccccactgcagaccagaggagcggacgagctggctccagctgcttagcaagtgggacaagctggacgtgtgcccactggaggagggcaattactcttttgatgggcccagcctgcagcccactgcagccctcatcccaggtaggagaggggtccctgccattccccgcaacaacccatccctattgcctgtggcctagtctccccatcatggtgctctgggggaaaatggaggcagggcggaggggacgagcccttacctgcctcctagccaggagacagtgagtgtccagggcaggggcagcaggcagcctgagggacagtgatgtgaaatatttaagatacctgtagttctgggctgactcagtctcctcctggccatggaggcagaaatcgggtggggggaaggggaaacagaaagaaaaggaaacaggtattaagaagagaaagacaagtaaagacaggcagagaggaagaaattgagtatggagggagaaagatggacag

SEQ ID NO: 56457 - DNA, 1282 bp, Bovine  19866881318058
gaaagctggacttttgccagtgccctctcctctcagggcagctccccgcgcatggctttcactcacccacccgctgcctgtgcttgctggagtcagaccaggtgagaaatggagggcccggaggggggcagtgggggtggcagaggagccctgcctgaggggtagctggccagggaaccctgagtgacagcccagctctctgaactggccttggtgtggcattgggtgggcgtggggacgggcccctcccttccacagcagcaggctggcctttgggccttctcactgtgttcccccacactctcccacttgcctctcacaccccatgtgccagggtgcacacctgcttgtgcgctgtgtatgcatgtgaggatgtgtgtctgcttatgtttgtgtgaggatgctatgtgcacacattcgatgtatatgtgttcgtgtgtttgcgtggacgtgtgcacacgtgtgtgctgtgcatgtgtgcacgcgtgtgtgctgtgtgcacgtgtgtgccatgtgcacacatgtgccgagtgtgcacacgtgtgctgtgcgtgcacacgcgacatgtgcacatgtatgtgctgtgtgtgctcacgtgccatgtgcacatttgtgtgctgtgtggcacaggcctgtcctgaggccttgggcccactcctcccagctctccttgcctcccgccagctgtggatgggagagcacaggcttctgtgtctgccctccttccagttcctctctctcagtgccccaaagtgcccagggtctgttttccctggcaccagcccaggttactccaagggaccctcacaagggcccaagctccctgctcgaggcctcgcgctcttttccagaagtgaaggactaggccaaggggaaaggaaaggagccggcggctgcctgccgggggcggggggggggcggggcactctctgctccagtctggcagagagagagcttgaggggagggtgccgcccagttctgcaggggatggaaccaggtggggaactgtgggagcctcttccctcttaagagaggtctggactctttctgaacactgccctgtgtctgcccgccacctcccgggcccttgcgtaggacacggagaacatggagggttaccctcctggcttcctcctcagggcctcctggctgggagccagcagaggggcagggcgtggtggctgtggggtgggggtggggagcccaggccctccgcacaggcaggggagggcggcaggccccgctccactcagcttttatgaactccagagagaagccaag

SEQ ID NO: 56458 - DNA, 1173 bp, Bovine  19866881366891
ggaagacccaagaatgttcccaagactgaaaagaagataaagccgcctctgacccaagagagacgacaaaacttgatccgtatttaactctggaatttcgcgcttcagagctgggatctctctcgcattagctgccttaaataagtagcttccaaaagcacaattcattccaagataaagtctcagcttttcagaggaaaaaaagttacttatcttcatctttcctgggcactggcaccatctctggctccctacatccctggggtgttaagaattcactagtagatcgatagcgagccggaagcagctgaatagcacagggagctcagcttggtgctcttcgatgacctagagggctgggatgcgagggtgggtgggaggctcaggaaggaggggatatatgtatacctatagctgattcacattgttgtccagcagaaaccagcgcaacactgcaatgcaattatcctccagttaaaaagaaaaactcaacagtagggccaccaaagtccttgttagccccaaactgctgggcttttcaagatgttaaaaccaggacagggccaggcaaacagggacatctggtcaccctacccagacaaggactaacgcccggtggtttttgaacacctggattcctctcctggaatgttccttgtcttcctctatgctcccaggaagtgagggagaagggagaaagaagaaagacagaaactgttggggaagggaaggggatgtaatctaacagcaaagctgagcaggggtctactgctcaactctcaggagtcgcccaggacggccacagcaactgtcctaggcctgcggtctccatcctgcgtcggaccctttggctcagaagaaggagaaggggcggggcagggaagctaattatacactttgaaactccctcaccttgtcacccacaaaggaaggaaccaagggagaggaagacaattttacctcagaccaaagagaatagaaaaataggtcaagtggccatgtatttctcctccccgcccacaacttaaagcttccagagagaaaggagaacgcaaatgggcttccaaaggggaaagggggaggggagggataaattaaggctttgggattgagataaacagaccactatataaaaaataggcaaacagcaaggacctgctgtacagcccaggg

SEQ ID NO: 56459 - DNA, 1481 bp, Bovine  19866881390717
acagcaacaggacctagggagggaaggggatctgagaggggggcacccccaggcttttcagaattgaaactttctcagaagctagcatgattcctaactgattcctccttgtaggagtcgctcaaataactgatggatggagggagaagcatatttaattacattctcatatccacagtgtattgccttttaaaatctttttttgggggaagaaatttgtgctcacttgataagaaaccaattgtaccttgattttttttttttttttttgggcatttttattaatcagcattctgtgaaacttctatgttaaatcctgtattcacttaactattgaggttcagtgtttcttcctgacttgtagctgctttttatatatgaaggccatggatgccctgttttatttgtggcaatctttctcctctaatttgctgtgcacttcactttgattattattactattaaatctacaggacatcttaataataatgtagccaaatactcaaatacttaaaaaagtgggagagaagaaagaagggggagaggagggagggaggaataaaagagaaagaaaaggagagagggtagagggagagtggaccgaaagaggaggagaaagtagacgataaagagaaggaggcggaaagtctggctggagtcagaactacattccgcctcctgactttcatggtacatctctaccagctcagaggtgttcagaaactctggagagttctagctcttctgacacaacctgacctcattgtgttcccaggagtggcccactttagcccttaaattggaaatgggccaccacgctggcctcctgacaaaccaagtcctcgctgtgtggtcggggggccgttcaaggactcctccaggtctgctgagagggggccaggaggcaggggcacagaggaagaccctgacttctcattatgtgggtgaggtgggtctgagtccttctgagactcctttttaggaatgatccactgtgattgggcacagacaaggtctgtaaaaagaattgtttctggattaggagctgattagtttttttgaccccaaacatctacgacttaaggaatgtactgctaagtttgctaccagggccctaagagctaatggctactcagtccttagatgccatcttggaattgccacccagaatgtgggcaccatcttggaatggctactaagcctttgggtgccatcttggaatgactgcccagaactcaactgccactttgacatggttgcccagaatctaggcaccatcttggaatggcttctcagcccctggggtgctattttagaatggctgcccacaactcgggtgccatcttggagtggcctgatgagacatgacctttcagagtgtcctaggactgccaggagaagttcaagacacatgaggggagtcatcaggtctagagttacagggcctgcaggcatagggtgggggtccaaattctcatgca

SEQ ID NO: 56460 - DNA, 1245 bp, Bovine  19866881398454
cttctcttgttgcggagcatgaactctagagcgtgcgggcttcagtagttgtggtgcacgggcttggttgcctcatggcacatgggatcttcccagaacagggatcggacccgtgtcccctgcattggcaggtggatccttaaccattggactccagggaagtcgctgagttgttttttagaaaaaatgatcttgaaagaattatggtcacagaagctgcagagatccctgtggaccccccacctaagttaccccactcgttacaatttatgtatctgtagtacagtatctaactcgaaaactgacaattggtcttatatgggggtatctacttctgtgtctttttataacatgggtagatttgggaaaccaccatcaaactcagaatgcagaactgtcctgtccccgcaaagatctccctggtgctacccttttaaagtctcccttaccctcctcccttccagcgttcctgacccctggccatcatgaatctgttccccatttccctaacactgtcatttcgagaatgttctgtggatggactcatacttgacgtgaccttttgacactggcattttccattccgcctacattcatttaacagctctccgcagctagtggtgatggcctgggacagcgcagttctagagagttctgctggatttagttcccatgggcaagggtgacatgacaccctcgccagcatggttgtcaagatcacaatgggaaataaatagagcgcttagcgacgagcacttgagaaatggaagccattcttagcattcttctgattcttccgtggccctcgggccccaggtccagtggctcctggaaaactatgagacggccgagggcgtgagcctgccgcggagcaccctgtactgccactacctgctgcactgccaggaacagaagctggagcccgtcaacgccgcgtccttcggcaagctcatccgctctgtcttcatgggccctgcgtacccgcaggctgggcaccaggtggggccacctgcccctgacagcccccagtggctgtaaggcccgccctcaccctaagtttcaaggtcctctgctccccttgtcccttcactcctctccagccccaatggcctcgtctcagttcctctgacgctcacatgctcctgccccagggccttggcactctgtgcctttctccgtctgctgactcaaatatcccctggccctcctaactaaaacttcagctttcccctacctccttggcat

SEQ ID NO: 56461 - DNA, 1257 bp, Bovine  19866881416201
ccccaccctcctccctgagctgcctcctggcctttttcagcccctattgctcctccgctcccaggtgtccccgcagagagcctcctctgtcccccgccccaggaggtggtccctgtgccactctcctccattttctgttctgcatctttgttatgtcttgagcacgtggaacaatggacagcagttgctccacgaacaagtgtttgttgaatgaaggaaggaaggaacattttgcgtctcagtgaatctttctgaccattcaaagcaccgtctccatacaacacgtgcttgccttccgggttagctgattcataacagcctcttcgaacttcacagctccttgaattgtcagcaactgatagcaattcaaaaccactgttacctgctccttccggctcatccagccgaggtcccattgacaagcctcctcccctgtggaaaaaccaattggcctccattcggacatgtatttactcgaatagtctgaatagtctgatatgtccttaagagggcctgtttttctggactcttgaacctcgtggaacatctgcctggttcccataggagttcaatagaaaaaaaaaaatcttaatacgtgtcctttatttgtcagtgagagccatgattacacccgcttttgaaaattatcttttaaactttctatgtggaatctcaaaagggcgagggctgggactctctgggctctgggtgccatctggcgcgtccctcagccacaagggggcgcctcagaccctgggccaagcccatgaggcagggcaggtggaggactcttgtaaactggctccctttgtccctctgatgccagccccttggagggggaccccaggggtgaggaagggcattcaggtgtgacagatatggaatctggactgtcaacccatctgttttgtcttccccgaccctccaccctgtcactgtcccgagtgactcctctccttcctagcacgtgggtcctgcccgcaaatccccttttagtgtcgcagccgagaaccccaaacttgggcaaatccccatacctcctgttcttttcagtccctctctgagcctgtttccgcacctgttaaatggagaccctaacacctcgtcctgagtgtggagaattcgctgaaccttaaggctgtgacagctgcctttgtgtcctgggtggggtgggaagcccagttccagccactcagcctgtcttctttccctgcttcccccaccctcgccactctgcccaccccctacccctccccg

SEQ ID NO: 56462 - DNA, 785 bp, Bovine  19866881459960
gcctcgctgctccttgaacgtcatggggattgctggccttggtggggtctcagaggagaaagctgcacaggtccctatggtctcccttgctctccaggagctgagacggaggggctggagcccagcctgtggctcagctcaagggctcccccagctgctgagcacgtagggtggaaacagaccgcggggaccctggcccgtccttgacggtggcctctgctcctgccaggcagccccctgcccctgagctgagaggccgcacgctagcgcggaccaggcggggaggccggctgctcacccccgtcgggctttggccagctcggcttcttggcgccccgtcctggggaaggtagactgtgcaggaggtccaggtgtgcggccaggcaggcttggctggatcttgggaatccctgatccttgctcggtcacgccctttttcctgggagtctttggaattgcagcttgaaataaaagtgaatataattatcctaattaaccagatgatcgctggaagttttgcaataatctgctgtctattgccttttatgctgctgaatttacgtagactctccctcttacccttttttgaaagtttgaaaacttcagggttatgtatataaaaactcttccaacatgctgaagggggctgggtgtgagagaggatagctcactgctgaagattttcctgtttccctggcaaagaagatagagacttcacctcttaaccattgaaatcaggtcccatagaacagggtttcctaatcatgatgctgttgactttgggg

SEQ ID NO: 56463 - DNA, 1654 bp, Bovine  19866881893905
gagctgctactgaacaggtggccctaagccctgggcggggcgccaggagctggggagcccgggccaacaggccttactgtgggggtcgaacctaacctagggggcagggacgtgggctcacctgggagtggagagccggttcccccggggggtggggccctccctcgaacgtgtgacaagggtgggatgggatacctcggcggggccatgggatacagactcacctggcgggcggtggcggcgcctcgacccgggggtcccgggggtcccttcttcttgtgcatcttccaggctggctactcggaccactggacccctggcctggccttgccctgcctcctaccccggggcctatggcagcgcacacgcccttcctgagtcccacgccccttgtcggtgcccggagaccgccgaccccacgccctcggcccccaggtggctgccccacttccgccttggccctcgggcgccgcggtaccaggagctcagcccctggacttgccgggcccacaacacagaaactacaattcccggcaggcagtgcgcgagtgcgcaggcgcgttgccggcgatgggcaggtgccggcaggttgcgcgggaaagaggcggagcgtgcgcaagtggagaagtgaggttccgccatagcgcgtgcgcggcagggcctcgtagtgcgcgggaaagaggcggagcgattgcaggtgtgaggggtggtggcggcctctgggttcacggtgtggccggttcacctgcgagctctggtctttcctggtttaggcagttctcactttcggcgcccagagtagggttaggatgggcctggtcaccagaagccaggtccgcagcactcgggcctcagaactcgaggtgcccggcctccgtgagggacaactttgcctttaattgtttaaaaaaaaaacaaaaccttacagaaataaccgaattatcccccagcaggtccaggtagaccttcccagttcctggtaacgacagagggacctcaacaccttctctggcccaggtcagtttgggcttgcctggctcctaggctggaaggaatggacctgtggtggcgactccggcctcccccaaggccccaggcatcctccaaagggccttcccatcccttgaaaggtccccaagtgtcccctctaaagccttcagattaccttgcaggccccatgtgtcacctcgaaaatcctggggtgtccctggaagggtcccaagtaccccagcctggaggaagggagcttcacataggctgccccatcttagagactagaggggccataccccggcccaggtgctctcagatcctgggcagaaaataggcagttccctctctgcagcgtggagaagtttaaattctcaccccgagatagcctaaggtagctatgattcccatcctctgccctactggagctctgttgacccctggggcagccagataggtctaggtggaggagaggtggcctcagccaaggccactgggtcctgtaacccagagataggaactgcttgtaatgatgaggtttgctccttgttttcagatttctctagggagagagaaaatgagtaagaggaagaagcttcggacctcaggtatttggatgatcaaattgacacatttttattgctgcttctgctgttaggaggaa

SEQ ID NO: 56464 - DNA, 1359 bp, Bovine  19866880285006
tattttataccttaagaaaaaaaaaattagtccccaaaataacctaatgtgatgttattatccgcatttttatagaaaagaaaggcaggatcagtaagaataagtaatttattatggtcatatatctaatgcatagcatatatgagaaatgtagactctaaagtcagaagacctggatttgaatcctgactccacctgtttttactcaggcaaattagttactaatctgtgctcaactttctcattgataggataggaatgttggtcctatcaacctcaaaaagtgttctgaagattaaataaattaataaatattaaagtttctcaaacaattactggcatatagtacacgcttaatgctgctgccactgctaaatcgctttagtcgtgtctgactgtgtgcgaccgcatagacggcagcccatcaggctcccccatccctgggattctccaggcaagaacactggagtgggttgccatttcctcctccaatgcatgaaagtgaaaagtgaaagggaagccgctcagtcgtgtccaactcttagcgaccccatggactgcagcccaccaggctcctcccacccatgggattttccaggcaagagtactggagtggggtgccattgccttctccaacactctcaataacaactagctattattattggtcacatggattcagtattgtttttaattactttgaaaacacaaaacaagttacagtgattgctcctggggcttatggtacaatttgtaaactttgaaaaaaattcatttgaaaataaacatttataaatgtatggcatgacatttgtaatgaataaacaataatttctaacctggctaaaatctaggcctctactactgattatcagaaaagtttagaaaagcattattgatttcttttatagaataggcaagaattccacagtgacccaaggcaccaaataatcacaaaccattgccctgcaatggccagagctgactcgctttttattagacattgatctttggctttttctgaatgcaccagtgagttcaaggtctggatatgtatgactcatgcaagctctgtgccattaaactgctttataggagaaaatgattcttcatgcattgagtctgacacttgacattctttttataatttgaaaattggcagctcagagtatatttaaatggaaaacactaccatttgtaaccatcatccagttgatagaaacaatgtttttgccattgaaatgactgtacaaaacccactgtgacctgaaactatcattgacctagacaaatattaatcttttatatataatgttgttagcacatattgtttttataacattttttatactcagcata

SEQ ID NO: 56465 - DNA, 1645 bp, Bovine  19866880436365
ttcagataatagatgccttattctttaggcactttggtattatttaaagatgaatttaatggtcaaggcaaacaaaatatgcatttatctagcatatgatttcctctcacagattaatgctatttaggcattcatctatcttaacccctgtattactataagtcagatttataactcatagtacctttaaacccataaacctctcttattactgccacttcattgtcttatcccttgtcctatgccctatttcacaaagggccaaaaattgttaggaatgaagtacttcaaatcaatgtttccaatttcataaaggcacctgcttcaagtcttttacattccctttttttgttaagtcaaccatgatattttatttaattgacacttttgtacagtcagtgacattcttaaaaatacttttattgtttgatgcatatttttgacttttttttttttttttttttgcattttaagtcgtaactcttgacttcttttcttttcatggagtcattggaacaggaacgaaactcacagtatttgatatattggttcactggagatttaattttctatgggtctctgcttttacatttggttaaggtttgagagctcaaagtattattcctgacaacatgctaaatgtttgaggtgtggatgtataatgaaataaagcaataaatgtcttgtgcccatatttattttgtagatgaatctgctttgaaaaatctggcacccagtagtccaaaatcatttaactggtaaccttttattttttaaaagagtgtggcatctctatagccaggtataagccccagcagaatcttggtgacagaaggagaattgttccttatcctctcatgctataaggtcatttcaaggaatctggctctcaagagccacacttctaagaaagctaggcagtaccaatgagcagaaacaggatctgatattttctacaatatctgtttttattttcaagaagaagtgttcctcaagaattaaggaaatactgtggcatgtggctttaagatgtgatgaataggaagcaagagttcatgccctggccttagacttattcatatgcagtttttgatgatatcctgacatcccggagagatgtgggtaaacttgatgtaaccaatgaaaggaatctctgttcaatgaaggttaacttaagaaccacggaaatgtggagaatcaaggaatgtattcaccttgcaccataggtacttcagaattactgtaaaagtgtaataggagagccatattgtgaagggaatgagcaaatcaaggaaggtaggggaatttcagagttctctttatttccaaaaccctatactttcctggcccaaatctttagcatctgttaaagtggatagatttccaaaaagtgatttaagcctgtccaactctcaaagcaggtgtttgaatattttataagacttctgtttgcctggcattcaatagggaggaaggaaagaaagaataaaggaagaaagagagggagggaaggaggaaggaaggagggaatgaagaaagggtaaactaaggaataaaaacggtcttcagtgagatcctctaatgaaagaattaactccagacaccatgtttcgctgtgttttgctgtggacccaccatcttttat

SEQ ID NO: 56466 - DNA, 2307 bp, Bovine  19866880458540
acaccatgtttcgctatagttttgctgtggacccaccatctttttatctctgtcttctcttgatcatttttcctatcaaggtaaagttttccaaaaaagaaaaataacaaaaaacaatggtggtttcctttaagcatttccttttatctgctcctacattgaggatacataagggatattaagttcatctttagagcacttttattttttttacttgctcttccctacagaactgatgttagaaattaggggaattataacatcttctagttatgttatatgatcagtttggcaaaactcgactttaatcgttctgaactcaattattcatatctataccatttttatccattcatacctactcagactgcttcatattcagaatcatatcttgctttcctgtgttcattttctcattaggagttttatctatatattcaacaaaaatgtcttgagggtttaaagttttattgtgtgaccacacttgtccagctcctgggactacagcaatgagccagatacccctgctgtgggatactgaatagattgatccagtggaacagagtgattcaagacgtaaatattcaattgctatgaaatcttttcaataactcacctaaatcattatacagttaatcacatgtgctgtgctttctttagagcaccataagtaggcaattcagagaaataatcctaagccattttcctgaaatagaaaaaaaaaaaaagatttttataaacttctaaactttgcttctaatacaaatgaattttagtctgtttgcgtttcatttttcaactaagtaaaatgtctgcaatgttaaatgggccatttttcagttgtcagcctgttagttttttcaaatttgaattctgttctcagcattcatttttcatatcatttaatattacagagtgcacccttttaaactgtgtgccctacatacaaaagcacctagcataaataatacctgaaaccaggagtgatgctaaattctttaactaacaggactgaaccctatgaaagcaatatgtaagccaatgaaaacaagtttgttttggctactactgaattaaagaaacaactttttaaagtataaacattatccatatcatcagcagtagaaacagataacaatttttaaattaatgtgtccccttggcctgaattttactggattaagtggcatttaagaaaaaaaagatacatttagtatccctttaacactatttcacaatggctaacagattttaaactatcaagcaacccaaagaaaaagcattacaactatgaaggactcaaaagcaatttggtgaaatgttatttgaagtctctgaggctgctaaaggccaaacattggaagtttattttccatttttactgactgtagttttatccagaccaatggtcctttcatttcatgatattttctcaatccattgctctaagttctcagctctcaccacaatcaggatgagatggggaaaagcagagctacagctatcaccatgagatcctatcagccgtggcctcgattgacaccactactttccaagctgctataaatgtgttaagctccctttgacctttttcctcatctcagtgagctacaaaggagaaactttcactaaactgttatttttctcctaagatccataacttgtaaagccttgaaactgagatacccttatcataagagaatacagtcacagcctagtgcctccagaagcttccaggagattccaagttgctgcttctacatgtttttggagtaacactgctctccttagcaattatttcttaccagaaattacattctggctagtgaattttatctaacataaattcatggctccactgcctttatctctctgaatacggagtatattgaaagtaattggggtgaggagagtttctttcttttcttcttttatgttcagttttttttttactatactttgttgtactttgtggatatactacctcatattgtttcatttatgttgtctctctaggtgaactatacattcctcaaaccagtcaagaggtttcttagtttgtaaaacctccttccatgctcaatactgaacaaaatgtggtaaatgtcagctacctaaaataggcagttaattaattaatgaccacttgcttcaaaggaagtccaatttataatcattatctataaatttaatttcccaaatactaagataatttttaataaatccattaatactttcaaggtaaaaatttagtttacatccttctgtggtatataatctacttatggtgtcatacataacatacgt

SEQ ID NO: 56467 - DNA, 1383 bp, Bovine  19866880554408
tgattgtgataattaagatagagtaatgataaaaatgtattaatagacactgtcagaaacaatgtgctaaacatctaatatcacgtgtaatctgccagtatttctgttgtagtgtctaaccgtatgatggtggtcacaggtttctttaatcttgtaatgagtactggagtaatcctctggctattttttgtgtttgatgaagcattttttatctttttggttttgctgcattttgttttcagcctttgatgttcattctctctcatgaaattttatgtctttttattaaaattggcttgtaaaaagaagacccttaagatacactctgtacctgtccatcagtggactcagaaagtttctaaatgataattgttgattcggcatattagcttgttggcattatctgtatggcagagatgtcagtatattgtttccaagctcgacttctacatgcagggagtaacagagcatgtccctgcttcttttatattccacaggagagcaaccaagtggcataatcaattcttccagcctttgtattttacctgatgtttactttgcacattgctttaagatgtgcccttatttcacctcttaaaaatctatttgcctttttttttttttatcttgtgggaaaataagattatcttaccgcaaggtcatggtgcatttcattagacactcataatattttttcttttctcagaatccacagagcagtgaaaaactgccctaattactaaaagattgtcaggttctggatatacaaagaataaccttctcttatcaggtactgagggaattggaactgtgcagatggctttgacacagtagctttactggtcagtgacatatattattgtaaataagagagatcaagcataagcttgacatcttttgtgccatgaatattgaaataaagaaagcatagatttggtctttaatgcatgaaaataactctgtgttccttaagagaattcaaaggcaaaaaattctcagtttttcacaaatgaccaagctggttttttcctttgcgttctctgtgtatgttttcaagttacttaattaagaagatcaggataccatttctggatgttaaaggtgacattaagaaactctaagcctttgctttacattgctgtgttttagcagccaataccagtcacctggaggaatggccactgttgggccatggcttctttggtagtgacatttgctcaataaattttttcatggtaataatttaaaaaagtaaaaatggtgtgaagaagtaaatgtcatgttcccacaatgcaatataaatgaaattcataaaggctcagtgactcacaagacaggttaattaaagcttccatgtggcacatggaagttagcacaaaattt

SEQ ID NO: 56468 - DNA, 1373 bp, Bovine  19866880624475
aggaatttcaagatgcatgtaaggcaattacttctttcaagcaaagtcaagccccagaccttactgaactgaaattcacaaatgcatcttaaattcacagaccccagttcctattgttttgcttaagggacacagctgagttcttccaatccattgtattcaggtttccagtttatattcagactgagaaaacctgagataagaaggggtgacaattcactcatgtaaatcatagccctgaaagtaacattttcaacaaagtattaagacactgctttaagacattattgaaaaggcaaaacacttggggttttaaggttaacagtaccatctaaatagagtttggtactgaatatgagagcttttgcttgaaaggaattaatggctctgaaatatgatctacatgaaggctaagtgacaacttaaacaaagaaggctgctgtgcttaatttgagtgaattccatgaatgtgttgtggtattaggaacttgtttacaataataacccgaatgcatctgctccatccctgtgcagttacctagactacattgtttgacaccacctttctgcattaacctccatctgctgggctatgtctgtcatttctctcactataacataatgtgacagagtcttcatttacctaaacttatcttggcaacttgtacttcattaaaaagaatcctgaaagcatcagttaaagctttcttagctggccatgcatagccaggcttcataaatcattctttcactttccattttgcagcttctggaaaggtaacattattgaattcagatcactgggaaagagcagtactaaaatgtttattgaccggcttttaggcaccaagctctgctctaaaccagacattaaccaaagcttttgaagttaaaaaaaaaacttaactcactgatatggtttatactgtgctataaatacctcttataacagtcgctttagcaagctagtattaacttgtttgaagaaaaaatatttttggtccttggttccccattccttaccacctaaacttcttaactagatttgtgctaatttaaggagatattgatattatcatttacctatcaccaccaactctaaacaatctcagtgggtagtaaaaacacaccaagtctcccttgggttccttccttagtaaattttgcactctacagaagtttgtgcatcaggtttctttgactgagaatcagctaccagaacctcctcaacaacacagtctaggtcaaattggccttttgctaaaaggcaccaagaacacgttccttatccaataggcttgcatgcatggtttgtgggaagcattatcgtatttatgctggcaaatttacggtctttctttgacagcattgga

SEQ ID NO: 56469 - DNA, 1729 bp, Bovine  19866880747293
ttctacacttgtttccttggttatgtttctatggattacttttgatttgcccagaaataataaaatgaatacccttgatcctaggttcctcagctggataaacaacaagttgctcttattttgattaaggagagccattatatgtttttcctcaagctattagtctgctaggaacatgtaatttataagccctatcaaaactttccctttaatgaaatgaataggaaattaatgcagtcaggcagaaagttcttttcactaatagtatttagcactttctgctttgaaatatcagagagtagttttcatgtattggttatttaaggatggaaaattcagtcccactgatatcaccttgaatgggtttacatacaagtatggtatattcttttccttgggcaagctaagtgctgtaacatgcaaacataaattttccagctgtttaatattaatagctattacaaatagaactgaatgactattagcaaataaactcccaggataatggtgtttcctatatgttaatgattacttgtagaatttgggtaatttgtgttagagatgaaacaccttattcatggacattaaaagagatgtgattttaattctgcttgacacagagggacaaattaacctacttagtttagttcttggaaagtgctttgtgtttgaaatactgaaatagatgacagtacaattaaattttacttcttaaaggtatacatgtagctagttctctattctatatgtgcctgtgtcctttaaaagaactagcttgaggcaaatttcattggttcaggattgttagaaccagatcattatatagggcttttattgtcagcaaccattctataaatacagtgtttacatataattttactattttagacaagtcgaaaggagtttgctttctatctatctatctatctagtctaactatccccagttgcaacatactttttgttcctggttatcttaatgaactctttcatagctgaatggttatttccagccaatcaaatattaatatcaatacatactaaagattatagaaatctcaatcactgttgttaaattaataacttctttgactcttgttaatacatacatatatatctgaaataaaataattttgaggagcaatagcttctaaaacaccaacctataacttgtacaaatattaaaaaggaaaatcagaatcctaggaacatgattaaaaccaaggactcttttgtctattacaattcccttttcaggattcagctttgaggcagttttgaatttcacatctgataccgcctttgaaaatattctcacagtgatgaatgacctcttccacataaaacagtttttgaaatatatgtatgtttaacaaagctcctttcctcttatgttggaaatgttgaaatgtttatttcttgattggaagcctgtggtgatgcagccatagataaacgttacagtaagaggaaataggaaatctatttccttcagttaaaaaaaaaagtaaaaaaaaaaaaaaaaaaaaaaaacctacaaatgaatcctactcctctgttgacaaattagggttcctaaaaactggtcttttttttttttttttaattcaaaaactggggttcattaggttgaagtataatcatattttcaaattcttaccatgggggggtattcaaacttcatcactaattttgacacaagttaatgagcatttatgcttgatcttcta

SEQ ID NO: 56470 - DNA, 1386 bp, Bovine  19866880777158
ccaaaaagaaaatctaatatattatcccttccctctagggtcactataatcaaattcctcaggtaaatcagacttgcattttgactgagtcattcagactactttgattttgaatgtcaaagctttctgggtcaaaccagaatacagctcatatttccaagctctgtattagaaatcatgctgtgaggggtaaatatgttgtcttaactacatgaaaatatagggcaacattgttcaaaaagtctcacagggaatcctaggaagagataataaatattcagagtcaaagggaaaaggattttatatcatacacacacatgcattatataagaagtttttctatcaccttaaaatgatggtaaatctatttatttatctatcaatctattgatagattacctttctttctctgtctccctgactttaaaaatcccatttacattcagaacacatacacaatgcttattttttaatgaatatcagatatttgtgcaaaatccttactgcacaaatatttctaaaaattttatattgttttatattcaatggtttgcattgaatcaagtcacatcaggctcctgtaattaagatattttgcaatgaagcaaaataactttttacactcaaattttaaattaaagagggtacttccatttctaggtgaacaatttaattttgtgacacagtttcagagtatgtaataattattcactgaaatcaatatcttgagacatttctgattcattaagcattcttgaaataatgtacataataggaatcccagtagctaaaagaagagtaaatggaaagacactgatactatttgacagtagtgtatagctaaagaaagagcagaatgctcagtttcagggggcacatacagaaaagcccaaatgagtgattaccacataatatatgccaaaccttttgtagagaaactacagcatgtcaaaagctaatcgaatatattaaaagtaactaaaatacaattcacaaagtagtagcaattatatttctaagaaacaagcgcaacaatattttcaaatactaagacaaaaagcaatctacaactctatgtctactctctcttcactccccatataacctcactaaaggaactcctcaagaatgtgcttcaagaggaagaaaattattacaggaggagagtatgatatttttaaaggactagtaagtaaagaaattgctctttgaaaatgttctgtttcacaaaatgagtttgtcttctttcctcatttgcttataatgctataaagacctcaaggaatggaacatcacttattaaataacttatatatgctaaaattaatttttccagccctgctctatgtctttatctattctatgggcttacttaccacagtaatt

SEQ ID NO: 56471 - DNA, 1547 bp, Bovine  19866880792563
tctccacagttatcatgtttcattaattcactgtacattttcccttcaaggcatttatcacaattgcaattaaacaattttctgtatcattctttactgtttatcccttacattaccatgaggcagaaaccacaggatcagcattatttacacagaaaccttagataagagaaaagggccagacaacagcagattcagtaaatacttaccaaatgagtaactatatgaacacacaattagttttttatatttctccaattctaataacatgctcttttaaatgtatcccatttcttgtttctgaagcaaataattcttacatatagacaatattgctcaaacaacttcttgaggcatttctcaatttgtatggaaagactaagaggactatttctatacagatgaaagaaagaagtcaactactctaagaagtaacatgggaaattaagaatagttcaagcatcaagaatatctctcttatgcaatatatatttaccggtatacatggaattactttactgattgtaatccaattcctgattatagtacattcgtggaacatgctcctttaataaatgtcttctcaataagttatcacaagggtcttagcgtattacggtttctattttacagatggacaaacaatatcagaatattaaggatctgcccaaatttaaatagctggtaagtgacaatgacacaatgaaaccgcatagcctatattctgattgaaatcccaatgacagaatttgaagaggattccatagtttgcccttagaataaggtatttgtgcttagcctcttaggttttcctccgtgagccaaagttttagttagctgaataaaatggataattaaaaacatcaaaaattttcctttatgatagagaaagaaataaatgtgaaccatgaataatgcagttaagtaactctaatcatctactatgcataaccaatagtcaacagatgttcaacatagatctaagggaaaaaacaccttacatgtctaacaggattttacaaaaacagtgcatctccaaaaacagcaatttttaccaaaaaatagtaaatttcaccaaattttatacttttggaggtcacattttcctattctagggccatatggtggcttcaggcaagtaaaactgggcagtttgagtgtatatagatgcaaaatgtaaccaaacaatttttaaatgatgtggcactatgcatgtatacatatattaattctagaagtgtatacatgtgtgcacaaattaaatgtttattataacttataaactgtgcctacacaggatgacttaaataacaaattaagtaactctaactgtgattttggtctggatcacctatgcagaaaaatcttcattatttttttctcaataccatagtaataatgtttatctattcaatcctagcccttaaaaattattgctatagtcaatcactgtatttggattagaataaaatgtaattcaaataagaaatatttgatacttgaataaagtgtgatatctcaaactgaccccaaaatctagctcctca

SEQ ID NO: 56472 - DNA, 1406 bp, Bovine  19866880818631
acacaactgagcaattaagcacagcacagcacacatatgagaaaagaattttaaaaagaatgaatatgtgtgtttgtataactgaatcattttgctgtacatttgaaactaacacaacattgtaaatcaactagtcaattatactccaaagaaaaaaaagttgtagaactgaagatctttaatgttgtcatatgtctaagatcacatattaaatggtggaaatgatatgtgaaaaatatagttggttaatattaaataatgcatattatagcaataagaattttcccatacttaaaaaaaaatcaccgtaaccctctgatgtgtatactactcttatccctagtttacaggaaagaaatcaagtctggaagcaatgaagtaactctacagagtcacacagagtctctttatcctcttctacctgcctccagagactgtgctcgtttctgtagcctgtatgagaaaaagcaatctaacatcaaattcatttatttggatacatccagacagcaaggagatcacaccagtcaatcctaaaggaaatcaactctgaatattcattggaaggactgatgctgaaactgaagctccaaaactctggccacctgatgcaaagagtcaactcattagaaaagaccttgatgctgggaaagatctcaggtaggagaagggggcgacagaggatgagatgattgggtgctattactgactcaatggacatgagtttgagcaaactctggaagatagtcaaggacagagaagtctggcgtgatgcaatccatggagttgcaaagagtcggacacagctgctgaacagcaacaacaacaaagaccgaattacaacagtctgtgagattactagtttgtgaccctgtgtgtcagtgtgcctgtgcacacataaggtataagagagaaagcaagtaaaaaggaatatgaattttaacttgcataaaaatgtctaaagctaaccattaggatgattaaatcagactgctcatagatttggggaaggaacagatgtatatataaggatacagagagccatatttctaagacattggagaacaattttgccaactggctgtgatatagattaggcaccctctggagaagcctttttagcccagtgagtttgttatcctttttatgttacctacacaggcagactactaatttggaaataagattgcactgtgagagttaaaactatcatgatcaatacaaaatagatcacaagaaagaaaattgcaaaattaaagagactcctgatccccaggtcaaagacttaagtggtgatattaacataacccagaaaagaatatgtcagtgtaaggagggattaatgtggaatgaaaaaaggcaaaatgtctgagaaactgaagctggtggagccaagctaagagcat

SEQ ID NO: 56473 - DNA, 1031 bp, Bovine  19866880834480
ctaaagttatagcgaaataagcttcacccattttattccttatctgaattgctgatcccattgtgaacttttaatacatagatggagcccctaccttaatttattctaatccttataaagtaattaacattctagctatgactcagattctgcatgtctatatgtatgaaataaagcataattaacactattattagattcatcatctgcattttactgagtgaccttattgcttcaataaaaccttactgaaatgtcagcataaccacaaatataaatggaaaagaaaattaccattcagtagttatctctcaataatcttctgctaaagggaaaattttgtttctgaatacatgtatccattagtcatattgattaaaagaacagctgagaggcagtctcagatgtttttaatttgtgctaaaggataaacaacaaaacactttaaaagataaaatattctataaatataaaatgctttaaatcatacaactattgaattattatatacccagacaggtatcatttcacatgctagatcaattatagaatatactttatttttgtaattattatttatttcctgtttttcccactaaataaaaggatccttatggcagtgactaggtttatctaaatccccaatgcttagttaatgggatagtgtaggaacttaatacatagctgccaaatgaacaaataaataggcaggtagtaacacaaaaataagagtgaatgcacacattgctacctttctaaggttataatattggcaaataaaagttttcaatgactacccaaaacagtgtgtgtgtgtattttttttttttttgcatgaaacaaggaaaaacatgactttagtaatatttaactggtgccgtgctaagtagcttcaggagtgtctgtctctttgtgaccctttggaccatgccctgcccggggtcctctgtccatggtattctccaggcaagaatactggagtgggttgctgtgccctcctccaggggatcttcccgacccagggatagaac

SEQ ID NO: 56474 - DNA, 2272 bp, Bovine  19866880837642
caaagctatgctaatggagtgattaattgcttttataacacagacttttgtattcgtcagtatcatgtttctgcatttgcagttttcatattactttcgttgcagtttcatatttatttctataaacacatatttcgagtagtgggtggaaaataaggcagccagatggctcaatgaactaaatgaaagaactgaaattcaaagaaacaatttccttgttttgtctctcttctgtataacctgagatataggacagtgaccttacttttgttggttcctatcaagtagctcttgtaagtacagggtttctccatgaaatcaatatagctacttaataaatactacagataaaaaattgtgtccaatctacatgttttcaagagagtaagtatgagtcataggtctacatgtaggtgacacagcaccattactaacatcagttaaacgcctctatttatgtgattccaaattttccattcagcttagagaaaaaattatgtaaacctgcacaggtgcagaagcagttggtagcaccaggttgcaaattagcaggccagaaaggccaggaccaagaaagtataaacatggatttctcagaagcagtttccctccaggagtaatgagaacagacaaagaaagaggcagtttccatggcagattgcatggaaagttataaaggactatcgttacccttgagacaatagaacacctttaaagttcaaggctagaactttaatcctacttcagtgcacaattgtaggcaaatctgttatattttctggggttctgtttcttctgcaaaatatttaaaagaatacataatttagaagactggtgtgaggttttaatgagataacatacttgatgcaactgggacataaattcacagaatatcaactcaatgagtatatttaagtgccagatactctgttggataatggaacacagtactggacatctccctccccttattctttagtagaataattcctgggttatagctgggcttatagcctccaggaagaaagacagtctttctttgtctcttgctcttcctgctaataagagtatgaacgtgacagctggagctcatgtagccatataggacctttaggtgtattatatgtaccaagaattgcaaagcagcgagatgaaaagagccttgtttccttatgtctagaacccacactcctgtatggtctggagacttgtataagagcctgagctgatggctaataaggcattttccacaacccagtagaagaccctttgaatacaatcatttcagaatgggacctctgagattttgaaatttttacaagaggccaatctcaggcaccacaaaacctaactctctgctgcctcccttcggtctctgagtgaatggactttagcagctcatcccacaaaatgcaattgaagattgtctatccaatgtgatactagtatagagtatgcaaggactggtggcatttgaagctgtgaaaagtagttttgggtccaactgtgaaattctgtgtattcttttaagaggttaaataaataggcagaaattagtatgttggtaggtggtatagtcagaatgtcttattaactgagcacagatgctgtgaaatgggatgggactagagtagcaggaagcaaattaaaaggtggttatggtgcctccttggtgccactcttaatggttctctttcccttgatgttataagggtcacccatcaaaagcaacttctagaaaaataaataatatgaaaagcaataatcgactttgtagatagttattatagctaattccaggaaggaaaacagtacctaaaaaatcctagacaggttgttccactgaaacataaaaacataccaacaaacacaaaccagtaatatttcactatggaaagagtaatgataaaagtaactagaatactacagattaaaggagaaagcaatcaccaaacatttatctaatagcttgtattgaaagtttcaaaagagacacagtaggacatggttgagatactgatttgctcaaatcttaggcaatcaacttcatgattcagttgacagattcctgagcccaatcatcaaaggaatccatgatttcattcagaaaagaacaaattgctcacacacacacaaaatctttctgaaccttcattttatattctaaggatctagaaagagaaagaatattatcactaattttctcaaagatttctaaaatgatgttggaggtaggtacctatatattataaataaaacagcaacaacaaaa

SEQ ID NO: 56475 - DNA, 1518 bp, Bovine  19866880844287
attccacaacaattcatcaggttgctcacttcaacttgcaaacgccccctctaagtaccctcagctgccgtcctgagaacttcttccaatttcaagaaacctacaataagtttatgattctcaatggggattcctttgtaaaatagacagacagacgagctttagaaatatgaataagaaaaccagagcaaaacctcggggatggtaggcatctggctagaagagaaggatttatgagcgtggctacttagctaggcagcaggaaaatttactccccgaagtagctatggctaattcacaaagcctaactaatcacttagcgccccacccgggccacaccagcctgcgccgggcgcccgcctccacctcccacgccctcgcccccagctcctccgcagatctgcgggaatgctgtcgctaacctccggagtgtctgagcatctcccagggagttgaggctctcgccgcacctcctctgctttccaaatttggaaagagtgtaaccgagatgataggatgcctggattacctctgaacgctgcggaagcttcctccacccccaccctcatcccagagaaaagctgagctgccagcgcggagccaccgaccaccacaaaactgggcggcaagacccaggggggcgctcggctaggccaggaggtggagggggggtcagaggacccgagagagaccccggagaggggagtcttggctttctcctttcagtctcttccactccgcttggaagggctcggaaggcagggatttgcctccatcacctcaaactccgagcgcaagaagaaaacggcggtcagcctctgtgcctcccctccgcccttacccacccttaactcctggctgagctcctctagatcccgggtgtgcccaggaccccggcacttattttttaaagctcagacgcattaaaatgtcagttataaagtggccgggttacccccggggagtttcggatttagtttgaacgaccagtccgtttcctcagagctgagaggttttaagtttctccgtcgccgacaagcagggcgacccggagagggtacgagagcggggaggcgtgcacaccccgggcctgtcgggggctgggacgccgtcctggtgccccgcgaatctctactgcgcccagggcagccgccgaggggcaccggcgtcggagggtccccggccgcaagggacatgttatcttagctgagtgcccttggatctggcgtcttcagagactcactgaagatcccgcaaacccagacgtggcacagcgcggggagcctctgcgcatcagagagcatccgcggcaggccacgccgccgcccgcaccgcacccagagttcctccaaacctcggtgtgcgcaatgtacgacgacgtgtgagtgtaggacagaaagtgcaaaagacaccccaggctcccacatgcccaggggtagatgcgtgtccacactccgtgcgtccctggccccgctgtgcccatctcggatgacagattaaaaataatcatgaccaaag

SEQ ID NO: 56476 - DNA, 848 bp, Bovine  19866880878850
aatattaatagaattgaataaaatagcccctgttagggttattacaatgcatcactgcatccatagagtctttaatcagaagtatttgtttatctgactgggaatcttggcctatcctcagtagtgtgcaggggaacagagtatgtgcttggcataattacatgaacttaaaaaactactttattcctctgagaaatttagtggggaccttcttgttatcattagtgatcatggtgtctattcaaggaatgaataagctggtaatagtttttattcagggtcaagcagggggagaattaaaacaattaatgaaaattaatcatatgaaaaattaatgctcgtcatagaggtttcctaggagcaagttgtacttgctgcttttgtttttgaatattctgaatgtgatagaaagaaagtgaagagaaagggcccagcatgtaagttttcatacagccataggatttttaatatatgccatcgttttgttctctctgcagctctccaaattaagtgtcattattacttcctctgtatagactgggagatggagcaaagaaggaatggctaaagcaagcacccagaatgggtctctgattcatattccatgttctcacatattctcttcaattatggatttttcacagggtccctggagtttcttaagtcagttttcagagcacagagtataaagacacctcctaatttaaaattagattttgcctttatcttcaggaaagcagagacatttgacctcagctacgagtgaacagagcaggaggtagaaccctaggatgactcccagatggagctgcttattagagtacagagcaggctgggtaagacaaaga

SEQ ID NO: 56477 - DNA, 807 bp, Bovine  19866880949023
tgcagttttgtttcctcaaacttccgagcgctactcctattgggatgctcatgtgatattcggctcaggaagttctcttccagcagaagatgtaatcctttcatatagaaagtatcatcattacaatagggtttattgaaggatttctctgaattagtaaaggtattccctggaggcagcaggagacatctcactattgaccccagaccaccactttatgtatatctaaatatgatgtttctgagatttaaaaatcaacaaatgtatagttctgaaacagtggattgatatttttatcttacatgcatgatgcctatagtcatccttgggattccatttttaagaatcctattctcagccacttccctcatagttattgttgttgtttcgttttatatcttgaagaggaaatactcctaagcatgcatgtgagtacaaacacacatataagtatagcagagtcatccgctggcagccattatctgtaaaacgaattaaagaaaatagcgtattaacatgcacatcatgaagcaaactccattctctctagagtattctctcattgagatacaaggactttatctttggcacagtgggtctgaactaattgagatgtcattaaaaaaagaaatcagttaaaaaggttagaggagaggggatggttggttgtgaaattgtcaatttgcaagaatacatttttttagtaaaaatacagccctcagttgcagatctaatcagtggcagaaacgggggagggatgaggggagagataacagagaaaaataatgtcttaaagagaaaaaaaaa

SEQ ID NO: 56478 - DNA, 1530 bp, Bovine  19866880952559
cattaacaggttggcattcacttagattctcattataatgcattgtctgttagagtcacttgacataactcttctctcaatgcaataaattcagtttatttttctaatattggttggctgccatcaggacacaaaccttctgaaagttactgaaaaacaaaagtgaaatgaaataaaaacttcagaaaatgtattaagaaacactaatagaatagaaaccatattatttacatgtttttattttatttctgctctttttacttgaagaatatgcaaaaccacctagctgactctttaaaaaagcataaaatagcatgcctgcccctggagaaggaaatggcaacccactccagtattcttgcccagagaatcccagggacgggggagcctggtgggctgccgtctatggggtcgcagagtcggacacgactgaagtgacttagcagcagcagcagcccctactcctctaaattctttattatagtttgacactgaacactgcttccatcctatccaatttcattttgcttatattcagtggaaatttttcactagtatccttagtgggcaggaggagaaggggatgacagaggatgagatggctggatggcatcactgactcaatggatgtgaatctgagtgaactccgagagttggtgatggacagggaggcctggcgtgctgcgattcatggggtggcaaagaatcggacacgaatgagcgactgaactgaactgaactgatccttaacataacaaagcaatttgaattccaaacctatggcattttcttctctttcacctcagcccctaattatcacttcatatcaacctaacaggaacttcaaattaatgtcattaatcaatcaccactatctaatatcactaagaatcctgaaattttatttcctacaggttttataatatacaattttatcttaaatccattcgcaagattaatggtaaagccaagacttctgttcttgaaatcccactgaaaatttctatacaataataaacattcagtgtatgataatataagaagccactccccagttgtcagatcctggaaaaggttcaccattctttcttctacagtagggtctacactgtgcctttctacactagggcttcttcccctttcttactgcaaacacaattcctctctgagcacatttccccactattcagttctaaatatagcacaaaataaactgaaaactttaagcatttctttaaccttctgtctttaaattcccagttgttccttttgggcacctctcacttcctcctgaccccatgtctgtggcaaatatatataaaggacgtatacatatgttccatgaatcacatctttgtggacctaacttctttaatagtaccctcaaaaaaaataacaggaatcataatcatgaccagagtgctgaataatttaggagtatttcattactgatttcatctattatttgaagatgagtagaaaaaagtttttaatgggagaaaaacgcacattaattcatgtctacacaca

SEQ ID NO: 56479 - DNA, 2377 bp, Bovine  19866880981346
cctacacgcatcgcatctaggtgtcctttagcatattgtttaatctctttttctccccttgtagagaattcctaaaacagtcaactttctcctattcgtctttgtagcccagagtacagcatagcccatagtgggtggaaggagattagttaaggaatatttgaggttagaagaataaggctaaaattagtctagtcactaccacattaattagaagtctaaattaaatgtgaatataatttttatattttaattttaagataatttatatgttgtagtgatgtaggattaggatctactaacttgtttacagggatgtttgaaatgctttaaaaaaaaagggtaagcatggagccaatattataatacatgatatcattgaatctttaaataagtgagattaaagttctgtttaaaaaagcatgaatttccctccttgtcaaataacaagagactggatttctaaaagggaattgaatgcctggaacagttgaattaatttctccaggatgctctcttcacctaaaacagtggttaagacttcctttgatctattccataggatatttaaaataaagaacgttatacatatgaaaagctttgagctttttttagaaaggtcttctaattttcaattctatgctctttccacatctgtgacatttgagttatcattttaatttgtatttccttgagggcactggcccatgggtggtcttgacaggaaatctgttttctgcatggtttctccttggttttggtgaagttgctgagctgggggccatccccatactgctgggcgccatccccatactgctgggcatctgtctcagtgaaggaggacttttacttctcttggaggtgggggcggtgtgccagctgtctttcagtgaagaatgactttctctgttgaaccacttccccagatgctggcttgccctctgcctctctcagtgccatagtggcggccattgctggtgtctaagcatggcggctactcccaatggttctcatagactaatttccctagacaagagctgttcacctccttgaggaccggttcaccatcctgctcctccaggttgactgaggccttaatccttgccttcctgctactgccaggaggaggagttgggaactatgcaagagaactttgcttctgcagtctgtctgcctgttttccacttatttcagcagcttgttaacattgcctgagtcctgtctaatcaaaaaccaaaggaatttcaaaaggctctcatcctgcaggtcttgttgatattgttcttgttctttttctgttgatttccaccccttgatcctccaaactcagtgtattcctggaatccagagttatccccagtacttctgctgaggactggccattccttcccagaaagcactggatcactcagactgggtgttggtctatgcttgaattggaactagcagataacccacaaaattactggcacttcaatggctcttggaacttgtttccatatagaattgatgagaagtgctgatggcaggctatcaagagtttgtcctcaagcctccatctcttctccataaataaatattggcattaaaaaaatggaaaactcctgcttacatctcatttcttttcagtgtgtctggagagattgcctttgatagcatcccactgtcatgctgcatcactaactactttagaaactgtccacttgctccatatgtcccttaataatctaactgaaacctcactggtgtttgcaacaatgataactcaccaggaacttcacattcccataaacatgatccacttcttttctgcagttttttttccctttcttacactagcttgaacaagtcctacaagactctgtcacatgttctttattttactcaatataagcaaggctatttcaaattcttgttactttaaagaatatgtcagaaggaaatttttttatttttaattataatcatgaataaaaagcaagcttaaagattatcattggaggaatctctgctttcttaacaaaaggagttatggtcacatatacagagacggtacacatggatggaagatatgtttccttttacataggaaaactattttctaacttctcttgaccttctcccctggcagtgcttttagaaaaattagtgagatatggtctggaaaccacggtgtgctccttagagaggtactgtgcaaatttaagaaaacaatataaggagtccctatattgagtcaggaaattatttgaaggactgggaaacttaactttaacttatagtgattgaagtatttattgaaattttgaaagaagtgaagtccaattctaaatgagaatcatcactggtgtcagtagccttggcaagcatcatcaaa

SEQ ID NO: 56480 - DNA, 2784 bp, Bovine  19866881001938
ttttggaacgttggtctgaagagaagttgtggtggtggtttagtcgctcagttgtgtctgactctttgtgacaccatggactatagaatgccaggcttccctgttcttcaccatctcccagagcttgctcaagctcctgtccattgattcagtgatgccatccaaccatctcgttgtctgtcatccccttctcctgccttccatctttccaagcatcagggtcttttctaatgagttggctcttcacatcaggtggctaaagtattggagcttcagcttcagcatcaatcctttcaatgaatattcaaggttaatttccttgtagagaagttagggcaagccatgtgagttgatgggaagagagattagagaaagaagagcagccagaaatgtctgatgattactttagttcaggacttaagcaactacaaaaggatttgcaacaggagaagcattgataataagaaaaatgctcacttaacaaatgtttattgaacatgggataaagagtaaaaaataggaaaaaatggcttctatcaaaaatcttacattctagagaagttcaagaaacaggcttaatgactttttaacactcattactaaagggactgttttgaatatcaaatgcttatgatcatatgtttatatgtggtcacaggaagggatctgtaccttcacattagtgtaacgaagttgcttttcttatttgtgctattacactaaattcaacttatagacatgaaaccactgttgtgttcttgaatggaaaacatgaaagcaatttacctttgctaagtttatgtataatacagctactggttatctatattcttataaatgctcatagctttgggggtttaaaaatatatctagctcttagaatatgtgaaaattccaggtgtatctttgataactagtcattctaaagcagactttcttaatagaatataatggatatgacagttatatctcatagaataatatttcttggacttgtgtttctatgttcttactttctatcttactcaggcatattgtcagataaagctagagattagaaaaattatttaaatcatcttcataattaactacccttacttataagaaacaatttatttagaagttcatccagacattctgtcttcccctcttctttaatttttttttgaatgagtagaaattgtggtacattctctaaatttccatgaatcagacttaagaaaatataatttttagaactactaagcttctacattgttggtatttgtgatttcaaatataaaatgcatacatttgtgaaacacacccacatatatataatcacacacatatatatgtgctgtgcatatagctgaattcttattccacaatagagctgagtttgcaaacagtattttctgtaattaaaataaacacacacatgcacagacacacttatgaaccaatctgaaattagagcttcaaattgtaaaatgctataaaatccttaattgcagaggcattaatgggaacttctatggtataatgctaggaaactatccactgaataatgcctttccagagagagttgctgactacacacctgcttcaggaaatgaatgcagaaatcgtgcttcacctcatatcttcaaccttaaaactgctgagaatcctcactcttctcattttgatatatctttcatatgagtgacaagtatatacatgagataataaaatgtgttaaaactgtctgcttggcagtgtttttgctgatgtattaattcatttcatttcatgtgctatatcaccatcatgtctaaccagattttatgagagggctcactgaagtgaaaatcaagccaacgaatcgtttaatatgagctaatgaaaaccagatataaaaagctttagtaactgttttggagccttaattgtcaagtgaatgtaaattctgagcactactaagtaaaggaaaggactgtaatgaagaaattgggatcactttgtgataattggtttaattgaagagtcatgtagcaatgatgtccgggatgaagccacggaaataggaaggagtaaatattctctccaaagtaggaaatgccttttttgtttattttctaagaattgagagaaaattattgttctcatatcatggtcatttaaacaaattcaatttcttcagaaaaatttgtgagaatatacattttttgatatataaagcaacaaaatatttcaaaacttctgtagcatgtttatagtattgctataataaaatttgtgggttcccatgtgatcaactattagaaagtacagcgaggcactatgagtaaggtggctataaacacaactcatttgttattccaggatgttgaaaaaatattttattatattaagccaggcattatctataataattgattcaaagaagggcaaaaagtagatgataaaaccacggggtagaagagttttagggaatagaaattggtcagatgccaaagtatcatccaatagaaaatttactaaatacaaataaaaaattacaactttatgatgaacatatatgtagataagacccttaagtagatcatcaagtttagcatcattgctaataattgtgcttcttgatatggtacagtaaagaaatatgtaacatcacttcagtaatatttgtccggaaatatataagatcacttagataatgtttgtactgaatttaatcacaaggaagcaagcagaaaattccagaaagtagagcactctacaaacaacggtcagaatgctaaaacaaaacccacctcccgc

SEQ ID NO: 56481 - DNA, 865 bp, Bovine  19866881043827
ccagtactcttgcttggaaaatcccatggatagaggagcctggtaggctgaagtccatggggttgctaagagtcagacacgactgagtgacttccctttcacttttcactttcatgcattggaaaaagaaatggcaacccactccagtgttcttgcctggagaatcccagggatgggggagcctggtgggctgccgtctatgtggtcacacagagtcggatatgactgaagtgacttagcaacagcaacagcaattttcttcatatctgtattttcaaataaaatttatatttatcttgctcttttcatttgaagtctgttaggactcttttctccctattcttggtaaaatatgtatttgtgaagggataagagatatattacatattttattatttttatgcttgacttttacatattttatgagattttattaagttctattatttttatatttaattaatataacttttctcaatgtaattaactttcaaatgctacttgcttccatatttagctttacaaaaaagaattgaattccatggaattatacccttgctcatctctgtgattatgaattacagatgtaataagagctacacctattaattttataaagtttatttatatgtttccttaaacaagatatgattattgaattttattggagtaaatttactgcagtaagtttacattacattctttatttacattatatcttttgcaaacaattagtgggtgaatcatggcctaagaacacttctacaattaattatgcagcaataaaatcctcaatatgtattatcatttaaaattgtaatttgctagatgatacaaatgagatgtagcaatgagtaacataatt

SEQ ID NO: 56482 - DNA, 1510 bp, Bovine  19866881043896
tcttggctcctttggcagtccttcaatgtcatcctaatctttgcagtgaaagtttcatgtagtggccaaattttcaattaaatacaattttactcaaatttaaatcacacacaccatttatcacagctgctcaatctgatgactaaataatttttatgttccactccagagctgcctcattttggtgataaattaagagatccttataaagtagcctatctacctgttactagctgttgtgaggtgtgcgtatgatcctcaggggctggtgttgagagtgagagaagaagcaagggaatggagggaaaccaatccactgcttaggcaggtcagcaaaagaataaatggcccattatctaattctcagattttcaggttaaaggattcaattttgtcagaatggctcaaattcaagatggagaaagacagtgattcaacaacaacaaaacaattataatacaaacagcaaggtatgcattttgtcacttattttcatttcaaaactagtacataaggtgggtaataacattacatgtatttgccaaaaataaacaaaaactaggttaaccaaatgcctaagaaactggtgagtaaaccagaatgcaaatctatgaatttaccatgagagctataactagcaaagtgaccctagagtattttctttgtactgaaaaatctacaagggaaataaaattaattagagcaaggagagttagttgaatgaacctaatagttaatgacatcaagctatgatagcttgaggcattgtgaaaagtactggggaaatgctgacaaattatccttctcagagtccattttcttcacactttgagtaactatgctatcttcaggaatgttaatgtcattgatccatatatttttctttcataataattctattacagttatgcagtcctgagcctacttcccaatcaccttgattgggtagacctttctcaaatctcctcaagataaactgagagaccatttcacccaatgagctacttcattggatgactaacctactatattatttattgattcttattaatatggtttggggggattaatacttccctatttttttaaaggcctctcgcttatacccatctacttattaaataagaaaccagaataaagtagtaagtattcaagaccttaatccaggatgaaaaataatttgcaattctattcaatctactgataaatatttgagggtttactttatacaaggcaatgtgttgagtggtgtttcacttactgcattctataaacattcttttctaatactagatgtgctgaacaatggaaactaggattacattaaaaaaagtaaaataaaaaatttgattaggacagcagagacctctagtaaactctgatttttttaataaactttaaattttagatggtttcatctttacagaaatgtttcagagatagtacagagagatcctatatgctcttcattcagatacccctattattaatatcttatactactacaaaa

SEQ ID NO: 56483 - DNA, 2243 bp, Bovine  19866881062278
tcgcgaagagtcggacaggactgagtgactgaactgaactgaactgaactgacggctaactttcctttgctttttttgttaaaaccttaaatactttataaaatgttgccaatctcaagaatttacataattcagtaaactgaattgcatttatatgcaccatgttagtaaatttcctcaaatgaacatgattaacatttttcacacagccaagacagacccaccatttttaaagagactgtttctgaataattcgaaacatctctccacatttctgaaggaaatgtcaaatgagtttgctctggagttcatcgataattacagcatatgatcagataggtgtaatgagaaatctagggacacttttttgatattgacctattttaaaaatgatttccctctattctcatttaagaacttaaaagaaatcctccatccagaagctggcttccttggggatatttaaaaaggaggaaattacctagcttatatttagctttattcctgtagaagcaagtttttcctccctcagtctctcttttgtttttattctttcagatcaaaacttcaaagaaaaggactgatggatcagccattcatttattggagttgaatttttgcttgcctctagattttctactctgatgtttctttgatttccattctatctgcatcttttatgtctttagtttatgcgtgtgaagaaaattatagtgtaggctttgctcaaaaaattatatttcatcatattccaaaatcttagaaaatttaaaacacttttccaagtctgaaaatgactttagacagaagcctctagcacagaacttaataaatatgtccttattgtattctaaataattgaactttacagaagctaggcttcagaacagacaggaatcaatttcaccagagatatctcaaactaaacatcaaggtaatgcacagttccatgtatctcttgcctgacttagacaaatactcattaaaaaataacaaagtaaagacaggttgggcaggaggcaatgcagtagtaaccaaattctttggatttgttagtagatagacctgaccctgtttctgccacttctacctacaaaacttttgtcaagttaataataatatctttttttcttctgtaaaatgagaataataggcctatgttttgtatgtttatactgatattatatatgataatttgtatagtgtagcagtccttaactcataaaaattaacaaaatattagatgttatttttgttactagaagttgtttgctgaaactgtgtgtgaccttgttggccccccttcaggaccactgtaaagtcagtagctgctgccatggtcctcaaaaatgtccaccaggcaggcactagatcccaacacatgaattaaaaaggactgagaaaaaatgatattacttttatcatatcttcactgagccagtagatcacaaagtacccaacactgttattctccaaactatgattcaaagggcaatgtcatatcttatgtacatctatggtatacatgatatacatcattgattggttttagaaaaggcagaggaaccagagatcaaattgccaacatccaatggatcatcaaaaaagcaagagagttccagaaaaaacatctatttctgctttattgactatgccaaagcctttgactgtgtggatcacaataaattgtggaaaattctgaaaaagatgggaataccaaaccacctgtcctgcttcttgagaaacctatatgcaggtcaggaagcaacagtcagaattggacatggaacaacaaactggttccaaataggaaaaggagaatgtcaaggctgtatactgtcaccctgcttatttatattatatgcagagtacatcatgagaaacgctgggctggaagaagcacaagctggaatcaagattgccgggagaaatatcaataacctcagatatgcagatgataccacgattatggcagaaagcgaagaggaataaaaagcctcttgatgatagtgaaagagaagagtgaaaaagttggcttaaagctcaacattcagaaaactaagatcatggcaactggtcccatcacttcatggcaaatagatgaggaaacagtggaaacagtgtcagactttatttttttgggctcccaaatcactgcagatggtgattgtagccatgaaattaaaagatgcttatccttggaaggaaagttatgaccaacctagatagcatattaaaaagca

SEQ ID NO: 56484 - DNA, 1700 bp, Bovine  19866881105751
gggtcgcaaagagtcggacacgactgagcaacttcttttcactttccctttctgcattggagaaggaaatggcaacccactccagtgttcttgcctggagaatcccatggacggagaagcctggtgggctgccgtctatggggtcccacagagtcggacacgactgaagtgacttagtagtagtatgacacacaggacacaattagtcagcattcagtaaaaatgtacagccaaggtctgacaagaggctaaatcaagtttgctttagtctcaaggaatttagataagaagacaaaatatctgcctaagaaacagcattaatttcagtgttttactagttaaatgcaaagtacatcaagataggttcacaacatacttgtcagaggtgcctgattcaagcagtgattagagaactagacacatcaaggtgagaaaagggagctttgttctgaatgactcactaaaatctgaatccagggcctgagctagtaaagttccaagttattacttttaattattttcaatcaagcttgggagggcaccaagcaaaataagtttaagaagtacctctgcctctaagaacactatttttcactatcagaaactgagcacatgatatctagtcacctccctgcaggacaagccagctgtggtttgggacacattctctaatgtgtaaactttgttcaaaaatgctggtaaatatcttgtaaaaggctagctacacaggcagtgctattggggctgaaattctccctaaaattcaaagatgattcattctcattgtctacagactatcaataacatatttgtaaaaacaacaacaacaataaaaactttaaaataacatgaaaatacaaagaagtaatagtgcctgagtgatacttattttttttaataagttaagagttttgcctctcttttttcctgattacaaactcaggaagagagggagaaaaaggagtaaaaagatacctgcaagttgttttgttcaaaaatgagagaatataacaaaaatcagccaatataactattaagagcagaaataatagatctaacaagttcctatgtatccagaacaccaataaaatgaagatacttgttttcacaagtgcctccaaaataatgcatgaaaaaatgaaacatccttttatactttaaaacgtatgacaaatggtgattaaattcaccctgagagcatgtcagtttgaaaagaggattataaatgcatatgccacagggtgctctcttttgcaaggtaggtgtgtgggtgggttgtgggggggaagactatccatttaaatactgtgttaactctggcacatttagaatgagaacaaaactagatgaaaattggaataacattggccttctggaaggttagggaggctgtccctgcagcaggttggcaatttgtcacatcagctctttcatgaactatcaacctcattaccgtggttcactgcacagttggcccttgggattccaatactaatagcatgtagagggtgatgagacttgtggtctcaactacttcattattgattcacttaaaaacataccacctacatattcgaataaaataggtaatacattaggagagggagaaacatgaaaaaaaatccaaaatcaatggaagtaaggggaacaaaaaccaagaaagggatgtaggcagtaatagcaccatgaaagcaagtctt

SEQ ID NO: 56485 - DNA, 1356 bp, Bovine  19866881116154
aaaatgagttgaccagtaaattaataatatttgtaaaatgcccatcacatatcagctaaacaaaaaatagtaggtaaaaggaaaaagaaataagctctgaaaatagtagaacacagatgggaggaggctgcatcttctggggctttgctttgtagacataatacaaaactcttcattctgagaactgggcatccagactctttgtgagtactggaactattacattataaaagagaagaggaaaagaatagagtctcattttgtgacacagctagaactcatagtaattttgtgacttttgaattgtaaagtgagtaagaatgttatttacttcaagaaacattcccactgtaccatggttgaatgaatctagaattcttaataaaagtactgtgctgtgagaagtatctcttgatgctgctgactgtacatttcctgtgttactttttattctttaacttcacatttcctgtctcccactttatacataatgaataaaaatttttctatattttatattattgtgcacattatcatttcttattaacatttttattttcacaaaaaaagaacaaaatgccattttccatgaagaaggggaagattaagaatttttaagccttcaaaatctttatggctattagaattattactctaccctataaaaaaaaaaaaggcattttaagggaaagagtagtttacccttctcctgattacacagtgaaaacagttacctaaagaaatatgttaatataattagactgatgactttgagctgatgcagttttcacagtattttttcaaaaatctgtattaccaaccgccccccccccaccgccacccccacgccttgactcagatttgagactctaatggagtctagtctatagagtctagtctaatagactagaaatgccacttttaaaaggtatgcagtgtttgaaaagaggtttagtatatcagaaataggaagaaggacattgatttgataattagtaaaaatatacactaaaatgcaagttattttcaataaagaaatgcttgttaacccatattgaaatatggggcttccctgatgatttagtggtaaaaatttcacaagccaatggagaattcaatctgtcaaaatttaagagagattccaggttaagatactataactcttctatatgtctagaatcttaggaagtaaggagaggactagaaatgtaaattatacaggatttcacagatcaagaaaaataattttcattgctattaggaaaaggaaaacactgctgtttttgagtgacatcaaaaaagcaatgaaggtttagaaatcacggaagacaattctacaacttaaaggcctagaga

SEQ ID NO: 56486 - DNA, 2099 bp, Bovine  19866881140818
aaagttagaaaaagaatggttaatggaagttagagagatttaagtcaatgtagggaagaaattttaagcacttatttcatggatgagccttatcaccagaggcaagggaacccactgtcagtgtttctatgggcactgggactaagggttttgaaagattactggctaaatatgagtttttagagtgagaaagcacctgaaatggtggtatgcactgtagcttccctagagaatcagtttaatttaagtgaagttcattcttcagtacatctttgaactgtattatctttaagaactaagtgaaacaccaagtagaacatagccagaccctgttctggtgacagtgatttaaacaaacaaaaagaggcaataaggatgtggatatgacacaaaatctctgatgtcatgtgtaagtgctaccttgattccctggctttagggataaaaagaaaactaatgtatgaaaattaagaagagatataatttgattcaagataaactggatttatcgggaaattggaacaattaggtccagttcacttaactatttttatcagtactacagaaataagctttcatttctaaaacttctatgagatcattatcaaaatgtctatacatcatctccaagtctcagggcagcaggacaaaacatatgacataattaaatggcttgtgcttcttggaaaaataagcatttatagcgtgtttaataaacagcttttaaagctctttgaaaagatccagcagaatgcctatcctgcacaaagtaaatactcccatgaagttgcacatagattagaactagatgagtgcttgtgatagctcaaactcctgttccaggaattcaagaggtgttaagtctattgtctcacttatttctttaaatagccctatgaggaagagtctgaaattttctcactggtgagaaacggaggtcaaggaactgtccgaggtaagttaagtgctagacacaagaattgaactcagctctgtctgatgaccccaaccacatgcttgctgctgctgctgctgctaagtcgcgtcagtcatgtccgactctgtgcgaccccacagacggcagcccaacaggctcctccgtccctgggattctccaggcaagaatactggagtgggttgccatttccttctccaatgcatgaaagtgaaaagtgaaagtgaagtcactcagtcgtgtccaactcttagcaaccccatggacgtagcctaccaggctcctccatccatgggattctccaggcaagaatactggagtgggttgccatttccttctccaatgcatgaaagtgaaaagtgaaagtgaagtcactcagtcatgtccaactcttagcaaccccatggactgtagcctaccaggctcctccatccatgggattctccaggcgagagtactggagtggggtgccattacccactcttaagctctgggctgatgaatctccaggctccacttgctccagaatattttatttttatatatttcagaatggggccccttaggacctttgtagtctaagaaactacagctctaatggcacacagaaaaatgaattgtatatgaaaacgattttgccaggtggagatttaatacatctttttgcataaattagcactgtaagtactgaatgtgcattaagttcaatcatttgttttaaatgtgcctccctctactacagagctctttgacctatattttcattattaataactccagtgtttgacatcatgcacttgttgcatcatgattttcacatttagtgagcaggaaaaatcatcctcatgatgaccattttgtaattctccttgaaaatgtttccttgggatgtagttcagattgattaaaactaatttagaggaaaaatgaggtaaacatcttcagttcctaagctaattagcatcatataaagtctgtgtaattgacataacatttcatagttgtatttcatcattcaaacgctgattattcatgaaggaatgccaaagcaggaaggaaatgggggtaggcacaaagggaatgagtaggtgaaggagcacacagggcctggagtgtatgtctctggcattatgccaaatccaaa

SEQ ID NO: 56487 - DNA, 981 bp, Bovine  19866881216915
atcactgacttgatggacatgagtctgggtgaactctgggagttggtgatggacagggaggcctggtgtgctgtgattcatggcgtcgcaaagagtcggacatgactgagcgactgaactgaactgaaagaggttgaagtactttcctaagtcctagagctaaagcctagcccaacctggttaagagggtaggcagtctgacctagaatcttcttaaacgcctctgagaacttagaatggaatgtcatgtagatgataataggtcatggcagttttttggaatttttaagactgatatggtattttgagaatgaagaacattcagacagaatccctctaatgggacagtggtgcaaagagttccagaacagtgattaaattagtctgactgaatagggtcttaataaaggagaatcaaatttacacaaagattgggaaaaaaaactcatcaatgttatcctacagactttattttttaccttgaaaataatggggaacaatagaggaaatggaacacaatgcaacagtaaccattcagagcagaccctccaggtttctttcagcaatgatgttagaaaaggagattaagatattccaacctaaggaattatcaaggaaaaaagaccccaagaaatcagaagcctcaaaaattaaggatgagaaaaaatgtgtgatatacagaaacaagctgctctggacgtggtgaatgctttctccttaagcccattgtagccccaaactgggcagtcagcaacaaagccactggttcaaaagttctgatgcaatttccatctacagaattctctcaaactgagctggaaatattttttatcagaatcctcataagatttcaggtagcctccagctagaaacacttttcataccgtttgaaaacttccatcccttttatgcctaaaatatggctttgccttatcttaaaacacacgtacatgcaagcttgcatacacactccacatgaca

SEQ ID NO: 56488 - DNA, 1842 bp, Bovine  19866881327409
cagtttacatggacattgttattgcagcatttgtccctttcctgacaaattgcattatgcctctgccctctgaaccattagcaggtccagagggaatcaggtggtgaggaggaggggccactctcacacttgtcaaccccaaggcagagccaggctgaaccgatctccctttgattctttacgctggtgactggagtgggggctgtttgtgtgggacacatatttgaatgctgtcatttgcctctgagcagaaggccatcatgtcttcagtgttcagagtgaatgcagtacccccagatttgttcaataattgccctgatttctgcctggggcttgactttcttctgtctaaatgttgcgtcccctaacacgctcccccattactaacaaagtgcctctttcatttgctctgggcggtagatgcatcagctgcctgggcttcagttctgaggctgattcagcgtcacagacttccctttgtgagcatcttgcctctcttccctcctctctcccctccttcaggaactgaaaaaaataataggggatttcagttaacgctcaaacatctgttgacttctaaaggagtggagtttgtaatgaatgcacaaaagtaagagaagacaggtagccccttgaatgaaatctgttcctcttctcttttttgttttaagctgtgacctactgtgggaggccacgtatttgggagtggtacccaggacagtataacccagtggattacgatggtttttatgcacttgcagatgattgttgagaggtgcgttagtacctcttccagtgtggtctatggtatgatggtcccaacttctctgagaatctgtttgtcatctgcaaagtagaggcaataatacccatcttacagaccaggaacaaatacaacatgaatgtaaggtactaatatgatgtgctaagcaccccaaaattatcaacaggcaccatttccattgccatggttgtttttctacttatgctatgaccatgcactctctatgaggatagagttaggagtcagctgggagaactgggggcagggggaaacttctctatgaagtccacagagcttggtgaagcccatcctttgccccaggtcagttctggttgcacacaacaacctctgcccttgtgggccacaccctctagtggcaggtgagggatagatcatagtgggctccagaacaagtcagtaggtaaagggaatgcttgttaatgtgatgagtgctatgaagagtaaagggggctgaactagtgcatggagtgggtgcttgagttagtttggctggtcaaggagagcctctctgagagcatggtgtaaagctccccaacttgatacatatagaatccctttcaacatcaaaaaacttgacaacctccacaaaataagtagtggtactttcaattttcatcagtttgagagtacacagaaataaaaggctattgggaattcagttaaaaaaaaaaaaaaacccttatacacaaatgtgtattttatttattagtgcaagatccatgtatatttgaaaagtacatatatgtataggaaatgttattggttcttctgaagataatgccaggtttgcatttggacctgaggatttgaacactaaaattattctgagtcacttaggttacttgaggccagtatgttggaatcactgacagaatgaaaaaaagatttgggtggagaagataggagaactgagccctatttcctgctttttcaaaaactatgatgcatgtgtggtaagtcacttcagttgtgtccgactctttgcaaccctatggactgtagccctccaggctcctctgtccatgagattctccagg

SEQ ID NO: 56489 - DNA, 1822 bp, Bovine  19866881374728
attcctgcccttacccgtaattttatttggccaaatattaaataaccaataaagttatttacttaaaattccagagagcaaatataaattttaataaagggcttgatctatttctccatcagtatttctcaatggggacaactatttgcattttgagagggacaatatttcaatgtgcaaaactgacctcacattgtggatcatttagcatcctggtccttgagcaccaaagacagcagtgcccaatgcatcattcactagtacaataaaaaatgtttctacatgttcttaaatattttctaagtggtgacatctcccccaccagcaccccacctgctacaggtgatgtataaaaattctcagagtataagactccactatgcattctgaaatatgagtacaaattgaattactggagaaaagtattttccaagcagaggaaacatgttggatgcccctgaggcccagagaagcacgggcataccaaagaactcaaagaacacctctgagcttggagttgagacagtgtgggaagtgctgcaaagaaggctggtgatacatgcagggacccatgactttactaggtcttcattagtgtaaaatacctgcagtggtttaataagggaatggcatgttgagatttttgttttaaagtcattttattatataattttcatttacaataagttcattttaaggtaatactcactgtttgcactaacttgaacacctttctaattcacaggacttttttcttttgtgtatatatatgactttttgtttatttgttgaagggattttcttttgcacaaagaataagagcattttatataaaatgaaaacaaagcatcttttaattacccatgccttcattcctcattgattttcacaccatgttctcgcacatgagatgtaaataaatccaattgttccataacacatactgcataagaacctcgttctcatactgcttagtttttaaagcttcaggagagaaagcttgatagatcggctgatgaatgtgttcagttaattaacaaacagagtgaagggaggtttccttttgttaaggacatctcttccttattgggagcttgaaatcggggtcagtggctttcctccggtgtccctgcttacttcctgcttaatgactttatttgatctagcctaacctcctctccctctcctggagaaggaaatggcaacccactccagtattcttgcctggagaatccccatgggcaggaggagcctggtaggctacagtccgtggggtcgcaaagtagtcagacacgactgagcgacttcacttcttcacttcttcaaagaaataaagacgtgtcttaatggtgcatttctacaatcccaccctacagacaggtcctttaaagtgctgacaacaagggaaaaaagaaatcatagaagacatgctgctgctgctgctaagtcacttcagtcgtgtctgactctgtgtgaccccatagacgacagcccaccaggctccaccgtccctgggattctccaggcaagaacaccggagtggattgccatttccttctccaatgcatgaaagtgaaaaatgataggtgaagtccgctcagtcgtgtctgactcttagtgaccccatggactgcagcccaccaggctcctgcatccatgggattttccaggcaagaatgctggagtagattgccattgccttttccatagaagacataattactcccaaaactatgatgaaatagactgaacattttacatttcttcatttaatggtgaaaaatccattttatttttaagacaagagaaggtgattaaccaa

SEQ ID NO: 56490 - DNA, 1122 bp, Bovine  19866881387103
atgcctcttcgcacaagacttagcagatgaagttaaaacagaagcccccatgtgcaatgagatatttcagacacataactggcaaggtatctaaatttggaatatatgaaatattactacaaataaataataaaagtaaaacaaaaaatgagtttagaatatgaacaagaaatgcactgaagagaaaatccaaattgccgataaacacagaaaaataagccccgtattactagaagcaaggaataatgtatttatataaagcaacaaagaaataatatgcatattcattaaatggtctaagttgtaaacttggacaaaacttaacaaaaccaagttttgctagagctactaaaagtgagaatctcataattgctttctgttagcctgcaatattacatagtgacaagtgagtataaataaacacaattaaaataaatattttaagaaatagtatttgatagtaactacatttgttacaatcatgtattcaatcataaaagactgagtacattctagagtccatagtagattgtcctaaatctaagatgattggggtttaacagtgagaaaatgagtatagaggaagctttaaaatgtagatcacacaacaggcactcaacgaagagtagatttaatactgtttcttgaggttttgagctagtagttacaagggttatatgccattgtacacaagtcagtttatgatcattcataaaaaatacagtaagtgtgtaaattctagagatagactgatttatatttccaatcctgtcctgtaggatgatttcttttaagaaatggagttcttgcagcttagaatataatttccaaagacagctcgaaatgtggattcacaatgtgttatatctcaaataacttttatagaaatgaaatgatgtgctctggggaaaagtatgttagccaactcaaaaagcatcttaagtgatccagatgatattaagggcacaaatattaaataagaactgtgaaatgatagagtgaaataaaataacaatactatgataatgtattacttaatataatgttatagtgtatgcgtgcatgcatggtttagtcgctcagtcatgtccgactctttgtgacctcatggacttcagcccg

SEQ ID NO: 56491 - DNA, 817 bp, Bovine  19866881401163
atattccactgtatgaatatatgaccttttaattatccaatctcctgttgataaatgtttgtgctatttccatatttttgtattatacacagtgatatcaggtcatttaagtcacagtctatacacaaaagtgttcttgtggattggtcagtgtcatctatcagtgttctttcaattaatgtgaaactgtaagttactgaatcatagttctctttgctctttaaatccttctgtatcgatcatctatttagcaacctttctctgtataaaacagtatttaagaaaaacttgaccaccactttgcaaagaattatggattttcaatttgtttcttattaaaagcagttttatttcaatgaaaatgactaatgaagacacagttatattgctattattgagttaaccagacacaaaatatactttctatgtattgaataactttaaccttcatgaaggaccatattttaatcaacaatagagatattcaaaggctcctaaatgtttgtctctgcatgactagagcttcaccaaaggatcacagtgtctaatgaataaatccattaagaacttgtcaataacatagagaaatgttttatttgctttactaacagcttatcggaaaaaaatatctttcaatatctttgactaagctaatgggctagcatctgatatataaaacaagttatataatcattacaacagataattctgagtttagagtcatatatttaaacccattttggactttgctgttagtcatatcatttgtatacatgattattctgatggctaatcgtttaattaggaaatagataac

SEQ ID NO: 56492 - DNA, 1811 bp, Bovine  19866881411616
cactgagtttgaactagagttaagtccttaataacttgggttccccatttgaaagaaaaaaattaaatatgaaagaaatactaaaatacattaagcatgggatatatttcattttcagtcattgacattctctcaaaatactcatgtaacattttgtattacatcttttcagtttcttcagaaaaataaagtggtgaaaagagaggcaattatgttaaaacaaagcaagagtgtttaggggagagttctacattcgttatttaagaaactatatttttatagccatatttacatctagtagttttacatcttccaaactcacaaatttgttagctgcagctctattatccaacatgaaaagaccctcacacattcttgaaaagtgtgattatcatgatatctaaacatcatcgttctagacattacagtttatacaagatttgttataactcataaactcatagatttttttctttctccagaaggaaagtatgttaaaatacatgaaatttaaaatattttattactttattagtgtttcttccttaagtaaataatgtttttcttatctatgtaccctatcgacatatataataaaacagctgctctgtattgagtacatatgataagcactggctagatgggcattttgtatcatttcatcaaattccctaaaaaaatctattaggaaacattgtattttctcatttaagagataagaaaaccaaagctcagagagactaaactgcccaatgttatgtaactaacatagtaatataagaatttcaaatttagtatgtcagatgcaaattctttggaggaaaaaaaaaaaaaaaagactctctttgactaaaaagaatactgactgattgtccagaacaaaatctgacctaaaagggcctgataaacggataaactgacattgtttaatagactaaatctaaacatctatagcacaggggggcttccctgatggctcagtagtcaagaatccacctgcaatgcaggagacatgggtttgaccctagggtcgtgaagaccccctgtagaaggaaatggcaacccactccagtgtcttgcctaggagatcccatggacagaggagcctggtgggctatagtccatgggtttgcaaaagagctggacacgactcagggactaaaacaccaacaacacaggacaaggagtgaagatctttaatttagctatataggatgaaatatcctgatttagtcaccaatgagtttatgatactatgaattcatttctttacttattctacatactaaattgttcctttcctctcatttctgtgaaattttaatgtaatgtttactagttatgagcatgggccatggagcaagatttccaggcttgaatgccaattttgctagtttttaggttttgacttcaggcaaattagttcacctctctggggctcaatctccacattcatgtaaaacgaaataacatcacctatcttgtagtgttgttttaaggttaatttagtttttatagttaatgtgcttagaatattgtcatggaattagaaagaataaaaaaaaatctgttttttcctatccaaaataacagaatcctattttggattgtatataacaagtgtgggagaaggaaaggatggagagtgaaaaggaaagaaagcaacacaaaatatacagaaagcttcagcagaaggagaataattcagtgagaccacaaaggcatagtctcatttattggaagtttttatttcaaaatgtcctgtcccccagcagtggctctctaccaggagtctaatctccattcagttt

SEQ ID NO: 56493 - DNA, 1788 bp, Bovine  19866881435219
ctacaatgcagacgagtatggtcaaaagattgagtgttgaccattgtaaaataagctgatgtaatttgcaccactttctaggtctggcccatagtaaccttcttaacatttttgactctcttgtcatccacttactgcagatcaccaccatgtcctagaacatgcttgggacaatatatgaaatcagtgtgaatcttggaatagctgttctcacagattagaggcattcactttgaaatttaaatgtgcaagaaataaatttctattttgtgaaccacttagattttagagtttatgtgtttttcagctaacaaacaaaattattacaactcagataatataagttactcatcactctgggggttacttaaacctaagaacattatcaaggcatagataatcctaaataaaggccatctttcctctccacaagtttctataatgtgtaataatttgtcaagcaatatgaagtttctaagatttttgccttatttttgcaagctaacaagttagactgccaaaacttcatagatgctggcagaagacatagaattcctgggtgagagtaaaggaccttttaactcattcacagcaaggagcatcacactggatcctcttgtcttcaagtctcatgaggatgttgccaaaatagagccagatgaatcctgcaaatataatgcttttgtgccaaaactgaggaaccctgagcttaagacgctctgatcatctaaaaggggctgctagcaaactgcccaactttgccccagagggagacattgtctttattctgctcatgatataaatcttcccttgtcccagaaggtgatgttatcttagttccaaaaccgtttgttatacaaactacaaacatgcttaaaaggattgtctgggacaaaacctgatagaagatgtacaaaaatgccgtggagaattctctttctatacgttttagattccgggttgtataaccagagagtaagtcatagaaagatgcaataagagagcaattaggaaaatatgaaagccagtgattctgttccttcattttaaggatgaagaaaagcacgtgcagaggaaaactgactcggtcaaggtcacatggagaatcagtgagagccgtgagtctatttctcttatcttattccagattacacatgcatatgtatggctggtgttaattcatatacccaccaggtctacattttgttttaaaagtagttctctgggagcaatgcttacaactgtattgggaatcagacaatctgtgatctcattacagatgtgacagtaataattttttgaagtcattttgatctggccaccttcagggacaattaaccaacttttcttttagagtacattgttcatatctcttattttaaattgatatctttggttacgaatttgttaaagtcaagaactgtttctaaaaataactcagtaagttgaaaagtacatacgaaaaaaaaaataaaattgatgactgctcctatgtgattactgtattccaactctttatattctgttttccaatgtctgggccgtgaaatatgccattataagattttatttccatttgtgttctgttaccttgaatcgtaggctcaagctcccagagataatgactagctgctaggaagtctacctgatctttttcctatcaccttaatgatacaattggtataactgaccacaatgctatcattatattcctatagttgatttctactcctttgagtaatgagattgctaaattagaaaaacaagaaagaaagatttttcataaat

SEQ ID NO: 56494 - DNA, 1669 bp, Bovine  19866881448693
tgtgaaattatttgccttttgatgtgtgttagtccttaatagtgtccaactttttgtgactcccatggatagtagcccaccaggctcccctgtccatggaattctccaagcaagaatattggagtggtttgtcatttctttctccaggggacctacatgacccagggactaaacccaggtctctggcattgcaggcaaattctctaccatctgagctaccagagacaacagtccatatttgaacatggactgtggactttgttaatattgctgctgctgctgctgagtcacatcagtcgtgtccgactctgtgcgaccccacagtcggcagcccactaggatgccccatccctgggaatattaagtagtaattattatactttagtgtgataacggtattgctattttttaaagattttatcttttagatacttactgaatagttatagataaaataatatgctggctgtgatttgcttcaagttaaaatgtagaaatgcatgtggctacagattaaacaaaactgaccttgagttgatatttgttgagtctggcttaacaggcatatgactggggcttttcataataaaaatttttaattaaaatgtaaatctatatgtttcacatattttcataaggccacttaaaatataacttagtattgatagttatgtcatcacatcatatacagtcccacattagtatgtattttctctctggcaatgcctatgattaaagtatactcaacttgatatgtttttccccctggcattttagataccaacaaccttacagatgagcacagggctttatgcccagattttaaaacataaggctagagctaacaataaaagtaatgactaagcactgtctattatttaccttcacttagttgctcaaagagatttgaattcaacaattaactaaatcatacttggctgcatatagtcacttaattttatagcctattgagtttgataatcataagagagcatgaattgcagagaggtaaggataaagtggttgggttagtgcctcattatccttgcatctccagttttttgtatactgtccagcacacagaaaatgatgaataaattttaatttatcactgaaggaaggaaaaaagaaagagatttcagggaaagacatagagaaaaagaggaaaggacagtagaaagaagctgcaccatttatctattgcaccataatgctatataaaagaaccacaaaacctcagtggcatataacagtaagttttcaaatgcccaagggactgggctgctttctagttgcattgtggaactttgctgcactcactcttactggcattgggcttacctaaggcagcctcaggtggaccaactgggataaattaactctactgcaagtctattacacttcaacacactctagaccaggcctggtgctggcaacaatgcaagaggttaagtccattctttgaagcacttttccagcttctacttggtcatgtttgctattacatgtttctggcccaaacaaagaccatggctaatcccagaaccctgaaaagctatcaatagattaaaaagatcatggatgcatgatgtagggaagaatctaggccattttttggatctacagcaaataaataaagatattactacacgacaagtgcaactggact

SEQ ID NO: 56495 - DNA, 883 bp, Bovine  19866881582623
tttgatcaggtggggaagatcccctggaggaggaaatggcaacccattccagtattcttgcccggagaatcccctggactgaggagccacaggctacagtccatggagttgccaagagtcggacataactgaattacctagattgtgtgtatctctgcctgccctccccttagtgttgatgaacatctatcatgatagatattacattcattaaaaagcccaaaagataatctacattttttttttcatttttatgggagatgtgggttcacaccttaacaaaaattttcacttggagggctgctaaccccagtggtccagaatatgcctcaaaatgcctatgagcttcctgaaatttaatgcatttatttagggggactgtttatagacttcatcaaattcttataaggacctgtgatttctaaacacctaaaactccagaaaaaccaataaatattcatgaatgataaaaatgacaaactagtaagaaacatgttcatatattcatttgaaatatagcactgttatttttaagaaacttgagtgggtgagacctgttgaaatatatctactactttaaattactatgggagaaaggtcaagtcagtgttcactaaaagcctgctgctccattgggtggtactggagtgtgtggtaagaacacagaagtgtgagggctgaattctcctttgactcagacccttccttctccaactttggtacaagtttcttagtagttctttcctcagttgaaaaaaaaaattggatgatagtataaacctatctgaaagtaaaatgctagtcactcagttgtgtccaactctttgcgaccccatgggctgtagcccaccacactcctctgtccttggaatgctccagcaag

SEQ ID NO: 56496 - DNA, 951 bp, Bovine  19866881894060
caggaaaacaagcaacattctggtttgataaatattttaaggaggtgatagagaaaacccatttctagcaagaccaaataacccttatggtctacttgcttagctaagcagaaattactaattattctttttaaattgtaaaagctgccttgattttttaaaaaagaaaaaagtatgaaatatttcatctcccagcaagcatagattaatggtgctgaaaaagttcttgctatgtatggtgaatgtaagtaaacacttaaatttttttatccttgtcaaagaaagatataaagatggaaacaattatccaagcaaaatgaagtcaacttgggaaatttagatatagttttcatacaacttctcaaatttaaacataggaaaaatggctgaaacttaaaactctatttctgaaggccaagaatgagagagggacacagtaagccagaggtgaagaggctggaattaaaagcagaaaagggggatttttccttgagagtgttgattttggtttgaacttgaattgataaaaataatataaatatattatgttataaacataagtaagtaaaagcctcaagcatcactattaaatctaaacaaaatctagcccagcagataatggttattacagtcagagcatattttgtatagtttctgtttatttccttaataaggacacaacctatttacaaatctattcaaaatttacagcaattaaaagcattggtgtaaattaaaatacctgctgaaggaatatcaaacaaaactcattaagaagatggaaatggaaaatatttggtagcttccattttatggctttgctgtaatagtgtatcacagatgttatttaaagaagaatattttccattctaaaatattttaattaatccacagaagtgtaagttaaattccagtataaaggagtaagaggtgctcatttcacattttcat

SEQ ID NO: 56497 - DNA, 2503 bp, Bovine  19866880368190
atgtaactctgctctaaacttatcaggtattgtgatgggattagaaagaagataggaaagagcagagtcacttttcattgccaagacttacagactatgtttaatccactcattctgcctggtaaatatatgcagaagaatataaaacaatttgattggccaagctattagtgggtaggtatattctttaagaatcaggtacctggttaccctacagctttatattttgggtgtaagtcttctttgcttttcctaaaccatttattttccaatatgaaaaaaaaaaaaactaagtacactctatcctttgctaaatcttaatatgtgggacactttgtttcctgacctttgctaggctgattccttcttgctgtttggatgatagattaaatattatccagattcacttttccagtcaagcaccagcacattcaacttccctttatatcacttttcatcatttatttcctttatttttggtttattccccatcccctagaatgcagaaacagaaatgttgtctgctcagatagtcagtatgttctggcacatggtgagtgtctggcgaccactggatggagaatgagtgaatgaacgaacacttcaggtcacctctcatcccctagaagggtagccagatgctttgttggtgaaaaaggcaaagcagtttcgtgttgtagggcaaaggccacgcgaaaccaggaaatgatattttaaactgaataaagagtgaaggctaaggagccaaggagctttcttcctatggaaaagcacatcctaacagcctccttggaaggaaagttatgaccaacctagacagcatattaaaaagcagagacattactttgccaacaaaggtctgtctagtcaaggctatggtttttgcagtgtcatgtatggatgtgagagttggactgtgaagaaagctgagcgccgaagaatggatgcttttgaactgtggtgctggagaagactcttgtgagtcccttggactgcaaggagatccaaccagtccattctaaaggagatcagccctgggtgttcattggaaggactgatgctgaagctgaaactccaatactttggccacctcatgcgaagagttgactcattggaaaagaccctgatgctgggagggattgggggcaggaggagaaggggacgacagaggatgagatggctggatggcatcaccgactcgatggacatgagtttaggtaaactctgggagttggtgatggacagggaggcctggcatgctgcgattcatgggattgcaaagagttggacatgactgagcaactgaactgaactgaacagcctccaatgtcttcccataccttctcttcctcttggagttgggagactactcttgcaaacagaggagagttgatgtaaataagaggtatgccatggtctccagaagtacttctgggaagacacaccatgttcaaatctgtcgatgagcactgagtgctggagaactgaaataaagacagcaaatgccaaaatgtgggactccaatgttcttcccagactagactcatccaaataaaacctttacacaaatgtttacccatcatctactgcataatcaaagtttttcttttctttttaaatctgaaactgctcatgagaaagttagaggaaaattgacagtaatggaaacatgttgctgctgctgctgttgctgctgctaagtcacttcagtcgtgtccaactctgtgcaaccccagagatggcagcccaccaggctccgccatccctgggattctccaggcaagaacactgggggtgggttgccattttcttctccaatgcatgaaagtgaaaagtgaaagtgaagtcacccagttgtgtccggctctttgcgaccccgtgggactgaagcccaccaggctcctccatccatgggattttccaggcaagagtactggagcgggttgccattgccttctctggaaacatgttaacagtatagtaatatctaagaagatataattttattcaataatacatatgcatcttaatcttggtatttttcagatgaactgtttcccctgctaagtttttcttttctttctaagacattataaaggaacacttcactcagcctgttcataccctgttaggttaatgtatttcctttgaaagcttgtctttggcagtctagccctcgcttttacccaacatcacaacaagaaacttagtgtctgcagtaggtcgatgtcttccccgaaccaaggctgaacaggtgataatgaccttgaccaagggtgcagcaaaggtgaccgaggtagaggcaatttcacttggtgtccctgacaactgaaccgtttttttttttttttcctttttaagccaagggtcttgaggagtgtctacctgttctgaggctgtctttctttttgcacaagcgggctcatgtcacaaggaccacctaatcactgtgcctgcacagtcattcttgcacagctcccctcgagctggacacacagccaag

SEQ ID NO: 56498 - DNA, 1328 bp, Bovine  19866880416777
ggggtgggactcacatcctccaacttcagaacgtttctgtccgaaaatcattttgaaaacaggacgatcagactttttaatcatggagggacattatatctgtgaaatgaagtgttgaaacaagtgtgaacttgggacagaaacttgggacgctgtttctcttgaggaaacagcgttctctccttggtctcaccactaaaaagacacctgtcttcattaatcgcattcatcggctcaaagcaaccctttgtttcccagtatcagaggaagaaggatgggaggggataccctgactgtgatagttaatgttctgcgacggcagactggtgtgagtgcgcagtcccactgcaggaagggcaaattccagactgagcggtgtgcgtggatttatggagcaatttagggagccaccctccagagaactgctgccgccgagaagacacttaaagcagggccccgctcggccggaacacaggggctgagcgggcgaatcttgggttgctattttcagggacacatttgtttccaaacaaagggctctctgccagctattttagaagtccttgtatatttactcagccaacgctctgcgctggggattgtctttgggcactgaggttttatcatccgtgtctatttaaagcaggatgaaaaacagctccagatgaaaacagagcatatttccagcctcgaatgtgagacgctttcttttcttacaggactgagatctggcttccctccctctctctctctgaaactgccacctgtcttaaccatcttcgctgtgtcttagtttaattggtgctgttttctttttagcagtacataaaattatagtgcgccttaacaagttatagattggatggaatgtggtgtctatgtgtgcgcggttctgagagagagcaaatctccattaggacccacttacaatctctatctggttacacccaccacggcacacatcacatcaagatgtcatgtcatgaaagggccaacaggctagtgttcacagggtgcgaattagcggagggagcgaaacggaagggagaacaacaggctcaatacagcaatatgttgattccaatctcttgggaagatcaaaggtcctgactcggaatccgcacttctgaagcaccctctgcctgcaacgcattccagaactcgctgctcagtacaaggcgctggggacccaaacaggaaagagattgcacctgccctcagggtgctcacagcccgtgcagggaacacctgctgcctgtctctctcacacccccctaccttctgaactcagaacaagtctgactttgaaagtcactgaactcaagtgt

SEQ ID NO: 56499 - DNA, 2583 bp, Bovine  19866880549911
aacgggtgaagcgcagggagattctgccccctcatttctattccagctttcacttctgaatgctttctttcacctaacccaagttacgctgacatgatctttgacttcccaccgagaagcgttcattttaactggcaggcaaatgatattacactctaaaggcccatcatgctaaatgaccattaaaccactccacttaagaactgcctctcaagacggacgccaagcgcttcacacagtatcactacttaacgctcagcattttatagacagggaaatgtcatcaaagatctcaatgagttcctctggttgtaaacaaaacatctgtggctggttagctgagtcagttcatccgtgaagtgaaatgaccaaagccttaggtgggaaccctgtaaagctctcttcatatggctctattgaggtatttactgcagcccccctgaaatgagacgccccacgaaggaggctcagattcggagagggtgtggtggccaccgccccatccaccagcctcctctctccttattcagcgtggcccttcctgtgtgggaggctcttctccttcccagacacgctgcctctgttcctttccccaacttcctcctcccaccagggttattctgttgccatgcgatccctctccgctgtgtcctttgaactccagtctcacctagtagctttctcagctcattccagcctttatgagtctccctagagctcaatgcacaccctcagaaactctgttccatggtttgccctcacccacccagtcgtgtccgtgctctttgctcatatgtgtgtaccctgcagtgtccagagcctgtcatgacctgtggtatcacagcttcgaggcagaagtagacaagcaaatcaagatgcctttattaagccagatgctaaggagacttgcaaaaatgtaggaaaatgctatacttcttactagtcattttgcctgtcatttttcatacaaaattttatttgtggtaccatataataggcttatattctaaataaagcaacaatcacatgtctctaacatgtgcctttggtttctaatatggtaaatctcagtagcttaacgctcatgcaaaagagggattctctgatagctcagttggtaaagaatccgcctgcaatgcagatttgattcctggggtgggaagatacgctggagaagagataggctacccactccagtattctggcctggagaattccatggactgtatagtccgtggggtcgcaaagactcggacatgactgagcgactttcacttcttcttcatgcaaaagaactctgtaataacttttaagagttcttggatgaaaatatttgggaatcactgtgctgtgctgtgcttagtcactcagtcgtgtctgaccccttgtgaccctatgaactgtagcccaccaggctcctctgtccatggaattctccaggcaagagtactggagtgggttgccatttccttccgcatggaaatcacttctctgtatcaataaggatatgagataaacacttgtcaaaagtaagaaataaatttaactgtgaaatctggataagacatgaaaagtacatccacagcagagtatgactctgtcttttattgacatctggaacactgagcatttcccaaaggatggcaataaggtccagagaacccaacccctttctcatccacccccaccacctgttcctcccccaggttaggggcggcagggaccaggaaggggaccggggtcacgtggtgacctctgctccagcagctcacttcaggggtggagactctacacagctcccttataatctcacgcagattactttctaaggctgtaataacaaaataatagagaagacttggaacaattttaaggaaacattatttaagtgttgcttgaaattatttctttcataaagaattatttttccaataatcatgcccccgacttatttgtgtattcatataggtgtgtgtagagaataaggggtggagaggcacatgggatttgttcgtatcttacacttgggtttgccgacaccagggcatatccatgttcaaacggtcctcgccaaatgtttgcaatgaaatcctttaatcaaagaaaagtggtagaggcagaatataaagaacctcctgccacgtaatttgctgaagagcagacaccaagtttacaacttcctcctgtgtgtgtgttagttgctcagtcctgtccgactctttgcgaccccatggactgtaggccaccaggctcctctgtccatgggattctccaggcgagaacactgcagtgggttgccatgccctcctccaggggatcttcccaatccagggatcgaacccacatctcttacctctcctgcactgacagccgggtttttttaccattagtgccacctgagaagcccacaactccctcaagtcctgctaactagttaacgagctcaaaaagactgcaaaagggtggaaaccggtaaaaagccactggctgcaaaggagatggcccaggtgtgcacaatgggtcctggacacagaacgagcaggcaggggcacatgctgggcatcggcgtatcgacaccccttc

SEQ ID NO: 56500 - DNA, 938 bp, Bovine  19866880599995
ggcatagtgtgtgtacgtgaagcataaaattatttacattagtagtataaggtcacttcttttaattaccaacatcaagacaaaagaaggaagccagggctcacatttcgaatctcctttccagctttcaaacgtgaagagttgtgtgttgaaactatttgctccctgaagttcttacgcgtccataaattctgtaatcgagtttgttttgtttttaaaaaaggttaaggctttattttggaaactaactcttagatggtctaatcttggagttggcagactccttccataaagggccagatgtaaaccttttgggctgcgaaccacagtatctgttgtaaaggctcaagctggccgtggctgagtggaagccatgcagacaattcataaatgagggagcatggctgtgtttcgagaaaacttacccatgcacaccgcatctgaatttcctatcattttcacgtgtcatgaagtattcttttataacttttttttttccaagcttttcaaatgcaaaaactattcttatctctgggctgtacgaaaaaaggcagccaaccagatttagcctgtgggctgtagcttgacaacctctggtctgaaacggtctatttttaagtcatcagtgaggctggagaaaacatgatctctgtctcacacacagacacacatgaacacagagtcgcacacaaatccacctaactatcaacatcagggttttttaaaccactgacgtggtacatggaaaatgtgatttcaagcacgtgtctttagtgccctgaaccagacgccaaaacaaaaatctcagccttgaagaaatattacgagggtggtaggaaaaagagacctccttcctcctatcctttctcatgaagaaaatcaccactctcaactacgaaccatgccctctactcctgtaaggagttaaacgcagccca

SEQ ID NO: 56501 - DNA, 609 bp, Bovine  19866880622540
ctccggcatcttgagctgggataagcctggttccagaagacgcagaagggcggtggcaactatgctggttggccatgttccatctgggaaggtcagggcaacgtgaccatgctgtcaaggttaggggaagctggggaagggggacgagcaggaaggaagggataatttaactgaacccagtctgaaccttcaagcagttcagttcagggacagcactgacgtcaaagctgtttcttattttaaaaaagccaggctgtctgattcaagtagcccctcttaccttctgccagtccaaagtgccaggtcatgaccctttggaaaatcgttctttataactttagcccaggtagaggtttccctttcttcctcttgttagatagggttctgatgctaagggccgaaggacggaggggctaaagaaaacttcaagtctcacacatctgatggattttacattcttgcttcatcagactctggatctcagcctctcctacagtgatttcctaaacttaaacatttctttgtctgtcctgtttaaactggcacaaataataagaatttttgattacttaaatgtgattttaaagaattgctgtgacagtcaatttt

SEQ ID NO: 56502 - DNA, 1034 bp, Bovine  19866880636667
gcggggtattgttcctcgagttgggaaatgctaaccgaggtcaactccagttcagcttcctacctacagaattatggcaggacgttacgtttggccctcgtgagatgaataggtcagcaaaaacgtactcttgtcttcctaatagcagacatctctatttttaagccttaggtcagaacatatttttcccctgtttgagatccaataattcatattctcaaatgaggaggaattttaaaatcaaaggcacggacagcaaaaccaagaaaaatctaaaaccgtcgccccgccacaaattctccaaccaaaattgtgcttcagatgttaccatgttaggatctgaaactggaagtcagtgttccggttaactgttgctgaataacgaacccaccctcaaagttcagtggcttaaagcatcagctgttttatttctttgcccctaattctacaccgagcacagctttgggtggaactgatatgggtgaaaaggagaggttctgaagcaggatcttaggctcctgcctagggattgggcggcctggatgaaaaccaggagtcctagcctccagaccaccaggggctagaggctagaagcagaatgggctcttacctccgttcaaaattaagaatgttccaagaggcagacactcctactgctgtaaaaacaggtacaaaggttattagtagagacacagcacacgtgggagagcacgcagaaggaagcctgtcatttatttcagaccagaagggaggcagagatgcccacctggtgagaaacggtgtgggcgtcttccctaatggagaggaaggtggtaaagagatgacttaaatctcttacataggacagttcttctagtctttgcttacctttggccagttgtctcacttctttttccacctgttctaggtccctctccaactggcatgtgcgtattttagccgagatggggtccagtgcagagggctatgggaaggttgacagcaccctttatgggatggtgccccctcccttttacccccaaggagcctttctg

SEQ ID NO: 56503 - DNA, 1073 bp, Bovine  19866880694116
cttgcctggagaatcccatggacagaggagcctggcgggctacagtccatgaggtcacagagttggacatgactgaggatgaaaacaaccttccactgtatttcagctgatacacacgtcatgaagcagtcagcgggcctgctaaagaggtgtccgaaatgcttaggaaacaaagccatagattaaaaaaaaaaaaaaaaatcccccaataaaacaactgtgaactataattagttacagggccctgattttggacagaagagctttgcaaaagaggcccgccgtttgacagactcccccgagagcaccgggtggcgagtctctgcttggcttcttcccgccttctgcacatcaggccaggcttggcattgcattaccttctcttggccccactggttccgtctgtgccatcacctcttgaggtctctgttccaggggaactgctgaccacaggcacccatcttccagctgtcgagcaaaaggccactgagagtttacttcctgaggggagccctgctggacagcagagaactcggccagccagccaggagcacgcgcgggcacttcttgcaagggcaaacaggcgcatctggccttctgcctctgggggcgccccctctgcgctctctgctgtgtcctctccttgagctggcgctttgtcacctgtcagaccagagaacagacccaagcagggcacgacagacaccgggaagcatccaagtatggaaatcttgttgcagtgtgtagggatacgctacacataatcagtctaattaataagccatttgcttgattattatttagccaatcaccaaaggcttttaaaacatgcaaagcatgctttgatcttaagaggaaaataggaaataaaattacacattccatatgatcttatctatgtaagaagaaaaaaaaaagaaaaaagacaactggaaggaaataagccgaaatgttaacagaggtctttctgggttcaaggattatgaatagttttcatttccttccttagtccttctctcttctttgtatttttttttttttaggaagtctattattttatcatagaaaaagta

SEQ ID NO: 56504 - DNA, 1649 bp, Bovine  19866880712393
tgaaacattcttcaagtgaggcagtttgacacatttgtacagtttttactaagatgtatgcagagggaaatttcactttgttgttctttggattgactgtggctatatatatatatatccccccttgcgtgtttcaacaatccaaagtaattaaaatatgacatcttcctcgcaaggaatttggcctaattgaggtggctgctgctcctgaagttcacaaaccaccagttaaagctgctgcctccagtgttttccttgtggaggaaaggcaatatttcttagcattgaccctgctgccacctttccaagtcactttgttgctctaagaagttgctgttttgctagaaaaccactggcaatgaacaccccttgggctgagccatccattatttccatatcttgcaattcagccgggaacctggacgctggttaaaggaagggaaacataagtggggtagcccagttttttaaaaaaatattgactatttggttatctgatgctgacggggtgccgaggcccgcactggtcaacagtagcctggctgcaggcttgagaaatgagcagcagtcccagaaaaccccaccttcgggtgtctgcagtgggagcctgcgggatgcattgctgccctgacagtgatttagataaatggctccgctatctatcaaaatgtttttagtactttatttgacaattcattggagcattagcctgaaaatgacattttaaatctttgttttcaaagaggtcaaagtttaactgaagaaattgagttttcctaataacatgacggcttatctaaagaaagggaagaaaaaggagaggaagagaggacaatgacaagatttaaactgccctcttctgaaactttttcttaagaataaagtcttgcttccagggccaggaaatcaacaggtttctagctgaaaaatcaataaccatttggatgccaacagtctggctgtctgacttaatatttcgtagagccataaacagggtaaaataaataaatatatatatatatatatatatctttttccgaaggtgccctcagttagctgctcttgaaatggctttactttcctggttcctgttttctttctgaagagctcaaagaaattgttacaaaataaatttccaacctactaagggatcttttagatccctctgtagcaattaaaacagtatgaacagtttcatttggaatctcagggaactagagctgtctcaaactttttcttgtgagagaaagttttaatgaaacgttttttaaggaaggaaaaaagaatgctgggatcctggcgtcaagctattagacctaatagacgttttacaagtagacattcttccttttgtaattaaccctccaaaagtgcctattaagttgcaggagttgggggaaaagctttgtttgttcttgaacaagttaaacaagggatttgccttatctggggagagcgagtggtgaatgtgccattcacgtaggggcagccgataagcaagaagtgttgataacagcaaagttcagctaatcaaagaaacttgccttcaaaaaagtaaataaaggcatctgacaaagggatttcaaaaatttcagtgtctttatttttgtaagcagggcaattaggctgctgggtcagtttcacaaggg

SEQ ID NO: 56505 - DNA, 1370 bp, Bovine  19866880758066
aatttaacaattttaacaatttttttagcaggatttagtatcacatgatggcattttcccccatcatgtgatatttaaatacacagtttcctccccaaacagaaaaacagctaagaaacgttacagttcatgcattaccagccaaactagcaagataatactgctatattttcgtacaaactccccttctcctaactctgtcctgaggagtgggctaccataacttcacctgggagatcacaccaccactttgtattatatgtaaaaccaagtcatgcttcataattagaatgatgtgattattaaaatggcaattgtttaaaaatatccttttataacaatgccatggctcaattcttactatatcagaatcccttataaactctgttatatattaaaatgtgttactggtttcaaagatgcttctttgagaagatgtagactttactctaacagtgctactcatgatcaaagtgtctttggattcttgttgtaactgcctagtttatttattgaagtatagttaatttagtgttgtgttaatttctgctgcacaccaaagtgattcagttatgcatatatatatatgtatatatattgattttttggtaatccttccattatgctttttttgtgggatactgaatacagatctctgtgctctatgctaggaccttgctgtgtatccgctctgcatccagtagctgacacctgctgaccccagcgcccagtccctgacccctccagctctgccccccttggtgacccccagtctgttctctgtgaccacaactctgtttctgtttgatagacaggttcatttgtgtcctattttagattctacacagaagtgatatcatgtggtgcttgtcttctctgtctgacttacttcactcagtatgatcatctccaagtctgtgcatttgctgcagatggcattctttcactctatatatggctaagtacccatcagatcagagatcagatcagatcagttcagtcgctcagtcttgtctgactctttgtgaccccatgaatcgcagcacgccaggcctccctgtccatcaccaactcccggagttcactcagactcaagtccatcgagtcagtgatgccatccagccatctcatcctctgtcgtccccttctcctcctgccccccaatccctcccagcatcagtcttttccaatgagtcaactcttcgcatgaggtggctaaagtactggagtttcagctttagcatcattccttccaaagaaatcccagggctgatctccttcagaatggactggtaggatctccttgcagtccaagggactctcaagagtcttctccaacaccacagttcaaaaccagcaattcttcagca

SEQ ID NO: 56506 - DNA, 4249 bp, Bovine  19866880780234
tttatctttttcttacgattttagaagggagagaggccgagggggagactcgacctgaaacctggaccacaagtgcaagatggtgaccttcctatactcagagcagagccagccatcctggaaacgtccagaactcgaggagcggtcacgctgccctcaccagccaccgagacaaggatgtccaccacctcctctccgcgtcccttccaaccagagcgagcagcattcccagctcagcatgccccgtgtcttgagatgcacacagcagaactctgcaggcagttaagggtggctggaccttaagctggagaggaatgctggactctatagtgatattcttctaattccactgggccccctgtccggcctgttcccccacttaccctggaatcttctgactaaatttgggaaactgcacaatggtagggccactccagcaagtgccatttttaatcacacagatgttccattaccaggcatcctgaccgcagaggggcctgtggtcaaccctgagggtcaacctgaccctcctacgccagggctcttggtgatagccgtcttatttccaaactgggaaaggccagtaagttgtgggacttccttacgatgcatctggacttttaaaaaaatagcaagaattatgaaacattaaaaagtgccttgagctaacttcaaaaagagcaatgctgggacgtccctgggggtccagcgggtgagactccgagctccaatgcaggggactcaggttccatccctggtcagggaactagatcccacgtgtctcagctcagagttcacacgccacagctaaagagcccacgtgctgcaatgaagaacgaagattaaatatcccgtgtgcagcagcaaagacccagtgcagccaaatacatacatttatatgtgaaaagaagtaagagatttataatataagtaatagacttccctgctggctcagacggtaaagcgtctgcctgccatgcaggagacccgggttcgatccctgggttgggaagatcccctggagaagggaatggcaactcacttaagtgacttagcagcagcaacagcagcagccagtattctaagcctggagaattccatggacagaggagcctggtgggctacagtccatggggtcgcaaagagttggacaagactgagtggacttcacgtcacttcatgtcaatagatttatatataaatatatatatttaaatattataattttaaaaatatatatttatataatttaatatatatacttatatataatttaaatatataatttaaaaaatatatacttatacttaaatatatacatatatatttaaagaggaatgcttaagaatgtggactggacttctcctctccgagaactcttgctgattcccatatttataatgaggcgatggagggcccctttgagaaagctagtaagaaacactgcacctgagacagccgtatgctgggacccccacaaggcctccctgcagcacatttaaagggctctctaccccgggagcatcccgagccctcctctcccccttcatgagtcctgagatcctgcccaagccatctaagcacgtgcacccggaaggcacgagccccacctctgcccctgacttcccaccccgcgtaagacgtgcgcctaccgcccccggacgtcgctcagccccacccaccgaccccctcctaaggggatccctgatgccctcacccgaccccgccctgtgctgctgtcagctgagtgactccggaccctccgcctggcccgggccccagtgggtccccctaatcccgtggacctgctgaagtcggctctgtctgcctgcatcctctctgtgagtaacatttgcagacaatagcccagctgtgaacgctaggcaaaaataataataaaatagcaataaaagtgttagagctaaaacaagccgtgtccacagaggtgtcctgactcattctctctcgtggggccccataaagcatccaggggagcgctcaggtgaccaaggtcctcactacggcacttcattggagggagcaacttgctgctcccagcactctgctaagatcctgtccctgcaggcttcatgacgatcttattttgcaggtcatgaccttctcaaccccttaagacagacaaacacacatacacacgctcacactcacttattccctttccagaggctccagaaaagtagagatggtgaactggccattgtcaaccatgcagactgctttgactccccaggaccttaactgcaaaggggcccctggtctcaacccactgtgtttaagcggcacatgttctcagactaacctcaccttgtttgggtactgtgacagaggactccctccctgtgcctggaatgtttcaaacatgaggaggggactttgaacgtgtgtcctgaatggagacctggggggtggttagagctgccagggatccccttactgatccctggagtccctctctggtgctctccgtcatgacacggcggcaagcgctgggtgcgggagctggtttacgtctcgaccctggcccgggagctgagcgaatcccagcaaggcacctggcttctctccgtggtagctgctccgaccaggagggcaaggtactaatccaacacaggtgctgaaaagatccagagcgtgacgaaccgtcgccaactttgcggctctccttttcgtgcgtggcccctcataacagttcagagcaagcatctcctccctgcggctgaatctcccagtccctgaatttccagtgtgctccgtcgtgtctcccagcggacagctgagtcccaggatgtcctgctccagatgccatgggtgatgttctgagaatgaggtgcgtagagcaaaacccaacagcgctccaaaacgtgctctgcccagccgcagacagagagccccgcgggcctccagagtctgatccgcccaagatcataggagcagacaggctggcccgcggggagcctgtgccctcggtctctcgggccggccgcccagcgcatcccgtggcgctgcatccggacacctcgtctccgcgaaaggcgtctccgctggacccgcccgtcgtcggtctctctcgagatctgcaggaagctccagctcttgcaacgttctcagtcttccatgctcttctccgggaccagatgtaggttggaggcctctcctttgagtctgtctgtctgtctgtgggcctgagagccccacgcggcctcctctcccctgtcctggactccttggcgcctcaagggggcccagcaggcagggggaccctcagaggggccgctgctcgcggggggcccaggtgactgcgcagcacacagcggacggattcgccactcccaatctggacgccagtgagacttcaaccaggagaggccacagacgggaagagcccagcctccctcctaaagaggcgagcaggccttaccaccagagtaaacagttagatgactacgaggctccaaatgcagagtcaaacctcctcgaaatgagatcccccggggctcgccctgaaatacccgtaatgtcagctgccgcttcagtgggtattggaaaaatatttagaactaaaatatggtatttctccagggggcgtatatcaaaaacggggggagagcagcaattactagaggaactcgataaatctcctggctacctgtcagttctctccaggtgcgccaataacatgtactagaaggactcacatcttgctgtttcctctccccattttttttttgtttgtttgttcaagcctagtgaagctccattcagatcatgggcaggaaaaaaaaaataccctataaaatgcagtcagtgacttagagcgtacaccacatttaaaggaatgggcttcagaaatgtagaaaacaaactaaggttaccaggtggaaagggggcaggataagtgaggagattgagactgagatacactcactactatatataaaacagataaccaatgaggacctactgtacagcacagggaactctactcaatgccctagaatgacctatatgaaaagaatcttaaaaaaagtgaatatatgcatacatataatagatgcactttgctatagacctgaaactaacacagcattgtaaatccactatattccaataaaaattaatttttaaaaagtccatttacaattaagaaatgttgtcctactaaattaaaaaaattaacaccaaaagaaggacttagctaagactttccctcagtgctgcttacaatcca

SEQ ID NO: 56507 - DNA, 1651 bp, Bovine  19866880812852
acccagcaatggctggttgatttctcctcccatcacgtgtctttgacctactctgcagcttccctctcccatgctttaaggaccttctgttcactttggactcaaaataatccccttattttaaggtcagctgtttagcaactttacttcctcctctatatatacataaagcctatttataggttctgagggttagaacctggacttctttggacaggctgtcattctgcctaccacaatgcccatttccatgttcctgcagaactctgtgcttacctcaatcattccgtgcaggaaataccatcatagcattttggttttggttttgtgtttctgagatgtcattgacacgtaacattgtgtaaatttcaggtgtacaatgtgttgatttgatacatttataccttgttgttgtatttgtatatttgtcattcttcctgactttgaccttctttaagatctgttcatttttgatccctatattaagaaaaaataacagatcctcagtaaacattttggaagactcaagcacctagtgataacctagattccctttaaaggatcagcacagaagagggattaacctgtgtccagtaattagagttattcatgttaataattccatttctatgaaaactggtcaaccaatatgcaatgttaataaaaattacattcctcttactgctataccaacatttactgtttattatatatcggacattgttcttagtgcttttcatctgttgattcatttaatttttacaatgatcctctgatgcaggtacaatttctattgcccatttcatgaatgtggaaactgaggcatgagacattaagtaacttgcctgttatcggccagcttggtatacagtaactctgggctactcactctattctgccaacccagacaatcccttctgtggtcagtctacatgaatgggaggtcgctattgttaacgtgaaattttgtttatttctcatgaaactcaacagcctttagcctcacgggtttcagaaatacactgaatgaatcagctggctgcatccgagatttttcaggcgggcaacttctcagacctctgcactgtgggcctcaagtgtaaaaagccagccgtgtattatctttcagagtcaccttggtccttggggaaatccttgggcctaaccgtgagtccacgcgtgatcgttttgtcccaggagaaggccagagagccagggaggacagacgggagaaggcgcacactgaatctgcggttgttcacagcgtccgctcttgatgtggcctctgggggacacgccgtcgcctcctctcgtcagcacattctgtgtgttctccgcacttctgaagggggagccctggaaggcgtttcgctctgacacgctcatttctctataagccctcagaggcgaggggtatcgggagcgtgttttaagacagaagagaatcggcgcgtttcccggcagctcctgcttacccctgcagtcgggtagcggcagcgacgccagcgacgtggatctggtggtttgcgtacgattgtattagacggtgggtctgtaccgtggcaaacaactttgtttagaaagctaacgatttactgcactaactcaaagctcatgttgaacaggaacctcgtgtgctcggaggaagggg

SEQ ID NO: 56508 - DNA, 2204 bp, Bovine  19866880836686
actcagggaaagcttaaaaagatttttccatgtggccaagctacagattggagcaaataagtatttgttgctcaagaggtgattatgtgtgaaatgaagtacagttgacgtttgggcaacgccaggggttaggggtgccaagccctgaatagttgaaaatccacatataactttacagccagcgctctctgcagccatccatctgcatcttgggattcaaccagctgcagacctgcagccctggagtacgtgttcattgaaagaaatctgcgtacgtggacccgtgtagctcagacctgtgctgttcaagaggcaagatgtatcggttagcgtttggtgtgtaacgaacttctccagagctaaccaccattcagctagcttgtgactctatgcgcctgccctttgggatgggctctgaggagtgtttcctctgatgtcagtggaatttccccatcccttggtggtcagctgctaggtcagttggggacagtctggtctcccggcggccaaagcaagggcacccgaggcctcgctccaccaggcctctcagcctgatcccctgcttgggtgaaacttccataccatttccatttattttttaatatggccttgtcgctaaactccttttgtaatttctttaatgtgtgccacactagactgttcctaagggcagcatcctctccgggttgcctggatgctcttgagacagggagcggagagaaagccaacatttcttctgactgatttttaataactcttaggattatttgcgtcttttgttgtcgtcagccccaaatgctttcaggaaggagccacagtccaaacaaaactaattgattcattaatgagatggtcaaatgattaaaaattgatggctaaatgaattagcatttttattgaatttactgcctttaatctctacttgccgtttcctgtatgtctcagagaagctcaccagtctctggcagtttcgccctggagacttcatcccgtggccagtgtggacaccgctccccacctccacagccactgcagactctcccccgttgtcccccaccagcctggcaggaaactcgaagtgactggctgcagctccagcaacaggaagttttggcacagctgtttggacaaggctgttggaggacccctacagggcttccctggtggctcagctggtaaagactccgcctgcaatgcgggagacctgggttcagtccctgggttgggaagatcccctggagaagggaacagctacccactccagtattctggcctggagaatcccatagactgtagagtccatggggtcgcaaacagacatgacccagcgactttcacttcacttcacaaggctcactggcatctgggagaaggctaaggtgatactcctgtgtcaccactcccaaactgtttctgttctacttgatgttttctgcttaccttggataaaaaacataacttggctagactatatccagaatttgtggtgcatacctgtgcacttgctggacttcccggagggcacagtggtaaagaatctgcctgccagcacaggagatacaggagacccagcttcaacccctcgtttgggaagatcccctggagaaggaaatggcaacccactccagtattcttccctggaaagtcccatggacagaggaactggcaggctacagtccatagcattgcaagagtcggacatggctgagcaaataagcacacacgtatatgtgtgtgtgtatatgtgtgtatatgcttttttctattcttctccattatggtttatcacaggttatgagcatagctcctgtgtgcagtagggccttgtttatccatcctgtctatcgtagtttacacctgctaatcccacactcccactccctccctcccgtcccctcacccgatttgcccagtgttgcgtctcccagcgtgcccggccagccctgcctgtgctctgcggcacagagggtctggaggtccacgtgtgtcttgctcggccttgggcacccttgcttcctacagaggcagaaagtggcaatttccttgccctttttaggtgtctagcacttaaagctctgagccaagtcgcagacctactctctcggcttttctcaaaggcggacgacgggagatgctggtgacacaggtgtgtgtggtcccttggcttctagcatctttcctcctcagtggtggggagaggggtg

SEQ ID NO: 56509 - DNA, 1627 bp, Bovine  19866880883278
taaggaaaccataaaaatccgtggacacactgagttccgcttccagcctttgccatcaggagactgtgcacgctcaagagctcaggaagcatccagaaggcacccatgtgccttcagtgctgtatgtctagcaaaaaacggcctctcgctcactcccacagtgctctttattgcggttggcatggacttgcccaggggaccgacttgttgttccacgaaggtccttaaatggcattactgatgaagcatgtcatccaagcctcaggatcaaatggcagctactgccagggacggtggtagaaaagcccatcccccagttaaacactgcacgctgggctacgactggtcattacgtcctttaccccgcttcagcttttccggaacacagccgataggcttcatattttattttaataatatgtatgtagtattcttgagatcgtggattattttagacattttttgaaggaaatcgtctctttcccctacgtgaaaaatggagtgtgagtttgaacaagagatgcgtgctctgatacaccatagagcaattactcctttaagttcatattggctgtttctgaaattcttctctgctgatggctacaatgttacactctatttgggggccatttctgtttcctcagtaccatgaatattttatttcggcctaatttaacctgttcatacaccaagcgagatgagattcattaactctgtattaaggagctatgcttccaaagtctaaaaaatcttatcgcccagggacagaacatcctcactctatgacaacgttagacaacaggaaggtgggcgaatggaaacgtccagaatgatatgctgtcttaaaattagaacacttgtaaagacaaatgaacttatttacaaaagagaaagggagtcacagatgtagaaaaccaactgtggttacccagggagaggagggctagggatgagctgggagactgggctgacatacgtacgcactgctgcgcacaaagtagcttgttaacaggacctactgtacggcacacgcaactctacggagtgctctgtgatggcctctgcgggaaggtagtctaaaaaggagtgcacatatgtatatgcataactgattcactttgttgtacactagaaataaatacaacattttaaatcaactatatttcatttaaaataaaaaaaaaatattgaaaaaaaaccacttgtacaaaacaagtaaattttggttttgaaatgcagagttgttaaaactaagatcaaatatcagaagtttggagaggtttaacatcccctattggagtctttcttcagatattttttccaagaaagaactaaaaacgctgcagtgcaggcttcttatctgtatacgggttttatctccaagttctttctgtgataagcaaaggtcccaagttgtttccgatgataacctattgcataatttgtctcccatccccgtcaaggaaatagatttttaattcttcacagttgtcccatgtctgtgttattttgtgctttcattcagattaactatggatttaaattacagctgtcattttgttaatgaatatttttctgataagccgtatcagaatgatatggattgaagtcactgatacagctcacg

SEQ ID NO: 56510 - DNA, 1790 bp, Bovine  19866880901262
caataggtgcatgaaaaaacacgctgtgacatgcttgcttcggaccattttcaacgccacttcaaatgtaagagctgtttacttagtaaacatagtaattgatattaagcaatattaatatttcaacacagctcttgtcatagttcgggatgtttttgtaggatatgatccagttctcctcagcttacaattctctttgattttctttgttacttcctttatttttccttgatggattaacattctcaatcatgaaaacactttgtgtaaataaatcacctaaaatttactgcatctagtgatgtgctactctaatattagaagtataattcgttggtaaaagtgtgtatgtcatttttttctcagtaggctattgaaatatcctgatatatccttagctggaaaggtaatttttatggagaaaaaccaaaataaactgaaaataaattacagagtctgatattttcacaacgaatatgaaacaataatggcttactctcaaggattggttctttccaatccttgagaagaatctcaaattactttcagaaacttggtatcaatttttgcattctgaagaaatgtgcagtttagaaagtttcactgaccctttttgaatcagtaaacctaaagggtgaggaaggaacacagccttaaattcagcaagttctagaatgacaggtcctgcaagctatgaggctgtcaaaaacagaacagaacaaaaacatctgtattttttttccttttccattgttagaaaaaagactgtgccacttaaaagagcttccaaaaactctgcagtcaatgactaagcaacttgtcaggggctctgaagaggcttctcaatattaataatctaagtactaatatcaaatttcacttttggagtagcaagtatatctggttcacgagatagcttggttttctttataaatgccccacaatgaatacatcagctttaacatttaggcttttgataagccatcttgaggtggtctgacttttgttttctttcctttcacaaacacactcctcaccatgatgaatggcctcccattgggtatatggaaaatttcccagccctgttcccttgagaatgtgccactacatggatttctgggcaaaggaagattaaaagaggaggagcatgagctatggtccccttaccccacagccatcaattatttccagttataaatcaaagttttcagcccaaacaaagacctgtgtggcaagcaaacaagggcgttcacggcaaattgttttgaagccgaataaaactcttgacggaaaacaatggggtcagcaaagccactgtcaatatcactctaaagtttagctgatttatgaagaattagatatggtgcatcaagtctcaggaggactgattgagagaacaggaaggagaagtgtgaatacacttctgtacactgatataaaacgaaacagagctcttccttcgtcacaaaaagtttaacccaatgtgtttatcctcatgaatgtgaccccttgcctgagagccctactctgaaacctctaattatcaaacatgccctccctgcttatttttggtttctgcagaagcaaaactattggcatttccaccactcatatgaaccatggcagcaggctcataccttcctttctattttgatcttacacttggaagaatgtaatttaaatagtttcacatactgtttatatgccccacataaaaatctattgtacatggtgaaacaggaaaatattgacttttgtgagaacaaatagaaataccatcgggaggcaaa

SEQ ID NO: 56511 - DNA, 1000 bp, Bovine  19866880928357
gtaagtgtgcgcgatgcatagttttcacgttacgccatgagtgccacttaacaactgtgctagccaagcagcacggggtgggtacccggcaggctttttaaaggcctggatgccagtgcgcattccagcccgcgcacagaaaggagacagcagccgcccttccctgggaggggcgcggaagccggccccctgcccgcccactcgccctccctgctttgtgagcgaacccgcaggccggagtggagggccactggatcaccaagggtgttttaatccctcctggagctgcttttctttgatgtccccttgcatcctttaagcaagttgtgcaaaatggctgcagggtggactggctctccctttaacagctctctgcttgggtgtatttgtaaacaccgtgtctgtccttctcagtgatggctgaaaagcttttccttcctccagtcggtgtgggagatgtcaaaaaaaaaaaaaaaaaaatcctttttcttaaaatgactgtcttctaataaatagccaagttcggaggggctaggagaggtgaaaggtggcccttggaaatagaaaactttgacacaatcagttctcaaaatctgcattgagttacgcagtggtgggagtgggggaaggggtatagcagtggcgggtgtggtgagaggggtcacccaaccccgctattccagaacagaaaagtgattttcattcaggcctggggttccggggagctggttctagtcctgattctgagcagtgggcctcaggcagccctgagcctccctgagaagagtcacagctgactgtcctgggatgtgtgctgtgggccgcgcaagcgccgtttctcttcggcctcacagcaacccactgggatcggcagtcctatattcccattttacagatgagcaagctgaggccccgggaggtgagatctttgtcccaggtcacacagctgctcagaggttgagcggggttggaaccttgttcagtctgactcccgcatgca

SEQ ID NO: 56512 - DNA, 1155 bp, Bovine  19866881004519
aaatgagtaaggcagctgtggactcagggtaaatcggtacttttgcctttattttgtgtgggctcgagacccatttcctgcttacattacttaaaacccatatcctgctgctctgtaaaaactggcaggtcagttgccaatttaaaaaaaaaaaaaataataatgttcacacccacaggaaaactctagtttcaaccctcaaggaacttatcactctaattagtttgaaaaatataggaatgggaagaaaatgggatcgttatgcccgagtatacaaaaataaatgtattttctttagaaggaaattgaaggcgaagacaataaacacttggagtatagtgactgagagtctaatagaaaattttaaaagttgaaacagaaggaagcaggaaaataagggaatcggtaaccagttagaccacagtatccgcaactgaaataaacccagaaatcgtagagactcttgggatggtcgagctgaaaatggatctcatagattggttttcactcacccctctcccttgacacacaagtataccaggacccagaaagatgaaacggtcctcccagccatcccctactggctgcagacagagccaggcccagagttcacggctgccacctctccttgccacgctttcttcgcagcaccaagatgagccaggccttcgggtctagttgtaggtcttgtcagttcaccaggatgttgcagaactctttggatgcaagggacagaaaacccggctgaaacttgccataagctcaaaaatcagcacatgtaacgggactttccggataccatgactggatccaaaggctcctgtttgttttaggggcattttcattgtccccttcatctctcccagctggtttttgttttgtttttgttattttactgggttggttttgtttctgggaagcttttccaagtgactaataaagatggccaaccaacagctccagccaatagcctacccagcagaaacacagggatccagatcctgggtgaaggcaggacttgggggtggggcaggggcagagtactgtgattggctagttctggatccgtgtccatccctggatcccgccccccgagccagaaagatgggggcagaaacgatttcatgttcagcatgaagtatcaagtcttcggca

SEQ ID NO: 56513 - DNA, 1799 bp, Bovine  19866881039361
cctccctcctccctccccagagttttctttctcatatgcagtgctttcttcaaaaagaatcacaatagtgatcaaaagacttttgataactgttacacattggttagaaatacagtggctcagcactgcaaaatgaattcttctatacagagaaattgctctgtttctctaaatggaagacaactgtctattagttggtgtctgctgaaccatgcagttagggaaacacagctgtcaggctgacgggtcgaaccagagttactgtgcaggaatccgaaggcagtttaattacaatatttaatcaatgactgtacattgagggttttatgaaacatgctaagtggtggatttcttgttatgtaaggtgatatagatgcctttttaaagaaaatcctatatccctattcaaaattgttcatagaaaaacaaaatgaattcaaatcaatattttttcaaaagtcttaactctaagcatagtaactatagtcttaagatgaggtctatgtgctacattatatagatttacttgtattttgatcctagattatttttttccatttcaaggctcacactcgactctctttgtatgaatgtaaaagccttggatgagcaggtcggagtctgcatttcagaatcactcaggagtacagcttttgacaagacttcttgaatccttgaagttgtgggttatcatccaactcaactgtccagataatactgttttcaagaacaaaaacatgctttatttaaagattctgataagagggattttgggtgtgtgtgaggcgagggcaacatgccactgatgggcaagtgcgatccagcaaccaagcagcaagccgctgtagatccctgtctgggcaccaagggatgcattaggtgttgcagagcaaattgttgattttatatcccaagcaacacagcagtgttactttgttaagacaaagtgcaaggacaaaatggctcaggcccaacagccccgaactgttaaatgcttcattctccaactctgcctggaccctttcttcttcttataacagaaggtgaatgtgagaaggcggcttgagccctccccagtctttactacaacgcgatgcatggagacacactgattttttaacctagaggccattgttttcccatctcctttcaggagagaggatcgtcagaagtcgatcttaacagtaaacatgagacgtaaacatcacatgtacacgtgtgcgcgcgcgcatagatgtataaattgttcttccgcgtgactacaagcaccttgagggcgttttgtttcctgcagccggggcgcagtgcttaacgcacggtggatgctgacaaagcgctgagacccatgagtagggtacacgatgggctggctggaagggaaaagggacaggatgcaagtgcctgcgtcagctggggcctccacaagggcagcgaggtgcatgtgaaggcagggactcatcgtccccgggcatgagtggaggccaggctggggtggcaggaggatcactgggtgaggggtgaggccagctgagtggtagttctgccccagcagctccgagaacctgcgtcacctctctgagctcaggtgtgtgttttatcaaatgcgagtggaagtgtgtccccagtcctccttcaggtcagaggcaagcgtgcacttgaccgtctctgcacagatgcagtcaaaccgaccgcgacgtcaggactttgcggacgacttcccgcatctcctatgatcaaacatctaagtgttgatggagttttgcgtctctgtggagaacgtcccagaattctcctttcct

SEQ ID NO: 56514 - DNA, 1452 bp, Bovine  19866881041827
cgctaagaaaatgcttgggaatttagcaaagttgaagagaatagtaatagaaatgaaatttgatggatttatttgggataaattcagaaactgcatatgatatcaagacttaccaagctaataccacaagtattctcttaaatgttttgaatcatattaagaaatattactttagcatgttactactaaaacccacataaccaaacccaatgacattaatatctgttctcttagttcatgataactataagaaagctttttaaattgagcatataagacgctatatatttttaagtgatctgatttcaataataaagcctctgttggtgaggaatcagtataattcaaagaaataaatatctgcaagtaaaactatggaaaaaattcacattatcaagacctatcgggagaatagtcaaaagtttgtatgatataatttccttggagccatacagactttgtatcaagaaatacctcctgtcttccaaatactgactgatacccaaaatactcttttagagtcacattttaatctcttttatttaaaactttttctgttaaaataaaatatccacaggaagtataagatagtaagttcattaagagatagtaattaatgattaatcatattagtatccttttccaccctacatttccaaacacaccttaatgagaagaagagagtcaggagaaaagaccgtactaagtgttcaaagaggcccagaccagcgaccatgggaactatttgatgctgttggtccgcagcatcctgtagtctcatcttaacacacaaatgctttcatttcagctgcacaggcaaacgatcattttatgaattggttaatcatagggcttcccggtggctcagctggtaaagaacctgcctgccaacgcaggagatgtaagagacgcaggttcgatccctgggttgggaagatacccacgaaaggaaatggtaatcctctccagtatttttgcctggaaaattccatggacagaggagtctcgtgggttaccatctgcggggctgcaaagagttagacacgactgagtgtgcattgggctgcatgcatccacatacacacacacacacatagatactttaaaatacttttccatacatattttaatactgagtacactttcatagtgggtaaacatgtcatatataaaatgtacactctgaacatgtttatatagtctcctcctttcccccttttcctttcccatctgatcattttctttcttactctgaaaagcgataatatacatatataactgaaagaaaattagaaaggaaactctcaaaatatctccctataaaacatatcacaacagctgttagcaaaagaatatattccaaagtagcagaaacagataagaggaacaaacactaaaatgatgaacaatgaaatttgattatttctactcttttttatgacaaatttattg

SEQ ID NO: 56515 - DNA, 776 bp, Bovine  19866881076434
ataactgcttttgtatatactgctgagtgttggatttatgagcttgttaatttaactgactaaacaactaaaaaatttaactgaggtttaaatccttcaatagactgttgcatcctaacaaaatttgttaagaaaacaaagcaaaaaactatatctgaattaaattttaaaaaccgagcttgatgaccagatgctgactctgactcttctagcaccatctttcacacatctaaaggcaccatctactttggtttgtcggtctacacactgaagtgtcgagaggtaatttatcaatttgttgattgttcatggttatcagtcagcagatgggcctgaaattatcgttttacagaccaattcttcaataggaagttttcatatccatactttctcacccctgccaaatcattccaaaacagtacatggatatatcaggggactcataacaaatgtcaaagtcgtttgtttttccagtttttatctgaggacaattccatcactaaatgatcttcaccctctgttcccatcctctctatggataataagagcgttcttaacaattagcagagttccagtaaaaatattttcccctagctaaactgtagtaatggccaagagaaatcgggacaaacatttttttacctgctttactaagtgcacatccaagtacggacatgcaggatgcctgctcaggcatgccccgggctcagcatccatcttcctgttcctttaccacttccagactgacagctaaattactgcacagaaatcgtttt

SEQ ID NO: 56516 - DNA, 892 bp, Bovine  19866881091855
ttatatgtgggatttaaaatatgccacaaatgaacccatctgtgagacagaaacagactcgcagacatagaggacagaccggcagttgccagagggaagggggtcggggaggaatggagtgggagattggggcttgcagatgtgagtctttgtataaagaacggagaaacaacaaggtcctcctgtgtagtacaggaaactatattcaatatcctgtgataaatgacaatgaaaacaatagagaagaagaatgtatatatatgcgtgtgtgtatatatacgtatgtatatctgaatcacatcgtacagtactagttaacacaacattgtaaatcaattatacttcaattaaaaaaattaaaaatacgaaactacatatctatgtattacttattctacacaaaataatcctgcagctttcttctctgtgaaacaaggcttgaaaagccctggtgttcgtgcatttgctgttttccatccaggccggaaagaacgcagttggggtcccctatctcagggaactctgaccacggagtatcagaggctgatctcagtcagtacaaacaacaaacaaaaccacagctcagctgggccttgagcccaagaaaaccagccacacacgaactcgcaccatgggggaaggagaaagggggaaaacgttctaaaaacaaacccaggagagaaaaaggcaggctgagaagctggctccacacggactggctcccacatggggtgtgtgggagacaaagcctgagaaagaaaagcttcccttgacttgccaggaaaggagccccaatctcctgacttgactggaaaacactgacaaaggccaagagctctgagtctcctgagaagggagatggctttaattcatgcagcaacacagggttttg

SEQ ID NO: 56517 - DNA, 1010 bp, Bovine  19866881127937
acacagttctacaagtaaagaatcaaagacccttgcgaggttggagccttgcacagggtttccagataagagaagcagtggccactctgttcaatccacccaactaagaggcctcgagagcgtgctccgggtgagcgggaccgcagtgagtgacgcctctgtgacttacaagacccagttagcgaaaaatgtgatgagcaagtgctcagctgcagttgggtgttcttgaacttttgttgtcaagggcacccttgagctagagggtggggattgtgaaaagggagtagggaagaggagacctatcttgcctttttgtaactgccaaagctaatttcagtgattgctttagcaatataacgataaccaagattaaagcaagcaggcatccactttaggatatgagagctggaattttagatttcattataagattgccatttcaacacaatagtaatataatggcaatggatttccattttttctccatttctgttgaaatattatctcataaatatactttgatacaaaagagatctctcaatttcacgagagctccacagctctattttattcttacactgacttatccccaaaatatctttttgatgtacagcttcaatattcttgccaatgtctatgacatcagcaatcaaaaatggcattatttttagttttttttttcccacatacagttgcaggctatccgaaaaaaggggtcctgcttttagtgttcactgaaatgtacttacagtatatttgtgactcatggagctggttgttccaagagggtggaaaatgtagcatctatcaaagaaggtaactttacccagtgcaaacctaaaatgggggctttcctttaagaagggaactaacaccgttaaatattaggatttcttgtactggaagaaagcattgttttcccaaattgtatttcaggaaactgagtttctgagaccacaagctagagagtgtcagagctctgcatgtttcttccccaaggaaggtccaca

SEQ ID NO: 56518 - DNA, 971 bp, Bovine  19866881143636
tgaaagatgttgcctgccgtatgtctcctgaaattaaagggacagcatgattggtgcctaactccccttgcaggagagcaggctggaaaggctgcggtgagagcctgccgcatcccactgggggctgaacaagccttgtgcttcccgtggtcgcacgtggaaacgatggaaaggaccggaaatggcatcatcctggaagggaccccagacggacaagatgtccccagttgtctcctgagacaattgtctaatgagactatttttaatacctggaagtggtccaagtttctttcaaggggaggaagaaaatattcaagataatatggttgacagactatggtattaaaaaaaatgatttcctgacttcagcctgacaagtccaactatttttcaacagactagcttcatttgtgagcttaatcttctttcagtatctccttagtagatctgtaacttacgttgccaacccctgagcctctcctgatactctgagacaatctgaaaagtggcaatcaatatctttttatagaaatgaaaatatttaataggtaactaaatgagaatatcaaaaaacttgcccaaaatgtagaataaaaaggcaaagggattgtaaaatgagaggaagaaaaaaaaagatttagatcaacacagaaggtttaacatctgactatccataattctggaaagagagaaaagacaaagtggatgggaggaacttttgaaaattccaaaaaagaagtttccaggatctgcaggacccaaagttccagaatgaaagggcacaacacacgcttaaatacggttactgaaaaatcagtaagtaaaagatccacatcaaggaacagtactgggatatttcaaaataacagactcagagagcgttccaaaaaggaaagcaagtcatacctcaagtaactggaatcaaagccgatgtcagagtttttaatactcacagttagaagagagagaaa

SEQ ID NO: 56519 - DNA, 781 bp, Bovine  19866881180702
ttcagtttggaggtagagagatatgtattgggtgagttagtttgggttgacatcattaatgatattcaataccaagcagatttgtcaagagcacaaaaagagccagaaatttcattgcacccaaggtgttgaaaaagggaaaaagtgttaaccaggaaagagcagatggacgtcaaactctgtaatcactgaggtgctcagacgttgctttcgcatgaacatatattagtctcaggccttttaatatagactgaaagccctatttagcccagacactaaatatttctattatttaaaagaatacttcattgtaactgagtagtgtttaaaagagtgggctatacagccaaagaaaacaagctttaagaacttaaaattcaaggaattttgaatgcaactggaatgcttataatttctcatttctcacataggataaagtttgatattttaagatacgttttctgtttcaacagtgaaataggatttcaataaagaagtatgacttctgtccccttctccatgcctttaaaaagcttggtaatgctgaaattcagaaatacgggtgacacataccgtaaggcttgagttttggttccatctatattttgttgtgacagccaaaaagaagcaaagtcagtttggtcagatatgaaggaaacaaagacatttggtagaaatctttttttttcttttgcatgtggatgttgaagtttgaagagctttataggttgtaaacatattccttgttgaattttactggggattgcatgtttccagcaga

SEQ ID NO: 56520 - DNA, 1390 bp, Bovine  19866881183934
tacaactgctatctcctacctcttagcttctgaaagctttgatgagtgtggggggtcttcactttatttttttaagatttagtctccctgccctgaactggatttagggtaattgtgtatctacttgagggctgaatgcaatctctagcctttttcataaagtttatggccctggtgcccctttaaaagtctcctgtggctgactgatgggctcatttctgatactaactataaaggattggccatcttgaagatcagccgctcctccccggagcatctcagcggggaagggcagccgccttacggacaaggcccgtgttatggatggtgcttccagcctcgagcaggttcatccttcagcagtccaggctctgccctgcaccgaaggactgctccacggggcacgtgagctcagccacgtcctttagctaacaggcgtcagaggaccgagacatcatcagcggtgggagggataacgtgacagctaacaccccaattcccaacttgtgttcattttctcttggcgtcgttagtctaaagagaggtcggcacacccacagagccttcatcgttcaagaattcgagccttttgatttaatctaatttttctcagattttacccattaagaacgtgttctcagttttcatgtcaatctgccttttctcctcaagctgtctttcaaaaatatcttcgtgggacaaacagtgtgatgagtgagtctcccctactcctaccacttgtatgttctgggtcaaaatggcacttgaattcccagggaagcataaaaatgggagaggagatggctggaggtggggagagaaggtggaaaggagagtgagtgagacagagagacagggaggcagagagaaggaggcagggagaggagaggggagagagagagcgcggactggaggctgaggaaggcaggagaggagggattttaggagggttaccatttaagttttaactgaagatttaattccctgcaggaaggggagttaatttgcccttgttaaaaaccaagatatgaaagatgccacccaagagtggttggtgaccaccgggcagcctagcaggtatgatgagcagccgaagggaggagtcagagaccagtgcacacacagggggtgggggggatcacacgtgtggggagaaagggtgatcctccattcaaatattcactgaaggttttacatggcgggcatgacactgagactcggattatcagagctcaaagacaagctttggctgtgagatagccaacgcgcataaggaacccacactttaagcaatggaaacaccagcagtataaccaaaccattacacccaaacactaaaagtcacaaaaggcatttagagacgctggcagcatcgcgcacccacccctgc

SEQ ID NO: 56521 - DNA, 1720 bp, Bovine  19866881233185
aataagtctttaaaaaaaatgtatcccagggctcccgtggcggctcagtgtaaagaatccatctgctaacacgggaagacacggatttgatccctgctccgggaaaaatgccacatgctgcagagcaactaagcctggagccccagctactgagcctgtgctctagagcccggagccccagctactgagcctgcgagccgtaacacgcaagcctgcaggccctagagcccctgctctgcagcaacagaggccacagcactgagaaactctcgcaccgtaacaaggagtagcccccactggccacacctagagagaagcccaggcagcaaagccccagcacagcctaaaataaataaagaagtaagtaaataaaaatactttgaaaagtatccactttacaattatgtaaggcgtgaatcacatagaaactcagaagttttgacatcagccatggaactaaaggttgttgaggggttcctcttcaggaaagaaccaagtgggccaattatacagtcaaaggaatgaaagtcagatatctgtgggcaggtaaaggactctgagtgagtcagagaggaaaaatcagaacagcctggggacagatgggcattggtttggataacttaaatgcagctcaacttcaaagggggggaaaaaaaggtagggagatcccattccagagaactttttggagcctggaccgcagtcagcctccatctgccccgggatggcttcctgcatgggcaggcctgcctgaggagtaaggacacactagtgggattcaccctggtgatgaatggcactaatgcatcatcaggatgacaggccacactggcgatgtcttgccaaggagcttaatgagagcaatagctcattctgattattctcccatgaaaggagggctctgtcttcagaagaactcatctacaagttgactctgtttaattacaggatacaacacacactaatagtaatgttaagatgttctttggcaccaaggttttggcactgataaaactaaaatttatgactctactctgtacacttggaaacattcacacagtgtgcatagtcttgaaatgagaagcgaggtaccctggaatccacttggtttctagctaggctggaaaaatgaatttctactgtagatctctcaatagatgcttcaaagatacagatttatgtacttgtgtcaatcaagctgtcctggaagttgcatttgattcacaagagatgaaggagggaggagaagtactgtgacttcccttggtgacaggcagaaactgtttattatacaaattgaatcttcacaatgacatcactttcacgcagactgcacctaacaataagcccaccaatgtcttaagcttgagtggaatttcgatagtaccagtgtcagcctaagaaagcaataaagcacgacgataaagaagaggaggattatttattaaacttctaataacaaccactaccatcttcaacctgcctgttttgtgtcaggtaagctattgggtgtttctcaggtgttccctctaatctttacagcaaggaaggtcacaggatcacttccactttacagataaagagactgagggtctgcgagtttacatatctcccctaaggtctagtaaagagatggctcagaatctgactgggtctgaaccatccactgtacaaaagctcagtccctgagaagatactgtttggggccagaaaagaggag

SEQ ID NO: 56522 - DNA, 1361 bp, Bovine  19866881260330
taacaggtaagctattttcttatttccgaaagttcagtaagggatccatgaacatgtgatcagaattctgttccgatgttctacatgttcatggtggtgtctggaaagttctcacgttcaccagatctcatccctaagacaaggaaatgtttcagttgctgacagtgttcccagcatgtaacacacgggtactgatgacggtttctggtaggttctgcagacctgtcagagcgttgcctctttcataggagaagttgaggggatgtctgcctcaggacacgatttccgcccttgtttctactgggtttctggcctcctgcagaataagtcgagtccctctacgtaagaagactttttttccagatacagagtggggtgatcacagtgtccatggggtgttaggtaagttttttgtaaagtgaatgacccctgtataacgtgagcagtccccttcagggagttgggtcttggcaagtttcatgtgaaacagtaggggagagaccaaaagcgcctgtttaaagactgaggaattgaagattcctggaactgaaatgacttgtccagtgtcggtggctaatcagggttgtgtcagaaatagcactcaggcatcctggttctgagcagagggcccttgtttccttagagagcattctcaccagctgagctgaacaaacgacagattaggagcttctagaagtcagggtctaccccagcatattgtccagttccctcaaaacacgcttaacaagcgctttttgaaaatgatgagaaaatagcttacctatcacttccctgtttgaatggagcgtcagccctcacacacgctttcagaattaaaagggggaagaacaaccatcaaacttctgcagcaatttttgtaaactcttcctttcttccttgggacctgttggtgacattgcctaatttttaaaatgggtcatttgtagcaatagaagttagcggggaaatctctcaatctctcgttcccattcccgtataaagtacagtttgaaaactgcctcttaaaaagttctagcagtccgtcctaggggcaatgcctgaggctgatgcccatttagttttctgtggggttccgctgctgtgccctcgatacaggagaggttgctcactgaagctaggagggaaagtgcttagagtcgagggaagtgttttgaggcatctgagcagcatcttgccgtcacagctaagccggccgctgcctttcccgccacactctgtgcagctgacccgcacgtggctttcagaggcgcatgagccagggtgctcgcctgacggtgctcctggagccagatgcatggccaaggcagggtgacctacttccgttaccacagcacccagca

SEQ ID NO: 56523 - DNA, 1786 bp, Bovine  19866881277922
acgcttactccttggaagaaaagcttgaccacctagacagcatattaaaaagcagagacagtactttgctgacaaaggtccgtctagtcaaagctatggtttttccagtggaccataaagaatgctgagcacagaagaattgatgcttttgaactgtggtgttggagaagacttttgagagtcccttggactgaaagaaggtcaaactagccaatcctaaaggaagtcaaccctgaatattcattgtaaagactgatgctgaagctgaagctgcaatactttgagagtcgactcattggaaaaaaccctgatgctgggaatgattgaaggcagaaggagaaggggaaggcagaggatgagatggttggatggcatcaccaactcgatggacatgagtttgagtaatctcctgtagttggtgatggacaaggaggcctagtgtgctgcagtccatggggtcacaaagagtcggacacaactgagcgactgaactaaactgagtgcagtgataaggcagagtcctcgttcctcctcaagggatgtacactgaacagtctcacacagatctctgagttcttctggaggaataaggcccccacccagatgaaggatggtgacttgggactgaacacagtatgtgaactcagaactggctggacccagaaggctgatgattgagatcctggaacctcaccctgttacctccctcaccaaccagtcagaggaaggtcagacactcggcagccctcccctccaaatttgcccttccttgataaccgttggggagtttgggtcttttcagcgtgagccgccagcattctttgctctgcccaacaataaacctttctctgctccacactcagacgtgtccgtttgtttggcctcaccgtgcatcaggcacatgaatacagcctgtaaatgacaactcagtaatgctatttttcagaacagtgaactgtgttcatttaaaaatatttttattttttctatgttgattctcatcactgtaagataaagacaatcaatgaaatactgtttcttttctgatatatgttggattctcttagccgtcatggatgtttccgctttctcaattcagtgggcaagcttcaccctgaaactaacagcctgcaggcattggctgaggatactaacatccaaaaacaatagaaagctcagttggtaaatgcaaatcaatagcactggctgatgagtccacgtgagtgaaaagagatttgtaagatggagtgtcttcacgttagccattaaacctcccattcaccaggtcttcatcaaatgcctgtcttcagtggggcaattgaacctaagacatcagacatgtttgaattatggagatcgataactccactgctagtcctgggcacaggttaaaaggagctgagcgtaatatcccccagaaaatgatgtaaggagagatagcagccagtgcctggagatactctcttagagctactgccacagatgaggttgtagacgctaaagtatattcgaaaagacaccccaaaccccatatgttaaaatgctgggaaactcactcaagcatcagatttgagaactaagtggatgtgtgggatttttaaaaagttacttgtttaggctgcacctactcttcactgcagcacgcaggcccgttaggtgcggcatgtgggatctagttacttatccagggccctgtgttgggagtgcggagccacagccgctgaaccaccggggaagaagtccctgtgtgtttacacaggccctgtgtgtgtgtgtgtgggtgggt

SEQ ID NO: 56524 - DNA, 1058 bp, Bovine  19866881310097
tcttgaggtttcctatacttttctgacctgtgggcgaacctctttgcatcttatgaagcaggctgagtggtcataaaaacattcaaggctgccttagttataaagtctaatatgttatgcagagagaaatcatattgatgcaattataagtagttttttttttctttttttttttagaaaaggaaagatcagcagtgcctacttttccttccctctctctgaacttcatggtaggaacaaactttctttctgggcaaaggcattccttctgaatctattaatacatcactaaaaagtttcttatttttcctcctttctccctttgcttctctgtttctccctccttccttccttcctgtcttctttctctcccttctctctttcttcctttccacttccaagttctgatggaagtttttttttttttcctagttatttgaaaaaaaaaaaaaaactcattgcattttacatctactctgacaattctcaagttacaagcctctgaagtgtgcttggcctgctgctgggtgtatttattaccgataataaatgagttgctggtgtgagaatgcaaattttatgtggtccatgtataaatgagcccgttatgaatgagcagatacacgtcttatgtgactgctaaataacaatgccgtagaaatacagcttgtgaattcaacattaaagaaagaaatggttccggataatgttagaacaagtattagtcaaaacgtggttttagtgagttaaggtcataaaaagaggacaaagaaaacgtctggtgtctgggtcttagaaagagaccgggaagcttaggctgaccaggaccgctctaccctcatctcactacagtaggaagacacatctcattcacaaaattgctcttatgttttcaacatctccatctttgcggatggtattcgatgaaggacgtctgaagttgtgtctatagatagccacaaaacatgacgtcagagctgcgaaagtggcgtcaggggacagcggcgtgccagaggaggagcctgacgtaaccgtggggctcacgtctggtgggggaa

SEQ ID NO: 56525 - DNA, 1054 bp, Bovine  19866881323936
tgtcggcaatcagtgagctcactatttatcctcattaacccaaagtctgcatattagagcccgcctgtccacaccttccgcttacctgaggcaagagtgggaaaacaaagacagtaaaagctaatgtccctgtgggctaagataattagctgcaatcctttttccccccttgaagccagttctagtcatcagttgaagtgctacataaatgctaaggctcccttattgctttataaagttaatccatcccagggtgagactggtttattgattgattatgtggcagtgaagggaagcagaggtgtgaactccaggcactactgtgcgttcactagagccatgtcgactttaaacaacattgagatgctgttattccccaatcagatgggcagaggtagaaaagcttgatcagtatcgcacgggtcaggatgtacgggaaacaggcacttttatacactctggatgggagcataaattgttaagagatcagtggagggtgtttccgcaggggggcgccaggcaggtgcggttcccgggggcagggattgctaccgaatcctccctttgttctagcaactcagcttctgtgaattcatcctacaaatctctcacaaaatttaacaaagataaaagggcaaagttatgttgtggttaacaacgcaattatcagtcataggagaacgcattacgtcatgcagtgaatacagctagatgtgtacatctgtcccctctttttcagatttccttcccatttaggtcaccacagaacgctgagcagagttctctgtgctacatggtaggtcctcattagttacccattttatacttggtagtgggtatacatcagccccaatccgtttatgcattcttctgtggatggacatttaggttgcttacatgtcctgactattgtaaatagtgctccagtgaacagtgggatgcacatatcttttggaattatggttttctctgggtatatgccccagagtaggattgctgtaaatgtaaggctagatgctataaaactcttagaggaaaacataggcagaacgtt

SEQ ID NO: 56526 - DNA, 1061 bp, Bovine  19866881375665
caagcctctgtcgcaactgcccagcttcgctgttctgctgaaaaagcaggcacagacattacgtgaacacatgtgtgtgactttgttccaatagaacttcatttataaagacaagaagcaagaaacgtttgtgctacaggttatagttttgtaactcctacactacagaaagaaaaaagttattttagaaaactgtgatggttgagaaggaagcgtgatgaatatcctgcgtgtagagaggagggaactactctgagtgttcaccattagatgtgatctcggacgagccaggtgggctccttgacctcttgagtaaagcaggtttactaatgccgagattgtagggttattttgaaaactaaatgaatttatgtaactcagtggttagtacatgagaaagttctcttccccccagggaggggattaatgcaggacttttgtactcatgtaggtgaagcacttgggcaaggaaaaattgcccaaatttactggtgtctcagcctgtccaagtcttgtcccatgtagatccctttagaaaccgtgttctcagactgttggcgaagtttgggtaaacatgactataccagaatgatcctgagatttcctgaggaaggattaacatgcttcgcatggaattttgcaataaaggaaacactatagtttaattcatagtgatttaaggagatggaagattttttagaggggaaatctaattatagtgaaaataaaatttcatttgcccatcatttccttcattattcattattttttattgggaagataagtatgtacaaagaataggaaagaaaaacatattagagtgtactaggaaaaataaggaattaatgtaatgctacttaactataaatttctcatattataatcatattttaatttatcttcaagggaacctattgggtaagttgaattggttattttaagacagaatttctagtagcagttccaaagtaactagtattgcttgttctaattcattttgaattaaggtattttttaggacttgataaatttgtttttttctctgcggtatgtttcattca

SEQ ID NO: 56527 - DNA, 651 bp, Bovine  19866881500646
tatgttttcttggaaaaatgtgtgtatctgggatgtgacaggagttgcaaccttaaacaagatttctaggcatttatggtttaaccatgccagtgaaaatatgttatgtagacattaaaatcctagggtgcccacgtacatatcctaaataatgtgtgttacatgagctttcttggccactgtgctttagcttggaaggtttttagttctggctcctggagtgctgttagtgtactgcagggaaaggtgaactcaaatggtgagtcttatttgcggttcagcacgttgggtggcgtgtttcttaggttcaggagaattgtgtctgatgtaggtaaaagttgcatcacaattgataaggtaaaactccttgcttttattgcccctagcagcagagaggttactgatgggcgattggaagaggaaaaagacagcaggtttcctcgtcagtcactattcattcatctgcgtgttaacaagcatcactcaatttcccattctctgcagagctgtgtgggaagatgggtaagcagagaggggaaggcggggaccctgtgctcctggagcctaaagtttgatttttttcatctgagtgtcaaaaaatcaagataaatttcttcttcggtcaaattgtaacacccaaaagttaataaa

SEQ ID NO: 56528 - DNA, 1420 bp, Bovine  19866881887664
caaatggaggtacttttttaactaacagatttatgtatgtcctacgtcattgaggaaaataaattttactaacttacaaaaaattcataattcaactttttagaattgtaaaggaggacatctggggaagggcttcctaggtggctcagtggtaagtattctatctgccaattctggagatgtggatttgatctctgggtcaggaagatcccctggagaaggaaatggcaacccacgccagtattcttgcctgggaaaccccatggacagaggagcctggcgggctacagtccacaaaagagtcagacaagttagcaactaaaacaacagcaaaacaacaacaagaacgctggggaaagagaaaataagtgcggggaagtgggttgaaaccagtatgaggccagggcaaggaagggcatcccccaaggtaggtcctcagtgtcgctcggatgatgtgaagtcctgtcccaagaagagggtccacagagtcacgtggacgacaggcttcataacacagaaccatctagccccccagagaacacgtacaactgtatcgccaagggcaggccgacaacacggtaaatctgactctgttcatgagtttgtgtttttaataacatctctcaatgcaggccaaattaatcattccagggttcagtccgtgaaggcgggtccctgtggggatcccaagcaaagtctccaggtacatatagctctcttgcaatctgaacttaatccaaaaataaatatgagtgtgtcaagaccaaaaaaaaaaaggccttcatagccttcaggcaattctccataaaaactgttttctttagccaaagacttttgtcagccgtgagaagccatgaatctgaggttatactctcctgacaaggacctacggagtcaaaggagcaggactttccctcacagaacaattctgagtcggttccaacagtcaccaagttacggaaaagtgtagaacagcgtatttaaaagtgtgggttttggagccagaaaaaaacctccatggggacccagccagtgaccccgggctaaaaccacctcctctcatcttctcttggtgaggctctgcccatcttacctgcctggaagcatggccagcatgtggactgaatcgaagcccacgtggaaggtcctttgcccagatcctggatcagactcagtttttcccaaagcttcagtcagttgactgataagggggcaaggggtttgaggaagaggaggaatatgaagaaggtgaagaaaaagcggaaatgataaataatacgtgtgctgtgcttagctgctcagttgtggccgactctttgcgaccccgtgcagcgtagccctccaggctcctctgtccatggggattctccaggcaagaatactggagtgggctgcatacataggacatacataattcctc

SEQ ID NO: 56529 - DNA, 1508 bp, Bovine  19866880828525
attatacagtctctgaacatattcacgtcttattaaatttcaaataagatcttcatctctaattccattttacaagaaaggatgtaaaatttctattcaattaattatgtcaacttaatctcaataagcctttattcagctcaaggagccaaactgtgtctgaagtctttttcttacaaatgagcacatttactatttcctcttttccccctgctgtttcttttcaataaagttaaatgtccccagtcaatcacagttaaataatttcctcctaaactagtcagtatcaatcaattatgataaattaagactgacaagggataaaccaaggattgatgtacgggcaaattgaaacaaaagaaggcttcagtggaaaggaagtaattacaaatagtggaaagttaccctttataaattaaaaagcaaaatattttattataaaaaatcattttaattatatatacacatgtgtgtgtatatatatacacacatgcacacataagcaaatagttatttttcaatcttcaaaatatttccagcctgctacactagtataagttgaaaatcaataggatataagcttcgctttttttttccatttcctataaaatatatccacttactgcaattactttcacctgttcttttgtagatgaaaaattaatcagctactctaagaaagcagtggaaaattttatttgagccaaattgtggattataacctaggaacagcctgagaactgttatagccattagaagttgaagcatagctatacaagttttttaagggggctgtacattaaatgacattttactggcagtttgagcctggcatgctgcagttcatggggctgcagagttggacacaacttagcaactgaacaacaacaacacaacccagatctaagcctacaaagccagtagtgggccatgggtcatcatggacccttccaagattaagaaggaacattatcttcaaggagtggtcttgttggtgctgaagaaaggttgaacaggtatttctatgagtaagtttggttgatgcaaaatgaagatacacaatatacagtaaagtctggagaggaagctaaagggaagggaattttttatgtttaaatttttcttgtcttgccattaaaataagaattttatttcacactctggtcatcttcttacatactttacaaataaccttactacttagactaatttcttgtcttttttcatatggtttcttctcaacaagaaatcagttttcaaaagatattgtagttttatgtaaagaatcttaacttcagcagtcaaataaaagctatcaccttttctttctccaacatgagagaaaaattatcaaatgaggtcaaaattagttgcatatatggtgtgttttcaaagatgcattttatgaattatgttaattccttgtacaaataatggaagacgtttcattgaattatataaaagtagaatataatcataacatggattttacattatgaatagtgata

SEQ ID NO: 56530 - DNA, 1225 bp, Bovine  19866880900809
gtacattaattatgatcgtatgtttgtaagattgtaaaaaaaatatttaattttgaattacttgatttatgatccaaaagataaattattaaatcttgattatagcaaggggttgaatagccagaagagaggaaataaacataggcagaggaagtagagacaaaatgaacattgtttctacacatagttcatcacatccttatgttcaagtgctttatttatactatcaccagaaaattcactttgttctttcatgtgttaatcttccaaagctcttcctattgcttgaagcacatggagattggcaccttcatatttttcctaaattacacttttttccctcagaatgcttattcattctagtatttctgcaagcaagactatgttaatatcctgtaagcagagaaaatgcagccatgtcaaatattgtagggatactattagaccactgagttagttcataatacatttaacctggttctatataagttatgaatacaatcacacaccagcatggcaggattatatattggcatatacagtgaaaagaatcacacaaaccaatgttaacattaaataaggaaataaattaagagtagaaagtattaggactgaaagtaatgacagttttgcattcatgagcaatcctgatttgctttcccagtatcattactcagcagagtctgtaaatgtgacattttgatgaaggttgtctttatgtgattggttgctttcattttttaggtgttagaaacagtccaagaaacaaaataatatatcaagcagtgcaagagaaaatgaattcagggaactttatgcatagtgttttgagtgatgaaggcaaacttgctggaaaaaaaattatactagctaatatatagtcagctaataaaaagaataaataattctccaaatcagtgatatttagaaacagaaaatagtattaatatattcatccatttggtcaatgaatattattttttattacctagtctcctaaaatagaatcttattcaccaaagcacatgtctttctctccatgttgtacatacttgacaaaatctttgataaacagaaaacagtgctaaatattgttaaatctggcataacaatcaagatggctatttgttaaaattgtgtgcaaatgtttagtaacaggatttgaacaagcttacatattttggttcttaatgtaaatcaaatgaataacagttattttaatgca

SEQ ID NO: 56531 - DNA, 4744 bp, Bovine  19866880986575
acttcactttcacttttcactttcatgcatggagaaggaaatggcaacccactccagtgttcttgccttgagaatcccagggacaggggagtctggtgggctgccgtctatggggtcgcatagagtcagacacgactgaagcgacttaccagttaccagtgaatcagtggcaaagaatctgcctgcaatgcaggagacacaggatacatgagttcagttcctggtccggaagatcccctggaggaggaaattaatttgctgattgtctagtgtttatgtgtgtgtgtgtgtgtgtgtgtgtgtgtgtgtgtgtgtgtgttggtttgcttttgttgttattaagagtaagaataatgctgtttcaagctttttatgttctacactgaagtcaaaagtcacatagtcatttagctagattttgaagaattttcagcattgaaggcacttgtttccaaaattcagattagtttccctccttctggtttagtggaatggtaaaaatctccacccaacacatcttatttgagctgagcttttccccgactccttgcaagactagtaatgacattgctattcagatacaagggactagaaatagatttgcgatgatcctggataagaaaaagttcagactcttaatgaggaaagtgggaatatagatgaaaagaaatggtggattcaaaaagcagaagagaattaatttaatgacatttatttatgaggtacttaagaagtaaatgatgaaaataatacccatttttttttctttgtgtgactatggagagtgtgaaagtcttacttatagcaagttatacaagtgaagtaaaaaattgggggaagaagacaaatagtagacattgagctctttttttgtgtatatgaattaagctgctgtttttcagaggtattgtttaatctttgcaattaccctttattctttaactttttatttatttacttttggctgtgctgggtctttgtctagttgtggcaagcaagggccactttctagttgttacacccaggcttctcattgcagtggcttctcttactgcagagcacagactcgggtgcatgggcttcaatagttgtggcacatggactcagtagttgcagctcccaggctctagagtgcaagctcaatagttgtgacgcacagacttagttgctccacagcatttgggaatgtttgtggatgggggattaaacccctgtcttctgcattggtaggtagattctttaccactgagtcaccaggaaagacctaagtatttattactttgatcacatttcacagattgggaaactcagttttaagggaattgagtagctatgatactacatggcagaatagagaatacacagtaacacttgccaaggtttgtaatccttgacagtaatgaagttttgaaagtgaaagtgttagtcactcagtcatgaccgaatctttgtgatcccatgaactgtaactcaccaggctcctctgtccatgaaattcttcaggcaagattactggagtgggcagccattcgcttccctagggtttcttcccaacctagggatcaaacctgggtctcccgcattgcaggcagattctttaccattggagacaccaggagggcaagacaattcctggggggaattgtgctatgcattacaggatccctgagcactacttaatagatgccagtagcaactaccttcccactcaattgtgacaaccaaaaatatctccagatattgcaaaagccccccaggggaaaatatttgccccattttgagactcttgagagttggtgatggacagggaggcctggcatgctgcagttcatggagtcgcaaagagtcagacacgactgagcaactgaactgaactgggctgagaaccatcaatctaatctcccttactccaaactttcagctgttaatgagtcttatctattgcctcctgaagttcagtgtgtatctttgaatttgacattaatagattataagtattgtagctaattctaaatggaagcaatggtataaaatagcatataagcattatcagaaatttgagaaaatgaatgaaattgtcttggtctgatggcaattttaatatctctagcatatgcataattagtgatactaaagaatttcacctaacccattttgtttcatattagattttattagcacaattaagctgctctttaaaatccataaaagtccatctgtctgtagtctagagtcaggcacatctttttcaaggtcattttataaattgataattaaccttctaaatatagatacttcatactaaagttcttttgccatatctaattaaagcaaagcaattgcatttatatctcccaaaagatatgtggtttgcatttattttagcattacaattaaaatgatgatttattggttttcctaaaaataaaatggtgcatgtaaacaacatctgttaagatactcacagtagtatttgtgtataattattaatagtccattattaagcacctacttgttggaatcatagatttatagatttcaaaagagatcatccagaaaaatactaaatgggaaaaacagagtcaaacagctgttaaaaattcaaacatgaaaagaaagtcatggcctactgaattccatgtagaattccaacttggtatggaattccaagttggtgtaagattgagaaagaagatgactaaaaagtactattgaggaaaaagccagctaagcacaagttaaaggaagattagttgaacaacaaagtaaagtaagttactatgtaaggatgaaattaagatattaagaaatacatttattgttgtttagctcttaagtaataaaggaagtccctgctctctggtggctcagtgataaagaatccagctgccaagcaggagatgtgggttcatcccagggctgagaagatcctttggagaaggaaatggcaacccactcccatattcttgcctgggaaatcccagggacagaggaacctggcgggctacagtccatagggttgcaaagagtcagatgcaactcagcatgtgtgcattagttactggagaattgaaggaatgcagttaaaatataagaggccacaatacaaagagccacaatgttattttgaagttgaactgcttttgtagtcagttgtctgcatattttaattaaagatccaatacacattgataactgcagaaacttgggaggcctttaaactgcagttccttcactggtaaatagtgatgtccatatttaccttgcaaaatatctatgaggacaaggatttgttgtgcttaagtaaggctagtactggccttcaattcaacagaagagtatcaagggtcataagtctaactgtagtgatcagaagtattcaaaacaaaggatataaatagtgagctatattttctcaactattaacacttgttgaatgtaggatggtttaatataaagtattaagtttatacttacaatataattaatattctaaactgggaaacatttttaatttttgagataaagcttaagtaaatacaatgtagaaaggatattataatcgtctataaacaattttcaatgcatgatcagcctacttttacacatatccccacccaatttcccttctctacatagtgtaaattaatatgaaacagatacaaattagagaatcattttagtttaaatataccagcatatgttctataaaacagtttctttaaaaaacatgaaatataccctcaataaaattaccacatcaaaaaaaaccccttttaaatatcagaaaatatagagacattgttcacaagtacacattataaatctgtttttaatttcttttttatcagtttgacggcaaaattaagtgatacctgtgtatataattgaatgatacggccctcaagtctcttttttcttttactttctcattttttaaaatttgtaatacaatttacatttagtaaatttcacagatcttatgtgtacatttgaagagttttacatatatataatttctaagtctgcttatctatcaactaaaacttacaagattttatttactccagagaatttctttttcttttcaatagtatattaactggttttaagtaattttttgcttgtttgttttggacagataaacctggcttgctgcagtccacggggtctcaaagagtcagacacaacaactgagtgactgaaccgaatttagatataattgacacataaaattgtgtaagcctaagttgtatactatattgatttaatgtatttctatattgcagtatgattaccacttcagcagtagctaaaagcatttctttatgtaccttttagggggcaattttttccccccagaagcaatcacaaaccacatttctgatttctctaaatacagaacagttttcactgttccaaaattcctttgtgcttcacttagctcttccacttactcaaaccctggaaatcatggtatttttatcatcctcatagttttgtcttctcatatatgtggcatagttaaaagtatacagtaagtgatctttttaaattgcttccttcatttagcaaagtataatagcttctttcacttagatatgtacttcatatcttgtcatggctggctagttcatttctttttattactgactaatattccattgtatggatataaaaacagcattttgtttatccattcatcagttgagagacttgttgactgctatcatttggcaactcg

SEQ ID NO: 56532 - DNA, 1598 bp, Bovine  19866881016890
aaatttggttacattggacacatttcctaggtcaggcccctcagctcaccatttgaaacaattctcctctgaggcacctatttcatgagatctggtaacatgcattttgaaagtgtacagctctagttatttctaccaagtttatagagaacatctgggtggatacaagccactcatttttctgatacataaggttatgaagcaggaattctctgttccttgtttcctcattcccaccaggtatccacacaccactggggtgtattctccaaatattcatataagagatggaggtgagagaagatattattttacttcattatggaatttttttaatgtagttttcatccttacttaggaaacaagttctccagtctagcaatagcaaaaaaaaaaagaaaagaaaaaaaaatgatatttttattcccatttgaagaatatgactataaatgaaactctaattaattagaatttgttagtgaggagtgataattaatgaggttctcctggacctcctatagtgtagaaattaattaaataacaaattaaaaaacgattttccacattttcaaatggggttaccaccttcactaaattactttctatattgttgattttttgcctttaccattgtactggtggtagaactgaaaatctggacactaaatgcctcaatctattcttcattaaatacaaaaaattatccccccataagatatgttactttcccctcaaatgtatatttttgagtatttaaagttattgctctaattttgctaaatccacatttgtgttttttctcattttggaagctagtattgaaaatgtatagctgtcaaccattttgcatagtagctaacatagtactcatttagacaactgatgatgtcatactgaaacactgagttgctgaaacactcatcatgtctaagtagagaaatgggctatggagtcagaactacatgtatcccggttctgtcactgactacacctgtgcaggtagatcagttattgggtctttttacacttacttgtacttaggttcagttcagttcagttcagtcgctcagcgtgtccgtacttaggttacctaaagttaataatcattacacaatggtctgctggaacaatatgtatctatctttaaataatattgtatcctgtcattgaattccaatatttaaattgtcaaaggttaatatttgcttttagataactaaaatgaaggcccatttatgtgaacagtatctgctgctgctgctgctgctaagttgcttcagtcgtgtccgactctgtgtgaccccagagactacaggccaccagactcccctgtccctgggattctccaggcaaggacactggagtgggttgccattataacttaggactgtttaaaccactgggtttagggttttgtttgtatggtgattcatttgtaattggtttgaagagaaccagtttttttctctatataaattacttgaagacacagaatacataaattataaaagaataatagattcaagacaagatcttctcataagataccacttaccatatgcatatggagaaacattacaaattaattacgagacaaa

SEQ ID NO: 56533 - DNA, 810 bp, Bovine  19866881158256
tcgctcagtcatgtctgactctttgcaaccccatggactatacagtacatagaattatccaagccagaatactggagtgggtagcctttcccttctccaggggatcttttagctcctaattataaacgtgtgttttgtttcaaattcttacccgaatataaggacttcctaggtggctcagaccataaagaatctacacacaatgcaggagacctgggttcgatcctggcttgggaagatcccctagatcttcaaattcttatgttttatctctctcttttttttttttttgtattttttattattgaatagtacaggtcatgaactagagaacagtagttataatgaaaattcctgcttcctttctgaaattatatattattgaactatccactgaaggtgttacctttggggtacaagtatctgtgcaatgatatgtaatccaaccttccattttgttgcctccatattattgattcttccatccccaattcatgcctaattaaaattcaaaagtatagaccacagggataaacaagaaacatggagggaattgatcctttcaatgctacttaaatctcaaaactagtcattttctttatagcactttttggctttatagcacagcctaattttaaattatttatcttctatctttcagattttttaaaatataatccataggcaggaacgcaatttttaattatattctccaagcctttgactttttttttcattttcttactagtgctttttgaagaacaaactatggtaatatcaataaattctaatttgctatgagtttttaaa

SEQ ID NO: 56534 - DNA, 4308 bp, Bovine  19866880348415
tgggagctgtttccggcactatgacataagcaggaatccctgggagggagaaacaacgtttagttagtacaaatttactacttgttagtacaagtttaggatagaaatctctgttcagttcgcttgtaatcgggctgggaaatttatttccatggctatcaccaatctcactgaaagttaaggatacttttccactcctctctgatgaccctactcaggaccctgagaaattagtcaagtaccttccaatctggcagcaaaggagagagcctggccatggtttccgctgctgtgagcaacaacagctctgggcttctcttctggatgggcagaaatcaggcctctgattgcattaagggcaccacgaatctagaaaagagggatggtgaattaatccatttgttctaaatgtttctttaaaaaaaaacaaaaacccaccagctttagatttttctctcccaacactgcacacccagtaaattgtattggttgtacctcctaaatatctcatgttcatcttggccactaccctcggtgaggcttaatttctcaactgggagtttctgatctcagctggtcctgcctcaaggatcattctcatctaatagttccgctagattatgaaaattaccttttaaaaacatgttacctttttcattgattgcctatctgtaagaaaagtacaaattctttaaaagctgcagcctttctaacatacctaatacattactttctaacatgtcagtgtcatagccatcttaagttgctgctagtttcctgccaggttagctcacacctctatttcttgacatgccaatgcctctacctgtagttttttctctccctgatctggctagaagtatcatcctataaaacttggatcaaacatcacctggttcaaccttcttgctctcgcaggcaaaattaggtactccattggcttccatgttccttgtttgtatctttatatctttttatttggactgtgctgcatggcttgcaggatcttagttcctcaaccagggatccaccctgggcctttggcagggaaagcacagggtcctaaccactggatggctagggagttctctctatctctgtaagacacttgtcatcaacctacttttgtcttcccctgaaagtatggctatagggcaaggcctccagtacatacacctggtatagttagtgaaaatatgtgcttgatgtgtgacaagtgaagaacaaaccatgacagaagcaaagggcataaggaaataaagaagtttttgtattgtttaaaagttctcagttaatgggtgccaaaaaaaggtaaatacatgatatcctaaagctaccacttaacaggtactaatacttctcagcacagtccaaaatgtagttttcagatttttacttgaatgaatcttgaagttcattctaatgaatgaagttcaactaatggtcagaaaattctgataatgaagaaacacagaaacctatttttatgcaaaggagaggccctgacatatattacagaaaaaggttttgttatatgagggctgagctaggtgtagaccttttttattcataatgtataaacacatagcaagtgaatgcgtaaacttggctacatccagcgtgatcacacgtgttgcagtcatgtcgcaaggcactggacacgactgaacaacacaggtgtccaagctgacaattgtgctctctgttctgtcattagaagttccccttttcatccccaaacatgtcctaatatggatagtaagctgtgtgtgatcaccttaattataagggattttgagatagtgtaaaagtggctctctggaacaccatgatgctaagtaactaggacttaagcaaaggaaaaatttgacaaccctttctttagctataagaagacatttaattctacctacctcactgggtggtcaggaggatcatatacatttatatgtgaaagtggtttgaaaagaaacatgatacactatcaaaaaggattgttaccttaaaagatccagttttctggaagagttcacatttgaagaaaagattacgtcctgttatttgattcaaaatggaacttgttagtactggtgtgaggtgaataaaatctcgaatgttgatatgagctttttcaacatcagcaaaggagatgcagtactgatcacacatggttctgtaacccaagaataagaagggggtcaaagcaagcctagacgtatgtttaatgaaaaggttttgaaaatgcacaacagacccatggaatgtacatccccaagagtgaaccataatgtaaactatggactttggtggtaatggtctatcaatgcaggttcaactgtaacaaatacaccactctggtgggggatgtcaataacgagggaggctatacatgtgtgtcggagaaggcagtggtaccccactccagtactcttgcctggaaaatcccatggatggaggagcctggtaggctgcagtccatggggtcactaagagtcagacatgactgagcaacttcactttcacttttcactttcatgcactggagaaggaaatggcaacccactccagtgttcttgcctggagaatcccagggacgggggagcctggtgggctgccgtctatggggtcacacagagttggaagtgactgaagcgacttagcagcatatatatatatatatatatatatatatatatatatatacacacacacttagatatacatatatatatttagatatacatgtgtgtgtgtatatatatacttagatatacatatatacttatatatatatatatatatatatttatttagatatacttagatatatatatagctcagtcggtaaagaacctgcctataatgcaggagacccaggtttgattcctgggtttggaagatcccctggaaaagaaaatggcaacccactccagtattcttgcctgaagaatcccatggacagggatgctatagcttttcttccaaggagcaagcgtcttttaatttcatggctgcagtcaccatctgcagtgattttggagccccccaaattaaagtctctcactgtttcccttgtttcctcatgtatttgccatgaagtgatgggactggatgccatgatctttgttttctgaatgttgagctttaagccacctttttcactctcctctttcatcaagaggctgtttagttcttctttgctttctgccataaggggtggtgtcatctgcatatctgaggttattgatatttctcccagcaatcttgactccagcttgtgcttcttccagcctagtgtttctcatgatgtactctgcatataagttaaataagcagggtgacaatatgcagcattgatgtactcctttcccaatgtggaaccagtctgttgctccatgtctagttctaaatgttgcttcctgacctgtatacagatgtctcaagaggcaggtcaggtgatctggtattcccatctcgaagaattttccagtttcttgtgatgcacacagtcaaaggctttggcatagttaataaagcagaagtagatgtttttctggaactccctcgctttttggatgatccaacggatgttagtaatttgatctctggttcctctgccttttataaatccagcttgaacacctggaagttcatggttcacatactgttgaagattagcttggagaattttgagcattactttgctagcatgtgagatgagtgcaaatgtgcagtaatttgagcattctttggcattgcctttcttacatgaagtttaagagcactgttaacaatgttgaataaatttatttcattgtggaaaaaaagatatatgccctctatacccagttttctgagagtttttatcaaaaatggtgactggattttgtcaaaatcttttcttcatcttttgaatagtcatatgatttttatccttcattttgagttaatgtggtacattacagttattgatttgcagaagttgaaccatctttgccctcttggaataaattccattcagtcattatatataactcttttacatactgttgaatttgttaatatttttaaatacttttttgcatctagctcaagaaagcctgtacttttcttcttttgatgtatccttggttagttatggtgtcagggcaatagtagcttcataaaatgcatttgggagtgtttccttctttctaaattttataagagtttgagaagaacaggtaaggaatcttctttgaatgtttggcagattcaccagtgatgccatctgtcttaggactttacttgggggaagatttttttatt

SEQ ID NO: 56535 - DNA, 1728 bp, Bovine  19866880485513
attcactgagtggatgctgtagttgagggattggcagggtctgggtttttttttaggttacaaaatgacatctcccatccactgatcttccatactgtggagcctttttcttttaaggctgtgaggaataacatactccagatagttctgtagatgtcagaacagaaatccctctgacacactaggtccctatgctgctcttcactttggaacgtctgggaatgatctcaagaaagtaggaaggaaatcgcttccacctaacacctctccttcgcgtgttttcattagtctatgcccgcatttgttttctgcaaagtcagattcctcattgatcctaaactaaggtggccagaaagcctgtgcttcagttttcttctcctccagaaatgcctactcccacgttgtctccttgacacatttggacccttgtttaatcgttcttcattccctgtctgcctttcattgtgttaccatgtttccttgcacagtcagtcacttggaagcatcctccacctcctcagggcagttctaaaccacatcatgaggtctccctggttttctcctcttggcccgtattcctcttctttctggtcacattgactgttccttgcaggagccacttaggcacgtatggagcacttgttctgatggtgacaggacttccctgacactgcagagtgacaggggcagggcttcagagccatttgtgcctctgcacacagtggcacttagtaggctggcattggcacgtgggcacgttgacctcccattcgtgtctgttaggagttgtaatggaatggctttgtatccgagatttgggtatggaggtttgtatcagggtgtggaaagttgccttgagccactgtaaaaggcagtgtagagtgctttggtctgtttagaacagatcacagtctttggaggggccatgcacatgttgggggttggaggaggagtggggagcacagattctgtggctttcgtgagaggggaggggcagccactcctgactctgcccagggagcatgaggccgttgtgaacatcaggtggtggagaagagcagagcaacgggcttccgcgagcccacgcgtagcccccttgcatcccaggacctttggcaaggcgaggtcagtgggacaacctacctcatttcagaggctccaccaaagccaaatcttccctcatcttgatctctagttctcagtaagtgaaagagtcaggggactttgagaacatccaaacctagcccagctgtggcagttggtttattgctttcagctggtacttgaacccaggtcctggtcttggaggctttcccaggtttaatccccggagctttctctgcagctgtatgacactgcgctgaccccgaatgaggataggaaaatagaaccggtgccaagccagagtctctttttcatttggagtctggctgtctgcccatgaccagggttacataatgggaaacatagctggggctctggagagcccgcgcttcaccaggctgcccagaccttcgcattctgatgctatatatcttcctaattgtagctcggatgcatttatcacactgttggattggagtactgttaaaaaaaaaaaaccctccagaaattcctggacttgctgcttttccatggtttgccttgtgtagtctacggagcatgctggaaatgacctggagggagccccctgaggtgccgccaccttgggagacgtggggacatgga

SEQ ID NO: 56536 - DNA, 1298 bp, Bovine  19866880505573
tctgagcccgagctccagagcacatgctccacaaaagaaaccaccgcaatgagaaacccacacactgcaagtagagtagcccgtttgctgcaacaagggaaggcccaagggcaacaatgaagacccagtgcagccaaaaaacaaatttaaaaaagtgtgaatgggaaaaccaagaggaagccatccccagaaaggccttctctggactctaaagatgatgccactctgtgtccatcacctccctaaagggacctgtcgactctactcctccctcacctgtaagcttccttgagccgctccaaagccaagatcagcaacttggtgtcatgcttgtaggagagcggggggaaggggatgggtgagaatctacggctttccagccaatgcacagtagtggtatacaccgccaccgcttcctccgctgtgatgtaaggaccgtcctgcaaggtggatatgagaatcagcttcccactgcagcctcatcccaccagggccaggcatggttccaaccctgcagtctgccctcctgctcgcgcccacgcccctagcccagcctactccgtccaacctttaggtagttgtgctgccgctcctgctctgccttcaggtagagccgagtcaggcggcccaggttctttttgcacacagtcttgtctacggtggccccgcggcggatgcgctctcggttgtagtgggcggtgttggtccaccagtcagccttggccttcacgtaccgaagaatcatattctctatcggtgttggcagcccagggacctgaaagtgcaaaaggcacaatgaaaaagtgacagggggctaaagcaatccaggaccggtaatacccaggcccctctatgagccggggagacctccccaccttccagggaatgttggccttccagcagcgccaggcctcactgaggtgctgcaggatcgtccgggccttgttctgcttgatcccctcaggcatcatgtccaggatgtcatgcatcacagcggcccgaagctcaaggtcaaaatgtgactccactcgctgctttgttaccgtcttggccaccccctttgagtgtcggcctagaagtgaaagtggttaaaagccagatttgttgttcctactaaagtctctactttcatatccgttgacaaccatggttacagtgaaatcaggaagtatgaataaagcccagcacatgcaagacacaatacgtctgaaaagattcacaacgatgcttctgaggcatttccatcctacagatgctcgcggccttaaggccccacaataagcccaagaaaagagaat

SEQ ID NO: 56537 - DNA, 1249 bp, Bovine  19866880509111
gtacttgagaaatcctggaatgaggttaccgtgacctgctgttggccatagggctccagctgcactgctgagaacatgaagtttatgttctcagagaagtgcagggtgactgggctgcagattgattttgccctattgggcagaattaatttcagcaggcactcttccaggggcccaggttgacttgtttgtgtgaattagaaaggcagaaaggatcttctttaactgagtctcgtagttctcaatggtcacctaataaacagtgatgttcttggaggatggtatctggccacccatgtcttaactcctagagcagtgagccctgataacgtcgtctcctgtttatatcatggtggcatctggaaaatacactgtggttcccgagtctcagagagagatgcatagatctccctcaccccgactcaggctctgccccatcctgccgagctgcctagcctgagaccagaaccagagcctcagcccactgagaacagagttggctttccaaggggcttaccgagctcttcaagcccaggtactgttcttttgactctaccagacttgttgcattcaggtccgtttctgctgttgcctgctcatttcctccagtttcctccagttgggtgggtggggggagggggtcctgcagggctcccatgggggttggaaccccgagtgaagggtggtggactagaatacgatggtccgtcggcagacaagtttgaaaaagaggatataacgtatcttaagagcaatttctcttgctgtggccttcagcctttcccctttgtggctgtagtccacagaccatctctttttcagttttcttatgcctggcttctgtgccatcttagctgtttccagagctcctcactccaggaaccaaagacccaacttgtttcccatctgtaccgcttctctgatcttccatagctccgaaacacaatgcagggcttcttctcactcaactctttccgggtttgttctgcagctgtggcgtttgaatgttagtgtttaaacaagctggtattacacaggaaatggccacctccacaggcccctgcaggcttgtaacatggggtcattgtacttgatattaatcaccagtcagcctgttcccccagtaaaaatatgaaggggtgtgtgagggctcagtcctcctcagacttgccagaaggatggcctgagccccagtggggccctcgtcctcattctctgaactgtcgtcgcggccccgggggagttagca

SEQ ID NO: 56538 - DNA, 1331 bp, Bovine  19866880521369
tttacagtacatttcatttcttctgctgagatattttccccactgccttgtctgatcttcagaaatcagagcatttcagtgctgaaaaagcacacagaacatcccagtcccattcagtcatttttcagtcaagggtagggaggagccatgaatgatgtcttgccccaaatctcagtaccagaaccaaggaccagcaaaaacccgagtcccagttctcgaccagtgtttcctctattttggcttcctcctgagcctcctcctgccagactcttcctcagccctgctcccacccaggctgacgaggctgccctccggggatggggggcactgtcagggctccaaagaaaggtttggtgctgcagtctgatgcgtgaactgggggtgtgtggcagaaggccagcagtgggttaaagttaacaccaaacaatgatgcaatcacagatgcaatcacagactccaaattgagtgcagatcgctttaagaaaggagtagctgtaatctgaagcctgctggacgctggcttgggaggcagcagaaaaggctctggtgctcacaggagcccctcagtgtgcagacccaggctgggcgcagagcggcggtgcacccacaggtaaagcagctccctgtctagtccgctagtgtatcaggggaagttgggaggctcccctgggctggggtgaccagggtgaggcaggtataactccaggaagcagaaaagaggggtgccagggagaagaggcaggaagaccatagttcctccagcttggggaccagggtgaataggtgagggacggcagagggagttggaggtcagaaggtcagaacccaattatccctaaaccactaggagaagaagctggagaaactgcaccactggaagaagccgggaaaactcttgaatggaatgggttggaaagcagtggaggaaggcagtggaggggaagaagtgagaacgtggctagctgctgggtcaggtctgagcagcagtttggggtggggtgctctgcaaccctcgggaaaagaggctgttgggtgctgtgcctccagtggggagcccattgggcaacctggccatggcttaggcttagctccctgttgccttttcaacatcactggcgctgattttaaaggtaacttctcaacactgcccagcagctggcctgaggggagccctcctggggtgggttggtgtgctgggatggagggcagcggggtccttctctccagggcccaccatttttctttggccaagtcagctgccactacaagctgggagatcaacggggtcttggcctcttgcaaacaatgaccactattgagttcagcctagg

SEQ ID NO: 56539 - DNA, 2644 bp, Bovine  19866880560381
ttcaaaatattttattatttatttggctgcaccaggccttagttgtggcatgcgggatctagttctctggtcagggatcacacctgtgtcccttgcattggaagtgcaaagtcttatccactggagaagtctctccagtgtgtttttaaattcttttttttgagctgtaattcactacacacaattcacccatttaaagtgtatgattcggtggttttagtttattcacagagctgtgtaaccatcaccacagttattaggacattctcgtttcctcagagagaaaccctgcacccatggtagtcactgtctatttctcttgaattttccatgtctaggcagttgctaatctgctttctgtctctatagatttgcctgttttggacatgtcatataaatagtgttgtacagtatgtagtcttttgtggctggcttcttatacttggcacagtgtttttggtattgattcatgttccgtcatgttcttaacataaacagatctccttccccaggcccagtttttggagcttggacaggaggtggttgcacgtttacctctccctgtgttgggggctcctgtgggaggcctttggtggagagccagttggggtgagaggagtggtgctcactcgcccagttggccctgccctgttctctgctcccttggcctcctttgccctcgttcttcagggcttctcttgtcaggcagcccagtttccatagcagatgtagccactgtgtttggccccagagagtttctctctcatcccaggtctctgcccagttcagcaggagctaaacccatgggggttcttctttcagagccaggaaccattgccagatgacgatgaggagtttgagctcccagaatttgtggagccctttctgaaggacacacccctctacacagacaatacagccaatggcatcgccctgctctgggccccccggcccttcaacctacgctctggtcgcactcgccgggccctagacatcccccttgtcaagaactggtaaggcttctacctggggagagtagcggatgtataggattaaagactccagctgggtgggcatatagcctttagcagggcagctggagggagaggtgggccaagctctaatgggtgtgttttttcaggtatcgggagcattgtcctgctgggcagcctgtgaaagtgagggtctcctaccagaagctgcttaagtactatgtgctcaatgccctgaagcaccggcccccgaaagcccaaaagaagaggtgaggtgccctggggcccctgctcagccttcttctgttccagagatgatcaggagattcactctcactccttattcccatcccaggtatctattccgatccttcaaagccaccaaattcttccagtctaccaagctggattgggtggaggtggggctacaggtttgccgccagggctacaacatgctcaaccttctcattcaccgaaagaacctcaactatctgcacctggattacaacttcaaccttaaacctgttaagacgctcaccaccaaggtacttggattggaccttaagggggtcctgggctgagagacgggctggttttgccctggcctcttgggatggtgtgtatccagtccagagcattgctgactaatgttgtttctgtccttggcattttttccaggaaaggaagaaatctcgttttggaaatgctttccatctgtgtcgagaagttctgcgtctaactaagctggtggtggacagtcatgtgcagtatcggttgggcaatgtggatgccttccaggtgaggctaggagtccccagtccctgccccttgtagggaagctgggtgaagcttgggctgatcatggagctggctctagcttgaagcctactggggccactgtgttgcagctggcagatgggttgcagtatatcttcgcccacgtggggcagctgacgggcatgtaccgctacaaatacaagctgatgcggcagattcgtatgtgcaaggacttgaagcaccttatctattatcgctttaacacggtaggaccctgcccttgtgcattcatattctcagatccatcttaattttacatcgatcagggctctttccaagggcctatttggagagaggctctgagtgttattactgctgtcctgtagatctcaacacttctccccagagcccacctttagttctaaatagaaaatctcagttgctggtttcctcatttactccattttaaatattgagatcttaaaagagtttctctttttcccccctttattgccatacctgtgccctttgctccacctctgcccagtgttctgttgttgtctgaatgaattactaacttgtgttcttgactttggcttgggatcctagggtcctgtagggaagggccctggctgtggtttctgggctgctggctggcgggtctggctgtttttcatgcgtggaatcacccctttgctggagcgatggctgggcaacctcctggcccggcagtttgaaggtgagtggttttctccatgtctgacttctcccattcaagaataggccacgtgtgctcctgatccttcccttgtccttgtttgagattgagcatcccttacctgttggatcacctctaaggcccagtacctaaggag

SEQ ID NO: 56540 - DNA, 1785 bp, Bovine  19866880606957
ccttacccctttaagaaccagcataaactctggttttactgagactcacctttagagcagacaagatcaccttcacccctaactcttttgttcttgctgttttacccaaacttccccaaatcttcaaatgttatatagtttaattgagtcttagctccaaaggaagcatttgctaattaaccacaattatatttctgtaacattattagcatgtactacacagtgtagaatgtgaatatatatgactgttttcctgtacgtctgttcccttcctgtgtaaggttaggctttgggaggaagaacaatgtgttttttcttcttttatatcacactgacatagttctgagccatgcaggttttaaataaaaatgtgttgattggttttggacttgttgactcaccgaattctagcagccacatcacggggggtatctacttcatctgggaacatctcttccagtctttgttgtttatatttctccagcattttttcctcagcctcttcatccactttctcatcatacagatcatcacgtacagactctcctatagtcatagtttcacattcctcctcttcttcctcttcactaccctcatcctatagaatgaaggatcacagtttctgaagaaacccacatctttacacaaaaggccactatgctgaaatttactagatacacagtccaaaccaatattaactctaatagagaatgagttataaaacagagactcagtccggcaactacaaagctattcctaagaaacagaccacacataccccttagggtcaggaacgcaccttgccttgcactgggggctatacacagagggtgcccaagggcccatttccttacctgagattcctcttccataaaatcctcgtgttctatatcatcgtactcatctccttccccaccactttcaccatcctcatccagaatccattcagcttgataactggatgttcctttgggaaccttcttcactaccttggaactttccttcagtaagtctgtaaaagcccacatgatgaagttacagacctcctcctctcctctatgacacaggatatattgctaccaataccaggaactctggcaggcacttataagtttatttcagctgcctcagaactagcaatactgacacggtcaagcaagtcttacaatgaattggaagtttatttaccctttcattagaaaacagtaagtaattcttagagatagaacaaagctgtgtccagtgtttgctcagtgcaaactacagcctttggaggtaagagaagacagacttctagtactgcctcatctaccttttaaggtcctcactgtgagcagttagacaaaacccacaattctaggccagatgaatttcaagtttgccaacaccaaccatgtgcctcgctcagctcctcctctgtgggccaggtctgttccccctccattggatctgggataacctctgtttgcaaagattcttgtctatcagggtctgccttcattagaaccttcaggtcttcctccatacgagctacagcatctgcagcacaaatctgaaaacccgaacagtcgacagtcaattaagtgttagccaaaaatctactaaatctaacataattagaagatctagaagagcacagtcctcaaatagaatagaaagccaaaacttgtcaggatttttcaaatagttctatttcctagcattctaaatctataagtctgctgagctcttgaagcctttcataatctgatcccatgcctacctgtttattactcccagccactg

SEQ ID NO: 56541 - DNA, 1113 bp, Bovine  19866880613394
ccctgggttgggaagatctcctgaaggagggcatggctgctgctgctgctgctgtaagtcacttcagtcatgtctgactctgtgcaaccccacagatggcagctcaccaggctccgccatccctgggattctccaagcaagaacaccggagtgggttggcatttctttctccaatgcatgaaagtgaaaagtgaaagtgaagtcactcagtcgtgtctgactcttcgtgaccccatggactgcagcctaccaggctcctccacccatggaattttccaggcaagagtactggagtgggagggcatggcaacccacttcaatattcctgcctggagaatcccatggagagaggagcctggcgggctaccgtccatggggtcacaaaagagtgggacatgacttagccactataacacaacaacaacagcagataactatgatgctaaaatttgagcactactgtctttagggactagacatataaagcagattcttgggccctggagatcctaattcagtaggtctgggatgggacccaacaagatttcataagcttctgagttgattctgacttacaacccgatttaaaaactactgaccctgaggactcttcctgtggccccagggcagtatcctcagtttttaaacccctctctcattacgctccagtcactcactcaccacacagagcaaggatgtggctgctatcttcatgcacaaacttcctggtgacagcctcctccatgatttgcttcacctgtaaataaatgggcggcaccattattgattgattgattgatcaaaggcctgtgagcaagtaaatagcttggcttgcctgcttggtctgagttcagccacttgcagagtagaggaggaatgggaggggtggggaagcaaagtttcttcaatacagacattgccaaatgtcttggaaagtcaaccaggaaaaggtagcctgcctggctcttctgtccatgggatttcccaggctggaatactgaagtgggtagccatttccttctccaggggatcttcccaacccaggtctcctgcaccacaggcagattctttaccaactgagccatcagggaagccaaaaaaggtgctataaac

SEQ ID NO: 56542 - DNA, 949 bp, Bovine  19866880658427
agattaaggagcctgtccccatctacaggaagtttatctcttacatctaaatagtcatgttttaaaatcaacaagtttgctagtttcagctgccactgaccggaacccccagtggctctggcccacagtgtagacagactgtgcccagccggactagttgaagacatgcagccggaagtcagccagccagcctgatccctcccagcttcgggaggagtttgagcaaaatgctacccagctacagtgaggagtagacaagaaggtttaaccctgacagcacaggaccatctgtggaggacagcctttccatcagcagattcagagagtaagtggtctaggacccaaggggaatccaggaatgagaacagaaatctaccagcaagtttagcaggacctttggtcccttcctgtccactgcagttgcttattcacgttcacagtcacatattttaaaattttgatataattatctcctagaaattactgtatgtagcctcttgggatctaaagcaattaagtgaagataaatttctttcatggagcaagctgtcaaaggatgaagcaatttcattccccatttgaagtggaagctttgggtcatgcatggtttatttgaaacaatgccatcacctaaagctgctgatcttatctctaactccgttctccatttcaaactgctggagatatgtagcgtggcactgcctaaagttatgacatctggctcaaggccagcaacaaaacaagccagctcctcttctagattgcaagcttaagaggacaaaaataatattaaagcaagataattttataggtgaagtatgttaaaccctaaaaaggggagatctttccagggtatccggtgtgactatgctgctgctgctgctaagtcactttagtcgtgtccgactactgtggaccccacagacggcagcccaccaggctctcccgt

SEQ ID NO: 56543 - DNA, 778 bp, Bovine  19866880668780
taatcctagtccttaatgaccctctccaaagtccacccaaccccaagacagcaaaagagggaaggaaaaaatgctgcagcagcgaggggcgggagggtggggacggggcctgcacgcagtggggaacgcgctctgctcctctcgggactgctagttaagagatgctgactaatcctgcagagagaggagcagcctctgattagatgcgaggaggtcatgccaggagactcaaggaaatacctctcagcagataagtgctgtctcctgcatgcggccctccggcgccagggccgtaaagctgaggtcggcaaggcctgcctggccctctcctgggggggtgagccaaggtcatggaagaagatgcacgctgggtgaatcacgttctgtgccaacctcggaccaacaggtcctggtggggggcacactgagggtgcgggtgctgggatctgggttccaattctggttcctctacttgctattttatcacccaggagaagcgacttcatctctcactatctcagtttctttatctgtaaaatgggcataaggtaataaatatatctgtctctccagggacgggggagcctggtgggctgccgtctatggggtcacacagagttggacacaactgaagtgacttagcagcagcagcagcagcagcagaatttggggtaacataaaagagaaaatccagataatatttgagagctcacaaaggcataggaagtgctcataaccaatagctaaaagttattactattattagaagcttactagg

SEQ ID NO: 56544 - DNA, 2502 bp, Bovine  19866880682076
ccctggggacctcccgagctaatcgcttcagggagcttgattgaaatgtgcacctcacccttggctgctcataaacgctttattctgggcaaaggctgccctggaatggatgctggcatctaccaagtcaggaggccagagatgcgggtgaggcaggatccaggctcacagaaagaactccattgcagctgttgtattagaaagggtggggggaagctgcaacttcatctccttgtaagcacacctctctttatgggttggggcctacccagtggctatttgtacataagccgtcatgggcaaaacaccagcaagatgcaatttttttcaaagttagaagaaaaaaaaaaagactctaaagtctgctcctgctgcgtttataaagagctgttttcttccccggctctagagtgtggtggctctaatctgaaatttctttttaatcatagcaggagtcccaattagcatgttgggtatctttcaagtagaactgggagttccatgaccacagagagcagaggaaatattacgtgtgatgcctccgaggaagagggcagaagaggccaaggcaacgggcctatgtacacatgtgtgaataaacatgtggattttcaggctgccttcccactcacaagaccagctgtgcacacccccggggtccctgaaccccaacattataccaggatcggagcatggctctcagtgccagagccccaactttgccttgtcagcgagctagtgtgcaaacacacggaatatgtgcctggacttacccttcccagagaatatggggcaggggtgggaacccagccccacttacaaagcagcaggcgcagagtttggggtgtctccctgctctgcatgggaggagtcataccccctgactcagctggcactggggcccagctccgacctgaaaccgccagtgacctactttcctttgttgttgtttttggaagtgctgatgtcaatgcagaattcagaggctgagtgagagaaaaaaagagatggagaagcgaggcagggaggggaagaagggaatgaaggcaagcaatggaaggtggggggcgccagactgtgtcagacggctataatggtggcaggtccctgcaatggtgctaaacacatactattacgtccccgcagggcctgcccagtatagcagggatcggtgtgggccctgccgcttcaggataagggaacagggcccaggctgcctagagcttcctctccgcatggtgtacatgtggggggcggaggagatggcgggcaggcatgcccaggtgtgcctttcctcgtagaaggagccatgcatctccccaggggggcctgaagatgcggagtttgcatccatctgctgagccgtccgtgaggctccagccggggccaccctgacgtgtgggacccggtggaggctctgcacacttgctggtgctggaagaaattggtctttggggacagaaggcagtttcctctgctcacctgctccttggtaacacacaagacagagctccactggcagctcgcctgctccccgctacccccgcccgttctcaggaacctggggacagctgcagggtttggggtgagaagagctccggatggtcttgttatagcagtagcactgcggagaactattccaaagaacttttccttctggcatctgagatctgagtctcatcccttcctaactgcctggctttccatcctccagccggggttgaactccaggcctgggatgactgaggcttatgcactttccacccatttgcaaaccccagcagccagctgcaccgccacagcaccactgctgagcaaaaacccacagccaaagcgtctaacttcttctcccgcactgagccctcccccaggacacttggtcaacagattcttaatgagaaaatcatttcagatccacattttcaggaaacccaaggccagaagccccgtgattccaccgatgcaggcgtttccccgtccacatttcacctgggtgccaaaggtactccattccggtggggtggggcgggaaatgccatcctctgctctctgtctctcggacctttggtccccagatgagctcgggcacatgattaaaattcttctttcctgctccataagctcatacatttttcaggcaaagaaatatacgggggagacaaaaccctcatacgctgaaattagcccccgaaaaataggttacctgacaattacttgcttctaagtggagcatgatctagtggaggaaatgctggaagggctgcggggaccccgccttcgactcccaacttactgcctcttaacctctctcagtctctggatttagaggaaggataataactctctccacctcccgccctcggtgggctggtgaaggcgtcatgaatcaacgtcgggaacgcgatgaagaggccgggtccaggacgccgtgtaagtacacagcatcgccagccacctctcgaatctacacggagctattattacttcccgagaaagagacaa

SEQ ID NO: 56545 - DNA, 1615 bp, Bovine  19866880768439
gaaccgccatcggggaagtcgagggaaactatggccaacatagtcaagggtcaccaggtcaggcgagatgaggaaaatgtccagtagggtcagtgtcaggccagaggggtggcaatggagtgaccgctgaatctcttctcttggaggggtgagcggtaggtaagggtaagcggattccaagtgtagacagcttctcccagcgagctaaatggtcacaaggagtccaagtcccgctgcacgagagcgagctccaacccaggcctgggcagtgtggtgtcctctgggtcagcacacagcacacgacacagccagtggccttcctgcctgcactgcttgctagtgggggaccacaggggactccccagcccccaaactggaggagcttccagggcagcagtaaggccagaggaggaggccccttgagccaggtgtgaccagggccacctgagctatctgctttgtattctgggctctgacactggacatcatttgaagaaactctcctactgccaaaacatttgccaaatcatcaatctgattatgtgacacatggggaaactgaggcccagcgtccggggtcctagtgagtcagtcacagagacggaagcaaatccagccccggggcttcaagtttgggattctgtccacagccccagagtccatagtgagaaaagggccttggccaggccagagccaggattgtgaaaggctgctgctgccggtggagccgggcggccagagaaaacagggacagacagcagagtaaacactgcgtggcccggccgcctgcagctcaggccgcggaggtggctggcgtgctggccggcgggctgccagtccgtgaccacagctctcgccccgtgcccagcctgccccggccgccccaagctggccactgagtgaccgaccccggcctgtctcccccaaagccccccgcaccgcctactcctacctcctcccagcctgctcagacaaggccatgaatagaacattaaaggtaaaaccttctaaaagaaaaagcagctccctggtaggagtcgcctcttgaaatgtcaaaggcagagcaaggcttcctgccttgtgcgcttctcactaatggaggcaccttagcctccgtatccccatcatccaatcgccctataaataaatcatcgtaagaagaatgccaattttccccctagggcctcatgaatctctgcataaaagcccccttcatgatgcatgcattggctcaggtgcccggagagagagatggcgaaccctgcttccaacaatttcagaggcagtagcaactctcatgccacctctgtgggctgagagttgggaactctgctttcctcctgacttggggaagaattttttgctccatttcctgcaaatccaccccgaccacagagccactgccctgtggaatcagcccagggagctaccaggaggcttcatctcctagggctgaggtcctgtgtcccttggcagacatatgatgacaagtcgtgcccacccccctgtgtgggtgggcgagccacgtacccactggagctctgttcccaacatgtggcacgcacagtgctggcccgcccgcccactcccagggggcccccacgagggctcacca

SEQ ID NO: 56546 - DNA, 1803 bp, Bovine  19866880831407
cgactgaagtgaactgaactgaagatgtacacatcaccattgtttgcaactacaaaaatttggacctaaaattaacatctagtaattgaggactagctgactgaatcgctcctggagaagattaccgtctgatcaggaagaggggataagagacaaggttcacgctgcactcttagaacctactgtgaaggcacgctttcatcccagctatgactgaaaactgacgatttctaattcatccagtttatactttctgggactgtccaagcattcccttttgtactagtcaaattctctaggggcctgactcagcttaggttcaagtgagacataaaacaggaggaaaaggagaaacagccaaaagccaaagcaacataaatacacgacagtctatcattcagggcagcgcaggcttcagaagcgcccaactaacaacactgacattcggtaaaagaaaacaggtccctgcccactgtatgttctctttcagaaagcacgagggggatatcatgcagtatacctaccaaaagcataaactgacgtagttcagagtcatgcctatggaggataatatggctacatttttcctactagaaactattaggatgattttatcaaaggaagaaaattttaaaggctgattatctgaaggaaggagaattggcttctcttccactcatacatatattctagggatgaatctagaaacttctcatcttaagccccataagttccattgagtataaaagatgttttaggccacttatctagttgcagggacggagatcacttactttcatccagccttgaaatatttgcttacagatgacgtaacacaacagacgtcatggaatagcaactcacactgaatccagcagtgtggtaagaaagtaagaaggtggggttaaggaggggagagggaaagagagtgggatatcagctgtgccctaggtagcacctcatcaggaattttaacaagttttagaattcagaagagtcaagaagccttgggaattgcctggtggcccagtagtaaggcttcccttgtagctcagtcggtaaagaatctgcttgcagatctccctgcagtgcaggagacctgggctcaatccctggatccagaagagcccctgcagaaggaaatggcaacccactccagcactcttgcctgggaaatcccatggacagaggagcctggcaggctgcagtccagggggtcgcaagagtcggacacgacttagcaactaaaccaccacttgtgggtaaggttagtgaagaaagggggacggggatccaccttttgcaagagccaaaactccataaaataggcaagaggaggatgaggcagaggctgggccagctccccaggtgtccagcactaatgcctgatgacttgtcatcactagcagcattcgctcaaagcaagctcctcgtcagcagtggaccaggccccagcctccctgaagctcagtcgtggttcccctcttagcagccttctgcttccttccagccctgtctgtgctcatcttcatcgccctggctctgaatggctttggtgggatgtgcatgacttttacctcattaacagtaagtaccattttaaaaaaatatatttatttggctctgctgggtcttagttgtggcatgtgggatctagttccctgaccaggaatggaaaccgggccccctgcactgggagcatggagtctcagccactgcactatcagagaaggcccagtaccagtttttttgagaacatccctattgacattggagaaggcaatggcaccccactccagtact

SEQ ID NO: 56547 - DNA, 1835 bp, Bovine  19866880870837
cctcctcccggaagccctccctgacagcccccaccttgcctgagtttctcatggtggtaatggggtgcacttacagagacaccagtcccactcagatttcacccatcccatacttgtttccacatctaggctctgaggtccttttggcaaagccacatcttcacacttttaggtccccagagcctgggccaatagttggcataagtagatccttgtttaaagcttgttgaatgaagggtagggagctggccaagctctggggtctggggaggaacttgtggagaaaaacgctgagaccactggtggcagatgagcagatggctccctcctggggcctggggacagcaatgagcgaagacggcagaggggctggccccaccaggaacaaaggggtgggggatggccctagcctctgggaggaggatggaactctccgggcaggaacccacccctctttgccctgaaccacccagaagagacgccgggtctggtgaattgaggggccttggcttagctcccaacgtgtcagcttgctccaatgctctgcacaacggtgtcattgtgcctgagtagcgtatgagccactgagtgacaagtgatgtcatccaccacagagctgcttttattccttctactcttagaggagcaagctgctgaaacacacctggcatcctgggcccctctgcctcagctctaataacagtcggcaaccagagactgcgctgtgcttgacagaagtggatcatttataaaacattagcatttcttgtcctgacatttcactcccatattacaggacttacaaagtctttttaaaaaaaaatgtaataaagtgcttggacccttgattttcccgccgagggctgtgctgtctaaagttggaaatgaaatcaacaacataacagcatcctcaggttctaaaggggacagctagacctggcactggcctgggtaagagcaggcagaccactgggagcaaacgcagataatttgttctgccgccaccagactccctttagggcacatttccagccctgtaattaggaggatttgtccaggcctggaaacacagcctctttcttctatttggggaaactcactcctttcttcaaagccagggaggtgggtgcagcctccagaccccacacacatccactattccataagtcagtctctggcttcctggaacaccctctgggtcctgggaactggcagttcccttccaactaccccccagagcccacttaagaatcgacagctcagctgctgcgggtgaagctcttaggaacaggccaggagtgatccagggccagcctgctctggggacagccacagaaatggtgccgacccagtgcagccagagcatgggaagtaagtcgcatcctgtgtcagtgagcgaagaaccgagaacatgtgcgtgcatgcatgtgtgtgtgtgtgtgcaggcacacgtgtcccagtgagtcagtgtgcccctgcttcaaacagcacctcccaccgacaaacgtgctttgtgttttcagagctgagcctaaccaggctcgcccacccccacgaaagcctgggatctgccactcctttaggaatgcggggttaagaattgagaaacagggttctttccaagagaatttttttattattattatttttctctcttaattggattcaatgtttcttgcacctgacacacagcttctctggtggggaattcggggtttgtgcaaagccaaaaacaattgctcccgctcggaccccagccagcagcatggctgaccttgacttgagcccccctcccctgtctctgggctttcctgctcccttcctgcacatcccca

SEQ ID NO: 56548 - DNA, 2869 bp, Bovine  19866880877802
aggaaacgaaggaggaggagctaaggaagggactagaaggagggaggctgggagcctaggagcccgcaaaggggatcagcccccaggcttctcaacctgtggccagcaacttccgggccccaggaacaggctgcaggcagggctcgcccttcacctctactctctactctcggccgtgcaaaggaggggtatttgctgtgggtgcctgccaggccctcaggctggtctcccagcctcggtaggccgcatggagagagtgagctgtgtccatgccacaggatgagctaatttccttggctcaagtccatcccaccaatcccttgccagtgagccgaggtacaaggaggcctccagtcttgggaagggagtgggtggtaagagacaagtgattttgccctctgagaggggccagctccaagtctgcaggaagaggccctagttcaatctggagggagccaagggcttggggactggcatcttttagcctcagcagcaggatcacatctgatgtgacctcctggctctgcccgcctccagaggactcacagctcttgcctcagcacctctgggcagattagggtaacggagtgaattctgaagcaatccaatcacccagggaaaggaaaaaggaattctggtatttctgagaagcaatgcttcttggaggtatttttagtgggactgtgtttcatctcttagctgtgcagggcagacaagtaagattcagcaatctagagcattcctgcagattctcctatggtctaaacatttctcaaagaaaaaaaaagatttcccaaagaatactggccttatagactgagaacccttctcctccacatgtgtctcttctaacctctgagtctctgaggatttgaggtgcatgtctcttaagatcagaggacaccctctgataccagcaggagagtcataggatacctgtcaaccttcgagatcaccagtacagtaataaagtacagtagttaaggacacaggttatgaagtttgaaagatctggatccaaatctgtcatgatctctgagtcttggttttatccatacaacacctatatttcagaatagttaagatttttaaataatgtatataaagagtttgtttataatgctgatgctttcaaactgtggttctggagaagactcttgagagtcccttggacagcaaggagatcaaaccagttgatcctaaaggaaatcaactctgaatatttattgaaaggactgatgctgaagctgaagcatcaatactttggccacctgatgccaagagctgactcactggaaaagaccctgatgctgggaaagattgaaagtgggaagagaagggggcaagacaggatgagatgggttaatggcatcaccgactcaatggacacagggttgcaaagagttaaacacgactgagtgaacaataaaacacccaccaccaataagcaagccatggacagtggcaattattattatactctgagatttcaggctgggtctttgagtagagactggaggctgggggtggggtaggcaatcaggtgttactaagccctgctgcatctccccaaggaattctcccaacctgaaaaatatcaaggtgttaaactagcccctggggtcccagctcagccccagctacttcagaaagacacaaggcaggcaggagccccagggaaccaggtgcaactggggtttgggtctttaaataaaagggtaacagcatgaaagctggactgggagacaaaggactagggattagtaataagaggtgagacacatttcccaattgcccacgaacttgcaagttaccttgacgaagctcagaggggaaagcacgtccatgaagtaactgctccatgggtcttcaaaggcagtgtcggaaaggaggctcatgatcccacagttcagttcctgcaaactgcccatcccagatcagaggcctgccccctggcctgtagggccctgcctctgctccaacatccagcactgtcctcagccgactgtccagcgctgggttctgcctcccctgtggctactgctcgccagccccttgccactgctgacccaggacaacagatgtggcctggctctgatgcaggctgaaagttcttggctttcacactccagggcgagggcgaacaggttatagtggttccctgtggggacaacttgggactggtcaggcttacctgatcctgatctcagatataggcatgcgtgacaggtcctgtggacacctacccaatgacatatatgtccaggtccaggtccaggttgttcagctgaagcagatcactgaggtctggagggggtgctgcagaggccacgttccacgtcacaacatgtatgctgagaagggaagccatggaggaaggaagatgagacctcgtccaggtaatagactgggggctgctcctgctaagggctggaccataatctgttgtagtcagaatggggaaatgtgtgtttttctgcatccactggaaggaactggggcactgaactacaagcccttcatcttcaagccctctgtcccttgaagcaggaaatgcccaccctggatcggctcctccgtgcaggtatacagctgcccacggctggcggcacctgtgctgctgacaccagcagagctgccaacgagcggtgccgaaggttttggagtcaggcaagggaaggggtgtgaatggggtggacagtgaggactttattaattccaatagtccttcatctgtggctcggtcagaaacttcccaccccccactcttcaatccatggggtcccaggaccaccagaaagatcctagaggttcagttttcaccttgtgagaggcctgagtacagcaagacaggggaatttcagagagg

SEQ ID NO: 56549 - DNA, 2472 bp, Bovine  19866880906245
ttcattctgttttactattacctctagtcttaaggttttttaagtctactgtagatattgggttggttagggttttcccctgaacatcttaaggaaaaactctaacgaactttttggccaggtggcacggtggtaaaagaatccacctgccaatgcaggaggtgcaagagacgcgagttcgatccctggatcgggtagatcccccggaagacaaaatggcaacccactccagtattcttgcctgggagattccatggacagaagagcctggagggctatagtccatggggtcgcgaaagagtaggatacgacttagcaaccgagcatgcataatatatatatgacggtgtgttatcgtgtgacaatggacaatgtattgtttgatactagccatgatgaacacatttacaccatggaaattgccaaacatgagaaaccaaggctcccgctaccccactcccatctaaagtctgccatcaggtgtatgtatggacacggcactaggtaggaggtcaccgatcatcactcccgccttttgggacccgagggctgtgccccggtctcccagcctggtcctccaggccctactggcagatggctgtccccctctcctctcactcgctttcctaaggaaaggccactgctggcaggctgagcaggcccttgttaacgattcctgagagccacgagctgtctactttgctgccgggaccctttgtttgttctctgcacacagccctgtcatcaggcgcagcagccaagccctgtttccgggaatgtgggcggcggaggcagggggactgctctctgcggcgctgtgagagggctgtgcccgaaagcacacgcatcccttacaggctccccctttgcaccccaaaggctgtgctgcctcttcacaacttgtctttcagtaagaactggttaaaacaaaaagcagatcgcggtcctcactgaccactgccccgtgactggacaaggtggtcagggcaagggtctaccggtcttgcagagagggccaccaccaccaggaggctgggaaggcaccagggatgtgccagtactcccgtctggaaccggcatcagtctctgggggtttattccagctgcacgcggagtcggcacaagcacacgccaatacccgtggggtggtgcacacctggtgttcccctgtatttctacatgtggccacttgtagaaaggaagggcctcctgctttcctcctggacttggtccaagataccacctggactcgggtcacacccatctgggagcaatgccatcacttgtatcccttccttcaaagttcaacttgaggactggaactagaacccttctgtggacctaagggtggagccaggaaggtaacgcaatctacctttcttgagctctctgccaaaagtcaggttccaaaagcactggaaatcttgtgcaaggcaattaaacttttgaacccagataccaagagctcatcatcagaggctttctcctgtgaccatcctgaaccagaagagcaaatgctcccatcaatgccacagactggccagacctcttaggatgtcagatcccagctgtctgagcaaaggcaaaacaattagctacacaaatacaccatgtgactccagaaatggtaagatgatggtattcatggtgtgtaagatgccccaagaccaagaagaataataccctttcatagggaagggtctactgtgaaaggaaatctcagttccatttacagcttgctcttagaactgtggtgctggaaaagattctggagagtctcttggactgcaaggagatcaaaccagtcaatcctaaaggaaatcaaccctgaatattcattggaaggactgatgctgaagctgaagctccaataccttggccacctgatgccaagaaccgactcattagaaaagaccctgatgctgagaaagattgagggcaggagaagggggcgacagaggatgagatggttgcatgatatcaccaactcaacggacatgagtttaagcaaactctgggagataatgaaggacagggaagcctggtgtgctgcaatccatggggtcacagagagtcggacatgacttagcaactgaacaactcagcgttgcacacagagcctgggagatagaaggcccttggtaaaccagggtgggctggttgattggtttggctggttggattaaatgaataaaaagtcactgttctctttgctaatggctcccccatgagacatcaggccctctctcactcatcatcccatcccccacacccacctggagcggcaggttgggaatgaggcaggtcaccccgaaacccacgagcagcaggttggtgaaggcgaaggcccgcgtggcattggtgatcttctggatctgccggtcccgcttcttcttcttctcacctctgtggggacacagggcgtggaacacaggagctggggtgggggggggcatgggggcatggggccct
